United States Patent 7,468,248 (METHODS AND SYSTEMS FOR INFERRING BOVINE TRAITS) - sequence listing, part 20

SEQ ID NO: 58615 - DNA, 1641 bp, Bovine  19866880930962
aaatacattactccaggaacatttcattcctttttcagatgcttaccaggtgtttttcttcatcaaattgattgtgctgttaattgtagtaaagactgaagtgagcatgggggaggcctccaaaagagcagagtcatttggaaatcaatttccacagctgcaactttgaaacagttctttagtgaataagcggttcagtttcattgtattcaaggtgagcattcttttcttgtgggatatcttattgtttccttccacttcaaggagagaaactcttttttaactttgtcaatttgcacacactttaattttttcaacctaggggaaaaaaaaaaaaaagaagaagaagactccaacaaaacagaagactactgggttttggtaggtgaaatattctagatgcttctcgtcctgtcccatcccccaccccagatcccagcacttcaagtgagtatgtgaagatccctttcttggatatctctggtacttctttaatttttatttttattttttttaccttattttgacaaagaaccaaggaaaattgcatctttcattttcaaataatgctagaaggtttctgtgcataccccaacgggagccaatcacggcctgttaacaacaagaaaaccagtgatctggggatatttaatgccgcattggccctggaagaaggaggactctttcatttcgcatactttgtctccgccatggagctggctgacataatggacttttacaaggagctctgaagcaattggcaattaagtggtttgaaggggtgcttctgggctgctgtgaaaggcttcaggtgtgaaacgcttgttttcaagagcactgaacaaaatgtatggttgctttcagcgcccccttgtccttcccgaggaagggggggagccgggggaagcaaggacactcaagagcaatttgctattcagcatctgaatgccgggttgctttcttcccccccaatccttgtgcggctggggaggggggcagattgagatggcacaaacagctctcggcacaatggtagatcaagagagaggcagggaaaatgaggccggggagaatggacgcctgaatgaagggaagacggcttgattgttaattgtgggtaaatgtgttgcaagagtgaaaagggttcatgggctactttaaagctatacccaagcaataagtatagagagtggggaaataaggagatggtcctgacccttttaaggactatagtagtacatctggcccacttgaaaaagtaaattgagaactgttcaaaaaggtaggcaaatgcatatgtgtgttcgaatctcattgcttacaagggaaaaaaaaaatctggcaactccaattcacatgcaatgtgcacttcaaagtatacactattctttttgagtattagtcaataggacaaagataatacgcaataaggatgctgtcgaatagataaatatttaaaatatgacttttcctcaagaatacagccttctattctaggataaaatatatttgcactgaagctagcacaagggtaaaggaaacttcaaacagtcttcatgaaggatattgttcccttagttctgtttcatgtcacttttcctagtctgacctttacttccaacatatgattttttcctaacc

SEQ ID NO: 58616 - DNA, 1104 bp, Bovine  19866881235839
cctaccaagagagcgggggtgtaaaatgtgcatcgccggagagaagcactcctttctgcaagatgcagtgtaacacggggcttcttcaggggtatcagaaacctaactctgactccctgaactgcataatttgtccttcttcaccaatagatcctctttcttcattccttgtgaaatgcaaactacgtattttagttagaaaatgtggaccctaaatatcaatctggcattggaaactaacagttattaaggatgagtctgtgtttctttctgtccaatatggaatggctttatatgagttgaccttgtttatctattctttggcaccaatatatgtgggcttgggtttgactggatatatggctggaagagtagtttctatcatccaaatatcccctttctacacaagtcagagcaattctaaaatcatcaaacatgctatattcacatcttaaaatatactcgagtgtgtgtttaaatagccctctattgtacaggttcttcttttggcattttccatattcacttctaaacaaatccaacgcttcaggtcttagggcaacgatggggtaagggttaactcaatgctcttcagtagcttttctgttcttcctaaccaggagacaatgtagtaataattggcgctgccaaggagtgaaggcatgtgaaaagctcatggtaagactgggaaagaatgtttcgagggttttccccatgatgaagattagcaggggaaatccatataagtttgtagcatggaaagtataacgttgtatggaatcttcactaggccccaaggcagatgtttttcatcagcaggccctttttacttctagattggtgaggcctgttaagaacagctttgggaattcctatgcaggggcagccagtgttcaagtttaagtcaattaaactaagtctgccaaagcaattctctatgcttactgccaaatcctgcctgtgaacaaggaaacttaacttttatctgcagagcagggataatgtgaagctgcttcagaacccaacaacaacaacaacaatggcttaacttttgtttaaataataaaaaaagttagttcactttaaaatcaagcatgtgtccta

SEQ ID NO: 58617 - DNA, 1520 bp, Bovine  19866881259828
ccctcttacccctgcttattcctgaacatgctgagaaaagttaaaattttaaaaggagaggaagtatatcatagagatatactaaccctcgaattccttagaggggtgaataaccttttctcttgatataggaaccaagcattgatctgtcacgctgtttgttctagtagagctcccagaggcacgttcagtttgaaacgttaaggctagttcattaggcgtccccagcccgtttctcccagagaatcaagataacactgtggttagttaatggctttctcttgtttcccccagagcctgcctgtctgaagcctgcaggctcgagaagcttcttccctcctccccccgacaacccccgcttctctttgctattagtcacagctggtaaggctcacaggagccaagcctgtttgaaaacagtcggatcacgaaagcgtttgagtctttctgctgcaagcaacaaacttgcccgggcggccaggaggagctgagtgggagtgggggcggggcggggacgcaccgggcaggaaagggaaaagggaaattgctcaccaccccagttcacaaccctctcccagggagcccacggcaggcggccttgctgggaggtgggcagactgactgaaacgaagtgatgcctcttggggctcctgtctcctgtccgctacccactgggctccctggtatcctggtcatgaggtccagtcattatcttattgataagactggaggtagtgaatgacccttcagctgttgcatttctctaagacccacctacccatccccactttcctctatacatactttttatagagcctgaggggaaggaaaaaaagaaaataagaacctagacataatctcttcagtcgccttgcgaccccagaaatcgcagcatgccaggcctccccgtccatcaccaactcccggagttcactcagactcacatccatcgagtcggtgatgccattagacataataggtaaattcaaatcccaacaccagagccataaagatctctaaaatcctgaggttgaactgccaaaatgaaaacagggtgcctcacgagaacggcttgatttctaaccgccctgttatttgagggttcagttactcctcccaaaacaggccctagaaatgctaaataaatttatttgttgcctctgatggagcctccatgaactgctaccaagaaccactactctactgttgcctgaagtgcctttgaggactgctgtgcaaaaaggatgctcagacaagtcccacggtatgtaggtgataacagtgatgtcatcgccagtgacaaattacccttcgtcacagcccctgaacctgattcatgaatgcttccgttgcattgggtttatgaggctaataaacatatatgctttggggtcgagtttaaatacaagccggaagggtttcatttccctttttccgtgtttcaaggattgtattgagaaatcacagaggaaagttttatgagggattaggtcaagcccataaaagtaataggttcttca

SEQ ID NO: 58618 - DNA, 751 bp, Bovine  19866881482558
atgagggactatggaatctatcctttgcccattacatgcatcatagttcaaaccacctaaaaagggtgtcttcatgaccccctggtcggcatagcctgtatcatttccatctaaataaaccaatctttttcccctcaaaatagaactctgctataatttgccctccttccataaaaactggagagagagaaattcaatggaaaaattgagtcccaggatgccaataaagccggggtgtctgccaggcaggatctttgtgtgtgtgcatccctacgccccccagcaccagccagtaagatctctaccctgagagaattacattctcacctcattctccttgtgacctggggtcaggtaggaacagggcaggtttgtgaacttggaagagagtcgcactaacaggcccctgtggtaatgaaatctcgaccatcacccctgtaccagactctaatcaactgagtgggggggttgttgcctctggccaaaggagcagagataacaaggtgttggaggagtcaggatacatcaagcaagcactccaggcagaggtgtcttcgtcaaaaagcctctccacacacaggtatcattatggcgggactcttccgcctgggaatatatattcagaaaccttttcttgatctccttctattcccttcccttgtcattcattattttatttcctttagttttgattaaatactctgctctgttatcagaaaaaattaatgattcaagtatacaaggacccaaa

SEQ ID NO: 58619 - DNA, 1243 bp, Bovine  19866882004783
gctattttattgaaatgtattttgaggcaatgctttttaaaaatgatgcagctttcagcagaaggaagcgctaaatgagattgcaaatgccttaaggattgacttcctccggagaagcagaaacatcatatgacatcccttatatgaggaatctaaaaagacataatgcaaaagaacgtatttacaaaacagaaagagactcacagacttagagaacaagcttatgggtgccagaagaaagatggggggaggggcatggggtagctagggagtttgggatggacatgtacacactgctgtatttaaaatggataaccaacaaggacccactggacaccacatggaattctgctccatgttacatggcagcctgggtgaggggcctttggggggagagtggattcatgtatatgtatggctgagtccttttgctgcccaactgaaactatcatagttaatatagttaactggctatacctcaatacaaaataaaaaggtttttataaaagaactgattttctcttcaacatttgtcacttagactctgaaatcagtgttagaagaatcacatatctgcatattggaataactatcgacttattttcccgtgaagggaaaatatagagaattgctctctaaaaaagagtagatttaaacatgtatattatcatatgtgaaataagtcaccagtccaggtttgatgcatgaaacagggtgctcagggcgggtgtactgggatgactcagagggatgggatggggatggtcaggatggggaacacatgtacacccatggctgattcatgtcaaagtatggcaaaaccactacaatattataaagtaattagcctccaaataaaataaattaaaagaaaaaaagtagaaaacaaagagtagattgatgaaaatataaaggaacatatattatggagggggtttgaaacatcttttttgaattttgaggtatcttagtccttcatctgcagtggaggaaagatttgttcacttctaaatttttccagtctcccaagtttcactcaaagaccctacgtctgtaacctcaccaccgccctctcacatggctgcagagacctcaccccaccgatcacctacagtgggagctggctgcaagctatatacatatctaatatcacagagaaagaagaagaattacattattgtagtttctggaaggctatattacagctatttcagaagagagattatagcagtgtttaatgaat

SEQ ID NO: 58620 - DNA, 957 bp, Bovine  19866880435057
tgaatgggaggggagttatggggagaatgttgtttagtcattcttttgtgtcctgtctgactttttgtgaccccgtggactgcagcatgccaggtttccatgtccttcactatctaccagaggttgctcaaactcatgtccattgagtcggtgatgccatccaaccgtctcatcctctgttgtccccttctcctccttccctcaatctttcccagcacaaatgtcttttccattgagtaggctctttgcatcaggtaatcaaagtgttggagcttcacatcaatccttccaataaatattcaggacggatttcctttaggattgattggtttgaactctttgctgtccaaaggatattgggggagaatggatacatatatatgcatatgtatggttgagtcccttcactgttcccctgaaactatcacatcattgtttgttaattggctataccccaatacaaatttaaaaagttaaagaaaatcacccatcaatacaaccaaaaataaaacaaaacaacaaaggagaaatttatttttttaaaaagttgagtttgttctgattttcactgattacttttttaaagggagttaaaatatttaaagaaaattagatcatcatgtagttgtatgccattatattctctttaatattcaactgtaacttatgtaatttaaactataaattttagaattgtattttatttccttgctcagtaagaaatatagaaagttgcagtgccatcttgtgaaaatgatgcagaactacattgtgctaccttatttgaataaacttaaataggcagagaaagggctgtacagctaaagagttgtgtataatagagattaattagcacatttctgttaacttagctagacttaatgtaaaaagaaatagaatataggtgggttttccaccctcccagatttttctgcagcaggaaaacagccaaaaagg

SEQ ID NO: 58621 - DNA, 1063 bp, Bovine  19866880601276
tgcttttgagtttgctgattcctagaatgtcaacatttactcttgccatctcttgtttgaccacttccattttgccttgattcatggacctgacattccaggttcctatgcagtattgctctttacagcatcggaccttgcttctatcaccagtcacatccacagctggttattctttttgctttgactccatcccttcattctttctggagttatttctccactgatctccagtagcatattgggcacctactgacctggggagttcctctttcagtatcctatcattttgccttttcatactgttcatggggtttcaaggcaagaatactgaagtggtttgccattcccttctccagtggaccacattctgtcagatctctccaccatgaccttgctaaagaaagccttgatatgtagctggacctgtaacacgcatgtcatgatatcagtcaagtattttactggaataatttttgacatctcatatccataatacttggattattttctatattgctgtctacttaagtttgttctaatgattttccttgaagatgtaaatattataatcatataatttttctaattccctggacttgtggaaagatgagattatgactagtagatgtttagaaagaattagttaacatttcatttttttcctgttaaacataattaggaaacttaactatttcagttttgccaagatgtttttagtgataacttagactttagagctttttaaaatgctgtttatttatatttattttatctttctcttatctgaagaccaagacatttggaggcggtggtggtggtgctagaagtaatctcaacatgcatgctgctggtaaccgaaatagggaaattttacagaaagaaaaggcaaacaaatcagagggaaaacatgaaggtgtctatagagaactggtaagactgaagaaccaaccattaagttcgcgtcttttttgctttaatagtcttgtttttaaattctcggaaccaccactaacttttttagtatattatagacagtgttacaagtataagacgactttca

SEQ ID NO: 58622 - DNA, 1431 bp, Bovine  19866880631258
acaaaacaatatatatttaaaaacttatacttcacttgtttattggccatcggcataacttttctttgttgcttataggttgatgagaaggctctgagacacataacagaaatgggctttagtaaagaagcatcaaggcaagctctcatggataatggcaacaacttagaagcagcactgaatgtacttcttaacagcaataaacagaaacctgttacaggtccacctttgagaggtataatccattaatcaatgtgccagacgatattgtttgcttttcagagaaatgtatgttgttgacagaaactgggttttgttgctgtgaagtctgtaacttcatttacctttatggtaagtggagggagcacccattttggaaccacagagacatataggttatttttagtctcatagtcttcatctttatgtaaaataaagtagatctaataaaacaaggttttgagtaatagagaaaatataaaataactggctctatttaatctatttctagaactaggccacttttataactgactaaatagtctacaaacaataattaacaggaacatgacttttatttagtgttacttttaaattattgtatggtcaagcatatgtcatttttcaaatcctaatcatatattcttttaaaaaaataagtagtcactatatagcagagattaccacaacattgtaaatcaactgtatttcaatttaaaaaaatgtggttacagaaaaatcttataaaaatgatttatttccttcaaacacaatttacatgaacaaatttccagataggccatttagaagattaaaggtgctagttaatatagtcatttaaaaacatttttgttataaaggatatagatcctacagaaaaatatgaaaagaaatatgtgtataaagttttacttaagaggtctgctgataatattttagtgtatattctccttttgtttttgcatgtataatgtatgcatcttactttacttcttcaggtaaagggaaaggcagggggcgaataagatctgaagatgaagaagaactaggaaatgcaaggccatcagcaccaagcacattatttgacttcttggagtctaaaatggggactttgagtgtggaaggtaggctaaacttaaagtagatttctgtttaaagtaccaaactttatttggaattatacaagaaagtataatatactgacaatataaacatatattctgaattttgtaaatttatttaatcacaaatttcctgtttgacaaatgcacagaataaaattttaattgttgtattctgaaaacattgaagcttattttgccctttaactgaatgatagacaatatcatcaaattctttatcccagtttactgactgacaagattagctatgaaacattgttatgttggagaaattattaatattattatt

SEQ ID NO: 58623 - DNA, 864 bp, Bovine  19866880673967
tataaatcgttccctgttaactctgttttttttcttttaggaagaggtcgttttctttcttaattatagataaaaagggcaaatagaacaaagagaaggaggagattagcaaagacacattgctaaaaatgatcagtcaaaagttaacgacactattcacataaaatatgagtgcttgaaaaaaagctagaaataaactaacatgattaacttctttgaacatcttgccttaaatatcaataccatatccttaaaattttatcaaatgccatacaaagaaaccagttagaacactatttaaaaagtagaagtatagtaatgatgattaataatgaaaaatggctatctattcctggtggtatgttttcaagacaatgcctataaattattcttgcaaaagtaagtgctttccaaatatgctaattgagcaaatatgttttagaatattttatagttaaaacttatgagcactaatcacaaatggttaatcatttcagtccctcagaatttattatttttacatcttaaactggtagctaatataacatactttaagaatggattaactaattctttttctaaaagtaattaattgaaagtgtcagtcgctcagtcatgtccaactctttgccaccccatggactgtagcctaccagggtcctctgtccatggagttcgccaggtaaaaatactgggagtggattgccatgcccttctccaggagatcatcccaatccagggatagaacctgggtctcctggattgcaggcatattctttatcatctgaaccaccacagaagcccataattaccacatcataatgccagactcctttttattccacagcagtcagcccaatacat

SEQ ID NO: 58624 - DNA, 3242 bp, Bovine  19866880685452
ctggaatccgattgcagggagaaatatcataacctcagatatgcagatgacactacccgtatggtaaaaagccaagaggaactaaagaccctcttgatgaaattgaaagaggagagtgcaaaaacaggcttaaaagtcagcatttgaaaaactaagatcatggcatcaggtcacatcacttcatggcaaatagatggggaaataatgggaacggtgacagactttattttcttgggctccaaaatcactgcggacagtgactgcagccatgaaattaaaagatgcttgctctttggaagaaaagctatgacaaacctagacaacatattaaaaagcagagacattactttaccgacaaagtccatatagtcaaagctatgttttttccagtagtcatgtatggatgtgagagttggaccacaaagaaagctgagcactgaagaactgatgcttttgaactgtggtgttgggagaagacttttgagagtcccctagacagcaaggagaacaaaccagtcaattctaaaggaaatcagtcctgagtattcactggaaatgaagtaaaactcgctcagtcgtgtctgactctttgcaaccccatggactataccatctgtggaattctccaagccagaatactggagtgggtaacatttcccttctccaggggatcttcgtgacccaggaatcgaacaggggtctcctgcattgaaggtggattctttaccaactaagctatcaggaagacctattcgatactggaaggactgatgctgaatctgaaactccatggactgagtggactccatgtttggccacctgatgtgaagaactgactcattggaaaagacactgatgctgggaaagattgaaggcaaaaggagaaggggatgacagaggatgagatggttggatggtatctccaactcgatggatatgagtttgagtaggctcttggagttggtgatggacagggaagccgggcatcatgcagtccatggggcccaaagggtcagatatgactgagtgactgaactgaactgaatgccataggcaggttgggggcttgctcctacgtcttcgttgattgacttaaacaactgaccctcaccacctgaaactttccttgtgatgtttggcagagaaaacaagagtcttgtatttaaggactggacaggagcttgcctgtctcctcttcttggccccaccctgctgtcatagaccttccaaagttagagcatcctcagtaaggatgctgctggttaacagccctctgtttgatcttggatatcccaacaccagtaaaggactacactgtttaaactggggtggtgagggactcccatgaaggaaataaactaagcctctaccttgatgtataatcatagtgaagggaagagaatgaggaaagccagctcagtggcataggaagggtggatggtggtctcatttgaattctatcgactaatctttgcaatttccactaaattgtcctctcctgatatcaagacctaaactctgtgtacttgggaccttgtcttgcccttgactcttttcactaattggagtgaatggggtttgggaagagctctggtttcccatagaagttagtaacatttggggctgttaaaattttggagtgtcaattgctgttctctacttcacattgcttgtgtttgcatgaatttaaaccttaggcttctggcccattaagtactgcaaactttgattttctaattatcctaagggttttgagaaccgtttgttagtctcactatcttgatactcaccagggaaaatatccaatcctctatggaacagagttgttaactgacacattcactataagaaggaaagtgcataatgttataaatgaagtcactgccatgaaataatacagatgtattcttttcagcgaattctgtgcaagcacccagtcaagtgagacttctctgattatatacagggaatgtgtttcagaaaatcaccagctgtgtttttcagtggcttaaaagctgctgtgctatagcattccagaataaaataagtaaataccacctaccaaccagtcaagcttattgatgcaacatccctttacttcaaagcttataatgaaattgattttctgtgctttttcaattcaacttgcaaaccccgtgaataactactctaaaataatttcagcttaggaatgttcaggaactggtgagaaattgatagtgactgttttattcttagccaaaaagtactgagtaaaaatgtaaaggaagaacttgctgtgtttagatgagaagaactatatgataggaggcaaagaaccagaacattattttccatgatatccagagtaaaacttcctttgatttttagtgggattgaaccctcaaacaaatgagatttcatagcctggagaactgacagaggctgtaaatcagattctaattctgaattgtcattcagtgattacaactatctgaggagacagtgattctgatgagaagatttttaaaattcaggaaatcatccagatatttgaaaactcctagtttatagaattttttactttgcattcaaataaatagaattttattgatattcattttgaagacatgtgtggatccagggttttgtgtgtgctgaagcttatacaatttgaggagggggatttctttaagaaaaagaagataaagttttgaatataaaatctggtaacaaagtgattgctgctgttgtttagtcactaagttgtgtccgattcttttgcgaccctgtgtagtctgccaggctcctctgtccatgtgatttcccaggcatgaatatgggagtgggttaccatttccttctccagggactcttccagatccagggatcaaacctgtgtctgctacattgcaggtggattctttaccactgaaccactaggaaagcccaataaagtgattattatttagaaatatatataaattgtagcaagttacacatttcaaaagcctgaaatagcacaaaattcagaaaattaacaaaactattttaattgatggatttactgatacgtttctacaatacttttttccctacacttttagcagcatacccattaattgtctcttcatatgacaaaagcttcagaatatagcttttttttacccagagaatagaaagataattcagacttttctctagcatagttagcttatatttgtttatccttattaaaagtttagagaagtttcagcttcata

SEQ ID NO: 58625 - DNA, 1337 bp, Bovine  19866880790165
gagccctgtgcgggactgagcccttagctgggggctcttgtgctatctccaggtagatgatgtcagaactgagtagaattttaagacaccaatgaatagccaagaattttgtagcgcgagaaaactcccacacgtctggtgtcagaagtcctctgttttgttgtagtgtgaaagtaaaagaaaaagctagaaaactgaattttcccttattcacctgggttaagtcatgctatcccgaatggtaatttttctttcttatatatacagagatccactcttatattcttttcccatatagatcattacagagtattgagtagagtgctaccatagtaagtccttattatttatcaatgttcaaatggtacttatatttaagaacattttattgctagaggatggaggtcatagtgtcaacttaaaaattgttgcacagaccatggtggttggcaacatcagtgtcatcagagttcacttgagtgctgactgtgagatgtgtaccaaatgcttcacatgtattatctgatatagttctcatagaaagtccataaggtataaatgttatccaccttttccagactaaaagatattaagaaactcactctaactcagtttgtaaatggtgaaattaagattcaaattggagacgtcagataccagagcccacactctgagtaactgctctttcctgcctttcagaaagaagcctaggggtgcggtagcgaagtggtagccagactgctctaggattcctcactgcttcggttttcttgtcgggcttcctagcagaaaggcaagcaaagatgtctgaatatattcgggtaaccaaagatgaagatgacaagcccgttggcataccatcataaaatgatgggacaatgcagcccagcttctaggggcatgtggtctgcactacaggaagccagtgtctcagtgtatgagaggtgtccatctggtaggaggtattctgcgtgcccctaatgccggctgagggaatctggtgtacgatgtcagctatcacaataacaaaagaaaaatggatgcttcatcagcagtgaacacgaaaaaagtagtccagaaatagtgttgggtctcccatggaaaacagcaggacctaaaagagtattttagtacccttggagagggtcttagggttcaggtcaagaaagattctgaaactggtcattcagggacttccttggtggcccagtgctaagactctgcactcccaatacagagggcctgggttcgatccctgttaagggaattattaatagatcccacataccacgactaaaaattcacatgctgcaactaataaacccgacacagccaaa

SEQ ID NO: 58626 - DNA, 1043 bp, Bovine  19866880810069
attatataaccttattattaacactagcaagcgggtactctttctgcccccttctgatgcctatgtcagaagctttctctatctcctttatactttaataaaactttactacacaaaagctctgagcgatcaagcctcgtctctggccccggattgaattcttctcctccgggggccaagaatcccggtgtattcgcgtgattcaacaacaacctttcaggtttattgctggttttgaataaagaaatttatttcaatatcactggttaagaaaattctgtttaagcaaccaattcatgaactaaaatttcttttcaaaagctacaaatcaataaatagagaaccaacctatttcaaataagtaagaaattaaaaataatgaaaagaaaaccttttgtctaataatagtaaataagagagggtatgtacaaatgcaaagataaaaattgttttttattatacattatttttaagaatgaaaactgacaaaattgttaatcctgagccattgatttaccttctaatttttacctgaacccctccaaggtttctattgtaggagaaaactttcttcagaaagtatcatctatcccaactaataataggaacccctctgccattaaaaaaaaaaatttgttgtgttcagtagtaaactgttaagaaaaaaagaaagagggagaaaagaagggtggtttgtcagcaaaagcaacttaatggaattgttaaagagacttggaaagaaatgtttacaagtaaaatggtgtaagcttaagactccaaaagataccaggacattctctactgatagaatatggaaaaagaatgtcaaaagtttgttcaattagttactttatgtgaaaagacaataatgattgtgagtaatctaaatagaacataaagggaaggaataagagaaatttgcaatgatttattttcttacttctttgctctttgcaacttctgcaatagcagcagtcctttgcttttcaaattcatcattgtcatttggaggtttgacaggcattgtcacttgtaatgtcttt

SEQ ID NO: 58627 - DNA, 2310 bp, Bovine  19866880891376
gccagtgcctatctggaccctcccctttggttccccacagcctctactcctctcagaaggtttaacatccatctctccctttacaccagtttctacaagaaatccaaccaaatgaaataggctgtgatggtctgtggatttttacttcatgctgggagggtctggaaacatgagggtctccatgcagctgtcactgtctgggcccctctgccttttcaccgcctggtgtcctctcaggggacccgatgtgctgagcacactccagtctgccctggtactcacagcagggcctctgccaggagttctgggttatgaagtttcctctttctcattatacttgctttggatacagtttctagaatgatccggtctgatatcttataagttcctcttctcacctattcagctgccttcccccagtagcaaaaagtaacacactggtttccttggtgtgtgtgcccagaagtgggattgctgtgttgtatgacagttgtatttaagttttttaaggaatgttcacactattctccagagtggctgtaccagtatgcattcccaccaacaaaaagattcccctttctctacaccttctccagcatttactgtttgcagactttttgatggcagccattctgaccaacatgagatgatatcttattgtggttctgatttgtatttctactaataatgagtgatgttgagcatctttatatgtgtttattataaaggctcatttctataaacatgttctatgtaatctactctacttataattccaaattggtaactgtttttgatttgtaatatgtctctttcaaatatttctatttcaaattatttactaggatcaggtagaaagcttccatatggatgagttttaattaaaatacccgtgtgccatgcaccggaaaagcatattttaagagaagtgcaaacagactatcacaatgaaaaaaattccctctttctggtggctagaaacaggactaagatgaagcatgattctaaaaccagcaatgtttttcataaatcatgagattatcattaacaacattcttattacaaatgccactgtgatgttcttgcttgtagtgtgataagggctgcatcagcagggttgggtttttgtggcgatgaagtgcttagtgttccatttgccctgcagggtcttctgtgacaaacatgcttcatctatccaataaccaaagtcagccatatgcaaatgtgggcaacactgatgattttctacatatgtttccgaatattaatagataaatgttatatttatttcctttaatctattgttggttacttttagctcttttttcatctcctccacaacaaaaacatatactgtaaatgactattaatttggggcattttcttagtaaattctttgtcttctctaaagttaaaaggcaatagtagcacttaacctttggcttaaaaaatatgattcaatcgagttaaactgctgttctcccagaacttaaaaagtaaaataccaatataaatatgtggtaattatcaccagaactgttcatttttaactattaaatttaaacaaagagccattgctgtttgttcatgcaaaacaaacagtgcctgcttaagatctttttgattaatttgtctctctgtgtgcagatccaagagaaagcatcgccttggcctcagcacacacatctatgaaatggaaaaaactttgctgtcccagtcaattgttaggattttcccaaagcaggggtttagtggtaaacaatggagtggggggaagtccaaatcctggtgaacaggccaacatacccagggtctggcaaatgcagcctagttctaggaccggcatcaggaaaaaggaggtgctttgctattggtcttccctagtgactcagttggcaaagaatctgcctgcaatgcaggagacctgggtttgatccctgggtcaggaagatcctctggaaaaggaaatggcaacccactctagtactcttgcctggagaattccatggacagaggaggctggcaggctatggtccatgggatcacaaagagtcagacatgactttaagactaacttttactttttgctattgcgggaaggcagctgaataggtgagaagaggaacttataagatatcagaccggatcattctagaaactagtatccaaagcaagtataatgagaaagaggaaacttcataacccagaactcctggcagaggcactgctgtgagtaccagggcagactggagtgtgctcagcacatcgggtcccctgagaggacaccaggcggtgaaaaggcagaggggc

SEQ ID NO: 58628 - DNA, 1825 bp, Bovine  19866880937601
cctgtaaaacttcaaaatgtagcaaggaaagaagattctgatgatgggtactagtctaccccaaagtgaaagtgaagtcatgtcccactctgagccacctcatggactgtagtctcctccatccaagggattttccaggcaagaatactgaagtgggttgccatttccttctccaggatatcttcccgacccagtgatcaaacccggggtctccagcattgcaggcagactctttaccatctgaaccatcagggcagtctaccccaatcctcccccaaaagctcaactgagcaaagaagtcaaataaacacaaccctgaagaaatctcattattactcaaaattgagagtggcacagactgaggaatcagcaggcaacagaaaaagatcatggtaaacccataggattaggagtccctttataccaactcaggctcccagctcaggcagaaagagccactgaaactggatactgagaaggagcctatttcacgtgctttgtgttctaactagtaacatatacatggtctttttccgtgttcataatttaaataataaaagagcaacgtgtgcttggtggactgggagcctacgccaatcctgactaggtaagtgcctaaatgcatacttctttgcctcatcaaaggccctagaataaattacaatctcatcatcctaacaccttgttaaccagggacctggagctaacaattaattctaaaatatcaaaaagacaaataagaattagtggtttatctcataaaatatctaatttatgagaaaataattaggacttaggacaaacatatactgacttaatgagcttttgaaaatagttctattaatattactttgaaagagaacatttcaaagcccctacagaagcagttggttgttccaagcaaaaaaaatttatcaacatatttcaaactttacatctaactaaatacaaatacatacttgtaactatatatttttatattcagttagaaataagtatcaatagagaaatatttgtgtaacagatcattgcctgtactcctgtggagattacatttgtcataaaattgctagggctgtttttttcattttacaacattcatttcagaaactacaattttctattctacaaaaaacttgaagaaatttaatgtcccttgaaaacacaaaaactatacgatgaaagataccaagaataattaaggtgatgctaacattcattccacaagcatttaagtgcctactgtatacctttcccttggactgcaaggagatccaaccagtccattctgaaggagatcagccctgggatttctttggaaggaataatactaaagctgaaactccagtactttggccacctcatgcgaagagttgactcattggaaaagaccctgatgctgggagggattgggggcaggacgagaaggggacgacagaggatgagatggctggatggcatcactgactcgatggatgtgagtctgggtgaactccgggagttagtgatggacaggaaggcctggcatgctgcgattcatggggtcgcaaagagtcagacatgactgagcgactgaactgaattgtataccttacatcctgctaaatgctaggaatactacagaaatatgaatagacttgatcctcacctcacaggagcttacaaaacaacaactcaaactatttcaactaattagaaaagccaaatatttatttagtttgactctaaaatcaaaatatatttaagagaaaaaggtaaaattatttcattaactttatcatgattatctctctctcaaaacaatacttaagagaatcaattccaa

SEQ ID NO: 58629 - DNA, 1156 bp, Bovine  19866881047304
taactttcctaacaatcctaagaatcccttttatacattccttacctgccattacctattcaggtatccagactattttatttctttgcttttctcattcaacttttgaactatattctagagtttcctttcttctatatgtgggtttactgactacgccttggcccatgcattattgaaagtttattgaagagtagaaagaggctcttcatactctcagagagaaaggaattaagtttaatttttaggaagagctcaattgggaatttattgcagactgaattggttaaaaaaaaaaaagcataaagatagaatcaacattttgcttttgttacccagagtaacaaggagaattgcccaatcactaatgtgaattgccagtcatcttaaatgctaaacattttgaaagttattggtttgattactcaattcttttcacagctttatttttgttaatatggactatattttgaggactaaattgagaagtaaaaagaaattttaatcatggtaggtgattagtaggtttgagtgtgtggttacaaaataaagcacataaattgaaaatacagagattttgtatacactgattcatggaaactcctcctgtacattttcatgaagaaatcatgctaatgttaataaatgactaatctatcttaccctctctttgtctctctctctcttaaactctgaagagtcaatgcttttgtaaaagtcctggaaatagcttcaagaggaattttcatatggatttggagatagctgggatcaagcaaatagtctacttgccttaaatgccatgtataagactgaacaacagatattttcttacatgtggcttgctaatttatttcgttctttctgtctctttacatgatccattctgaaaatttgaattgagaaagtgtaattgaatcttctgctcctcctgaaaaacaaaatctaatttctcccattaatatgttatctttcaatgccaaaacttcgagagaagaatgcctgttaccaaccacagctttacattatgtgcaaataaaaagtccacaccttcctttagctttatccaaaaataccaacacactcttctaagaacagcagcaggagagcaaacacagctatcacactatcatgctttccaaggattaacatctat

SEQ ID NO: 58630 - DNA, 1603 bp, Bovine  19866881069402
ttaggctgtaattcatcttcagaacagaaggactccaaatgtaaaggtcagactactcggaagctgccttggcatctgacaaaatgattctgtgtcccagggcatctatcagccctccaggtgggcctgagcaatccattgaaaatttcacgatccccgcccccggaacatggttgtgagtagtactgtattatccattcttacagaccatcaaacgcagatggggcttgatcccattctcaaagcagagggaggctttggctcatgtgctgattgtagtctactcaccgcccccatccaccttccaacctcctgggcgcaggacccaggtgggtccctgacgggacaagcttctcttggcactgacagcaaaggcttccggcgctttccatttgtcgcttgacaaaggctgcagccggtgtgcagtccaagggtctggcttgacagcgccgtgtgctgtgggtttgtggtttgccttcacttgttttcgccgtgtgtgggaagctctcctgggaaaggaggccgcgcctgggcgtgccagactgctcagtgatcttccgctgtgggtctgaggccagctcctccagcacggggagacaggccaggctttctgaagaggcttgcaacctgccagctattttcaaaggtactttggtgtatgttctcttctccaattgtcaagtctgaaggtgacaagttgtttttcattcattatttctttcccttcttctttctttctgccatggaattgtaagtcccaatttagcattttctgattatattccctttgtcaaagttgcaacataacctttcagatctggcagtatcacctgttaacatctccttatgagtaagtacttgttaatggactccactcccctcttctctccctgttcaggattttatttcatctagaatatgtcttttattaacatcagaaatttaattatgtacatatttgaaacctgaagccattaagtctacagatcccttgaaaatgctgtttgctagatgtgcaatcacaatgaatgtgcagaatggcacacagttagcttttaaagctccccttaaaacaggctgagggactagctttttaagaatagagaaaactgaagcgacttagcagcagcagcagacattagaagaaacaaggaaaatacatgaaataagtgaggaatggagttaagagcattatattcaaagggaagatattggagagagagagatgtgaaaaggaaggaaggaaacagagacttttcagtgtgaacacgaacgattcctcttgctaaggaaggcagaggctgctggctcttcctcctctcttgcatctcctgggtcttatctatcccaagtcagtgtgtacataatcatgccctacttgtgagcatgtttacctttatgtgtttaattttacacttcaattatcatcatgatttatcccaccggactacagtctcctcaggggcaggaatcatgacaagtttctaggatagaagggttagctgttgagagggtaacgacgtctggtggatatgaccacccttcagaggaggacttctctccggcgacagtgcggcagtcagcgtttcagcgctcagcccat

SEQ ID NO: 58631 - DNA, 1322 bp, Bovine  19866881305362
cttattcataggcttatcagctttaattttctattgctttttgtactctatttttatttctttttgcttgctcttttacttttgagaaattcatcctttatttcttaaaggcaaatgctctttgattactgtcttcaggtaaaggtgtcttagaatcagactaaggttgggagttgatggtggaattgctgaccatcaactctggaagagccaaagttagctctgttagactagtactcctctatcttttcagtgggagactatctgtggtggcagtgccagcaccagagtatgtaatactgattacaaaaggtgccaaattttcatgggcatttttacaggtggacttttgtgggggggtgatacgtgaattgtagagttatcaaagaacttcaaaatggttgtgttgggcgtgggtgaattggtagagatgattccctcccagcctttggattaaataatttttcacccttcagttaattattgctacagatgaatggttggtttggattgaataaaagaacaaagggcaataagacaatgagtaaaaaactgaaaagagacaggaaaagtaaaagatataaggtaaaaagttgcctaactttgtgccacttgaaatcaatagtgtttattgaagattcttaggaacattatgttagacaaaggagagttgaaaagataatgtgagaaagtatctgagaggaaagttttgttggattaaatttaaaactatgctgtttttagttctatttttattgcacatgtcaatctcttaagagtttactctaacttaatatttaagttggatattgtatttgtgtaacagggaagaggagcttattgattccttaagaagcatattgatgtttaaatagcttttcttagaaagcatttggatacttttattaacataatatccctttaaagacataaaaggaaaagtatgcgttctccatcctgttctatcagagatggtaaacagggagtatccagggctctctggtatttgcagtagaaacatttaatagtagagaacaaaactacttgtagacttaagaaagtaattttggttaactttgattttagaaaatattaagccatttattttattttaacaggtatctttcagatgaaggcattgaagcttgtacaagttctcctgacaaagtcaatgtaaatgacatcatcctgattgctctcaatgtaggttttatttattaacttataaacatttagaatctggaagctatatttatgaaaaatatctcatagaataaactggctcttataaagtggagaacgtcttttatttttattgtcca

SEQ ID NO: 58632 - DNA, 1229 bp, Bovine  19866881372236
cattaggtcttcctatgctctgagatcagtcccctttttcctcctcctccatcatccatctttcctgtcctgtcagtatccctaaaacatgtgccctccaggtgacccatactgtgatgtgtgggcctcctctctcactgctcctttgtattcagccacactagatcttttgctgttcaatgcctttgttcagtttttcttctggatcaccctaacctgatctgtcctttctgttgaaatcccctccagtttaaacgccaccactccacaaagccttcctaaaggtctcagcaggaagtacgttcccttccattattttttgtccccataaagccttttctttatttttactttctttgttcttctcacatgatttatagttttgatatttgtgaaagtgttttacttctctcccatcagctctggaaagcagggactagtgtgtctatgaaacatctataacactccatctaatacaacacctactatttagtaggagatgctgaattttcatatccattgatacatattttattttctgttgtaggaaatcattttggaattattcccttacacaacacaataagtgaaaatgcttgtgtgctctctttttatgtggcccctggcctggttactttcatattgtcctttttattgcaatgtaattaaattgtacagttaaaccaaatataactaggggacatagagctcagactatttcctccagttacaacttggagggccaggctttatccgccatttccagtctttcagtattcacatattggtcatgccgaagtatttatcgtttcagaaaaaatcaaacaaaaatgttataaaggcctctagataccatataactgcatagagctggaaaaataggaatgaagcatagacagattaattgaggtggaaataaaaatatggttcccttagcttcatgctccatgcttcaaatggagatttctaaaagttctctaggaggcctttgctatgtctattgtttggtttgctaaggttggaagatgaggaatttgggaattttaactccaaaaaaacttttcgattctgtgtatactgtgaaattgaattgattttaaatggtagtttgtatactttacatattttaaataaagtaataatattaaatactacttattaatcatccaataatccttttaaccttataaccagatccaatgcagatattattgtccccatttcataga

SEQ ID NO: 58633 - DNA, 1005 bp, Bovine  19866881407250
ttgaatgtgtatgttttgagtttgagtaagtattcttatcattttaatactcacgtatttaagatagttgctataccttagatgttttagattttagataatttcaaaaggtctataatgtatcaacatttttcacattttctgaatgttggtcctcatatgtgataggtggtaatcatttagctggaaagagaacaagagtttataatctgccctagcttttgaagcagatactcaagagaagagagttctacagactcttcagcaattcattttaatgtttaacaatattctatgtaagcgaatttaattgtattttaatctaaatttcttatgttgcaacttaagtccgtaatatcttctttatcttccctcagggaaatggagaacatctggttaccttcctttgtgaataattcttcatatacttgaatcttgtaaatgtcactgctacaggtttctttttgttaaaaccatctatcttggttcctctgtttattctgtctccggggttccattcatcttcattgctcttctcagagtcctctccagttccttgcatttcattttctggttatggtagtagttctgacctcagtgtgcatcagagtcatcctgaggcctgctacaacacagagtgccagcttcccacctcgcccactgccatgtttctgactccactgaactgggaaagagcctgagaatttgtactttgaacaggtttctgtgggatgttgattcagccaatctgggaaatatacttagaaaacctctagggtgtagaactccaaattaggcagcagtcttggacaggtctgatgaatgcaacagttcctcacagaagaagtaactagtatcaaagcagtgcctgcatatccttatactagtctatataagaaaactagcactctggattattgattttccattttttctttttctgtctttaaggactctcagaacctaccactgttaaaagctcatagggaaaggtactgcgagagt

SEQ ID NO: 58634 - DNA, 2018 bp, Bovine  19866881484309
aaataagcaaagcagaattcacagtctgaagatgaggtactaacaaatttcagccctttcaagtggtataggtattttcttctgatgcacaaaaatgcagaaggcaattcaaccctttagaggtctgtttttcatcagctttgatcttaaaattgagacaagtgtttggagtactgtcgctgataaggagcaaagcgagggctggaagcacacttgaacagaatgtggttgctcacacccggaacgattaaacactcactgcattttttcaaggcaaattccacaattcacatagttttagaaatcattacagagaaaaagaacaccacacacagtactttcataagagcaaacgctgtcatgaccacagaataccaaagaataagctctgcacatattcccagtttcatctttagttttccttgtttgtttctagacactattttctctgccactgacagtgtttaccgtctccggttgtcacataatgaaacagaagccgaaagcctgattatggcgttagtagtttagaaagacaccaacatagctaggtgtcatattacctttgttttatttttattattttaaaaattctctctcctgagacaggctgtttttttagtctgaggatcctgaggaatcctaggtcagcagagttttggtaactggaaggttacgctcatagctagctgcagggttgagatgggcttccttggttgctcagttggtaaagaatccacctgcaatgtgttcaattcctggagagacatgtgttcaatttctgggtgaggaagatcccctggagaaggaaatgcaacccactccggtattcttgcctggaaaatcccatggacggaggagcctggtgatgtcacatgagtcagacatgacttagcaactaaaccaccaccatagttgagatgcagtccaataagatggaaattactagagatgtttcccccctggaagaggaagcgatgtcccagatgccaacccttccttgccattataaaaccctagggcccaggccaaaggtggactaataaagtgtgggacttcctcagctgtgcatttcattcactgcccctcttcatttcaggtggggacgcacctgaaaaacagaagcttctcacttaactactgggctttagtttcccactttgctttaacagaatgtgtgaaatctcttgagaattgtacttttttgttatctatgctaaatattcatgtgagacaaagtagtatagttcatgaaatcatttaaacattactcaggagatactgcaaggcccctggaagcagaaaagggagtaagacataacatgccagacctcagactgtcaaggtctagtcagagacacagagaggcaaacatctgatgacagcatagcatgggaaatgcagtcatcacctccgcagggagctgcaggagcagggggagggtgaactcatcctgctgaggttccgggagagaggggctgcgacacggtgacaaaggaaggatcagctgaggtggagctctccaggaagagaaggcatggaaagccgttccagaaacagctaccggcagaagccaaggctggtgcagtgtttggaaaagcgtgtgggaagcagctcgttgggaaagtttgttagcgagtgatctcttcggatgagggagaaccttggagcaaaaagttaattcccgtacctctagcactggcacccagagagatgcaatcatctttagagttgctctgagaaagggaggagaggtggagatggggcagaggctgcagggggtgcgagaggggctgctgggaggaggaggcggcaaggcgccccggtcgtgcccttctgtttacagactgtttctgcatctaggtctttaccaggaggattctttttcatttctgcactggttacctcagtgacggggcctcaaaaatgactaatggacctcatgagtgaccagaatcaaagatgttcccagctttgctatgtcctaggacagcgctgtctaaatcccaagaaagaga

SEQ ID NO: 58635 - DNA, 712 bp, Bovine  19866881559320
aaattcgcaatgttgctgcaccaaaggataatgaagaatctcaggctgcaccaaggatgttgcgtttacagatgactgatggtcatataagttgcacagcagtagaatttagttacttgtcaaaaataaggtaattggctctttattgtgtatatttgttgtgtttaaaggtacaattcacaatggattttatttctaagacctttaaaaagaaggaatgaactcttaagtacatgttatagtttttcagtataaattagagagtttgtactatatctgtaaagagaaatagtttaaactggatttagttgctttaatattaataacaaaaacagaaatttaagatattcttacatggaaagtaatcttgttaattttatcactaaattttagattgttaaaaattttccgaacagaaagtgaaagtgaagtcgcttagtcgtgtccgactctttgtgaccccatggactgtagcttaacaggctccaccattccatgggattttccaggcaagagtcctggagtgggttgccatttccttctccagaggatcttcccaacctagggatcgaacccaggtctcccaattgtaggcagacacttgacagtctgagccaaatttctttaaatatgttacagtttcttccttgacagttagttgtgaccatcacactgtttagtggtttagaaaagttataggcaaatgagtttt

SEQ ID NO: 58636 - DNA, 1269 bp, Bovine  19866881680099
aactttcaaatttgcattttttctgtcaaatgagagttcaaaaaattaattccattgaggttttaatattaatatataacttgaattgtagaagaatacattaataggaaatatatatcattctaagataagaaaaaaatacttaatacattattcctaaactgattttttttgctgttgttttataagattagattgcagatttcctttcattagaaaagtactttacaacattcgttgaacaatacgtcatacaaataatctttcttgagaatttgtaataaatcagagactttctgacaattaaaaatagaaatagccttcatatatcactgtatcagataagctgtgtccagctataagaaatagaaatcctaaattactttgctagcatatgagataagtgcaactgtgcaggagaaagggagtgcaaaaagaagaaaaaacctcctcctggatatcacagtcacttgaaagtgccgagggcaggccttcggcagaaggcctggtcggtggtcacctggcccagcaatctgcaacagtgtaggcgccaaggatgcagacttgatggggaatgtgccctcagcgcccccacccccggacttggggcagctctcaggacaccacagactttgtcagtgatgccgcgcctcactgaggctttccccgagccctggacggcggggccaggactgcagagcagcttgagggctgccccagggctgactcccagcagggacaccctgttgaggacagctgtggctcagccttccatggggactgagactactgagagccttggagtcgctaagggacaaatacttgaatccttggttgagggcacagctgccagtggggtggagttgcacaccatggagagctcgaactcggccccagcaaggcctagagcaccccacctcctgtggatgccccagcctctgcagtgggcacggtgcccaccagtcagcccaccaagtcatggaccagtctttttcatgattctaactctattcttcctccttgcctgtggtttctgtggaaactaagaattccccttccaccacatctcccttcatctctgaaaagcaggcagaagtcaaggaagggctggttccagtttcagaggatcccgaagccataaagattgcagagttcctggagaacaccaccctgattcataaaccagtgtcgttgcaaccctgtgggctgatctacacaggaaattggtgctacatcaaagccacactgcaggcgtggtagtcttgccca

SEQ ID NO: 58637 - DNA, 636 bp, Bovine  19866881924974
acacaatggtcctatttcaccccttcccaccgtgtaatcacctttcacacaagattgcgttcttcgagtcacctgtccaacgtctcctcccggacttcacatgccctgcaaaagggacatgcactcagtcccctgctcccccttccttacccagccccctgtaaaatggacccatcaagtggacggactgaattacccccacatttttggctgtcacctaataggagatgagggcccaatgtggagaacaccacaggagaggaaagccaaaaccagagataatgctaaagatagtggaatgactggggaaatctgtccctggaaaattgggattcaaatgttttatacctgaaataaaccacaggaaatcaatgaatcttcataaaaccacagagtgggaaagactttagagtcgctttttctggctgaaccctgttcaccatgaatattcacagttctttaacaataatccacattcttcatttacaaaagtttttttttttctttcctccttagatacagaagaagccaagtctgtgtagtgtggcctggtccctatactttgttaaggatgtagagtctgtatttcctgagtctcaacctcattatgaagaggagctattattttccccattt

SEQ ID NO: 58638 - DNA, 1207 bp, Bovine  19866880296487
aatggactggttggatctccttgcagtccaagggactctcaagagtcttctcccaacaccacaattcaaaagcatcagttcttcagcgctcagccttcttcacagtccaactctcacatctgtacatgaccactggaaaaaccatagccttgactagacgtacttttgttgccaaagtaatgtctctgcttttgaatatgctatctaggttggtcataactttccttccaaggagtaagcgtcttaatttcatggctgcagtcaccatctgcagtgattttggagcccaaaaaacaaagtctgacactgtttccactgttttcccatccatttcccatgaagtgatgggaccggatgccatgatcttcgttttctgaatgttgagctttaagccaactttttcactctccactttcactttcatcaagaggcttttgagttcctcttcactttctgccataagcgtggtatcatctgcatatcagtcgcttcagtcatgtccaactctttgtgaccctatggacggagccctccaggctcctccgtccatgggattcttcaagcaagaatactggagtgggttaccgttttcctcctccaggagatcttccccacccagggatcaaacccgcgtctcttaagtctcctgcactggcaagtggtttctttaccactagagccaacaggaaagcaggggatgcagtttcggttcctggtcagggaagtaagatcccacatgccatgcagcacaaccaaaaaagcaaataacaacaaataaaatggagatacttgtatctctctccatctttgcgtgttgatcggatataataaagtatgcaaaagtatccaggacagagaaacctctggcactagaacctcaatagcattaatagtatgagaacctttagaacctacacagcagtccctcccagaagcaggttcgtcctcaactgcttcacagaaacctctagaagcctctcaatcactgacccatgggctggggaaacagcacttgctgcctggccctctgtgtacccttctgcctctgcacagtttgttagctagggcagttgtgacccaaggaggaatccccagagccaagactagctggctggtctctccaatcctccagcctggcccagcctttgtggtctggcctggttctcacagttactttcaaacaatcttcacagtattagtagggtat

SEQ ID NO: 58639 - DNA, 1800 bp, Bovine  19866880385870
aggcttgtgaggtggatgagaaaactggaaatacgctgggtctgcagttctttgtaaaccagacagaaacaagcagacagatgcttcctgctgccctgggctcttaaacagaagttctcgggttggatcccagatgtgggcactgtacgtgctccatgcagtcccagccccccacccgcctgctgtttgcacgttccctctcctctccagctggccccagatgtcctgagttggcctgcacctgccttggggtgtccctggatctggctgatgttgcagatgctttagcctcagatccatccccgaggcaggatggagtcctcaagttcatgtcacttgtgaactggtctgacttactgtcggacaggagacgaaatggtccctgacaagcactactgtgaccctctgagctgcaccttgtccacccagggcatcccttcctagaagcaagccccttggccgggcccagtgggcaattacctattgctgcacagagatcccgctccctgcacgctgtgttcatcaagtcagacagcgcctgtgtcaaatccattgtcacacggtgctactacgtccctgactccatatgtgaaatcaattaccacacattagggcgtgtttcacaccataatggagcgtttttctgtaccattgtttgcatagagagaataggaagaatcattatcaagtgattggaaatagatttttgtgtctgctccaaggcaggagggcgtggagcgaaggtaagaggactcagcaccgtgaggggaagcccttggagtccctgtgcctggctcccagggatggagtgttcagagaggatgctgggggaggctcctccaggaaaggaaggaaatatgcattcaaacctggagggtaagaatagcttcctctgtatcatttaggttctctggggtcctctgatgccagatagctggctccggtccatcgtaacccacacacagcatatccctccccacaggagagagagaagcagccttgaaagcttcggcttgaaatctgaccaccttgatagaaatccccatctggccacttcaccgctgtggagctctgtctggacaaggcacccacctctaaacctcaatttctttatccgtaaaatggggataataactgcaccagtccaacaggctgttcggagaatcagaagagatgatgcgcgtataaaacacgtagtcctgtacccggtactattttatttcataaaccttgggctgctgaaacaaaatcccacagacagagtggcttattaacaatagcaattatttctcctggtgtggaggctggggaggccaagagcaaagttccagcagactccccatctgattcagagatgccgtgtcctcacatgtggaaggggcgagggaggtccctggggcctctcttacaagggcactgacccctcatcagcccatgggacctgtcttcaaagaccagcacataggacaacctggactgatttcctggaaggcagtttttccagagattgggaagggggtgatttcgggatgattcaagtgcatcacatttcttgtgcactttatttctattgttatcaatttctattgttatcacatcagccccacctcagatcatcagacatcagattctggaggttgggtctcctgacataggggattaagtttcagctttttagggtgatacatttggtctttaaccctgaattttctgtttagttgctcagttgtgtctgactttcacaaacccatggattgtagcccaccaggatcctctgttcctaggattctccaggcaaga

SEQ ID NO: 58640 - DNA, 1746 bp, Bovine  19866880491988
atgggctccagtccatggtgtcacaaagagttggacatgactgagtttctaacacttcccctttttcaataaaacaagcccgtgatcctctccataattttaagcaaatgttggattactatactacattgctgggcattttagagtccactctctaatcatttgctcactaaagactgactctgtgctagccattgtgatagagattccaaaatattttttaaatcatccttccagtttagtggaggatgtccacattatcaaaaatacattttcctttctatagttgtaattttctgctcctttagctggctgattagagtcaaaagtgatggagattcccaagaaatgctgctgtcttcataagaataatgttcccatccatttctgcctcctgacgctttgactgttcctttctcctttctgtttctgccagaagaggaagatgtatgcttctttttaaacaaaagtatctgtgacccatgaaacaattcaagaaaaggtcaattttcagagaagaagcccagaatccagctggtgtcatttttttctgatgagtcctgggcatgtgctaatttgtagttcattgtcatagtgatgattgaagtccaagaacagaaagttaattctctgtttcagaagtctccagagctagacagttgggtgcaaagtccagtgggtcttcagaaggggtatgtaaggcttggactgtgccctctctagcccaccttcatggctggtagccatgccctggagaaacctgggcaactgtatcacatggacatcactgggcctctcctgggccacctggtcacattcaggtgctgagcacagctaagtgtccttgggatgctgtggaggaggctgggaatcctcttgatctgccaggaagcccaggagagacatgtgtctggttaataatagaaccaactacttttcaaggctcttttaatttattagaaggaggcttcggatggcaggtggttgcaactgggaaggaaaaaagggggcaaatactacttctttttgctcaggcatcacctttggaaacaacttccacccccatctctttggcctgttgggggctgggctgataatcaccgataggagaagacttaggcataatcccctccttcctctaactgagaccatgcattttatttaattggcatcaccccatggccctacgacatctagaatctgtctctgtggcctttcttatgcctcaggaaggattcttgaggccaacccaaaagggcagctctggctgttgaacaggcaactccattaatttgggatgaactgagtgtcagcaaattgagtttcaagggcaacccaggaacctgtcaatctgaagcagtctgccatgtgtccagaggatcctaggagctggattttggaggcttgtttacgttggtatatgtaatagctacaatcccccaggtagattaagtaatttcttcatttagaacatccaaacctggatgacatttgagagattttctctgccttgtcaagggcaaactctcgctttattgcttcccctgattctttacttaaagacaacagacggctttctccctcgcggcgactacaggagcagaggtgagtgaaaattaccgcagatgttttatgatgttcaagctcttgcaatcacactccccaaacaggctaatagcttctctcccgtgttttctcattctgtctcctgtaattggcctatattttctttccaagtcaagattt

SEQ ID NO: 58641 - DNA, 1799 bp, Bovine  19866880552523
cccgagggcagacggtgggcagaatgggctggtaccaatggttagttttcaagaactttgctattacacagtcatcactaacattttggttatgtgaacttataaatcatgtgtaataacaagccccaccacatcctaatggtttgagcacaattatctgtgctctggagcctgggagatcaacagtccttcaggacagaccccagcccactggggcggggaggtgcagggaggagagcagatggtgagggtaggagggcaggactgagtggtgcccatcccacatcccacatgatgcaggggcatcatgacagaagctcagaccaggagctttaggaggtaaatgctcaggactggagaggggttgggtgatggagagccatatttagcactgaccagcacaccagtgcccagggatgtggagaaaagggtggtcttcctgccaaagaggggctgaggcactggtggaaagtggaaaaaacatcaagaaaaggtactttctgggacttcaccggtggtccagtggctaagactccaggctcccaatgcagggggcctgggttcaatccctggtcagggaatgagattccacatgccacaatgaagacccagagcagccaaataaataaatgaaaataaacattttttaagggagcatcctcaaagtattttcttagaaaagaaagaaagagtacttcctccctgcctttctctcctgtgatccttgaccaagtacaggaaggactccggagtgagaagctgagggtgcgcagtggtgataccatcaagtcacgagatcccactgactctgaggggagtctgggagccctgtttcaggctctgggccccaaggtccttcctagctctcagtaaaatgcacgtctttcttctgagaagaaaggagggcaagtagagcaaggaaggctctcctgtctctcctgagacctagaaaatctttccagaaccaaagggctctgggttgagcttgtaagaggaggagcatgtaagagtgggacagtgcgtgaagatctgaagcatgagaaggggatgtgaggaagaagtttggaattttcttaggagagtggctgctggagtcaacaactctgctgtggaagggaagagaatgctgggactggtcccagaaagagcactttctgcccattattctctacccataaaggatccggacgcaagagccccctggggctttggaacaggaagagtgctccggtgcccactattctcctggggccccacttcagctgagatgtgtggggctgaaattcattatgtgaatgagtaagagatggtgtttacgctctgcaaatgaaagggagagtgtgcatgtggagatctgtgagagagagttcacattgacaaaggccttctgtgtccaagtgtttaaagaggggctgtaattaaagagaaacacagacaaacaagggcaatcataagtcacttctttagggcaggcaattgttttcctacacgcagcagttttaatggtgagttacaaggcttccaatgacattttacgttcactgtgatccatgggttttggtagggactgtgatgtgtcgctagtgatgatgggcacaggagaagaaacccttccccacctgttggcctcacttccccttccccagtcacacctcgagcacagaagtgggccatgtggacatcgccaaaggcgtttgcgtacactgagcccttactctgcactcagcactacactgatttccatgtgcatcgttttccgtgaccctggtctctctgctcttgggaagctgcccttctgt

SEQ ID NO: 58642 - DNA, 1151 bp, Bovine  19866880570206
tgagcaaacgattaaggggaatgtgaatcaggaaaggccccagcagaaaagaagagggatcccagtgctcccggttcccctgggagaagtgggctgagaactgtccctgaggaacaaacaggtggagttcctggatgagctggcactgcttaggctttcaaagcactgtgccccatggatggacggctgacagcaatggaggcggcaggtggactaggggtctcgtccttcccagggcacgtcctcggcatgccccacgacgactccaagctttgtactcggctgttcgggcccctggacaagcaccacatgatggcgccgctctacgtccagctgaacaaaacacggccctggtccccctgcagcgcctcgttcctcagagagttcctggaccgcgggtacggtaggtccccgcttctccctggccggcggcgggcacccgcattcctggaccgcggggtacggtaggtccccgcttctccctggccggcggcaggcacctactttgcttgagtctcaggacgggagacattcagcagcagtgtcctcactgccctccagggctgaggtgctctacccactcctctagcctgctgttcctcagcccagcttctagcgccaatgagattatctgcagagcaggtagaagtggtctgagaaggtctgttggagaagatgggttcccacagaccttgaaggaatgaaagaatgtttgtcatacagagcagagaagggagcctccggctggagccgtacatcacagggtagcgtgaaaacagcataggcaggaacgccccctgagagcaaggagtggggcgaagtgcctggtgcaggcagcctggcttgtggagtaaagaaatgaagacacaagtgattcttgatgcagacataatagatcgttcaaacatcaatactttggctttaattctctgggcctggatttaacagtccatttacatccctaattatactgtgacttagattagtgctacaattagctggccttccctcggtaaacactgcatacatataagacattctggatgacaaagaaattcagtcctttaaataaatgtgctactgataatcaaaacgtggaaggaatttctctagatgatggagtgttacagtttgggatgaagtcaaggagt

SEQ ID NO: 58643 - DNA, 1728 bp, Bovine  19866880598918
tttgccccatcctcctgttgcttctcacctctgcttgtctttggaccctgtctccctccttcacagctgctcgtcttccccacccttctttttctcccccaagttctgcatcagcgctatcaaatgggagcccgggaaaatcactggcaggtgaggaagaccacaacagaacactgaggaaatacaaacgccacggtggacaggaactgtgagaattccttggaagaattcaaattcttttcacttgggctgctctgaatacacaatgggagtatcagagccaatcaaataatgatgctgcctctggctcattgcagttcatttttaataaatgttacagctggatacaatggccagatgaattttaaggtcctcccaacactgagattccatggttaatagaatattacagctgtagtaattttaaaaatcctgtattgtctacaattaaggatgctgtaattgtctattctaattgtggcaaaaggccatctttttgtgtcccagctccaaggaccagccacgttctaagctctgcagtgtcattggacgggagttgctctttcctctcctcctgtcactgctgcaaccagagccagggaacactagcacacccagaaccttcagaaaggccagagatgctgctttccaattcctcccacagtttggggaggagatgggctatcagcgctctcattccagtgttgctgtggcttcaaaacaccataaagcaaactgagaatggttctggccaagacttcagctccagcctcggcatcctcccatcgggaagaagcctggtcagaacccccagcttctcagccggaggaggtggtgtgggcatagtcatgggagcctccttgagcaggaacctcgtctttagaggacgtccatcctactgtcttctcccaggattcaagttgctacccagtagggcactgtgggcttcctggtggtaaagaaccctctgtcaatgcaggagatgcaagagacttaggttcgatccctggctgggaagatgccctggaggggaaaatggcaacccactccagtgttcttacctggagaatcccatggacagagtgaacctggcgggtctacagtctatggggtcgaggagagtcagacacgactgaaggcacttagcatgcatgcatgcagggtactgtgtcttggctttactggcacctgaccaggcgtgatggagagttttttgaagtgttttatgtatctattttcttttttaactttttactttatattggagcagttaacaatgttgtgatagttacaagtgcacacagactcagccatatcaatacatataaacgtatccattctcctccagactcctctctgcgatgggggatctaacgtgtcactttggcaaagcggcagtacccagatacttggtcaaatactggttcacatgttgccatgaaagtattttttttttttttaagatgagattaacatttaaatcagttgactttgagtcaagcagggtggaaatgggcctcatgcaatcacttgaaagcttaagaggaaaaggactaaggtcccccaaggaataaggaattcttaatggcctttagactcaagacagtaacatagcttttctctgggtttccagattgctaattttggactcaccagtctcctcagtcacatgtgccaattacttaaaataaatctctctctctctctgtacagtggcttttaaaaaca

SEQ ID NO: 58644 - DNA, 1971 bp, Bovine  19866880656044
catgtgctgaggctctgactgccctgtgtgatggtcgttagaggtggggcctttgagggtgagggtgattaggtgaggatgggactcttgtgcccaggttagcgcccttacaaggagagacatcatagcttcctgtctctcctccaggtgaggatacagcaagagggtgcccatctgcaggccaggaggagagctctcaccaggaacccaggcagttgcttcctccatctaggacttccagcctcagaactgtgagacagtaaatctgttgtccaagccccctattcgtggtattttgcaatgttagccccagcagatgaatacacaggtttgcctcagttcattaataaagcaaatgggacctcttcaaacatctcagctcaacctaactgcacaggaggcaaagtgatgagatggctctcgggataacatacctgtgattttaggtgagttttcactttcatgcctcttaatagactcagctataaagtggggggttggatttacatgcctcaagcccctctagttcctagggaatcggtcagactgccattcttacttctggttgagttgttatgaactctgtttcctctcagacttaaggagtgacagagaaatgatgatttcagttctctgtttgtgatgagttctcatctatctgcaagtttatgtgatttttttttaagccttaagaacagatttttccaggacttccctggcagtccagtggttaagactccacgcttccatgcagggggcatggctttgatccttggtctgggaactaagcttgtgcatttgtgtgtgtgtgctcagttgcttcagttgtgtccaactctttgtgaccctatggactatagcccaccaggctcctctgtccatgggattttccaggcacaaatattggagaagattgtacatgccacactgcaaaaaaaaaaaaaaaaaaaattcctaaggttgaggctgatggaaataggttcttggggctttggagcaatcatgagtggttaatgtgtgaagtgccttagggcaggtttagctgccagagaactagctctaagttcttgaagagctaaagcagtggggctagttgagggacacctgccatttctgctgtggtttacagctgcttgtggtgaggcatgccagtgacaggtgtggaggcctcactcgtcaccacaggtaggtgggcaagaccaatcaagcagtgcgaaacgaattgtgtggttattccagcttctctatgataagcttgtccagggagggggcagatggacgctagaggggtctggctgtctgggtgtgtggaggaaggtggggtgtttcacagaacttcacaatccccttggcaggcataacctgagccattagactgacctcatccatcttgatgttatttctctcaacaagcaataacctcagctttccatggcttgtggtttctgtaggctgggactgaattccttgactctgaaggaaggtgtccaattggaaacagtaaaaaaataaaattagtccataaaggcattttgtcatcagggagtgccccaaatttggaagagtctgttgggtaaaggtcttggaaatccacatggagcccgaggagagatttgtcagccactcaggcattcttataaacaacattgattaagcatctgttgtgtactaggccctttgctagaaatgtcagatactggagatgaacaaatgctggtcttgttttcaaggaactcacgtattagcaagagagatgaaagcgtgaactgttagagtgaattgcatgaaaactgcggacattcaaccacttactctgctctattaaaaaccacgaaatttcctatggttcagtcagatactattatgtcttatgtatagcatgctgtgggaacagagaagaatgagtgatgaatttacatattggatcgttgtcaacaggctttaaccttggcctgaaagggagaatagagt

SEQ ID NO: 58645 - DNA, 1267 bp, Bovine  19866880668978
atggaaaatagatgggaaaacagtgtcagactttatttttgggggctccaaaatcactgcagatggtgactgcagccatgaaattaaaagacacttactccttggaaggaaagttatgaccaacctagatagcatattcaaaagcagagacattactttgccaacaaaggtccgtctagtcaaaggctatggtttttcctgtggtcatgtatggatgtgagtgttggactgtgaagaaagctgagcactgaagaattgatgctttttaactgtggtgttggagaagacttttgagagtcccttggactacaaggagacccaccagtccatcctaaaggagatcagtcctgggtgttaattggaaggactgatgctaaagctgaaactccaatactttagccacctcatgcgaagagatgactcactggaaaagaccctgatgctgggagggattggggggcaggaggagaaggggatgacacaggatgaaatggccggatggcatcaccgacttgatggacatgagtttgagtgaactccgggagttggtgacagacagggaggcctggcgtgctgcgattcatggggttgcaaagagtcagacatgactgagcaactgaacctgaactgaacccctgctctggatacaaattctgattttaagattgcctaagaagccaccctgcttgactcattatttcacagtatggttttaagaccactcaaccacactgcaagcctttttcaaaccagttctgtaccaccttgtccttatataattgttttcaacctcaagtgaggacttgacatttttacacagttgaatttcatcttattgattctggcctataacatcagtcttttgagatttttctgaaatgccgcccagttctggtcatctcttagtcaacatttttatcaaccaattatatgaagacataaaagatatacatatcaagtttgtgggtaacacaggaagtcctgtttccccagagaccttcctttggaatggctcaaaagcattaatcagcacataaaagaacaagagattgcctcccttacaaaaacacaatgcaaaacttgccaaagtttttagagaaaagctccagaaatgtgtctggctgaggatacaggcttccctgagtctatttcagagctcatgggggtcaagtcagacaggcctgtataggggtcccagctgtgggagagttactctgttttcctaaggatcagttttctattgaaaaggaagtcagaagcaagcacc

SEQ ID NO: 58646 - DNA, 1977 bp, Bovine  19866880704146
aggatgctcggaggtgggtgggtgggaccgggaccctccaggtttagaacttgaacttggggcaggttagaaatgggtgggtgccggcagcagggagcaagctggctacacagttctcgaattgatcccctgccctgctcccccaactcacccccatatttaacaccttgtaataagtataaagagcagaaatttacaaagaaagccaaagatgacagttgcagggtaaaaaaggtgtgggaaatatgtgaggaacagaaggctcagaattctgcttggctattagtagcttgtgaggtgtccacaggaaaccacagtagctgggcctggggaccgggtggcagaagggacctggggaaacgggccagagcctggggtgactttggtctttcatgctcctccagggggcagaaactgaccccagggtcctggctgccaggctctgctcttgcattgccttcttcacgcccgcctttagtatctgctttgcagactcacactgatgctgtcagcaaggtacttagcactttccaaaacaggacaccttccctgagacttcagtgacggcaaattgtgctggtcgtttagtgactcctcaaagaaatataaataacgagaagcggagttttgtcttctgaaccaggacagcctgctctcaccagctaagcctgttttcaacagaagcaaagcagaaagttcaaatgtagcccacccacaagccaagttctcctaaatcctgtaccttcttttgtctccataattgagggtccagcagtcatcctgtctgctcagactcagctctgcacgacctcaggggtggagggcagcccactgactgaccaccacgccagaccacatttccttcttctcgggggaaggccgatcctatggccatcatggcccctctcttcttaagtcaccaggcacttgtctgcttacctgcctgtgcttctcaaggagaaacgagggagagtccttctgtagtgataaaaagctgtgaaagatgaacagttatttccggagatgaagatgggcatttgaagtccaaggtaacatcatttcatagaagaaatatctcaccattggctttataggttcttgaggccacgataagtgagtagctgccccaggaacaaatgatgtgcagtgtcaaaggcacaagcagggggaggtccatgcccggtggacccctccgccccccagggtgggaagcagggctgtcccaccctcacagatgtcacacctctggtgtctgcctgacatcggaaccagcgttcaattagctgaacaaatgtgttccatgttcttccagatcatctcagagccatttgtatttggcttcataatgcatggtggcaggggggtgggatgtgggtgggaggtggcagtggagaggtctgggtaggaaagagttgctgaagatttatctttctaattatgctttgcttagggctaatattaaaattagtcttaattccctgagcacatagcagctcaggaacacgctgggctttggggaggctgggctaggattttcatttatttgggatagacatacacgggtaatggcaagtcggctattcagccacgggactgggctgagatgtccaagtgtccctcctgggctggccgcccctgagttcactcaaggaggatggcagggagccaccacactgcccttgacctgctctgccaaatggcttcagcaggtaaaccacacagctcttcctattgttctgcagcaaaataaccctcgatatggtaaataatatgcaattaccaaattaatacagaatggcatgtctcctttgccccaagtacccaggatgtgttgtgctaatgacttttgcacctgctgagcgtaattagtgagtaatctgcctggctgtgtaattacgggtaaacacatgatatttaccaataacttcctgctaggtgagcaccagtgaacactaacaggtagccactgagactaag

SEQ ID NO: 58647 - DNA, 799 bp, Bovine  19866880740121
atcctgccgtcccctgggccaccacaggctcacccacagcagagcaggagggctgttccgatgcctgcttcccaggaagccgggctctgtgcctcgggctccctcctctgcatgcacagtccccttaattatgtcctccctgcacacagcgccttcatctcctcctcctttgaaagaagcctgggcaagttcttcccgcctgcccgggacaggtgtggggatgaccccagccctccaccggggcccttggctttgatgctccggctttactgctgtcctttgtattccgtgcttcccgctcccgcgcctcctgcccagggtgttttgatgagcttccctctgcactcatattgtctcagtcgttaaccacccatttgcaagtctgtaatttacttttgatcattcattttatgaggcgcgcagggtaaaaagccgatgctgttcttccttcgtttcccctactcctcggtctagtctgcagcggacgatgctctgccagccccagaccctgttgccatatcagctcataaagaggcatgtgcagccctgaccttcctgggagagatttttctttctgtttctccttctgatgtgttctttagcttcctcccctcagggattagcttctctgggaaatggaggagttgggggaggcaattatttgcgagtctattgatatgataaccccgattgacagcagggggactcgctggcagaacggatgggattgcactaaaccccgagaggaggagctacaaacggagacccagcaacacttcccaaactatatttcacagct

SEQ ID NO: 58648 - DNA, 1745 bp, Bovine  19866880766455
agggcagggagctccagcagaggacaggcttgggtgtcagaaaaacacaggtggtgatggtggtgtctccaccctcgctggcctgtttctctctggcagaaaaagcaatgactctgtgattctgacatttcccaggcatcttggatttcatcttaggaacgtatgtacattcctgatgggtggacagtggaaaaagaatggcttttgatgcatcttctgtgctaggtcttctgtgaatgctcatatacatcatgtcactgtatgtgagaaatccttgagaaatagacgttatgattattattattatcattatttagtgaaagtgaaagtgttagtcccttcagtcgtgtccgcctctgccaccccatggactatagcctgccagactcctctgatgacagagttctccaggcaagaatcctggagtggtttgccattcccttttccaggagatcttcctgatccagtaattgagcctgtgtcttctgcattgtgggcagattctttaccatctgagccatcagggaaggccatcattagttacattgtaaacatgaagaaactgaaggccacagggttagatgatgtggctgaggtggttctcctgagttgtggagagccaagctgggttccctagaccccacgctgtagtactgcgagatttttactgcattttctcatacactcatacatcagattccgtaccatgaaaatgcatgaccaggctacatatgatcatccccacttgacaaatgaggaagctctggctaagaaaggttaattaggaagagaagcagccttagatcctgatctgactcttagtccagacttttctgacgaccctaagctgcctactttttcctgtcactgctatactcagtcttattcctggctcttgtgttttgaaggctggaaaattcccctggttgaatctccaaatttaaagtgtaacttaaagagccccagggaaaacaaatcaactgcagtgctttccatcaagcttacaaagtccaccccaaaattaatgggacagttattgtttataaaatgcgaacctgattaaaaacatatttattgaggattagcacatctgcaatagctacagatctcctcatagtcattaaaatcttaaaatatgtttctagtaacaacgcagttatttatatgatagttgcctgagtaaaacagaataaaatgaatatttgatgagtatagatttcaatctgtaacacacagatggtctggggttgtggggctggggcaatgggaacaaaaatcgccttaaaagaacagtgtgaggttgatttatgttgatcaagtggtgttttcccgctgaataaaatccactggaggtgtgctccctcagggaagtggcttccttagatcaaatgagaagagtaggtagtaccatgggtaactctgtaaccttacggattttcagaagtgcgtccaagtacagtaagaaacgcctgtatttcatatcattcaaatccagtaagagcagaaaaattactaatcttgaaaataagactctaaagagtaaacttctgtttgcagtgactgttttgattgttgttgaggtatagttgctttacaatgttgtgttggtttcaggggtacaatttttaaaatttttttggaatttatttgtttctggctgtatcagggcctcgttgctgcccatgggctttctctagttgcagcaagtggggcctgctctactagttgcggtgttacagacttct

SEQ ID NO: 58649 - DNA, 1063 bp, Bovine  19866880780709
ttttgttgacaaagttctggaaatgatgatggttgagccagctggtgtattatgttccagtgaaaaatcgtgatgatgtggagatcaacagtgccatgaaaacctccaatgcatctgcacctccactaaggttgtgggttacacccaagtgacctcagcgtcattttgatccagtttgcatctaggactgactgccagttgctttcaaaatcctgtgctggcttcacaaacccctaaaattcggctttcattcccagttgcctttatttttgactttgcttttgctctgtgcagtgcataaccttcccttaggacccagaggtttaaccctgactcttggggtaggttgcctgtttatgtaccatgaccttgaggaaccagaaacccagaagtgcaatcaaggaaaacttccaaagacctggatatctaccctcttgaagcaagttcaaggctgactcagaaatctggtaactgttgcatcctttagcccaaggatggccatgtccagggtgaagctggggcaagcctagttgcaaagatggggtggaggaggaattatgtcatccaccaggatggggtgaggcaacatttgggggaacactgtcctgccagcaagctttgtagggaaagggctatggataaaattatcaagtattattatcaagggttatttaaaaaatgcacatgattgatttgtaagcagggagacagaagtaaaggtgagatgaaggatggtgcatgatgggagttgctcatcaaagacatctgagcaggggagagaatcacctgtgggggctggagaggcacagagtctggagaagggcctctagggtcagcagtagacagcttccatcccaggcaccaaggagttggagaatttacataagatcccaactgagtgggtgtggattaagacctaagaatctgtttccaaaaccagctccctccctagctccattcccaggttgggctgattaatgcatagattttgaagtctcagaggcaagagcctctgggccaaatccaacctgcagagactctttttgatagccttaagaatgtt

SEQ ID NO: 58650 - DNA, 683 bp, Bovine  19866880879020
ggggtcgcaaagagttggacacgaatgagcgactgaactgaactgaagatgaattaactaacccaaagtggttgagttgctggatgacagagccaagattgggagttccatccatctctctaactaaagcctgggccaccttggcctttcagtttcaacatcctgagggaagctggccagtggccccagggatttgacctgcaataacgtgagggagaagcagagatgttggatgagtccatcaagtcacagaccagcatctttggaggcaatggccctttggataggggggcagtgaaatttagatttcagataaatgatctagaatatatacaaaatctgcaatatacttatataaacgttatttctaatatttttttaatttgctaaatctggcagcctgtcatagaaaggcatcagtctccaaactgttcagcatctaccagaacctaaactataatttagttgtagggcttggctggaatctgaggagtgtttctggaagagggaaagatgaaggtcaggtcactgcagtgggaagggctagactgaacttcaggacacctgcttccagccccaggatgccctacctagacaggctgctccctcgccctcgggctctgcagtccctgcatatctttccacagttcctggcagcagcattcctttcatactggactttg

SEQ ID NO: 58651 - DNA, 1681 bp, Bovine  19866880880392
tatcccactggaaaggcagtgggccttcccagctgaaaactgagtgtccaccaaccccacaacccaaaactagaccctgctcaagtactgggaagaaaagatgagacccaaagcccaggggatcctgagctgagacgctagagctgggagaaaagtcctgggaagaaaagatgagacccaaagcccaggggatcctgagctgagatgctagagctgggagaaaagtcctcagatgcacctgtctctttaggacatatgttccctcaggcctaggcctcagcaacgagagacaggaacgttctggctgactttccacctccaccagctgcccagcccatccctggcagacgcacagatgcccccaggaaaggagagagaagaggagtcttccccagccctcactgttcctcattccaaacattctgtgagtcccagcacactggaagagtgtgtcctccgccaagcacagctccctgtttctaagaaagggaagaaaaaatagttgaaagggtttttggaccatggagagcttaagtttctggtaacataaatgaatcagacacaggtaaaagaattttctccagaagtaaagaaagatgctgtgagttcttctattggaccagaaagtggggaaaagatagcggagaagggagatgcatccaaggttgaaaggagggagaaaaccactgtgaacggtagatcaaagagagggtctggtgacgacaaaggtcagcgtgcacctcccaaggccatatcctgcacttgcttattactcaacttcttcacctctaaagttatagatttaaatattgtgtccaccaaccacgacttccaatccttccagacgctttcatgctccctcaatacttattctagggaccccaggtccttgacccacccaccatacccacagccccatctttatttctcctccatctctacttctttccctgtgcacatggagtccatgttccagcactgcaagctccatcttgccaacattcctgtcttccttgccccactgactgactagggcgccacagcagagcccacggagaccactgcaccctctgccccaggcttaccatcatggtgttgactctgagaagcagggcccatgccactgaactcaaggggccaccatgaagttagcatgttcagtggaagctctaaccagccacccaagcaggcctccctcattagttctatcgctgatcctgtataaaattaccttccactttcttcactctcctgatgagttcatgatcccaccatgagtggaagacctcacctctcccaactcagcagaactcaaccctacatcacccatgatttgaggagaaaggagacacagtctcactgctgaccagtcaggctacagacctgaagctagaggaacaccctgattttatcttattttagaaccgagaagcatattccagtaactctcaagtatatagtagacggggtatttgggaccttattaaattaatctcccaggtcctccgggcatagagcataggcttccaggactccccaccccgtcatccttgcctgcccctctttcttctaccacccacccagagtcctgcctttccttgtgcttgctccctggcatgatttatcacttagtccacactgtctgctgtcgctgctgcaggacctggaccttcagatctca

SEQ ID NO: 58652 - DNA, 818 bp, Bovine  19866880931344
agaatcccagggacggaggagcctggtgggctgctgtctatggggtcgtacagagtcggacacgactgaagcgacttagcagcagcaccagcagtgatgaggaaattgcaacgggagggctgaggtgggtctgggagagggggttagcctccagtcttcatattgcattcctgaccccaactgccttgagataaaggctaagacccagggcgcagccagccgcaggtccggactgatgctctgggcactggggccggacgcagatgcagactccgccgcgggttgctctggccagcccacgcctcctgcttcagcgcaacgccactccctccccgccaagtggctctgcgctcgggaggcgggatcgagttcttcggtggccccaggaggctgcaagctttgggaggctgggagaggagggagggagagcgctgactgggcagtccaaagaggagggggcctttaataggctcgcccagcgcctggtttgctgcgctgcgaaccgctggggttcggagaagcggccggcacctccctctagctctccgctgcaaatcttcgtccttgcacttgacagcgattgcacttaagctcccagggcgcgctctgcttggaaaggcacaggtaggaggcgcgagctgctcggtgcacgctcacagctctgggaggagtctccctccctggggttctcctttctgggagctgcgggcggcccggggcgtcggtggttccggtgtgcgggctgcaaggagaccgtgccggcggtcggggagccgggccgggcccttccgagagcgcggctgtgcgctgcccggcgc

SEQ ID NO: 58653 - DNA, 1116 bp, Bovine  19866881012635
gctgagcagcagagctcagcaggcagacaagaggggtggccatcctgcctccttcctttccacctcactgccgcctctgtctgctctatgcacaacaagctcttaggcgggcggctgcaagtgcacagaaagctgggtcagggatcaggcagggtcactgggcgctcaggccttggattcggctgctggtccccacggtgtgctgggcgtggacacccctttctctttccatgctgtccccaggctctaccgcacacttggccctgggccttggcaaacattctaatttgctgcataattaatgtaacagtgattcaaagcagagaggcttctgggactaattagtgacctgaatctccatggtagcttgcattccattcttatcagtgccgggaagagctgcactccctgaaacaatgtctcccacttacgactgcgacacagccaagaggcaaagatcattttccctttcagtgtgcacagattccagcagtatgtgatcacgtcccacgggggctgcacttcccctggaagagcctcaccgaattagtccctcgtgaactttcaggtttctatgtgggcctggggagctgtcgtcgcaggtggagaaataaagacagtcagcaacagcttgctgaccatccacagaatggacagcattgttctgggggttggagaagcttgaaagagaatggaggcctcactctctttccagagaccttgtagtaggataataaagcccacagtgatgagaatagatgacctgtgcattctccttcctaacttgatcccctgtttgtctgagcttgcatggctcccagtgcgccagtattcaaagtcagagtgacctcagaccaggaaagtcaggagcaccgcagcagtgatggcctcactgcctcccccgcccccgccagcttcctggagctcctcacccccatcagaaccactgcatttcagctcacttgctcaggcccagcctcatgaagcctagagtcagcaagttgaggacacggatagtgggccaatccagtctgaccactccttcaattcacgtacacatgtggtccgtggctgctttcacgtgacaatggcagagtttaatagttgcaacaagca

SEQ ID NO: 58654 - DNA, 1169 bp, Bovine  19866881049463
ctgctatctagcgtgtgagtttggtaaattacactgaatttctctggactttgttcttcatctgtaacatctatatggatcgtcctttgtgtagtgttagcaggacaatttatcaagtctctggctaaaaggaggtgtggcttaggactagatctgggtgagatcagctcagagtttaggacctggtgtttaattcatactggtatctcagagttatttcccatgtgggattctaggatcagagtagatggacctcagagaaacatgaccattaggaaagaggtgatggcggtggaagctgcccgagttcatcctgaggctccctggacaccatggactgatgcccatttagacttgattactggaagcccaaggggccaagcactgtgtggttaggggagtcatgtcccggcaggaaagactcagtgacttgtgcaagctgcaagctgagccaggaatgcaacccaggcgtcctgactccacacccctcccagtgataaggccccttcccgctccctgcatccggggctggacagccctggagccaagggagtgacctcagggcgtccggtgagctcattctgcggccgtggtgtggatgtggacggcgctgtcccagatccgagggaagggcttcacagcctgggtttttcagaggccggtgctgggaacaggcccttccccggagactggaaggaggcggtgtgctttgagaaggctccacggacctgggcgcgagagccagtgaagcattgaagggaggggagagaatgatttatgagcgaaacataaatgagcagaactggctggcttgacctcaggaccaatggaggggcgtgggagaacattctgtaaatactttagaggcatcggtgccagagaatagcagctgaacctggatgccagggaggggagggagcgcaaggctaggtctgtcagggaaatctctcctggagccgtcgggaggcaggcctcctctgtttggtcatctcctcgtggcaccgggtttgagggttggcaggtcccaggatacagaccacgggggccagagaaataggcccagatcacttttcctgtaaggaaatcaggcagaaattataaggcaagacaggcagtgaggacagggtgaaagggagagccctgcccttcctctctatgtcctgttctaa

SEQ ID NO: 58655 - DNA, 679 bp, Bovine  19866881051995
gggcttcagggcggctgcacctggagcgcttcatcccaatggccgtctgccccccaaacccggaggctgagaggcagctggagctggagatcgaccgcacccatccggatgatcatgcgggacttcgtgtcgtcctggtaccgcacggtgagccaggagccagccttcgaggaggagatggaggcagccatgcgagggctggtccaggagctccggaggaggatggccagggtggacagccatgctcttgcccagagggttctgactctctgcggttgtcacctgcagagctatattcaggcgaaggaggccgcagggaaacagagtggcccaggggagccctcccagctctgggaggcttactgccgggccagcgctccacaccctgcagtgcagagccccagcgctgaggtcacctacacacgtggcatcgtgaatgtgttgcttcaaggactagtgccaaagccgcacttggagacccggactggcaggcacatagtggtggaactcatcacttgcaatgtcatcttaccactgatcagcaagctctcggatccggactggatccaccttgtactcgtgggcatcttctccaaggccagaactaacccagcaggagtggctaatccactctgcccagccagtgccctggaacagccctcagtgcccacatctctgc

SEQ ID NO: 58656 - DNA, 1481 bp, Bovine  19866881070793
ttctgcctggaaaactcttgcattttgtgcagcaatttggagctccttcctatctgctggatgggggtgctgcctgattcacgaatccagacataagatctttaaaatctcttcagttgaattctgtttttcacaccccaacccccaatttccttctcccactgcagcaatgaccgcactggtctcgtcattcttctggcctctgtctggcctctgcttcagtgtgaccttggctgggagctgtctgtgcatggttacagggggggagggctgaggccaagggagaaactgaggtacaggcggaagggggaacctcgcctctcccccttccccctttccccttccagggttactccatcactgacttttccaggtggacacttacccctggcactcagccgggaagaatccaaaaccctttgtttctgaggaagccttttcccttcatgtttgtgagggaaaggaaacagaaaaatgagagagaaccacaattgagctgcaaaccccacatagagcctgtggctgttgaagacaaaaagggcttttggaaataaattgtgaaacagaaaggggaaaaaaagccccataattttctctgcgcttgggcggtttctactgttccactgtgaaggaacatcccgtctgtttctagccatggctcagaacacggctggccaggaatcagtccccgagtaacacgcaatccctcatcaccagggaactctggggtgtgaccaccccctgctccatggatcccccaagatccacggggcaagaggcaccatgaacgattccagcgcccatcactagatggagctcttgctatgcacaaatccaggccccctgggcccggggggtagcggcgaatcccttagctggagggcagcatttttcgagtggtacttggttaagagaatccatttctcttccagttaggccagaagcccagctgctttttcaggtgctcaggaattctgtgcgtgtggattcatgcgtagcatccttacgtgcacgcgctcgtgcgcatgcacacaccccaaactcccactcattacctttactagctatttccccgaggcctggacccgccccactggcagcctcagtctccccaggtgattctttgtagccccaagctccccattttggggtaagactctctggcttcgtgaacacacagcttccatgtaattagctgtctaattgctcccccacactgagcccatgtgtgtgttactaattatgatttatgtaaaaactctccctgccattctttgttctctgctttctctctatggaggggccaagggagggatttgatttgcaaacttgtgaatggaaagttttccttcctctgcgttgtctggactcttccagtttcaaaatccaggccttgtcttggacctaattcccatgtgcctgcctcctgcctctcgctccccgacacaagctcaaggacagggtgcatatcacccgtaagg

SEQ ID NO: 58657 - DNA, 1482 bp, Bovine  19866881127682
ctcctgaagtcttttcttctttctctccctctgcacacctgccgggaagggagctggtcttgctcacctttgaaacctccccagctccaaagtcctatgtgtggctggtgaattcaaataaacacatacacacacacacaggctgcccttgcaggcgcaaagacaaagaaaaccgacgaaggttaatttttttggcctcttctcataatgactcatccataacgatttctacgggctgtattttcttctgtgacagaaacaatttactgcattcctgcaaagcccattttctcagcgtgatctagttgtgcggtggtttgggaagtaatttactgatattttgcttcaaaatatcttacaaagacaaagggttctgttgacacttgaggtgcattccttatgggctagaaagataggataaaacaattttaaaaagtaaaaacatggtattacagtcactttgaacttgggctgtaaatcacacgcccctggttgagacggccctctcctccccatcatttccgagtcttgctctgagcgctaggatgctctgtatgtttgcatgggcagattcactttctgctttgttggaagcatgttttcctgttggatcttgagcccggtcctcaggatgccagtgcacgcttttcttctgtgttcttcctgcctgtcacatctgtggaggcaggtaaccctctccagatccgtaataaaggagccccacagatccctgcctccctggctgctgcccttggtcccagttctttttcttttcctgaacattcctcagtctgggagtgtcgatgagggtttcccgggggcttctccgttcaagctgcagactagagaactttcaggctgaccctggctggcccctggctttgggcagaaactgtgaggctgtcctcctggtccagcgcccctgcaaggggctcctcagcttccctggattatccgctccaagctgagctccttctccaaattagacaggatttagacttcgtcttgttcttagtgctggcacacatttgttattggttttacccaagatttagactccttttaaaattaataatgattttaggactttataatgggcaaggtttatgatcatcagtataatcctataagtctaatcctaaaccaacatgaattatgctcaggatggcttcagccagatgcacagatctttgatttcctgagcagttgacatgaggaggggagagagaagacagccactgttagctccaaatccccaactgaggggactccgtggaaatttacttctaaaggagaggacttcctggacctttatgtttgctaaagatgaatttaagttacactaaggtggctcagaaggtaaagaatctgcttgcaatgcagggtatgtgggctcgatcactgggtcaggaagattccctggagaagggaatggcacacccaccccagtattcttgcctggagaattccaggacagagcag

SEQ ID NO: 58658 - DNA, 716 bp, Bovine  19866881144202
tgcatgtgtaaataggtgacatttgaaggaacaagagcaaagtgactcagacatagtgccctggactcataagaactaggagagacttacccattatgcagttaggcatttatctaattgtctcaaaggcaatatgcgtcagcctctcccaggatgatggggacagaatatagcccaaccattggaatcttcatttagatagagattgggcaacaaggaaatttacccagtgtgcttttaagaaggttttcttgcccagaacagtacataaaccttcttgtccggaagatcctcattttttctcagcctgactccaatccatttgccaatccaaaacagagtgtgttacacattaaagccacaggagtctttatgggtaacatatggagccataatatcttgtaacccagtagtattgtccctagagctaatataactctgttaacatatgtttctgctattcccatcctgagagatgtgtattgaaatatgctatgcacaatgtatggttaattgaaagatacagggggtatattaaaaaataaacctgtttatatgacctatgctggaatacatctgaaataccatacagttgttttcaactgcatatagaagaaaagatagtgaacaatctcactgtcttttcctctaattgctctgtccttttcctttcaacctcccatgtctccttatatgttttgctggtgccaagctaa

SEQ ID NO: 58659 - DNA, 651 bp, Bovine  19866881187304
aagtggggaaattaatcaacttttcttctcttagcatgtctttgcctatctcctctgctgtctcacctaattgttttgcactcaatatggacaaaggcattgttctcatttcaactttccctacaaagctcaggtgtccttatctgactctgaaactcactctaacctcatccagcaaaacctgcctttagctttgcagcaatgaatagggaagatcctcagcttctttcaggatgtgagtgcaatactggagcctcatctcccactgggtcacaccaggaaacacttctcagtttccctttctggactcaacagcctcgtccctcctctcgtaggcacctgaaagaaaaccccagtgtccaaagtcattggtgacagcgatgcccagaccgtgtgactgctctgaaaaaatttctaactacacctatgaagcgacaacctttctgtaaaaaccactgcagaggtttccaattctgtctacgtggttaacaaaaaatgtagaggggggacactttcatatccaatttatttcatgatgaaacggagcaggaccctatggtccttgaccaccgcccccccaccagccctgcccaacacacacacacacacacacacaccctcagcctgccttttgtctatggaaaaattttg

SEQ ID NO: 58660 - DNA, 935 bp, Bovine  19866881253012
ctcctctcctgtgcagagactgggcctgcaggctgtcacccattcatcaacgcattctaactgtaactcaggtattgatctgtgtttgttggtttttttcctgtaaactcgggctgtaaaggtttcattagcctgcctcacagtcattacatcaagtaataggtaacattcatcttctctggacttcacttctgctcccaatggatatcggtttgaagagcgttaatcaagctatgaaaatcattggcagctcattcctttatgatgaaaaaggtggtttgcagcgtcactggctagcagaggcctggccccttagcaccttcagcaattacgggctgtgtggcttcctgcttgggagaatttttttttgcctggtgcctgtatgcaaatctcattctttaaagcgagtctctgagtcatgtgcagttagacaaggcacagacaaggctgggcttctctgcagaccgtgggcagagggagggtggttaatcactgtgtggatccctgccacatccagacccatgcagaggtgagaagggggtctgccaaatggtgtccgggaactcagctaccagtgacttgtctacctgctccactctgtccacccaggtgcagctcagttcttcagagtccattatggctgtgctggggttagtggaggcaggggaggggggtgatgagagatgagaaacagggacaatgaggagagtacagtgttccaggtaaggggtggaggtgaccagggccagggcagtgggaggacagatgcagcaaagggcctggaaatgtgctagaagacttagagacatgtgtctagctccatccaactctgtgagattagaattacaaacccatttcccagatgtggaaactgaggtgcaaagagtttaagaaacattcctaacctcagagcttcctactgggcttccctccag

SEQ ID NO: 58661 - DNA, 1538 bp, Bovine  19866881262916
atcagtgctgtaatagtgaaatgagcaaagtggggaggaaggggttggctttgtcttgcggatccagggagagcatcacggaagaggtggctttagaactggaccttgagagatgcggaggggtcactgggcacagatgaagcgaaggcaccctaggcagggggagaacaaagccagccagatcatggaaggggatggggaggcctggtcgtggcctgaggggcgggtgacacagccacgtgagcaagttaagggtgagacttggaagggccagggcatggtccccgataaggtaactgtgagctggtgcaggtctttctttaggaaatgatctgatctgattttttttttctttcctttagtacaatgtcatctttgctggtgtgtctgatgatgtggactgtgagaggttgatggtagagaaactagtaagagaagtgacacttaaagtcagtcctggatgtggtcctgacggacccgatttggccgatatgtctaagtagacaggacaggggctggtcaccaaatgcatctgggggatgagagagaaggaaaagaggagggtggcagaggtttctagcttgatgggctggtcattcatgatggaggcagggttgcagaaggatgggtggatgtgagtggggggtgaagggagagatgcagtgactgtgctgattatggttctctcaggaggagaggggcagtggagggtcttgacatttagatctgggtgtcatcacctcacaattacgtgtgccaaggctgtcactcaaagtgagactgactgattcccacttccagactctgatccaatcgccaggctgctcatcctccctttgtctgtccaaatcccaattcttgtctgaatctgactggcatgagggaattgtctaaacacctctctcatttcagtcaggacctgggaatctctgttgtgtttctttcttttttttcattttccaagtcatttcccaggactcatggcacctcaggactccaggggagggcctgtcagatggagtttatttattgaatgaaaagcacttaataatttggttctgttttcccttgtccttttatttttctttctacctctctctctccttccctgggctttgctgagtggggaatgggtcagcagtttggccaaaacattcttgagtacttaattcttcagctgttttacaagcctgcctggtttatgtagctaatctttctctctggtgcttgttcctggaggaacgtgtgtgtgtgtgtgcatgtgtgtgtgtgtgtgtgtgtgcatgtgtgtgtgtgtatgtgtgttggggctgtgggagggctgggatggccatggggccctgctcaatcaagagaactaagagcatgattaagtctgaggtgtctgcctgtgctcagctcttgcattcttgtccactggctctgggttaatgtactcagaccccttgagcattcttgttcagtctggggagcttggtgaggtcatttgtctcaaggtttttgtgagatctggagaccctgcaaagatatagagagat

SEQ ID NO: 58662 - DNA, 2700 bp, Bovine  19866881316519
ccggggccagctgaggaatgtcttccagacctggagaaccagagctcccagccgctggagcacaggaggggagaggggtgtggagccacagaggagggcctgggcttgacggcctttctctagatcctgggctcaggagttcattccagattggaaacacatgcgcgacgaggcaaggcaggaaccagaaatcaacaacacataaaaatatttccttccaagacacttttccctcctcgatcttgcccctcctccccagacttcacttcccttctttattggccatggggcttgctggggaggtacaggctctcgggccccataaataataatatgaggagaggctttacatacagttcgtgtctccattcctgagtcgttcagaatgcacctgaagctgtaacagccaagggagagatttccaatggcacatgaagcctgctctaagaaatgtgtaaaaagggctactccttgttactccagtgtttggtttggctttttcccattagtgtcgagtgatggtggcgccgcctccacacctgtaagtcagaagttggagggaaactcatctccaaaagcaggttctgagcaaaagtgtcttgtgagcaaggaccttctacacaggaccctcatgtggtgcccaggaagatatgagcatccttactccccaacaggttgcatggcgatggtttgctgctgtgtacatacacggacttttctagggagaaagcccacagactgttgtcaaattctataggaaccatcactcaaaatgcttagaaatgactgacttagttgttacctagtctggtgacctcaatcttatctgaagtttgaatcctttccttaaagtttcattaattcaataacccaatgtatgcttgaactcctccaatgatgaaaacctgagccaatagcctaataattgagaacaagggctttggagtgccagctccaaagcctgtattcagagtttgatgtgtccctttctaatcgtgtgactttgggtcagtgattcagcgtggttctccttcatttttatcatctatatatgtgtatggatcataacacatcttaggtatttttgagattaaatgaaatcatgtatgcaaaatctgtaggcagcacatgggaacatagtatgtggataagaactgtcattgctgttactatcatcctcatctttttttttaatgtggttttgttttgtattatttgcaggtactttttaattgaagtgcagttgatttacaatgtgctaatttctgctgtgcagcaaagcaattcagttataaatgtatatacatgcttagtcgctcagtcgtgttcaactccttgtgaccccatggactgtaactcgccaggctcctctagccatgggattctccaggaaagaacactggagtgggttgatgtacattctttttttatattcttccccattatagttgatcacaggatactgaatatagttttctgtgctatatcataggaccttatagtttatccattatacatataatataattatattatataacatattataattatatatagttatactatatagtattatatgtataatagaaagaaagaaagagaaggccctcagtcacgtccgactctttgcggccccatggactgtaacctaccaggctcctctatccaagggattatccaggcaagagtactggagtgggttgccattttcttctccaggggatcttactgacccagagatcgaacctagacctcctgcatatcaggcagacactttaacatctgagccaccagggaatcctatatataataatatatctaattgcatctgatgatcccaagctatcaccctcatctttatcatcattgctgttaatacagaaacaattcactaccatttggaaagaaatggtaatcctgtttttcttccttaataaaattcttcttccttatgttgaactgaaatctgcttccctgcagcttctggtcattggcgttcctagacacttggtcaaacacggcaagagtgggaaattgaatgcaggctgtcccattgttcaaagtagcaacccaggaaaacgtaccttctataataaggcatcatagtaagaatcactctataagaaaggaaattaaagtgagagagttttagactcaggataaagtgggtctttttgtttcatgaagacattctgacaataaaggatatgcagagtacatcatgcaaaatgccaggctggatgaagcataagcttgaatcaagattgtcgggagaaatatcaataacctcagatatgcagataataccactctaatggcagaaagcaaagaagaattaaagagcctcttaatgagagtgaaagaggagagtgaaaaagctggcttaaaactcaacattcaaagaaaactaagaccatggcatccaattccatcacttcgtggcaaatataagggggaaaagtggaagcagtgacagattttcttttcttgggcttcagagttactgcggacagtgactgaggcatgaaagtaaaagaaacttgctccttggaatgaaagctatgataaatctaaacagtgtattaaaaagcagaaacatcactttgccgacaaaggtctgtgtagtcagagctatggtttttccagtagtcatgtatgaatgtgagagaaggacataaagaaggcttgaacgttgag

SEQ ID NO: 58663 - DNA, 852 bp, Bovine  19866881361155
tgagcatttgggaagagcatctaccccaagccccatttctcagccccctactgtctccagacctgaggggctcccaaggaaaggccgctgggatgcaaaggtgtcctttgcctgcagaactgaggctgccttaagtaaaagacattgtttgcagggagttgaggctggaaaggggctgcccaacttctgtgcgcccagctggttctgatcaggggcacggataccttgccaacctggcgcttagccctggcagaacttggcagcaccggcgtcagcacgagaagggaggggaacagaatttctgcctggggattcagcccaggaacctgaagcttcaggggagagggaaggagaagacaatggggatctgacctcctgtggtgagtgtccctggtggagccacaactattcttggcccacctgagctgccctctgcctagacacagctctctattgagctggggcagggaactgagtccaggggacagttcctgcagccaggccgattccaaatagatttactgatgctgcggactcagcaggaggtgtgtgtgtcaccctacaccccagcacctcctccaaggaccagatgaagcagaaggctccaggtgaggccgcactttctcttatcctggggagcgcagaaccagagatgtgccccatggaggactgacctacccagagggcaccgattcctgaaatgggcaccctggccgcagctgcagactcagttgctgccattttggtgatggcagtcttggctatcatcccattctagcctcagcctgtgcccagctgatgcctgccttgggggctttggcaccacctgtgcagaacagtctacatgaggca

SEQ ID NO: 58664 - DNA, 2127 bp, Bovine  19866881384171
tgattctggaagattaagcaagaaaacgaaggcccactaatactgtagccagaaaagtaacctggcttgaaattcgtgcactaattcaaaagaaaaaggcaggctgccagcaattcacgccacatttatctaagttacattacatgtttaatgcttattttgaccattttctccatcctcagaaacagatatccatgctcctgattaaagactagatgcagggacttcctggtggtccaatgcctaggactccacgcttccccccccgggggcatggttccatccctggtcagggatctaagattctacatgcctcagccaaaaaaaaataaaaatccacacacaagaaataaataagtaaagactagagacaggagatttagcttcacatttcttcctttctccaaactgatcatatttttctcccatgttcttggtgtcagaggcagagcaggagcagggaagaccagggagttgtatacctggacacagattgaccaggatttctctatcagctgtaatacagcccgtttctggtgcagggaccatgtttggaagtgttctttcagtaattccacaagcactttcaatgtttgtgtgtctaatggtttgtaagctctggcctcaaggggcttccacatggggacaggttggcatctccagtgataagcactgtgatgggatgtgaacaggtggctatgttcaccacggcaggagaagttgtcttctgtggatggtgagaatcagagccatccacacctgtacaattcatgtcacatgacggggctgtttcctgccatttccccaacgtgactctactcttccaggaaatctctgcccaggaagaacttttacaaacagctgaacatcctccatttaaaattgatcaactttccaaaaaaataacatcaagttgattgtctatgattcaagtcacttccattcctatcaaaacccttacctccctgggtccaaagcatagactcacatcttgagtgttggccaatcctaagcaagtttctgcatttaaagatgcaccttaaacaagacttcaaaacctcatgcgtgtcctggctttgccttaccctgccaagaccctctgagaattctgtcaacactgggttctttctcatcacagaaagcaacaaacccagctctgaattatcaacaggctatttgatggcacatttgacaatgaggaggaagaatgaaaagagaaatgacaagtaggtcttgaaaatgacgggcctgaacctgaagctgcagaagacagagcgttcagctgagcaaaagcttacagtggtgccattccaggcctcctggggcttacattgcattgtatctgggggacattttcaccttcttcctgtacaggatagcatctctgtaagcacctccttccatgactgttggggctgcagtgtatcatgtcccatttagaaataatgagcgacttcccgtcccccagagcaaagtgcttcactctttatgtggtcctccttcctccctggctctgtctctaccatgttactatccagggttccccacttcccacttccctcctgtcccagaggtcatgccgattcctcgtgcaccaaatccaatgccactgcttggggacctcatctagccaggtatcctgtctccaggatagtcatcaagtccatagaatctgtgcagacaacatatgatcagttcagtcattcagtcgtgtccgactctttgtaaccccatggactgcagcacaccaggcttccctgtgcatcaccaactcccagagcttgctcaaactcatgtccatcaagtcggtgatgccatccatccatcttgtcctctgtcatccctttctcctaccctcagtctttcccaggatctcctagaaccaatgatttcttctcttccccaagatgcattccttcctgctcttgctgctgctgctgctgctaagttgcttcagtcgtctccgactctgtgcgaccccatagacggcagcccaccaggctcccccgtccctgggattctccaggcaagaggttttaataaagccacagcctcttccagggaatattttctttccagaagcccctgagacccctgcatggaacacatagactttacggattgggc

SEQ ID NO: 58665 - DNA, 1312 bp, Bovine  19866881465333
tagcatggcatgagaaaacccaacttcgcagaaaaggaccacactctgcttacagaaatccatgtctaaacccaatgacaagctcctttcaagcttttgccaccaagaacattctcaagaatcctaacttcctcttttttttgttttgttttgtttttttaattttattttatttttaaactttacataattgtattagttttgccaaatatcaaaatgaatccaccacaggtatacatgtgttccccatcctgaaccctcctccctcctccctccccataccatccctctgggtcgtcccagtgcactagccccaagcatccagtatcgtgcatcaaacctggactggcatctcatttcatacatgatattttacatgtttcaatgccattctcccaaatcttcccaccctctccctctcccacagagtccataagactgttctatactttctctttgaatagtcccaaacactccagatttatctctttcacttccctagccctacttctaatcaattttctttcgcactttcccatccccctgataaatcaaatgccaatttatcctcttcttccctattttctgcctactttcatttcctctcttgctcttcactcatcagcctatgcaagcatccacatgtacattcagggtgtatttgatatttcttgtttgcagaaagaagcgatacctcaaattcatcaaatgcccaggcaataaggaagaacactattaactgcaaggaaacaaagtaaagtatttaaggcaattgcagaacaattcgagctaataatacaactaatgactaatgatgtctgtatgtggctttgccgggcacaaagcacataacaacctgagtcctattcaaccttcacaataatatgtaatctcacctaacaatgcagagaacaggatggcggagtggagtgaagatgacatttaccaccacgtagtaggtttgaattgcgactctgccaactaatgcgtgatgttacttggccagtgccaagccacctcagttttctcagctctaaaatggggtaaaaatattcaagatgcaagtgtttgtgatagttagtgataatgcatacagaatacctctctcctggttggtgagttactacaacctcaatcaatatatataagaaaacagaggctcaaagacttttacaagtttgctcgaggccacacagctggtaagtggtggagttggaattcaaaccaggcttttttgaatgaggactagaacttttggttctagtcatatcaggactagaacctttggttcagtgtgtctcaggacctaagt

SEQ ID NO: 58666 - DNA, 746 bp, Bovine  19866881485027
aaaccagttgggcccaacagacacatacagagcactccacccaacaacagcgcaatacacatttctctcaattgcacaacgaacaatgtccaggacaggcccccaaacaagtcttaatagattctttaaagagactgaaatcatacaaaatatcttttccaaccacaatggaatgaaattagaaatcaatagcagaaggaaaactgaaaaatccagaaatatgtggaaattaaacaacatacttttcaacaaccagtgagtcaaagaagaaatcacaagggaaattgggaaactaccttgagacaagggaaaatgaaaacataacataccagaacttacgggatgcagtgaaagcagtgttaagagggaaatttatagttgtaaatgctatagaaaggtctctaatgaacaacctaactttatgctctaagtgtctagaaaaaatgatactggctgacagtttatgttctaaggcctcagagaccatgcttcctggatggtatgacccaccctgacttcaaatgttccctcggtgtttcaacatctgcagctccaaactttctccagcccacacatccatattttgcaagatagtttaacatgagtgttatgttcagcacatcccaaaatgaactctccaccttctccaggaaacttggctttgcctctatggttcaaatcccaagtcttctctggttcctttctctctctggccaccccccaccccactcacctggagacagtgt

SEQ ID NO: 58667 - DNA, 753 bp, Bovine  19866881651749
gccaaagccctgccaacaagctcatgcagacacagacagagagcatctcatcacagagcagcttctaggcccaggaactcccaactgcctgctgaatggcagtctccgacacaccagagaagtaaattaaacgcattaatctcagcgagagtcaccattgaggcattcagggctgcacagaaatttccaacaattggcctcatttgcttcaataacaaataaaaaagggcgggggagggagcgtttgggtgggcctggacggcttttctctgctcgtctcctccagacgggtaatcaaaatgaagttccacattgagaatacgcatttcattttattctgtgcttgaaagcaaacacatttggccctttctcctgtaataagatggatcctttatctgttattcatttaggaacataaagatgatgccgcaacaccaagaccctgcaagcttcatttcagcctcttctcagcataaaaaggcaaatttattcctattaagattgttttgtgccgggtacacggtgttcattctcttaaagccgtgcagctatttggatccgtctctgttttcattcttattttttcagtcatttaatctctattcacgtgcccgggaaaccccctccctcccatgtcatacacaaaggttgactacaggctttgtatgaattgaagagaaagttcagcacaaacccaacctcaaaatgtctgatttggactcacttttcaggatttaaccaagagcctggatg

SEQ ID NO: 58668 - DNA, 1611 bp, Bovine  19866881892037
cacctgctgttccatcctgaagccctcaggtcagttcagtttctcagtcatgtccgactctgcgaccccatcgactgcagcacgccaggcttccccttgaccatcaccaactcccagagtttactcaaactcatgtgcatagagtcggtgatgccatcctaccatctcatcctctgatgtccccttctcctcccgccttcaatctttcccagcatccagggtcttttccaatgagtcagctcttctcatcaagtggctgaagtattggagtttcagctttagcatcagtcctttcaatgaatatttgggactgatttcctttagcattgactggttcgatctccttgcagtccaaaggactctcgagtcttctccagcaccacagttcaaaagccctgaagctccctgaaaagggcctctaggaaagttcccatgaaagcatcttcaagtgtggcttcttcctgcccatggcatcaccatgaaattcactgaaattcagcgttgtggaaagagagcagaaactcttcctgtgcagcagatgggcctggtgacacagaggaggggagagctccttgattttggagctgactcgagaaactctgtgctgcccccgtggctcccactcagaggcctttcttcatagagagtgaagttacctcttttcattatctttttcattcttttctggagcatcacacactacattttttcctgaaaattttccctggccaagatgaaaaacgaagaggtggaatcagaatttgccacttattagttgtgtcccattggggaaattattcatctaagtatcaatttattaatctgtaaactggggatacaaatcagaacaaaaatgggtggtgtaaggaaaagtgctttgtatatatttccatacatatgtcaggaattattttgggttcttcctctgaggggaaatggtatgataaaattgtgaacgaccgaagataaactctattttgatattctatgcctctgtgggtgctatcgttgagagagagaggtggagaaagatttctcagtgtaatttaagtaagcaggcgtcagaattggaggggagcagagtgaagggtgaggaatttattataattctgatctattgcaccatctcaaaaagacatctatttgaactcatgtacaagcagcaattacctggaaaataaatgtaataaggatctccttagttggcagtaaaattagcatcactgaattttaattaatagtccagcttggaaggaatatacttctccttagatgaaaagaatgcccttagctatggagtgagctcacccaaatcagcgctttctacagattttttttttccctctctgagtttcctggagaaattttgcacccccagtgtcaccgagagctcattccaaagaaataacgtcaatcaacaccctcccctgtgagcctcccttgtgaaatggtggaagcattggggaaggatggggaagacttgactcatcacctcttgggtcccttttaacttgaatgtgctctgtgttttgatcgggacatgtgatacttctgggtctctcagttctaaacattgcggtgataatggccattatgcagatggtcaccggg

SEQ ID NO: 58669 - DNA, 707 bp, Bovine  19866882136514
tgaaggcagttatcatctctacttctcattatttttttctcccacatgagctaagggcagacctcagcgagcaggaaaaatggttcacagtggcttgtaatatttccatttcttaaggaagaaataaacatggagcaatttgtcacccactaactgtcctattttttcaggtagaatacatgctattttcagcactgaagttaccaacattaactctctattcccaggaagccagtgaatttggtcatgctctgaagcttctgtcaacctcactcctggaaaatgtgacttgctctctcctgtgccctcctaaaatgctctaaattatcacatttctttgtttcagttcatttataccgaggcctgcctttcaagaccttaaaagtctcaagcctggcccatcatagtcaagggagcattcactatggctagcagtgtgcccagaacttggtcgcaagaaaataaatgtttgttgctaaatgaatgctgtcaatacatcataataaagagggttgtcaagatttcttcaatgccttaaactattgggaatctgttactttacaaagttggtttattatttctcctgtcagcttcaggttccaaaaatatggagcacgtgtacaagtgtggaagccactttgtatatatttcccccataaagaagatctatgccagctctctgctgtatttatcggcgactagcatca

SEQ ID NO: 58670 - DNA, 1290 bp, Bovine  19866880437339
attgaaaactccatacaaatgtcatttaccatttgcaagtaagtgtagagttgttcttaagcatgatttcaaaggtaaaagtgcaggaaaagcctatggctggaatgaaagtgaaagcaattctgtgcctatacatactataagagggcatctgtcccctttgggaactaggctatgattgcaaagactccaagttactattataatatttataatagcctagtttgtaatgattttatttggcctgcagaaacagagttatggacagttgtgcgtcaccattaggaaaaaaaaaaaaaaaacaatgaggatggaattgatctcatcaatttccctgtcactaaaaacttagcatactccacgcctgttctttacccatattccttgtcctgggtagaccaatcaaaatgctgcttttactcatggttttgtctaaggaaaattgaaaggcccttggtgagacagaagcatcagcaggtctctagggggctgaagtctagtttgactcaaccacagcagcttgaaccagtgatgggaatttaacccatcagccaatctagtactgagtccaagcttgctctgctggccacgctgcaggccaatgaattggagatgaggtgttgaggcaaggaatatgactttaattagaaagctggcagaatgaaaagatggcagactgatgtctcaaaataaccatcttattggtgtctcagtgccaggttctttcatagaacagagatggggggaggtgatggaataaagtaaaaagcccattactcttgcaagtgtctcttggaagggccatcctggggagggagtgtgttaatttcttccttcctgcagccatctacaggtggatagggtcctgaacaaaggcactttggtttaacatttaggcagaggggtagggttccctgaggtaggttattatgtgcagacagtatccttttagtgaacaaaagcaacggggagcaaaggttaaagtaaagaaacggatccaacatgcagtccattcatcccagtaaaaaaaaaatctattaaaatattaagccagagacaatttgcctcccaatatcaattacctttctctctgcctagaagaatgaacaagatgaatgaataatgcaagaaattccttctagttatgaaggtttccctttccttcttccttatgatggatagaatgtaaacttaacagccaaactgtcagttttaatgtaacctcagcaacagttagaaccagacatggaacaacaaactggtttaaaatgggaaaggagtatcttaagg

SEQ ID NO: 58671 - DNA, 1159 bp, Bovine  19866880785818
acgcctggtgctctctgcacaaatacctttagctctgtaacagacttttcaaacccctgaagattctgatataaaaggtaaaatcagaagacaaaaccatatgcataacaactagtgattaaatgcccaagtttagggtaccactgtgcatgtgtgtttatcataggaggatacaacagagaaaaatgatccattaaattaaagtggctacaaatttggaaaaattctgtacacgcaaaaatgaaaataaacctgtcagaaataatgcatggaccaaagatctgcatgaaaacataatcacacatttttaaagtatacacctcaaagagcacaggttcaaggggagagagagcaacagaggttgtatgatgtgaatgcttattgcctcttcataaccacaaactgtggttcttaacctggaaacatgcatctgattattgtttgcctcagaaaagccataaacatcaggagaaggaaatgatccaaaaaatgtggcgtgttcactctaaggggtaaactggaaataacaatgaactgtgagtattgatttaatgtctactcatcattaaacaagatgcctgtggacttgtaattattggtttagaagggcagcagtgatacatatgaatctctcatactggaaacttaagtttttgcattaacatttgtctcagggaccacagtatctgtacatcatcaatataaagagttatactcagagattgtccacatgtgcactctaaaaaaagactacactgtgttcagagcagtcaagaaatacttaaaaaaagatagcacaaaagaagaggaagatataggctttattatggcaacatggaaaagactgatattctgaaaagttacatgagttagttactttctagaaaacatatctttgacaaaacattatgactagcaatggatttttctaatttgtttttccagtggtcatgtaaggatgtgagagttggactgtgaagaaagctgagcaccgaagaattgatgcttttgaagtgtggtgttggagaagactcttgagagtcccttggactgcaaggagatccaaccagtccattctgaaggagatcagccctgggatttctttggaaggaatgatgttaaagctaaactccagtacttggccacctcatgcgaagag

SEQ ID NO: 58672 - DNA, 1594 bp, Bovine  19866880845984
aatgaaacataccaagttaaatttgctctcatgatgtccattcaaatactaaataaaaggcttcttcaacaagagagatgaaacacctataagtagattgattttaacagtcctgaaacacagaagttgctctacaaagtcacataactcaagtcgttccattacattcctgatggagagtatgaagaactatatcatttcactaaaaaaaaaaatggagtgtcacaggaaattattaacaaactttaagtttcattttaatggtcttatttcatcagcacaagaacctgataaactgtttattcacatggacactctgaccactataatgcaaagaagagcaacagtataataatgagctgacatgaagataaatgattccaattagtttcctcattagttttaactaagattatttctttaatcatgactgatttatctccatttcacttctctagtgcttcaggaaggtgcctgttagactaaagccaggtaaagagagttaatttaaactctaggcagcaaccttctattttcccttgggttgatatgtgactggcactcaaaacaaaaggatccacatactcgtgcctttgctgttattcctataggaagatgatcgataatattaaagggcaaaatccacaaaatataacaatgagtgtgtaatgcacatacatatttcatatgaaaagaacagctaaacattttttaataaatgtctagagaattctggaaaaatcttggattgaatttatgtttctgacttagtcttgctctcagtttcacatttgccataaaaccacagtgagtgctgattgaaaatggggacattcaccaaaagcctaagatccttcctaggtgattggggttgccacgccgggaacaaatataaaactgtattcttagcatttacagaaagttacaggctggcagaacagggaagactttgcctttctttcagtctcatatgacaactaacattttgtgctttcttgatgaagacatagcctacagaaaccagttaagcccctaccgagaaagtctgtgtgtccacgcccagggtttgctccaggaaggaattgtacaggtcctctgcctcatacttcccctgaggcttatgtggtatggcattggtgtgatgaagcacctcaaacttgaacagttaaatgttggaaaagagacaggtgctttcacccagaaatttgagttcacagatgctctctttccatgctcaagtggaagaaaaatggtttgttcatctgattcttaactaactattatgaccaacctagatagcatattcaaaagcagagacattactttgccaacaaatgttcatctagtcaaggctatggtttttcctgtggtcatgtatggatgtgagagttggactgtgaagaaggctgagcgctgaagaattgatgcttttgaactgtggtgttggagaagactcttgagagtcccttggactgcaaggagatccaaccagtccattctgaaggagatcagccctgggatttctttggaaggaatgatgctaaagctgaaactccagtactttggccacctcatgcgaggagttgactcattg

SEQ ID NO: 58673 - DNA, 1174 bp, Bovine  19866881493421
tcacttaggcaattgcaacatatatatcatttttacatattctaaatgaacctaagtatctgtgaaagtcctcctttatcattttattatttcatagaatacagcaaatttaatgttgaaatctagaattcctttaaacgagactcgattattttaaaagaggaaaacttggaataaacttgcaagaacttaacaaagtagttaaaaataagaaaatgatacccattttcaattgcttctcttgaatgttcattaaggaaaatgtcagttaagtggattgctgtgatagtaggtgtcaagcaaataaatgatgaactgaaataatttaacagaattaaccgaaaagtgatcaagcataaaagaaatcctctcaaatatttgttttacatagttctgtgagctgttgaacttttgaatagctttaatgaatcctgtagggtcttgcactcactcatgttatggctgggcataaaaatgtcagtctttttctaaaagttaatgactcagaaatcttttcagatttctctggatagcaaacagttttttctgagtgctaggttttgttggattgtctcctttgcaacctcatttgagtgagaacaggcaattaacaagtatcacgtaaccttaagctttggaggcaccaaatataaggtagcaaaggtggaggattatgctgttttacatgcatgtggtcgagttaagccaggagactctctgattttgcttcctcatcaaaaatgcacttgtgccatgcttccctctcatgattatttcatatttcaagtaagcattcaatatctgacaggtttaattgtgggcattgaggtaacatggaaaataagaaataaaattatctgctttcataagtatatattctaggggaaaagaaattaatgtataaaaagtcataaagacaaaggatacaaaatataacttcaccacacatggtgatcaaggaaaaagtctctaagaaaacgatatatgcaccaagcattaattatgattagagacaaaaacatctttgaatattgcaaatatatttatagacaaaaatacaattaccctattatttatctgagaaatgctgaaagaaaaagaggattcacttaggattcaatcttaagctcgctcaactagaatagactgacagggcactaggtaacagctcaca

SEQ ID NO: 58674 - DNA, 951 bp, Bovine  19866881633961
aatcaaaaagaactggacacgactgaatgactaacactttctttttttttctacttttcttacaattttcccctaagttttatattacatcaaaataaaaatattagcacaaaataaaaaagaagtaaggaagagtaagaaagataggaaggtaggaaagtaggaagcaaggaaggaagcgcctgggttattgtattggttggtagttgacgtactaattacagttaaacttgtagcacagccccaaataactcaactcttacagaaattagaaggattagctcataccctatagaggaaaagggcttgcattctcctaaaatagcaatacattagtctctaacagttctttaaaatacagtgttctgaatataatgaaaaattaacagatacagaataaagtagaaaaatgtaaccttactgaaaagaaaataatagaagtaggccaatagataatccagttactggaaatggcagtaaggtctttaaatcaattattataactatttcaaagcatttagagggatatttcaaaaatatcctttcataaagaatatttcaaaaggagaatcagaacttcaagaaaaggaccaaatatgaatactaatattaaaatattcaatatctgaagattttctgcagatctgccaaagcagtaaaattaactgccatttttcttccatttcttcctgaaataactttcatggagatgcaaatgagtgatttaaatgaacccagaaataacattagaagggagccattgctttgaaagttattcatcacctcatcctttagaactgggaaaactagtcactaaaccctgatccagtcaaccacatgatgaagatgcactaaatttaaatttttttctcatattttgggctctaaataaaaaggacactacttatctcaactctgccacttgcttccgaaacagatggcttcagttat

SEQ ID NO: 58675 - DNA, 1827 bp, Bovine  19866881929138
ttgtttatttatttttatatatagttgtgtatatctgttaatcccaagcccctaatttatcccttccctcctttccttttggtactcatatgttttttgagtttgtgagtctgtttatgctttgtaaccaggttcatttgtattttttagattccacatataagtaatatcatatgattaagaggtgagggtgtgggtgcgggtggatgggttgcgggggaatgagtctatttaaactcttccttagaacaatagtgacaccctgtggtaaattcttattataggctatagtacacagtggatgggtgtgggttccctacttgtctacttgaaggcagaaagtactgtcaaccaaattaatcagacctcaaattaaatgagaatgtactgagtgcctcctatgtacaggaactatgccagtgccttcatagatattatttctttttagtattcatccagatgaccagatgctaaactaattttatatgtatctgtgtctcactgtggggtttcctagctggctaagtggtaaagaatctgcctgccaatgctggagacgtgagtttgatccctgggttgagaagatcccctggtgaaggaaatggacaaccaactccagtcttcttgcctgggaaatcccatggacagaggagcctggcgggctacagtccatggggttgcaaaagagtcagacccaactcagaaatgtactatattcttttccaaagaactttggtgttacttgcccatttaagggcttccctgttagctcagccagtaaagaatccacctgcaatgtgggagaccgaggtgcaatttctgggttgggaagatcccctggagaagagaatggctacccactccagtgttctggcctggagaattccatttaaggtgtgccattgagatccaaattgtcttgggaaaagagtcaaaaaatcaatcaacccaatagaattatcacatgatatctaactcatttttctcacttattttattaagcttctttgtagtattaccatattcaaaatattctcaacccatgttctcaaagttatttaccttttatctttgagttgcctttcatttaaatgaataaaatatgccaaatatacatatttctctagggctaattttaaaagctattatttatcacagaaaagtccaatatttcacatcatgtaatttttaatctttaaaaatgtaggttccagggccatttaaatgtgtttatgggttaatataatttctttataattctccagggcttggcctatagtttttgtgttccttgtatattgcagactttcagatatgtcttattaaaattaatcaacattgtacataaaattttagccaactttttcttttaggtatataaaactctagagcataccaataagtgctgaaagaaaatagagaaataataaagttgatttgttaaagagatagaatttagtaccatattctcccttttgatttttgctgtaacaatgttgcctacataatgtatatttttaatagaaggctatcagtgtaaacacatgtagtatactctattgtttctctgctttctggagtttgtctaatatgagattgctgtaagccctggggagatggagaattaagtgatgagatcagtaggggacatataagcaatcagcaaaagatttttgagtagctgctcactgagcctggcacagtgaggaatacagagtggtagtaaaattatttccctccctcaagacagttaagtacatagaataataacagtcttgattacttttaaagccattatgtaggtcatttgcagataataattatcaa

SEQ ID NO: 58676 - DNA, 989 bp, Bovine  19866880662889
ggtgtctaggcaagatgagaaagcaaattgcttcaaatatgaattgcatgatgactctcatagtgttcctattattttctgaaaattcaggatggctttatgttgagcttgaaccagaaagattctatgtccattctgggtgtaatctgtaagaaatgaactaaaacaggtgaacatgttaaaatgtcatcctttgttttacagcctagccaccacttttctgattgcaaaacaagtccttcagtcgtgtccgttgtttgtcagtagttcttatgattaacttccttatacttagataacttattaaaaagattttaaaataagaggttcaagggcatttttttaatgccttaccttctcttgtctagggagtgcaaggcaaaattcagacttgaatatcatttttctttcttaggaataattgttcattttgtagttgtttataaacgtgatgctcttgcacttcctattagctgatgataattcaagttaagtcagccatatgttaaaactcatacattgatttaatgggagaaatattggtattaacaccaacctcatcttagagatatgagtctttttaaacatatatatttgactaataatgccagaggaaaattagtagaatcagggaatattacacttaaaagaatgagatactggtactactgttcatttgcataaatgtgactgaagggatggtaattatttgtacccctttctactttaagaactagtgtatcttggccttgtcagtgactgtggtcattccactgttactgattacagtctaacctataatcagtaaggtataatcagtacagtaatcagtacctgtaatcaggtactgattgtctttagcatgtcaaatcatcaccaatgtcttaaacatcacccatcattggagaaaggatagtggtaaaattatagaaacatttagtgtggataaagctgctcaattgtatcattagtagaatcagaaatacaga

SEQ ID NO: 58677 - DNA, 1429 bp, Bovine  19866880822117
tattgatatttctcccagcaatcttgattccccttgatcttaatccagcccggcctctcacatgatgtactctgcatataagttaaataaacagggtgacaatatacagccttgacgtacttcttttcctatttggaaccagtctgttgttccacgtccagttctaactgttgcttcctgacctgcatacaggtttctcaagaggcaggtcaggtggtctggtattcccatctctttcagaactttccacagcttattgtgatccacacagtcaaaggctttggcatagtcaataaaggagaaatagatgtttttctggaactctcttgcttttttcatgatccagcagatgttggcaatttgatctctggttcctctgccttttctaaaactagcttgaacaccctgaagttcacagttcacgtattgctgaagcctggcttggagaattttaagcattactttactagcgtgtgctactgctaagtcacttcagtcatgtccgactctatgcgaccccatagacggcagcccaccaggctcctctgtccctaggattttccaggcaagaacactggagtgggttgccatttccttctccaatgcatgaaagtgaaaagtgaaagtgaagtctctcagtcatgcccgactcttagtgaccccatggactggagcctaccaggctcctccgtccatgggattttccaggaacagtactggagtggggtgccattgcaactgttactagtgtcaccctttaatgagtagcaaggtacaggaattctaattttatttgaggttttattcatttagggggaaaaacttctccctgttacttttcagaaatagaaaaactatgtcttatttacttaattgtaacccaatcattttcttttctccatcagcagaatattgctgcctaataaagggtatatctttgaaagaaaaaaagtgatcatatactaataagtaggactagtaaaagtagtgaaagtgaaagtagagtctctcagtcatgtccgactcttttgtgaccccatggactgtagcctacaacactcctctgtccatgggattttccaggcaagagtatcggagtgggttgcctcttccttctccaggagatcttcccaacccattgatcgaacctgggtctcccacattgtaggcagatgctttaacaacaagcaaagttggaaaacacttctttttttttttttcacttgtcttactaggcattaaaaagcagagacattacattgtcaacaaatgtccatctagtcaaggctatggtttttctagtagtcatgtacggatatgagagttggactgtgaagaaagctgagcaccgaagaattggtgcttttgaactgtggtgtggagaagactcttgagtcccttgggctgcaaggagatccaaccagtccat

SEQ ID NO: 58678 - DNA, 608 bp, Bovine  19866880887005
tcgaggactctgaggctcctagggatggcagaccacaaaatgcgaagagtatggggtcctaaatgatttcatagatggcttcccactcatgacctaattggactatgtagaaaatgagaactaaatctttattcagtgtagtctgtgagacattgaaattgtttgttacagcagttagactctcttgacttatctggtgattgtagcctctgatgggccaggatcaatgtaagaacttgagacagggatatgactatctcagaaaaacatttgttcccttttgggagttgtcacaaagaatcttgatcctacaattcaggaattactctgtaggtaatttaactcttcttatcatatgcccattgctctattgaggaagtgacaataacaatctaccaaagcaaaagaactctgacctctcccagagtaaagcttagtagttaggtaaacaaactttcttagtgtcttttatccttctgatgtgtagttagctaattattgctatagactctttcgcagtgctttaatcattcttataaccactaaatggtatcatatatcaactggaaacttgtagcaaaacaagataaagatttaacctctctttt

SEQ ID NO: 58679 - DNA, 986 bp, Bovine  19866880956793
actaattggaaacagagactttatggaagtgagcactcatttaacttgttcacgtgacagttggctttgaattctatttcattaccaatcaatcaaacagtggaaacagtggcagactttattttttggggctccaaaatcactgcagatggtgactgcagccatgaaattaaaagatgcttgctccttggagaagctatgaccaacctagacagcatattaaaaagcagagacattactttgccagcaaaggtctgtctagtcaaggctagacaaggtttttcctctagtcaaaaaacctctagtcaaggtttttccagtagttatgtatggatgtgagacttggactataaagaaagctgagtgccaaagaattgatgcttttgaactgtggtgttggagaagactcttgagaatcctttggactgcaaggagatccagccagtccatcctaaaggagatcagtcctgagtgttcattggaaggagtgatgttgaagctgaaactccaatactttggccacttgatgcaaagaactgactcatttgaaaagactctgaagttgggaaagattaaaggtgggaggagaaggggacgacagagaatgagatggttggatggcatcactgactcaatggaccagagtttgagtaaattccgggagttggtgatggacagggaggcctggcgtgctgcagtccatggggtcgcaaagagtcagacacgactgagtgactgaactgaaccaatcaacctaaattaaaatacccagctcacagcaaaaattggaaaatgatgtcttaaatattaaagcacatactagatgtcagtagcatgaagtttaggacaaagatgaacaaaagcaatgacatgataccagcagctttgagcccctgccatcaacaatggggaacatgatggaatcaccagagtgagtgatgcagtgacttttctaacttatctttacagacttgaagaactgttaa

SEQ ID NO: 58680 - DNA, 858 bp, Bovine  19866880996775
cattctatttagatagtgtgttagtcgctcagttgtgtctaactctttgtgaacccatggactgtagcccactgggctcctctgtccatggaattctccaggcaagaatactggagtgggttgccattcccttctccaggggatcttcccaacccagagatcgaagccgtgtctcctgcattgcaggcagattctttactgtctgagccaccaatagtagtggcatagtaaacacaagactaactggaccagtgcctcaacattctgagaattatgtctttttctgttttgataaaattaaagtcaagggaatttaggcctatgtgatcataagcctttgccctctgtttatccttaactgtagttttcagattggagaaaactgtaagatcctcagaagaatgtaaagttcaattaattatttaactgatccctgttcagacatttattcagtgagcccacacatgtcccaggcattgtgctaagctttggggataccaaggttaattgacctggtccaacctctcgaggaagacacagtttgagaattagtttctatataatacaggagagacaagttgtaccaatataaaattcagagactgggcatgtgctggtgggtaggcagtgcagtgagtagaagaaggaggggttatgtgaacaacctgtgacatctcctatcccagcaaagtcagttgaatgactcagatctgcaatcgagaaaacttgttttggaaaaatattcctctctcttagaggctcctgctccctttaaggagttaatttacatcacctctcagaagtgagagatggacaaaaagcagagtggaactctgaagcaaaatgaaaaagatcaat

SEQ ID NO: 58681 - DNA, 642 bp, Bovine  19866881097106
tactggcatttaaagattatcattccttgaagcttaacttcataagtgctttattttgatgtgtctacttgacctctgcatttctttgattttcacttttacattaaaaaaaaacaaaaaaaaaacttccctggcttatatcatatactattttatgaagtaactgtataactatctagctactgttgtgtaactactgtttgtgaatactgttatatttttattacaatggatagagctgggttcagagacagacttgcaaatatgcatgtaatttctttcttaggattaagtagaaaagatttacaacttcaaatttgtttcaaccatgtctcttcttaggatagcagggtccaaagaggaaagcagggaggacgtagacacagtatgcttcactcatagccccagcacatttcttatttagcttttaattcattctttcaagctatcaacatgtgacactaggcacttactcagtggacagcactctacaaaacagggaattataaggcactcttctaagaaacattgccacaaatagatcaattatgtatttcttccactatgtagtcttatttggaaattgagagaatttttggttaataaagagccttgcttatcaaactgaataccaaagaaaca

SEQ ID NO: 58682 - DNA, 874 bp, Bovine  19866881274813
atgcacacttttaatgccagatctattttggctttacctttaaagaaaaatcactgcactttgctgtatttgtcaaaaatgacaggctaattctttgactcaaaacagtgtacatgaaatgtgatttttgttgcttttctgaaatatagcacagcttgttttttgaaacctcctttgctgtggttaagattcccatggcatagaacaaattgcttattttgaggttgcagaatatagctaatctacaagaataagctttctaatatctgctatcaaaccaagaaatgatgtgttgcgccggaaacatgcacgtataaaagaaattattttcttacacaggatgctgcctcttggactgtgcatagagttgatttgtaatgtaaattaactctccaactattgattgttccatctgactgggacacattaaagctctgcaaagaggttcagagttatcaataataagaatgccgtgtatgaaatgtaatggggtgcgtcagctggatctgagtgtgatattgcaggaaatgttactcaacattaccatgtgtcacctattctttgtgcataatattttaatccattaaaatgtttctttttcttgcttttaaaaaattaacctacttcggttatagcaaaaaccctaagaggtagtgtttgaccactgacctttgcagtgtccttgttttgttttttttttttttttctctctttcctgacttttttttttttttttgtcttggtggcctcattaagatgaagaatgacaatccctagaaatagaacatgccgggctcccaggtgcagtgctaacaagtagtaagtcccattaacttcttaactcctcagacaagaactaaattggccatagata

SEQ ID NO: 58683 - DNA, 928 bp, Bovine  19866881362450
aaaggttggtatacacgatgacatgcttttgttccttcattcaatgatttttatgaaaaattttgtacagatggtagttgctttcaatttgtatttgaccatctttaaaaaagaatcttctgtttattagtcttctatataatgtatatttaaattcacaaagatgttcaactccaaggagtaaaatcattaactctcccttcactacattaaagaacagaaaccaatgcccaaataacatagatctaataaagaagattctgttaaaatgaggccccttagaagtgtgcattaagaaatatttagcaaggattgaaaaccaggcaccatgcctaaaattctgtaacattaagaagaaaacctaagcaacacaaaacttattttgcctaagacatctaagtgactgcaccactgttgttcattccaatataatatgctctgtgctctctgtattaacgatgctgctgctgctaagtcgcttcagtcatggctgactcttagtgaccccatggactgcagcctaccaggctcctccgtccatgggattttccaggcaagagtactggagtggggtgccactgccttctccgtattaacaatgaatgactaatattccatgtagccactaaaagtaattctaaccagatggtcctgtatttctgaagatgtctatatgtattttctctcctggagcaatgctatcaagtatattgatatctctgagaagcagggctgctgaggtaaaccctgtattaagaagatacattataaacaacagaagagctagctcaccattcacatttatgaagaggatgctgtggcttgtccacttacctcttcatctatagccatgtatacaaatagcgatccatcactagagttactctctttaaactgtaaggtagcaatatgtgtttaagaaaaacag

SEQ ID NO: 58684 - DNA, 1463 bp, Bovine  19866881516386
ccatccctgtgattctccggcaagaacactggagtgggttgccatttccttatccaatgcatgaaagtgaaaagtgaaagtgaagtccatcagtcctgtcggactcttagtgatcccatggactgcagcccaccaggctcctccgtccatgggattttccaggcaagagtactggagtggggtgccattgccttctccaaaatgtttactatgtgccaaacattgttgcctggcactctacagaaaatatctcacttgatctttttaacttattttattttttatacagttttaaaggttacactccacttatagttattacaaaatattggctatattcactgtgttttacaatacatccttaagtctatcttatacccagtagttactggtaaccattggtttgagctctgtgtctgtgagatctcacttgatctcggtagtaaccatctgaggtctgaaacattatccctgttttaggcatcagttcagtaggcagttctcagagcctaggactctaaagccagtgttcttccttttctgccatggtaccttttttcttccctaatgttttagccatgcctcatggcatgggggatcttagttccctgagcagggatcaaacctttgccccctgcattgaaagcacagaatcttaaccactgaaccgccagggaagccccgccgtgtcatcttttaagtggctagttttcagcaaaaagaaggtacactgtgtgttatggctcatagtatagtttttaacagataacaaatttttagaaagcagcaatttttaagaaagatcttcctaaaaacaaagaaaaaagaagtgtgctgcttttcctcacttaaaaaatgtatatagttgctataaaatttctttataagggcatttggaaaacttgatacaaagtaattcaaaattataccagcaatttaagtgaaatccaaacatgcagcaagattctctactactttaatgatttcagttaaataaaacctacaagctgataaaaaaattttgaagctgtatttgagtaggtgtgtgatgttggcatgctgaccaattacaacaggaaattaacatagcattacataatatagcacgtaatgaaaacaaggaaaattttgaagtaagccatggaaaaatcataacaaactacaggactaaatggaagcatcaagggggactggtacattgaagtatattaactatgagaacgttttctaatccatcatataacattattaagactgcaccggaatgattacaatgctaaattccatgtgactgctggactattattgagattggaaatttgaaccagatgattaccagtcttttaaagttgaggcaggaggggctgctggtatgagttgtgtagaaagatgaactgaaaacctatcatgtttaacagaagaaaaggaggagttggaagggaatgtaattgttttagaaatag

SEQ ID NO: 58685 - DNA, 1282 bp, Bovine  19866880446439
gacctagagagaaggcacctctctgcattcccgaaaacccctcaaagcttcagagcagaaggctcttctctaggaatgaaatcccaggaaaagcaatctcctgtgatcaggagttgtcagagcctccaagggctaggactattttaagagggggaggctgaggacaggagggcaggcggccagggagagcagcttaagcaggctggaggacacacgtgcagagtcaggtgcagggggcgacgggcagcacaggagtgtctgacacccggctgcacacggcaggagccgtgggctccgggtccttccccaggccacagatctgcccgcgtttctcagcatctggacctcctgctggtgactgtgtgttgagctcactgtgattggtcacggccaaggtcacagccaaggtcacaagcagtccggtctcttcccaggagcgcactgagaccccccgtcccttcctgggagaccccttcctttccccaggcatcggtgagccgcaggaggagggtctccgctccagcaaaccctcctgacattcccacaccaacactgacatcacctcctctcctggccactctctcacggcacataaatcatgaaaacaaacactcggaaagtgtttacgagcattttagcaactcctcctaaaagcacatatgcttcctcgtagtaaaaataccttgggaaacatccttctgttaaattttttaaaatggacaaatcttacacggctttttttttttgcaggactaaactacagttgagtggctgaataatagctggaggaggatctaacacccaaccacagtgtaactctaaaaacactccactgagactctgatggtacttcattaacagttaaaagaaagagaacagttactttctttggataaaagtacatattccaaaggaaatcctggaacaaagtcccttcaactgctgaagatgacattacagacttttctgttataattgcaatgaatttggacagcaaatttctcttctgctcaataaaaagacttcagttaaaaaaaaaaaaagtttccttccaaaaatagaccaagccctcagttctattttcccatcttacattcttttcctactaaatgtaccctgaaacatttcctttcattgttggcaccttgggttgttgggatttaaaatcggacaatacacagcaacaaagaagtctttaaataaagctttccaaatggaaaaaggcatctaagggtatgccttcccctgggcccagaggatggagccctgatgcctgggagca

SEQ ID NO: 58686 - DNA, 3121 bp, Bovine  19866880533191
cttccatgtccctcaccatctcccggagtttgcccaagttcacgtccattgaatcagtgatgccgcccaaccatctcatcttctgctgccctcttctcctcctgctctcaggcttctcaggcagtatcttctgctcgggagagctgtccgtttcactgctgcgctcagccttggagccgggcatgctgctccagccttactttgccagcttatcctccctgccttgcctcaccccagtcacacccccacaagccacccgcttatcactaaagcctgtgtcaatcttgttacaggacataggggagaaagatgtctcagagatttcaactgcgggcctggactttgctgcgctcatcattatcggaccaaaatctgtaaaccggtgctcctggagggacacgtctgctccaggaggggtcacaacaacaacactcatgttgtggatatcttccagcgctgtcactgtgcgcccgggctagtgtgtcagagtcaggcggctcaagatccagtacacacacagttgcacgtgtgccagaaggcctaacggctgcaggtctaatccagcagaagtctcaggcatgcgctcacacatcttcccatctacacatcttaaaatccaatcttgtagtcagtgaaacaaactgagctggagaagctgtcttgtgatgaatagaaactagtttggctttttgtttccgcagaaaagtggacatgattctagaacaaatttaggttcatctagtgattcagttagttcaaataaatcttttaagtactttctggtgaagttctgatacctgacgggaattgggcggggaggcagagtgacagtttatctgttgttaaattagcttaccagggaaattttccttaaaacccctactgttcataatccttcatttcttggaagggaaatgccgtctcgctacaacaacagaaacttggttaataaagacataagattgaaaagctaatagcctatgttggtataacccactgcaagttccaaagcacctttccattactttgttctcaatagccttactacttaagaacttttcatatttctgtattgatataatttctgtatttcaaagcttgggctttcaaggagtgcctgaccatctgtactcaaaagttacaatggaggaaaacaaggggaaaaaagtgaaatcttgtctatttgaagtttaaatggtcatatttgatacaaatgggtgcatgttggaaaagaccctgatgcagggaaagattaaaggcaggagaagggggtgacagaggacgagatggttggatggcgtcaccgacgaaatggacgtgagtttgcgcaagctccgggaaacagtgaaggacggggcagcctggtgcgctgccgtccacgggtctcagagagtcggacacgactgagtgaccggaatgaacttaattagggaagttctttctggtggattacaatcaattgctacagatttcatttaagagataaaccacacatctgttctttagtttataagtatttataacaaaatcaaatatgggtcaagcaaagaaaaaagttaaatttatgaagttctctaatctctaaaaaagcctgaaccctcttccagaggctggcccctgggtgcaccttaactaatttataatcagtaaacaggaggaaaggtaatgaggtaatgtagtttataacataagggcaggaaatgagaaaataaaaatccccatttaagatttgttatcatctcatctcttaattctctctactgacccttagtaaagtgcagtcatgaacagaatatataaatttaaacgtttgctaataaagtaagaactagatcacagctgataatcatacaagaggttttattgactatagtgcaggctacggcatgaagaagaaatagttacttaaaaacaccacagacccttacatagcaaagcttaagaaataaattaagactctgattgggctgtgccggggaggatgggcctcactcgcttcggtccttgggctcacggtatttccactggatgtagtcgaagatgtccttctcactgtccacgggcaggggctccccggcaacgcctgcaaggagggacaaaagaccttcctcgtgagctagttctggagctcagttacagaggggtcaggatggagagctcaataggacttgctttcagagggaaaagaaaatagtccataagggacttaaaaagacctccctcaagagcttctggtcatgctttgccacacacgttatcaccagcgctacacgacgaacctgaatacctcaactctggccctttgaagtgaccctaatccatggctctcctctctgctggatctccactgtgccagagaaaagaccccattgagctcctctgtaactcagcacagcccctggactagcagtgcagcagtccgcaaagcccactgaagtgaaacctgcatttagggagggtcccacgtggtctgtacacccactgacacgtgagaagcacggccctactttacagttttaggacaaaaagacgaaatcttcactctcctagtagatcacagtagaccacataataaatatactgtgaaatgttaacaagatccataaaacagactaagcaattcttactctttaaactttgaaagtttggagtcaaagctaccaagtttggcctgacacggaaaggagtaacaccctgagtttttcagaaatcttggaggtacatttaagaaaacaaaaatcctttagatcaataagagttttttctttttttactaaccatggaagtagaaagaatttaatccattctaacacagaaatcttgtcaactagagctgagggcctgggaacacctatggagcaaagctttctttgttgcctgagggactaacaattctaaagaatctacaattaactaccatggttacttaaaggctcttagaaaaaccaaagttgctaaaccaaaatatccagatgactgggattatctccgatgcagacacaaatactcaccagtgacacccaggggacggattgtgtattcattgattgtgaagcctttttctagggcatgagctctcatattcttattaaaacatcactcccagtaaatagaggacacc

SEQ ID NO: 58687 - DNA, 2410 bp, Bovine  19866880565726
tttgcatgtattgaggcttcctgggtccaggcccagttctgagggtttgatctgaattatttccatttgatcctcactgcatttccatggggagggtgccattacattatactcacttaacaaagtgagtatagggaagcatgtggaagctcatgaagtttaggtccttattcaaagtcataaagctccagatttcaacttgggcttcagttattttacattgttttactatcccacattcttccagataggattggaggttggcattgtcaacagtggtaaatcatagaagatacttttataaggagaaacgatgctagcggaggaagggtgattcaggctccactaaaccctgtcaccacgggagccaatacatctagggctagtcttgtgtcagaggctaatttactttagactgttaactataaactagggtaatgttttactggattacccctgcttgggtcattcatcactcctccctttctcacacctgtccaataagaacttagtctcctcaaatttgtcctccttctctgctctcatcgctgttccccttatcaggtcctcatcatttcttgctggatatggaagtaggatattcagtaaggacatgggaaactagaatcctgtgcattgctggtgagaatgcaaaatggtatagctgctgtgaaaaatggtctgatggttcctgaggaagttaaaattagaattaccatttgattcagcaattttacttctaggtacataccctccagggatcccccagtggctccgccgactcaacacttcttcgtctgtctgtctgttttttctctacactgtcaccagaatcctgttgctttcacttcctaaatgtcttcctttcagtttcttctctgttccagctcagaccctatcatggggagtgtggccatctaacctgtctccctgtctcttgacctcactctacttcaacccaccctccacataccaattgaaagatatcaattctttgcataaaattatttactgccttttggcgcatcaaaggatattatcaaaaaaagtgaaaaggcaactcacagaatgaggggaaatatttgtaaaccacatatctgacaagcatttaacattgcatatagataacattgcatagattctatatgcaattgcatatggaattcataaagagctcctataaccctacaacaaaaaaagcaaataactcaattaaaaaataggcaaaggatttgaatgacatttctccaaagattatatgcaagtagcccacaagcacaggaaaagatgctcacctaaggatcaccaatccttagggaaaagcaactcaaaatcacagtgagatactgcttcacacccttcaggatggctattatcaaaaaacaaaaacaaaggggaagatatggggaaactcaaattgctgttgagaatgtaaattgtatagctgctgtgaaaaatagtctgatgggtcctgaaaaagttcaacatagaattaccatatgatccagaaatttgggtcttcccaggtggtacctagtgggtaaagaatccacctgccaatgcaggagacgcaaaagatatgagtctcttcttccctgggtcagaaagatcccctggagaaaggaaatggcaatccactccagtattcttgcctgggaaattccatggatagaggagcctggcaggctacagtccatagagttgcaaaagtcagacacaacatagcaactaaaaaacagcaacaacataccccacagattaaaagcaggaactgaacaaacacttgcatatggatgtttagagtagcatcttcacaatagtcaaaagggggaaagggcagtgcaagtcctcaattttgtgtccgactctttgatgaccccatggactatacagtccatagaattctccagatcataatactggagtgggtagcctttcccttctccaagggatcttcccaacctgggactcaagcccaggtctcccacactgaaggcagattctttaccagctgagataccagggaagcccaagaatactgcagtgagtagctgatgctttcttcagcagatcttctcaacccaggaattgaactggggtctcctgcattgcaggcgattctttaccagctgagccacagggaagcccaatttataaaatggacttgtataaatgatgttttctggacaccaacattaccgtttgtctacagatcggacaactgatggccccaagccacgaaccgtatctccagtatgcaacaatgcaggtacctaatgggaagaaaacatcaatactgatgttgttaagtccatatatcccaagaaagtttcatatatttgaaatattttaacaacatcatctactttagaatgttttttcttcatccaaccaactcttcaggcaaatt

SEQ ID NO: 58688 - DNA, 3160 bp, Bovine  19866880586297
tctgggctgcatctccacaaccgtaaagtggcatgactccccggaagtcctacttcggagggttcagggcatgactatctgtagcgggcctggtgcagtaactggcactcagatgctctatcccaggccatcctcacgtaaacctcaggacccagcacaccacacggcccttcctcggtggcgctcagcagaagtttgtgtaatacaatggttgttgttgttattcataagtttcggtcgtgtcctactcttctcgaccccacggactgtagcacgccaggcttccccatccctcaccatctcccggagcttgcccaagttcatgtccattgaatcggtgatgccatcccaccatctcatcttctgtcgccctcttctccttctgccttcaatgtaatcctaggcaccaaagaaaaatccacccccccaccaattgttatttctaggtctcccaaaggccagagcgactttgaggacataaatactagagtctccctggaagatgacctggggtatttccagatctgcagaagctgcttgcggatagcaatcagggttcctcagccaggatgcccagtggctgcgctcaccgccctcaggctgatctcagtccttgcggcttagagattatggagcagtcggaagtggatgccagagaggagcagaggggagaggaaggtttcagaagtgtttctgctgaaaaggaattgatgcttttgaactgtggtgttggagaagacttgtgagagtcccttggattgcaaggagatccaaccagtccatcctaaaggagatcagtcctgaatgttcaatggaaggactgatgctgaagctgaagctccattactttggccacctgatggcaagagccaactcattggaaaagaccctgattctgggaaagattgaagacaggaggagaaggggacgacagaggatgagatggttggatggcatcactgactcgatggacgtgagtttgggtaaactcaaatggtgaaggacagggaggcctggtgtgctgcggtccatggggtcgcaaagagtcggacacgactgagcaactgaacagcaacagtaggtcagggcccctgagttcccagacgcagatggcagagcactgcagagcccactccccacgctgggagcctggcccctcacgtgaggacgccctcacatgctttccttcccctggacgcccctgccaaggactgtgggccaacagacaacccgagctggtcctcctcatgcctcagggagctcctggcccaaaggaagggtgggattagggagtatcgactgagctcagaggaaattaaaattctagaaaagaaattccacccccacccccaccccggttcagcaaggagggagatgccacccccgtggatgattcccagcccgggcagtggggtgcaggctggtgtgtaggagctgacacctgtgccctccagtgacagctgctgtagttcacgtcaaagacagcactgtgatttatattcacttccacttcggaaagcgaagttttgttatggctcccgtgtcaaagccagtttgatttccatacattctgcttctcttaaaagaaaatcaaaggaactgaaacgagcaggtctttggcagcatctcacaggaaatgttcaataagtgaaagatgagaggggcaggttgatgaggggagacaaagattgcaggatccatgtaatcactgcagccgtgtaaacactgaggtcaggaggggaccgccgaaggaactgggtctaccagatgtcttgcccctttgggtggttccacttctggaaatggcctggatgcagtcaggaagacggagtctggcctatcaccgatcttgtggccttggctgggtcacgggcctctcagcctcagctccttgtggcctggagaccaggttttggggaatttgcaggtagatgatgggggagatgactgtgatgtcacacaccctgggggcaccacttggacccgacctgtgtctatgtgagtggtcccccttcgaagttgtgcagtcagatggtgttaggacctccctttcctgcagcaacagcctcagccctcctgacgccacagcagacatgtagctgagaacggcaccaggggcccctagcttgcttaatcaaggttgtgctctgccttctttgggcaaaagaaatttgatgatgttgagtgtgatgcatagatcctaactgccttgtctgccctaccccattcctgggcacacaccatacttctgtgtaatgaaaatcccatggaccaggtgcttgcattcaagctgaggtctgaggtcagagtccccatgtgctcaggttctgtgtcaccttctccacacatgtgaaggaggggccaaggagctctgcagggggctctttcacgagggcgctgatcccattcacgaaggccccacctccagaccaagcgcctcgggaggttcccacatctaataccatcacactgggagttaagatagcaacacgtgaatctgggcacacgagcattcagaccacagcattgctctttctcctctgcatcctgacacacgtgttacacaagacacggacatgggggtagtgacagcagatgctgctgtgaaaaggcaaggaaagatgtttaaaaagctgcccaggtctcaatacacgttagctggaaacagcgtcgcttatcttcggtcatggcaggagtcaggcgctgggacgaggccttggcactaagttgactcagggaactgatggccttttgctgatgccactgagggtcccggcagcctgcactcatcagtgcaggagacttgggtggtttccttttcaactgaaaatacacttatggatcacaagtccctttcagcctctttgttctggcaaggcctttttgcacagtccactttgctttattcttattgttcactaagtagttgtcaactctttgcaaccccgtggactgtagcctactgggctcctatgtccatgggattctccaggcaagaataatggagtgggttgccattgccttctccagggcatcttcccaacccagggatcaaactgaagtgttctgctacgcagacagattgtttactactgaaccagctagttagtcctttattcactgtactgactgtaatttaatagtaaatacactgcaggga

SEQ ID NO: 58689 - DNA, 2642 bp, Bovine  19866880703586
aaatggcaacccactccagtattcttgtccaggaaacctcatggacagaggagcctggtgggctacagtccgtggggctgcaaagagtcagacaggactgagtgactgaacaacatgtatgcaattaggcagagtatacttacaaatggagtacatttctagctgctgtcttaaacgaattttgcttattgtgtcataaaagttgggctctgacagagtttctgctggaggtggcaaactgaatatcctcataattttccttttattcctaaaacacaaaaacgatgcagagaagagatttgtattctcagctataggactgtaacactctcgtgactgtagtaaccagaagccgcattaaaaggacacaagtggccacgagtccctcttcagttctgtccccgtgagatgctgccttggctcaagtattctctctttcactaaaagtaagaagttgcacatgtatagtcacagagttacaagaaaggaaaagcagtgactgaatacacccacttcatacgacatgtctctcctcatctccacaaaaaatgccctattgtttagaaaaatgcacagacaaaaaaagtacgattcttttcctccctgtcatgtcatgcaaataaagctaatttactgggggtagtgaataaacagaatgtgagcagaccttaattctgggaaacaatgaataaaactatttcttaaatagagtagcatggccttagtggggtcatctagttaaaatgaacaacagcctgtctatgcttttaaaacagtggggtggggaggaggcggcagctctctttaggggaccgctgtcgcctgccagtggccctggggtgatccgtgggggctcttctcgcccctccccccagcctggagtccaggaggccagcggctcagggttcacggggctgtgaagggcgagcctgcatgtcccacaggcagggtgaatctgaactatttcccaggccaggcagcaattattcttggatgactaattatcccggactgtctaaagcctctgaccttggtacaggacgtcacaaagcatgtggctatgagcagaagcaactcaatccaactactgctttcttcctcttcaaagcaatacctccctccctttttgttcactgttcttaaaggagccagggagtgtggaaaaggacagttaaactgtgcgacagtcagcaggaagtatttgtggaggatttacactaatgcgccacttcagggacacaaaggttaaataaaagcccctgttctcgggggactgagtgtttgcaggatggacagacaagaaatcgaaccatataacatcattcactaagttctgggacacagtcatgcgtaagaaacagaagggaaagcttgaaatgtgcgaggacagaagtgctgaacatgtaggagttggtgtttgtgcatttcagggacgtgggccaaaaatatgtgctcgtccgagggtgacagtgaactggctgagtgataactctgagctatatcagaagtgatagaatgggagtacagagcagctggcctgggagccgagagctgcactcacagcccggctctcagagcagctgggttttgcaagccaagtcctggtgtctggtgtttgagggcagggccgaggagagagagctttcatagtaggaaccaaaatgctggtgaaatcatttttgtgcattaaatttagatcaaaccaaccaacctgcaaaactcgcaaatgctcaggatcttctcatcaaccctgagaacctcaagcctttacctcttggcatacatgaagagcccgaagctgacgagtatcaccaccaggtacacgttggtggcttcattccaggcctcgtggacgctgtagtccatggccccgtcgtcccccatcactccgtagcccccaggcatgggcctgtaagacaataaagggggcaggtgacagtgtgaaggccggacaaatgcgggcgaacagagggcccgcaggccagcggcagcccctggtctccctgtggcccaggagccaaaactggttttacatttccaatggatacattttaaacagttgagagtactaccagtatcttccatttttgcctcacagccctcaaagcctcaaatatatacaatctggcctgttaagatttacaaaacagaaaacagactcacagacttagaaaacaaacttatggttaccaaaggggaaaggggaggtgatggggagggataaattaggagtttgggattgatacatatgcaccacttatatatcaaataatcaacaaagatctactgtgtagcactgggaactcgaatcaacattgtaataaactatatcggaaaacaatctgaaaaacaatggctatatgtacacatataactgagtcactttgctgcatacctgacactaacacaatattgtaaaccaccaatcatacctcaatatattaattaataaaataaaaaattaagttaaaaaaaggcaagaaaaagttgaccaaccctgatctagatcactaaggcacagaacgcatttccccttatttctgactttgaaacatcacagatcctacataaaagttcaaacttggagattaaaaaaatatttctaaaaggatatgggtgaaatatcactgcacattttccaa

SEQ ID NO: 58690 - DNA, 929 bp, Bovine  19866880914166
agtatgctagttgttcatacccagcatcccagaaatacatgcaaatcatgacatcagactacttactgttctttgtgtaagtgttaaacaagccgtctcttctcctaagcgtggagtggtgggccagtgttgagtaaaataattaggataaaacctcaaacatccccctgcacaatatccaaaagagtctctctgagattatttacgaaaagtaatctctttcaaaatttaactaatcctggccactgaagaaaaggacaaatcagtcaaatttaaattatgattctttagaatgtgttggacaattctgagacacactgagaaaaaagtattaaaaatagccaagagaaggcagcagctaaaacacaaaggccagaggtgagatcaaaattagaaacgtacaatgtctggagggctgtccatataagggtatctttaaatcagtaataagttgggaccatccactgggcaaaataaacagctgccatcatcgaagtggctgactccatctctcattcagaaatctctagaccatctcagaagacaaatatgacatgactttatgctcaacggtgtttggggctattctcaaagctggtctcgactttcccagtcccacatgagaaacacatatacatgcatctttccttttgacaaaagtatgaaaacgcaacagtagaggggatttccctggccttccagtgactgagacttcaccttccacgagcatgatgcgggttcgatccctggtctggggactgggatgccacgtgcttcccagccgaaaaaaaaaaaaccaaacccgaaaccataaaacagaggcagtgttgtagcaaattcaaagcaatattagaggataaaacgtctgctaagccttcctcaccccatctgctagactatatttactacactccccaaccccataattt

SEQ ID NO: 58691 - DNA, 901 bp, Bovine  19866880996676
gtagcttcccaaaccagggatcgaacccaggtctcccgcattgcaggcagattctttactgtctaagccaccaggaaagccctggtggtctagtggttaagaatctgcctgccaaatgcaggggacacaggattgaccctggtctgggaagatcccacatatcgaggggaaactaagcccatgaatctactgaagcagcgctctggaggctgtgcgccacaagagaagtcactgcaaagagaagcctgcgagccacaaccagtgagtagccccactcaatacaattagagaaaagtccgagcagcagtgaagacccagtgcagccaaaaaaaaaaaaaatcagtgttgtacacctaaaactggtattaccaatatgtcacgtcagtatacttcagtaaaaaaaaaagagtgtaaccccatgttgcttttcatatttttgcctcttccatgagaagcaactgtgatagcaaaccccacactgggcatctacccccagcccctgcccggccgccaggccttttcggcctgctccctccaagcctgctaactctcaggagtcaagaggatccctgggttttggcttgtatcctttcacctcaacttcaccaccctcttccaggcttcgtgtttttctaggccagagttcactccagatattttcataagcagatcaggttttgcagggagtattaaaagcatcagctgggggagagatcgccttcagaaacagttgttgaaaagctcacgaagggctgcaggggaacaaaggggcgggctgataaacaggcgcgtcattaatcccaaacgttaattctggaaatctggttgcttggcagcagcagcgccttcaaacagacccctggcattttctccaaaaatatctgtgctacagaggctcatg

SEQ ID NO: 58692 - DNA, 866 bp, Bovine  19866881007147
gatacacctgagcatctcaataaagaggattccccgactgctgcaaccagaggcagtctgagcacagcagccaagactcagtgcagtacattaagacgtaacagaagtatctgctgtagggaccaatcgataacctctggataagaaccaagtttcagaggtgaaaaaccaaacaccgtggaaacaagtcagtggactctgatgagccagtgtgactctggggaattcagctgcaaacaacgtcaagaaaccaggccaaccttcttacctgtctcttatacgtctcgagttgactccgagccgcgttggcttttcgcagctcctcctctagactgactgtgttctgcatatacatagtattcttttcttctaagagcttaacttgccgcctcaaatcacctagatcttctagcttcttcttatatgattctacttggccttctagtttagaaactttatcagaagaatgtctagaacgagatgggaaaccaggaatcacaaacacacccacagttgaaagctgctgtagacagggataaaccaagaagatcgccaggaagtaacacattctaatgaaatgacgagaccaaaggtcgagtccagcttagttttttgggcaggttcaaaagtatgaccaaagtgacagcaaaatttgtaatgaagaacattacataaaatttaaggaatgcacgcaggagcaggtactcacagagctccatgcagcacaaaagcaaaatatactgtacagtgtccaaataatttggcaactggatgttattagtgaccagaggaacagctgtttcagaggagcagttgggggggggggggcggtggcaaactctagtgggttaaggagagaatgtaaa

SEQ ID NO: 58693 - DNA, 1349 bp, Bovine  19866881253862
tgacgtgtgaaccagctcgactgcccttcagaaccggaagcttgtaacttgtgtatttttctcagaatgtggcgtttgaagctttaaatttgaaaaatggcgatgtttttcttttttacatattttacatatgggttgttgcccagcccacaaacttcccccatttttctggaaaaggaaacgataacaaaacagaccttgataattgttgtttaaaaactaccaaagtataatgaaaactcccctatagagaaagaataaagcggtcctctatcttttagttttttccttaattgtactctctctgtcttctctaatttctggaagatacctccaacttccagttcttctatagtattttttattttgatttaaatcctttcctagagttttctttttctgtagcattctgtccttgtatcatggataaatatctgtaatctgagaagattactgatagcttttgtgtgtgttttcgtctccctgaataatcattgtttcttccaagttgcttttttctgtttgttctggtctgtctttcgtgctttccttgattattttcctgtttagagtcacaaaaagccagatgaaccatcatctgctgtttcctttggttctttagtaatcgtgaaggattacagtacaaagcgggtgataatatgtagagcacagagaagttaagttacaggttttcacagttctaaaaccacctccgtttaaagcgaaagtaacttcacacttaacaatatttgattagaattaagcctgaagtgtttttaaaaaatcttttaaacattattttaaatatccattttagggtgtttgccagcttcccagtaaaaacgatgaaaaggaatatccacacaggagaattgatatcaggtattgctcaaaatttgttgctcacctattaacttctttcttttctcctttccccccctccctctctatatcttggaatttgcataaatacccaggatcccttttcattctgcagtcccatgctactgctaagtcatttcagtcatgtccaactctttgtggccctgtggactgtagcctgccaggcttctctgtccaggggattctccaggcaagaatactggagtgggttgccgtttccttctccaggggatcttccggaccccgtttcttacttcccctgcattggcaggtggattcttcaccactagcaccccctgggaagcccctgaagtgccattcttgcaatagacagtttggcctgaaagtatgtaaagagtaacactatccacagaatctgctttatcatctctggatttgcctcttgataaggtgccttccacagcatgaggtggatcctgctgggg

SEQ ID NO: 58694 - DNA, 1387 bp, Bovine  19866881296468
ctttgcttatgtcccaggtctttctagcagtaactagtaccaccgggaaaattctgctcataagtatataaatgaagaagaagaaaaaattgtaatgcttaccctaatggaaacagcttggtacccgtgcaacaaaatacagacaccagtgacacaaatgatccataaaccagtccaagtatatataaatatttataatatgataaaagtggcattttctaatccaatagggaaaggttatttgttaaatagtttgggaatgattggtaggtgttttgataggaaaagttagattcctgctctgtatcatatacccaaatggtttccagagaaattgaaaactttaatgttaaaaaaatgaaaccctataaatactaacagaaaataacgaattagaagaaaaaaattctaattgtgcattagaagcaaaaactatgaagggtgagattcattagttgaattggataaaaactaggagtcttatgctttaaatacataaacaaaattaaaataaccagtgataaatatttgtgacgtgagagagaatcctgtaaatccaaaggaaaggtgtatgtgttaagcaaaacagattcgtacatggaattccccagcagcccagtggttaggactctgcgcttttatggcagaggggctgagttcagtcccacaagccgtgaggtacggccaaaaaagcagcaatagattaaaataaattaggaaccatattatccatatttgagaggtgaaaagatctatgaaaagaagtcaggcttggaagttacactccataaatgttaacagtaggtacctgcctagagtaatgcatgatttttatcttctttgtttttctgcatttttttaaatttctaaagggagtatgttcatttcctaattaaaaataaaacttaatagctgatatattttgaaaaatagcacttggtgtctacctttctgagtagaggatggcagttgttgtctttcttcaagtcttagaacagcagaatctgtttccaggatagttaaaacttggaaatacggcatatggtcacaaaagtgggagacaagttcaagaagaacatattgtcattgtttttaacttactttttgctgttctaagaagaattattagacagtagagctttctgggtctgtttcgttttgatgacaggcttgaagcagccaaagatgactatcgaatacgctgtgaagagctggagaaggagatctctgaacttcggcagcagaacgatgagctgaccactctggcagacgatgctcagtctctgaaggatgaaatagatgttcttaggtaacccagccccccatccctgtgggatctcagacccgccaggcccccggggttcacctccctggaaccatttctcat

SEQ ID NO: 58695 - DNA, 866 bp, Bovine  19866881364000
ccgtctcgcgatggtcacatggggcgtgagaagcgtgtgtgcttttcggtccccatgtgcgccggtaagctggcggtgggcctcatgcacgtgcacgcacacacgtgggatgcgaagctggtgctgggcctcgcacacgtgcgcaggtgcacacacacacccccgccccctcagcgtcctggcccagcggctggagaagtggctgcagctgatgctgatgtggcacccgcgccagaggggcaccgaccccttctacgggcccaacggctgcttcaaggccctggacgacatcttgaacttgaaggtgagcctgcgcccagtctgccccaggccatgggccccctgacccctgtgagggtgtgatgggacccttgctgactgatgggtcgtgaggccgttgccggggacccacaggaagggaaagattctggcgtgcggaccccaagcggggcctctgagaagccgggccagcaggaaggcgtccccgttgagccgtgtctcctgtgaccctcccgtgaccccccgggtttttgcagctgcttcatgtcctgaacatggtcacgggcaccctgcacacctaccccgtgaccgaggacgagagcctgcagagcctgaaggcccgcatccgccaggacacaggcatcctcgaggaggaccaggagctgctgcaggaggcagggctggccctgatccccgacaagcctgccgcccagtgcctctcggacggcaaggtgagcccggcctcctgcaggcggcaggtggcccgtctgccacaccactgggcaggcgcctgcccgttccgaggtgggaacgcgagatcccgcgggcttggtaggagacacggatcgccccacgctttagctgta

SEQ ID NO: 58696 - DNA, 1581 bp, Bovine  19866881408525
aaacataatttttcttttgaaaactatccttgtcgctacaaaatatagccagattaagactaatttgcttgcaaaatgagtccagtttcaataaacttaacctgattatatatataagtataattgaccatatatgcttaaaactcagaatttgggggttccatcaagatcatggcaaatagaaagggaaaagtggaaacagtgacaggttttattttggggggctctaaaatcacttcagacagtgactgcagccatgaaattaaaagatgctttctccttggaagaaaagctatgaccaacatagacagcatattaaaaagcagagacatcactttgccaacaaaggcccatatagtcaaagctatggtttttccagtagtcatgtacatatttgagagttggaccacaaagaaggctgagtgccaaagaattgatgcttttgaactgtggtgctggagaagactcttcagagtcccttggactgcaaggaggtcaaaccagtcagtcctaaaggaaatcagtcctgaatagtcattggaaggactgatgctgaagctgaaactccagtactttgaccaccagatgctaagagctgactcattggaaaagacccagatactgggaaaaattgaaggcaaaaggagaagtgggtaggagacgatgagatggttaaatagcatcacggacttcagtggacatgagtttgagcaaactcgaggagatagtaaagaacaggggagcctggtgtgcctcagtccatggggtcacaaagagtcaaacatgacttagctactgaacaacaacaaacgctcttttaaattggttttgctagaacttttcataaggattctcaggtttgaactataaaaggtttctcaaggccaggaaagtcatgctaaggactggccatcagattctgtttgagatacctataaatttgggtgaataactctcttcttgaggatccaaaatgtcttgaggttcttgaacctgctgggaaatggcttgaattattcacctgataaggttacaaggtaccagactatttttttcaagaagttaatggctccataaagtcagtcttagttccttaatgctgtcttgtcttatctgagtctatgcacatctctcaattataacattccaatcaaagccttgagagtataaccaatgtttccaattgtgtgctgttgtaaggagaataggttcttactgaatttatgcaaataacagtattgccatgaaaataagaatactcactaagagtttccaaattctggagggatcaagtagagagaaaagataaatgtttcagttctgcttacaaagatataattcatcagattgctgtaaatcacagttagcttaaggggaaaggtttctttacatctggaaagcaaagattaaaattcagtaatatttcagacaaaaagccacacttgttaatcttgatacttcataggtttgatgccatcaagttttccattagaattcttttaattttttacccagttcagcaatataatctaaacattttcagaaacctgtacttatcagaaagccctttctatgagtctt

SEQ ID NO: 58697 - DNA, 1045 bp, Bovine  19866881520083
aatggaatactatcgggcctttaaaaggaaggaaattctgatacaggctgcaacacggatggatcttgagaaaactgtgtcgagagaagtaagccagtcacaacaagacggataaagctctaccgttctgcctcagacagagaactggaacggtggttgccagggctgggatgggggtaacgggtggggagttatagattaatgggaagagtttccattttgcaagattaagagttctggaggcaggcagtggtggcggctgcacagcagcgggaatgtgcttaacacaaccaaactcacacttaaaaatggtcacgatggcaaatttatgttgtgtgtatctcgccacaagtttttttaaagcccacagctcaagagtcatgtccctcttctgaagtctggagtcgcacctgccagatctccacgcatcaccctgaatgtagggggtgacacctggaaccttgttggaaactgagatcttatgggaaccatgaaaaattggttccactccagacctcctgaaccagaaactccagccctggaattatcactgcaacacgtttgtcagatgactctaatgtccctcaaatatgagaactattgcccaagagtgatagatgtagggcaattggaagggatatgtttgaggtgtcttgaaggtagaaaaatatgacttggtgtggaatggacacggggcagagaaggcagaggctggatagatctgaatgaatgaatgtcttttaaaactattctgctcttactttttcttccttttactagagtcagaaagaaaaaataaaagcatgctttctcaaagcatcaggttggagaacaggaaacaggctaggatggttgatgtataatctttagaaatccacaggaggtaagctttatccaaatgtgtacttagctgcacacacggcaattatgaggcaggtgagtggctgagtcatatatttgcttaccaacaggcccgggtgacgtcacacacaaaacccacgctcacagcacacggtggagagctctgagcaggccctaagttctt

SEQ ID NO: 58698 - DNA, 706 bp, Bovine  19866881712274
atactgatctattcctttcaagaagtcagtgacaagaaaagaaattaaaagatttaaaaggcacagctctatgggttgaatcctactttggacaagcaacttcttaagttaggctattcttgagataggtaaacttcaatatgaaattaatgattcttttaagtatgatcatagcattttagaacttttttaatgtaagaaaagatttctttaagatgcatactgaaaattacatgtgcacacaccgagttggaaatattgggaggggctgagcaagaatacaaatttgtcctcattttagacaaataaccaaactctgtggtttgagttaattaatcaacaaatattaattaaaccatgaccacatactcaactctattagaagccactggggatggaacagagggtatgctgtagtttagctgaggaaataaaattcacagaataaagcaatagagaacaattatgttctaagctgtatatcagaggctgaaaactccacagactctcagagtcaggagctgggggagggagggctgtgtgttctgtgatgacgtcatgaggagggggtgtgagcagagtgctgaaggatgagagtaactgagggctctctgtgcgctcacctgggtatgcccgcatgtgtgccctgcatgctcacacacatgaacgtgtgagatagaaagctcgacaggtcttcaaacgtcca

SEQ ID NO: 58699 - DNA, 2471 bp, Bovine  19866880625636
ttgtgtctgactctttacaaccccatgggactgtagcctaccaggctcctccatccatgggattttccaggcaagagtattggagtgggttgccatttccttctccaggggatcttcctgacctagggatcaaacctgggtctcctgcattgcagcagactcttgaacatctgagccccaacaaagctagcttgtcaagtcatgatcaggaatgacgttttggtatagtgtcacttcagttcagtcgctcagtcgtgtccgactctttgcaactctatgtgcagcccgccaggctttcctgtccatcaccaactcccggatgtaaatgaagcaaaaccctgatgatactgccatctcttttactttaacattcattctattgggttggtcaaaaagttggtttgtggttgtccacaaacccgaatgaactttatggccaacacaatatactcacgtactcttggcacttcctctccaacacgaacttccatcatgctcctcctcttcagaatctcgctgtgccttcgggcactcctgatttatgataaactcctccagaacttgagtttcttctctgaaccctcaacacctttaactgaattccaattcttccctgagagagtatcattctccacagtcttttcaccctggttattctctcacacctaaagtgcctcagagtcaggcagcaaagttctctgctgctttcgcagacactgttcctctaaaatcatggaaaagaataacaattttcctttaaggcgcacgtcgttttgtcttcatagttattctgtctgagacatttcctcttcattccctgaccattttctctttgtttcttgagaatcacaatccttgattaaatcctatttcatacttcaatttcagccaccatcttttatgactctcatggggataacccatccaagaacctggcctcctttaaccaactagtccgtctccagtgtctttaccttttattccatctcagctgcctactgttatgcttagtcgctcagtcatgtccaactctttgtgaccccatggactgtagcccacctggctcctctgtctatggggattctccaggcaagaatactggagtgggttgccatgccctcctccagggggtcttcccaacccggggatcgaacccaggtctcctgctgtgcatagattatacaaattaagtactgtctgtacaggaagggttgtatgtttatgaaagaaagaataaagtctaattattaataaatcacaatgaatatgtatattattattaatagatttaataagttgaataagaaataaaacttgagaggggaaaagggaagaggctatttcagacaactgtaatagagagattactatatggtaccaaaaatgcatgtgaagaaagtaactggggttatattaatatacaggaaaatgaaggtgaaaagtttgctcagtcgtgtctgactctttgaaaccccatggactgggaattctccaggccagaatactggagtgggtagcctttcctttctccagaggatcttcccaacccagggatcaaacccagatctcccgcattgcagtcagattctttaccaactgagccacaaggaaagaatgtcatataaacaagttgagagtaagggaaaagttcaaattatgagagggatacaccatggtgggcttccctggtggctcaaatggtaaagaatttgcctgcaatgcaggagacccaaggttcagtctctgggtcaggaagatatcctggagaagcaaattagtacccatttcagtattcttgcctggagaattccatgcacagaggagcctggggggctacagtccatggggtcacaaagagtcaaacacgactgagcgactaacatacacacattgatataaacttcaactttattcttcaaatcatgcttaaaatagatcttaactatcatttaatttttggtttgcgtaaataatatataaagtatcaggttctcaatttttgtaggcatttggaactagtatttacatgaactcaaatttctggtatatttttggtttgcatagtcttggatctcaaattagaaagaatcagtctgttaacagtataaaatcaattttaattcattacattgagaaaagtaaatataaacaatattgaggaatataaattttttaatgtaagaagctaatttgagctccaaatatcaggataattggatgtactagacatatgctggaagtgcagagaatacttccccttgatattgactcttttctagatcagtagcagttccaaatgtagtaaagaagcagacacgatttaacaggacctaaattattaaggccagtgcattgttgctagagagttcattaagaatcccatcaatacagtgtggttcatgggcgctagtaagagcttcatggaacattttaaaagagaatgagatatctcaatagactgatcttagtgg

SEQ ID NO: 58700 - DNA, 2261 bp, Bovine  19866881121379
cgggtttaggccgtttctggacataacctctcgtctcgcttgaaatctatttactagaaatacacttgcttccttaaacaaaattagaaaaacaaaaaagccagatttaaattagtccactggttatttttaagcacttattgcaaatttaacaactacttttagactaaaattttggaatttttctaagccattgtcatcttcttagacaaaaaaaaaaaactttcaaaattttcaacatatatgtgtatgtttttatatatatgtataaaacattgtagcaaattggaacataatcataattaacattttttaaagttttggagacagttaccctgaagaagagtctcaagttcttatccaactaataccttcgattcaacatttttatgtttcatttttagtatctacagggtgtcaggttctgtgataaattctggcaatagatacatcaataattctgacctagtggaactcatagtctggcaaaaggaagaaatttacataaacatttatgatgtaaataatgtattaaaactatttaacttgaatcattaaattatagataccaaccatttttgacttatagaaatggcaatttcatatggtttaattaatacatttaatgtcctccttaaagtctttagttgtacaagaatttcctaattctgtacaagaatttcattaatttgtccattaattgagcaaggatgattaactcccagaatacaaattttatcactactaaataatttttatttaattatctgctttgtgctaaattgatcagagtggtagaacctgattaattatgactgtattctatgaccttttctaatagaaaacatataataatctattttattctaataacttttagcataagaaatagctatgtccaaagtatttacttattttgcctataaaaatattatacactttccattttcacatcatccgattacctacgttaacccaaccagaatttgttcccagttttacatggtagctgctatggtatataattttatttatttttcctaaaaatgttcacatttttaggaaaaattctagcaattgcaatgccaggtccctttggctggtatatctttctgacttggcaaaatttgaaatctccctgcagagactctggctgctggcctcttcagcacacgatctgccagccacagaacaaaataagatattattgttgtttagtaatattcaaatataaattctgtatcacagttctctcttttgtgccctgtggcctcaaaaagccatagaagtagtctttttctctattttcatctgaatttaattagtattcagatataatttaaataacccaaacaacagtgtgttatgtgtctatcaacactaatgtctatattgttattacaaaagtgttattaatattaattttcagattatttttaagtatattattaactcaataaagacagccatacattgatgaatctacagacatcaagcacagaaatttcaaaatatccaagaaactaggtattaatgacttaggagaaagtaaagatctatttttcaagaaagaatgagggccacagataaaggctgtcattcaccaaggagaaagaatacattttatgtagacttgacacggccaaatagaaagtgcattctttctggaatatgtgaacaggacataatagaaaaactgccaagatttatcacacctgctgacaactacccatgctcgctggttctgtgggtatgaatgatgtcatcatgagaaatatacaaatcattcatcatgagaaatatacaaatcatttctagaagccataatatcttaagcaggaactgaagggatcctgggacccacatgctgttttaaactctttctccaatttaatgtatgatttcagttcagttcagttgctcagtcatgtctgactctgtgtgaccccatgaattgcagcatgccaggcctctctgtccatcaccaactcccggagttcacccaaactcatgtccatcgagtcggtgatgctatccagccatctcatcctctgtcgtccccttcttctcctgcccccaatccctcccagcatcagagtcttttccaatgagtcaactctttccatgaggtggccaaagtattggagtttcagctttagcatcagtctgaaaaaatgttgagttgctagtaaaataggtggtgacaaaatcatggcaaaatcatgatttaagatgccaaaattggtgggtctggccaagaa

SEQ ID NO: 58701 - DNA, 827 bp, Bovine  19866881718205
atgagataatacattaaagcagtttgcacaatccctggctcgcggtgcataggcaggtgttagatgatgatgatgatgatcgccagtaagagcggtaatctcatcaagatggatcctatccagaacaaggagccggtttagaaagtagaatgtttcaacccttctgcacccactgttagcctaaatgagggaataggcctcatgctgttcaagagagcagatcaagttctggagggagaaggagcaggaaggaaattaacacacaacaacatgatccctataaaatgtggtgtgtacacaatgccacaattcagtgctcaaaaaaaaaaaaaaaagttcctaaacacacacaatatctggtaaagtctggaatttaaagtataagtggtgaaatattacagcatcttgaattttgttgctaattaaaggactgctgttggacagataattacccaccagcaatgtgaacctggacaaatctgccttgcagttttttctagtctcagtttcttcatctgtaaaaggagggcaggaaccaggtgaattttcgggtgccctgtagtttacatttgcactcctagaaaaactcatcttttattttgattttatattggcctttataatgcaatcataatcctaatttatccatctcctccccataattctttatgctttctgtactttttcaataaactttaatactaacatttcatacacatatataaataagggaaatcaaagttaacttttcttcaatcatttgtctgtgttcatactctatccatttcctccctgatccaacaaaatctgccaatacttggattata

SEQ ID NO: 58702 - DNA, 1347 bp, Bovine  19866880402180
gagaagactcttgagagtcccttggactgcaaggaaatccaaccagtccattctgaaggagaccagccctgggtgttctttggaaggaatgatgctaaagctgaaactccaatctttggccacctcatgcgaagagttgactcattggaaaagactctgatgctgggagggattaggggcaggaggagaaggggatgacagaggatgagatggctggatggcatcaccaactcaatggacatgagtttgagtgaactccgggagttggtgatggacagggaggcctggcgtgctgcgattcatggggtcacaaagagtcggacacaactgagcgactgaactgaactaaactgaatggtgtggggttggacttagcactcctaagagccctcctggcttaggcatttcaggattctaagtgccctgggacatggactgtgttgcttctaagcaggagctagtttgggtgctttggcacagaggactggggctctaccctgaacagcttggcagctggcccatcatccctccccctcactttttaagcacctccttgcatgcagcactctgtgccaggaactctggaggccacaagggagatgcggtccctatgtttaagaactatagtcaggagtttgagatggggtgtgcccaggtcccagtggactgccagcctgggtacaactcagtgctcatatttgcattcccagcaattagagtgggaccaatagggactcagtaaattcttgtccacataatgagggaatgagggtgagacccactagcctgaaaccctgcagaggaaacaatccgtgggtaggactgagaagtagggagagacacagccatgggtggtacccagccatctcggaggcagacctccaggcctcataattcctgcgtcctgaagcccgacgttagatgtactgagtttgcggaacctgttgctttggattcaattttggaaacgtccacagccttctggttatgtaatgtccagagtcaggcctggatggctgcccttggctgcccaagcctggtcatgggaccagcttatgtcttcagacagccatggggaaagaagagtgggtggagggggaaccaacaagagcagtaacaacccaaaaacccactgtgtaaccactggcagctggcaagcagatgcaaaagcagattagacaaaggcagaggttcaggagatgcaatccctgtctgctctgaaacagcccttcacattatgagagacgctctgcagctagcagagcactgggaggggaagagcggggggcagcagttcctaagcttgcccagctcctctccttccttcaggccggatgccagggtcac

SEQ ID NO: 58703 - DNA, 1560 bp, Bovine  19866880529006
cctttgcctgatgggtgaattcccagctctttgtccgctgagcatctctagcacacagctgtctcaatgcacactggaatgcccttcctccttctcttatataatctgcttctgaagtcatccttacctctcttacaggtcccacaagcccctcacttccctccagcaagatgttattatctcagccatctgcccacaggctgtctttcctccagacctggtctcatgtgttcagtgtgttgcccctgaacacatagagctgtgtgtgctgtcgagctcagtgctgggcacagaatgagctcccagggctgctgagcaaggtggatgacggaggagactgaggacgaatgtccagtccaggactctggcctttatcctgtgggcagggagcagctactggagcagataggtgcttgaggcctgggatccggtgggatatttctccataccaggtagcagtgggtgaccaatattctgtcatattctatcctagttctctcagctcattaagatcttccattccctgggtcctgagaagttcccgcttgtggagcaaacatttttccccaatcacaagccaatggtgagtaccttttttcactcttaccatttttgtgttatggaataaatacagatgtccatgtactcagtccgtttgaatggaggaggtgggcatgggggctgctccctgaccacctaggctgtaaggaagagctgtgacatcctgtgggaacacctggctttccaggggaagagtcaggtctccaggtgaaatttcaggtggtagagtaaatgacaaagatacacagcattccgtgggaccctgggaatcttcagcaaatcgggacaacttgagctggcagttggaaacaaaggtgaaagatgtttctaaggtagaatgttatttcatgtgagccctgtgcaggacttggtttcaactcttattttaataaaagcagtgatatttttgtttccattaatcatcaaagggcagtttgctcgtgcatcctctctgcactcaaacttttgaatatacccaaggttgttgctgggaagtggttggagtttagcttggaatatgtgggatagcctcccatttggagggtgggaaaggtgaacgtctttttgggtgtgaggtgaggggctctccatcccgcggccagaagaagttagatggaagagttctgggatgctggaaagagcccgtgacatgcctgctgtcatggtcagtggtcttgttaaacttgtcaaaggaatgcagggccatggccccatgcatgccttgcaaagaacacaagtcgtggggcacaagatggttaatagggtcccaacagtctgcttttagtcccaagtttaggcaactgagcttccaagtcctatttgaagacactgataggtgtctccaagtggggggacagtctaagcaggcaaaaatgtttctcattgattatctttcccttgtatctgatctagtgaggcgtcataccagccagggtgtgctggtggaataagaagggggcatgttccaacaaagtagaaacagtaagaaaattcaggatt

SEQ ID NO: 58704 - DNA, 2742 bp, Bovine  19866880538977
taaaaatgcttttatcctttgatccacaacaccatttcaggtattttctatacagttgatcctgcacatgtaagaaaaagcttgtttttaaggccattcactgctgccttcttcgtaagagaaaaccaaatttccatttacagtggattagttagataaattgcagtataattacacagtggaataattatatagctgtgaaaaggataaaatgttaatgacctgcgtggaagagctccagaatgcattgctaaatgtaaaagcaaggagcgaatggcgtggatagtgaacactgctgattgtgtaaataagtgggaggaagaaacagaacatatatttccgtatatgcataagggaatactggaggaacatgctagaactaacaaaagtgcttacctttggggagcagggggcaggaaagcattggatgagaatgagatggggtagggttttcaataaaaacatcaaatattttttagatctttgaaccaggtgaatatattacctcttctgaaaacttatggttagcttgtttggagttgaaggaaaggaaaaactttccaaagaaaatacatttgggatctctctctctgacctcaaaccaagagatgggcttgagaggaaacaagagagagaacagatgtgtgccctgggatggaagcttccctcccatcccagtcatctagccttcacaggatgactttgcaggtccttgtattacgagtctatttccaggacttctctggtgtccagtggttaagaatccgtcctgcaatgcaggagacatgggttcgatccctggtcagggaactaagatcccacatgccgaggagcaacttaagcctatgcgccataactcctgagcctgcgtgacacaacaaagatcccgcatgctgcaactaaggcccgacacagcccgataaatacggttttaaaaaggagtctattttcccacctttttaatctgggcttgaccatgtgacttgtttttatcaaaagcctatgatgggatgaaatgacatcgtgcagcttctaaggctgaaccttgagaggccttgaagcttctacttttgccgttttggaaagtaattctaccacataagggagctgggtccagcctgctggaggatgaggccccaggagagagagaggctcggctgacaggcgacaccaatatccagatgtgtgcagaagccctcttggactgtccagccgcaggtaagtggcagataactacagccctatgagcaatcccaggagagcagggttgctagatttagtaagcatacatgacacccagttaagtttgaaattcagattaaaaaaaaactttttgaatataggtctaacccgtgcaatatttggcttccctggtggctcagacagtaaagaatgtgcctgcagtgcgggagatctgggtttgatccctgggttgggaagatcccctggaggagggcatggcaacccactccagtgttcttgcctagagaatcccatgaacagaggagcctggcaggctacagtccatggggtagcaaagagtcagacatgactgagcaattaagcacatgcaatatttgaaggcatacactccaaattattcattgtctgaaattcaaatctaattgggcatcctgcattttatttggtaactctccaggagagaccatcgggagatcctcccagctaaaccaaactcagtacaagtgactaaatgaaaaaaaactgtgaacaaagaaaatggctgctttcttaagccactaagtttcagggtggtttgttatgcagcaaggagtacctgatgcaggtacacatggaggatcacagtggggcctaacctatgcttgggccttgctaggtcctgcctgcccaccaggttccatcctctaggcctccttttgcccattcaaagctggggtgaggccttagtgggtcttgctctgagtccccaaccctgagccggcccagctccacccacaccgcaagtccactctcagcccttcccgggtcccagagcacttacttgagatggggatggggtgatgctggcttcttggcctcttcgccctgttgggaggcgctgcggccctgcacaggaggccggggctgcgaggtaaggggtgcgctcgacttgggggcctggtttggagagctgcctccagatgcacgggagagctggggagaccctggcgatctctgctgtggcgatccagactgagggctcaggggttgctggccttgtggggagagcctctgttgggaggggctcccagatcttgggggctgaggagactgagctgggcgagggccccctacagggagaaaaaaatgattccattcaaattcttttaggataaataaggctgtgcaaaggtgtcactttgaggacgttcattacagggttcttcctgccagtgaaaaactgaaaacaatacaaatgcgcaactgtaggggaactgactggagcgttaagatacattcatgtaatggaatgcgctatggtcatcatgtatgatgtggcagaacaatattaaatgccatgggatgctgttgataatatatgctaaatattaatatagactactagacagaaagcagcttatagaacagtatttgtgggttaattacattttgacatgtataaaaatacatgcctgaggcaaaggaaggagtccttgccctgtccaagggagcaggctatgcatgctaagtcactcagttgtgtctgactctgcgatccca

SEQ ID NO: 58705 - DNA, 1149 bp, Bovine  19866880593093
tttcctatttcctgtctccttctcctctgacacggttataaataactccagggctgccctgtgggcttaaacataggtgaggaaagtggaaggtatgaaggtggagctacatctgcacttggccaggggtgacagggtttcaggttgctcagaggaatttggtttccttattttttccactaaggagtgaggtagtgaaagaggaaataatctgtgttagcttgaggaggcttggcctcccttgggccagtgctgggttatgcctgcaaggagctgctgctctgatgactgcagacccctgaggccacggggctgagaggcttagagagaaggcatctcaggatactaagagggcccggcaccatgtcgggaggaccagtggtgtccttctgaagccctatctggttccatgtggaaagatgaacaggcaagaggctgtgtgtcactttccttcttcagctgccattcattgagaccactaggcctgggcctcagtcaccatcatctcccagtctggctgcctctgcccagctttaaaggactgtgtaaaagtccacaaatacgttcactatggatgcactcactcctcgaacaaagatttattgaacatctactatgttccaggcactggacaaggtactgaggccacagagaagaactggccatagcccctctgtcaaggccacggctcagcctgtccctcttttggctgtggctccttccccacacttccaacttggacagatgaatacttaagggaagcacatgaaagggccccctttcccaccgtatcttttgtttcctaaggttcagaaaacagaaaaggggggttctgaagtggccagtgtaataacttccttataaaccattcactgcctggctcctttctccccatgggcccacagaagctcttacaatcatgatgtgatggtttcttgtggtacccatcctactacaagggcttccttggaaactcatttttcttctggagcccaagagcattgggacctttttctgtgtggtgtgtggctcgggctgccagcacctagagaggatgtctttggttcacatgaaggtgcacgacaggagtcattcctgactcagcaagtgaggggagtcagaccccttgccgtgtcaggccgtctctga

SEQ ID NO: 58706 - DNA, 1370 bp, Bovine  19866880598483
ggttttaatggagtggtgtgatatatctgcattggaaacctgactttgtaaggccctcttagggacttattagttaaatgaccttgagctgatttcaaagccttggtttctttagcaataaaatgagaatgtccttccacctgccttgtggggttgctgcatggattgaatgatataatgtacagaaagtagaggctgaacacagagcctgctgcacaggaaccactaaagtgggcaattaggttttttgttgttagaaaagcactctttaaatgctgaggtgcttgtccgacagtcaatggtcgtgtatacaacggccgtgaattttatattcctttttcatggtgagttttaagagcatgaagtgaaaccaagaggccctgggtatggagaaaagttagaaataaggaaacaaagatttctgaccatctcctgtactattttgcatcactgttcctaattttccatgcttctctgaaccaatacctgttggcaggtaactttgtaatttctcccattaaaggagaagtatatgtatcctgtgcttaattttgggcttggtcacctgacttgctttggcaaacaggataccagtagatatctggtagaggcttaacaagagcttgtgtgcttgggcatgggctcctgtacctctgcacttgccatgctgacaacgtgccctggttagcttgctggtccatgtggagccaagtctagctcggcccagtcttgtttagttgctcaggcgtgtccgaatctgttgcaaccccatggactgtagcctgccaggctccttggtccacaggattttctggacaaatttactggagtggattgccatttccttctccaaggccaggaccagaccagccaattcccacccagaagcaagagcaagattaatggttatctttaaagccactgagttttgggctgttttgttaggcatcatagttgtggcactaagatgctgatgacccctgttatgtaccagctcaagtgcttttacttaggcttttaaatttgattctccaacatccccatttactaatgaggaaactgagacttcataagcccttctggtccaagatcacacagaaaggaaaaagcaaagcttggaagcaaccctgttctgtctgattcccagaacatctctttccattacatcatgaaagaaaggggtgggaggtggtggaatgccatgtgactggcctcacagctgtgcttcagtctggggccgtctatagtcatccctgagaccacgctggccaatatcataaatctaagattgtgacatcatgggatgactcaggcaggaggtggaaggacagggaagccctggtgaagggctggtcagtataaacctcagt

SEQ ID NO: 58707 - DNA, 2004 bp, Bovine  19866880608793
tgatcaaaactaactttagccataatggaacagactggaattgtgtccacataatagagtgcaatgaaataaagcatgtctaatgtttctgccgaaactatgtaagctgaacctagccataaattaacatcaaaaacaagacatatttctacaaaattaatggcctgtgatcctcacagatgtcaagtttatgaaaatcaaggaaattaaggaattttttcagattgaaggctagagacatggaaattaaatgcaatgtgtaatcagtgtagattggattcttttgctacaaagggcaaaacacagggctgtggattcaatggtagtaatatagcagtgcttgttaatttcctgattctgatggttgttttgtgctgtaagaaaacatccttgttcacagaaagtacctcaaactgttgtccagtatggtagcaactaagccactggtacttagaaacatgtctggcataacacttcttaaaatattttggataaaaatgatacattattaaaataatttcagctgtttttttaataaggactatcaaaagtaaaattacatggatggcttgcactgtatttcttttggatggcactacaaggtattcaggttgatttggtatcatgttagcaacttatcctcaaatagttcagggaaaaaagttattaaatctgagttgcagcttttctgaaagattgaatgaagttattttaaaataaaaatttgttaatgagggatataaaaaggtatgttattttagattaatgggcaaatgggcattatgaaattttaaggttatatatggcattgacattcatttggggcctatcacaaactaaatgtttataatgtacgaattttaggagttaaccccccacaaccgtcacaagtattgggaattattttctatgtttaggctgtgatggtgcctttaaggagctgcctttcactagcagcacaaagtacacatgaagattaagcttatctatcccactggatattgcctgctcctcatgtaccccctttctgggttgttcacttggtctcttcatcactgatcttcctgcccatttgccattagctgtgaacctgcttgactctcacacctgtttgtcctactctttagcctttctttgtagggcacccttgatttgtcccagtgtcctgcgaacagttcgagccttgcctcgagagcagggcacacagttctccctctgacaagaaaagaggctcggaaagattaagcaacctgtacaacactgtgcagctgggattccaagtctatttctaattcatgccactctgtaagaggcccacctgcttatctcgatgatctgctttctctaattgttctgtttccttcatagagcttaccacaactcataatgatcttttatgtccctcaggagatgctgattctgtgatagcagctatcttacctgacatgtttacagctgcatctcactgcctggaacataaaagtgcacaatcaacttttattgaatggcaaaaaaaaaaaaaaagtactagtttaccagtgggtaaaatctttttcaagactacaatgcagttatttgtaaagatttttctttttctttaggtatattacatataaaagtggatattttccatgataagtgaaaatggccaattctttaagaggagaagtattgaatctttataagaatgtaagtacgtacgttgccagttttgtaaatgttatatgacatagattgtttagaaatatataatctttcttttttaagctgctgtatcttggacgagactatccaaaaggagcagactatttcaaaaggcgtctgaagaatgttttccttaaaaacaaagatgtgaaggacccaggagaagatcaaagaacttattgaaaggggcaaatttgtaatgagaagaactagaagcattatacttccttaggaaatacagagctatgaaacaacgctattactcagataccaacaaaactaaatgatcagtattactat

SEQ ID NO: 58708 - DNA, 985 bp, Bovine  19866880703688
ttaatgaaagtatagagggaggcaggaaccagaccataaaagaaagatacagatcagtggtttttacaagattttgcagcagtagccttgttttgagatttaaaaacccctttgggaatctgcagaaaaccatagacatgcttatcggtaaagaccctcatgtccatacagatttcaggttggtaacctctgaaaaatgtaaagacatttcagatagtggggaaagagaagagaggaaatgacattgtttgcaagctttctctgtgccagaggctttgccagttacaataaattatttatttaacatgttttttataatcccatttgataaatgttgaaaccggatatcagaaaggctgagcaatatgctttaggttcagtgggtaataaatgataatgaatttgaattaaagttggcttctctccagaaatattatttttatttgatatagagtctgatttcatcctgccaatggtatttttattattaggtgaagggtctgtattttcaaacagctgaagcagtatccatttcctttttactggctctagctgaatagcagagcagctcagattctaagtttccatttctttactgccacagtgattataatgtcagcctttattactcccagcagagtggtgaaatataatccctacaccactgccaattaaggcagcatcaactctattcacatttgctccctctttgtgaatgctagaagatctgctccaagacttttccagtggtttagtattctgctcaaaggagtcatttgctgagcatcatccttcttaattagggacctaatgtattgcagtcagtcctttgaacaaggggaggatggagacctaaaaaggaggcgtgaccattcatttcaaggtaatcagctttgaagctgcttgacaatggatattgatttcctcatgcctggaaaacctctggagagagggttctgatctgagcagtctaggcaatccatgt

SEQ ID NO: 58709 - DNA, 2030 bp, Bovine  19866880716554
caaagtaatgtctctgcttttgaatatgctatctaggttggtcatacctttccttccaaggagtaagcatattttaatttcatggctgcagtcaccatcttcagtgattttggagccccaaaaaataaagtctgatactgtttccactgtttctccatctatttcccatgaagtgatgggaccagatgccatgatcttcgttttctgaatgatgagctttaagccaactttttcactctcctctttcactttcatcaagaggctctttagttcctctttgcttctgccataagggtggtatcatctgcatatctgagattattgatatttgtcccagcaatcttgattccagcctgtgcttcttccagcccagcgtttctcatgatgtactctgaacagaagttaaataagcagggtgacaacatacagccttgacgtactccttttcgtatttgtaacccgtctgttgttccgtgtccagttgtaactgttgcttcctgacctgaatacaggtttctcaagaggcagatcaggtggtcttgtattcccatctcttccagaattttccacagtttattgtgatccacacagttagtggctttggcatagtcaataaagcagaaatagatgtttttctggaactctcttgctttttccatgatccagcggatgttggcaatttgatctctggttcctctgccttttctaaaaccatatctaaagtcatattagagatatgactgtaatccattctttttaattatttcaggatatttcttggtgcggatgaaccacagttttttcagccattctcctaccaatgatctcccaattctcttgtgaacagttatgcaggaaacatcctataacgtagttttacttagcagtgcatggaaggttcttcttcccctcgtgcattcctacttaagagctttaaagtcagttcaaggatctttgcttccaaaagaaaaaataaaaaagcatctctgaatacccccaaggagtgagtcccacccaatgcccctgagtcctatgcgcttgcgtctctgttatagccttttcaaggatgtgttgaaatttctcaaaaaagtctattagccagtcagccctttgagggctgggactgtgctgctcgtctctgcgccctcccagtacagcataaagcttgccgcaaagtatgtgtccactggttatttgtttacctgaacagcagaaaatttgggctttgaaaccgaacaggctggagttcgaatcatcatggttctgtcacataccgtgtcacttagtctctgaacttagtcttctcatctgtgtaaaggggaagaaaaatccccaactatgtgttgttggaaggatgggatgagaccctgtagtgctaggagtggcatgaggatggtgtttgaggatggacactattgtggttgggatgtgcttgaagaaggagactagactgagactttggcttggcactgggccccttctatgcacctttgggcttcacagatagggaaacaccctggaaccagcaggcaattccctaaaaaatgcccagataaatcttgctggttccaagatgtctgggacctattgcctctacctggatcctcctaaatacccaagccctttccagatggaaatgactggcttccattccctgtgacatatcttcatgcgtaagccttgtagaagtcacccaaaacttctctccaagttgattcgctgtgtcgtgaaggtgcaagacttgatgaagggtgttcagtattgtttttgatatgggtgcccttggggcaacggttggggagggtctttgggggagatgttgggctggaatcatctgaggtatctgctaggtattgatcacggtgtggctgtccttttgcctttttactccaccatgccttcctgagagtctattctgggagcttagaagtgtcttggaccactgggtaggaactgatgatacaatagcaacctgaataagaggtgcacaatgccttggcgacaaatgttagttcctgcggacaagccgc

SEQ ID NO: 58710 - DNA, 1463 bp, Bovine  19866880730954
tattgggatgggttgccatttccttctccaggggatcttcccaaccgagggatcgaacccaggtctcctgcattgcaggcagacgctttactgtctgagccaccaggaagtgttccatctctctatccaggctctactatgtgcttagcactgtgctagtccctaggaatcatactgaacaaaacaaccccctgccatcctggtgctcctggtctagccaggagacaggcccagatgaagaatatttactctgactcctctcttcatcagaaattactaactggcaaacctcatggagtccacggtcttattttgttggacttacattatatacttttgattttaaaacagagaattcatttatcaagaattcagacttctggcttcccctgaaaatcaataactgagcatcacgagacctgtatttccacgtggcaaaagctggctgagaggacggcagctgttgcctgcagttggggcatcagttctcacgcccaacagtccccatggctccctgttgtctctctgcagccagtgtcaagtggcagaggcatttgtcatagagcctgggctgccgtcttccttacagaagggaaatatttctctgtgcctttgccttttcctggcacctgccccttcactcaccgaccaccttgccttctgtgagcagctgcacaagcaacccctaatttaactcattccattatgaagatggcaattagctcagtgaaaatcttcaggaagcccacaccactgcccttcctccaaactcaggtttggaggtcagaaaaatggatacaaagcaccgtgccctctcttgccatcacagacagcctccctcctgctgaggaaacatcccatgcaggcttccacaggcctcaggaggaaagacattctgcaatgagactgatgtctgcccagtgacctgcccccccagggcaaggctgtagccagacaggtgaagtctggaggaacaggaacagctattgctaagagagcccatggcatctgagggacttctctgaaagaggaggacctaggcaagaaaatcacattttgaagaatgaaggaagactcagaagttggacagtggaattatccagaaaaaggcagggcaatggcaggaaaaatgactaagacataaaagcagagagaggaaaatgaaaagtttcaggtctgagactcctttaagggcttgcaggctggccccttcagagtctgggttcttctgcattactcctccctggctgcccgcctagttgtattggaagctgcaggtgatgggggctcactcctcactgggcggcctgcgtggtcttcggctgatgttcccgttacatacactgagctgacacatctccctctttgtctgcttcatcggcctcagttctcccagttgggaaccacatgaaaccagtcctctagccacgaggtttctaaactggctcttcatcatttaaaaa

SEQ ID NO: 58711 - DNA, 1523 bp, Bovine  19866880757167
ggactgtagcctaccggctcctctgtcctggaattttccgataagagtactggagtgggttgccatttccttctccaggggatcttcccaacccggggatcaaacccaggtctgctgcattgcaggcagacgctttactgtatcagaaggataaaataataagccctttaatttcttgaggaatgtgtaataagaaagtaaataaaacgccatatcttaacctgcccctttgttcaagaaacacttactgagcacatgctttgtatgtggccttaatgacagagctcaccactctcaaagggttctccttctggtggaaaataaacaatgggggctgtggctattgtacactgggatgcgtgctgacacagagatcatacaaagcatagtggagcacagaagagggagggatcgtcaaccttgcctgggaacactcttaggagaggcttcacagaggcctgggggcaagaattagccaagtgtcaggacaggaagggtgcagttgtgcacacagggtagtgaggtagtcaggtattcaagccttcccactaaagagtatgtttgaaatttcaatttgttacatgtcagggaaatgaccagagtagaggttgcatgcaaaagggtggtgggagatgaagctgaaaaagaaaacagtctctatccaggatggggtttgtatggcaacgcatgcggttagaaatcgaattgtgtcctgggggagtgagacatatttattggactttttaaaccatggagtaatatgatcatgttttcattttaggatgcacatgctgatagtggttttagaagatagactgggtggcatgaggctggaggcagggaaattccgctctggattgggtgaaaaaaaacatcttatcctggaatattatgcttggggagaaggttcatggaaagaacttcataaaatgtgtgtgtatccctgacttggtgttctttagcccattgagcttcattctcatacctgtaacttgtatttgagaatagaagggataacctgttttccttaaaacagagaggatggaaccaaacccgcaggatgtgtttgagctggcaacgcatgaaagtgaccaccatcaccctcatcttgttcaccaacagtcctggccacttgctctgacccatttcacacccacattccagcttactcccaacctgctgaatctctggcctcgtgatttcttcaactacttatgctcttctccccatgccatttctccagctttgacctccagcttttgctcagccattctttacgtttgctgccagctctgctgtcatctctactgtttggggtctggctcactccctgatgagaggagccctgctgggttcaccccagccctgccagcaggccctgcccggatgtgcttgcacacaggatttcagtctttgcatttcagtaggaatcaagggttattaattaacccagggtggaacctattatgaaacatcccagaaagctggaacaaaccaaagggacttctgaactcacagcaggg

SEQ ID NO: 58712 - DNA, 1130 bp, Bovine  19866880778923
tatttcattttgccgtgacgatgataatgatgatgacagtaataacatttacctagtacacactccgtccaagacatagtgcccagagtttcacaggcattacttgcctaatcgattcaggtaactggtaacattattatcctgttttatagaagaagtcagaggccagaaacaaaggtacttgtccacaatcataataaccataaagaacagggctgggatggggaaagttcagttggctcctaagcccctgctcccaactgcttcttcctctaccacaccctcactgagccgccatcccatgccatctaactgcggggtaccaagggccctatcacagtaccaactggggcatggagggaaactggggtgcatcacaactctgtggatgtaccaggatgtggcaaaacgtaggcatgcaaaggaagtcccaaatgagcaagaactcagaaaggggtctgagagaccacgggattatcagaggtgcaatgaggagagggcaggaagcactgacaggagaagattttggattatggtgaaagcatagagtcactcctccagggatgactgcagcctagaaatttctggacagcaattatgaacatttagggaaattagctccaaagatgtctgcttcccttgtctcctccacttctccctgccccctactcccccatcccagggtttcttatctgaattcttgctcttataaacacaattgtctattccagttgcctcactattactaagaaagcaattccaggcacacggcaggtagatgcctgctctgagatgcggtccctcatatggttcaggcctccctaacctccctgtttgtcttgcctttttctccagtgatccgagccaaggtggtagggaagaaactgctgaaggaggggccctttggcacgatggtctacaccatcaagcagatgaaggtgagtgatagcccaatcccaggctcaggaggatttgggggtgggcaaagggcaaggtttctgtcagagtgtcttggccagtggaggcaactggaactggacttagagagtgtgtttgcttggtatctgatccccagccatagcccctctacctggcaggagagggtgtagatgaggcagcagaaggggaag

SEQ ID NO: 58713 - DNA, 2182 bp, Bovine  19866880808917
cctaactcagccaaagtcatttctttttcttgcaaccaaagaactctatctatacagaaggtgaagagcggtacctgataatctgaatgtcattctgacggaaacagtgctttggggaccgtgatctcagtttattgtcattgcttgattgatgaaggcactgaagcctgcagaggacagtggctcctagatttcacagcatcagcagggaagggggaactggggaagacacagcgtccatcagactcctccccgtgctaccttctgctctaagacacttcccccagatttcctagccacactctcacagggtgaagactctaccagggcaggagacaactcttcactgttttcccctcccttccctctcgccgtgcaagagcaggggaggaagcggccggggcacagagcctctggattggatggcggggagacctcacggagagaggtcagcacttgaaaaattcctcaagtcaaagggctcggggcctgggtgccacacaaggccctcactgtgtgcggacattgtccccctgataaaaggggccgggcctgggaaagcggcgctggtgtccaggcaacaggccaggctgctggggaatgcccaaggcccctcccgccccaggcaccaaggcggagggagggggagtggcagggggggtgcccagattgggaggacgagcccagaagcccagcgccaccccaggttgcagggggtggcttgtgtgaatccgtgaatgaagggagtaagaggatggcaagacccctctcaccaggcctttcctagctccctgccctccacctctggattaccccacagggaagaggcagggcttgcccttatttcaaggagagtcttaggggtgggggaagaggtgggtcaggggagacataaggattttgtttcctagagcctagtgtctcgaagagacaggtgtgtatcctgccttgagcccccctaccaactctaggaggaggggaaccagcccggtccccgtcttcccatcttcagagtagagagtgtgccagcccaccagcacccagacacccctcctccagggcttctagaacgcagccctcaagcacgtccggctgaactgagaaacgtgccaagtggcctcctccccattgcctgccagtgccactatgttcaccagcagttagtatcacaattagctggttgtttgttttttttaacatttttatttatttggctgtgcaggggtcttagctgtagcacacaggatctcccgtcttccttgtggcatgtggagctctcgctgcagcatatgggatctttagctgtggcatgtgggatctagttccctgaccagggattgaacccaggccccctgcactgggagtatggagtcttagccactggaccacagggaagtccctgcaatcaactgttaacaccatcaccatttcagtgcctgttatgacagctaagcccaataccagccccacttgtggcatcatctccacctcttactgacccttcatgagaggtgccacgatcctgccttacaactgaggaatgtgaggcccagaggtcagactcccccaaggtctcatgagtgagagagaggacgggggtccaggcagtctgccttgagactgtccacttgattttgttcctgccctgctggtgactgagactgttcagtcctcatcacaggccaggaaagcagcttcctgagaatgaggtcaatggaaggggtgggagggctggtttggctacccaaccggaatgcaaggacgcacaaaggccagcttctcactgggcccatgttagcagggctgggcactgcctcttgttgccactctccgtaagtagggtagaaagataaactagcagacatctacttaaaaatgaattccagataaacaacaaataatttttgtggtacaaatctatatattgcaatggggatatgtttatactgattcattgtttgtctaattattaattggacatacttatttttactggctaaagcaacaaggaactctacccaaaagcctctgctggtgatgccagctcttaatttaatgcccccttcccacccactgcaaccgtcccccgacaagatggcacagtgggaagcagaaagtcctggccaccctgaggccaattaggccacagcaaggcttcaaggggctgccaagacaccctgag

SEQ ID NO: 58714 - DNA, 1754 bp, Bovine  19866880883020
tctttcaagacccagccccaaactgctcccccgaagaccccctagttccccaatgtcagtaaggttcatcccagacccaaggttttatagcttaataacagaagctgggaatccaacagctttacttgttctgctcttccccgttcactgaagaaaaggaaagaaactctttgctgggtcaataatcaacttcaaaatttagtccttttgcctaattctcacttccggtggcggggggcggggggcggttcttaaagccaggcaccctataactgggtcaggctggcaaccctaattcaatagaaggaattggctgtgagattctaaagaagctggagctgtgaggcactgcctgaggcccccaatgagaaatccaaagccccaggctcttcccacaggatccttgatcttgttctcatttcctcctccagaaacgtggggctaaaataagcccagaggctgaggcaggggtgagtcagctcttcgagtgaagcaatcactgcatggcagctccttgtaagaaacatcccccttgagtccgagttgtttatgccaaaagctgcaagcctgaaaaatgagttcccctaagataggttggctccctcttgtctcaaatggtaaagaatctgcctgcaatgcaggagactcaggttcaattcctgggttgggaagatcccctgaaggagggcattgcaaccctctgcagtattattgcctggagaatccccatggacagaggagcctggtgggttacagtccatggagctgtagagagttggacatgactgagcaactgagcggatagcatattaagaaagagaacaatgaaagactgtaggattagtcagttatatagaataatggaggtacatgttatagattttgcttgcctgatttatgagctatttaatcatgaaaaccaagagaaagctttatttattttttccaggccatatctgccttaacataaggcaaaacttcaccatctactgctaattcagaaaataaataaataaactggacaaagaaatgaacatctaaaaaaggaataaacaaataagcaaacaaaataaacatctgaaaagcattaattggtaaaagtgataagggcaatctattatgatatatcgcataaatcccttgaccctacctttatccaacatctttcagttaatcactcaattatatacatttcttcttgttggaaggtggctggttactcatgctactacacaactggaatcaagaaagatgatttcagatacttttctaagtaagtgtctaagtgctataaggcatctctcatagtctcataatatgcagttgctttgtttatcccccttccaaggagcgtttcattatgttcaggtcactatgcatttgctgtatcttaatcttttagtaccgtcaaggttatttcatcataccatcctttagtatttagtctgggtgggaaacccctactctgaaatgtgcagaaaaactacctatcatggaattctgcacagtttattaatagaatgaagggttcaggtattggccagggaagtgattgcacacagtttgcacttgggcaaataagagtttaaattccaactcaaacttatatagtaagttaccaacttatttgaggccccattgtttcacctataaaatggatataatgaccttgaatctgagatttcttgaggccagcaaagaaggaaaataagagacaggtggcatatcaagaatatagagtaataagtagaaag

SEQ ID NO: 58715 - DNA, 1314 bp, Bovine  19866880891906
ctaaatcccttccttgtgtctaaggcccccccaagcttgccactgcccacattttcaccctaattcccactgcgtccccagcaagcctctactcacaccaacctttactaacaagttttccccaaattctgtccaactctgcccgtatacatgtgacttcattccctgtcatggaagcctttgtctaacgcccatccaacatatacacttcctgcacagtcactatatgccaccccttggatggagcctggggatacagctgtaaatgaaacatgcagagcaccttgttctctcagcgcacctaccttggatttgagagagggacaacaaagaaaataaacgtgcaattacaaatagtggctaactctatgaagggagagttcatggtatgataaagaagattcaagaagcacttatttttttagaccaatatccagggaagtgcactctggagacagagcatatcaactgaactgtgaagtatgtaaaggggtggcctagaaaacagtgttaggtagcatctttcagagaaaaggagcagcggatgcagaggctggaggtaatgaggctcattcagtaaagatctgaaaggcccatgtgttggaacatgtagacagaagctggggtggtaaggaggggaaacacaggatgaaacaacaggtagtgcgaactagatcaggccgagcctcagaggcttggatggagacccagcttctccttgaaaccttccaaggtgtttttggtccttgttttcctcccccagattcttccaagccttgctttctccatcacttaaccaggaccaagcactgtgtttttaaatctccagagagtcgtgaatatacagagagctgcctccttcagtggggagctgcctcagaccactcaggtcacagctctccaattccttggcttgacgttgaggttggtacaactctgatctggcctcacactgctctgactacaaccccccaagagaatgcctagcaggagtcctgggccacccccacttacttggttttcttgggagccttctgaatagggcccttatcagcctggggatctctggtttcaaaaatggattcgccccttctaacaggaagtcaggcctcttgcgccactgggcagtgctgaactctggagccccggggcatgtgagcggggacaggggggtctgtgagagactgatgcaggcctgccatccccaggggaactaaataaagctattgttgggaagggaagagagaaaatagccgacaagatgtttttttgtccttcatgacctgtctgtgtttgggggaggggctggcatgt

SEQ ID NO: 58716 - DNA, 960 bp, Bovine  19866881064612
gcattcattaaattcaattttacatttcaaacgtggcttaggaaaagatacataagacccaagaaataagacaatcaatataaagggaaataaaaacacacacacaaaaatctgaagacaggatgtgtatctaagaatgcacatcatagtgggcttcccaggtgacgctcatggtaaggaacccacctgccaatgcaggaggcataagagacaagggttcgatccctgggtcaggaagatcccttggagagggcatggaaacccactctagtattcttgcctgtagaatcccagggacataggagtctggcaggctacagtgcataggattgcaaagagtccaacatgactgaagcgacttagaacaatataagctagatatttgaatcagagccaccaaacagccaaagcaaaaaaggaaagcagatcgatgacaagcatccctacttccctcactgtgtcgtttgttctggtacaggagaacctccatctctggaaactggaaggccaacacaggctctgccatgctggagcaggtggccatgacagagaggtaagaggtaacggaggcgcttcgggaagggtaccgaccacagggggaggtagacagggatacagcaaggatcctgtcatgaatgctgtctcgcactttggccagcgtctcaccacccacagagcactttcctaggcatgatccgctttattgcccataatagccttcagggaatgttttacaataaccccattttacagatgggaaagatggttcagagggggatcatggcttgtccaagtcacagaactgatcaatggcagagataagactaaaaccttgacatcttgacttcgtccaggggtctttgtggccctgccagttgctgcaggaagagagcaggaagtcctcaccagtctcttctgctcttgacagctgtatggaagcatcccgttagggtaccacag

SEQ ID NO: 58717 - DNA, 2131 bp, Bovine  19866881126667
ccccctgcttaagatagggcatgagacttaagttgacatgacacaagtccttctgtaaatcaagtatacttcaataaaaacaaattttaaatgaataaataaaagcaaccagagaaattaaagacaccttaagtaagaggaacaaagataagaatgacagcaggcttctcacagaaaccaataaggccagaagaaaaatggaataaagtatttataaagtgcagaaacagaggagagtcacaatgaggattctgtactctggaaagtatctttatgcatgttgatgtatggcaaaaccaatacaatattgtaaagtgtaaaaaaaagaaagaaagaaaaaaaaattaaggcagcaggaagacttgtaaacatcaacaaaagctgagataattcaggaccagcagatcttcacaaaaataaatgttaaggggaattctggcagaaggaggaggctgaggggcagaaagcagagatgaaggggaagggaggggacaactgaggggccgatggaggatctgaggggagagtagaaaaggaattccttcacagcaaactgatgttcacgtcattgactatacagcctgatggtgctgaggccctctttgacgtctgaccagcgtcattcccatcagcactgtgtgctctgctcatgccctttcttcaatagagtcctgcatcttttcccggacctgttccctcttctgctctttgttcccaaatcacttatctcaactccagtggcccttcctcttcctccttggttcttgtcagtctccagagggctggacacctggcctctctgactcaattttgtaagagactaacgtcatcctgttgcctcctatgtcatcccgcccacatctgaatgtcactctccttttcaggtgatctttttctgtgatccctggtttttttttctgctctcccttcagcatcttttgaatttgcaacatgagcatatattactataataataaaaatgataatattgataaaaactcatgatgggtaacagatgaaagaatgaatgagtaaggattcccagtcccagaccctcttcaatgatgcaagctcagaatctgtgaatggatgcagatacgttcattcgccaccccaggagctgtgggcacttgccaaacaactgatcagggactcatgttagtgtaagtcaggaaaaacccaggccatgtgggtaatacttgagtcacctcattcacccctaaacctcaacttggaaccactagtgattctgagaagcatgggactcagcattccttttcccaaacacccctgctcagaagctcagaatcctaacctccttcccagtcagccatgctgtcaagccatccgactgctcaggccactgggacaaaagggaggtgaggggcattagcatcaaagtgaccagcattcacttttaggctctgcctcttatttgtaagtgtgcctccaggtgaggaaactttatcttcctgagccatggtatcctttcctgtgaactgaggctaagctagtacctgcctctggaggtttctattaaataggaagcccaaacacaataagaagtgagagtgcctagaatgaattaggagcatttccaatctcctttctctaccaatgagatccaagcactaatcaatcgtttggtctgttttctccctcctgataatctctagagataatgctttaagccctggactggtggaaaaggggcttggaggcactgtatctaattttcataaatgcccccagggtactttgcccgacagagcccctatctcctcatctgtaaaatgggcacaattgtatatatactgtaggtccagtataagaactaggagggaatatgcctgtgaaaacattctgtaaattgccagtgcctgcacacagatgagaaaccacagtgcttctcatctgtgtgcagagcatcagattacgtgttatcatcatataacatctaataatacaagaacagaacctctcattgatgatgtgaagtcagtggcaggcaatggcatgtccaggtcaggggatggttgggaggggtcaacataaaagatgaagggtatttattactgactcatttagaaatgctgatgggtgggggatcatagacaatggatttagtgag

SEQ ID NO: 58718 - DNA, 1521 bp, Bovine  19866881174912
ccaaggtgtaactgacaggtaggcagttgaaaaagagatgaggtggtaagggaattaacatcttttggagtatttgttttttgctggacatgtgcctttatggatgtatttttcattttgtcctcatagtaaattcaggcgggttttaaaatcgggggtgggggatggggactggtgtgatatagcagggaaatggcatttacagcagtgtcttttagggtaggctacctagatctagatctttgctttgaaggccttgagacttatttttgtcagttcccaggggagatcagactctgagagacttaacttatatgaactgaagttgatgaggaaagggagacctcagaatatgtatttttaatggtctgtgaacaattaatgtcataccaggccagtgttgctcaaccattttttcattatcaatcccctaaggaggctttgtacacaatcccccaccccaactcccaaatcattctccctgatgaaattttaatttcatagatatactatatgtttgtatactatggcccttttgaggtcacaaaccaatgtaatagctaggatttttgcttggttggaggcggtattgtttcttttgagaatgcatgaactagactgatgaatctgtacggatggtcttaccattaagaccagaaaaacttgagattccttggctacaatactgtgtattcatctctgtactctggaggtccttattgtggggagtagaaatgctctacattacagcagtagacacttctacgcccattttctagttcaggaaacaggtctagaggaggttaaattacttcaaggacacagagttaataaaagtagaatttaggattggagtagatttggctcctgagcctattttttaagaacagtgtttaatgtcgctcagatgatttgatttatgttaagtaaggaataaggaagtgaaaaaggaggaagaaaagtaataccgttagatcacaagtttatgtgaatgcatgttaagtcacttcagttgcgtccgactctttgtgaccctttggactgtagcccaccgggctcctttgtccatggcatttttcaggcaagaatactggagtgggttgccattttcctcctccaggggatcttcctgacccaggtattgaacccacgtctcctgtgtctcctgcattgcaggaggattctttatcgcctgagccatcagggaagccaccagtttacggattatattaatttagtattttcagtaggtactttgtatgttgggtaggagtatgctgctcatttgacaagtcatttaaataatttttactgtggcttatagtatctagtatatactctgtactattatttatccttttatttataaattcctaatcactttttagtaggtccattaaagaaagattttgtttgaagagaattcagccttcagagttacacagtgtctacttcctcgtctactggagactttagttcatttctctttatgtaggaattatttggaaaactaacttacca

SEQ ID NO: 58719 - DNA, 875 bp, Bovine  19866881198777
cagctcactctctccttccttcatatgccacgtcacagaaaggcttccctgatcactcccctgccctcctcacgatctgttcctcttatcctgtttctgccttcagaatccttctcctcacctgacatactgcagtgtaatttatttattcttttatctctgccgcctcctacaagatgtattgcttatcgtgatttgctatacaaatttttggaaaaccactgctctagactatagatcagcaaactttttctgtgaagagtacggtggtaaatattttaggatttgcaggccatgaaaatgattgaactctgatgttgtagtgtagaagcagccatagacgatatgtacacaaacaggcagggctgtgttacaaaatctttattaacaaaaccaggtccaggactaaatttgacctgtgggggggtaatctgccaagtcctgcattagagtgtagtctagtgagagcctgtgtctttcatgtgtaaatttcctgcattcaggagccatgtgtttttcatgtctcgatcttaaccaacagtccttcacctcagggtctagcccattctttgcatataacaaatgctcataaatttttgccaaaatattcaataaacatttactgagtccttaactcagaacagctaggcaccaactccattaacgttggttgaatgaacacaagagtcctggcctcaagttctcaaaagcctttgcccctcctccaatccttctgaagactgagatccagagtccaaaggatgtccgcgccctggcagcctgggtcacgtgctgccaggggtcggaaggggtggtggggaagtgatgggaacaacagaaggcttgatggactgtttagggaactgcctaattat

SEQ ID NO: 58720 - DNA, 912 bp, Bovine  19866881209940
ttttattaatgatttgataaactttattaaagggactgaatggaatgcttatctgcagacaggttaggggcctcttgtgcttttcatctttttgagagtagtgcactgtccttcattgtctgtttccctctatttcatgtcattgcccaggggactgaagccaaagctgtgtccatgccgcagaactggaggttgggaggcgtgtataagctgcagtacacgcaccctctctgcgagggtggctctgctgcgctcacctgtgtgcctttgggaaacctcatcgtcataaatggtaactagctggaggagtcacgcttgttagtttatgagtctttacgtgtttctctcccaacacttcacagccacttcagtgatgggctgtcgtgataggtaactagctggcagagtcaggcttgttagtttatggatcttttcatgtttctctccaaatgcttcacagccacttcagtgattggctgtcacagtacagctaggaatctttctcaaatttgtttgatccccagaccactaatcacacgggggccaaaaggttacagaatacagggctaatcatgctattatgtcacagcctaacttgcaaggtcacagctatcaaatagtgaatgtgaggttgtaatttttgcttcagtttcttataaaaacagctcaacaacacttcagcaatttattaacctttatgtactagtcttaagatacttaatatagagaatagctgctaaatgtgttagtttctgatgttttgttcctttactaattcttgataaatcagttgcttgtggacttagtggcagacagccattccagaagcattccaggcctagttctttgaaaagggagcagtgtgtccttaaatctttcctttacccaagacatcctgctcagtgcacatgt

SEQ ID NO: 58721 - DNA, 2709 bp, Bovine  19866881232411
acccctcacatgggcccccttactttgccttctgggacactggatggatgagatggtccactgagggaatacaacattagtggaagggacagctaaagataaacctggggaacatctacctttaaggggtcagcaaagaaataaataacagtaggaaaatgaaagaggtcggcaagtttggaggagaaccaggagaaagcaacctcatttatccccctctggaagaacaccagaattgtcagacatcctatttcttgctcttctgttctctggagtcctctacaccagacaactaatttctttagaatgttaagtacttcacaagttgctgtaaacagccccaaggtgcacatccaacacctatcatgcagattaaactattaatactgaggaaggagcagcagaagagataatcaagcttaatgtgattttttttttttttttccccaagaaaagcataagtcagtaaggaatgctctatctaaatagcctctttgggcacctctatccaagagaattagctcattttttctggatcttagcactaggcactccagtacctcctacaaggacatcttttgttatcccaattatttctaatatgactctagctaactgaagaattaagagtttaggtcaagtaagaggaaggtgagtgcacttattctgatggtcattttcttcatctaaaatagcgagtatgatactatgctctcttggggttactgtaaaaattaaatgacatgatgtctgtcaagtgcttcagatagtcctggcatagtgacaaacttaattatatggtagctattattagatagctggatttatgaaacccttggaatgtatttttcattcttctattcctagcacttaacatttatcttcataaagctttgattgaagtgagaccatacacaaataagttaaatatatagcacgtatagaagatcaaagcatcccactcaaaaaaatgtcactttgacatacatattatttggtgctggaggcaaataagaatcaatagctgcaaaaagactccttccaggagcttgccttatctggctaaaagcagagacttctgagaaatgaggaccaccataaatcccctctcccgggaaaggttcatatgaggaagacaggaagccagcaatgagatgcatctgcacaaagaaaacctcctccattagttccccccagtacttctcttcaccagttgtgctgcccttggaaacctaaacctttttctttgctttatcacttctctgcacatttattgttctttgctaagatgctttttaagcccaaattctagccactcctttgagttactcatcagtggatttctcccacatgcatgcatgctgcatgtgttaatacaatgtttctttttctcttgttaatctgtctcttctcagtttcatctgcaaggtctcagcattggcctcctagagaacctaggcctgtacagaaaaaggcttttttcccttccctgtgtgtgttgaatgagaataaatagtatggagaaaaataagaagcatggagcaggagggaggtgatttaaaataaggttggcaatgggtgtttcactgaatagttactgataactatttttctgttactgatagtgaaggcatgctgatggctatagaagttgcctaacgtttaggcttggttattgtctttagaaagcttgcattggtgatgaatacagttgagtaaacagaagatactacacctatcacagtacaagcgtgcacaggctgttgaagaagtacctgggcacatcaggcaggcagcaagatcagccagaccacatgatgcctttggtgctacgattccttgtcttctctaatgctctaaccaaagcagagaagagacacaaagccctctcctgagttccctgacatggctgttttaagacaagactctcttgtcttgtatcatggggaaataaacacaggggaacaataagtttagaatctgtgctgtccaataaaataaccactagtcaaatgtagctatttaaatctaaatagatcaaaattaagtaaaataaaaattctcttcttcaatcatactaaccacatgtgcttaatgaccacaagtgggtactctattgaacagtgcagatataaaacatttctatcattccagaaagctttattggactatgctggcctagataatatgactcaggctacccaaattccaattgtgcatatgaatcacttggggatcttgttacaagcagattctgattcattagttctggaagtggtgactcagattctgtattcctaacgagctccctggtggtgtcaaggctgttggttcatgaaccactgttcaataacaaggactcagagctcagggtatgttctccagtgcttgtagaaaatagatggtgcccagggagcttctacataaccccttccacacccatcctgagtcttacttctttcttcaaggaagaagacatatatcaatcccatgtcccttactgaaggttcatagtttatggacaagcccatgggctagagactcagaatgcctatgttaaattatagtatataagatactgtaataactgtgtaaacttgaacaagtcacttaacctctctgtgcctcattttctatcatcaaaacaggaaataaagcaatatcttacctttgaaattttgtgttttataaatgctagctatgtgtatg

SEQ ID NO: 58722 - DNA, 965 bp, Bovine  19866881263685
atgtttctgggcagctctggtgttgcgcaatgccgccaaggggaggggggggaaagaaaaagaaaaaaaaggaaaagaaaggcaggaaagaaaagagctttggtattctcagcctccacagacaattcctccattgatgtgtagtgagtcacggcgggccgccaggccatcgtggtttctgaatcacttcctccaagagaggctctccacttgttcctgggctggcttcagccagggctggaatgcgaggaggttgagcccttcagaatgcctctgactgctttcttcttttctggagctccaaccacagaggtggaaaggcctggctggaaggagatgggaagcaggttgaacctgcttattccaaggagtggaccctgcccccagccacataattgaaactcatgccccctacctggtcagagcctggaagtccagtgaaaacccagattaagggccatagtattctccagtgggcgccagactcagatctgaattttccatctcctccacctttattctctggctgatttggacaaggctgacaccttttgggcagagttagatgtaaagtggatcctggtcattcctccagtgagtaacatcagggtatcttggactgcatctctcggtctcccatcttgcaatttccatctttgaagacaaggatattaatggcctgagacaccctctccaggatgatggtactcaagtgagactgttttaagttcttgcttagaataaacttcattcattcaagaaagagctttaaccctccctctgggtcacattttgtgtaggcgccaggcattgtaagaggaaagggatgtggtcctagccatatgaaagaaaaatgggaaagcatgtgatgcaaattcagtgtggcaatgtgctcaggtggagggacccaaagatcctacacatacttggggtcagggtaacttagggagggcatccaggaaggt

SEQ ID NO: 58723 - DNA, 1688 bp, Bovine  19866881372181
cctgtaatgccccttgtctctgtgaggatgactttctgcctgggcatctgtccacacaatctttcttcctgcacaactcactcagctgaaatgccacctcctcctggaagctttctgtccatcccaggccacaccagtccctcttgtcttctgctcagcttcttttcttcccacatagatttcctaataatcagtttcttggtgctcactggcctgtgttattaaacagtgggggctgcacctggggctctagaaccaagtacagtgcctagaatgtggcaggggtcccccaagaatgtttgttgaatgaaggaatggatgacactacaggagggaatcaaaggtaatacaataaagggagacagggatgatatcgtgtttaggctgttggagtggggggtccagagtcccaactcctaagggtcacccagacaagaagaggggtgcagggaaaagtgtgatctgagaagccagaatgagactctgaagattcatagctgaagaggtgagtcacagggtcctgatacaggagacactggttaacacgtctctggagagggtcagcacccaaactccacccacagatgacaaacccagggcctggcatcctaacggaggtcagtggtacccacccctcctcctttgtcccccttctccctcctcttccttctcttcctttatcatgagtgattggaattaattcattgactcatgctattcattcagatgtatttgagggactacatgcctcaggtcctgtgctgtgccttagggtctgcagtcagcaggtagaggaagcccctatgtcacagaagcttacttctatcttgtgagatgagaagccaggtggtcctagtcagagagccatgggggcgtgcagcagacacacccggccaagcgaggcatactttccatgcttggggtgctgacagtcccgtcctgaccatgctttgcagagcaagagcctcagcgattctaatcatgcttggtgaacactttgaggtagttgactcactggcctcctagaaagccagatcacactagcaccatctccctttgaagatggtcctcactccccaagtgagtcagccctgaatccagccctggtggtgctatggatatgtctggggaaggcatcctgcctgagctgggatctaagaaatcaccacaagtcagccaagagaaagaaaggaaaaggtcttcaggtagagatggaaccagaggcaaaggcctggaggcaagagagcctagcccatcagagtgacaggaagcagagttgagacaaggggcaggggacagtgaaatccaagaggtaggcagggatgcttggcttgtggggaaggggagccttgttccaatacatggcaatgtcatttctcagatgggatttcactctttcagggcagtgatgaagacttatcactttgtcctgccagcagacctcatgataacatggggctaaatgagtaggtgccagagcctcaagaaagacctagaaagaccaagccttgcttgccccactaagcatcagactcaccagtgagcccatttcagttcacatcctatctgtgatcttcaaagttaagatttaatgaatctgtctgcctcacaccctcctctccagcccatcaacctcttccgggagttttccagggtgttttatcaggctcagctccagtgtgtcccag

SEQ ID NO: 58724 - DNA, 1175 bp, Bovine  19866881413129
cccctggcatcaggagttggctcattttggagatgacaaggtcggccatcagctgcttgtcctcttccaacgtgctctccaatcagaggcattgagctgtccatcacctgtgggcgagaaaggagtcctgaaggaggggagcttggcagctgagcagcgcatcccaggagggtgggctcagacctcaggacagaagtgaacactagatggcagtgttctccatgcaaatctccagcccagcgcctcggctggaaatgacccccgtggagacagccgatttcccgcagttcagtctaaatcaactccctggactcagttcaattcagtctgcatttgctgggccttagacatgcgaccaagggcggggagcctttgctgaccttttctgctcatttctttggggagccggtctctgccccctcctttcccacctcggcccctacccaggattggggccagcttcctgaactttggcccaaggtcaaggttttccacaaagccggaagcagtgaaggaaggggctcaattatgatcaaaaaatgacacgggttgcagtcaactcaagattcggagagaagagggaagaggcgaggcctgttctctggaactctagcagaataaactgcagagaaatttcagccttccacagggagaaggctgcttctcaaaggaggcacacttgtaattggaggggccctcagagatcaggggcttcccaggtggtgctggtggtgaagaacctggctgccaatgcaggggatgtaagaggtgcgagttcgatccctgggtggggaagatcccctggaggagggcatggcaacccactccagtattcttgcctggagaatcccatggacagaagagccttgtgggttacagtccatggggtcgcaaagagtcagacacggcagaagtgacttggcatgcatgcatgctgagtgatcatatttgtgcatccactcttttggcagatggagaaaccaaggcccagagatgggaagggcttgcccaaaggcatgtaggccagtgatccaggtggttccctaggcatggacagaggtagaaggtcttgggtgggttggtggaaggggtggggccttggtgggctctctgtctcctccccagctataggaacccagcctgttcccccagctcaccgccatctaattctccat

SEQ ID NO: 58725 - DNA, 1136 bp, Bovine  19866881438157
ctcccttccatcccattgcttcagtggaaaacatctagaacctattcttgatgcccagcaactaagccacctagaaataaaaatagctgaagctgtgggaattccctggtggcccagtggctaagactccccactcaatgcaaggggcctgggttcgatccctggttaggaaaagtgtattagtcactcagtcgtgtctgactctttgcaactccatagacggtaggctgccaggctcctctatccatggaattctccaggcacaaatattggaatgggttgccattcccttctccagggatcttcctgacctagggatcgaacctgggtctcctgcattggcaggcaggttctttaccactgagccaccagggaagcccagattaggaaactagaccccataggctgcagctaagagtacacatgctgcatctaaagatcctgcctgccacagcaaggtttggagatcccacatgctgtactgagacctgctgcagccaaataaataaatgaggaaaaaactagctgaagcccaaatgggaaagctttaatgggtcccaaatcgtttccttccatctgtttgcctgccaccctccctgcatctccatcatagggctgttatctttagctctcagaaaagctcaagtttgcaatggaccatcaaggtcatctcatctgaccacactttggatattggggtctgtttgctcatttcccttcaaactgccctcccacctgcgctctagtgcttccagtgatcagcactcatcacaccctgttctgtcctctctggctcccctgttatgtccaaactcttaagaccctctcacatgcaagaaccctcacgtcatctccagctgcacctctacccacaggccttctgcagccacactccaggtctcacctgtttgtaggtggtgttgctccattattttgcatatgctgttcccaccctcttcccttctctgactgacagtttcctacccattctctaagactctgagcaaaacccacctctgccaggagcattgacagctccccagagggtttcaaggtttcagtgtcccattctccaaacttctccagcatttctcattttgcaccactgtcatctgtttatgcgtctgcctccctca

SEQ ID NO: 58726 - DNA, 1333 bp, Bovine  19866881516082
tccttttcttttcgccatagtatgtcttataagccgggatgtagtttattcttctaaacacttcactggggtgtagggcctggagttgccatagaaacaccttttaactcctcatcatccagaaggcagcaccaattcccagggctttgggggagggggggggggaaggcaaagaagagacacttgtggatgaggaggaaggaaatggaaggctgtggggggattccttagagaggggctttgcccagcaatgtggcacccagccatgaaaagagccaggaaggttctggaagaggaagctagtgggctggagtgagcatcttttaaggactacagtattgactggtagagtcataggggtcaaggggaatgggagcgtctacacatttccttcagggagagaacaggcaggctgggaaccagaagaggagctgtgagctaggagtactgggagccacctactggacgctggcagggcgctgtaaggcagtggaggtcaacaagccagcagctcgcatctacacctcccagaaaaagcattatctcatccctgccactagtgcagtgcaccaaccaaggcagcacagctttggatcagggccagcagtgccgaggtctttttgtttctttttcatttttgctaccacaatgttcttgcctttcggtatttcctggtaacttcgcttttctctaggcagtcaattgaggagggggtcatgggaagatttcttactaaaatccagcaaaattacaagaaactttctgtatcagtcccagacacatagcaggaaacctaagcagtggtcaggcagggccaccatgggaagtggtctccttgttcctgtttccactgtcccctggcgaacttccagggtagaaacctaaaagccaagagcaagggaaggcatgaggtctccctctccacacacatcagaaatccaggtgaacgtgcccgaaccactgtcaggcagaggacgacgccctgactccacctgacgcctggacccaagtacgtgctcttcactgagaggaccagagccgccaccaccggcagcagctgccagcatcacttaggtgggaatgacacccacagggtgagggggaacaggccaagcagaatttgggtgggggcagtcaagggagacgaaaaccttgcagggctctggcagccccgaagaatccttcccagcaatccacaaacccagaggccagtcaggttcccccaggagaaggaacggggcatagcaaggaccccaggaaacccctaatggggtgaccctaggtcacacaaaatactcttgcctgccagccagactacccagtcaccacagcc

SEQ ID NO: 58727 - DNA, 1206 bp, Bovine  19866881521388
ctgctggacaagccgcctttggtcttcctggaattccaacacctgagcactggtagcaatcattttgcttctaaccaatgatgggactcccagggttgaggtgacaatctgttagcctcagctcatccctgtctgtggtctcacctccccccttcaccaccagatcagggaggttttcatcaggtctgcagtaagagcaagcaaaacacaatcaggcaattaatctgtcagccttaatttagctcagctgacttttcgcttaatgctcataaatgtggtgccttcgattctgggttccatagtaacctccttctcccaaagcaatgactcatctctgtagaggttgcccttcggtgcaagagaagaaatccagtgctctgggaatgcgatgggtgtccagagttgcatgaaacatgctgtttatagcatctccagtgtcaacctagttcccagacaccagccatcgcctcgtccccaaatcacccctgcctaagctgccatatctgagacaactggacaacagacgcaagtgtccaccttgtggtcactgcctgacatcacagcctcctgaccccagctctccccagtgaagccctgagttgggcatgctttcagaaagagagtctgcaggagacagcattctgttaggtgttgtgtgaggtctcgaagctgaacacctaggcttgggggcaggtgacaaagaaacaaacccacaagacgtacttcctcctgagttccccgccagagcaggccctgaagagttctccagcccattcagactctgacaaacccggaggcctcctgagacatcagagttttctctcaaccccgtagtctctgtttcgatcacatttttgttacttacctgagacaagattctggaatacgggaaggtggccttagagtcagagagacctgtgttgacgacaggatctgctccgtaaggtgtggtgacaattaagtgagataatgtgtacaaagcactatgagtttggttccttgtgtgtgtgaaggtcttagacttgtgatgataatcacactgttgatgacagtgaaaccagtgtgatgagattatcactgtgtctgtgggtgttcacacgtgtgcgtgcacacgcacacttatctgttatgtagatgtatatttcatacagtctcgtgtgcctagatatgctatcagccttctgcccatcctggtcatttccacca

SEQ ID NO: 58728 - DNA, 800 bp, Bovine  19866881596527
tttcttgagaactcctgttgtgcctcctgattacctcctaactgtctaagtgctccccaagctgcacagcacttcactctattttgatctctctgccctgtggcatccactattctttgttgtagtataagagggtccatctcttgacttggagtctctcttgtttgttagaattccttagatctccaggcacacgaaaccctgtggtttccttgatgtggaacctcttttcatccttccaccctgcaagtggaattaagctccttccttcaatcatctctacacgccctgcacagccttccatcagatcctcagcatgtgttatacttatttatctaagcaattgtctcagttttttgagagcaaggactgggtcctattcatcctcttattgtcagcatggagtaggcaccgatcaatacaaacaaaggggaaaaacagacttgaggagggtcaggaacttcaatcatgggatcctgggtgaatttccaggaagactgagttaattcaacagcctcttcaccagtttcttcctggaaatgttctccttgcttctctccaggcagacagtctttcttctggagagaaggtgaaagtcctgtaaaaggtaccgtcctgtttttctcctgttcagccatgaatatgacatcatcttctcagttggcatgtccagaccatttctgatacttttcttattccaaacagaaggagaaaagcccctttcccttgatctcagcattttttgcaaacctcagtttattccagccagtgacacttttcatccttggagatgagccctc

SEQ ID NO: 58729 - DNA, 1696 bp, Bovine  19866881624396
atatgtaatattacaatattacttggacatttgaaaatgatcagagaagctattcattgtcatcagattgctgcaggggattatttttattgtgtagtggcaccctttcttcacgtgaaattatttgcaaaagcctgatttatggaatgaacacaagcagagccagttttgttgaactggatgtgaggtgaatggacccccgccagctcagcccctacccccctctctgcagctgctcctcaggctctgtgccgaaacttctgggctccaaaacagtgctttttggccaccattgggttgttagggactcctgtttctggcttcttctggagtggagcttgggttctttttccttgggttttaaatccttggagcctaacctgtaagtagacgacgtcttccaacaacaaagtacagtgctttgagtgctgctcaggtacttgttctgcaaagaaagcctcgtcatttgtagaatattttgcttttgagacttaaagtacacaaaattcaagttttattttgcctacaacaagaaaaaggtcaaacaaatatctcagcatacaaacaaccatagaaacatgctacagtgacagatcagtctgaatcacaaagcaggagtaaaactctgctagtgtctgcagaaaacaggaatattgccagcgtcatcctgcttttttaaaaatcggttttgcatataaggaaatggcttggaatgctgtgtgatgcaagaatgttagagtcctacatacatgtgaatttttgtctttttgggctacacatgtgtattcttttttttccccatcacagtgaagaaagttcagccaataatattttccagaggccatgtcacctttagtggcttaatgtacaggtaaaggattagggctgttgacactttcttttccctgtggaattttgtaatatctgagctatagattagcttttaacaaagtgtccaccagaggccatatggctttaattgggtctaggttgaaagagtcaccctgaaacttcgatgagtccaaaactggttctccagcacccctcttcatggccttataatgttgggatgcgccgtgtgtggtgtgtgtgtgcattgtttgggtgccctgtggtgtgtgtgtgtgtatgtgtgtgtagtggggatggaaggacatagtcataaccagaagcaccatgtactataaaacagtttccaaaatgcggtcctttttgagtggtctcggagaggttcgtgagccatgctggtgtcccaaggaaacagatgctacttcccaaacttatctcagacttactggcccatgggacagatcccgctcagcttaggataccagcagtgtgtcacacacctaaacttgcagtcctctcataatagtttattctgagttcttaaaaccaccatcaaagcttttcctcttaactagctcatagttagaagcttataaaatccacattcttctccttagactgagactgttaagctgtatgttgctggtgaacgatggggatgaagtcatggtgtgggtgtggcctgtttgctgcatgactttctgacgtcactgatgcgatggatgagcgccgtggtaggtgaacctccaccttgctggcttgtagccttaaggactttcctggcccctcattttcccctttagttatttttattaacagaagcttgccaaccaccacctctgcccca

SEQ ID NO: 58730 - DNA, 1432 bp, Bovine  19866881685668
catcaaatatacatgatgttcctcaccaagcacttggaaaagctagtgaatcgaattgtgttaaaaagcatgaagcggctcatgactgtgagatggggaggtaagcagaggaggatgtggacttttgacttagacctcactggactctgatctggactctgccatctgctagcattgtgacctggagcaaatcccttgccttctctggggtaattcagagcagatgagatgggatgagcaaaggcacaccagctgttgcagaagcatcagtgccttcagcatctcctctaaccgtcagagacactctgacagctcttcctgattgcagctttgcagaggttccaagagctgttttgcttaaactcacaggtaagtgacagaagcagaattcgaactaaggttgtcaggtccctcagcccgcttcttcctgctgcctgggacccgcaggaacgccctggtggaatcatcgcttcctgttttaaggccaccagccaacttaataagagagttgatttataaagaatttcacagggttccacccaagaaacatgtgagtaccttggaggccagcactgacctttgcctatgaaccactcttgtctgctgaactgacttcatcccaggcctaaagccaagaataagcacactcatgcaagagaatgagaagaagagaaagaagactatcagcccctggcacagtgctttacaatcagggtacaccccagccacctaaaaggccccattttgtcaagagggacagagacatagaaacagtctcctctggaaagatatgctacctgctcagtgtgcactgaccgcaccactcctccatggaaaacagaatatttctgagctgacaaacactgaaaaacagtaggatttcctctttcttttttctgctttcctggcagtgtctgttgacccatcttggctttgtattcaagaaaggtcagagaagtcatgccttaagaggctcccagaaggaggagggggcgcacgctgcctgttagagtgagacactgtaatttcccacaatctgatgagcagctccgtacttctaccccagcttgacagtcaatttgcaaagtatttccacactgggagcctgcttaggctcaagccatcttttgatgagagtattgttatcatgacacccatttaacagatgagaccagcagaaatcaaggaggcaaaatgattgggtgtatggtcacacactgcattctgtgaatgctgttcattcttttctctggtcccggaacccgtgccagaggagggaagcctccagagagctcgccagcccatccagaacacagcctgtgtgtccactgaggtcttcctcagccaaaatgtgcaggcgcagcccattgttgctattagtgggctagagaagtgaggcctaaacaagcaggtgcccccatgctcactgcgg

SEQ ID NO: 58731 - DNA, 776 bp, Bovine  19866881758316
aatccagttatgtccgatatcccagcttaaacttgccggtacttcccctaggcagacagcactactgggcctatattgtgccttggaacatgatcctaaatattcttaagaaaaaagaggtctacaatcaaatgagaatggaaaatgctacatgtcacagccacctaacctcaccctccatatccacaaaatacattccagcattataaagctctgagaagtccaggaattacagaaagcatgcccaacatttaaccaagaaacactatcctccttcctcaacactcagcagtccccagtaacacttacttttaatctcatgagacaagttttccatagaggacatgctgagaaatgcaggtctacaaaataaagtccaaactcctaaaccccttagcgtacaaggcccttcatcacctgacccctgactctgtatcaagttcacgttctgcagtccctccctctccattcccccacctcttcaagtattacaatagactatctttctaccttgcaaaggccttgattattgcacttcacccacccagtactgcaattttctgatttcatgtctatattctaccatgacaaaaagcttagaaaggaatagacatgtcacccgctgttgtacaacaggaatagtacctggcacacagtaggtacaataaatgcttgctgaacaaatgatgaaagataatatcttacaatttcatgtttttcagtgttttctaatttaccccaaataaaaataggcaagacagatgaggcaagacacc

SEQ ID NO: 58732 - DNA, 731 bp, Bovine  19866881761374
tctataaatgcaattcagatggagtcaacgttgtttttgttttcaaatcagaccaaacccgtgtggatcagttggaacctgagtcaaaaccctatgtgttctaaaattaatggaccagaacaaaattggaaaataaaaacatcttttcaatgaaaactctatttcactgggtttgttgggccaggaatcttttatatcttttaaaaaaatgggaaaaaatccaaatatggaaacactaattactcattgcaaaatactcagaaaaactgaaatagtttaaaaatgaatgtcatttgcaatctcatcctgggatatttccataaaattttttgatgtgctcttcctcaccattttacataactgtgattattcatgtaataataaatatttccttgtcttgttaagaatatctcatggcaaagttccatattgatatttagaaagctacatcattatttttaatggttgaaaactactcactggatacattcgggttcatttcactaattctctactggcagttatttaggttactttcattatttcagttttgcaaataatgcttcagggaacagctttgcacatgaatctttgcaccctgggctgattattttgcataaattacccaagtgtttctaagtcaaaaatgcacatatattttaacaactttttacacatatttccaggtttctcccctagaaaggtcataacaattttcactcccaccatca

SEQ ID NO: 58733 - DNA, 960 bp, Bovine  19866881943401
tggtggattataaaactctttgtggtgaggtttccaagggtggagatggggacagaaatttccggggttctcagccagcgattctcagctaacacttgggtggaaaatgccaaggtgatcggagacggaaaacagaaacccagggcagctgaccacggcatgcggctcagaggctccttggtggcctggtccactcaggggtggctcagtctcatgcagttctactctggtcacctgtaatcttactccccaggacacactcctgtgatacccttctcatttatcttcccttccccccaaggccacctgcagccatgaaatcccaatccagttcagcaaaacacaaaccagatgcactgtcccacacccatgacctgacacctgtttaattggtgttcaggcaggtgggcaaaagaagagcgaaataagggaacacacatcgaggggctcattaagggcacatagggttccaggtagatttggtgatgccagggacagaacacagaagtttgctcagccttgacgagagaggaagctctttgttctgtctccctctgccatgttttgcttttctgctcccattatcctattgcagaatggggccaccagtacctgctcaacctttgtcgaagctggtgtgtgtgtgtgtgtgtgtgtgtgttagtcactcagtcgtgtccgactctttgcaaccacatggactgtagccatccaggcttctctgtctgtggaatactctaggcaagtatactggtgtgggtagccattcccttctccagggaatcttcccaacccagggactgaacccaggtctcccacattgcaggaagattctttaccatctgagtcaccagggaagctcatcatagctgctactgaggattgaaggaattgatatggatagtatcaccattgtaatctgcagtgtgcgcagctgatagccacattcttcctatttat

SEQ ID NO: 58734 - DNA, 809 bp, Bovine  19866882018473
ccgctggatgtgctgtagtttacatatttgttatcctgtggttgaacgttggaagactttccagtattctgctagtgtaaataatgctgtgataaatacatttgtccaagaggctttttctgtaactcggattgctttcttggggtagaattccagaaaatggaaattgtaggttaaaagggtgtgctctaattagatgttgccaaattccttgccaaaaagatgtcctactttgcactgtccccaggagcagggcaagaacgggctttattggtttgctcttaagaggctgaggtcgtttccactaatgtatttcttggcctgtttccacaggtgaaaaaaaagacagctgtagctgacttgtgtgggactcccttggctcttttggcccaagaccctaccactccctgtccctggcagcctgtattctgggcctcacctagacagcccgagtgggaacaagccatctcgtccatcacagccatgaatttcctccggcggcgcctctctgacagcagctttgtggccaacctgcctaacggctacatgacggacctgcagcgcccagacagctccaccagctcacctgcatcccccgccatgggagaaggagggcaccctcagcccctggcagcctccttctcctctccaggatccagcctttttagctccttctccagtgccatgaagcagacctcacaggccccctcggggctgatggagcctccgggtccctccacgcctgttgttcagaggcccaggatcctgctggtgatcgacgatgcccacacagactggtaagcagcaat

SEQ ID NO: 58735 - DNA, 1302 bp, Bovine  19866880518798
attggcccaggccacaccctgtccaccaaccatgagtcctggctcatctctctctgtgcttacgtttactcccaagcacctcactgtagccccatctcattccttatcatgaatctccagtcctcaacaaagtaggctttcaaagcaggttggaagagggaaggaatgtcatgggggtgggggtgggggtgggaagcataaaagagaaaaagaacagcttctgggctgcaccttccccaatacctgacctctgcccagcctgtgcagagttctggggcttcaggaatggatcaagtcaggccccattcccagggagctcccaggctggagaggtgggccttgctgtccatcactccaaacgttagcacttagggctctggactgcagcccagaaggggtagcaggagccaagtttatcttctctctacccacaggatgggcccagacttgcaccctggagatagccaagcccctgccccatacaagagggctcttccctccagagacagaaagctgagcttctcagcagtggaagggaccaagcgaccacctcagccaacccctaccatcaactgcacagatggagaaagtgaatcccagagagagacagacgcagactggggagtagatacctggcacccgaatgtggggtctaagcaagctcgccatgtgtttcccagctgcctgatatgtggcccagaggacacggcccggcctgggaggaataactctcctgccccctctgcagtcactagctcccagacaacagcttgctttgtctggagccagtggagaagtgcccaaggtgggtggagactcgccagcgtggggtgtgtggagggaagaggaaaccccgaaggcaaggggacagaagggaaagggctttggcatccggctgatctggttctggccccccactctgctgcttgcttgctgggtgaccttggatgtgtcacttaccctctgtaagcatgtgtttcctcacatattaaaaaaaagggtgagagtgtgcattctcatcaggccagtgatgcagagctgcagtgtgaacctggttctttcccttgccctgcctcctaccctggggttggcccacatttgaacctaggactggagagaacaacagaaacaccaccaggaaactccctgcagagggagggtcaaacagcgtatgggagagaggttacttccaactgggaggatcagtcagggaggcttcctggaagaggtggcatttggaagagttagaaaacaaggcagatttcaccagaatgggattgtgggcaggtgccttcctttggg

SEQ ID NO: 58736 - DNA, 1200 bp, Bovine  19866880833023
tgtgattctttccctgcttgttaggggagtgaagaaagaagacaagactctggctgtggggatccagttcatgctcatgagagttttgggtaaagaacgtgctggggaccactggtccagataccggctatgtgccaggcctggggggcacagggatgagtgggaaccagtccctgaccttaggcttcaccggtccacggggctccaaatctgacctaggtaccctggatgtgggtgcgcaagcagctaaagagcccatcagggaaatggcatccaatacgagggtgaggggtgggcttgaaggctgaggacttaatgggccaagaggctcccagtggctcagagccccagtggttcagtgccagggacggggcggggtgaggggtacagggatgccaaggttccactgtcccctgagcacctcctccttcagcctggatgcccagccccgtgatccacggcagtgccatcgacaccacctgtgtgtactgggcccatagctgcgggcgtcaggccgtctgccgctactatgaccatgacctccttcgaaaccggtaagacctggtagtcaattgccagggggctatagggaaactgctaaaaatattcttggggtcccatcagggaggggaggtctgctgacacccacctgcaaagtgacacgggctctctccagtgctaatccccaggcctgccagctagatattgtctcccctttggatggatgaagataatgagatttaagtaagtggcccaaagtcatacagctgataactagcaaaggtgggctgagtgaggggagactaagggaagtcaagcagtggtgagaaagacaggaagttggcatggagtaggaagatggctctatctaggacactggaggcctaggatccaggcccagctctgtctccctcattgtgagacctaccttttttgggactcagtcttcccatctgtataatggggagcccaaaggaacctgaaggcagagaggctactggccctgagtacaatggacagttaaggagagggacttactagcagatctggaagcagggagctgtttacttccagctctgaggagtgcatggttccaggagggcttcctagaggaggaaaactcaaagaagaggggtgaattagagaagcaggaatcctcttgtggcaggcgaggtatccagagttgcaactaacaggctc

SEQ ID NO: 58737 - DNA, 1610 bp, Bovine  19866880852028
accatgggccttgggttgggaggaatgtgacacatcaccctagggagagacaatttcacagaaatcttgaggggtggggagagagtgttctctggacaacagccttctccaaggcggaaaacatctggtgggggaggggctgggcacagatgaactctggtctccaaatccacccagaggagcttgtccaggcctcgtggctgggctgtcagcccagaggcagaggcctgtggatccggcagcaactccacagtctagtatcatctgctcccttctctaccctaaggtccccaaagttttgcctttgatctcacttaaacctctctccctactgttaagttggcttcctctgattccttcctgggccagacaattgtcaggtgcctgaaaaggtgaagtaaccaaaaggagaatggtggggaggtgcgggtaatggggaccctgactagctctaaaatcctccgtgaaccccagcagagagccccgctcctcaagggtgggatcggaaggagctgtgatggggttgcacgtggcactaggggaagggtttacattagggccgtgagagagggggagtggaggtgagaatctccctcaattccccaccaccttcccccgcaccgtggctgtgctgccagggccagtacctcattgaaggcggccagcagccccgatgtctgactggagaggccgaagcgcttctccaccgtggagatggagctcttgaggtagccggagatcatgagctgtgccagctgcagcaggctgtggcacaggacgaagaactggtggaggggccgcaggtagagacagtcgtggcggaggatgcagagagacagagacagagaaagggaggaacagagtcagaggagacagacatacaggaggagcaggagcagagagaggaagggaaagagagtccagggcaagaggagagaaagtattattggggtagtgcatggattctcacaggcctgaaaaataggaaagctgtcctgggtaccccgggggtctgggggagacttgaaatctacaggactgagagtagagtctgcatggggccaaggatggtgggagcccctctgtccccctacgtctcccaggctggactagaacccctcctgtccccaggaagctccccagatctcacctcgccccaccccacccagtcctcacctgaacttccctgggagaccacctgcacacagcgaacccccaagctacactctcacctcactcagccccacgcaaacatcctgcctgcctgcagccctcctgaaaacctgatcgaattcccaagagaaaaacgtgtctcacagaattaaaaatagggtgtttatgctggagcttaaaaatagaatgtctgttctaagtttcggtttcctcatctgtgtaacaaggatgacacccctgcttccccaggttactgtgagagctaaataagactgtgtggaatggcccctggcacagggcctggcaccgtgtaggtgctggcacagatttggttgtttacggccgcccttggttgagccattgctcccagtattcacacaggttcaggataccctggggtccttctctttcgccctaaaaaaattggcgccaaaaag

SEQ ID NO: 58738 - DNA, 3148 bp, Bovine  19866881067680
tgtgtcatggttaaggtcatggactttggaaatagtgtgaccttgggcaagttacttaacctctttgtgccttggtttcttcccctgaaaagcagagatgctagtagtacctacatcataaggctgatgtgagaatcatagaaactagtctgtgtagaccacttagaacagcgctggcacatagaacatagacacagtgtctgctctttgtttactgttattttttgattgttattattaaactggtggctagaatgattcttggggttctcagacctgcatgatggttaaaatcacaaggggtgcttatcaaaaatactcagccttttccaagatcaacttagaactgccaccggagggggtggaaaggtagccaaggaatctgtacctttaacaagttccctaggtgattttgagccccatctaggtataatcaggacaagatgaactcagatatgggcttccctggtggctcaggggtaaagaatctgcctgccaatgcaggaggcacaggagatgcaggcccaatccttggatcagaaagatcccctggagaaggaaatggcaaccaactccagtattcttgcccgggaaatcccatggccaggcgagactggcaggcaacaatccatgggattgaaaaagaattgggcacaacctaacgaccaaacaacaacaacagtcccagatgtgcctccctactggagtgcccacctctgccatcagacctcttgaccccaaggctgagttaggtacctccttcttcaactgccacagcacctgcaaacactttctaacagtatggatgcatgacaacatcaaccccatgagtggggctggctcccagatgctttgtcctgagagcctctggaaccgggcccagaggacacagtcagcactcagcaaatgcatctgtaaaagtgggggtggggttggcttttgtgcaatttcctcctccacttattattcccccatcttgtgttccaggctggtgggaattcacgcacagccatctcagatcttccgcttctcacatactggtctgggcttgcagtggatgtgacccacccaaccagtgaaatcccccagagagacagaaggaatagcgagacagcaccttggttcacagtccacaggaactccatgtctgcctgtgaaggtgtcagcaccaccaggatatcaacagagccagaaacatactcccttctccggaactggggtgtgtctggcaaactgagtcctgacttttaggactgtttcatcaagggagaatagaattgtaactagagtccaagctgggatcctgggcccagatttctagaaggaagggggttggggcagggccacccctagtgactcctgttcagagctgtccagacctatcctgactagaggcacccttgggcagaagctggataacaagaagcggaatctgcctgtccatcttcttgtgtgtgtcacctgaggcttctagggttgctggaaaatctccaagcgagggatgggacatctgagcagcaggatgcagaaggcagagctgggggcctggagctgcttggcgtgaccagcaggcagctgagacgccacagtgacctgttctagaaacaatccactctcactccccacagaacgccagagctctgagacccccaacactcccccgtcctgactgtcttcgaaccaagcttcagttccacaccttgacccaccctgaccaccacctggattagagactccttttccccaaatggtgccctcagcataggtggccaggctttgaggtggtcagaacttgaaaggtccttagaggtcaccccgaatttcccctctgagatggcccaagttactgagtcctgctccaaaattctctccatcatgccagtgtcctctctgagtcctgaagtctgtcccccataaagatgggagcacccaagagaccaagagaatacatggccctgtctgtcccatagtgtatctgagcagagggctgagggcctggggtgcggggagtcagggtggaactcggtgaagactcataacaacaggggcaacaattacaactctccatctgatggcaactgctggctaatctccacattctcactgcattctgattgcagctttgggagatggacagggcagagagtatctcaaagatggggaagctgaggctcagagaggttaagaggcatgtcccaggtcagtggggttgctgggtcctctggttcagtgtctcctatgataccagcagtcgatcaactgtgtctgtgtggccctggggacaactgtgtgctctgaagctcaccttctggcattcgatcaatgtccacgtaaaggcgcaacatgaggctgcccagcccataggccatgcccggccccatcatggtcactgcaaacaggatacctgcgacaggaagcctgggttagtgccctctggcccagcttcctttcacaggtcagggcctgctcagcctccactgggcaggagcagcccatctcccccgctcaggcctgggaagctctccagggctcctctgggcctctagtggccacagaaggcagagggcagggattcgtacttagcccgacctgagcctggccccccctcagagcccgaggtgtggggtacatcctcaccgaggtagaggggcgagttgctgttgtgggaaaagtcatcgatgtaggagatgccaaagggctgaatgggcaccccgcccacaccaactagggtctgggctgtgaacatgatccccaccacagccaggtgccgagcctctgtgtagctagagcagctgctgttggatgaggctgaagctagggccttggtgctgggcaggcacagggaagcctcaaagtcttgtggcatgtctgctgagagatgataaaagtattaggacaatagctaagactcatacagcacttactgatgggaggaactcttctgaatccctcctgacccccacaacaaacccaggggatgggtactctcattactcccattttgcagatgaaaaaactgatgctccgtgcaccaactaacaaggggtggagccaggattggaacccaggcagtccggttctgagtccgtgctcttaacccaccctatgccacatctctgagcagaggtatgggaagcgccaggcgacg

SEQ ID NO: 58739 - DNA, 1084 bp, Bovine  19866881090330
ttgcagcactcagccgttgttacttatcaaagagactctgtcctcactaggctatgcctgttttaagggtggggctcacatgctaagccccagggtccagcctgatgcctggtccccagcgaggcactcaatacctgtttgtcccctcactgtccctgaaaaggccatggtcatttctagagccaagtcctttgtccaggctgtttcccacctcgaatggccctccctctccttgccatgcttccacacaggcttcaaagtccagtggaatccccctctcctcagagaagtcttctagaccctcctgtaagctctccacctccttctagttctcagcactgctgaagcatgttcacaatctactaagcacgttcagcgacaagcagaagcagtagggtagtggttagagcaaggggcgtgggctcagataggctttgggttctggtcccagcagtacttaaccatgacacgcactgccataaggttgagaaagtcaaggcccaggaagggtcagggacgtgcccaaggtcacacaagacacaactggcagagccacagctgatacccagatctccttgggtgggtcacttccggctctggccctccatcccctcagctgtgcaaggggcaggggagacgcaccatgcaggaatgctggggaatgcgacagagctctatggagatggctttggaagctgtgacttgctgtgcccaggagaacggagttgaaggttatacaggaggacaagcgtgtgggggttggagcttgggttaggatgggacagggaggggcttaccttgctgacaggtgggtctgaaactgccaagccctttcgccggaagcgaagctcttgcttctccttgggcatctccttggggaagaagaagtaggggatggcggccagggccaccgcgccagccgagatgaggaagcccagccaccaggcacccacccatcgggggtccttcgaggtcaggttgatgccacctggaagagagggtgttagggtcgggatgggctgtatgtagcttcttggccaccattctcggatcagcctctgaagtaggacgtgacctgggccgg

SEQ ID NO: 58740 - DNA, 1207 bp, Bovine  19866881166013
ccaacccagggatcaaacccaggtctcccgtactgcaggtggattctttaccatctgagccaccggggaagcactaaacaagacagaagttctgattcggggttaggacacatgggtatatctactctgtgctgtgctcagtcatgtccaactctttggactgtagcccgccaggcaactctgtccatggaattttccaggcaagaatactggagtgggttgccattttctattttaagggatcttcttgacgtaggaaatcgaaccagggtctcccatgtctcctgcattggcaggcagattctttttcacagcgccacctgagagacccagacttcatttatttcccattcatgacactccagaagctcaaatccctgtccttgactgtcctactacccgtgttttaacatgggatccaacccacactctagaatgaaattgaacttctagccctgtccatgctgctcttatttctctcctctattggagcagtaagtagaacacatcctaggaggacccagaatctgtgtttttaacagggacccaaatgattcttattcaaccattctgcagaagggaacactgagattggtgattgagacaaggatgccctctgctctactttcatgggtcctctcatccctttgcaggtggggaacacagccctgatcgtgtttgtgagctatttcggcagccgggtacatcggccccgcctgatcgggtgtggagccatccttgtgaccctggcgggcatactcatgactgtcccgcacttcatctcagagccgtaccgctacgaccgcaccagccccggtaagaacaggaggggctgggctgagggtggacatgagttgccacattactgtacacagggtccactcccaggcttccagtggtcaagatgggtccagcttcccagaacacctatagtcccccaacaccccccccaccactgcctcctttagcttcagcccggatgagtccttctggcagccctgggcagtggtgacagggggggtagtcctggggcagaaagctgaggccctctgtgtttctcttggtgagggcctgcttgtatggtgctgctttttttttttttttttttttttgaggtggaggtggatttaggtcctggtctgtgtgggtcctcaagaaatatttgggaataataataacagtatcacacaccacttactaggtacca

SEQ ID NO: 58741 - DNA, 2653 bp, Bovine  19866880350389
acttctttagcctgaacaccaattccgtaatgaggctgaaaccatggcatgattgatttacagaggctgatgttagctgcttagattggcacgttctagggaccctccatgaaatgattttcctactgactgctatcactttatggtaggtgaatagtaaagtccacaagaagccctctgacatacttctagctttcaattatccacagtaatgaggagcaggcaggctgccctaatagttctcagtgaagcatcaagttctgatggcctagaaataatagcagtctctgggtccatgcacccatggatcggttatgtcagtggtactctctgcagttttccagggtagtgggtgggagagtagcacccacctgctgaataacccatccatacccactggcctcctgatgtcaagattcaaaagaggactccaagaaccactgagagctcaagtatggaggcaacccagcacgtctgctctgcggagacactgacagccctggcactgaatcctgtccaaggacagccttcctccagcctctgcatagaattcttctcagcgtaaggcagaccaactgttgatgaatctctgatgagtggaggaacggctagcagtggggagaacctgctgtgaacggggactctgaaggtcagggatgcagtgggtaggccatcccaaagaaacaagtctgctggctgggtccctgtgggaagatgtggagaaagtgctttctcttcacttgctttcttattttgttgtgtctcaaagcactgtcatggcccaggacatggagctagcacacttatttaagaattccctttttttttttttttgataaactgttaagaaggttttgtgtgccagagtgggttggatgttgggacatatgtgtaaaaaccactcagtggattcagaaagacactgaagctgggagtgaataacatgacaagaggtagtcttagaagtcaaataaaaattgaggaaagctactatatcacacagggaactctgctcaatgttatgtggcagcccagatgggaggggagtttgtgggagaatgcatatgtgtatatatatgatcgagtcccttcactgtgctcctgaaactatcacaacattcttcatcggctatgccccagtacaaactaaaaagtttaaaataaaaaaataataaaaaaaaaaccaaaattgaggaaagaactttttcaagtgaaagtttgtgggaaacatcctgttaattaatgcaaatgaacaaattgatttggatcattgatgatgaaatagcaataccatctaagcttgcacaggcatgttttccattgatcgtctgatcctaaaatgacccttgttaagtgcgattgacaaggtaataggtcgggtgactctcccaggtaacacagctagagagagaggcctggagaggcggtctgtagggtgaaaagggcactggttaagagtcagaagatctgttttatgatttgaatgaactaattaattcagcaacagtaggcaagtaagggtttcccaggtggtgctagtggtaaagaatccatctgccaatgcagaagacataaaagatgcaggttcaatgcctggatccagaagatcccctggaggagggcatggcaactcactccagtattcttgcctggagaatcccatggacagaggagcctggggggctacagtctctggggtcgcaaagagtcagacacgactgaaacgacttagcacgcactcacacaagcatgtaaatcacttaattgcttaaaaatttcctcactcataaaacgaggaggcttgtgagattaattgccttcaaccctctctgcacttgatctttccttcccacaggagagttttaaaatctattaaatcccagatgttagaccaccccagctcgactgaatctgaattttgtgagctgagcccttaagtatcgtacctttgcttgctggtttgtttgcttccaagttgcccaggagaacctctgaattggatgatttctgaggtgacttccagctcttccatttgacattattctatttcccaagtcctctatgtagggccagatttttttgataatttttatttatttgggtgcactgggtctcagttgcagtgcacacaggatctttggttgaggcatgtgaaatctggttccctgaccagggatcaaacccaacccctggcactgggagtcttagccactagaccaccagggaagtcccagagccaggtattttaagtccggctactttttgttgtgttggttcctacaatgtgaagacttggtgagaaattcagtggacttgtttgctcacaagagcaaacaggggacaggaatgcttgaacactgatgcctgtctcatgctactgatatttccactaacatcccaaaggctcctgaaaatgtcagtctcatgtaaagtaagaactcacttgtgtaagaggaaaacagtaaatttgtgttgaaacataacatcagtttaaggaaaagtcaaaacagagcaaggaacaactgtcatttttttagttatatgaatgtactgaaacttttctggcaagaaggatgatctttaagaagaaatagaacttcaaatgtcacagctcattgaaggagggagtagaatcctcacatccctaggaata

SEQ ID NO: 58742 - DNA, 1733 bp, Bovine  19866880371353
ttatttcatggctgcagtcaccatctgcagtgatttgggagccccaaaaaataaagtctgacactgtttccactgtttccccatctatttgccatgaagtgatgggaccagatgccatgaccttagatttctgaatgttgagctttaagccaactttttcactctcctctttcagtttcatcaagaggctttttagttcctcttcactttctgccataagggtggtgtcatctgcatatctgagattattgatatttctcctggcagtcttgattccagcttgtgcttcttccagcccagcgtttctcatgatgtactctgcatataagttaaataagcagggtgacaataaacagccttgatgcactccttttcctatttggaaccagtctgttgttccatgtccagttctaactgttgcttcctgaccttcatataggcttctcaagaggcaggtcaggtggtctggtattcccatctctttcagccatattaagatacatatattgtctctgcataagtgggaaggagaaacagagatagcagttttccttggagtgtttaatatctcccccctcataaaacttgtaacaatttaaaaggagaataggaattccctggtagtccagctgttgaaaatgaaagttgaaagttagttgtacagtcatgtctgactctttgccatcccatggactgtagcccgcccggctcctctatccatggaattctccaggcgagagtactggagtgggttgcatctcctccaggtgatcttcccgacccagagatcaaacccaagtctcctgcattacaggcagattctttaccaactgagctactacagtggttaggactcagtgttttcacttcataggcccaggtttcatctctgattggggaaccaagaccctgcaaactttgtggccaaaataagtaaataaataaagagataaatgaaaagaatagcataaaccaaatattccttgaacatattcatttacttgcattataaacattgcttcagtaaactagatctgattggctggagaaaatgtaaagtatccttatcactgttgtattaaagggtattttcctcaactgcaaagcacaaatgaaagtttttatacaataatcttaacaaatttcatgaatatcattccaaagtccatcatctgataagagaaaagaattttctttctcaatgtagtacacatttcactctgggaggagtcagcaatttctggctccaaatactaaggcacattttggcttgtaccccaaaaggtcatgtcattcttacacaacttaatcatcagctacatagagaaaagcaacactgcaatttttctgatcattttagtgaggacgactggctcaattatatttgagcaagtcagttatatttcaattcagtcattgaaatgtaattgactggttctcctcttattttcataatagacactactacctagaccacatttacttaactataagaaatgtcaggaagaattggaacttttctgagtgtgcccattaaagctgaaaatatgccatcttgtcttttacacgagctgcaaacattttgcattggtctcattatgcaatacaatatgcaaatattccagttgcccttctcaccagactgcaaggccaggacaatatgcacaccaaaaatgttttgtttgatctttgttaacttgattaatatgtgtcttggggtggtttggccttgg

SEQ ID NO: 58743 - DNA, 1996 bp, Bovine  19866880539871
ttcatcagcagatgaatggataaagaagttgtggtacacagatacaatggaatattactcagtcataaaaatgatgcatttgagtcagttctagtgaggtggatgaagctggaatctgttatacagagtgaagtaagaaagatagaaacaagttttgtatattaacacatatatacagaatctaaaaaaatggtactgtctagacttttaatgatccatgtcctctcctcaaagctctgtttcaagatgttttccatattgttgatttccttctcagtcactctcctttgcacttgagacaggcgtttccggaaatttccactcagcaggatgtagagaaaagggttgatgctactgctggcatagctgagacaaatggagaggtaatatctcagacagaaagccagtgagggctgctccacctgttaagttcaccagttgcatcacgtgatagggggcagcactcaggataaagatcggcaccagcgccagcaccatcgtggtcagcttcatcactctctgccttggaacactgggattgtagctgtagaggaaaagtttggaaagacagaacatgaccatagaaattatgggcaatggtttcccagaactctttggccagtccataatatctctgcagtgaaatgtaaagctcatttttcttcctacttattcagagtgctgtaaaaataccctttttcatcccactaaaattttccctgattttccaaagctggagaattttgagaaacaaaataaataacataggacttaattataatccaaaatatcaaataaagatgtatgaatctacgttcatataaataattgaataatatgtgggagaagagacaaatcttctttacagaaaaattccaaataatatatatagatactcccctttccaggagttcaatgttaattctcaccctccttcttttccctttgaaggtagactatacttaatgactcattttcaaataatagaatagaggaagagataaatactaattttgtatcagagaagcctggcaaatactaccttaaccaggtgatcaagattaacatcaacagagctgtcgtgtagttatcacataccccccaacatgttgtgatgagacttctcctaaaatacctaaccaaagtctaatcgtgatacactatcagtcaaacccagattgggggacattctacaggatacctacctcaagtgcttacttaatattatcaaggttatgaaaaacaaggaaagaccagaggagacaactgaatgcagtgtgatctcctggattgagtcttggagcagaaagaggactttaatggtaaaactggtgcagttcaatacagagtagagtttggttaatagtaacataccaatgggagaaggaaatgggcaacccactctagtactcttgcctggaaaatcccatggacagaggagcctggtaggctgcagtccatgaggtcactaagagttgggcatgactgagcgacttcactttcacttttcactttcatgcattggagaaggaaatggcaacccactccagtattcttgcctggagaatcccagggacgggggagcctggtgggctgctgtctatggggtcgcacagagtcggacacgactgaagtgacttagcagcatcagcaacataccaatgccatttcctttgttttgacaaatgaatcatggcaagatgttaaaggggaaactgggtgaggaatatatggaaactctctgtactatttttgcaacttttctgtaaatttaactttattctaaaatttaaaaatacttaaaatttccaaattttgtcctgttctgtcatatttagacatttcatagagatttctctgggacatgactgaaacagatgaataagcctggagaatattataaagtaaaagtatggtagcctaaaagtcattctaagatagtgattcttctgcagctcatcagagtaggcaccattattcctctaacttattgcat

SEQ ID NO: 58744 - DNA, 932 bp, Bovine  19866880852969
tgcaatgtgtggggcaatccttccaacgaagaattgctgctactgctaagtcgcttcagtcatgtccaactctgtgcgaccccatagacggcagcccaccaggctcccccgtccctgggattctccaggcaagaacactggagtgggttgccatttccgtctccaatgcatgaaagtgaaaagtgaaagggaagttgctcagtcgtgtcagaccctcagcgaccccatggactgcagccttccaggcttcttcatccatgggattttccaggcaagagtactggagtggggtgccattgccttctccgcaacgaagaactatttggccccaaatgttgatagtgccatggctgagaaattgtactccgtatgattatgaagggactactgtggcatagttaatcctttccttccttaacagtctaatatgcatatggtttggaaaatagttgattcagtgggaaaattggaattacaaagagaatggatttttttcctgccctgttatgggaattcttcatagataagaaataaagaataaaaatggaaaaaaaaaaaaaaaaaaccctgttctgtagactaggaactagtttatttgtctactgttgtagaagtgtaatggaagcaatatgctaacctctgacatgcttcagaatcaccaaaaattccttaatagatctacattcttccatcagcagggagaaatcacatggtccatgactgttgtaactaaatatattttgaccaaagactgcttgcatcttttacttcttgagattagagtctatttggggaaaatgctaatagtttgtgtgataccaaactcagtctaattctgagcaacttggagaggttcagatatgaatttatttcatgataataatgatgagtttgtatgaatagatccaatttctagaggtcttttggacgga

SEQ ID NO: 58745 - DNA, 1188 bp, Bovine  19866880993672
atagcatattcagaagcagagacatttcctttgccagcaaaggttcgtctagtcaaggctatggttttccctgtggtcatgtatggatgtgagagttggactgtgaagaagactgagcaccgaagaattgatgcttttgaactgtggtgttggagaagactcttgagagtcctttggactgcaaggagatccaaccagtccattctgaaggagatcagccctgggatttctttggaaggaatgatgctaaagctgaaactccagtactttggccacctcatgagaagagttgactcattggaaaagactctgatgctgggagggattgggggcaggaggagaagggaacaacggaggatgagatggctggatggcatcactgactcgatagacgtgagtctgggcgaactccgggagttggtgatggacagggaggcccggcgtgctgcgattcatggggtcgcaaagagtcggacacgattgagcgactgatctgatctgatctgatacatgtgtgtgtgtatatatatctatatggaggtcatagtgaccagtttaatagctgcttatgtattactactttcttcgtagataagaaatttcatatgatctacttgttactttttgtcctggttaaggagtaaatcatcttagggacagagttggcgagagggagggaggaagcaagagatggggaaagatgggggatagaagaaaaaaggagaacttattctaaacctgtaaaaaaaaaaaaaagggactaggctgcttgctttttgttgactgtgaaaaatactttaaacacaagagaacctgtatgtaggaaccttgacttatttgggggagaatctggcaacacaaaattattcatgcatggagttttagaactggactaaaggacacatttaactttctaaaaattcagtcattttaatttacagactagggaactgagatccagtgtatgttgctgtttgaaaatcctcttttaagaggatgaagtttgagtcagttgtcactgaaaccagattctagtcacgggaacacagaataatgctttgaaaggatacattctagtatacattcttaagaaattcttattggtttgttttatagcgaatacaagctggcattctaaaagcattcaacaacccacctactaaaactgctgatgatgaaactagaaaa

SEQ ID NO: 58746 - DNA, 1005 bp, Bovine  19866881120110
tgttaatgctggtgtcaagagtttggaggaaagcatagctctaatcaacttctcaaagggggaaaaatctaattttccaattttttctaattctaatttaatgtaaaatctcatataaacctgtggaatgtaattattttgaagattataagaaaaaaagttttctatttagcctcccataatccaagacttactgaagagggtaatcaaatagctctagttaatgaaagaaaatcatgggcgcagaaggtagaatagatttagaaaactgtcatattgtcaaacctaataaaaacagctgattcacgcaaccttagaagaaaagttcatgggaaatcaaaaattcaaaggttaccaaaatatcacccccacaaattattaaatgtcttatgagacacaatattatgtccctataattactattttcaccaaaaatgtttacctgaatccaactgagcttttggctctcacttgcagtgcgaaagtaaaagtcattcagttgtgtctgactctttgtgaccccatggcctatgcagtccatggcattctccaggtcagaatactggagtgggtagcctttcccttctcggggggatcttcccaacacagggattgaacccaggtctctcacactgcaggcagattttttaccagctgagccacaagggaagcccagagtacatccttagaaatgcataagctcgaatcaagattgccaggagacataacaataacctcagatatgcagatgacacccacttattgggcagaaagcaaagaagaactaaagagcctcttgatgaaattgaaagaggagagtgaaaaaattggcttaaaactcaacattcagaaaacatcaacatcagaaaagatcatggcatctggtcctatcacttcctggcaaatagatgggaaacaatggaaacagtgatagactttagttttggggaggtgcaaaatcactgcagatgatgaatgcagccatgaaattaaagatgcttgctc

SEQ ID NO: 58747 - DNA, 1152 bp, Bovine  19866881175025
ttaaagacaacatgaggtcactgagtgtgattgtttttctgcatgatatttttcagagttcagtcagtcatatataactgttttgcctgaaaatacttcttttgctaagtttttgcatatatttaggcatcaaatttcagcataacaaaagcataaagttaacatttatattagctgatttttaaagtttgaagtaactgaatagaaaagtgggaaaattaagatgaaaataggtactaacattaaaaaagaagaatgaacataaatttaggttattgccttgaaactacatggtcgatgtcagactgctttgtaaaaactattttttactatcaatattacctgcagagccatatataaaaccctctctttagcggtgatcatcaatctgacttttccagttatcgcttctttgcttttctttatatttttactgttattatatgtatctgtggaaaattattaaagagatgggaataccagaccacctgacctgcctcctaagaaacgtgtatgcaagtcaagaagcaacagttagaactggacatggaacaacagactggttccaaatcaggaaaggagtacatcaaggctatatgtggtcatcctgcttatttaacttatatgcagagtacatcatgagaaacactgggctggaagaagcacaagctggaatcaagactgctgggagaaatatcaataatctcagatatgcagatgacaccacccttatggaagaaagcaaagaggaattgaaaagcctcttgacaaaggtgaaagaagagagtgtaaaagctggcttaaaacttgacattcagaaaactaagatcatggcatcctgttgcatcacttcatggcgaatagatggggaaacagtgacagactttattttcttgggctccaaaatcacagcagatggcaactatagccatgaaattaaaagtcgcctgctccttggaagaaaatctatgaccaacctagacagcatattaaaaagcagagacaacactttgccaacaaaagtccatatagtcaaagctacggtttttccagtagtcatgtaaggatgtgaaagttgggtcataaagaaggctaagcaccaaagaattgatgcttttaaactgggtgtggagaagactcttagagtccctt

SEQ ID NO: 58748 - DNA, 1128 bp, Bovine  19866881207010
acactttaaaaaaaaaaaaaactgttttccatgttcaaagcctatctgaaaggctggagtaaggtttatgcagataatgcattcatgattgaactatttgtatattaaatatggtcgtaggatataaattaacttaagttcttgaaatttatagacgaattcaaaaatgtaaatttgctcagaaaaaaagctatttatctcatctgtttgtatggtaattgatggttcattatgaaataatctgatgcacagagtccagctaaattagcccagccataatgtactatcttgaagcaacttcacattctcattagggcctttctaatttctaaagtgaaattaatgcaattagtgatcaaatcaatacatattgatcatgagtttcttcaatatggcatgaaaatatcaggtcaaaaagaaagggcttttttaaatcacagaattaatgtaagaaatttaagttgtggggaaaagagctttgttctattttcctatagtagctcctatttataagaaagtgactatgtcacttttaacattgctgacatgaaattcaacacaacgtgctacaccccagcttgccctccaacacatcaatactgtattcattgtccatatggattttttcctccccataaatatccaaaagcaaattttttcctcatgtgcagaattttagatgactaattactcaaaagcacttttgtctttttcacatgcaaatgtaagcaggattccagggagaagtacatccccctcccaagtcgttgacccagtatttgtacccaaggtggggtgggctggagttaaacgtatgcaggaagggacttaaagcccagaataaaaaaatcaaaacccatttgtgaaaatcaaggaactgctgcttttctacatactaataagcttatttcagtgtgaaaatgagacttccaagaaaaaaaaaaaaagaagtgactcagttccagaagtccttctcaccttcagccaaatggattctgagatgtggttcaacccgatgtctactcctggcatgtgagggggaatgtgcgatgaactgtgttaaatgctcaacttcttgttctcaaagtcacaaaattatgtagatcctgagggatatttctgagtaaa

SEQ ID NO: 58749 - DNA, 2220 bp, Bovine  19866881323533
aggaagatctcctggagaaagaaatggcaaaccacaccagtattcttgcctggaaaatctcaaggacagaggagcctggtgggttatagtctatggggttgcaaagagtaagacacaacttagcaactaaacaacaatcacaacagttataaatttgagcagtaaataacccatttagatagtgagccgaaattgctctttcagtcaaatgtttcgctggcttgcagacaaactgtggcctccatgtgtcactcagaccttgtggtctcatctgtgtttgcggctatgccctctaggcatggatccccactatcattagtggcgagggctgtccaaatttttatccacaaatttctttttttcaaataaaactggatgcagtctttcaacatataaaatcccaacttatgtaacagataaaaggggtaaggaattgaaaacacatcttactagtaacttcctcatcatgtctctccctgaggctatgcaaaaccctgggtctctgaaaaacaaatttggaaaccacttcagggctctacctacacagatggctgtctcatttctggagaaaactaaactctgttctttacccaagtgggtacttccctcatacttaaagcagtcaacaggcaagatacttcagaggggaacgtgttgcttggtgattagaatgagaacaactgataaagagaatgtcttgtttctgaggacatggcctgtgtgataccttagatgagagcttaacgtaaagcctcttttatgtggcccagtccttggactggaatgaaaagatgaggttggttttattcattgcagcttgccaaaaaggcaatgaattaacagcaaaaacctgaaaagtcctatgttcccatcttacttgttgacactgactcagctaaatgatatcaacaacatatttttagtcccacagtttcaatgaatacatccagatttactgttttgacttcttgtgatgacatctgaaacaaattttgaaaagtaatgacacgaacattttatgctgtcttccacttcctatactttaatctccatattgagggcacagtttcttccatgcatcagccttctaactttctgtttggttgtaaagggtaataacaacatgtggtagctattatcacaaccaatagcaaaaatatccaaaaaatgttccatttttaaacatgactactttctcaaacaattaatttaggaaggtattttcaaagcaacatacttattctttatttaaatcatataaataagctatcattgaagtcattctttaataaacttctctttagttaaccttaaaattcactaccttaaaatatttattgaacacctaccttatgtgagtttctgtgttgggattaccgaagtgaacaagccatgactgaacgaatgagctatctatctacagtttagtatgattgtcagagatttagaaagaagtggagtacatggcaatggcaacccactccagtactcttgcctggagaatcccatggacggagaagcctggtgggctgcagtccatggggtcgctgagggtcagacatgactgagcgacttcactttcactttccattttcatgcattggagaaggaaatggcaacccactccagtgattttgcctggagaatcccagggacgggggagcctggtgggctgccatctcttgggtcgcacagagtaggacacgactgaagtgacttagcagcaggagcggcagcagcagatactgtattaaaaagcagagatacctctttgctgacaaagatccatctagtcaaagctatggtttttccattagtcatgtacagatatgagagctgtaccataaagaaggctgagtgatgaagaactgatgcttttgaattgtggtgctggagaagactcttcagagtcccttggacagcaaggagacgaaaccagtcaatcctaaaggaaatccacgctgaatattcactggaaagactgatgctgaagctgaagctccaatactctggccacctgatgcgaagaaccaactaactggaaaagaccctgatgctgggaaaaattgaggtggttggacagcaccaccaactcaatggacatgagcttgagcaaactccggggatagtgaaggccagggaagtctggttccaactggtttgcaaccacagggttgcaaagagtcggacatggcttagcaactaacaacaatactttca

SEQ ID NO: 58750 - DNA, 1155 bp, Bovine  19866881496882
ctgaacactagtacagctatacatacatacatacatacgtacatgctttttgtaacttaaattctgccatgatttttaaggagtaccctgtattcagaatctcatggtttcataaacctttcagcaagaatctgttaagagcagcaacatgctgttttgattatgtctcagctcatccatttaaggaggctgaaaagttgtttcagcagatttcctgcaggtggatccgattacctggactccactgtttcagtaagataaatggaaaatttagatcttcatgaaagaagggctggagggagaaactctgcaatgaattgtctcaggaagtaaagagttccctctccctaaaaatgtttaatcatagacttggtgatggctgttggagagattttttggagaggattctgatgtaagactaaaaggcttataggcttgtaagttcttaaccaattgagaaattttcgaagtctagattatgtaaaaaggctgacataggatttattgaatttttaatgacatatacacaggctggcatccatgtaaggctggcatctggtgttctaagttatcactggtaaagtttgggttcatcatgacagcaacttcagaaaagcttgtgctgaatttattctttagcttgaaatcttcagtcacttttctttagcttattctttcttttcatgcactgtcaagctctggatttgaaggcaagtcattcaagtttaaagactggggaatccagatagtctcagacatgaatgttctttgataaacttctaatgattcttaagaattttggaagtacagaatcctctcagatcctacccaggaaagtggaatattaaatagtataggctcagaggaaattcaccacaaattaggaatccttctaaggaaaaatgtatcctcttcaaagtctcacattcttacttcttaggagctggcagaacacaccaattgatctttaagttattctcacttggcactgaatctctttgtgtaagttaaacacattaacagacataaaacacataacaaggacctactgtacagcacaggaaactctacttaatagtttgtgaatggcctgtatgggaaaaaaaaatctaaaaaagagtaggtatctatatatgtataacgactactttgctg

SEQ ID NO: 58751 - DNA, 890 bp, Bovine  19866881856147
tgttgttgttatttacatactttggcagattttcaaagctatggataccattgggggactggtgatatccctattgcaccatttgtgccagttcctgggttagtatatatttaattcctatggctttcaaagaaaatatgacctgtcataagcaccaaatgtacaaaggcgggatagagtctccagtatcttccatgaaagagcatcaaaaatagattctgatttgcctgtcactatcatgaaaagcaaaatagaaagattacttggtatttaacttcagacatctgatatcaattgggcacaatccatctctcagtttagagtagttatccctagcctgctttcaggcttaatcccttaaaaaaaaatcttaacagtttccagagtttggtcttttttcaattttcagggcataagcctttgggaaaactttagatctaatcttccctagtgcctttccttttccaaaaaaaaaaccagagaatttcttcacatgtgggatttttgtggttatcatttatcactttaggctttcaaccacaaattcatccactattttgtaaacttctcagtcttaaggtataggaacattcataaaatagttttctagactggtgcaaactaaaaaagttctatgacttttattattaaaaatgatccaatgatccagtccaatgatgtaaataaacacaaagtattagatgtgagagtcatggatcttcaggcatgagtcatgttataaaatatggcatccgtgctgtgtgagaggtgagctgcatttagatccaagagaagtaataggcatacccagactgattttaataaggctttagattccctctcatcaccaccacttactcacctcttgacagtcttgtctacaagctaaa

SEQ ID NO: 58752 - DNA, 783 bp, Bovine  19866881876683
ttccttctctctcctcctctgtccccttataccctcttctctatatgtgtttaaggttaggtacagacatcaggacacttacatcttttcagaataaagatattctcctttaggggtaactttaaaatcgttgtcatacttaagaaatgaacgtaattccataaaccaatctatctcatatttaaatatctctcaattaactcctaaatatcttttatagctttaaaattctttcctgacccagagtacaatcaaggttcatgaattgcaagaatagacctttttccccttgattttcattgggagaagaaataattttatgataaactcttaagtgaggtgatattttattctcagattttgaaccatttttacatctatatcttgatttttgaaatactgtgtgacctttgacaacataccaaaattttgctatttttcataacatctttagactgagcacaaaattacccagcagaagggtgacgcatatggagctgatcacagaacagtggcttaatagagttagtcgtgtgacctgccagaagttgacctcatttcagaattccattggagcacgatacattcaattccacatagaatttgaaaagcatgctaacattcatggtagttctcattttgactttggttcagacagttgagtataacgattttatgcttttccaaatagtatttctacttccactaatatatgccaaaagaaaaaaaagaaagaaagaaaacgcaggagagatggagagagagaagaaaaactgttaaatg

SEQ ID NO: 58753 - DNA, 586 bp, Bovine  19866881968796
atgataacaaataacagacgtcatttcataaatatgtgtcaaggtttatgtaagtatttttatacacattacttcctaatctttagagaacatgtctaagcgttacaacaatcccacttgatagaagtatcatataaataagaagttaaagtcacatagataattaaattatttaggtggaaccgaaattcaaattcagcaccatctgactccaaagcccacaatccagtaacttatcctttccatcttctcattattagttatgtaagataacatcacaaaatcgctacctaagaattcacagcactcatactgagaggtcacactaaaactcaaagtactctttataaatgtatcatttctttataagaattataaaatattataccttaatacaaatttctttagcaactgctgtgaacttacttgtttgtgttttagaaacatgtttctggagaaaatcaactatctgagccaaaaccttcttattacaatgtgttgataatttttcatcacactcataacacctaaaaagaaataaatttaagcaaatattatgaaaacatgttcagtagtttttgcacat

SEQ ID NO: 58754 - DNA, 1406 bp, Bovine  19866880110303
ttgcctggaaaatccctggatggaggagcctggtaggctgcagtccatggggtcgctaagagtcggacatgactgagtgactttgctttcacttttcactttcatgcattggagaaggaaatgacaacccactccagtgttcttgcctggagaatcccagggacgggggagcctggtggctgccgtctgtggggtcacacagagtcggacacgactgaagtgacttagcatagcatagcatagcatagcatttccacttcgagagccccagacccctttctcttccttggggaccctggacttcttatcagtctgcctaggaattgactcgctcactatcctgagagtcttctgtgttaacattatctctaaaatgtttatgtaacaaaattgttctaagtgtgtggacacgatacttttttgattgatgattcaggatgaacaatgtgggctgtaaggaagatacatgatttatctgcataagattttcagaagatattaatactttaggtgttaaagaggagaaaatgtcccatctctaaattaagtctttatttttcttcaagaataagctctctaaaaagccttaggctatgatcaaaatattcaggttttaaagtgacagatattttgttggctgattatcaaatttgtgctgcttacatgaagaaaaatacttggcacaaaaattcagttccaccagaacttttccatacttgctaattggattaaaaattatcaaaaacatgaattaagagttcagtttcagtcgctcaatcatgtccgactctttgcgaccccatggactgcagcatgctaggcatccctgtccatcaccaactcccagagtttactcaaactcatgtctattgagtcagtgatgccatccaagcatctcatcctctgtcatccccttctcttcccaccttcagtctttcccaacatcagggtcttttccaaggagtcagttcttcacatcaggtggccaaagtactggagtttcagcttcagcatcagtccttccaaagaatattcaggactgatttcctttaggatgaactggttggatctcttaagagggactctcttaagagtaattaaattaaatcatatagaaatacttctgttaaatacgtgtctgtaaatatatattttctgtattaataggaagcaaaatatggatttttggccctgttgttccattttcaatgattagttcaaattgaataattttattgttgataaattaataacagagtgtcatgtctctcattttaacactgaaatcataaattgcatattcagtagttttgcattaacccttaaaaataccctgtaacattgctaaaatacacagagaagaaatacaagtctctttcagaattcttcagtggaaattgttactg

SEQ ID NO: 58755 - DNA, 2477 bp, Bovine  19866880288668
cttctcctcctgccctcaatctttcccagcatctgggtcttttcaaatgagtcagctcttcacatcaggtggcccaagtattggagtttcagcttcagcatcagtccttccaatgaacacccaggactgatctcctttaggatggactggttggatctccttgcagtccaaggaactctcaagagtcttctccaacaccacaagttcaaaaatataaattcttcaacactcagctttcttcatagtccaattctcacatccatacataaccactggaaaaaccatagccttgaatagacagacctttgttggcaaattaatgtctctgctttttaatatgctatctaggttggtcataactagtcaaccataaaaagaacaaatttatgccatttgcagcaacatggatgaaccaagaggttgtcatgagtaaagtaagccagataaagaaggataaatatcacatgataatgcttatacatgaaatccaaaaaaggatacaaatgaaccactttacaaaacagaaatagagtcattggatttgggagaggtgggaatattatgaggtggttgaaatagtctgtttggggaaagaataggctccaagcaggaattctggtatgtaaggaatctcacggaaagagagatacagaatagggggacctgaagctgatgttatctgtgtagctataatccaggagtggacaagagtatggtaatgctgacagtgatggagttaagaacacagcatataaagaaggtaaaagggtctacttttgatagtctaaatcaataaaggaaagatgtatagaagagaacgaagccaagaacagaactccagaacacagacacttaaaggagttagaaaacaaaacaaaacaaaaattgcagcaatcagagaaaataaggaggaggaaagatcagagacaaaatactacgaatggggcaagagacacacacatagatacagacacaaaggaggctgggaaaaggcagcagagaatttcaaggcccagtagtcaacagttcttacatgtcccagaggagggttcagaaagaaacagctgagaccaggtcccgggagctgggcactctaaggagtcagaggaggaagtgagatccagccagtgtggggacagtgggaaggcagcaggcataagaccatcttgggaacactgctcagtgaagccctttcagaaatggggtgttagttcacgaggagccagggaaatgttttaagataactgagaaacaatgaaggtgctatttattgttcatgtatttcttcagagggaaagaatgtggaagtgtgtgaagaaatagagtgatttatggggcaaagtcctgtaaggaaagactcagtggaggcaaagcagtgatctctgtgttaaagctacaaagaggcatgctctgtgaagcatttttgtcatcttacatcatgtaaacaaatgtatatatttctcatttcttcaacaaatcaataactataggaaagcatgctctcagtcctttggaaactacacaggtactgggttctagctttggcttagcaaaacttctcttccatttcttcatctccaaccactttaaaaatttcactttgggcatataggaactggcttcttctagttttcccaaagccacctgcttgcagatttgggagatctcccaggagatacagcgaagcagtctttcagaggctgccatagatccaccttcagctgctcttcttatatcacaatggccacttgcttttctacagatgcttaggtttccattttgaacagaaacattctatcttgaatcagaattttccattggataaaaattgcatttagcatctttttgggagcttagactgtgacacaacttttttttttttttttcaggtgtcatcagagtttctgttctcagacctctgctcctttctactccacacatgtctctctttagtaatttggtctgtcaacgtggggtttaacttcatttgtatactgatgacaacagattgatgttataaaattagccttaatgttctctctgccacatctgtgctacatgcttgccaaactaatgtcaaggatagggtatctagagattgtcttcaactgatcactacaaaaatagttgttttcatgaaatgcaggcacattcttattccttggtttctccttcccagtttcttcaaacttcatattgtaaaccaacactttgaacatgagaataccaggcccaagtgagttttctcttttaatttttctaattaaaaattaatttctgggttaaaaaagaaaaaaaaagcagtatgcatagagcagaaaactggtgacatccagttttagcaatttaaatataaaaacaacacttcatttatatttcagaaagcaaataccagggggtaaggccaagacggcagagtaggccctaagctcatctcctcccagaggcacaccaaaattacaactatttgcagaaca

SEQ ID NO: 58756 - DNA, 2418 bp, Bovine  19866880392308
actgcagatggtgactgcagccatgaactagaaagatgcttactccttggaaggaaagttatgactgacctagacagcatgttaaaaagcaaagacattactttgcaaacaaaggtccatctagtcaaaagctatggtttttccagtagtcatgtatggatgtgagagttggactatatagaaagctgaggagtgaagattcaatgcttttgaactgtggtgttgcagaagactcttgagagtcccttggacagcaaggagatccaacaagtccattctaaaggaaatcagtcctgaatgttcattggaaggactgatgaagctgaaactccagtactttgcccgcctgatgcgaagaactgactcactggaaaggaccttgatgctgggaaagattgaaagcagaagaaggggacaacaaaggatgagatggttggatggcatgcatcactgacttaaaggacatgggtttgagtaggctccgggaattggtgatggacagagaggcctggtgtgctgcagtccatggggtggcaaagagtctgacacgactgagtgactgaactgaactgacaggctggaggacagctactggggacatggtcacaggacccaggtctctaagcagggcgtgtgcatgctctgtcgtggtcccctctgcaaatacagcaataaacctatagtacacacacacacacacacacacacacacacacacacacacacacacacacacacacacagtggtgtttcatccttcctacatggatgatgaacctgaggcacagagagacaccaaactgactggacttgcacctgacaaccagtgagaggtggatagaaggcttccatctccaagtcagtgctttcctgtgatctgtgctcccagtcaaccattttcacctcctcccattccccattcatattctctctctctcattccctcctcctctcccacatttgctattacaatgattccaggtgactcaatttgctcatctataggaatatatgatgtgtaaactacagcactttctttaaaacaaacaaaaaaaaacccccaaaaaacataaaagtgattcaacatctaatgattgcattttcaaaattcaaatattcttacctgatcgacaagcaatgtctacatccttttcaaagtctgtctgtaacaagaaataataagacatagaatcatcatttaatgaagacctcaagcttatactgaccagagtatctgacgttaacaaatacctgactaggcagtaccagaatattgttaatactttgtgcaaaggaattttctcaaggaataatcaaatgccttcaagagtattttctagcaaccatatgttggataaaatcagttggaaatatgttgtacagttttaataaagcaatattgtacctatggtcctctaataccagatatgaaagaacagaattttaaggcaattccttaatgaaattaattaaggaatttcaattccacaatgaaaatactagaatgtgaaatattgtgaagatatgtaaataaatgtccttgttatttacatttaaaaaaattcactttgaatatattgttaataatgtaatatcttataatatagctttgtcaaacccttaaaatcaaactagggttttctgatgatccccttttatgcaaatctgacaaaagccttagggtttacggattaaagttgaagattaaacaatattaatctggcccagagcctgttagagtttagttccatcctcatattttctccaaacttttattgtaaacacatagttgttgctgttcagtcactaagttgtgtacaattctttgcaaccccataaacttcagcatgccaggcttccctgcttcactatctgctggagtttgctcaaactcatgtccattgagtcagtgatgccacccaaccatctcatcctctgtcaccctcttctccttctgcccttaatcattcccagcatcagggtcttttccaatgagtcagcgcttcacatcaggtggccaaaatattggggcttcatcttcagcattagtccttccaatgaataatcagggttgattttctttaggattgactgtcactatttggattagttcacttttaatggtgaaattatagtagcctgttttaatcaatatttagattcaagatatcagtatttatctctttatttttaaaaagaaattactctttctcctgctttagttactagcatatcatttaggctatttttgtgttgcctaatacaaacacattgataataaatcaggtatattatgaagaaaactctattaagccttgctgttaatgacatagcttaaagctcacttcatttctaaaatatatggaagtgagtatgtgtaaagtatcccttatccgaacagcagtcagaactcaggca

SEQ ID NO: 58757 - DNA, 807 bp, Bovine  19866880416861
ggtctcttgggggttgatgcaggcttctggctaggtgagagggctggccacgaggaaactgtgaggctggaggctggtcagaacagggaagccaaggtgtttctcctcgctctgctttgggcagcacctgcgtctttatctgcagttctgtggtgcctccagccttggctagatgcctcagcccccggggtcaggtcgctgtgccatctcccttgtctgtccctgtgggaggggagcactagcttcttctcctgtgaatccctgcgttcctctgtggccccttatgtggcttctcggctcctccatcacttggattcctgtgaaacgctttgctccagtgtcagcacttaagtggtttctcttattctcctgacatatctggcctaagcttttcttgtaactaaacagaattagatagtcaatcgcacaattgctgttttaaacaaagttttgctgctccaggttttctgagtattcaggtataaatttaacgatgtatctcaaaacacgctcagccaaatctctctctgtttctaagtgcataaaaagggacagcattctgtgctaactttttatatgccaattttcctctggacatgaattctggagatctcaatataatggctttgaaaggtaaaacattttagctataatgtcacatcacaggtgcctcccttatggctgcggtgaacatcaaattggataatgtgtgtgaaaaatcctttgaaaattgtaaagagcactttagatgtaaggtggtgtgattattatttgattaccattataccttgaatattgctgcagaaa

SEQ ID NO: 58758 - DNA, 1515 bp, Bovine  19866880502088
caaagatgaagagagatcctgaaagtttatagtaacttgtgtgggtataattttgaggttcttcccaactgagttgaggggaattctagaccaaaataggcatgcagacaagatctaggataaatccctaaattctaaatcagtgttaaacaaaagacagtttctgaggaaaatcattccttggaaccataggcataggggcagtgagtccaagttgagtcctgagtggctggagctccctcaagacaaaaacaggccatcattctgaactagcagaagggctactgtgtctgtctcgaacttgcacatccccgacagtcgcaggtctatgacaataatgaccacgtaaacacaaactacataacatttattcaaagtcagaaaagtttctcaaagaatttcagtgattatgaatataagaacataataccataaataatcataatgaccatatgaggtttttctacatagaatgactctttaaaatgtgctagagggattagaatggaaacattacaatattttgcttgttctaaaaatgttttatgtctaaaaacctttctgggtttgatattgtatagattgtgtatgcttgaacaatagactggatttccaagtgctgctttgttccatggtaatttttccaaatctctgtattaaatataagcatcatgtataagtatgattcagccaaaagctctgcatttaaatgacttagaaatcacaaggctcacatcttgaaaaggaagaaaattcaggattcagaatgaaaattcagtttttcattttcattctttcaaagagtttaatagtgagtaattgcttagggtgaccattttaggaggcagctgaatatatagatgtgggaatgaataataaaattagcatttatatagcatctttcattagctgatcatcaaatcaccttaaaatatgaattaattaatcttcacaacacctctgtacaatgcataagtttttctaatccttgaagtaaagtcatttgttcaaggttaccatgcaagtgcacagagagtataggacctgaatctttctatcctcaccaattttacactgactcaaagagacagtcatgtgcctgaatgttaacatgagaatcactttataaagttcatttaacccaggtcagacacttggtcatatggaataatgacatggaatggatgaagcgtagatgtgtacagctagccaagtttgggagcaggactatggccgtgaaggtccagtctggtgtgacttcctctgtgggcagagtgagtggttaactgccacaatgtctgtagccaaccatcagggaagatgatattctgacactagaggagaagcggaaagatgcctagagcatcaacatggagcgtggggagcagcagtagccaggaggtgtcttgagaccttgacaagtctgacctgagcaagacctgatatcttgagcataggaagacagaagggagcggccctctggctgacatgaggccctggcgcagtctgagtctt

SEQ ID NO: 58759 - DNA, 2828 bp, Bovine  19866880519533
tattctggtatttattaagtaaactaattactgttatgtctccccaaagaattcattgtattttaggtgtactgccttttcatgagatctaatcattgaaaagatttaaaaaatctagtatagtgtgaaagatacttaagatatgttgtatacattgtttttcaataaagaggagctttgcacagttggtatatcgaacatgaaagtactgttacactgtagcaagaatactttatattttaaaagttttactaaatggaatgttttttctcctttgacatctagcaagttaaaatggcactcaagtatactttgggatttgttgtgatttgtgcacttcttcttttagttgggtaagtttcgatttttcttttcctgaaaatggaaacagcattattttaatgataatgataatagtaataagggctcattaataaaaacccaagagagaaaatcaagaaaattttaaaagaacagactaccaacaatcaataaccactacattgttctatctagatattttttaatgtgttcaaatatatgcagaaagccccttctcccatataccctccgtgttgtaattttacacagatgtgattactttttatgtgatttttgataatcactggttggtacattgcaggcatctcttcaggatagatgcatcatttttgtgtgtattgcattcccttcttaggttgtaacaatttatttggctggtcttgtgatggctacttggacatttatgatgtttgtggtttttccgtttttgtaaacaacactgatgaaaaatccttgtctgtacctcttttcagatttgatgcatcagtctttaaaactttgaattaatctttgtcaacaagttttttctttctctgtctctcttcttttattcttcctgcttccctccttcagtctctctttccctcccttttttggctgtgctgggcagcttgtggcattttagtaccttgatcagggatcgaacccaggccctcagcagtgagagcatggaatactagtcattggaccactggggaatttctaatgaattagttcttaattctttttccatacgtttttataaacttgtaacagtaagtttttgtgtatttattaatacattaaaaaatttcattttggaaaacatttgtccctgttaatagaagacatttatcattgttaaaatagatcctgatttttttttcccagcagcattcttaagcttcttcatttattcaactttaaacacttaacagtctttcctggtggctcagacggtgaagaatctccctgcaatgtgggagaccctggttcgaatcctgggttgggaagatcctgtggagaagggaatggcaacccactccagtatccttgcctggagaatcccatgaacagaggagactggtgggctacagtatatggggttgcaaagagttggacatgactgagcgactaacacatacacacaaacacctaggtgtgccaaagagcatgtgcatgtacatggaacactattaggctaaaaaagaaggcctacctctccaggtcaagttgtgggcgtgatcacaatgatcagcatgattccaagtacagccagaaccaagcaaacagaaaggtttcagagatgataaatgggctttaaaaattaaagtgagacagcataggacctcagttcctgaagaccaatgaattataaaaagcatgcatttgctgtagaagcagtaatgaaataatttctgtgagggaaattattttaagatccccaggataaacagtgagttaggagtcaatttaaaaatccttagaaccgaagatttcaaacttctgtctttttgtgcctgtgtgctgcccaactcatacccaaaaaggaacaagaatcagattcctaccaacttaagactcctaagacgtgtcatttgtcatgttggtttctgcagaagctgtatcttgtgaagtagtctttaaaaataaaaatgaaagaaaaccaaagagtaccatgagaagccacattctccttcccactgtaattttgctttggtttgctctctaaagatttaacaaaaatcaaaatcattggtctcagattcctgaattaatgtgacctcactccatggctgatgtggccaaggtagatgcttttgtgcaattagaacagaaggactttatatcagtaggactttagggctctggctccactgtgtttactataagctacacggatgacagggtggaggtcagagaaagaggtgaaaacgtccgtcacagggtcacatgacaggtagcaggaccctaggtagacttgaaggaaccagttccattctggcaggggaaacccacaaaaacaagtttcacacttgcaaaattatcactctgaattcaggaataagaggcactgggttgtagatacaattccatctgtagatactaactttaaatttagagaagaaaaacacttaatgaattaatattatgggttgggctttcttaagtgattcttaaatccagctgtgatacaattaacagctgtgataagaagtctaccatagctctggctcagaggtggtctttagtttcacagagtccgtctacagaaagtcatgtagctgtctgtcactgctaaatctgttgtttgcagaagccccagaactctatttgctgagtagagtcctcaccatttaagctcttcctacatacaggtcgtgcatcatgcagttctaaccacaacacaatataactgctgtcaaagtagtggtttccgggcaactgttggatttcctggtcacctgtgtaatcctctctgcatactggacactgagccctaccaa

SEQ ID NO: 58760 - DNA, 1590 bp, Bovine  19866880545774
aaaatatccaatgcagatatgcaatgtgtttggctatagtgtctggggtcttcattctactactaacagtatccttacaaatcccccagaacagatttcgagttctaaaataaaggttaagctgacaattatttttatttgaaagtttgcagcatattagcaacacgattggactacatacttaaaactatactgcagaaatttcaagttagaagacataaaattgagtagaattttgttatagcacaccaactagaattcatttcaccaagccactgtagctaaggaggagatgaacccaattttgccaccctgcaacattttccatttccccatttaaaatgcagttccctggagaaacactctccacaacgtccctgcctttgcattaaagccgtgttttccctttgttacttactatttctctaggttgctgagccaaaatggcgaaggtagagagacgatcacataagcatttcgtatgggatgcatcggtaagcacagttttacatccctgggtggaccacgttcccaaagaatcgttcctgcaaagtgtggggggaagatcgggataaatacgcctgacggccaattccgtaaagaagcaaatgcagtttaattgagagaatcgtctactgtaattcccgtacaggaaaaaggaaaaaaaaaaatctacttgttgttgaataggacgtaatttagatgcatctccagtaaggcaaagcgagagtgtttggaggaagcaggcgggcggcggtgcagcgtgcagagagctgtccagcgccggaggtgctgaaaccgggactgactctgtccagccctctgcgaggaacggcggcagcggcggcggcacgagcagccgccagagcgttggcagccacttcctatgctcatcggatcgtttcacacactcagagtgtaaagaggcttttcacatttcataccagctctgattcccgtcccgtatttttggatcgtgaatgttggcttttaaaacgaggatttctctgaaaagcctgcctaaaaggttagatagctcgtgttgggtgatagaatcttctccgctgttggttagggatttttttttcccctccccttagaattagctgctgtgaaaatttcaccctggaaatgggaagcagcagcagcagcagcagcggcatcagctggttccgactctcattgcctttgcctggtatccaggggaggggtgggtctcagacagaagcttcccactccacacttcactcagcccgagctcctctgaagcccttgacattgctccccccatccccacccacctctcttcccggggtggggcattaagcgttaagctaacctggagtctgctacaacatatagcagaataactccacctcaaagtctggtaggaaaggggaaagagggcctgcttcaatgttccctttggtgtagccattcaaaattctaaagcatatggtttatttcccaccccagcagaacaataaaaatggtatcaacctacgccttcttgagggggttaaagatgggggagaatccacccccgacttaactactccacaagaagaggaaggaaaaaaaaaaaaaaag

SEQ ID NO: 58761 - DNA, 1480 bp, Bovine  19866880568437
ttatgaggttgacatagtgactacgggactttactggtcccaagaggcttagaaacaattgcattgagtaaacatgaaaatggcctgaacagaggaaagcacatgatcctcaaggaagcctaaaaggatactacccacattcagctcttgtatacaagctgagagacacactcatgagattacaactttggcaacatggagggaagaggtgctgccaaactcatagctaaaccattggattaatgttgctttatcttaattaaatgttgttttaacttaatttgacttattgttataaccctgcactaagtgttgctgccctgtctgtccagtatttccagtagtagtagaaaaagaaacacgccagcccggcaatattccatgaaattaattacaaggggaaatttgctaaattgtgctctaaatgtgaatgattttcctatacttgctggtttggattttatggttagtttttaagttggttggagcaattgtaatacctttttaagaaaacaaattcctgaatgaagcctctaaacagaatctactgatttaataaaaatatattaatgaacaattgatcttgttcatgaccactaataagtgatcactttgtcagtcttgacaatgggatgtcccagttacaaccaaaaatgtatggttaatatttcctttgttccatattactaattctggattttgcaacataccagttacatacctggctaataatcttgctgagggattattgtccatatatcatagaacctgaaaacaattaccccttcatcttgaaatataatgatatgaatttttaaatgctctaaaagaccttatctttcaagtgtttgtgtaaatggttaaacttcctcatgcacaatgattttcactttactgtgaacataaccgtacatgtactcttaatgagcaattcatttacatcggtagatgtaatcacctgtttcatcacccaaaacaaatgtcaaattcctggagtaggtttctcccccaaggctaaagatgtttctcatatatcatgtaataaactgagaatgcctgtgagtacttagcagtaactctactcagggaaatcaaacctggagggctaggacagtggtgattaaagcagagtaggacctgtatcattatgtaagtgctgtagttagatctagacttcattgtctttttatttgtttgtctgtctccttggttattagcactcagagacttagctgtacaggagcttctcaagggaagaggaatgagaatcttgagttttctatgcatccctggtaatgactcatcgtttgactttgaactaaggttcacactaatacagtcttctactctgtcaagattaccgcactataggaaaaattatttttatttacttctctagagggctacaatttttaattaatgcttctgaagaacatttaacctccttgaacatgtgctagcttctgcataatgatctcta

SEQ ID NO: 58762 - DNA, 3645 bp, Bovine  19866880641405
tttacactaaataagaaatgtaaaagtaatctgaataattgaaaaggaactcagaagccttccaatctaacaccatgcattttaaatataaggaccatgaagtccaaaaagttcagtttggccaaagacacaaactaggtagtgaggagccaagactagaactcaggtctgattgtctgcagcctgcatcgcagtgactcagggtcttcaacatgacataagagatgaagaccataatctgccactaacaaaggtccttctaaattatcttaattagataatagaaatccagtcagacttcaagagagctactacaggcacaaaaataaaacctattgtgatcaattggcaaattttttgattaacaaaaggacttagatggttgtaaaacagtgaaaagtctcttccacattagttgtcacatcttcagcctctgtgtgcatttccattctcacttactcccagagacaacaataaaacacagcacacactgcactgctacacatttaattaaatacttaattgccaagaatatgaaagaacaaaataattaccttaaatgtaccattttgatttttcatgtaagaaaccaaaaatatatccactggaagaagtgctgatgtgatcagtgcaatggccagagaaaaaatggcggttatggtggagacaacttcactttcccgctgactctgatatttgcgaacatatatccagcagaacgccaaaatagcctgaaacagacagaaagaaatgttttgttactgccctatctatgctctaatactgattttagaatgtgttttaaagttcctggtgggaaactttatgccaagtaaagatgctttcggatgtgcatggagaagtcccctaccccttataaacttagtcaggatttatcattttcaaagccaagttcattaaagcagtacatcatcactggggtgccaagacaccaaaaaaacaagcaaaggttgttgataacagtgctcagttacatatttgctcgcaaacacagtatgaccattaacggttgacacattacagttataactagctctgaatacttttccctatacattttcccaagctaaaggagatgtaactgaaagttgtttcccattgttcattgcagcactatttacaatagccggaacatggaagcaacctagatgtccatcaactgatgaatggagaaagaagttgttgtccatatacacaatggaatattactcagccataaaaaggaacgcctttgagtcagttctaatgaagtggatgaacttagaacccattatacagagtgaagtaagtcagaaagagaaagataaatatcatattctaacacatatacatggaatctagaaaaatggtactgaagaatttacttacagggccgcaatggagaaacagacatacagaatagatttgtggacataaggagaggggaggagagggtgagatgtatggaaagagtaacatggaaacttatattacaatacagattgccaatgggaattttctatatggctaagaaactcaaacaggggttctgtatcaacctagcagggtgggatggggagggagatgggagagaggttcaaaagggagaagatatatgtatacctatggctgattcatgttgaggtttgacagaaaacaacaaaatctgtaaagcaagtatccttcaattaaaaaaaaaaattgattaaaaaaaagttgttctatcctgttcttactacagaagcatcataaaacaccacccaaactgaaattaacttctgtccctttgtgacagttcaagaatatcattcagctaaaggttaactgtcaacaatcaccatgcaatcaacatattatactgtaattcacattttaaagggtattaaacaaagaagacagagaaggcaatggcatctcactccagtactcttgcctggaaaatcccatggacggagaagcctggtgggctgcagtccatggggctgcaaagagttggacacaactgagcgacttcactttctttctttctatagttcctgctggagaaggaaatggcaagccactccagtgttcttgcctggagaatcccatggacgcaggggcctggtgggctgcagtctatggggttgccaagagtcagacacaactaagcaactaacacacacaaacaaagaagaatgaacactgaaaatggatgcatgtgcatttcaaggaactttccaggggaaaaagtacactcagaggtactgaggttgacatctgtaatccatcaggtcttcttaatggaccaacatctttctagaaattaacacagagtaaaggactttagcatcagaattcaaattctggcatcagaattctctgaagggccactatagcagtttcaaattcaataggtctggagagggtccagaaaacctgtatttgtaacaagttcccagaaaggctgatgctggtccagagactacacttcgagaatctctgctttactcaatcataggggatggcagccagatcctaaatgggtgattctcaaccttggctgtgttagaatccccctggtaaaaacttaaaatttctttatgcaccccccctcccccaaatcactttcatcagagactgaggcttctctaggcatcggcactgaggatcccaatctgaggcaaacttgagaaccaaggttttacgtaagctctataaaagctctgggacacaagctttgttctgtcctttcatgcttttcaagatttaacttttggtgcagacaaggtacgggttccctagagaaagagatccaggcatggctttcttgacatatgagaagccatttttggcgtaagctacttggtgatctaagcctggccacaatgcttgcccttgtacagatctcagtaattaaagatctagagggaacaaaatgatgcagaaacaaacgactctatcaagcaagagaagtaactacagcaaagatagtacatcagttgtaaaaacttccaggtctgttttaaagattgtgctgaagtgttcaactacgagatcaactggaacctgagggatgatgctgatcttttctgaccctccttggattctgtctaccacccaagccccatcatgaatatgtatgacccttagctttaaacttccccaatcctgctgatgaggactggcttaggaaagacccccagtgttctcccttctcctgatctttggtttggttgtgtctgctgactcaacactcatcaataggcaaacctaatttttcatgtaacattatttccctttcgggtatcatacttcaggagccagaaatgaactaagaacaccacctaactagttatagtttctaaattctcctgacacaatcaacagaaaagaacagttccatcactgcagaaaaacctcctttgcccctccataattaacccctctctccacttccctggtggctcagttggtaacgaatctgcctgcaaaacagaagacctgggttcgatccctgggttgggaagatcccctgaaggaggtcatggcaacccactccagtattcttgcttggagaacctccttggacagaggagcctggtaggctatagtccatggggtcacaaagagtcagccatgatggagtgactaagcacaccactc

SEQ ID NO: 58763 - DNA, 1537 bp, Bovine  19866880663353
tttcctgatatctcaaaatcttccacatgttattgtgtcctgtgaagccgactcatttcctgggagaatgatcagtgctgtcgattggggtatcatggagtttattttatttttttttaatttttaaagtagttttatttatattaccactttaattattctgtaatttgttttgtgtatagtgttctaattaacctaaatttaaagggctaatcatacttaaaaaaattttttttattatttttattttttaactttacaatattgtattggttttgccatatatcaacatgtatctgccacaggtatacacgtgttccccatcctgaatccacctctctcctccctccctgtaccatccctctgggtcatcccagtgcaccagccccaagcatccagtattgtgcattgaacctggactggcgactcatttcatatatgatattaaacatgtttcaatgccattctcccaaatcatcccaccctctccctctcccacagagtccaaaagactgttctatacatcagtgtctcttttgctgtatcgtatacagggttattgttaccgtttttctaaattccatatatcatggagtttagaattatgtttacaaaacaaatttttggtcaggaaagatcagagatcagttaacactggccataggaaaacattttcattataacagtcataagaccaacgtccatcaaaaagagaagctttcttcctcttaaggacttttggtacccagttgccagatcatccaggtgtgaccctaacctgacataaccccagaggcgggtctttaggtgccagttctcacagcacatggtatagaagagtgagccgtgagcaaagacagcagggagctactggtactcctctcctttttccaaaaagtatttttggcaatgtgcactgtgtcagcgtgctttactggattacataccatatcttgttatcatgtgtaacttgtaaaatgatataaaaacgttatatttgaaccaaccccatgaaaataattgtgttcctcatggacaaatggacatagttctgtgatgagtaacagaagctgtttccacagaatgcaccctggggtcaaatctgaatgtgctttgactatcactttattaaacaaaatgggaagtttctaatgtaattgtgggatgcctgaggtctaaaactatatacctttttaagtaatctgaatatatttattacatagataagaacatagtattttattgctgcttcaacacttcttaaacttagccacaaagttttgcctttggtgtccagtatattctgtgataaaagcagttttactgtgcaacacagataatttaactgaagaaaagccttcatctttaaaattatgtgcacgtatatcgcagtatggggcatcccaagtggttcagtgaggaaagaatctgcctgccaatgcaggagacgcaggacatgtgagtttggccccgagtcaggaagagcccctggaggaggaaatggcgacccactccattcttcttgcctggaaacatc

SEQ ID NO: 58764 - DNA, 779 bp, Bovine  19866880667496
cttagtagacatgagttagagcaaactctgggagatagtgaaggacagagaagcctggtgtgttgcagtttatggaggtgcaaagagatggacacaacttagtgactgaaccacagcactctcccccacactcccctcccatccaggctgccaaataaccttgagcagagttccctatgtttctatgtatatatttatattagttttaatttttgaaatatatgaaagcattattcattcaaaatctaaataaaaatggtacaaaaatgtaaaggaaggtggtatgcaatcactcaattctagtttgtttagattttttaaaggaaaaccgatttttaaatatgagtttctgaaaattccaatgggatttttctaatgtgttagctctttattaaagtaattatgtccattggtatttgcactactctattaagaagctcagtttcagataagcaacatggttaggcagaggaaaatcagaaaacgtgatcaataaacttagagcataacaagtgtaccaattcctggcaccatgtttcctaaagaaagacttttaatataaatgttttattatcacacataccaagtctcacacatgatggaattttcaaatagccacatatattcttaaagaaaaacctccatggatggtagagtgaaatactgagacataaagtcctatcctggctccaaactgtatatattaaaggaatattgatcttaaaacactagtacagtaaataattgaagctttagcctgcactgcctctggcattgtt

SEQ ID NO: 58765 - DNA, 1150 bp, Bovine  19866880757277
aggagggcttgttttaaggggaagtctttacaatgtcacagtgaacaagtgctaactgtaacagccgtaatattagagagccatccaagctttgttttcccattaacaacctatctgcctgaatcccctcggcaaacacaaaaaggctaagatttcagagtctctgtggctctggaactcaagcatcatcccccagcttggagagaaggcatttcagacaaaccctcagcctcacgagccaaattgcttgtgacgtgacaggtgatggtggatgtcagctggacaagaaatgacttactataaactccaagcatctctcacttcactctcaggaaatgtaacttgtatcagatttctcttcctggaagatattcagcaagtcaaaggctccactgatacttgtaaatacggaagttcttcataaaccctgcctcacgcctatttagaatggaagaattaatttggaagccagttcttgatatttaaaaatagacttttttccatttagccatttcatttttaaagcaaaaaaaaaaaaaaaaaaaaaagttggtcctactaaatatgatctggaaaactaacttcagctctaccaaaatagactttttaaaaaagggctttgcttcgaggcttgtgctatgagctagtggaattgcccctggaatcattgcctaacactccttgttatttagttaggtgaaagagcaaaaaagaaaccggtagtcatgggtttttctttctcatcttctcttattctgtagtttgcttttgtcctttattttcctatacatgaaatagagatattacttgccacatgacaaactgagattcatttaggaatactgaacaaatatatcaaattgaacttgtacaatgaaattgccagttacttaatattctaatacataaagaaatttgtaagtttcattatggtctttattcttcttgacagaaaccaccagggtatactgagaaaaaataagatctactccctagttccatctgtctgtaaaacaactttatcaataaatacttacatgtactttacaatggtgcattatttagtatttttaaagattttttttgatgtggaccatttttaaaatctttattgaatctgttacaatatttcttcctctttttttttttt

SEQ ID NO: 58766 - DNA, 1255 bp, Bovine  19866880789481
aagaataaaaatctcttaattttaataccaagggaagcattttagtgtaaatatcttcatgaaatcaattttgaggtcaaagtctcagatctggacattgccttctgccatagctggtcattataaggagtcccacttctgatcttccaccacttcccctacagttttatagcatttcctccaacattatgattgaactgaaggctgctatgcatagagaatatcagaaagcagatgaaaactaaattttagagttttttttaacaatctaataaattgtaagttcaaaagagtctaaaatatgcaaaatacaaagggtttcagaggcactccagattatatctagaactctcaggagccggtgtaaaaaggacttcagaggcagtaagtttcttgggcatctttgggtaatttgaaatgcctttattttgggtctctatgacttttacttactcatattttttaaaaattgatttcagattgaacgttttgttaatttggtatacttctgcacctgtctatgaatatttaagtgactttcatttatgtgaataaaagtagaaaaaaaaagtagaaaagtaaaaataaaagattaactgtatttaaatttcactaaattttggctctttaaaaatagaccaatattaatttctgtggatgaattaatcatttacaactttaaactagatccaatgtgtataaaatggagggaaggtagaaaatattccgttgagaatttctagcctaatatacttatgaatgactttggcaagcaaggctcaacaatatttttcttaatgggcgtatcactgaataagcaatggataggatttcttataggaaattacactccattcaaaaatattcaagcatggatatcttagacattgcaaactgtcattatatctctttggtaacagccccagtaatccaatatggcctcatttataacagaaactttggcaagatgcagcagaattattctgtgtcacattaagtgtttgtgcatgtgtgatataaacaaaaagcattgcttgtagtctttaagagttgttacattttgtaacttattattttttaaatgcaaaaatttttcttcaaaaattacagtcttggcaagcaaaatcatacttggccttgaaagccagaaaggtaaatatagtaattataaagattttcatccattataaacttaggctaagaaaaaataaatttttctctaaacatacctaaatttatttcaatgtattatttt

SEQ ID NO: 58767 - DNA, 2226 bp, Bovine  19866880822801
catattaaaaagcagagacattactttgccgacaaatagtccatacaatcacagctatggtttttccagtagtcatgtatggataaagaaggctgagcattgaagaactgatacttttgcattgtgatgctggagaagactcttgagagtcccttggattgcaaggagatcaaaccagtcaatcctaaaaggaaatcaaccctgaatattcactggaaggactgttgctaaagctgaagccccagttctttggccacctgatgcgaagagccaacttattagaaaagaccccgatgctgggaaagattgtgggcaggaggagaaggaagcaatagaggatgagatggttggatggcatcaccaactcactggacatgagtttgagaaaactctgggagatagtgaaggacaaggaagcctggcatactgcagtgcatggggttgcaaggagtcggacatgacttagagattaaacagtaacaacagcctgcatcaggtcctccccaagagtaggcccacccccagtaacgcctcctccgacctactgtcctctcactgccgtgtccagcccatcttgacatccatccactttcctggagcaggccccctctggttagcagatctgacagtggggacatcctccctaccacagtagctcttagtcttctctcttgcaataatccttctgaataaagtctctccttaaatgaaatgctggtgtgtggggttatttttattttaacatacatctgtgcctttcaaaggaatattctactcaactaatgcaattttttaagccattgctctgagagcaggacaattaatcctccatctcagctgctgtgcactgagacaatggtccaaatgggtcccacagaaatctccacggagtcatagtccctttccttggagcagttaaataaaaatcacccctctcagactccagtgaatttaatcttgccagctaaaattaacacaactgaaagtaagtaagaatttcaaggaaaaaaacttcaaggaaaggtcagaacagttttaaatgtatgagattgccatagatgttggcagtgtgggaagactatttttacttagaggctgagataagatagaagttatcctacccctcttactcacttgtgccctggcatccataaaataacaagacctcatagcctatccagaaactattaaaaccactacaccttcatttggagctttttagagttctgatgaggacaatttcaagttataactgggttttaatatttttcataaagcatagtagttaaccattattactttaataatcaaatctactatgagacacaaataaaagatgtcagttacatttacaaggacgaacttattctttgatgttaggtaggtccaggttttcaaaacttgggttaagaaagctctttggattattgaggaaatttggacgttctctgtcaaagtttaagtattcgtttcaaattttgaaagcctcatttctacccaggagagttcacttttcagattaagagatttgaaaagcaagatagaactcaaagcttaaaatgtatggagataggcaagttttaaaatctctcctgggctgaattctcagtaataaacattagatttttagacttgactaatgtcatttgccattcaacatctatcatacaacatagtttataaatggaaaagaaagaaaaacaaatcaatttaatgcatgtgtgatctaagacctgatatatttctctaaccactagcaaaacagaaaatctgctttatttaacatctctttttctttgttagcttccctcagggctcagaccataaagagtctgcctgcaatgcaggcacagatttgatccctgggttgagaaggtccattcttgcctggaaaatcccatgggtggagaagcctggcaggtttcagtccatggggtcaaaaagagttggacaggactgagctactaacactaacagttttgtatgttagcataagcaatgtggtcatttgataaaggatattaaaagactgacttaacgagaattaagtgggcccatgtcaagtcctgtcatcttaatctccatctatttcttgttcacataggaaggctttcttatctctccttgctattctttgtaacactgcattcagatgggtatatctttccttttctcctttgcctttatcttctcttctttcctcagctatttgcaaggcttcctcag

SEQ ID NO: 58768 - DNA, 455 bp, Bovine  19866880872400
actagaatatgagtaccgcaagcaccatacacagaacagcacataataggagctaaaaatatgctgaatgaatgaatgaacgttataccacaaagaaagtctaagtcatcaactcagctgtttctagaacctgtgaattctgtgccccgttgcccaggggcccttgccaggcaaggcgaagagtcaggttgtagagaaagaactaggcaagctaaatcataaagaactgttatattattcactaatgttctattatactttttcctttaaaaaccaaaagctttagaaaaaacttttacatagccttagcttgatattgccaactagatagtgaagaatcagaaatatttggaaaaaatgccccaagttttggcttgacttaatgtttatctgtactgcctattttctcctccacactgtgaagcttcattagtctgatttacggctgctttttt

SEQ ID NO: 58769 - DNA, 1412 bp, Bovine  19866880886752
caagaaagaatttcccttagggtgtgtaagtattcagcaagggaattctatattacacataaagagcctatcattttatcataagcagttgtcacacactaagaaacagatgcttttgaaagaaaaacagtagaaccttttctatatactgaaaaagcccttgcaaaccttttcagtaacactgacaacagaaggataagagctgtcaccagaaagaaaactttatgacagatttgtgtgaacaggaatgtttcaatcattctcagtcacagtaaacaggttccataattggatggacaattttatcttaccttcaacaatttaaaaaatggaggtcattcgctgtgctttcaaaacttaactatttcattcgaaagctttggcagcagtttagacatgaaccataatgaattattgttccttgtgattgcagggtaaattttaacactaatctttttctatgttttctgaactcagaaatcacatttcttattattatatagattctgaaatagcatttcttcagtcactattgtttcaatcaataaaaactagaaatattctaaattaaataatagaacctagtctctgactctgggaatgctgtggggaatctgtatgtcccacagatttttctctaacagtgacttttcccctctatgatgaagcactccatttcaaaagtgttttatatatatatatagagatagatatagatatagatatcctcagttccatttccctctgcatattatctagcaatatggactgtatttagaaggtgttgaatggatgaatgactgctaagattctgattctttgcacttctcctggtacttctgctctactgaggacattaattgtcatagctacagaaattccaatttagaaacctatattattcatcctcaaatcccacttggtaccaaaataatccaagttatttaaaattcttatgtggtagtactgcaaagtagatgctacacttctatttggaggagtttgcccttcatcggaagaagaaatataagcttctttctttaatttatctcacactgatgaggattaagtatttactttttgaaaatacaacaggaactgcagagattaaagtatccatataaaccattgattacaaagcagtagatccaattgagttactttaaatgcttattatcatctaaaataatgtagtttcctatttggcaattattcttgactcacttttattgattagtcataagcaatttcatattttagtaatttcatatttgtaattattcttggctgtgaaaatcttacatgaaacagcttgatttcagttaaactcaaggctctgtttacaagtaaaaaattacaagtacaaaatccacttgtattatctgctttaatgatttgtgtgagggagaatg

SEQ ID NO: 58770 - DNA, 4405 bp, Bovine  19866880993467
cgaaggtgaaagaaagaaagaaaagctttttggaagctagctggcagtctctgtcacatctgctttgttcagcgacactgtctcagcatcaggaaaggcgcagttggaagacactagctgtgggcactttgtgtataactacttcagggttctccttgtgtctccatgtgtctgtgtgtattcagctgccaactccagagctgtttagggctcaggtgtagctctctaattgtccttacctggtgccataatggcatcatcatggcttactgaaaaacttattcagtggcagccagtgttcacacataaatgtgcccaagtgagagtgagatttaaagtttgccttaacgaccccccacttccacacactcttctacaacttacttgattatttcataagtcctttccttggagaaaagaggctggctctctggtggttaaagtgaattacagtatactatgaattcttttttaactgatggttgctattttttttcttccttgaattccaaattaatgagatttattaaaattaagtttataaaatgctaagctaatgaattataatgaggaataagaatattcttttgtaaagttgccattaagactgaaagagagagctctgtgattaagttcacattgtaattcaagtgactaaggaaagcaaaggttataagaggcaaaatgttcacggagaaaaattgctttactcccatcagaagactctagaggaaaatattactttaatttaaaattaaccagtgcatggcgctgtgcagaacaagcagaccttgatttgtgagtttacaagtccaggaatttctacttgaaaaccgagcagtactgagaaagatgactcatcatgggacaagggcccctcgtgtctcgtgtggtcatgaaagcaggtaccttaccaggttcagcctctcagaatatcgtgactgtcatgattttggaactgttcaacccctttttcatgcctctttcacctcagcctctccccacagcagatgcttggtttcccgggcagctgggcttccccaaggagtgtcctgcaagcttcctccactcacccatgccccctggcccctcggtcattgcccctctgcccggtggcagcaccacaaagacttgtttctgcggcaggtccaatgcccaaaatgacagtgccatccactgacattaggcctggtccttctgtgccctgttctttactatgtcgagagtacctgctgactcggaatttcagggcattctgctttcactgaggcattttattgtgggtgtatcttcattgtaactcagctatgacccatctgttagatatggtcgtcttgaagaactgttttgatttgtaacttacttaatgatgaaatgatttatattcataaactgtatgtggaaatatgtgagcaaagatcattatagctaccattgtttacttttatgttccattcagttattgaagtatgttacctaagttaatcctctcaaaaatggtttctgcatttttatatttgtatgcttgttttacagatgagaagacaagttttcaaagttgtgtaagttgcacaagctcacccagtactaactaagagacaagcctagatcacaggattgtctaggaccaatgcccattgtgttaataacaactagtatatcttgacttcaattacatattttcactttactctcaatatgaagtgagcaaactagaaattttttatattttgaaggaaacaaagatcacttcatctaaagcaattttttaactgagacccacagaaatgaacggagaaggcaatggcaccccactccagtactcttgcctggaaaatcccatggatggaggaccctggtaggctgcagtccatggggtcactaagagtcggacacgactgagcgatttcactttaacttttcactttcatgcactagagaaggaaatggcaacccactccagtgttcttgcctggagaatcccagggatgggggagcctggtggctgccatctatggggtcgcacagagtcggaaacaactgaagcgacttagcagtagcagtaagcacagaaatgaaatgccccccttttaccagaagtcagccacacagcacagacgagaactagaatgaatattcttgctgctatgacatgttacctcctgtactataacctagatgactcagtgaatatgccattttagaatctgatctctttcaaaccttgtcctttcggattcttagtggaaatattcttaagcttcatagcaacatactaattggtaatattatatcattaattttatactctgaattcaagagcctcataaataagattaaataggataattcatgaaaatagtaactggactcagacttttaagtagagcatcgaggaaaacaaatatgcaatcctacttgaccacatcccagattagagcatgtacatactccaacagaaagagacccactgagaaagacactctcagcagaggcccccacagaaggggatgcacccacaccaagaaccagcgctgctgctcatctgcctttgttgtcatgagctaggaaagtctccagcttcctccaagtcaagactgatcactgtgagctttatgagaatgctgcttgtcactatcagcagtgcgctgagcaatctttttttcatccacagtgattgacttgtgtgattctgtccttctgatcaaggacattcgtttttaagacagctggccagggtttgggatgcattctacagctgtgacggggccaaggtacatgcccacatgggatggaactcacgctctcaacttaattagctttaaacctaacacactgagccaaacggccatggagcattccccagaaagctctgcacatctacgcatgccactcattcttaactgtagacaagacaaatgcactctgcacatacaaaccactgtcatatgtcctgtaaacagtttttgagaccagtctgagttaagtccaggagagaaaatgtagggatagatcaatctaacttagatcaatctaactatttgaaatctcctcatgggacatgatctgattaaaaactttcaataagttaggaggtacttgccaaaagcaagatcaaagcataatgttagagaattccttctcccctcaatactttgttactgtgattgttcagcttaggttgctgattctaaattcatcgatactgaccttcaaatcttgaggctccttgaagctaagacacacaccttcctgaacctctctcagacgctcagacagcatatgtggtctaattagaatttagcttttgactgataacatgtgggtaaatctcatctgctctgagtttttatttcatcgtcttaaaggactcaggtttgctcacagctcagataccccaatttctcaatttctaaagctttacaactacattttccttcatcctgttttgagttgacaaagtatctcacagactattcactgaaatattaagtctagtctgtgctatgaccctcaaggctgtacatgaacccctctctgttatgtcctcttcttcctggtttcctacttctctcttccttgttctccatgtctctctggcctccttggttctgccatgcacactggtaccttccagagcaacctttgccctgactggatggttttccctttggatgctgtaggacctgctctcccatttctgttagcagtttctcacacatcaccttctcagggagacgttctctgccacccttcggaaatatgaatctctgccccagcaccgggtccttatctcccttctttcactttctgtattcttcttaccatttactgtccaaatactggattatttttcttaattattttgtttattacttgttcctgccctcatgcaagctctattaggggaggaatttgtgtctgtcttattaatatttatagctacatttaaaccagtgcctggtatggaacaggtactcattaagtgtttgctgaatgaatgaatgcagctaatctctgtctaggggcccttgttcatatatttctgatactgtgaatggtttggctagttgtttacattatgtatttggaagggcccaaccaaagtgagcaaattttctttttcatttttaaagctggccttctggggtgaggagagagtaattgtacttcttttcaagctctaaatcttatttttatgtgtcaaaaatacaggcattattccacgctataattcttcaaaatggatttatcggtggagccattactttttgtagcttccacagctaccaccagagagaaatcttggaaacatagagtttaaattcatgtcccaaatgtgactctcctgaatgcaaattgagtgtgaatttattagaaaccattagtgggagtaaagtgtcct

SEQ ID NO: 58771 - DNA, 1815 bp, Bovine  19866881051019
atattttgtccagtttcatagttttttcaggaagaaggtaaccctgttgtttggtcattttcagaatcctacattataaaaaattgctttcatctttttccctccattttattttttaaattataaaaatataacacatttagaggagacttggaaaatacaaaacccagttacatttagttccactaaccattacaattgttttttaagcagagaaattaaaatttctagttggagtttaaatatccaagtttaaatcaaaatttaatagaatgaatatgcagagaagcaaaaggatatagtagccctgaaaatgcactatgagccaattcaacataattaagatttatacaattttcatacaacagtaagatacaaattctaagttcccatagactaagagacactggaatatattcagggagacaaagcaaggtgcaaaaacttcatggtctaaaggtattgaaatcacatagagtctgttctcttattaccgtggaattgttattatagaaattcaatatcaaaagatatttgaaaatagcccacataatttaaggtgcaatgtgacatttaccaagagagatctttgacttagccattgaaagcctcagtaaagttaaaagactgacgaaacacagagggtgattgcaaagaaaaaaacatttaaatgaaaaattaacatcaaaatgaaaaattaatatcaagtatactttagaaaccccatgtatttggaaattaaatatgaaatctatagacccttattttaggctccatattttggtttagtaggaaaaaatgaaatttagtttgcttatttaaaatacatttgaaccaatagtacataagtgttcctttctctgcatctttggcaacagttgttatcttttgtctttttttataaaagtcattctaacatgttaaatgatatttccttgtggttttgatttgcatttctttaagttaatgatcctgaacaccttttcatgtacatgttggtcatttgtacgacttcttttgagaaatgtcaataatctgcctgtccttagagataaccctcccaacctcagaaaattatgtccacctcttgaaaatcatcagcatgtttttcaccaaatgaaaggattttgtgtagctttaccttctgaaataagtactatgaaaacaatacagtttattttgtttggtttccaaattcaaaattatatttgaaatattctttcgagtttgccacacctgactctctggagatcttgtctgtcctgcacatccacctccaggcaggccagtcacgggaacactctccagattaacctaacctcaacatctaaccaaaaaattctctttatgctctccaccaaatatgcatttgatatctaaatatgtatattttttattcacttaaccaaaaagatttagatattcatttgatcaaaaatacaagtgcttcacttagtgtcgtgactttattaaaaaaaaaaaaaaaatcaaacttctagaggtaaaaagtcacatgcactaaggcgccagagtagtgtatctgataacgtggagagagttgccaagttgcacttaaaaatagccagactaactatcctcattgtgatctgttttgtgtgacagggcttttcaccataaactctgaagcccccagtatttgtagcaggatgagactaaaccaggcaaatccattgttccctaactgtctttgtatttcttttctgttggaaaatgaaatgactctgatctttgcatctcaattttcccttaaaaagacattttatgagaagactgcagcttcaggaaaaaaaggca

SEQ ID NO: 58772 - DNA, 1239 bp, Bovine  19866881080483
aatttacattcaggcttcttctcataaaaaattgagcacacaaatgacattataacttttattctgtaagatagtgtacagctgaaagactccagggtttctaatttctgtaaacaattactctgtcacaaagaagaagtagatatttgaagtaaaagcagtgagttggagattaacaaccctctgaaagacacatgatccccccccatgctgagttgagtcctttctgtttccacagagcatctgtacgaccaccacagcatttctgcactttttcttcctggcttcattctgttgggttttgactgaagcgtggcaatcatatatggctgtaactggaaaaattagaacacggcttataaggaaacgctttttgtgccttggatggggtaagcgtattgctattctcttttatgctcttgttaaaatgactttgaacactgctgtaatgaatgaagttggaaactgtgattatccccaggctacttttctttgtgtctaattcagtatgtcgaagtggaaatataggatgttagtcatattggaacattctttgaggttgtggaactttaaaaagagtgaatactggatggccacatagctggtcagttggtaatcaatagtgctcacatggtagtaaatgagatgtaaggtatctacaggcaagaaatcaaaagtattctctactataggttctgaaaatgcaaaatgtcttaagaagttcagttcagtgcaaagttcagaaagctttaaagtgtctatttcaagagagctattcacgacacaagagaaagtcatctagaccatgaatgaaaccacatggctagtctatggagttctcaaaggaagcacaaaaattgctgacaggctgaggatgaattaatttttcattagtaaaagttcctctcacagtgccgtatgaaatgggaatctggaggacctatacatttcaaggggccaattctaaagtttaactgaaattaatgaattcatttagtttaattagaattaattaattaaagaactagttttagaaaaagctcaggattttttcacgtttgcctttgagtttcaaaagacttgcactaaaaataaatgaggaaatttggaccaaagatataacaaatgaatgctagaggtagcctaaagaatcacaaataagtggacttattaccatgtcagaataatccatgctagaaaaacacaagaccaggagcaccaaggttatccatcagattt

SEQ ID NO: 58773 - DNA, 662 bp, Bovine  19866881125295
cttagttattattatgcattttcagagcactttataattaagcttcagatgaaactctctatggaaatgactcatcttacagaactagatttctatttgttttttttcttttctttttctcatgatattttagtttcccctacctgtattttatgacattccccactgctataaactatgctcctacttcatttttcagcctttacattaatttgactccttattcagattccttaataaaaatgctaattatgatcatatctaatagtgactgggaaggcactccaccacctccttcctccctccagctggacccactcacatccatcataagggtttggtttgtcagccagattgcagtattcccagctgccctttctccaagcccgctaaacccattttgggaaataaatccaattcacaagacactctatcaattattccagaaaacctcagatgcagaggcacattctgtgtattttctaacgcaatatctttgggagagaaccaaagctgaagatgaaaccgaatttattcttacctgttctcacagtattttacttattgctcctacatgtacaattagagcttctttggtcactcagccatatccgactctttgtgatgctatgggctgtagccctccaggcaagagtactgga

SEQ ID NO: 58774 - DNA, 1104 bp, Bovine  19866881263786
cctctctgtgatggctggtgggttctttctggaggaggggttgaaacagttgctgaagttacagaagtaggaaggaggtcagaggtttgagtacattcaaagagtctaattctctctattgaaaactggagagtgagataacatggaattgctagacagctctgaagcctctatccagctgaatgaccatgcatttatctgctcatcaccaccagaaaaccaaagacctagagcgtagacccctgtccaactatgaaacaagaattccagccccctgcaaaggcttctttctgggtattttattgggttccatcttccatggaccacccagtacacacaagcttccgtttcctcccccttgaacttctcattcccctccccttgctgccgtgccctcagaagactgaacccagctccatggaaacaactcacactactgccaggagcaaatagagatttcagtccacgggctggggtattctgaaatcacactgtatcaaacccctcattctgaagcaggatgaagatgtgtctcaagctgcttcttatcttttaataaacaattacttttgaaagttcagaaccctaccaggctcggttctcagcttctcagcatgtgggacagacaactatggtcagagtgctgtagtccagactggacaaaaataacagctggcagaacaaactatttctagtaccattacttttacaagaaatgactagtatttatggaacacactcatatattaggaaagaatagtttagcccagacaaaaccaaggtaatcttttctttttctttagcatgtcttaataggctttgctgttgaggaatttagggtcaaatatttcttgaggatccagtgtatgcaaaatcttgtattaggcaagttataagcattttatagaagaacataaacatacaaattatttaagtataacacacacctgcaagtagttattacctatgtgtgtatttagaaggatttctaaaaggagcaagatcaagagggtaaggacacttcaagtactgaatttaagttgttgggtttttttttgtgcgaataaaacacattcttaaatcacttatttctttgccaataca

SEQ ID NO: 58775 - DNA, 1945 bp, Bovine  19866881304522
ttgcattatttcacttaggttctacaacattccaatccatactttccattccatttatttatataggtagatagataaatcctttctctgcttgtctcaaaatcctataagccaaaatttatacttgaaatatcaatagactttttattaggcagagttgaaagcattctatgtactgaaataatacagtgaattttactagtcgagatttcatataatatttaaaactaaggtagtctccaactgataggtaaaggttgagggcatagatagctgaatttttataaaccccatttcttacaactaattgaattaagaaaaagctacatatgagagcagaggcttttgagaaatcagatactttattgacagccaccagaagtacttacttgtttaactttgctggttgaaaaaatgatacattccacagaaacctgagttgttgtagaagaaaacctttctctggcagagcctgcagaatgtgataaaatgctttgacagtatgttcgagttacatgaccttcaatgaaaatagccaagtaataaattagtcttcccagctgctagtgaataatcataacagccaatagtatgtgaaaactaacaccatgacagatagtaatcatgtaatgtaacatattgatcccaagtgctgaaggatatgagtgcagaggcctgaaaggagctcagttaagaaaacatgtatttcatcaaaaatttcttgtgaaattagcactgtgttatgcaaagacattgtggaaaccgttttaagtcatgctctaatctgggaggatacaagggcattgtctggtgccgtggttttactgttactgtctttgagtagattttgaacaactatactttgctcaacatcatttatcccaaaaggaggcattgttaggactgagtggagaccttgactttagggtcaaaacaatgacagagccctttctcttgtctttgcttttagttttttcaatattctgtcttcatccttccctttattctacccatgattaagtatactaggattgcatacatattgggagttataggagttactggagttggtggaagtcatgtccttctcctttgaaacctctcagtgttgaccagtcgtctaaaaggtggccagtcttagaaatgtggcctttaagttacttcagcaactaacccctgatcacttctccagggacagtgctttctacttccagtgcttgcattgttctctaagacccctacctcctcatgtctcacacatctttcttctaacctagcagtcatatcagtattgttacacacaactctgcgtaaactgaacattatgcctcttctgaagacctggaaatctcttttggtgagatgtatccatttcaatctcatggtttaattgtcttcagttcactgccaaaattttgtatatgagaaattccagtgatccctctggtcttaggtacagaggctaagaggattgctactaattttatatatatgttgcctctggtggtttttcatttgagaaatttctcagttacctttacaatgattaacggttctgatcggagaaacagaactctcatattttttaacattccaaagctgtgccccaaacatattcagttgaaataaatggtgttggaccaactggctggctgaccagtagtgcactgagaacgagcctgtcctttatcttggatacattaacttaaacttccaaagcctctctgcatcttatcttggctctcaagcctgaatattctgtgtgcaatacaaaagcccagagccctcaaaatattttccctttcccatgaggcaaaaatattttcactggacattatattttttagttggaacttaaatcatatttttttcctgtaatactaatgaaaatggttaaattcttatttatgaaaagctcaaaatatttaaagatctgaacaatgta

SEQ ID NO: 58776 - DNA, 1154 bp, Bovine  19866881305906
actaaaatgtcctagtaactggcgtatctgaatcccctcctgaaatacagcagcaggccaattaattaatatgaagctcagtggaaaggacaatgctacctggagaactaagcaattcaggcagccttgcagcatttaattaagctacagaccaaggaagagcattgatagtaatttagagcatcctcggccagtgaagcgtgggctccaaggcaggccttctccagtctgcttttcacttgtctggcgctctctgctcacccatagggaccaacagcatctactaccaggctctggtacctacttacaaggggatatgggcttccccggtggctcagaggtaaagtatctgcctgccaatgcaggaaacatgggttggatgcctgggacgggataatcccctggaggaggaaatggcaacccactccagtattcttgcctgagaaatcccatggacagaagagcctagcaggctaatccatagggtcccaaagagtcaggcatgacttagcaattaaacaacagtgaacccactttcagacacatatactgattctcagagcgtgagtgctttgactcgctttccaagaaacaggtaatagagcatgtggggactaaggaaggaaactggtaaaagagtgtcttgaaagtgtggcacccacagtgaatgtgttgtggctgtgagcacttcatatagaagagctgtcaccagcgtggaggtgtctcccctctgcagaccccagaggcccaactcaggctgggaagcattcatgcccctgtaggcttccttggtggctcagtggtaaaaatccagcctgccaatgcaggagacacaggagatgcaggtttgatccctgggtcgggaaaatccgcttgagaaggaaatggcaacccactccagtatactttcctggagaatcccatggccagagaagcctggtgggctacagtccaaggggtcacaagaagtcagacatggcttagcaacaacaagcccctgtagcaccttctcagagtacccgtgctgctcagctccaagctccgctaaacgggaaccacccgtggccctccagaattgctttggatgagagagcaggtccagggaaggccagataaagggggccacagagaaaggctcattttaggagaatcca

SEQ ID NO: 58777 - DNA, 938 bp, Bovine  19866881307531
agattttttcccctgggcattttaatacttgaaaaagagtttatcactattgaaattctgacagtacaaggttaaaacttacatttaacctgagttttattgtataggatggtcttggattctttagcttaccgattccatttgtaacaggttctaactttcagcagaagagactccaggtgaatcagtggaggactaatgccaaacatggaggcattacaatcacttctttactgtttccactgagaagagacacccatctggacatccagttccatggtccagtgtgagttcagcactgttagaaaagatgaggatgagaggagacacagagactttgaagttaggtctgttggagagagagcttaatccaaaaaagccaggaccactggaaagtgagtgaagacgatgggaagtggaaagccacagggaccctgggacctgtgttcctttaccatcactgagcgtattcaaaagttcctgaaacatttctttgtcctcagaattataataatttaccttatttcaaaaatttcacttaaaaaatatcttctgggagtctttgaaagttcaggtcatttaaaatgcatattattaattttactgagttaatagccattatggtctagcagtatgtatagtatatatcagaggacatcttaaacgcatattatcataaaatgtatatttaagggctttccacctacataaattgaatttaataaattgtaacaactacagtgggactattaggatctttgtaaaaacacagttcagggtcttgttaaaacatattttctcttggtgtcatattctacttagggaatttgttctagtaaccaagagcttgaatgtgtttgtcttgctgagttaaaaaaaaaattgaaaagtaagattttttttttcagtatacagtctaagtcaagaagaaagcaaat

SEQ ID NO: 58778 - DNA, 1437 bp, Bovine  19866881378796
ttgttacacaagtggctgggtggcatgatattcatgctctgacccctgaagagaaggctgaagcatgcattgtctaagcaccaggacttgccagctcttcactgatatcattggcagatcaatcttgattttcattacagtctcatctcttgctcaaagcattttctaattgtgtcactaccctgttaccaggcaaaagcaaaaaagatatatcttttaatatgtctcccagtccctttggcaatcttctagagagtaaagttccaataatttttccaggtgcatctccctttgtcccgtttctgacaccctgtgtctgaaacagccaccagactgctaaccatagctctcttcctgccttgtttttctcctttgcacattttcctcattcatctacctcaatatatttattttttgtctaccctttctttgctggctcacggaattttacctgaaccacccagcttccatgtatcttaagatgctttgaattgcaatatcactttggttctgtattttaagctacttaagggcagatactgtgctgtgttcaattttctctctcttatatggttctaatctagtggttgggaaatattaacataattacttactaaagcttccacctcataaagtcagatttagtttatgcagcttatggtcatctgataaatactgggcagtttaaacctcaataatcccattattaattcttttacatattttcccactgttaatccttttacatattatgtgaggctttatgtaggctgggactctttcattgctctagaatctcatgtctattatccttttattctcacaaagaccatctctttatttggttctgggaataagtatcaagcatctcacagcttcctaaaacagtgggtgtatttctatgtttaagccactttttaagtcagatactgacatctgtccccttttccaagtgattctcatctggtgccctttttttgggaaaactgaaggggaagtggaagcaggaccctgctggggggctgggagagatggatcgccatcctaagtctccgagttcccggtcaggcagggtcttggtggatccatgctgtgaactgcccttgacgccttgtgagccctgcttgctgaaggcaagtcccctcagtgagcccctattgagctctacttttcccaataacacatctggatagggacctgaataaattcacaaggaggctagcttatcctcaccatcagggaatttatgttttgtttcaggggtatgatctgccatgcagaacacaacacatttcacccttggtcatagctttccatcatgtagctttatttggcatccaacacagggcaaggcttttgtatttgtctaagagtggattctcccaaagggaaccctcccacactgtgggtgggaatgtaaattggtgcagccactat

SEQ ID NO: 58779 - DNA, 846 bp, Bovine  19866881498393
atggctgaattgtttaaatccatcagcttagcttaggtacatttattcatggatgaatggataagtgttaggggtacaaaggagggtattaagtgccaaattgaagcttcaacaatacctattgctgccaattggcaggactccaaatatcccctcaccaaacagatggtatgaaagttgcagcagtggaaaatatgacaggttttaaaatgcatgcaatgaattaaacattatggagttgaacctgaaagtttaaacttttatcttaaaattatacctctactaataaaacttcatagaacctttgaatattattaatgcacccacattattaatgcacccacacaaatccaatatgtgtcaagaagtttaggtcaagttcttaaaatatactatgaatatgatagcatatgttttttttattgatcaagtatgctaatatcatctaaatgaaggctcaaagggaaaaatacagagccatgttggatttatttcattctggatactagaaaaattcaaagaacatggaaaaatagagattataggaagcataagtgtttaaattattaagcaaatgcacaaataagtatcttattatctaattattttcctttctcttgggttctttagaagattacagtcgaagtattgttcttgatgctataggattcagtgcctttttaaataccagcatattcatcagactttttcacctgctttataaatataaaatacatttttggttatcatgtatattcatagtgatgccttgataagaagtagatagtaccaagcgtctgtcttagcaaatgataatccggggtcacaaaaggtagtttcagaagc

SEQ ID NO: 58780 - DNA, 749 bp, Bovine  19866881560884
aaattctcttattttttctaaattggatttagcccccaaatgcttctttagaggaaaacaacatgtatgggaaaacagggcaaaaaatatattgtatagccattttggaagttgggtgtaatgaaaattcaagaatctatgattatactatacatgtaacctgcctcatctaactctagtattaacaaaatgcagaacagagaagaatacagcatgaaaactcttcttatagattcacagatttttattcactggtgtattgtttgaaagtttggactgtacctctccttggccacaggactggtaggagagtgtataaaccctcccacgtcattcatgaaagaaaaactgctatgtagctaaggcatcaggttaaactgatccaggaacattttcagcacagtgcagaacagaacatggtataatgatacaagcaccagagccttctctctcagaatttctccttgcgttttatctccctctgttctgtctataccccctgaatagtgaagagtttcctgaactcttaactcattcttattgtttcttttacaagaagcatatgttgatcttatttcatgaggctctatttagggctctattcctgtaactgaaagaaataaaatatgtctgtgccttatctttcaaaggcagaacctacttaccattgactcttaggatgcaaagaatacagatgagttctgtatgatctgagaagcaattagcatattgtgaactcccaaatgtta

SEQ ID NO: 58781 - DNA, 625 bp, Bovine  19866881717732
tcctcaaaacaccccagttatttaactcaagtcatacatttttacattctgctgaaaatgattattcagttaaagaactacaatactgtttaagtgtaaaagtactttttggttaaatttttttgaagggcataacatgtagagtcattttcacctaatgttctcttcgattattgtctaaaaaagctttttagtggattttcgagagctatgttacacttgttagcaatttacatctgaatttaggaatcaaaatgttaatcaattaggccaaaacacaggaaatcttattacaattaggataatgaattaaaaattcgtgcttttgatgtttcaaagttttgaactcatagagctttgatataatgtttaataaacacatatttctactattataaacagcctctcaatccccaagaaattaagtcaaaagcatgtatttctacactggaatacataatacttttattcagaacaagatatttttacttttaaaaataattttgtcagaaattccccattttattaagaaaaaacatttagattatcaataagcaactttaggtcacaacataaacacagaaagagaatcaaaatcatcaccaaccatacccttattatgtgt

SEQ ID NO: 58782 - DNA, 867 bp, Bovine  19866880563569
catgttggaatctaattttgaacatgataatagctttgtttaaaaaaaaaagtcttgagttaacagtgaggtcaaaaacaatgaaatgaataaaaaatacatttactcagtcaacagaatttatttgttttggaacaggctgtttctcaactccgctgagtgttttggaaaaattaactgtattgttttttcgaccctggattaaacttttctctgtgcttccactggtcccataggtcacagtgccagatttccacatggatgtttacaggggtcacttacttttccctttgcttctcttacatgtgcttgaagatgcacagagagctgtcttctttaatcttttaaaaagtctcccaggaatttcaatcttgcctcaaaccaatgggcagagagattgagtggaaagagccagagcgtggccaccaaggaacctggacttgagtttctgtgtttcccccaaaactgactatgacctcagatatggccccttaccctctctgagccgcagtctgtgaaatgagagaatgggactgaggcagctgtcaccagccaactggcctgctgctgactggtttggcccacgtgttgttttttttttaattaagtgtgtatttctttgggctgtgcagggtcttcgttgctgtgccggctttctctgcttgtggtgagcgggggctactcttcgctgcagtgctcgggcttttctttgtggtggctcctcttgctgtggcttgagggctctagagggcgcaggggcttagttgctccaaggcatgtgcaatcttcccagatcagggatggaacctgtgtctcctgcactggcaggcgggttcttagccaccgtaccatcagggaagtccccag

SEQ ID NO: 58783 - DNA, 1014 bp, Bovine  19866880570560
tgatcggacgtatctaggtgtcaatcctatgctaggtgacctacacagcgtcggcacaaccctctgaggtatatgaaactgctaaccccattcacagatgagaacactgaggcaaggagaggttaagtaatgggccccaactcacacagctggtgaatggccagttttgtctggttccaactgagtctggtagtgacccttgactgtgagccttggctgcctcttctacccagtaacacagtgatctcatgagtgaggggcctccctactcgcagtcttgattctgctcacaccatgctgtgctgggcggagcagggacactaggtggagcagcaggagggaggttcgccccaggggagcttgtggtggcctgaacaggagggacaaggaacacccagtgtggtggctggccacagagagagctggaaaggagtcatggatgggaggaccacgggctggttcctctgcttaggaagggagtcctggagatgggacaatgcctggagcaactctatttggcatccacacccccaactctgtcctaattgctctttcccttcccctcctcagcccccagtgcctggtgctcacggggccccccaacttccgcccggccctggtggacttcgtgggcaccttcacccggaacctcagcctgatgatctgtggccatgtgctcatggtgagtgtcccctgcagggagggtggggctgtgttcctggaggagcctttgggcaccgggtccacccccaagggtgggcgtggggtagggtgaggtaggggccggaggaggggctgtggagcctggacaggctctctccccttccctgtccctgtcactggcttctccccactgcccagcccctcacctgctccctccatcttcctcctggccttccccctccctagtgaaaaagtgaaagtgaaagtcgctcagtcctcatgtgtctgactctttgcgaccctaggactatattcttcaggccagaatacggagtgggtagccttccgctt

SEQ ID NO: 58784 - DNA, 835 bp, Bovine  19866880633920
aatgaaggcaaggaatgtggaaggggtgaggtcagggaatctgggggctatggatgcattaggtggggtcctgtaggttattgtaaagacccaagcatttacagagatggggagccctaatgagtaggcttccagtcatgccttgaatacctctaagtgataagaaactcactacctcagtggtgaagcagtcttagctcggagtggcctgcagggccatgtgcaacggacttgtccctggaggggcaaggaaggcagtggctggaagtcccaggccatacaaccccagagctggggagggttgctgccccttgatggagaaccccctcccctgcctgcctcaccttcttgtccagcttcctgcccgccaggctcagcgtgatgacccggttatctgacagctcctgagcagcgatctgcaaggccagaggaaagttgggggttgagacctgtctccaagactccctcctccgacctcctttcaggcagggtggacatgggatgccctagcagtcaattctccggggtggggcagggagaggaaaagtagtaccatgtgacttggcataagcctcttgtcttcctaaaacctcagttgccatcttcggggaaagtggggctaaataacttatctggatctgagaatcagaaagtgaccccaacgtagctcaagacaggcatgagatggtgcagggagacgaagcggggatcagacacagggatggtctagagccctggggagaggttctgggtagaggaacagcctgccaggcctcctcatccccccactgctctctcggctaggactccctctcctcccacacctactaggata

SEQ ID NO: 58785 - DNA, 2073 bp, Bovine  19866880656436
tggcacagagaaggctgagagtggaactggtggggagaaaaagctagcacagggacagtaagaacacgctcacatcagcacaaagaaatacgagcatttcccctgagaaacagagaactgtggtggcatacggaggcagtgagactgggggtacagaggcgggtgggagggaggcttcacagtgtgttccgcttgtcctccctatattgtactgatccttgaatcctgtgtgaatgtcactattcaaaccattgaaaatacatggaaggagtcaggatttgatcctctccatcagggatcacactcagagggaggtgggggtctctggataactctgggggaggcggttactggccagcccctcttcagcagcctccagaatgtgagccttccaagagccttttcctgggggcttgcaggtcctcaggaatcggactgcctgaattccaacccagctgtgagacctcggacaagtctcaacctctctgggcctcagtcgcctcagctgcccagtggagctagcagtggtggcggtctgtcccccacggcggggatcccacagggggaggttttaacctgctcctggcatggagtgttgtgctgcgagcagtgcctgttgagtatttttctagcacctctccctcctctctccctccagatcgtctccagcaagaagatcactcggcctctgctgctgatgaatgacaagcctgcggggaagggcttgattacggtaccagccccgtcccccgctctccatgggcaccctccgccaccgccttccccacccccaaccggcgctgcccattgccctcccccccatcaatgggcctcttcactggcagataataaccagctttgtttggagtaaaaaagcccaacttacaaacttggcaacaggtctcttagcaacgggctcctggctccacatatgatgcgttggggctgccaagctgggggatggagggggactaccaaggggtccccacgggcgtctccccgggctgggccgctcctactcctccctgcatcccctcctggccctgacccttgctgtcctcccttggggggtctttcgggaggtttcaggagctccttgcccctcttagcttggctcatggctgcaatgcgcaatgattcctctgatacgcaaagatttggtgatgcgcaatgatccctacgctgcagagtgattcttgcgatatgcaggccctttgagcagatgagctctttggtcctcagactctgggaaggcagagtctgcttctacagatgagggaacagaagtccagaggaaaaagtgccccggggcggttcagccagtgagcttctctcctggcttatccctcttcagagcctgtgacgccaaggaaactggccgtgctgggaggaggagggctgtacctctgtgtcttcactcatgaagccttacttgcctgctctggaacattcctgcctccccactgcctgtggagccgtgcattctgggctgggagggacccagcaatctcagctgtttttttacccgattcatgaccatgggcctgagttcaggcatactaaattctaagcacgaagtgaaagtgttagtggctcagtcatgtccgactctttgcaaccccatgaactgtatagcccgctaggctcctctgtccatgagattcctggagtgggtagccatttctttccccagggaatcttccccgcccccaactagggatggaatccgggtctcctagactgcaggcagattctttactgtgtgagccaccagggagcacttaccccaggctgttatccactgttctgccactttgaatgtcccctcccagcctcctcccacctcttggggtgcaaaacctccccatttaagtgcctccactggtcagctgtcctccacatggaagccagcccagaaggaccccacccagctggtgtgccctcccccagcatttccagcagctcccctccagacctgggtacccacctcttttgaaataggggtaatgatagggcctaccctacagggttgttgagcaaggtctcatctggaggggaggcaggagcgagggg

SEQ ID NO: 58786 - DNA, 1953 bp, Bovine  19866880757603
aagggaagggagagtaggaatttgcagagtgacttgaagtggtggtgtggcaggtagtgtgttcagggcagagagaagagcctgtgcaaagtctgggagatagagggagcagggtgagttggaggaactgaaagaaggtgggcgtggtgaactctccatggaagatgggcaggatagagagagatgcgtttgaagaggtggggagccaggcatgcagcgagctatgagtgggtctacgtgctgttggcactctgaaggcccactctggctgctgagtgggagctggctggggtgatgctgggcagaatggagggatggagagaaggggcattatccatctctggtgaaaaacaacagaggctcagtgacttgtccaaggacatcttcataacaggaagcctgaatttcagctgggcaggtggactctcaaatctgttctcagaatatgctaccttactgatgagaagcctaggggtgtgagcacagagggctcctaaatctacattatgtctcagccagtgccctctctcacctgccatcctgtaccatgtgctgtttccactgagtattcccctctcgtcccctccagggagggcagttttcagctagaacttcagggagtggctctgtggcatgctggccatcgtgtggcaggggacaggatcctgtggggccaaagctgggcctctgagcagaaacagtgatgccgctggggggagggcaggctggtgcagccaggcccggcatgagctcgttgctaggaaaccagccagctttcaaagaactctggctgaatgagatgttttcttgcgcaaaaagcctccttggaaatgtcatagggcaactctggggagggtgggcgtggccaggccggagtgcccagcggtgccaggagggctgctggggcgaggcatggaaagggcaatgctctcccctcctccccttgctgctggagcaggccaggtctgcctcccaggcccttaccttccctctcagctaacttgccgtgtcctgccacgtgaaacttcctttggtcgttcccacctcagggcctttgcacgtggtcttcccctggcctttggccccctttcactgacttcccatgctagcctcaggtcatttcctctaggaagactacctcaggcccctcctgcctgccctggcatcgtcatccagcactttgtgggcactctgtgctggtttgctcattgtctcagggaggctcaatgctcggggaaggctcttggtttccttcttgctgtgtcgggctccaggcacacacacggtgtgcagtatgtgactgtggacagtaaatttggggtctggtgggctgagcagacagaggtgttggttctctgagtgggaggttggaaggagccagaagaagcatgtgactcagacgtctaccctcaggacctcagtccctgcctggatctgatccaggtgagcacagagaggacccctgtcctgggtagtggtggaaggactgacctttcaggacgagccagagttagtcaggtgaagaaagggattgggccaacggattggcctgtgcaaaaaggtccagggtgggaaagagcagtttatgactcttcccaccttacagatggggaaaactgaggctcagggaggatgatcactgaggtcctttcaacctcctatgtggccccaacccactgccctgccaggaccagagggaatggcctctgaagtaatttgggaccacgggctgtgcccagccaggtggggacaacggaaccgttgatattcagaaggcagtagagtcccagaacaaagctctgtggctggccagtccccaggggcccctaatcggcttgaggtggcctccaagaagcttggtatgtttgttggcatttctcaggcaaaccagggcagcaagtgtgggaaggggcttgggctgccacaggtagcatgaactcttatcccctggat

SEQ ID NO: 58787 - DNA, 876 bp, Bovine  19866880765323
catcacccaggagttggacatcctgagaactttctccagtcccaaagaggtcatctcatgctactctgggaggaagacagggtgagggaccctgagggttgtggtttagaaggtaagacctaagtgccatgagctttctgctttgcaaacctctgtgaggataaggacaggagtcagactgagcctgaaccctggcctggagtcttattagctttgtgactgtgagcaaatttacctttctgtggctaaatttcctccactataaaatgcccacagtagcagtacttacatcatagagatataaggattaaatgagaggatgtatgtaaaagtgcctggtacgtgacaggtgctaaataatggtagccgttctgatgatctgattcccccaaattcttaatgaagagtgtgcccttccccacaccatccacccaaaaggccttgcctacgctgccctgtcctccctcccgcctcctgtcccagtgctccccatgatactcactccacttcatccagttgagggccttcccgcagctgggctatgagcacctccacatcatggaccccaagctgacacttctggagcctgaagtgggggtcagagcagagaagctcaaggttagaagctacactatggctcctgtagctctgagtgtggctgctgggagctggaggagccaggaggccagcagacctgggtttaacctcggccctgtgtttcagtagccgagtgaccttagacagggcacctaacctgtctaagacccagttgcctcctctaccaaatggggctaatgtgtactttgcaggttttcaaaacaattaaaatgaggtaatggatataaaatattacaatgtcaagcgcaaagcaaaggg

SEQ ID NO: 58788 - DNA, 752 bp, Bovine  19866880775019
gggtccctacacggccttgctgccttgccccaccctgtctgctctcagacccggccccaaggactgagggcttttagagactagcaatcaccatcttcatcacagcgacaacacttggttgtttccaaggtgattctgcattcattagcttagcgagcagcacacagccctccgggaagaacagggcagtcactctgttcccattttaaacaagaggttcacagagatgaaggccctgcccagatcagtcagagagtcaggcagacctgggacaaggactcaggtctcttgcccctccccaccatgggttctttttccatcttaataagaaagagctttgccaaggcatccccaggaagcctcaggtgaccgtgaggccagagctggcaaggtggacagcaggattcccacagcccccctcactcacctggatgggtttctccatgtccccatcacacagggacaccaagggcacggtgaatggcttccacacggggtccagtgtgtacttgatcacctgcacgacagtgagggggtagggggtgagctgggacccaggggtggcagtgctctgggatcgggccaacacaatgggacagggggagggcaaggtggagagacccacagccacacttttggggatggacgtgagcacccccgtgatgaggagggagcaagtccttaggggccatcaggggtttccctggacactgtagaatgtgcctgcctggtcccatcctgagctgtcaggg

SEQ ID NO: 58789 - DNA, 1630 bp, Bovine  19866881137735
gggacttaccgtgtggcttgaggccctttctctagactccgcctcctcttctgggatggagatgagatgggtggcaagctaacacttccggttctcctgctgttctctccccaagcttgagccacaaccagatcggaaacatcggtgcccaggacttagctgctgtcctgccggggctccctgagctcaggaagatagagtgagtggccagccctccagacaggggcccttggcaaccacgctatggtctggggagactgtggcttcctcccctaaccctagtgttcaggcagtggggctggttacctcctggcactactgattcagggaccttgagccagccaagcccctgctcctctctgggtctctctgccacatcagtgggtggtgggggtgctgtgggtggtgggggggcccagcggatgtggtggggtgagggataagggagtcgagagtctgacatctgcccctgttcagcctctcagcaaatggcatcggcccagcaggcggagcgcggttggcagaatctctcaccctttgcaggcacctcgaggagctgatgtgagtgtctgcccgggtgggctgccctctgccctctgtccttgtggcccacctggcgctcgggtcccccactaggcacagggcaggggtctggagcgggccagcctggtgctcaatttactcccctctctttttccaggcttggctgcaatgccctgggagactgcacagccctgggtctggccaaggggctgccccagcacctgagggtcctgcagtgagtggcccctgtctgtggtgtgtgcagggttagcgggaagctctccccacccccgccaggagcactaggggatcaaggccccatcgctgaacggccctgccgtaggagaaactgggatgtgtcctggggctagctgccctacctctgaggccgggaaatcaggggacccagcctaatccagactcagccaccagcctttggccaagcccctgccctttctgcgtctcggtttcctcgtctgtaaaagaacaaggatcccagcttggtgtaccctgtgagccaatctctgagggtaaaggaggaagtgccagcaaagggctatgcaggagcaaagcaccccacagcatggcctcggcactttacagtgtatgtccagggtctcatctgagccctgtgtgaccgcgatttctaccggctccattttccaggcaagggaactaaagccagaggaagtatggaaagcttaccctattaccctattcatacatggaggagccaggccttgaacttgggatctcagatcccaaagccagggccccttgatacccacccatgtcctgtattgggggaggggggttggggtggcagttacccagagagggtctaaggtctagcagtgcagcctgagacaggctgaggctggggggatccagcccctcccaatccccatacctgcccctccaggctgccctcaccccttccctttccccagcctgccatccagccatctgagcccagagggggtgctgagtctgggccaggccctggatggatgcccacacgtggaagagatcaggtgagtaggtgccctggaacctgggcagagggacaggccggggagggtctggg

SEQ ID NO: 58790 - DNA, 1283 bp, Bovine  19866881157450
agaaagtctcagatcagtgctaactcacccaacacgggtgattgccccttttagccagcagggggcagactacagggtcagcacttccggaaggacccaggttccagttaggagtgaatgccattgtttgccctgttgctatccttgtgactactttctgtttagggtccccaacacaggcttctcattcatagtagtgatagatgtttctgaagatgaatttcttaaagtgaataaaagaggggatagaggactgatttaaagaaaaatgtgaaacaaataataatacaggtggtgcatggatgtggcaaagtcaggagggaggcaggtgcatggtggaagcttagatcctgatgtttccacagtcacgtgtcctgaactctcaggacagccagctcctaagctgtctgggttcctgtgggatgaccagctcgggaatggggttgggggagtagggaggagccctctgtgcctggtacagtcttcagggagggcacacaggtccccatcaggcacctctctggtgcctgcacagcaccccctagccctccccattgccaccttgtctccccctcacggctcttcttctgctgacttttggacccctccctaccctgcaggctgtcctggaatctgctcggggatgaggcagctgctgagctggcccgggtcctgccgcagatgggccggctgaagagaatggagtatgatgggcacatttggggaagccagaaaggagtgagaggaccaaagcgggccctgtgtctggggaaagccaggaggccactgggtcaggcccctgcctccaggaagccctcctggacttcccccccctttgtccattagctctcctgtgtcccagtcttcagccttcccactggactgctgaatgttgagttctctaagcagatgtgtggggagcctgtgtcccccagccttgccccggggaagagacatagagaaggcccctaggccatcccctccccatctcatgtcaatctctttccctttgttgtccatccggaagcctggagaaaaatcagatcacagcttatggagcctggctcctggctgaagggctggcacagggatctggcatccaagtcattcggtaacagggcttgtgggggcagggctggtgggggtggggtgagcacaccagcccttcagtgtaagaggacttcctgtaggaggaggcaggacctgggttgggggttatcaaaggagacttggacccactcatcagggatttggcagcaagcagaccggatcaaaccccagct

SEQ ID NO: 58791 - DNA, 916 bp, Bovine  19866881237315
cctactccaggctcccttgggtgcggagggtggggctggggctgggattcttgctatggccctgtcctcccagggcccggcccgtgcggctggcagacaggccccggagcactgtctcacagacgggctgaaaagacagcccagcatagcacaagagggccactccctctcacaggacaggggccaccggaggcgtccaggaagggctgacatgtgagctgggtcatacagcattgggagaatttgatctcagaaaaggcagggaagagaatgccaggctgagtgcccagaagcagggatgcttcatcaggcagtgcgtgcttggtgaacaaagatcccttgtggctgaatctgtgtgcacacatgcggtatatgagtggtgtgtgtgatgtgtgcctgttatgtgtggtgtgtacaggggatatgtctggtgtgtgtgcatgagtgtgatgtattatgctgcgtatgtgtgtgtgtgtctgtgtgtggtatgtatatatttggtgtgagggtggtgtgtgtagaggggcgggagaagtgagagagaacacggcaggaagtggcaaccagatcagcctcggcgaagaccaggctaaggatttgaactttatcctcagggcacttgggagctactgcagggctcagagcagtggagtaccacggtcagacgtgcatgctgggaaagtccctctgggggctgcggggggattggaggaggcctggtcagaggcaggggaccaatgcagaggccacgatcacaggtgaagcaagacatgtagagaaactcacccaaggctgagcaagacagagcctgaggctaccagagggggattaaataaaaaatcactgatacagcactcaaataaggcaggtcgtttccaggcacttaaacacatttactcatttaatcctcaca

SEQ ID NO: 58792 - DNA, 504 bp, Bovine  19866881255775
tcaactgtaacccaaatttccagctttgcatctcaccctgcagatttcagacttgtcagcccccacaaatgcatgcgctgattccttaaaagaaatctctctctatgcagatatcctcctagtggttctgttttctcaggagaactctaatacagttgccatttttcttcctgggtcttctcctctgggaaatggggtgaaggaggaaacttagatctggatgcattcaaggcacattcccacccttaaagctcagtaaacacggccatcagggccagtggggaccaggcatgtggctggccaaccaagggttccggctaccggggtgtcaccacctaagaccagaggctacagactcagaggtctgccgagacacagcaggaactcagcgtgtgaagctggcagggcttttatggggaccaagtatgatgactgcctcattatgccgagagcaggctaaaccacagccatccccgggtgtggtcagccactggggggccatgg

SEQ ID NO: 58793 - DNA, 1382 bp, Bovine  19866881330472
tgactgggacaaattggcaaaactggaatatgaactgcagtttaggtaacagtagggtatcatgttaaattgcctgaatttcatacttttactggattaggggagagaatgttcttgttcttaggaaattcactgaaatattaggggtcaagaggcatgattatgcaacttactttcaaatggttcagataaagaaagtggaggcggggcggagagaggggaggggtgaggagggaggaagaaaagagcaaacgtgagaaaataaagatggaaggcgaagttcggaaaagggcctccggggcttcttctcagtcttcttgcaaattttctttgagtttgcaattactttgaaataataaaagaaaaagaaagagcacagacaaggcactgctcctcgccacgtggccatgttgatgaccatgcacccgagcatcatctccagggctgtgtggagtcccaggccatgggagggggacacggagctcctttgagcccagggttggagggaacaggaagtatgggggtggggaatgaaaagaggtgttcctgagtgaaagtcttgtccacatacctgaagttcttcagctcagagagggacagcaggaggctttgcagcagcagagagctggcatcgcagaggttcacctgggacaaactgaaaaggtccaagcatattccagaagatttcaggctgaacacacttcagggatcaacatagggatggggaggccaagcgaggggaaaggccccaccaaggagctcccaatggggcaggactcccctctgccaccctggggctctcccccactggcccaacgagagaagcaagaatgccggggttagcatggccccaggctctgttcatccccatcctgccctggccaacctctcacctatggcctgaagcaggcactggggtcgaccagagaactcagggcctcagtgtttcagggtactgacctgagctgccgcagccgggcacatgtctccatcaacttcctggcgaggaggttttgttgggttcccaggtcacagtgagccagcctggaggtggagagggaagcagctgtctgtaaacacctgggtcagtattgaggactcagtccctgcctacaaggagtgtgtctgaaggtggtaaataaacgctaatcaaataaggtcccacaatttgccagtcgaccatgggaagtactgtgaagggagaggtccatatgggggcccggcacggctgtgcaggttgttcactgcacaaggggggtccaaccaaggaagtgagtcggggcttgagatccaggcatggtctatgcctcacagtgtacacatgcagggctgcactcaccccagagaggtgactttttagtttccataaatgtgctatatgg

SEQ ID NO: 58794 - DNA, 2593 bp, Bovine  19866880496041
tgcgttatggagcatctgccggagtgccctgagcggagagccccggcccgggctgggcgggcgaggggctcccgcgggtggccgtcgagggcacaggggatgctcagtctcgttgcctccttgcagtgcccggctgtggagcgcgcgccgctccttccccccgagaccccgcgctacccaccgcgtagctgggcacgcggtccgcgggtctcctgctccgcgccgcgcccgacagtgaccccacgccctgtgcttcctcccgcagtggccgaccggaagccgcccagccccggcggcaaggccccagacggcctcgggagcttacacggactacccatcccggcctcgacctcctagggctgcgcctccgcgagccgagcccgagctcgagcccggaggcagcggcggagcgcgcacccgaggattcgccgccgccgaggtgcccatcagcctggcctcgctctgccccgcgctcggaggccgcgcgtcctccattctcccggggtttcggcttctctgaacttaggcttcggagtgttacatcctcgtctcgacctttcgaccgacgtggcctccctcgcccgccggcctccagcgtcttttcgacttcgtcccaggcctatcggcaccctgcctccctcccccctcgtgcctgctctcccgcgcctcctttctccctcccttttcaattcttcctatcgaccctcctttcttccctcaccttcgccctctttatgttcctctctctcgtctccttttctccctgcgtcttccccgtctacgtggtccctttttcctgtgtccggccccatcggccacctcgtctcctgggcctttagtcactactccgcctctcttcgttggccctgctccccccagccctatcaccttgccaagagctcccctccccccccccccccaaccacccgctggacaggtgaatagggcagatcctttggtctttagcccccacctctcaggggcccccatgcctactcgaggcgggggctcgaacctgggaattggagaagctgcagcatttatttcacattttatcacaatgaacccaaaacaaagcctcggtgaactgtcccttctcctccctcccccaaggacattatctggaagtattcttgtctggatatcttctcagtgcctaaggactgggtttctctttgcttcctctgaggtgatgtcaccccaaataaggttgagggcaggggggcacctgcggccactggtgttttctgtggttagaaaaccattcctaccctggaagtgtcccctcccactcctccacacccaacaggagggagtccagcacatggtagacatgtctgcactgtttttgtttttgtttttttgttttttatttttgtattcaggagtcagcccatttgttaatttaaaccacaaactgcttctgggtacaaaggtgcaatctgacttctgatttgcaaagggatggggttggaaaaacccagaaagtgtcctctagagcagaacacaagctctgttcactgcttccaagttcaggcactctggaggcaggaccctggacataaaattgcaatctttgtggtcagaaaaatgtcactggtgagagtctgacatcacctgttaaccatggctacctttgaataaaggaaggcatctaaaagtctgctttgtaagggcaagccagtctgtgtccagcctggagtattgtgtaggtatgtctcactgacttagcctatgggtttccagcatcaacagtattaagagggaattgtttttactggtttattccttagcacttgccacctagattgaggtagaagagaaaggaagaggagacaaccgttttcagggatggtccctgaaaactcaaggtagcaaggcagaatggagggaaaaaaaatgggaagaaggcagtaatgactttttcagaacactttaaaaaaagttctaaagctaaagaaaattataagacactatcaaataacccagggatttctcagtgcagagaagtctccgctacttgttttatttttcctccctggttctctaaaactgacagcagagatttttgaattgaaggttttgcttgtaagaggagctgtctgtttggagggaactggtggggaaattattttcaatgcgtcttacttcaatagtacgtgctggaggtattcatcaaaatcaatgaaaagagtatctgccttttttcatatagaggcttttattgctaggtcttcaaagtctcttgcctattacaaaaagttccattttatagacaggagtattaaggattagagacctagtttatttctcgggaccacatgcagcaagctatggatcacaaggtctggacaaggaaactgggtgacattatctcatcagagaaccaagattggggttcgaacttggagcctggggtcctcagccttctgtaccagcattttctgcagagaggctgctcataatggtaacaggaataaagcatttagatgagcttatgtgctcagtcatccaagcatctcacacacccctccttgttgcctggaggactggctgcctcgggccaggaagaaggcacctacctttttgaaga

SEQ ID NO: 58795 - DNA, 1964 bp, Bovine  19866880607061
aaaactgtggcccatcaatgggtttccttcttcctcagcttccacagactggactgtttacagccaccactcaccacctcttcactgcagaccctggctccccagaagcatcccttccccaggaggaaccacgaaaagcacgtggcaaacaaacagaaactcaggaaagtaccttgaagctgtttccttccccagacctgatttaagacagcttggtttataaaacatttctatcagcaaatcacccactgtgtgtgtaacagatgtcctatcaaagagacaaaaaattaaaatgcgtgagtttcataaaaaatacagaaaactaatataaagggaataagggccacagattagccagctgctgctgtgaagcattttccatggtcaggctgcgcatccttattacgaccctatcctggagagactgagagcacaggtctcaggaagtggcagagcctggattccaacctgagacttcagagagaataaaaaggctcgactcagccacactgaacttttctgtagccaggtcctttactgaatctgagatgcatatgcactttggacctttagatgaatcctctttaaggaggacacgtctacagggtgaagtaagtcagaaggagaaaaacaaatatcgtatattaacaatgtatatgtggaatgtagaaatatggtatagatgatcttatgtgcgaagcagaaatagagacatagatgtagagaataaacatatggataccaagggggaaaggacggggtgggatgagttgagagactgggattgatatacatacactactatatacacaatagataatgaatgagaaccttctgtatagttcagggaactctactccatactccatggtgatctaactgggaagagaatccagaaaagaggggatatggatttgtatggccgattcactttgctacccagcaaacacagcagtgtgaagcaactatactccaatgaaaaaaagataaaaatgaagaggtcgtgtccacttccgtgtgctattttcacgatggcactcacacatgtgttctcgctgtggatagcagctcggctcggctcccatctgatcataaattcctccaacctcccagcagcttcaatactactacacaaagagaagctccagaggcacaatgagaacagaagaccctccgatgaaatcccagtctctccgtaatgggggggcagcaggaagccagcctaagaagccaggaggacatgggacccagaggaaattaaaccaccatccacctcacggaccgccacttgttcagactgaagctccgctgtgccctgagccccagccaaccccttccagttaccttatgccccagcttaaagagaaaccaagatgaaagtgccagattcgttctgcccacatcagtcggctgacatggcaaacgcgaacacatgtcccacacatgcaaagaccagcctctcatatcacggcctggcttgtattttgtgagatacaattacagaaggagattagacccagcagagtcttagctcagctggaggtgttattacggaaagtgaaatggacagcacctctatgctgccaggtcacaggggaggcaacctctccctggatggcctgtcaagaggcaatattcccaatgctgagcatttcccagttggaatggatattaattcatgtatccactttgccaacatctcaatgctaagaaaccctgtcaaaacttgttttctcagcacatccatttgaaaggcctgtgtcctgttgccgagttctacatctggtattgccttgggtacaactctctaaaccttaagcttctggttgttgctgagaaatgccgaatcattttgaaggcattctaatttttattgttattattatgattaatttccctgtacctttaaggtattttaaaattaccttagaacataacagaaacagtatcattttattaaaata

SEQ ID NO: 58796 - DNA, 1308 bp, Bovine  19866880881476
acccgtaatgcctccggttttgatttagtgttttggagtttgtgatctcattgcctggtatggaaaatattagacagggtctgcagattgcatgcaggaaaagacccgcatcaccacagtgggctgagcattcgtccccagtgccccagtgccccaataagccaaaagtgcagccattgaaatcaatgctgagatttgtgccttggatagaggccccctcagccagccctgccgaagcaagccttcttgaagacactgattctccccaaggctgcactttggtcaccaaaggagccttagaatgttctgacacccgggtcccactcatagagattctagctgaatttttcagggagcagactggagtttttaagagctgcccaggtgattccaatgtgcattaaagggttgaaaatctccactttagggaagggatgatgtaattcgatgcttcccgctttgcaactgttttccaggatgtaggactggccggcaactgacctgcctcgcttacctccgcgggtacttttaacatgacacatgaaaacgtgtttaactccatggagcaaacgtctttcctgtgcatttttgcactgtgccactttggcccctctcagaacgggctgaagagggggaaggctgccttctcagacttgctgggcttctgcaggtttgctgtctttaaaagcaagaaccctgtctctctgtgctcatacaggtgatcgcagcctcctgtttaagcgtaaccatctctacagggaactgtggtggggagggatcatggagacagagattgacttaacccttggcccgatgaagagggacttggagacaagtggcaacgaatttaagcactgcccaacggggagctggagaaactgcattgtccaaggaggtgggaaatgaactgccctttttaacagggttagttaactctgcccttttgccatgtaaggtagcagggcaggaataaccctccaggttctggtagcatccaagcctgaatcttcttaagggctcagtgtagcttagtattcttatgactgtttccatttgtcacattatttaatggccacgcacattgtcaggggaaaactttttctgagtggctgctgcagggttgcattttagatcttagagcttcttgcccccctagatggctggcttgttgtgataatgactaaagtgtcaattcgtagagagggtaaggggggaggaaatagaaaaatgtttcacttatcctcttcaaagtctctgaagtcattaaaaggaaactccttctcttcatttttaattagccctgtcttg

SEQ ID NO: 58797 - DNA, 757 bp, Bovine  19866881307726
cttggaactgggtcgagctggcagtgatggaaagaagtgccatatccctgggggctgacggcgggggtgtccttggaaatgcaaggggagaggagcaaagaaatgtctttttcattttccccaaatgaaatgaacagacaagaatacgatgaatactgtccggtgaataacaaaacagttccccgattccgttcagaggcggagggaaaaaagtcaaaaaaacaagacctgccctgaaatcctcattagaaacacatagagggaaattgaactttgcgaaggaagatctgaggtacttcctaccctaaaatgcaaggatctgccttctacatttataacatttcttttggagtagagacattttaaatgttgcatttgggtgataaaaactaactacaagaagccggtgccccgtgggaaaagatggtttctttgagctttctgaaagagcagcatctctgcgattcttgtatgcaaaatccaggatttccctcctttccctggcaatgggcatgccaaataagtttcaatttccacttaaataaaattatcttagatctatttcatttcattccagcaaccaaaagcctccaaggagttctccaggcactggacaaaattccacctctgcagtgagctctcaaaaaatgtttatatgggcagtgctaagagcctaaacagcactattaaaatggaaatatttgggaaatttaaaatgtccatggggcatatctcctgtactgggtctgggcacttg

SEQ ID NO: 58798 - DNA, 1397 bp, Bovine  19866881749778
aaaacagcaaatttcttttatcactggggtggtttccaagcttcatatccactgttgtagaggtgagctgagtcttttaggagtggttctcttgagctctgtaactttctcgtgaaaacccaaaagtagacttttcagactagcatcccttcacatcctcttgctgtctcaataccacttgacaattatttatttctgtgttatatatttattgagctctacctcactgcttaagtaatcatattatatccatgtatgtgattgtgaatcactaattcttaaatgaatgctattcatgcatctctctttttacataggaaactaataatttaaatatatgtcaaagatgaaattaagacaaatcttcagaacaaggatctaaaactcaggttcaaatagaaattactgttcacccattgccgaattgtagttttgctataactgggatgaaaagttgcttttcagatgagatagtaaaactataaaacaattagagactttgcattagaagagtgggaagaaaatggttaacatataattgtgtgtgcatacctcctccagcctctattctctcaaaaactgtgaaagatttgtaaggttaaaatatcttttttgttgttgttgttatgaaagaagttatacccagattatagaaacagtagggaatatacaaaattccacaatataaaaattattttaaaaaattttatgtaaaaatagtcatagtaatccctatatttgaattttagaattgtagaaattaacaatccataggcaatatttagtttaggagttggcaaactatggcccatgggctaaattcagctggccgcctgtttgtaggtaaggtttgattgaaacacaacacaaatatacaacagtatgtttacagactgtctctggctgcttgggaaccacaccgcagaggtgagtaactgtgacagagaccacatggcatgaagagcctaaaatatttgccacctggctcttttcagaaagcatttgctgactcctgctcttgtccacctgataaagattagattatcgggacagtcgctcttgaacatactgtgatgtgcctgggctttacctcaaggaacttacagtctaattgtgaaagagaaggcgtggacattaatacagttttaagcataagaaaatgactagtgccatagagggtatggcatgctttaggatttccatgggggcactggtaaggcatcaaggagaagatgaaggccaagttcagtttgatggatgggtggcaggtgatggacgatgccaaagtgtctgcacaatattcttgtttaaagaagagaggcaagaaaggttcagagataggaaagccctgtgcacatgtggggacccacaagcagatcacttggggtagtacgagg

SEQ ID NO: 58799 - DNA, 2404 bp, Bovine  19866880098963
tttgttgtttgtagactttttgatagcagccattctgaccagcatgagatggtacctcattgtggttttgatttgcatttctctgataatgagtgatgttgagcatcttttcatgtgtttgttagccatctgtatgtctttggagaaatttctgtttagttttttggcccattttttgattgggtcatttatttttctagaattgagctgcagaagttgcttgtatatttttgagattaattctttgtcagttgcttcatttgctattattttctcccattctgaaggctgtcttttcaccttcttatagtttccttcgttgtgcaaaagcttttaagtttaattatgtcccatttgtttaattttgcttttatttccattactctgggaggtaggtcatagaggatcctgctgtgatttatgtcggagagtgttttgcctatgttttcctctaggatttttatagtttctggtcttatgtttagatctttaatccattttgagtttatttttgtgtatggtgttagaaagtgttctagtttcactcttttacaagtggttgatcagttttcccagcaccacttgttaaagagattgtcttttcttcgttgtatattcttgcctcctttgtcaaagataaggtgtccataggtatgtggatttatctctattttgttccattgatctatatttctgtctttgtgccagtaccatattgtcttgatgactgtagctttgaagtatagtctgaagtcaggcagcttgattcctccagttccattctttctcaagattgctttggctatttgaggttttttgtatttccatacaaattgtgaaattatttagaggggttttaaaagcagtatttctgtcattattttttgagtcttattttcccaactcacttagaagtaaaatatttcatgagaagtggtgtggggcccagaacaagtgaaccactggttgtcaggcaagatttagaaaatataagcttcctgtagatttaaagctagaaagcccacatgcataaagaaagtcctcttagtccactgagaaatgcttataggtttctgaaaactccctttccctccacaaaagagagaaaatcattaaacatgtttatttatgccccaatccattgctttctatagcaaaaatctgtaattctcttgccaatggaacaaaaattgctttaaatggtaacagtcaaaaaatgcccaaaccaaaatatttgctgcatttttctttctagtgacctcaataatacctaagtggatatatagttatttcttggactaaaggaaacagaggattgtgtttaatgaagtctaagggactttagagtgtaaacatctgaacccctgagaaaaagtggggccatctcctctgctactgaatgtgtaaaacacacaaagggcttccctggtggctcagtggtaaagaatcctcctgacaatgcaagagatgcaagtttgattcctggagaaggaaatggcaacccccctccagtattcttgcctgggaaatcccacggacagaggaatctagcaggctgctgtccatggggtcacaaagagttggacacaacttagctactaaacaacaacaaaaatatacaaagatagacattgtggggaaacccaggaagattagtccataaaaagctatgttcctgtgattcatgtgttaaagactagtggaggaggggataaaaatttaaatggagatcaaatctagcattaaaaaaaggaaaaaaaaaacataaaagctgtggggatgttcaagattcttcccagggatttgaggcaaattttgaatagtgttcagtgaatatctgggtgtctgtgcaataataaggatgatgtcagtttcaaggaagaaagtcctcattgctccattttcataggcatggacaagattaagagttctgctcaaatggacccctaagctctactaaatttaaaacctgacattgtgtttcaacaattatgttgggattatctaaaattcactcaactatgtatttttgatatcgttagcatggcttgctaattgctaatagcttaaagctcaacattcagaaaacgaagatcatggcatccggtcccatcacttcatgggaaatagatggggaaacagtgtcagactttgtctttttgggctccaaaatcactgcagatggtgactgcagccatgaaattaaaagacactccttggaaggaaagttatgaccaacttagatagcatattcaaaagcagagacattactttgccaacaaaggttcgtctagtcaaggctatggtttttccagtggtcatgtatggatgtgagagttggactgtgaagaaggctgagtgccgaagaattgaggcttttgaactgtggtgttggagaagactc

SEQ ID NO: 58800 - DNA, 2177 bp, Bovine  19866880183107
agatggggaaacagtggaaagagtgtcagactttatttttttgagctccaaaatcactgcagatggtgactgcagccatgaaattaaaagacgcttactccttggaaggaaagttatgaccaaactagatagcatattgaaaagcagagacattactttgccaacaaaggtccgtcagtcaaggctatggtttttccagttgtcatgtatggatgtgagagttggactgtgaagaaattgagtgccgaagaattgatgcttttgaactgtggtgttggagaagactctcaagagtcccttggactgcaaggagatccaaccagtccattctgaaggagatcagccctgagatttctttggaagaaattatgctaaaactgaaacttcagtactttggccgcctcatgcgaagagttgagtcattggcaaagactctaatgctgggagggattgggggcaggaggaaaaggggacgacagaggatgagatggctggatggcatcactgactcaatggacatgagtctgagtgaactccgggagttggtgatggacagggaggcctggcgtgctgcgattcatggggtcagaaagagtcggacacgactgagcgactgaactgaattgaactgaaagtactgtttctctttctggggaatttacttgagaaatcattctagcaaaatcaaaagcaaaacaaaactatatctcagggggacttaaaatgtataaactcatgaatgagtggttaatctggcaaaatttaacagaccagtgtagaagatcatagcctggttcctgaatggggaacttggatatgataaagaaatttatatttctcaaactaatgtttaagcttcttccaattccaaacaaaccctgagaggggcctatttttgaatcatgacaaatttttctagaaaaataagtaaataagactggttaaagaatgtttatcaaaaggccactagaggttggtatttaccttatcaaatgctgaagaattataaatatataagagttaaatcatgttaagtactgagaatagtcaaatcagtgactcagtagtgatactgtggaattagagtttataaaatagaaaacaatataagaacatattttaaagaaattacaaatctaagggtaaggaactgtgttcttaataactaatgtagagaaaagggaacattttgatgactactttattaaaattttgcattacagaatacatatggatagattaaagagaaaaattcaaccgtaaaaaattagggtaggtatagaggttcatgggcttccctggtgactcagatgttatatcatccctttatgaggaaggactccctcaagccagaaagcaatgaaagaaaccacaggaacagataatagattttaccatataaaaatataaaatttctgtggttctaaaaatacatagataaaaggaaaaggcaaatcccaaaccgggaaatatttgtacaacatatacttttgcaaaaaccagggttgccattgcttgtcaaaagaattggttaaatccaattcttagcctagtttatgcctaaacctttatagatgagtgtgcctgcagagaaatacaaaactgtgtgcactggtttactgttaattgctttcaagggagacttttgtcctgttctaaaattgtaatacatttccctaggtcaatcactctgccatgtttcctgacaactgtttagtagcaccttctcatccagcatcttctccccatcttcactctaatttgatgatcttgcttatagcggcaatcagaagaggatttactacatttacaccaccatatcatcccaccgagtagcatctctcctgttggagaagaatcttctgtgctcccattaacaccttcacaagggcactgattcccacccctctcaactattcatggacaagaacctacctccagaaattcccatttctccttttctctagtgaaacactcccttcagccccagccacatattttttcacatcttaataaaagatctcttgtcccacttttccctcaagttattgtaccatttctctttgctttggaacaacccctccagaagaagttatatacacttgatttaacattttcaattccttaacttctgttctctctgaacgaatccattaggtttccatccccacaaactc

SEQ ID NO: 58801 - DNA, 1814 bp, Bovine  19866880406419
tggaaagacctcttcatgcaaagaacatcagatagggtagggttggcaaacacagcccacaggccaagtccatcccacagattggtttttgaacagcttgtaaaccaagaatgattttatatttttaaaggattgtaaaaaatacaagaagaaaaacatacaacagagaatatatttggcctgcagagcctacaatatttaccatgtatccccttaccaaaacagtttgtcaatcactgacacagtcatgttagtaatggagacaaattagctctgagctaaagactgctctggacccatcctagcaatccttaaaaggatcctacaaattcctggtaatttagctaatggtgaacaaaatctagcactattttatgaaatacaacaaaattcagtgcccccaaacacaaaattcatccaataagaattgctgaggttgtaagaaacaagaaaatattaccctgaattatatttctattgctgtataacaaactacccccaaaacttcgtggcttcaaaccatgatcatttatcctttcttatcatttctctgagccaggaattctgacagaggccatagagaatgcttctttccgcttcacagtgcttgaggcctaaactgcaagatttgaaatctggaggctggaattttctgaaatctcattcagctacatatttggcagttatggtattagccaccttttgtaaaggaagagttaacagagcaggtctggtggcttattccttgcgtatatccaagagaacctggagtcatgaatgacacttggacaaccactgggaatatgtcccttggatgtcagagattactgatttggttatgtacacctagagcaatgagctgtgctatatcagctgtcaagttgctctgcatagatatcaagatgaacgaggtgcacctggtttcattgttagggtcccgggtttcagctgccatggctggttgcatagcaagatatgcttatgtgagcagcacaccagaaaagccttggagcctaggactccaacaggactcactgggtagagacatttcacacatgttcctacagttctctgctagagacaaagcacattctatgtggcctctgaagaaggactctgaagcctgtactgagcctctcaggactctacccaatgaaaatatcttttctgctgctttattctgggcttcccaggtggctcagtggtaaagaatccaccagctaatgcaggagataaaggagatgcaggttccatccctggggcaggaaggttctctggagaaggaaatggcaacccaccccagtattcttacctgggaaatcccatggacagaggagccttgtgggctacagtccatggagtcgcaaagtattggacaggactgagcacacacgcatgctgctttactctgtatttcctgccataataaactttaagtatgtatataaccttctctgagtcttgtgagtacttctaaccaatcactgaaactggggtgccttgggaccctcaaaacaccgtgaaaatatcacccaaaagaaagttagaagatgttagaagttattcattgctatatcacaaattacctcagatgtagtagtttaaagcaacaaacattgactatctcatcacttctgtgaatcaggattctgggggctgttcaagtgggagttcttgttcagggtctcacacagtctagctgccaggcttgcttgggtgtgcaggatctgctctgcatccaggcacacgtacttggtgcttggcaggaggcttcatctccttgccacttggactctccatagggctgctcatga

SEQ ID NO: 58802 - DNA, 2042 bp, Bovine  19866880493320
caatgtaggagaccccagttcaattcctgggttgggaagatctgctggagaagggataggccacccactccagtattcttgggcttcccttgtggctcagctggtaaagaatcttcctgcaatgtgggagacctgggttcgatccctgggttgggaagatcccctggagaagggaaaggctatccactccaatattctggtctggagaataccatgggctgtatagttcatagggtggcaaagagacatgactgagtgattttcactttcactttacatggcagaaggggcaagggaatctttctgggatctcttttataagggcactaattctagtcatgagggctctaccctcaagacctaaccaccatggaatgggcctaattccaaatattatcacattgggcattaaattttaacaaatgaattttggagagccacattcaggccacagtggactacacagaacgggcagaggggaagagagctcacgatgggagtgggggatgtgggagacagaggactaaatcctcattttctagggtggaatgacagtaaagaatgtctaaaatgtaaaacccacaaagtaagaattcaaatatgttatttagcaatacggaggcaaattccttaagaatcagctgtttaggtagggaatgactctagactgtgagaaataggatagggaggtaaggaccagggactgttgttttcaaataaatctcgaagaactctgattctttaaattatgtgtatgtataactttagtaaaaataaaatatgaattagaaaaatcaaaccctggaagtgcccaagggtccaattcctaacatgttaattgcatggtgttgggtaggttatttaatttctttgcctgtcagtttctttatatgaaaaatgggaatagcaatggtacctattctgtagggcagctgagatgattaaattgaataaagtttataaaacttaatctagcaccatgcctggtctatgttctggcatttggagggttcccttttgctttacttcttgccaatcatttttattttattcactcagtttttccttggattatcatattgccatcacatttcagatcagattggcttcccagatgttaaacgcactttattttacttggaattctgagtgctatcaaatacattgaatgattataccagtatctcgctaagtgccaaaagcatatacagtgtgattacatgtacatgagaaattcttccacaatatctggcatgcatttaccatgagttatgagcaatccatattttctcctttattgtctttcttccccccagtacaatggacccattccccctctataaagtcaggggaataatagacattttaaaaacaacttttctgtcataaatttataatttcatctgtctttctcatctattatgtgtgaatcttactagtttgactctgtgagagccaaattattcccaagttcctacaggcacctcattgttcctacccaccaaagccatattcacagcctgtttggggcataaattactctagtgtgtgttctctggcttgtttgaaaatcaccagaaaggggcagggtgaacattcaagttcatgttttctcattctaagctaagtattctttctgccatatgaactgactgcccatcaataaatgacttaatctctctggtctcaaattcatgacatgaaggtataaagtagataacctctaagtttctactagccctaacattccatgaattactggggtatttcagtagtttctgactcacaagagttagcctgtatcattaaccatgtttatttcttccatatagggactgtggtttctaccaagtgccaaaaatttgtatgattgtgaagtctaagttacttacgtgcaattttcaatccctgtcttattcataaataccaaggcacaaaatagctttgggttttattttcacattcacaatcacttgggaattttatcaaggctgagcaagagatttggaaactcataatgcatttcccaagaagctgcaagg

SEQ ID NO: 58803 - DNA, 2130 bp, Bovine  19866880924290
atggctaagcataagatttcagttataacttgctaatgcttttgagacttggcagtttaagaaagagtctgactgtgggagatagacaactaaatgcctttattataacaaagcaggagtagagtaaggctggacacttttttccaacctttattggctcaggtggaaaaactagttcttctaagaatggaaagtttcctttagattagaaataatctcagcttgttcatgtaagaattaatgaacatgtatgagtacctgtagagtggaaaaaagggtatttctcatatactacataaaatgagagttgttgtttttcagtagctcagttatatctgactctttgagaccccccctgactgtagcccagcaggctcctctgtccatggggttctccaggcaagaatactggagtgggtcaccatgctctcctccaggggatctttccaacccagggagcaaacccacgcctgtatggacaggtgggttctttacctctgagccaccacggaagcccaaaatgagagttaatttaacttaaatattctgactacctgtcaaaatataagaacaaaacattatattgagagacagaagagtaaagcccaaaatccctgattaaagaaatttgaaatctgctcactctggtgtatggaagtagggcagaagcggttgaatggaaaaggagtgatattatctctcattgatacaaattgctgagtcatagacatatttagcatttatctaagaagtgcatgtgtttatatgcaaagggggctaggaagttgaacaaatacttgaaaaaaattaatttggagagttaatgactataaccccaaaatcagtctgtatgcacacattactaattctgagagttgtgaactgccttcatattagtgacccttaaaaaacctctgagtggatctattttatgactcattgctcatgactttaaagttttctcagtgtttgttaagatcttgtgcagttggttgggaaggtgtgagaggagtcaacatatgaatgtgagacatatggaaagcgagacaatcataggaatatgtagcacaggtttgccttctgtgggtgaagaaaggattcagtgggcttatccattccttacagaacagcatttctcactatccctgaagtatgagccagagatgtgctggaactttctgaagtctgattggccagaaagagccagttttgcacatttctcagctacaccatcagtgaggtctagacccagcaaacactaggaatcaggccttccctctcaccacctctcaccactcagagcctcttggtaaacatttaccagcacaccactgtggcgagctacactaatctctagtaaaacattctgggtgatcttcctttgagctcagggaggggcctgagggttgctttggaaagtatctgcaacaaacactacaaaagattcaaatggtttaccaagtgaaaaacaaagactaggtacttttaccatggggtggaggtgggggaatggctgttggaaattaagctcacatcttgtaagacggataaaacagtttcataaataactatgataggaggcaggaggtggtcagaagcacaaagtgtaaactggagatgattcagaggagggtgaggtcaagcacaccccacgttccagtgcaggcccttaaagcagagaagtggtggattgctcccagctttgaggctcctggtatgccaaaacatgaagaaataccaaaacaaggttattaaaattgtgtgtacatgtgtgcttagtcactcaatcatgtccaactctttgtgactccatggactggagcccacaaggctcctctatccatggaattctccaggcaagaatgctggagtgggtagccattcccttctccaggggatcttcccaacccagggattgaacccaggtctcctgcattgcaggcagattatttattgtctgagccacaagggaagcccatagtagtatattttaaatgtttccactaagcgtcttacaatgtcacaaaattagagtatccataaaaacattatagaagttattaaaatattaattcactgcacactccgggggggatggcttaaattaaaagttgtctgataacatcttca

SEQ ID NO: 58804 - DNA, 823 bp, Bovine  19866881036120
caccatcatgtacccagatgggaaatgcctttttttggtgggactggacatatgtgttgctccctcggatttcatgctggttaaagacaagaggctaataactcccagactcgtgcatgataaccacatctctggtggcaacggtactattaatttttccacaagaattttctttctgttacacgcgtacttttaagagtaggtagccacagctgtgaccagtatgacattcctttctatttgtttttaataacgactcaagttagcttgtgaagaagattctcaactgagatttttctttctttctgtcttctaaagtgtttattactaaaagattcaacttttagattctctgaagaaaattctttcctaggaaaggtaagaggttaaagaaaatgtagctaaaattagtttcttttttgactctgcaaaagggattgcagccatggcaatagtcagaagcagtgacttaacgaacggtttcagaaatgagctcttcactgtgatttgaacgagcgctccatgaatcctattttataattactgctcgattcttatggggcacttgaaagcttgagtgactgtctaccaggttcattcctcaggtgaagcttctgcttaactgtgtccaatctgaggcatcacactgaactctcaccctaccgtttgtttgctgatgacaatttaattacacctgctggccttcagaaatctcaatgattaagaattgctttgtttggtttgtactctgtttcattaatcttcctggattccttttcctccgaggaaatcaaagtgtttcttgttaataattttcagtata

SEQ ID NO: 58805 - DNA, 911 bp, Bovine  19866881101553
attgcttcatatcttaattactggataccagaaaactaagcaagataaaacctacactatctgaaaaaacatactagataccagatgtcagtgatggatgtctgagaaggaaaaatgtgttccataatgtaaaatattattgattacaaaattaagtcaactaagattcaagtctagatataattataatctcaatttaaaaagaaagtagaaattttatttttaaattgcattcctctgagtataatctctctctgtctcatacacacaaaagaatatatcactttgtgggaaggggtgcagggaacataagagttttcacaatggaatagaaaaatcatttatttcaatatccgttgcctgactatcttgaataatagatacctcagagaaggaacaaaattacttcagtgaagccaactgtactgttgaatagttttatcacattttgggtattgaacgtgataaagcatttttgccatatgaaattttgggttaatctttttttactccttaaaaaaataagagaattctaaggaactaacacttatatatttgaggaagaatttcttatatatctacagatgatcagtatattcgactttgggtctgtaaactttgcctttgtcaaaaagaatacaatatacttcctcttttaggtcgtgacacctttttacctaccaaaaatcatcaaggtaaattagaaaaaaatcccccatgggagtaagaattatggttcttattatcaacaaataataatagttgtcatttttgagtttgcatcaggaattttacatatcatctctattttaccataaggaaaataggtacagataaatgaaataacttatccaaggtcatgtaacttagaaataaattgtcaagccaggacccaagcccagaaagaaatc

SEQ ID NO: 58806 - DNA, 661 bp, Bovine  19866881815993
atgtgagagctggactgtaaagaaagctgagcgccgaagaattgatgcttttaaactgtggtgttggagaagactcttgagagtcccttagactgcaaagagatccaaccagtccatcctaaaggagatcaatcctgggtgttcactggaaggactgatgttcaagctgaaactccaatactttggccacctgatgcaaagagctgactcatttgaaaagaccctgatgctgggaaagattgagggcaggagaaggggacgacagagcatgagatggttgtattgcatcaccgacttgacagacatgggtttgggtagacgccgggagttggtgatagacagggagacctggcgtgctgcagttcatggggtcacaaagagtaggacacgactgagtgactaaactgaactgtccatataaaaaaatatcaattaggggcatatgcacacggggaaaaacatttcataaatactgtttactagtgtgaaatactgattatgtattttcatagcaacaatcaaatatagcaatggaatttcaccccagttccttccttcatgaaattaagcttccttcatgaaattaggcattgttttgataaacttgatcaactgaaaatattttctctataccttcaagttggtaaatgtttttagggaa

SEQ ID NO: 58807 - DNA, 1187 bp, Bovine  19866880164571
actctgtgcgacccctagacggcagcccaccaggctccccagtccctgggattctccaggcaagaacactagagtgagttgccatttccttctccaatgcatgaaagtgaaaagtgaaagtgaagtcactcagtcgtgtctgactcttagcgaccccatggactgcagcctaccaggctcctccgtccatgggattttccaggcaagagtactggagtggggtgccattgccttctccagtatatctcctatgtatttcctattcatatcatatattaatataatatatcagcctggccactccttacccaggctgacctgggaccttgcctcagtccttactggaccccaatactaagatagctttcttagttactataaatattggctaagtaaggtgatgctcctgtcttctactaagaaataatctgctttctaggagctaaaactaaactgaaggtctgtctcaatccagagtctttgcactatctgcttaggtcctatatgtaaatactgtttgtggcccatcttctaattgtataatatattcatcaatacactttaatcatatgaaagagtgtatcaagctagattccagaaaacttttgaggcatgaaaaaaagctaacatataagccagcaagatgtacagagtgaagcagagtttctcattgtagtaaaaagcaaccccccccaaatctatcttttgttataagagtgattaaatgccacctaaaaagaatttagtatccaggggtcagtcccttgttctggttttgacacttcagttttcagcctaattataaattgtctaattggtggcagttgtcttcattaaacaccatcagtacatcaaggtgatgctcattgagcccaacaaagtcaggcattgtgttcttattcatgcctttgtttctgtaactgatcattgggtgtttaataccttgttgagcccagtgaggataattacagaaatcgcttggttgtaaactaatgacaacagatatacaaactcctgatttcctgattgttgacagactttacacagtgggtgtattttcagtgtgaattctgtttcattgtttctatgcatttgagttcaaattccacatagtagacatataaatactgaggttgatgaaggcctattaactacgttgaagctactatactctttttttatttttt

SEQ ID NO: 58808 - DNA, 721 bp, Bovine  19866880373468
acattttctttcatgtaaacattgtgatgatacttcagtgtaattgttttgaaagggcttgataataaaactctttgcatataaatctaccacatgataaatgtaatataacatggtattttaaatttggaagctgcagtgtcttttatggacaaaagtacatcaaaggaagcattctaattacaaattaaatgcaggctaaaaattaatcctaggttacatctggttgctgtgtgtgagagataaatatttaacacaaattaaactactatttttgaaacaaatatttactttttatttaggatgaccacacacgtacttttctgtactatagctactgaatgtttatgcaaaataccaacagacatagacataataaagtccaatggaaattaaagtcaaaaaagacattgaacttcctttgttcaggaaaaaagtgttttttataggaaacatagcaaagcaagctaatcttaccatgtttaaatgcaaattttattgagacaaatcaaaggcaatgaaaggcaggcatagtagtttgtttctattttaaactactttattggcttcagctgctatctttgaatgatgccagtctctcatactcaattgacaatatccctatgctcaatcttccacttcagaagagaagtttcactaacatgaagaacttttccatcaccttttcttgctaagttagtaaaataataaaaagacatgt

SEQ ID NO: 58809 - DNA, 969 bp, Bovine  19866880403847
tccttaaagtttaacctataaatattctacttcattaagcataaggaccagctatggacatatgccactggtgtctactttccttcagcgatttaggggatgggaagatgaagggtatgttcaccagatggagcttgtcagattagcaactggagcagagtaaatatcactgtcatattgtttgtcttttttttgaagcataaagaaccccctctttaaagtgcatgtgcatatttaatggttgaaaacaaaacagcagaaggttggctggtggtgtacctctagccaagtggccattgcctgaaggcgggtttctgctttcctcataatagggaacattagcaaccagtggctcgagaaaggcagtcaaataagtctctcggggcccagtcagccacatgaagtgaaagccgttagacacagcaatgagattgctgctccagaaagggcttaccacatatattaccacataggctttgccgggctgccagctcactggacttacaaatgtcaaacgtgatttaaaaggttattatactatcacgaaggaaggaagatgattttccatcactgaaatttctatttcattctgtggcacatactgcatctcacagagtccaatattgctaaataacctgcttttatctttaataagtgttttatggagcttaaattggaagaaccactttcactttatttgtattagaaaatttgatcttttttggtcgaatagcagtgtgataaatttggtatgttcatctatgtattgtacttaggagactgttcttacaaggagagtgaatttgtaatgtgtcagttttgaagaggatacctaggtaagctgtagttttgggcaaatgcatttgtaagcctatagtatttcacactaaaattaagaaatatattccattatttatttctctttggggtttgttacaactggtctttaaatagtctactttcccaatt

SEQ ID NO: 58810 - DNA, 2964 bp, Bovine  19866880407047
agttggacatgactgagtagactaagctcgcacacacacacacacacacgtacaagcttaaggtaacataaacagagctattaacaataataacacgtgctgacaaagttcatttaattacctaggcaaatttatttttacctatcaccaccctcctctccatctgcatctcaaaaaaaaaaagtgtaatcaatggatttttgttttatacaatctaattttctacatgtgtcaaattcgtgtctaattatgggtaaaataaatccttccagggatccaaattcttgatggggtttaattatgttctgattcttacaaattagtgcaattgcaactggaatatctaagcaactcccttcctcgtccacccaaacacccatttccctacacttgacgattcatgatgggcttgtcaggccattggatgctggtgaacattattttgagtgaatatgctagtgagtattatgatgagtactcaagcagagtctcagggattccacccctagaatactgggaatacagcagaaattttgtacttcaatttctgcatttagcacctgtagggaaagagcaaattagccatgacggcatgttcaggctctctctggccacatgttttacaaataacgactacttaacagctgagctaatatatagcattgcgcatgcgtatcacgaggtactcgcttggtcacaagctactttgtgctgtaggtatatatgagccgcacctaagaaagcagcagcatactgtggcgttacggcttagtcacgagaggagagaatactgctacggctgctgtgtcagccaggagagagtttgtgcagttatcttgtgttatgtctgctgctatggctcctgtgccagccaaaagagaataaacatgtctgaagttcctatagctcctcacatgttcttccagcctcttagttcgcaccttgcctaccctgggttcaacgaacagtgtatcacaaacagaatgaggagcaattcagcacctgtgtatgctcctttttctttgattgaagaattaaatgaagaaagctgtttttaaaatgttttctttgagctgtctatagctgtcttctccacaacccaacccaacacacattaacaatcttacagtgatctctggtttctgaaggttcactggacaggagtaattgctaaatattttggaaaggcatgtttgaggtctctaaatcagcataagtaaattttatttttccaaaacagatgctttctgcctgaaaggatagacacacacattcatctgctttctacattgtattgttatgctataaggttctgaaataatctctcttttgaatttcacttgatcacactccaaccacagtgtataatggttcccagccctctacgctgacacagaaatgcattttccattactgttcacatccctgcctgcctagacagattttcccaggtgcttcagcttttgcagttcaatgcatctctccctgagaagtgaataaaatccagttgttttcttatttcttttgcatctttttccaagaacatttgattcctatttagatactcaagcactgcttattattcaagatgcggcaggaagtcagggtgagaaagagcactgatcattacacatgagaaaaataactttgtttccattaaggctttctgccagggaagggaaaaaaacaaacaaaatgaaacaactagataaaaaagaacacaaaacatactcatcagcagctttttctacaatgaatttgcctatcttgcaggcctactgaacagtttacctcaccaaaaggttacttaagcaataactgtatgatttgaattattagctatcctgaataagaaatctttgaaaaggtaatacagctttatgccagtggtttctgtattgtagcaatattttaaaagtctgtttttctaaagagattatctagatataaaaatttcagtacataataagatactaatgatttaaattatgtgtattacacagaataaagcatggcatatatagagatacactggatagacacatctatttatttatattttaatgtaattttaattttttgttaatgctaaatatttaccaaggtcaagaataaaatctgaaacttataattttgttttcctggttgatatggggtgatctgggtcccacaaaaatgtatgttttaatcactggtaattcagaatatgaccatactggaagtaggtttgtagcagaggtaattaggcaagatgaggaaatattgcagtagggtgaattcttaatccaatattatcagtatacttataaaaagatatgaacatataagattgccatttgaagatggaggcagaaaatgtagttatgtagcgacaagtcaaaagcaccaagaattgagagctactgaccgaagctaggaaaaggaaaggatgcactctactcagtctcagagggaacagagtcctaccaacaccttaacttcaggtgtctacactaaaggactatgaaagaagattgaattctctggtgattttcttttcagaggtaaggggtacattttcgtctggacctctttcctacttttcctcaaatcttgccttaatttcctgcctcatctcccatctgatttaggactaccagcagaaccctccatgtttcttctcacaatagagacatagtatttggtgacagaacgtggaagttaagatttggtactatgaaaagaaaagctaaggttcaaaccttggttctgtcccttgaaagtgcgtgtaagggttctattccttactgagtgactgtggatacggttctaaacccatctaagttcatcttccacatgtatgatccataaaactgtcctaagaattcaacggtaacatgcacaaaagacatttgcaaagtgtttagcatatgtgcattcctgctctgtcacttcagtcatgtccaatcctttgcgaccccaggg

SEQ ID NO: 58811 - DNA, 1963 bp, Bovine  19866880408530
tgtgatgatcaaagacatgagtcaaactaaactgccccgattttgtcacagggtagctgtgtgtcctcaagcaaggtacttgacctctctgagcctccgtcttctcacttagaaaatgaggaaaataacagtaccgacatcacaggatgatgttacagactgaactaatggcaacccactccagtgttcttgcctggagaatcccagggatgggggagcctggtgggctgctgtctatggggtcgcacagagtcggacacgactgaagcgacttagcagcagcagcagcaatctctatataaagtatttagaacaatgccacaaacagtgccctgatcgtttaaccatgactgatttgactaaagctgtattccttttcactgtgctgcataagtattaggcttaacgtctccatctttcataatcactcctaaatattagtgagttttattagctaagggaataaaaccaataaacatataattacacctgtttttcttttatatttgacatgtattcttgggctagaaattcttaaaatttatgatggattccaaatctaggtgatggtgccagatttccaggtctcttctctaccgtgttccacgtcactatattattttggaagatttaaaatacattgtaatttcaagcatctaatgggaaatacactcaatattctctaaatgacaaaaagataaaataatacattaatatagccgaaatatatacttggaaggcagaaatagcagctgactatgaccttcttattgaaaaaatgacccagaaaatggacaaggagatttcatcacttatttcctgcttcgaaaccaaaatcttagatgcctttaaatccctattggataaagttggctttttggttgtttatgaaataccaagtgattaagggaatgttgagccttttattttctgatttttttcatcagcgtcttaacagaaagcagcacttatatttctttccttaaaatgaacaatagcctttatttttaatccctccatagctaggatttttagaacttactatgctaccgacttcaaaaactagattttggtaattccctcagaatacacgtttgattctggacattaacatacaatagtacctccatgccatgttctgtgttgctgcaaagtttaagttaaattgtatgtactgagtagcatgatgaattaaaaactagattcctacagtatttttcatgttggaatatggacttctcagagtggacactcagagcatgtgttgttcaatgagtaacaaaagacaagataaatgaagctgatacactgtagaaggcaaaaataaccaactcatatgtttgttttgtcatcattgttattcctatggaaaatgtaaatatttcatgtttacaacagagtgaaaatgtgtacatgtattcctacaacaattagaaagtatctactgtgtaaacttacaaactaatctccttgtctttccatcactcagaattgagtggggaagaaagataaaacaggaagacaattaaaatatagatgcaagatctaaggataaggtgaggttactctgggaacgtgaaggtagcactttaatattttgagaagaattaaatctccatttcaccttcgtaaggaggtgtggtgctgggatctctttacaaatgaaatgcagagtgattaaaaaatggactgccatagcctgctgtaatagaatagctttccttcttatcaccaagtaacacctcttatgtatttatttttggttagtcctatctagggccttcctgggtggtgatagtggtaaacaaccccaccaatgcaggaaacataagaaacatgggttcgatctctgggttgggaaggtaccctggaggaggggatggcaacccactccagtatctttgcctagagaatcccatagacagaggagcctggcaggctacagtccataggactgcaaagt

SEQ ID NO: 58812 - DNA, 2741 bp, Bovine  19866880438071
ttggactctgtggaagagggaggggtggggatgatttgggagaatggcactgaaaccttgtataatatcatataagaaacgaatcgccagtccaggttcaatgcaggatacaggaagcttggggctggtgcactgggatgacccagagggatggtatggggagggaggtgggaagggggttcagggatgggaacgcgtgtacacccatggcggactcatgttgatgtatggcaaaaccaaatacactattgtaaagtaattagcctctaattaaaataaataaattaaaaataaaatagttcagatatgaggaaactatgtcgagttttaggcaaatttatcagaaactaaatatttagcaaagctttgcacaggtgtagaaatatcagagctggtaggaatggcgtttgtgacagtgacactgggacctttggctctgcatttgctgagatgaatgtgactgccaccgaattttcagaatataagtgcttaggaaatagaaggccagaatgttatcagtctattaggagtttatgtaagtagaatgtctttttctgaaacccattcatggtctgcaccagataaataccaatggtctttagaaaattaaacatttttaaacagttcattgaggttggagactgttgcattgcatcatcttttgtaaagccaaatgcaattttaaaccacatgaaaatattataaatatgacagtaagaagctaaatttcaaagatatctttctgaaatattgtttttatcactataaggcaaatatgcataacccgtggaaacctctgatttgatggcaaatcactctttaaagaatgccttcaaccatgggaagatgtaacagattgatttgaaacagttttggatgaatgtccaggttaatatattatctcctcactgaattgttggaaaatgaatttataaagtaggaaattattattttttatttctcaggaggaaatcattactctaagcttactggaaacttagagacttgtggtttcaaaatttctcttcagttttatataggtattctcatgtatttaacccctgcttttgattgctttctggttttgtttctaatttacccaaaccagtcctgccttccctctggtgttccgtcatttgggcccacctgctcacaagaggtcagtggctcagtgcactggatgtaggcagccagaaaatgaaatattacaatgagaaattaaaacctttgtaattaaggcactgaataacatgaggcggtaaagacggaatacgtgttccacttttaatattttcagtaatctcttctaagaatacagaaaaacctgaaatacaattgtgaaattcagagaaaacgttttatgaagtcagccttagttaccttatcctgaagtagcaaatattcacactgaataaggaaggagattttaaatatctttgactaagtttctattttaaataattgatgggcagtttacttataagataagtatctatgctttgccagttggtctttggtttaaatgatttatagctctgtgtatttattggctatgtaaataaatttaacagaaatttaagaggaaatggcagctgttacatgaactgctttttaaacataagcttttaaattattgataacctttggagggtgctctaagaacgcattttgacacccactgctttttgatagtggacataacacctatgacaggcaaacctttccaatctctacttatattaaaagtgtgaacattaacctatagtgtgtatcttttaaaatgtgctctgtggtagtaaatttaaattgctacctattatcttttcttatgggtatgtccattatgatgtgacagccataaagagtgtaatcctgctataaaacaatgaacttgtcgcaatttccttttctagttgcctcagttttggggttagaaatggtaccataataaggtcacatccctaatgacacaagggcaaggaaaaaaaaagtgaagcaaagtaaaacaaatgaaaaaaaaacccaataacagaaatctagtacttaagactttagtttatttaaaaaaaatttatttatttggccatgccaggttttagttgtggcatatggaatctttagttgtggaatgtgggatctagttccctaaccagggatagaacccaggcccccctgcattgggagcatggagtcttagccactagaccatcagggaaatgctgagactttttattttagacttttatatcttttgctattttttaaaatttctttttaattggaggataattctttacaatgttgtgttggttcctgccatacaacaccatgaatcagccttgagtgtacgtatagcccctccctattgagcctccctttccccaccctccccctaccccacctctctaggttgtcacccagcagtgcattgagctccctgtgttctacagcagcttccactagctgtttgttttacatacggtaatgtatattttcaatgctactctctccattcctcccatcctctccttcccctgctgtgtcaagtctgttctctttgtcgatgtctctattcctgccctgcaaattggatcactggtactatttttctagattccgtatatatgtgttaatatgcagtatttttttttctctttctgacttactttactctgtgtaacaggttctagtctcaaccacctcagttccactgactcaaattcattattttttatggccga

SEQ ID NO: 58813 - DNA, 1771 bp, Bovine  19866880446473
tgggagttggtgatggacagggaggcctggcgtgctgtaatttttggggtcacaaagagttggacacgactgagcgactgaactgaactgagaaatatcacagcatatttattttatgtaaatatttagtattatctgtttttaaaatgtttgttattttgataggtttgtgttttatataattatctatcccattgttatctatcaatacatcatggcaaacatctagaagagtttcaagttttatctcatgatctgatcatgtatcctagtactagtgttagttgctcagttgtgtctgactctttgcgaccccgtggactgtaacccaccaggctcctctgtccatgaaaatctccaggcaagaatgctggaaatgggtagccgttctcttttctagaggatctttccaacccagggatcaaaccctgtatatcatcttttatttctgttcccatattcagcattaggtagaggatgatgcaaattcagtatgaatgtgtaagaatattccatcatgataaaggattaatactgtgtcaagattaactcatataataagtaggaaaaacacaagattttgtttaataattttaggaaaatgttctatgcatgtaggttttagtgggccttgggttttcacaatcaaaagcatcaaactagtgagcatcaaaacactcttaaaaactctttaaagttaattgaagtaaatataaaagatgaaaaagtcaagaaaaaatagaaaaataaaaatggatcaataaggtttaaaaataatgcactgtttctattttcagtaaagtaaaaattttactatgataaataaattatagaaaccttaaataattttatgttttgacaaaagaatatctgttgttaaaagatgttatctccctttatacattaatatcattgctttagactcctttaatttggagttcatcaaaattcatttgaatgaattagaaataatattatgaaaaattagattcatgtgctgatttgtattcttgcattcattgggcactttgctttatactcttctagtaattgtaaatgctgaagcagcacagtagaatatgccaacatcggcagactagtcactaaacttaagaagctgtttacctaattgcagtgctaaactgtccaatagcctatatgcgcttgtatggtactggtttgtgaaagcaaaatcaggctagtgtagaataagttaggggattgtcagattcgtatatttgatattttataactcttacttccctactatacctattatatcttttcatgtcaagatagtcgtccccagaaacagacatgagactaagaaggcatttatagctaatatgtatctttctgccctaccaggtgattatgtcttagttatctttgggtcttaagctgtcccagacacaaattttcatgtggtgggcattaagcacacattgtttaaaatgtctttgtgtgtcttcgtaagatagaaggatgactctggaatcaacctgctcgtaagctgctgtgtcacaaaattacagttaattcaatgatattgaaccacgggggttatttaaatagaactgaattttaagccctgggtttaaaagtgattatcttactcttttcctgcaaaacatagctaatgtgtgcctttgaattttcctaacctcccctcattgaattgctccatatttactgctgaagagtgtagctctgcttggacactcacagtgatttgcacctatttttcttgaaagtggcagcctatcattat

SEQ ID NO: 58814 - DNA, 1362 bp, Bovine  19866880509452
ttttagaaataaaatacattcaaccattgaaaacaagaaaggcaagacagactttgaggaccaccagagacgggggagttcagagatttcagaaaagcagtcaaagcttgcactcacctggctgccttctttttgccaaaaaactgctggctgtgggtttcctttagtttcacagggaaatgtcactgttcgaccttgagcaacaatctgatctcttggcctaaccacaaactgtggaggagctataatttaaaaggaaagaaagtgtgtaaatataaactgttgacaaagaaaaatacatcaaagggaaaatctggtacgaggcggactgctcagtgtgagaccgaggctacagatgttgatttatttttaagtatttctcaaaatacaatgggaaaaaaaagagcactctatcaaatgtgaggaaagaagtaaatgtattagtagacacactttaaatgtacattgcaaatcttgcagtccatacacttgcaaagaaaaagtagatttttaatggtaatctaaagtttttaataaataaacatggtatcctcacatggttttgtgttttgaatgaagactgaaaaaaagtcattgcattactcaaatatctacttcctgtggcatcaatcttttgacaaacatgaattgctcttacaatatttgcaagacattgtgcacagggataccagaaggcatagaatatgatattctcaaatgcttagagtgcttatattctagatttgaggagctgaagtgctgaaaacatcaaattgaaggtatgggaattacatacagagataactaacaatatacaaaaacacatgagagtggttgactaattcatttcacttagattaataagcatttggcaattattatgttcctctactgggcactagaaactgaaaagtattcaaaatattgacatatcaataacctcaggtatgcagatgacaccatcctcatggcagaaagcaaaaaggaattagagagcctttaaatgaaggtgaaagaggagagtgaaaaacgggcttaaaactgaacattcaaaaaactaagatcatggcatctggtcccatcacttcatggcaaatagaaggggaaacaatggaaacaatgacagactattttcttgggctccagaatcactgcagatggtgactgcagccaccaaattaaaagacacttgcttcttggataaaaagctatgaccaacctagaccgcatattaaaaagcagagacattactttgccaacaaagttatgtctagtcaaagctatggtttttccagtagtcatgtacggatgtgagagttggaccataaagaaggctgagcgctgaagaattgatgcttttga

SEQ ID NO: 58815 - DNA, 1234 bp, Bovine  19866880522029
cctccatccatggaattttccaggcaagagtactggagtggggtgccattgccttctccctagggagaaacattaacagcatatagagccacgtactgagatatatatatatatatatatatgtatacactataatgatatatatactatataattgatatatatatatattatatatactatactatttattgtttgcttttggagaaaacaattcaaaagaataatggtcaaagcagaaaaaagaactactgaaaaaacagtttctaatgtatatataaaatgaagtttaatctcattactatttgattcagcaatttcaaatctggaacttattagtaatacttaatagtattacttaatagtaatacttctgtatgtgggcatagattgttttacaccagtagggaaataaatatgtaaattttgattcttgggtacaataaaatataatgcagccattaaaaagattaagctcgatctgtatgatatggaaactttcatgttaaatgaaaaagttgtaaaacagtttattcatcatgattcctttgatagctaattaaaagaaacttttgtgattgtgtgtgaaagagagagtaaatagaaaagcaactgaattcacactaaatgaataaaagattaacatcagcatttctgcagagaacatgggattgggtatgattataaataaactatttcacattttccttcatttttttaaaacttgactgtatttaaaatttaaaataatgctcttgaaaatatttttgcagttatttttcttattcatttaatcttacaaatatgcattaatcatttctctcagatatgtatagttaagttctagatatatgcttttttcatttattagatattgccaatggagaaatgcataaacagttggaatgatcatgcagtgggataccttatttcattaccataatctggagacacatgtatcaatgtagaaaaaagttatttgaattaattgaagtctcatagtataccatttatgaacattttaaaaaataactgattgtatatattgttctggagaaatacatattagtaaatgattaaaatatgcaaggagcaataccacaatctgaagagaatggttaatgctggtgggagatgttaatagttgggctttgtctttatatatttgactgctcaaaacatgtaaagcatatatgatatataacttgcttgctagtaaacatgtttgctatat

SEQ ID NO: 58816 - DNA, 2532 bp, Bovine  19866880551101
atatattacatatatacacaatttatgtatacagtacttttgaagcaccagagtaaaggttgtaagttttctgggatatagtgacatgtcaaggaagaaaatacatcttaggggtcacttctgaaacatcgatgttactataagtaaatctttggcatgcctaagtggaaacagtgtcagactttatttttgggggctccaaaatcactgcagatggtgattgccgcaatgaaattaaaagatacttactccttggaaggaaagttatgaccaacctagatagcatattcaaaagcagagacattactttgccaacaaaggtttgtctagtcaaggctatggtttttcctgtggtcatgtatggatgtgagaattggactgtgaagaaggctgagcgctgaagaactgatgcttttgaactgtggtgttggagaagactcttgagagtcccttggactgtaaggagatccaaccagtccattctgaaggagatcagccctgggatttctttggaaggaatgatgctaaggctgaaactccagtactttggccacctcatgcgaaaagactctgatgctcggagggattgggggcaggaggagaaggggacgacagaggatgagatggctggatggcatcactgactcgatggacgtgagtctgggtgaactctgggagttggtgatagacagggaggcctggcatgctgcggttcatggggtcgcaaagagttggacacgactgagagactgaactgaactgaaatgagaaacctattatcttttgactcaaatttttatgacaaaattctaggaacataatgtgcctgtgtatataatatgtgtgacaggttttaataggaaaaataatagttcacatatttcacccagaaagaaactcaacaaggagctaccatgggaaagtgctcaaacgctgatttaaaactgaagcaaattcacagatgtttggtttctgataagaatgaagtgccagttataatttgcctatggagaccttttaaaataatgtcaagtcccaaagaactaccaccatctgtatggttgctggctccaagacatggatctaaattaggcacagaaagtaaaccaggattattttaaacaatgacaaactgatcttaatttgaaataagcctttgttggctccctggtttagaccttttaccctctctatgtggttcctaattttctgggtaataaaaaacaatggactttacagtaattcttaccacaagcccacttacagaagtataaagagaatgagcccctacccattttctactcccaaattccttctggacagaggtgcttaccaggagaataggacacaagatatatgataggtagctacatgattaatcatttactcataattctagccaagttattagggaaaacaatgggcctcttaggtacctgggaatactttcaagcatgcaagatcaaaagagcccttttgcatataacaaactcttgcctacagcacaaaggtcttcttaaatcctcttaggcattcaacaaaagtaaaactagctagacaatatatggctcaactggtggcactagtgataaagaatctgcctgccaattcaaaagatacaagagactccagttcaatccctgggtcagaaagatcctctggagaaggagatggcaacccattccaatattcttgcctggaaaatcccatgaacagaggatcctgataggctatagtccactgggttgcaaagagtcggaaaacgatttagcaactaaactacaaaaaaatcaattaatatttacttcatttctttgagttgttctcttcataataaagagtaattataatttttcctaaatcattggtcagctatgataagtatcaaaacacaaagccaggagaaaagcatttaattctcccagaggatgttcagaagaggaggatctacaaagagctgactcataaagataggaaagagccagaccctgaaatccccaaatactgaattaagaagtttggacttaaacccgaagttattgcccaagattctgaggacggaaagtgacatgatcaacttaacatttaaggaaaaacttgttcaggtcactaaatagaacatggattggagcagagcaagatcgtgagactaattgggatgctattgaataaatccgggagcagttttatcgaatggaattagcttagtggcagtggatatggataaaacagatattggtggtcaattgagtatgataggtgatcagaatttgaggatgctgggtagaaagctgactgtattgtgttaccattcagtcatcaatggaactaaagaattagctttaaattagctccaatactaagtgtctaggttgaagaaactgctattcttttatagtctgtgtaaccagactcgtaactttgcggttgtgctgcaaatgtgagaaaactggcttgttgtgagggtagtgccaacagtttatctctttattgaaactcactttagctcgtctatacatcttcaaatgtctc

SEQ ID NO: 58817 - DNA, 1089 bp, Bovine  19866880565995
ctcttctggaaagattgactagatccaagattggtggtttcaggtcattataatgatcatcatttgattttaattacctgcttattcttgggaagttcctctacatgaggagcagtattacttcttgctgtcagctgtatacccagagccaagcacggtacttgaagtatctgaaaaatacttgttgacataatgagtaaatggatgactgaatgttacactaaatgaacagatttatttattttttagtatcttccccacaacagtattcaattaaaactttgtcaattaggaattatataatcccaacaaatgacttattcacagttctcagagaagcacctcataattggtggctgaaatagttgtggttctcacctgctctatttattttttttcccctgatgaaactatatagaaaaaaaaagagatattttaaccatgggtcaacatataatccccaaaagtatttaaaaaaaaaatgagagtaagagattctctagaacttggtttatgttcctgttttttagttccatgtcttgagataaatgtatttgaggtttctgccttatataacttgggctgtggatcagtttttaggagactgttgattctgtcctggatttactcatctcctcttgggaaattcgggtgaaattagggattattcagtttgagcatttgatcctccttgctgccaattttcaacattcttgtcagcatcttgtttcctaaatcttgtgacatgattctgctatgatagattttattggtacttgatattgacattgttctcttgtgatttccctttggaaaatctgcaaacaaatctaatagcttgtcaagaggacctgaccagaacctgaggtcagattgagctataattaagaaaaaataaatagattagccctagttatctgtagtagttcaatattccctattattcatagcctattggctttataaattttagctttggtcttatgcttattctgttaatctattacatctgtaaaacctgaagattttatgactctttgctttataactttgcttgcttaaaaaatatccgtttcttattttcatatg

SEQ ID NO: 58818 - DNA, 1141 bp, Bovine  19866880709764
atacatatatatgtgtgtgtattatacatatatatatatgtgtgtatatataaatatataaaaaataaccactgcactattatggtttacttgtccaactgagtctgtgttatttgtgagcttggatttaggttctatgaattctgtgcatttgcttctttacaagtcgcacaaacatatatttctttacactcaaactcagtaagaaggccaccagaaatacttcccatccacatgaccctgagacttctctgggaagttttatttgtgaacctttcttcttcatccaggccttaccttgtattcctggataattccattctgatgatctggaggaggaggatcccaggaaacactaatacttgtgctattgtggcttccgacagtcagcacagtgacagattgtggaggggcacttggggctgcagaagaagtcattagaataaaccctaattgtaagtcttaatgtgcattaatgctgcttatagaatatgaatataaagacaagatgcaagagggtcttgtttctagtagttctgaatgaacagtgaatggttaaaaaaaatcctttaaatataatggatagatttaaagcaaataaaacagctacagtgatatgtcctcaacaataaatttaacagttaacattcgagtttgtgtctcctatatgcctagaactgaggtaagagttaggtttaattttcacagtaaaaataacatctcacaaaaaaaattcacaggaaataaaaaacaacgcatcttagttttacagataaggaaaaggaaagctactataatagacttatctaagtcaaactgagggagaacttgaaccaggtatgtctgattttagaaccttgactcttctgcctctaacaggctcctcttttgtaaaacaaataagcaaaacaacaacaacaaaaacattgctatcaaaagtattctgagaggatgcattccaaaatttgaccagccattatttctgagtagtagcattactatctttttgttttgttttggtttatgtttaatacataaaaacagaaacatagctataaatttcaccaacacagagaaaagacagttttgttctcataatgagaaacataattcactggtgtaaactgattcataatttaag

SEQ ID NO: 58819 - DNA, 1398 bp, Bovine  19866880715841
attcaggatctctattggtcagacagctaagcactgcatcagaatcactatctgcaattctaacgctgcatgcagttaacagcaagtctgaacatcattttagatatcagttatgaattgtgcaataacatagccaagttttaatttgtattcaacagttcttaactattataaagacatagaaaatgagtcacagggcactacaggtgaatgttcaaatgtttatttttaccgtataagcaagcaagctatacaatagtgaagagacttgtccataactgaatagctggtagaggcagaattagaactccaggcttttcatctaaaatgtattaggcttttgaaaatgctgaagtttaagggaagcatgcacatgacaatgtgactaattgcgaaaccccttctaaaactcattttaacaaaatgagtcaaataaatgactctagtggcaatataaggacttcccaggtggtgcagtggtaaaaaacccacctaccaatgcagaaaatgtgggttcaatccctgggttgggaagatcccctggagaaggaaatggcaacccactccagtgttcttgcctgggaaattccacagaaagaggagcctgatagcctgcagtccatggggttgcaaagggtccaacgcaactaagcatacagccagagacgatcttgttttttcaaagcgagcatcaaaatcacctgggatatttctttaaaatggagattcttggtctctacaagtggaagggtctgagaagctgcagttatagcatgcctactaggagaagtgcatgcacttagacctggctagatgcaagcactccacagaaacatcaaattagtaaactgaacgaacatacatctttgaataatcttctaagcacccaaatttacataatggattatgtctgcttctcagagactctcaaacaatgattttgcaatgattttagtaaaatatttagtaaaaaacaaatttaatagtttattagcactttaaactttgaagaattagaggtgaagtaaaaaatcattcattcatgaatatatttcaaattaattttatttagtaaaaaaccactcatttgcagtgagtgctatagaactatgtcttcagaagtgatttcaattatataataaaataaaggaggacaaagcacttaaaatatttttgattccatttcttgtatttgaaagtaaactgcttctgcctccttattcaattggaatatattatttcttggctctaagctttacttttcattcatacactcagtagctatatctagttaagcaacacttttcaaacttctctgaattttccctccaataaaatttctgtgcagtggctatttttcttacatatattataatgcgtggcaactgtgcctcagat

SEQ ID NO: 58820 - DNA, 2119 bp, Bovine  19866880769765
ggaaaaaaatgttatatgccatattagttatgctgattctggaggtcctttggaagagccaaatgaatgtactgagtagaacatttatgtcttcccctaatctgacaattgggagaggtcagagattttaccaggattccttgaaacacctatttgttctaatgtacagtgtccaaactctctttaattctatttttatgtcagtgagtatatcttcattaatagcaagctatttgcctttactgttttcttttatatccgctggtctgtaactcatgattcagcaaatatattataaaatgaaattttatgaaaagagaagaatttgcaaagataagatttccagccttctggcttattatagtcaagccctgttgtagagaaataagactcgcaaccagtgaccaatttacctagacgctagaaatggtttccacagagagccaaattacccacactagacactgtcagtgagtcataggaatgcaaaccccaggatttgataatattttccttagacactctaaaaatattcagaggcaacatcttcaagttggaatttgcttggatgtgggcagtagataaggtcagggagattggtgaaggatccaaatgtatgcatataaagataggcaatggccctatgctcttgtattcttacactcagcttctagcttctagtattaatatgttccttacatcatgctcgaattactccccatcacagttgagcacaccagaataaaaaatatcattaaatatttatgtatcaataaggaacatctacagaaactagactcattctagttcattggagattaaatttggaaattatcagcaaggaaaacatgtacagtatctcaaatactgtcacagatttgagaaaatatgttaaataataatttataaaatgatatttaccatttaaaatctttaaaacttggacatttgtagttctttgtgtttaaatgttcaacaaacatttaagaaggcatcatcgttcataaagcatgatggtaggcaatgagggtatgataacacaaaatattgatgattgctccaaattgaaatgtgtcaccttttcctactattaagggaactaaattcttcatgttcacaaaattaaatacacacacacacaacaattcaaagaaaaatggaatcattcctctctatgtcagacatgaagagttctgtcattccccttatacctgcaaactgtcctgccaagtttagaaacacagccatatgctacttcacaagtcttttgtttgccatcctctccctctaccaatataatttctccatttttttaaagtctgattttctcttctaaaaagaaaatcattctaagaaaatcattactgaatttttgaaagatccttttatcctagataaaaggttaagcctactctgtggctttaaagggtgtgggtggtgagcaggattttacttgcttagtagacccaaaagttactgtgtcctttaaatattgagtgcagaatggatgttaatttctcaccagagtgggagatagatgtggtcagcatggggaatgtgagactgattttaatcagttgtcattagaaaagaacatagagctcttactatccaaaattagtgatgctgttagagcctactttatcctaagaactgccaataaattaaaacaggaccagcaatttgagtttaattttcttggtaaaacagcaaaatatttgaggtccttgtaaagctttgaaagacagtaccccaagcagctaagtaggggtggaattgacagctccctaaactgttccgacagaactcctatgagagtaagtcataaaaaggacacagcacatactcaccagggcatctctcccttacaagtgacactcccttcccccagtgctgaacaataaacatatagcactacatagaattttgattggattgcaaaatgggttaaagtccaaatctacagatagtaaatagcaaaggcaatcatccctaatagccttcgaataggccaaatgggaagttctttcagagagacctatacagacaattattattttttaaacatttgtgttctgacagaattgtttttatgattgtgtacccaatttcctctaaa

SEQ ID NO: 58821 - DNA, 1425 bp, Bovine  19866880795973
caagtgagggctactttttgttccagtgcacacgctcctcagagagggtggcttctcttgttggggaacgtagtctgcaagtgcgtgggcttcagtagttgcccctcctgaactccagagctcaggctcggtagttgtggcgcatgggcttagttgctctgtggcatgtgggtgggatcttcctggaccaggggtctaacctccggcccctgcactggcagctggtttcttatccactgtgccaccagggaaatctagatagcatcaattttctttctaagcctttcttgagccattttccctccacaatattaaatatcagaagttatcaaatcactgcccaaatagaaaataattggttaattcaatactatatcaacagtggtaaatgttctctctcatcaatatgcctctctcagctaggcaaaatgtatcaaaacataattattcttagctataaatataatgtattttaatgcaatcatgggatagtaggaagaattctatagtaattcagtagaaaactgatgctttgttttgctacagcaatcagaaattggcaggcttttctaggtggtgaactttattgtatttttattagtaatttggtgtttgtatctggccttttcacaagttagttcacatgcaacattgatttgttgtcatcctgctcattattcaccaggcaagacagataatatgatgcctcatatttcactgacagtaagtcaaagaacaaaagcttatctaggaaaggttggccaaaagacctttggattggcattagaatcatttgcacagtctttttatcttattgcaagaaaaagttgaatttccatcactcaagtaagatactcatctatgaatgtgaacgaaaccctaaaaacagagctaaaaatgtttggatttcataaacattcatagagtcatctgttactttcttgttcttcttcagaaaccacaggaaacctaagtatcagttgttctggaaggagttaagacatgaatacctcagaggtgatacctagttctccccgttgtatgatttgcaccgtgtcccaaatttctttcatctgttctctcgtgtttttcacctagactttcttgtattccccatccctctctattttccacttcttgcacaaagaatcaggatgaatccctgcttttttcttagttttgcttatgtttcacagggggacagaatttgctcactcctggtctattaatagaatatctttgtagaaaagacttggaacaactgatggtaaatgctcattctagttaaatagaatagcaattagaatattttttagtccttcatgcattatgtaatataattatcagatcagatcagttgctcagtcgtgtccgactctttgcaaccccatgaattgcagcacgccaggccctccctgtccatca

SEQ ID NO: 58822 - DNA, 1980 bp, Bovine  19866880800884
catagcacacagtcacattctttaatgcaagtaagtatgttttgaaatatgttgtgcaaaacgtacaatgttttgaaaagtgtgacaggaatgtgtatgtatattaatatgtatattgcatatatatgtatacatgcatagtatataaggtagtatagagtaaaaataggataacgattgttaagttaaaaataccaaagctatatttaatgttgttgaaaaacagtacttaaaaagcatttctggaaagattaaaaataatagatactatgaaaatatgtatcttcatgtctgaatttaaataaggaaagaattcctttataaaatgagtcgcactgcataacatatcggaattccagcatgcatcagtgtacatgagtcctttggaatcaaactgaagaaaaatgatcacccagagtaaacgttacaagataaatgtctttggtcaacactttggatggtgattttttgcctgttgtagaaaacagcttgcaagtttccaaaccttaaaattcaattttgggaactaaacttgaagatactagaagagtgataatttaaactattttttctgttcagacattcaaagacaacacacatttagagcgatctattttgttgattgccagcaaaggtccatctagtcaaagctatggtttttccagtaatcctgtatggatgtgagagctggactataaagaaagctgagcgctgaaggattgatgcttttgaactgtggtattggaagagactcttgagagtcccttggactgcaaggagatccaaccattccatcctaaaggagatcagtcctgaatattcattggaaggacccatactctggccacctgatgtgaagaactgactcatttgaagaccctgatgctgggaaagatggaaggtgggaggagaaagggatgacagaggatcagatggttggatggcatcaccaacgcagtggatgtgagtttgagtaaactccgggagttggtgttggacagggaagcctggtgtgctgcagtcgatggggttgcaaagagtcagacacgactgagtgactgaactgaactgaactggtggttcagcaggtaaagaatccgcctgcaatgcaggagaaacaggacatgtaggctcagtccctgggtggggaagatcccctgaagaaggaaatagcaacccactccagtattcttacctggaaaaccgtgtggacagaggagcctggctgtctatagttcaaagggtcagaaagagttggtcacaactaagtgactaagcacatacaacagaatttagaatttaaatgatatttttgaagaaattctgtccccaaacattcctactgcaaatttctcagaattttttttttttccattagacattcattcctttggtatgatcctgtatgccttcatctttctccagtgaaagtgcatgtgtctggtaagtcatcactaccatttacaatgaacttcaccttaacaaatcaatgcttccctaaagagacagttttatggtctaggggaatggaagtaattgacaaactggaaattcattacggctagtttaaagcaggagtgggtagaaagaaagtaacaattgaatctgtctcacaaatatgactggttttgaagtatcataagacagaaaataaaagagagaccactgaatacctactgtatgtcagctgctttagatgtgtagctcacttaattctcatatgaaataatcaaggaggcaaaattttacagagtatttaaaatgtagagagaacacataacccacccagagtcaaggacacacaagagtgacaggcagggactgaccccagcgtcgtgctctttgttcctaccacgctgacctatctcctgcttcccatgcccccaagcccctagaagcctccagaatcaataaccaaccacagctctgcagtgaatctagaaatgggactgtttacagaatcacctgattttctaattt

SEQ ID NO: 58823 - DNA, 2276 bp, Bovine  19866880808763
tgtgcaggtactccatcagtgctagttgcctgcttcctgtacatatccgtgaaagcatccacagtatctctagttcatatatgaacactgagactttgccagaaaaataaataaataaataacatagaaaacttccttacattaatctatttagtcaatgaagcaatagatggaatactggatctgataacacaaattagctctcatcctataaacattgtgcactaagtcaaaatcaactgctgcatcttatttcttcagggatgctggtatctaacattatacaggatggagtatatttatttccttctagtcaaaattagatggggatggtcagatcttcaaagactcttcagctagtagcacttaattatatgggcttccctagtggctcagacattaaataatccacctgcaatgcgggagacctgggttgggaagatcccctggataaggacatggcaagccacttcagtattcttgaagaattcccttggacagaggagcttggtgggctacagtccatggggtcacaaggattcggacatgactgagtgattaatcacacacattgtgtcccctgtaacttgaacagtgctttgaagttattggctttcaagaaatatgatatttatttccttctagtcaaaatcagatgggaatgggtcagatcttcaaggaatgttcagctagcagctcttaattatatagaatcccaaattcagaattgatgacattctggaaaaggatggtaagttccattgactagcttagaaatgacactatcaaggttcaatatgatatgattatgatcatccaggaacagactaatgcctgtttatttattgttaccaaatctaagctctgtctgttcactgtaggatgggccaattaacctggggtgcaatggctcggaatatgactttattcagaaagtcggctgacctagaagatggatgagtaatgtctcaaaataaccatcttgtcaggggtctgaatgccatgttctgttatagaatagaggaggggaggacttgaagaagtaaagatcataatcttgcaaatatctcctggaatagccaatatcaggggtgtgtgtgtgtgtgtgtgtgtgtgtgtgtgtgtatgcaggcactcagtcatctctggcactggcagggagattctctaccactgcaccacctggaggagatgtattaatctcatcaagcagaggaggagggttccctgaggcaggccaccattagggaggggatgtgttaatctcttcaggcagaggggtagggctccccaaggcaggtcattatatatgattacaataacaaaagcaaatgaaaaacaaaggttaaagtcaaagaaacagatccatcatggagtcagaattggctcttccctacagcattatgaaggttatgatgcagttttcaactgacaacattcaatagacatcaagatgacatttttcatgtcaggttttgattttgtttttgtttcaagagagtagggggagaagagatggaggggtacttcatatcgaaatttgactgaaaccaaccaagtgcatgtgtctacatagaagacgaggcctcaagttttctcatttcaagcctgagtaatttagatcatctggaaggcacgtggggctgcaaggccacagattctagtcagtgtcagttgcctttgtacaggagacaatcaagcagcagagcacactgtaatttttcttttatgttgcaaagggttctttaaaaagattgtattcttccctcacatttcccttgccacagctggtggctccctcctaaatggtatagtagggccctggagcacttgatgtctatcttctcttacttgactgacacgatgtgtgtcaaaatgtaaatagtctaacacagaaggcgcaagagctcaaggagaaaattataaaactgtttttgaaatgtctctgatgggctgtgctctgagaaatttcagcctacgaccttctctaattctaagcaggtggatttataaatttgtgctaatgaccacactaatctaaagccactgaaaagactgaaatgtcctctctcccctccttgaatacatagcactttctgcagtgatctgaggcagattattcacaactcgctatagagccctactgttccttagagcgaaattaaattaagcccatttcagattcttttactggttattaaggaatagtgcatttcatttttagcaccttgctctcatgagagttctgttgttaaggaatcattaggcatcaataa

SEQ ID NO: 58824 - DNA, 1366 bp, Bovine  19866880811211
caatttgattgctcagtagtagctccaattccatagaatttaaatttgaataaaggagagaacaggagtaatactgaaagtcaatataaaaaaatatttcaattatctaattttctcagaatcttccaacattactgccattgttaaagctcagactttcatcatcttttatctatacaaatagaagctgttattttccatccagtgaatggataaatatgttaaaataaaaagaccgtttgctatagcaatattttgccattttctgatctcattaactcaacatttagtattgactagcaactggtgaaaaaaaattcttttctttaaagcgtttttaggaaagagtcaaagagaatcggacttcccaggtggcgctagtgggaaagagcacacctgccaatgcaggagacgtagagatgtggcttcagtccctgggtcaggaagatcccctggaggagggcatggcagctcactccagtattcttgcctggagaatcccacggacagaggactagcagcttacagtccatagggccacagagagtctgacatgactcaaaagacctggcacacacaaagagaatcaagtttgcaaatggacattttagtcctgattctggaaggttgttcccctgtgagcacatctgaccattttacttttttgtgggctttagacaacttctctcatatagagaaaccttaggtggtgcctatatcttgaaaacagggatcgctttcattcattctttcacatattccagcattaatacatgatttggttatcaaataatataaatcctacatgtgaacttggaaaagatgaagggaaacatttttataaacaagggaaaacaagctatcactaattttgcctgtcatctcatagtaagatgtaaaatgatagaggacagcgtagcagatatgtgggggagggggaggttgctcatgatagatttcatttaaggctccagaccatctctgttgataatcaattccacttaccttaattataagtacctatgtttttaagtctcctcaataatgtaatttctttaacagatactaaaaaatctctggcttttctcatgaaatatatttatttctttgctgctcctactgagctataagtcaaaagaaaaaaagaaaaaaacaagaataaattgctaacaactattgaagaaacagctattttgttcgtctttcttttttctttcttcatatgtctatcaagtaaataaaaccagtgaaaaaggatatcagatgtttctgttacaacatgcccttataagtcaaagaactgggcacatatccatggctcgaaagaaaagtttgcagaactgcctggtcaccttgagagactatt

SEQ ID NO: 58825 - DNA, 1251 bp, Bovine  19866880814082
tacgtgtgtaggttatttttcctgcctttcttatacatacatacacatgcaaaagtatagaaattaagtatattttatataaatgaactcatgctctctttctacttactctttacatacattcaaaactatgtaatgggatatttccatgtcagtttataaatctcttcgagtacactattgatatgtgatgcaaagagtgactgttactatgagaataacaacagcctatatcactgacggcctgctgtgcagagatgaatttagctgagggacaagaggtcaaccgttttgactaaggaattactgacttttaacccatcatgaaaacagctaaattagcctttatttattcttttttttctctgaaaaccttgtctctgctctgtggactttaacctggacactaccacttagtgtccaatgactcatttggacacttaatgagtcacttaacctcttttgatgtctctggctccccaactagtgatcagcaggttctctacctttccaagagagaaagacaaagcccttatgatccaagctaccttagattaaaactctaatgcatagcaaaataagaaggaaaacaattgcatgaaaggaagtgttaaggaatgctaccacaaggacatgaaagcccaggatggaatcctgcaagagattatgaaatgttctccccaaagaggccacacttcacttcatcaaccactgaatattacccttctgggaatcattactattgattactgtgccatttatatgtatcacgctgtatgttaactatctgtttataaatttgtctccctagagtctgggttctttgaaagtagggaccacttaaagcttatcaatgaggaccaagcacttgaacataaagtatatttttatgaagtacttgttgaaatgaattgccatcttaagaaacattctggggcctgaccaaagaaggcatgtccaatccaaactcttgatcttggtcctcaaaagtgcacacagtcaggccacagtggcctttccgccctcccatctgataattctagctcttgtccactcctctccagccactgggtgtttttcagttcttaaataagcaaactgcattttcaactcaggaactttaggcaagtggctccctatcctttatgagagcaatccctcaagtttcagttcacattcttccttctcagcaccgtctaccctgacaaggcttccctgctgttcactactttagcgtgctgttaatttctt

SEQ ID NO: 58826 - DNA, 1778 bp, Bovine  19866880822456
tgaaactgttatgatttttagatttgacaaatcaaggcctagattctctttttaagaaaaaatggaaagtggagacctgtactgtttcataaggaaaagaggaactaccaccaataataaaagaatatttaaaaaacagagtatactggttttaaagaaatcatagtcagaggcaagattcagataaatattaggggatacagctccaggaacagcaagtgactgaaaattattccatgaaacatgtggagtgggtagggggttgggagtgaaagctgatagaaattcggtttgagttgctcacaataaatgttttagggaggatctggagatctaccaccccattaattgtagcaacgtaaaatctgtgtgagctcagaattatacacagaggagactctatggggatttagctcaggttaataagtgtcaacttcctgggactatgaaataagctggaaataatttgctaagaagtttcctgaatatgaagtggctttaatagatagtttgatgagtaaatgaatcagaaaattgagggctaaattttccttacatttcctacatatttgcagtgatggtaaggtcaaaacatttggattataatttgagaaccatcaactcttgaagtaaagactatctaagccaagtcattgtcaggcactaaaataaaatcatgaatcccactaattcaaacgcaatttgtaggcctagagctcacatttgagaaaggaaaactaggccacactgttctacatactatgcaaatatatagttcagctgcaactgtctgagattgtgaggtgtgcagaaaatcatgtctactaataatcaagtatgcaaaacatttttaagtaaaattgaatgaatttacggttccttttataaaacatcatatacatttttattgaataaaatagggtagcaaggagcactagatatttatacatagtaggaagactctcttatcttcgccaagacactgtgttgttaatgattgctgtgatcacacattattgtagtgctttccttttctgagcatgtgtcttgaatgacaatataagcatatgtccacaggaaggtagtgcccttgtgaatgtcaaccataataggtattatagcagaaaacgatttgacatcatcacgtacagacttttctatggtatttattctcacatccaagtatatggagtatctactctgtcccatgcacttttctgggcaccaggcatacatagtgaacacaaagggtaaggatgggcccttaattttccacctgatcaaatcacccccccacacacaaatgtgcaaaatacatgaagtaacggttttcacaaggatgttgaaaaactcacaaataactttctctttcctccttttaaaaatctatttattgacttacttctctctgatgatgctgtgaagacagatcatcaccgagacaagatactttggagtcgtcattgattctgctgtgtaccttaattgagaaatatagtatttgtttgtcacatgaatctgcatattattatcttcggttttccttccagatggcccttggaatgtgtaaaactaacctcttcaccatttttgtcttttccatgttctagcaaagaatacaatttagaggtttctcatctaaaatccaaggttatgatcagataatcttaccaagaacttactctaaacataacctctgttctgatatagagtcctgccttaactctggcccatttcccttcattcctaaatgcaaatttctactagaggagcatcag

SEQ ID NO: 58827 - DNA, 719 bp, Bovine  19866880837737
atttgcagaatatttgttttaaaaataaactggattctaagacaaggacaagcaaatcatacaatttacaaagatgacagagatttcattactgggactctttaaaaatatgaggaagggcacatttttatctctaaattgaaaacacgcaaaccaaccactctttaaaaatggtaaaagtcacatctttaaattaaagatgacaatatgctcatgcattttaattttgctgtattcatttggggctattgaacctacctgactggtttcctttactaactcctagatcattgaaacccaggctttgcctacaccgcataatgtcatgtttttacaactctgattattcaagtccctgaataaagattgttccgtatgtaaagtgaaagaggaaatgtgaaggttaactttttgttgaggaaactcattttcacttgccatttgattctgtcttgactctgcacttaacactgctaagtctgagctccccactgtggaatcactattaatacgaatctagctaacttatgcttctgagttcagctatattatgcttttgacacatattttaatttttatatcttgtaaatgtttctacaacttcactcatgaattaagttttacttagaatttgcatttatggtattttaaagcattctgtgaacattgatatcctgagtcagcaagctacagccagtgggctgaatttgacccaatac

SEQ ID NO: 58828 - DNA, 1698 bp, Bovine  19866880842812
accaggtttcatgttaaatggtttatatctccatcttttaaaaaatatttattttcaaaactcaatttaactttcagtaaatagttcactggtctactagtgaatttacctcttaaattactgccacattgcatttttaaatacatatattattttaataaaagctaagtgaaggaacacttttattgtatttttataattttatgagatacagttcatattaatgatcatactttataactgagtttatatataaactttgctttgcccaaataactgaatgcttcaaaaagttataaacatttatttatattttattaaccaaattgtattgctaatttgacacatactaatgtggtggtggtttagttgctaagtcgtgtccaactcttgtgtccccatggattgtagcctaccaggatgccctgtccatgggagtttccaggcaagaatactggacaggttggcatttccttcttgagtggatcttctgacccaggattgaacccgggtttcctgtactgcaggcagattctctactgactgagatatcagggaattccacatactaatacagctctcaaaaaatgtgagagatttgtgaaaggaagtttctatccaattagaatatgcataatattttgaaatattttaggaggattcttttaaaattaaatactaacataactacatcactggttactggatatataaatacattattatagtaaacttactgtttgagcaaacttcaaaactgaaacaaaatatttttatttcctatttaaaatgattcttccttttctattgttactgtgtggaaggaaaggggaataggatatttgcattatctactaaacttaaaattttcccgtgccttattaatatatttttacaataataaagaagttacagaaagtaaatatatttaggttcttttttttttctgaagaagaataaagaatgcacacacacacacacacacacacacaaaattctttggtagatattctggttcactctcatttaaataatataaagctactttcatactctggaaaactctgaaaacattaatttttagtaatattttcacatggaagtctggtagtttttaaaaatccaaaatagttttctgttttattattctctgttttattttctgttttatttttcctcttttgtgaccttttgtttttacacttatgacaaatgatcattttaaaatagatactgaacttggagaaagatgttatccttcaggcttagaatgctttctaccatggtcgttaatttaattttgataatgccaggtgaacatgagtgaattccctgattttaacttaacattttagacttggagatgagggggaaactgataatatctcaccactatagactgtactcttctgttctttttatatcccacctgagaacaccagccccaaaggcgtcagcctatagtgctaacatattgcacgcatggcccattctgggacttggatatgtaggcagccttcagttttatagtctaacactctgaaaaagcaatcacagtgatgtgctaggaaatctagtgaagaaggctttcagaagggcagtggaaaacccacgcataacctcttttatgaatgcagtgtttaaaaattccatttggacaatttgatgtttattggatattttatcagctatccttaa

SEQ ID NO: 58829 - DNA, 1859 bp, Bovine  19866880909348
tcgtgatttagaggcagacagtcccctcctacttatgactaagtactatcggcataaatcttatttgcctactgaaaccttaacaatgtaacatcaaccccagggttgaaaaagtttgttttagagccaaggtaatttagagatctctgaaattttcagaatttcctagtcatagttggataaagcattaaataatgcttgagggcttgatttagatattaaattccattgtagaataaatgaaaatatttataaatttgtatatcttctgttcttactatgaatttcatattttccataaaaatgaagtaacagggaacatattcagtatcacataatacttttatctttgcatcattagtagcacaaatccatctgtggttgaaaaaaacaaggtgcttttagttttgggtacaaagtttggttattttatatattttatattggttattttataaatatatatatttataatataaatatattttatatttgtgaatttgcttcattggtaaactgtgtgaatatttggaaaggaacttgttcaaatcatgggtccaaaatttattgttctatgtaaggtttgatctagagcaaattacctaatttctctgaaactacagaaaaaggaatatcaatattcaccttatatggttgatgtcaagttaaataacatatatatacaagtgcttaaaaattcctttttttttatccttataacctgaataataagacaaagcacctagtacagtgctttgcaaatggttggtagttgacaaatattgttgaataatatggagcaaggcaaatcttccgagtatagtgtacgtagaggttcttcttccatctcgtcttcccacttctttctctttacctcttgataatcaactcttatctttttgcttatctgattatgtcatagtagactttcccctttaagccttcgctaaatatgctgacctattcttaccccacctaagacttcctgaaacaaaattaaatgttaaagtggagcatcagtccacctaacctatgttgtgcaatcccctttgacaatcctttaatccactcctcttctactttcatgtattctgtcccagaacagttcatttatcgtgcatgtggaaataatgcaatgtggtacaaagaaacacacagtatctcacatcaagcattttagataaatgacaagatttctcatctcttctaaatctgacacaaagccaaaagtacatcatgtttaactttgaataacaaatatgattacttcattgctaatgaggctaataagtttacttatataaataatgttccagagctctagttagaaaacagttatgacctaatgagggtgtggtgctgttttctgtctcaaaattattctaaagctaaagttcagtgcaaaaccaaaagtaagactcaacaaataattaacaaacacattattcattgatttatgacaacaaatatgattgctcatgaaatctactggaaacttacagtttcatagcataatacagtgggacttccttgaattgtgagataaatgcttgcaagtttccttcagctctttgtccccgtcaggagtttcaacatgtaacatccaataacttatttaaaaacagagcaaacactttttcatgcacttattctttctttacacaagttgagaacaagtcacagcacttctccagagcacaacgtacttttaaaaataacaagttccataagtatagcttctgttttctgaaaatagatatatttgtaaggtgcatagttataatgcaaatatgagcagcacagacaaaatagaaatgatattaaatgttataacttatattcccaggcaacttttgatt

SEQ ID NO: 58830 - DNA, 614 bp, Bovine  19866880966207
ctctggggataaagtggaaaaagatgcttttcatccgtgatttgtagactctcttttgccattgcttctgtaaagagctaacaatttcatggattctaagccagaatgaacaactgaaagcattttttcaggagtgaaatacactaaatttctcattcatggttgaagaaaatgggggatagggtgtgtgaagcagggagacgtgaaggacggccggtaggcctgcctgtcaccaaggctgatagcttggcgacggttgtacatcatctacccttcattggctcatgaagcccatctcagctgaaatgcaagcgtgcggcatgacacatttatttttcatcttcagtcctgatagttttgggcttcctgtgcatcattaaattgtttcatttccctatgttcaccacagatgtgctgccaccggttccaggccaaggggataaaacggcaacgatgctctcagatggagccatttatagcagcattgacttcacgaccaaaaccacttacaatagttccagccaaataacacaggctaccccatatgccacgacacagatattgcattccagtagcatacatgaattggctgtcgatctgcctgatccacagtg

SEQ ID NO: 58831 - DNA, 1277 bp, Bovine  19866881126753
ccacagagtccataagttaaaaatgaaatatatctaataatgcagtagcatatataaaatttaaaattacctgcaatacatttaacatgaattaattctgatttatccttattagaattagttatttagtcataatgccagtaaaaatgcaattacattgttctgtggaatgtcatgttcattccctaaataaatatattttaaaaataactgttaaatcagggaaagatggagatttattcaattcatatgctattgaaattaaaataatttttcttaatgtgggggtaaagtcacattatataaaactattcattaaaatagcatggtacatctgattttcattttaatcatagcttatttgaggttggtctaatgttttcttgatgctccctcttcatgataaaaaaaaagagagagagactacttaaacagtgacacaaattgatgttaataaattagtacattcatacaaggactcctaattttactgctaaaagcacaccattatatgcagcattctgtagtttaaaaggcacactgataagtgcctgtattcaaatccgtttttgtgccctttgtgttcttatcttccccgggccagcagacaatccggcttttcactaacctctggcactctaccatcggcgatacactgtgctccttctgagtccctgggctgcttaattagcatcacctgtggtacgttccattccgaacagccccgtgaacgcacacacctgctccggtgcctgcaggtagactaagcctcagtgtctcaggactctgggcagtccatctgtgtgccctaaagcagtaactaaatacctatcatctttagcaagcttgctgcagcctctaaccttggtaattgtgcctcaatgaggtagaagtaaaatgataaacaagatcctgaacagacccacgcatccacactctagtgctccaacaaatgaagtaaaacatttgtcctcgttttcaaaatgaagcatacatgcttttaccccaaaactgagtaagatcgtttatgcccttttcaagaaaaaaaatgtgattgtttttacatttagatttgttctaagttttccttcataagccctagaagttgcaaatatttacatttttattttatcaaaatatgttttcaagcacaaattttgaagtacagcttcaaaaacattcaaggtcatattttcccttaaaatattttaatgatataaagcattttacatatatgttagaagggtaaaattgacacacttaagacatttaaaaca

SEQ ID NO: 58832 - DNA, 1987 bp, Bovine  19866881175519
tctagaggatttgaggaagacccaattaatcaatgccagagtggataatgatttatgaccagggtaaaaataggagtgcatacgtttcaatgtggtcccttctctctgttgatcagaattttttttctttctattggaatgcctccaaacatcttgctggcaaagagggtgtattttttgagatagcaaagttgtttattgagccactgagttcaataagcatcagtaactcctgcggtacaaggaaaattggaaagaaaaggcttagtgtaaattcttcaaatatggagcaatccattagctggttcagcaagtcacagaatggactttataatgtgaaacatggaatctggagtgtgtgtgtctctgtgttttaaaatatatgggacagtctcttatgcaagcatttttattatgctgccacatttatatccaggtatttggatagcactgctggcatagcactcccagccaaaataaaaaacagatataatttttccttgagttctacttttatccttcaagatgtctggtgcaaatattcaattagattttatcacctttgtttccaaatcataaattgtttgacaaataccatatcattgatgtgtatcatagaataagacaatatcttatttcgttgatgagtgattatagtatactacctttatactgctgagatttatggtactccattcagcaagagctactataggatggtgaaatgaacagtaataaagttggcaggctgaatgctgcaaagtgtgtctaatgtctgaaaaaggagtctgcttttatgcaaatataaattggctgtgacgcttgtaattctggaatccaaacatcgagtttgtgtcctctgtgtgacccactgtgattggaaaggcagaatggagataacgggtggagagggcgaggatcgagaaggaaaatattaatgctctttgtagatagttgttaaaggtcagtgcttattaaagaaaaagacaggaatagactcccaacaaattacaatcttagtaataaaagagtaaaggactgttgttacttttctatagcaacaagggttatctaatatccaacactgcctttggtgttaagtaaataggagatttcattttattaagtgttgtgcatactgtggtggtttagtggctacgttgtgtcctactgttgtgaccccatggattgtagcccaccaagctcctctgtccatgggattctccaagcaaagatactggagtgagttaacatttccttctccagtggatcttcccaagccaggaatcaaacctgggtcttctacattgcaggcagattctttactgactgagctatgaaggaatccctaacagtattccttttgtgaaggaataacaaacaacaggcagggagtggtgcctggtagatcagacctactgaaatccaatggttggtacccaaagtctgttttaaaccataataaagagtcccccatatagcagttaatgtaagaactgagaactctctctttataccactgcactgattactgactgctctgtctgatattctccttcttctaaaagtcttgctatctgttaatggttcttgcagtagtagctatgttttcatgattccatctcctaagcaccatcgttggttcaagggtgagaacctgaccaaagctggtaaaaatagaattccctgatgttgaagtcactggtccaggattgggaattccatcctatcagacgaatcaggataagtctatctctctgagatttgaaaacttaagatggaaaatacagactctattaaaaaccctgttcttctgctctacaaaggaaggccttatagctcttctgtattgagaaaaatgatttgagtagacaaatggcctctaagttggtcctttaagtccccgtttctaggggttcttaagcctcatctgcactcgtaacttcttatacatcagacattcatctctaccttctattccttggag

SEQ ID NO: 58833 - DNA, 1302 bp, Bovine  19866881219720
cttccatatttaattctgttcataataatcaatctaataaaattaaaatctaggattctttaccttgccaattgcataaaagcataaagcttcacttgtaacagtaaaattaaaaatacagtgtaagaagtagctgatgcaagttaggaacagccagctttaatgaaagtgtctgggacatcaccttaagaatgcatggttgaatcaacaaatctaaagctatagcctctttgtggttaataaaatggctgaggctgaaatctaaccaagcctcaatggaatccattataataaactggcttaagctaacagaactgaaatcacatgcactgtatcctgtgaaataattctttggggggaaggagaggaatctgtacagaatatgcagtaaagtggagtcttgagtaagaattcagtagatttcagtgaaccccaacaaaaatgggggaagagcaaaccatcagaaacattccctgattgaagaaaggaagtttatcacagttcaggtggaagctgtctgaagactcgcttttaccctctgttttgactgcttggatctagtattcaacaaccatcttccccatacataattgtactcacactaataacgcctactactgattattcattctgtgccatacatagatttgcctgagtaaaccatggtcttgttttttttttttttttttatcatatgacaactcaagtaccaataggtattactcattttggagttaggcctaatgaaatacataaccaggtcaaggataacacagtaaggaattgatgggatcaagattcaagcctgaagagttcaattccagaactttaatgatatactctagaacaccatctctggaaaagcatcacaggaagctgaagaccagactagatcaagaagcaacagcaccatggttccacctggacagagtcactggcttacaagccaccaaatctgtgtcatagtcctatagttttaacaaattcaagttggtcacaaacatttcaaacagaaacaaaagcaagaacaaagatatcacctgattgctttttcatcttaaaagttccaggcaatagatgggagtatacattacgagtacaaaatatcacctgattgctttttcatcttaaaagttccaggcaatagatgggaatatacatcacgagtacaaaataaagagattccctcaacactggcatagttatctaaacagcaatgtcaagctaatttctatcgcaggaatgtctcaatctatttcaaagtttttcattataaatacagagaacaaagaatatcaaccg

SEQ ID NO: 58834 - DNA, 2064 bp, Bovine  19866881221947
atgttaaataagattactcacctcttagcagcaaaaataaaaatacatatttgcatgtatcccctgacccaggaagatcccacatgctgcagagcagctaagcccatgcaccacaactatcgggcctgtggtctagagctgggcagctgcaactactgagctcatgtactgttactactgaagcctgtgtaccctagaattcatgcttcacaacaagagaagccgcagcaagagaagccacctcaatgagaagcccatgaaccacagctagagagtagccctggtcactgaaactagagaaaagcccgtgtagcagtgaagatccagcatggccaaaaataaagtaagtaaattcattcaattattaaaaaataaataaaatgcaacttagggaattccctggatcgccaggggttaggactctgtgctgtcactgtcggggatgcaggtttgatccctggtcaaggaagtaaaatcccataggctgtgcagtgtgaccaaaaataagtaaacaaaacttataaaacgcaacttagagaaagaaaggaaatgtctctctctgtataaaaacacagtagttatgctaagacgagattactcagaaggatgtaaatgtcctgttggtgcttgagcctgagactgaaacagttgttctttcctttaatattttctctattctcagagatccaaaatttctccattcatttaagtcaaaactagaccaaagagaaagcttgtcaatcatagataaaatctgaagaaaagaagcaagacaatcaggcaggaatgagggaaaaaaattctttaagggactctgggatgaatgggagaagggtgaataaaaaaggaatttactgtaggggagagactcccaagtgtacttgggaattaagagtaagaaagaatgaagttctgtcacattcaggaagttactggtatgttcactgagtagctgttataagcctcttctcatcccctactcactatgatatcctgtgtggagaaaacttgaaccataagtaaagaacttcttgatatattgctctgattctgggtgcttaattcataggccaacagagccaggggacttgactctataaagaactgtgctcatgtctccttctggtgttaatgacattatataagaaataagatactgcttactccctcaaggacctatagcctactgcagagggacaattcaagcaaacagttgtaactaaataagacaatttcttaaagatgcgtgggccaagtgcactagagggagaagaagcacctaaatcagcctggggtgtcaagttcaatgtcacagagaatacagcatttgagctgagaactttaagatgtaaaaagttgattagactcccaagagaaaggataccaggcagagggaagagtgtgtacaaaggtacagaggagaaaggattgttctggaatctataggcaattcaatattgtggtatttaaaagtaggtaataatatagctaagaaggaccctatatgctctttttgacacagactccccatgtcccatctttgccttttgtttgtagaaaaactttagtctcctagcccttccctgaattccaaatagtaactttcattagagaagttagaaaatgcagaaacaaaggaatacagtcaagcaagataaaatactaataatagtttagccattcaaagaagtcaaagacttttacttccccctcaagggcattggagaagggcgatggcaacccactccagtgttcttgcctggagattcccagggacgggggagcctggtgggctgccgtctatggggttgcacagagtaggacatgactgaagcgacttagcagcagcagcagcagcaagggctataagtaatattctgggccatgtcctttgaactgttttgtagatactgaagcccctaccaagtgggaagaagtatgctgcccacagcacataggtcccagaccagttggaaccagaaggttggatgatgttgactcccagttacttcaccatcagccagtcagaagaatgcccatgtgatcacataccgcacaacccca

SEQ ID NO: 58835 - DNA, 1568 bp, Bovine  19866881240082
tgttgttctgtgtgtctctgatgtctctcgaccctggaatatcaacactttgaagctaaggttgccttaacatttaagaaatgactgtgaactattttctttgcttcttccttcaagtatgatcgctaatgttcttatgtagacccacttaggaggcagatgagttatcagtgggcttggggtgtgtagcaaggaaggtgaatgaaggtgaacaaatagaggtagagaatctttataatctagcttaatgctaaatagcatcatttttgctctgtaattaagttaaaaagcacagatatagacgtagagatgactaagatagaaatagaaatgaaaggataatttttttgccttcaaaatttaagatttttccaggtgtaaagtgtgctcagctcactgctacattcaaaagtataaagtatgctaatatcaatcacatgtgtacttaaataaatttgaagaaaagactgcattgtctcttcaaatgttaactcctttttgtttgtgtgatactatctttgtgaaggtccatatttctcacctactgccatagacttgaaaatgtcaaatgcagtgaaagagataaccttacaaaatagatacatgccttgctcttactgtactacagggaattctcttatgggctgtgtagagttttcaggaccgcaagtaaacttgagttatagggcttaataattgccacctttgctgccagtttgtgtctcactagggcatacagcatcaaaaaaaattcctgaaaaatagcttgtgtcaatttttttccctccaggcttaaaagtatctgtcagtcctctgagcactaccaaagagctattgcctcttctgccacaaagcctattatatcaaaagaaatatcccagagctttagaaggacctatgtatctaagggaatgaggaagagaaggtgtgagagaagcagatctgtgatgtatgaatgaatgaagcagtgaacgcttcatcttatcctgagctagggtcaaaaaagaaaaaaggaaaaaaaaatctctcacaggcccgaaaaactacagcagacgtttaatggattggattgtatgagtaaacaaaattagtgcccgaagctaagcacaggcaatctgggacagatccaccaaagatgtcattggagatgatgttcagcttcatatgggtcaagagtgcccaaggcagaattacacagcaaagtgtttctttggcctggtctcactttctgctctgcctctgtcctctcaagatttttaatcatacttctttcagccctcactcccagtgctcttatttttctctttaactgcctgtagaatcttgagtataatttaaaatctctgaaatctctaacctaccagtcaaacttccatgcttctgagatagttgacttcatcaatgcattagagaaaagtacctataatcttcatcaagctcatttcaccctaaagtatacgtgtggactggacagtggatattagattccatcttctaaaaataaaaagcttactacatctgaatgaatctttcagtagagtgtctgggacagacattccaatcagagg

SEQ ID NO: 58836 - DNA, 1071 bp, Bovine  19866881366903
ggaatctaccatacctaaaatgaacaaattaagaccaaatggaagagcagatctggattgtagatttgaattttcccaaacagctttttacatagttctatttcttgtactttcaagccctaaaacatgcaatgcattaaatctgatttattttcactgcctttgggtctttgggtttgcccccagacagtcaaagcccagtcgttgttagggctggggtagtggcattttgtgttgggtgaagcagcagtacatcgtataatgagaaataattttctcaaactttaaatatttctcagggatttgttttatctgagaggatattaacactctacagatactggcatttctgaactacatgtgctagtgttgggaaagtgtaatattgatcattgccatccagcgtcatacttaaagctgtactagtaagtgtggtttcgtattatgaaatacactttatggaacttttcagaaccagggtggaatatgagtggtgataaccttcttctttttaaagcggtcttaaaataattataaatatatttctagttcactctgcatttatcagaagtagatgcatttgttgtttgagacagaagaaataaaagaacaaagaaagcatattcttggaatattgggagagagcaatgtagaaaacactggatattaaaaatatgcattatcttctaggtttaggccgctgggaaataaagcttctgtgtgtgtatttgatatataaagacaggcgcaaagaaaaaggcaaacgtgctatggatattctggcagggtacaattatgcagtatgtttcctaacccttttcatgaaaatttgacattactgtacctcagctagaagcagcaggaatcaccagggaaagaacagctggatactttattaggttttatgttgtacataaggagaccatgttttccattgtcagtgtgtaaaagaaaatgaaagctctgggcatcattaaagtctcgggaagcgttggatatgtcagctctgttctcgcaacacctggattgaaagcgcagtgtgaggtcactgtaaaacaaaaacagactgcg

SEQ ID NO: 58837 - DNA, 1707 bp, Bovine  19866881464744
ttcacagtaggcttttctgtgatacaactttttgctgatttctagcacattaaagaatccaggagaattaaatatgtttccacataaagtaagggtcttgctccctcaggaaatacatacccagtgagaatgagaaggatcccttttgtctgatgtcagtcgtttcttctgggatcacttactggttccatctgtaattacttctttttgctaaatgcttgagtattgactcagaaacagcctgcttttgatacaactgaaaaaatgtgaatgcttttgcttaactgttagttctccatgtgtgtgtatgtatttcttatagcctcacattaagcttcattcatccattgatttaacatttaaggaacacctaatgggcagtgaggatattggcaaaactctacattctggaagaaatgaagagataggggtcctatcaaacacaaagaagtcaaagccctgtatccattgtttgggagggacctattctttttggtaccatggataagaaagaccattgaagaagaaactccctttcacttcaaagagtgttttgtgtatatatgagactccctgagggtccaaaaagaaatgagatttggattctagtaatagtgggtgaagttgaatgtaacagagaaaaagtctgatgttaaaaatatcccaacaggaataaacaaacagcatcagctgtatctcattatacagtctgcaaagaatgagagggcagaatggaaagaaaagggtggatccagaaatgaaataaacactgattaatttttagaatgcatgagggatttacaatctaaatagaaacaaaagcatgatctctgtgctgctggttttgggaccagccagaaactggagaatgagctgtcacctcccactgcattggtgactttcagaatgtaagcaagaccattccaaaagtgatgataacattctcatagaccaacaaggtatcacatagcaaattattttcataataatttgcaaataatacataaagtattacattatggagtagcttaaaattgcacccaattattccagagaggcattgcagttgataatttttaaaaaaaaataatctattgtggcagatttaataaataagcataagtggcatacaagaggattataaattaaataattttcctaggaggtaaatattactttatgctcatccttgagaatttgaaatcagtgcttaggtggtatctaaacaagtagaaagatatgtgagaaggagttttaatgtcctccccagcccactttgaactctttaaaaaaaattgtacttaggtattttagcttccatgagaccccatatgttgtctgtcattttaatgtgaaaatcacatttgctttcatatctgaataaagacatgttctatactttagcgtgagatataaagaacagctataaaacttgtttagagttatattcaatccttatattttgcagaagattggatttctactttagctaccatatgtaagtaaaggctgttagacttcggatattttgaaaaaaagcaaattaggaactgatgcagaagcaaagtaaatagagaacattattagcatgtaagaagagaagaagagaacagagagatggcagcaaactcaataaacaaacacataattttggtaagcctcaatgctaccacaactactgaaatttaaccatacacaatttttacc

SEQ ID NO: 58838 - DNA, 1591 bp, Bovine  19866881477882
tatgagccatactaaattttaactgaaaaaattagggtgtgaaacaatacctagcaaattaacaaaaggagccttgaatttccagaccataacaggctgatgtgttcacttccatccttatcagtgcagtttgcataggaaagacaaattctaactaaccatactgtacacataatctaatagaaatctgctctgaacagaataaggttaaatgtttatatcctgataggcctttaggaagagttcttatcagcaaggaataagagtgattgttagcaattcctccaagttagtagcaattagcaagaaaaatttattggccagttcttatagtcaatttatggatctattttgccaagttctttgtctgatttcatttgaaaactttcattccctaggacactctgttggaggttgttctgtctgttttcaagctttatgcacagtaacctgctctcctgggcttcccaggtagctcagtgggtaaagaatccacctgccaatacaggagatgtgggtttggtccctaggtggggtagataccctggaggaggtaatggcaacccactccagcattcttatctgggaaatcccttggacagaaaacagtggagggtgtttcggggccggggcggtgagtgcgtatgtatgtgtgttacagatgggaaataatccttaatcttacataaaatgattggcccttgtgatgcagtgacctttataagcgaatgaaaccaggatgtggacttcaacttttccctattgagatcaccacatttcatgttcttttttttaacttttgtggatttttaactttttttgctcagaaaaaaatgaaactaaaggagagatattaatcattaaatgatattgtatatatcttttattctcaagaaagatttgaaacactacttctgcttgagaatgaataaaactctttgcttcagtttctcagagcagaaatgactcactctttcctgtcatgtgctataaaatgatattatttgtaaaaggggattctgtcatcaaatacatttgggaactacttgataaaaccaagttaaataggtgtctttactgtatgccttcgtagagcctttcatatgctcatatgcattgaaactatccaaaaagggatattgtatgcaatttttctcaagtattttgcaagctttattctcatttaaaacttattaatagcttgataaacttacattatgcccagcatattttgaaaaatgctactttaatgttgcattcataagtacaaccagtaatctttgatcttatatttcaatcatgattgtgtattctaatacaatgcaatgctatgacctgtgcaaacttctcatttatgtgttatattttcttttccttctgcaattttatagagtcagaaccttgtggatacagtctatttctgattctgaaaaacttctacataggttgatgaccattagtaactaaagtgacataaccttaaaggaactgctgctgctgctgctaagtcgcttcagttgtgtccgactctgtgcgaccccatagacgacaggccaccaggctcccccgtccctgggattctccaggcaag

SEQ ID NO: 58839 - DNA, 940 bp, Bovine  19866881503156
attcttaaaatgcactggttaaacatgtccttagaataaaacagcaggatagctcacttgagattttaggatatagaagctaaagcaaaaacccaatggagaaaaaagaaactgtctcatacctgaaagcctcaatgatatatgcacttgctggaaggattccaggggtacctggttgccaggacaaggtgacactattcttagtaacatcagtgacctgtggtttggaaggtggtccaggtaggtcatttaaatcataacttttactgattgttgctccagattctatagaggagaaacagaaaaaaattcatttctggttgcataagttgacaatgatgtttaaaagacagaaaataacctattaaagaatttgaatagacagtgagcaattcatcgtcatgaatcaaaagtataaaagtaaatatttgttttttcccctaaatatcagaaaatatttactttcacacatgatcacctgaactgcttgttcttttgtcagagaaaatagtaagattatcaaggacaaatgtatcaaatttcatatatgcaatgctatgtgccaagcagggtagaaatgaaaaagtgacataaagattagtttttacagtcaataaatttaaaatcttgctctctctttaacttgttatctgataatgagctaatcactaaaactggctcaagatttcttctattaaaataattcacaaagaattcacctgtcacatccagcacagcactccaggaagtctccccacttgaacttgtagccacacaagtgtaagtgccagtatcagaaatctagtgtgcatagaagggagagaataaaactgttttaattgatttgtagaatgattactcagtctcaacaaggcactatttgacttctaaaatatatcattaggttgtggaattatacactagagtcaatcatacatac

SEQ ID NO: 58840 - DNA, 1591 bp, Bovine  19866881570185
ttcatgtgaggaagatgtccccatagggctgattttcagtgtgggtattttagatgcttttatcaggtataaggtacctcgataagtaagggttttgcacctcattttttcccctgcagtcagtatatattttttttcaaatttgcggtgaactcagaaaatggagagacacagccaagttttaattcagtaagtgatgttctggcacctctgactataaatcagtgttgcaaaggcattgcagcagcataagtaaatggtgtccaaataaatgcccagccttggcgtgatggttcacaattttgtgcttcatcataagactcacaaggcaatttgcttaatcctgtctgcataagttggacttagaaaagtgcaatttgtaattcagctggctgaataaatggatttctactggccaaaagagtgagaagaatttagagcactctgtgcaagcttgagaaaatttacttggctaacctacttctttgtttgtgtaaagggaagttatatctagctctttaaaatccaaatatattttcctaggtatagagtgatgagggagaagcataggaaaatgcctggaactgagaaattataagcctttttgtttggaatgctagtggtgtgaaattgagtctagagagggacagaggtgagcagcagacataaaatgagagaaaagaagaagaattcacaagaatctgtgcctcagtggctatgaaagaaattgaggggttaaaccctgaaactaagagttttagtattggggaaaaaatgggattatatggtgaaggagagagggatgaggtatgtgataggagacaggcgaagggtccagtttgagagctgcagagtttgaggttatgaatgagcattaaagcaggtccctgaaccaagcatagaactttccttacctggagatactaaactagagatttggttcttgttgtcatagaaacctcagcctatgagagggaatgagtttcccatagaaggctctggagacaagagccaggtctgcagcatctttattgttgttcagccgctaaatcgtatctcactctgctaccccatgggctgcagcaggccaggctcccctgtctttcactatcttccgcagtttgctcagactcatgtccattgagttggtgatgccatccaaacatctcttcctctgtgatccccttctcctcccgccttcaatctttcccagcatcagggtcttttccaatgagttggctctttgcatcaggtggccaaagtattggagcctcaatttcagcaccagtccttccgatgaatagtcagggttgttttcctttagggttgactggtactccttgctgtccaagggattctctggagtcttctccagcaccacaatttaaaagcatcaaatctgcatcaaagcatctcacatgtaagaatgttagagttggactataaagaagactgagcactaatagcaccttaggaggccttaatgattgagacagaagtgatttgatttaattcagatttctagtgtgattgtttacatataaatcaaagatcgtttttctctgtttatagaaattaaacaaaagaacca

SEQ ID NO: 58841 - DNA, 978 bp, Bovine  19866881610884
gatgtttctttgacttttaaaaacaaccttatcgcttaaattttaaacacactgtgattccccaaaatataaactgctccagtttttcatattttatttttagaatgatgtgcaaaaattgaggtgagaaaatgcattctatgtgtttatttaaaattcagacctgttaatggtttgtgtgtgtatcaagtactataaaggtaaaaacaaaaagttagccactttaaacgttgtcaaagaaccaactagaaatatttttaaaaattaaaactctaaaatgtcagaagcagaataatttattatttgttccataaaggggaaagagaatgaggggccatttaatatagttattgggataatatcttggtacatatttttcacttgatccaatagtcaacctagcaaaacagtattttaattttattttgtatatgtgcacatgtatttggtggtggggggtgagaatttgagaaaacttgggtgaaatagactctcttttttcattttcttggtttccaaaatcactgcggatagagactgcaaccatgaaattaaaagacgcttgctccttggaagaaaagctatgacaaacctagacagtctattaaaaagcagagacatcactttgctgacaaaagtccataaagttaaagctatggttttgccagtagccacgtacgaatgcgagagttcgacagtgaagaaaacagtaccgaagaattgacactttcgaactatggtgctgaagaagactcttgagagtcccttggacagcaaggagatcaagtcagtcaatcctaaagaaaatcaaccctgaatattcattggaagcactgatgctgaagctgaagctcagccacctgattccgagaggtgactcattaggaaagaccctggtgctggggaaagattgaaggcagtaggagaaagcgggtgacaaaggatgcaattggcatgagtttgagcaaactctgggaa

SEQ ID NO: 58842 - DNA, 773 bp, Bovine  19866881691359
tggtctcttcactacattctcattaattctgcaaccactcttatgtcttctcatcctgctttatacagaaacatagaaagctatggagtccaccagatgggactcctcctttaacagtatgttgaagagtaggactcagcccttcccttctaggatctgagcaatctgctgctctaggggggcccatgttctgacagctaaagaagtgggaggctaagatccaaattacaaatccactgaaaatcacatacctggcaagatggcactaaaaatgcctgctgagcaattgagtcagctgtcagaaaatagtgatgctgttggaaacatgagtgccttacttttaatcatctctatccaccctgctttcagaagaagtaaagactgcactagtatcgctctcagctggtccctcaccccgtccccagcaagtaggcaaaaaaatgtaagggaaaatacagagtattatcacaggttgtaaagcgaggtttgcaggttgaccaggtaatagactaccagaagataaaagactaggaaacactgcttggggcttcccaggtagctctggtggtaaagaatccacctatcaatgcaggagatagaagagatgagggttcggttgctgggttagaaagagcgcctggaggaagcaatggtaacctattccagtattcttgcctggagaatcccatggacagaggagcctagtgggctacagtccacaaggtcacaaagagtcagacacaactaagtacttagcttgcatgcacacagtt

SEQ ID NO: 58843 - DNA, 999 bp, Bovine  19866881726805
cattattctgtctacaatagtggcttcagatataagcaacgcgtagattctgcagatacaaagtcagatacgtgattccaatattctaactgattgtttaagctgtctgaattattgctgagaaaaacaatttggtctagtcatggcctgaagccttagaaaattgaaatctctcttgcttctttcatgactgaattcatcattccactttctagtgatgcccttgtactcactgtctatcaataataggcccattataaacatacaaacccacctaaaacatctgtcctttcttagggtaaatcaatattaatttcatttggaactttcatcagatcaaaaagaggagaggaataaagcttctttctttctctctttttgaccttaacttaagcaagcctcaggggggaaaaaagaaatctatttgatttatgtatttatgacacattaaaaaggataaagtgaaactcagtcattcctcttaccaaatgagatagttaaattttagttgtgctctaggacaagagagagtatccttttaatgttcaaaataatattcaataacattgatggacttcacaaatataactgataacaaaaaataagatttgtcacaaattttgaagttgcttaaaggacattgaggcattcagttacagctgggaaatttccctccaagcaacttctatcttcaggcaaaaagctacagctacaattgttatgctgctgctgctgctgctaagtcacttcagttgtgtccgattctgtgcgaccccatagacggcctcctaccaggctcccccgtccccgggatcctccaggcaagaacactggagtgggttgccatttccttctccaatgcatgaaagtcaaaagtgaaagtgatgtcattcagtcatgtccgacttttagtgacctcatggtctgcagtctaccaggctcctccgtccagaaattttctaggcaagggtacggagtcgggtgccatgccttttccaa

SEQ ID NO: 58844 - DNA, 1469 bp, Bovine  19866882026775
ccttgactgttgatgcctgttttgcaaatgaatggtacaccaaaaacttatttttgtttctgttcacatgtgaatttagatatccacaactatatgtgtgataggaactcattaaatatttgtggaatggacagactgataaatgaataaatacacggatctctgtatatatgtatataattctgtcattttggagcaatgcacacacatgcaaatacaaaaggaatgcaggctgcagagaaataatcaggagccactgctaagtatcatttataaactgtattttgctaatgtaattgattacattatcagcaatgatgggaatctgctttgtacctctcccagtcactgttataactatcatgacaataataatagtaataataaaattcactgggaaattggacattttaaatattatgcaaagtctgaataaatgcatctttagaaaattttatcattttaaatcagtaacataactaagtttttaaatgcatctattattccaacatagctttaagtcaagtccgccagtctctctattcaaatcagactgtagctcctaaatttctcctgtaaagtaattctggaaatacccattatttaaagtgttgaggttttaataaaagaagaaaaattgaagcagaaagaaagtaaaagaagttcacatgatttattttaaaagtaaggactgccacctaaacaggaaaataactgggcttaatgtaccacaatttcttcttcttcttaaaaacaatttgttttctttcagcctgctggcatctgtattttctgtagcatagcaaagacagaactaaaaactcaaaagactgatataaaactaacctctttaaaattagggaggagggaagaacaaaacagtgggcttctacattcatgctccttacattgtactaaattgaattagaatgaataaacatttctttaggtccctgcctaaatatttagttaagaatctgaattgtaagctactactgattacttcaatcctgagtggctcctctatagactatattaattctctaaataattttttcttagaaaatactttggaatacataaggcagctttgcaaatgataaaactctaggcagaatcagtagcttaaataagagcaataacaaaaatgtgactctgctactactgtataatatatttaattctgtatcaatttctctttggctgtgaatctgtgctaatctgcaaaagtgattaaggttacagcatatgcactggtgtccatgttgtgtatatatactatatgatgtgtatgacagatttgtatgtttacagaagaatgaggaattctctttttaagtatgcaaatatgatgagtgttatagaaatatttgcatcccatatttatttcatgactgccttttttggtgtcacccaggctcaggatctcgttcttatctcccttcttttacttccatcagtagacagac

SEQ ID NO: 58845 - DNA, 1139 bp, Bovine  19866880446060
tttcatgagctggagacagctatattatctcttagaatcagatatacctgagtctgatttctggttttgtaacttaattgacttggagccaaatcaggtcaggactgaatttcaactccttaattgatgaaatgtgaatgattttatctaccacttggagctgttgcaaatattaaattacattttaagcaaacttagcaccatgcttctcaaactttaatgtgaaagatggagctctagttaaattgcagattctgattcagctggttaggtttggggtccaaagtccatttctaactggctcccatttgatgctgatactgctggtctttggctcacactgtgagtagtaagaatgtccatgatgctggccacatagtatgaggtaagtgcacttgtagctattagtacaaactcttaatttgttaccctgtaccttttggacagaagagcacaaaattcacacccaccagccaaatggagaaacagaggcatgggcaagcagactgtcaccaagaggatgcccctgggtgtctctgccatgtgttgccttcccttgtaaagatcctgtttttcccttatgtgggctgttgcaactcctactgctactaatgggagttacccagacatgtggaggaaagaacataaattctgtggcgtttctatctgctcagctaataaagcaattttgtattttgctgaagagaaaccactttcttgacagtaagctgttgagaaatttttgctttcaattggcccatcaggtgactagttttttttaaattgaactcatggtgttcacttgaaacatgattgtgactcaaaggcttgggagacctaagtggttgagattgtgcaacacagcactgagttttttaagattagaaggcaacctcttgctgaaaagatctagggattcttacaaaacaggagttggcaacctttcagatgtgggtaggtggtatttcttttatttatacacttcatttaggggagatggtaaattgcttcttctttgaaagggtaaggaaaggacttttccaccttcctttgtcaatggttcaaggaaatacttctctatttaatgtctgccatgggcatcgtcatagtttcccacctcctgggcttcctggcttttt

SEQ ID NO: 58846 - DNA, 853 bp, Bovine  19866880489058
catcaccgactcgatggacaagagtttgggtgaactctgggagttggtgatggacagggaggcctagtgtgctgcaattcatggggtcacaaagagttggacacaactgagcaactgaactgaactgactgaatgataaccctaactacaatattacaaattattatttctcactttaaaaggtgcccaaagggtgaatgttccctgccttaggtagagtctaggtcagctaatgaggagatcatgatgggcagaacagagaggccacaggaaattgcactcctggctcttgagtcagctcatgtttaccttccagacttcgcctttctcaggtaggcaaaggatataaaggactcttgttgctaacatcagggaagaaattgcactctcctatatatactactcatataggagagagatatcaacaacctcagatatgcagatgataccactttaatggcagaaagtgaagaggaactaaagagccttttgaagatgaaagaggagcgtgaagaatctggcttaaaactcagcattcaaaaaacaaagatcatggcatctggtcccatcacttcatggcaaatagatggggaaaaaatggaaacagtgacagattttattttcttggactctaaaatcaatgcagacagtaactgcagccatgaaattaaaagatgcttgttccttggaaggaaaggtatgaccaacctagaaaacatattaaaaagcaagtccatacaaaggtccatatagtcaaaggtatggtttttatagtagtcaggtacagatgtgagaattggatcataaagaaggctgagcactgaagaattgatgctttcaaactgtggtgctg

SEQ ID NO: 58847 - DNA, 908 bp, Bovine  19866880511713
tgatgaatgcttttttcctttaggtgattgctgaggaattatctggtaatgatgactatgttgaacttgccttcaatgcacggaaactggatgacaaggtaaagtgtttggcatcagccttattgaagaaagtaataaagctaacacacaaagcttaataagatttcccctcaaagctattttttccctttcaactcacattattaaacagatcaatgatttcagagaggatggaaagtaagacttcccccctaattgagaatcagttaatgagaagaagggaggactataattaaaacaattttataattaagtttataattaataattataattaatttaatttataattaagacaattttattacactaagacttcatttgttcccaaatgctacaggtcacatggcataggtgaatgtgatttaaacccattgctaggagcttttcaaaggaaaaaagaagatgggaaagggaataaaagtagcattttttaagcatcatatttgcaggcatggggttaagagcttttcaagcatgattacagttaatcattcttatagcatccatgtaacaggtattattaactctgttttacagatgaagtaacaggctcaaagataaagtaattgtctaaagtcactccatgtgttagtccaaataatccaagaaatagacaccaagaaagagttaatgatgcaagcaggattttattaggagaaacgcctgtgtagggaacacaagaaggaaatctaggagagctgacaggccacaatgcaagtctgaatataagtaaagaagagagggaaagaggtggcagtttctgcaacaccacgtagtctaaggaagattctaaagaaggttctaaggaaggaagtctaaggaagccagcaaggagtcctgtgtgt

SEQ ID NO: 58848 - DNA, 946 bp, Bovine  19866880594983
tgcctggaaaatccctggacagaggagcctggtaggctgcagtccatggggttgctaggaatcggacatgactgagcgacttcactttcacttttcactttcatgcactgcagaaggaaatggcaacccactccagtgttcttgcctggagaatcccagggacgggggagcctggtgggctgccatttctggggtcgcacagagttggacatgactgaagcaacttagcagcaaggtgattatctgggtttacttgcaattactgagccagcctttaagttccattcatcctaagtctttggtgtttagggctgtaaactcaggcattcaggaaaagttagtcatcacttttgctgtggtcagtgtgcactggagccacctgagtgtgtaactggctttgtccttgtctcctccacctctctgtccccattgtctcctgatgtctgacctatggcagcaatacttcatcctgctgatcctgactgatggggtcatcacagacatggctgacacgcgggaggccatcgtccatgcctcccacctccccatgtcagtcatcatcgtgggagtaggcaacgcagacttcagtgacatgcagatgctggacggtgatgatgggattctgagatcacccaagggagagcctgtcctccgtgacatcgtccagttcgtgcccttcaggaacttcaaacacgtacgcatatttggggggcttaccttgggaaagcagaaaccccccattttcccaccagtgttggtagtgaagcaatgccagccatacctgcctgggccaggccacctcccagctaggacatgtaacgcttgactcattggagaaagaagtatgccctgagttatggatggggagtcatgctaactatgtagccaacctttcattggaatttggccttgtctacataatttagggtcttcagtgtacccaagg

SEQ ID NO: 58849 - DNA, 3608 bp, Bovine  19866880597281
attggttagttttctgtgattgaacattggcgttcctgaatctttttagagttttgtccagatatacacccaggagtgtgatggcaggaatgtatggtaactccatttttagttttttaatgaacctctatactgttctcccagacaaggcaatggcaccccactccagtactcttgcctggaaaatcccatggacggaggagcctggtgggctgcagtccatggggttgctaagagtcggacatgaatgagtgacttcactttcacttttcactttcatgcattggagaaggaaatggcaacccactccagtgttcttgcctggagaatcccagagatggtggagcctggtgggctgccgtctatggggtcacacagagttggacacgactgaagcgacttagcagcagcagcagcagcatactgttctccataatgggtgcaccaaaatacatctccaccaacagtgtaggaaggttcctttttctgcacacccacttcagcatttattatttgtatactttttgatgatgaggctgtcctttttgttaggtttttgagaaaattttgcaggtgctgcaggtaaagccttgattcccacgtcactgcccacagggaggaggttttccttgggtaatccgattctgatatgtcatagtactgcttttgattacagaagaggcccaagaggacttggaccactaataatgaaaaagttaagcaagcttcattagaattgcaaagaggttctgacattcccccaaactccagaatctccagttcaagcctaatttgacaaagagaatattttattttgaattaaactaataaagtttatttgtttttttattttaatataaatttatttattttaattagaggttattactttacaatattgtattggttttgccggagaaaaaacaataactgcttgggttacaaaatcattcctaagtgtcttgggttcagattcaagggcaaaatgaggctaagtatgaattcattaactttgttttggatggaatgtgagcctttgaggttcctctgtcctcctgggcaggtcaggtgagccctcaagtgagctgattatagtgctcagcactctttcctggcatctgcccaccaggagactgaggacatcacgtactctgaagccagttttcagcaacaaatgaatggcaatcattcagacctctctccccataatgagacttgaaccaggaaaactaatagtatggtgaacttgcagacatagttccagtggaatcagaaaagcttgaaatggggaggaagaccaaaggctagctgggttcagccagcattatgcaggtgtcagccctcatgctcctggcttcagcttaagtactcccaaggaggggaattcattcttactgtaaggtatcctcataaggatatggtaacatagactccatttgccctaggccatcttggctcatacctattgtcatggtttaattattaacactgctctctttcattttcaagtgtccaaattaggacaatatattttacagtcccttcatgataataaatcactttcatagctgacatttatcaagtgctgatcatatgccaggcattcatgagcttggtgctgtcaacaccatcatcacagttcatcacagatcatcatcatcatcaccagaccaagatccacacctcctgagtcagagtcaagatgtaataacaggcttctggattcagagtcagagccctaagcttttcctcttttatctctaaaatgcactacctctggacttctgttttatatacctaataataaaaacatcccaaatccctctccagatgtccccaccactgactttctcttaagtgctcagttgagggaggagactgatatctgagggccttgtatatctcaggtgctatgttacctaataaatcaagaactgggctctgagagctcaactaattcatccgcactcaagttgacagcaagttgtgggactaaaattcaaagccaagtagacctgatattgatacttgccttcccagtatatcattttcccatccccattgcattcagtttgcagattggaaaaactggagaataattctccctaaatgtaaactgcagtaactgctcagtgaggtcaggaagaaagccaccctttccatatgttgataaattgacttctgtatctttttcccagctcaggaaaacctatgacatccatctgtgagtgtttatcttcatactcctggaccacagaatctgagcaacttacagtattcaggcctcacccttccctgggcacagacttttgttcagtgtaccaaatatggataacaatcagataaaaatagctgatatatattcatttattcatccattcagtgaataacacattcaatgcaaacaacaataataaaaagctaatatgtatctattcactcattcaaataaatatgtatgtattcattcatttactgagcccttactatatgccagacactcctctagaccctggagcatcagctgtgaataaagggacaaagccctgttatcatggaatttacctgttcctacataaaataataacagtgacagtcctatgaaggaaaaaatcttgacagggtgaggaataaagagtgatgggaagggatgggtgctaatttaaataagggttctgggaggccctttctgagctgagaccagaataaagtatgggcataatccatgcagagaattgtaggaaagcagtccaggcagagagcaaagtgaccagggcacttctgtgcctttgcctgtgggtgacacctaccaggctttcaacacaagatttacaggatgaccaggaagcaacctctgtatagcctgcatcatccatcttattctgcatctggttctgaccttttgttacatatttttgattatagaagtggccctggagggcttggagcactaacaatggataagttaaggaccctcaggggcccgtaaggatgggaagtttaactctccatgtcccaggctcaccaagcaagccacaggcaagcaggaatctttgatctggggccaggcctggaatagatggagtaggaagaacaacacactgggagccttcccttgtgccactcattccctctgccccacagcccacccattatgctttcccaatgcccattgttattcacactgagatcaactcagtgtcttaaatatctttactctctacttctttttccagtctacttccaggaccccagtccaagccagtcaatgactataatcatctttttgtggaaattgattagatgggagagaaaagaagaggaaggagcatttcctaagcatctccatgtgactgatgctgtaattttattggtactcattatgcacatgataataaaccagtggagtggatagtattttcaccatttcacagaagaggaaactgaggcttgaggaggtcaccctgcttgtcctatactgggctcagcatttggagcctcatgtgtgattctttttaaaattaatttatcttcatttttaattgaaatatagttgatttagaatattttgttaacttcaagtgtatagcaaagtgattcattatata

SEQ ID NO: 58850 - DNA, 3098 bp, Bovine  19866880676816
atcccaggcatctcatcctctgtcatccccttctcctcctgcccccaatccctcccagcatcagggacttttccaatgagtcaactcttcgcatgaggtggccaaagtactggagtttcagcttcaacatcagtccttccagtgaatacccaggactgatctccttcagaatggactggttggatcttcttgcagtccaagggactctcaagagtcttctccaacagcacaggtcaaaagcgtcaattcatagtgctcaatacactggtgcttctcaaactccaaagtgcacacaaattatcttgaaatcttgttacaatgtaattgctgactcagatgctcaagtggggcttgacattctaagttcctaggtgaatattgctggtctatggaccaaactttgcataacaaggcacagactgaaactttacaaaaattgctatccagtggtcctgccagacaagtaagaaaagaaagctgagaaaggttttctttttggtgtccaatgtgagcctggcatgtcagtttctctaggtatggagaagggaacaaacacatttggggcaaggctttattctctcccttgatgagcctcagcatgacttaatttccattcttctgcccaagctcagccagggcacatgggaacccacagggatgtaaagtctcatacctgtcatagtcttggcaagtctccacaacagatgtgctaaagtggttataataaaactcaggtactcagtggggttggttggggtggatgcagtataggaagcagctattcctggggtctctgtttgaggcggtggaatctacagctacctggaggagaagataggcaaatgggtggatttaaagtgaatgcatcttataagggaggttggaaaagaccttgatgctggagaagattgaaggtaggagaaggggacagcagaggatgagatggttggatggcgtcactgactcaatggacatgagtttgagcaagctccaggagataggaaaggacaaggaagcctggcatgctgcagtccgtggggttgcaaagagtgggacacaactgaatgactgaactgaactgatgagagaggtacagcccgagtggtgaaaaagcagcatgttaaacatccttccaataagcagaattagagaagaaattcattagctttaaaaactagttattaatttggctgaggccatttctgtagcctgcagtctccctctcccctgatgctccctcttctccacgtccaaaacagaacttgagactgatggaaaggtcagaaaggccagctgcttctgatccataatgccaccacgcagcgaggtaagggtggaatatcatgattcactgagaggcctgtgctctccgggcaggacaattccatctctgaggcctaagtagactccctgaaaacccaattttgtgttaaagacgtggtctgtataacaaagccatttttactttcatcagttgccagtagcagagagatgtgctaaagtggttataataaaatttcttctagaagcagctctgcgtaaggctccattcatgtaaaaactcctgcctacaacaggggtgcatgaatggtatgccgctgtcagcggcaagtggagaagagaaacctgtcttgccaccaatttgtcattatccttgaacttttaaaattatttctgacctccagcatcatcataaatagaagctgactcattcaacacttcttaacaacaacaacatacttaagtctggggggtgctcaaatggggagatgcatatcttctgatttttaacatcatcaccatttaaatgaaagtcaactcagcaaacccttctctaaagaaatgcttaagcttgagggtagagaatggggagatggggattaaaatgaaaaagttgtagggaaagaaaggaatgtttttggtgcaaccaacccagcagaattcatgtattggccctatcttctctcatgatgttttgaacaagaaatgttatttgtacaataattggcaaagttccattataacaaataaccttaaatttctcactggatttagtgtagacagaggaaaggctatgggctctgtgtctgcttctgaaaagctagactctaagagcaatgctggtgggaaaaaaaaggctacaacgtcttatatcgcaagcctgcaaccaagtcaaagtaactagaagagaaaaatcaataggctaacactaacaacttacaactgctcttttttcctttcataaagttacttttttcatcactgaatttttcccttttgtcctcactcctccacaggactaaagtgaagataaatttaagcaggattcacattttatttttcagaattcccagatgttttccacaatgtagaacaaactgataaaatgctggtactaagtgatgtgagaggaaggccacgtgaagaaacactgcacagcatctccccagcccttagacgcccttactgtggacaatgggacggagggaggggccacctttgttaaaaccctactatgcatcagacacctgtgctgactgcttcacaggcattgtgctatttcatttccataaaatccctgtgaggtagagattgttattcctttttattcatggaaagtctgatgcccaaaggtgatgatggtcataaggtcatacgggatgcagctgggtttagacccaagtctgcatggttccaaagactccacttctccactgaaatcattatactcaagagaatggggaaagctgtgtccagcttgcctagatgtctcgtggtgatggtggtgcttcagtcgttaagtcgtatctgactcttgtgaccccataggctagcctgccaggctcctctgtccatggaattctccaggcaagaatactggaatgggttgccatttcctactccagggtgtcttcccaacccaggaatcaaacctgggtctcctgccttgcaggcagattctttaccaactgagccacaagggaagcccagatgtctcgtgggtatgttttattcctataaagaatgagggaatttggcctggaggcagggaagacaaacctgaaggcaattacaataatttaggagagaagatacgc

SEQ ID NO: 58851 - DNA, 1312 bp, Bovine  19866880689678
gggacccggtttctattcctgggtcaggaagatcccctggagaaggaaatggcaacccactccagtattcttgcctggagaatcccacggacagaggagcctcgcaggctacagtccatggggctcgcaaagaagcagacacgacttgggaactaaagagagagagagagacattcaattcaacactcatcaaagtatcaggaaggtgagttttgtggttatgtattataaaaaataaacttacctaagaaaaagtaaagataattgtgagctgcaatcgtaatggaatcacagtttgaaatgccagctccttgttctcagagtgtggttcaggaccagcagctgtggcaccatctagtagccctgcccaactagaacctgcattgttaacaagatgccctggcagttcaatccatatacacactaaagcttaagaagcactgtgttcatgactttcaccttcaggccttccccaaacaacttatcctcatccaaagtctttctccttatttagcagcaaagtgtatataaaagaaagaaattatttcaaagatgtgtttgtttctttgggagagccctgtgcactgggccctaaagccatctctaaggtctgaataaactaaaggaagtaattagcttgattaacacctactcctccaaaggacctaaactctgaaagagtagcatatgagcaaggggagataaacaaatgaaaacatgtttttctataatgaaactcatttgtagagaaaagcagctaatcactgttcaaagagaagaagggatttaacaaaagcacatgctgccaaatgatttaataaaaatataagtctactgccctccttgctgttcagtttttaagatgtcactcttccttccctcctacctcactgagtaatttcctctaaggcagtttttattttatttgttctcaaagcagaattcacacacacacaccctgttcttttgagagttccaacatatggttatttcctgggttgagccaggtctgagatatttctgtaaaattaccaatattttctttaaagttgtgtgtgtattttacttctgaatccagtacccaggccttttctcttcatgggtctctgaatgatagatagctccctttcaaggttctggccgcccataaaaggctctgtagacttcatccaggttgaaaatgcttgttgactttccttcagaaagtctctttacaaagcagcagaacaggagcctggcataatggatcctgatgcctgcgcttttttgacaacatcagcaagatgtctcagggtaaaagaagacaccataa

SEQ ID NO: 58852 - DNA, 2935 bp, Bovine  19866880820396
tctggaagttcagggttcacatactgttgaagctcagcttggagaattttgagcattactttgctggcatgtgagttgcgtgcaattgtgcagtagtttgaacattctttggcattgcctttcttagggattggaatgaaaactgatcttttccagtcctgtggccattgctgagttttccaaatttgctggcatattgagtgcagaactttcacagcatcatcttttaggacttgaaatagctctactggaattccatcatctccactagctttgttcgtagtgatgtttcctaaggcccagttgacttcacattccaggtttctggctctagatgagtgatcaccccatcctgattatctgggttgtgaagatcttttttgtacagttcttctgtgtattcttgccacctcttcttaatatcttctgcttttgttaggtccctaccatttctgtcctttattgagcccatctttgggattataagtggaaccccagattgcaatctttgaagtctcacccacagagcagagatgctacctgggacccattcccaattagaactcgactatagatgtgctgtgacatggtatttcccttggctgattaaggtcggatgttggtcaaaaccccaatttggtgatgtatcttctgctctatttttattttcttttaatgttagtatacttaaagtaagctagataattctctgataaatactggcattatttagttgtatacaacgaatggcttattttgttaacaaatcctttgagcctgagatgaaagtgaaaacttttggcaaaacaacaggaagaaagaaatactcttgggtgctgggaatgttctacctctgatctgagaagtggtaacacaagtaacacattaagtcatgcactgaagtttagtacaatttacatactttactgtatatatgctaaacttcaacaattaaacagtgagtctagggagggaatcagaacctgctttagtaaggctgggtgagtctaagagagtctggatctaataagctcccaagcaatgctgatgctgcttgtctgagtctttaggctttcagctggagtcattgtgacttaaagtaaatgtgctacaaatgcttacccagtgcccatctgtgccagatgcagggctgggcccagctggtatgaacaacaggccctggacatgtttccagcatgtactatccttgaagaagtcacagtccaacacttttcatacaagaaattcactcactgaagaaagtcagacagagaaggagaaatatcatagacatcccttatgtgagtaatctaaaaagacataatacaaatgaacttatttacaaaacggaaagacacacagacttagagaacaaatgtatattgccagggaaaaggatgggaggaagtgatagggagtttgggattgacatgtacacactgctatatttaaaatggtaacaaacaaggtcctactatatagccaggcaactttgttcactgttatgtggcagcctggatgggaggacagtttgggagagaatggatacatgtatatggatgtatggctgagtccctttgctgtccacctgaaactatcacaacattattaatcagctatactccattataaataaaaagttaaaaaaaaaactcactaactgaaaaaaaaaaaaaaaaaactcagtgagtctctgccatttcctatgagcaggtgcctgtttcccctccccagagttattagaccagaaaatgctcatcctaaatattcactcatccaaattggcagaagtactataagaccagtgtaaaactgagtttgcagaaataagtccagtgtggctgaaagtcaggagtgatggtcagcagttaagctatgggttcaccgatgcaagcagcggccagagcttgagagccacagtaaggattctagtctttatctgaggagcaatgggaagcctttgaaaggttttaagctgaggggtggcataatcagatttgcatttttaaaaagatcactctaactccagtgtggagaacccttagagcggggcaggagagaagcctaatctagtagaccagaggagaggtaactttaccttggacaaggtgacagctgtagagacagagatggtttaaggatacttatctaggacacgaggaggtcttcatgaaagatgactatgaggctgtcaaagatgagtctgagtcttttcatttgcacaactcttataaaactcggggtgtcatttgcaaaggtggagaacactatgcttattatttacatatttttaaggctttccagagtactcccaatttcatacaaatttattattttccagtaaacatagtttatcagtataagacttttcctagaagtaaacccacaaaatttaaaaaacagcttgacaacaacggcatctcttttccaacggtcacaatagctctttccctatgtaaatatagctctttccacataaccatggatcactgtaatgccaagtccacttacacttcactgtgaatataaagcccccaaaactcaaaaactggatccaaataatccttctctttgtgcatcccttccttcttccctttagctctcataaatcaatagttgactactgtatatgaagacacacatttaggaaactgctcataattgtgtgctcttctgacttgcaatgtgctgaatttacttcccagagtaatgtattttttaacatgtaaaactgtgcagttttttctccagctttattaaggtatacttgacaaataaaagctgtacatttttaaagtatacagcatgcatttttaatgtgcattcagagcccactgcctggatgacagcaggtaccttgcaaagatgatgatgaacatgacctctaggagacaagccacagtcctgggttcattatagtgcatccacttttggt

SEQ ID NO: 58853 - DNA, 1779 bp, Bovine  19866880847493
taataggaaaatctgctttatcattttatttttaaaaagccattagcagacacgacagctattagtcactcctcacatatggcatggctgtcacctttatgaatcatgtttttatcttgaaacgattgtcctttattacctttccttttgcacgttccttaggagttgtaaaatcagaaaataggagaagctctgggattctgagtgccaggatcaacatttaaaaataaagcaagcaagaaagtgtgttacagttttaaattatgtacaattttgtgaagctgagtattagcaccttcatttccaagctttagaaagcatgccatctcttctactgtaggactttgcctcaaatgcacatgaaatcttctaagccctaagtattaagtagcagaaatactcagatagctcttatttcagatgaaggacttaaataactgattcaaagtaatgggcatggtattgcatcagtatgtaatacaatatatctgaaaaataaatttgataaataaaggtaaatatacattcacgggaaacatgaagatacacatataaggaagaaggaaagtttgcaattagatacttactttttaaaacagaacaacagaagcaaccaatataaaactaatgaccccagagaatgtgctttaattttctcacttgacctaatcatgcaatttcctgaactgcaactttagccactcttcagcagatcaatccctctacctccagtcctaagattaaaaaaatttcagaagttctaagaactacaagctcttaaaaattaaaaatctagaatgaacaaattctgcttttccagcaggactaggcaatctgtcgctgcaatatgcctcctagccatggagcttaaaggtatcagagtcagaacacagcacaaactgcatagtgctccatgctggtcctgtcctttctacccttctcttcccaaaggttcctacacatgaaagccaagagcaagtgagcaggcctcccctttctcagccctgggctgctcacatcctgcttgaccttagccttcagacctgccaccgtgattaagtgtgggatgggaggaggcagggccattcagctgaaacccagtgctctgagggctgcaattcctgaaaggaaaaccaagatgcagcctggatgcacatgcaaaggctgaggctctgcttacatatcagcagaggcagcctgtcaccctcccaaacgaatgaatgaataaatgatgaccccacagtcaactctgtggagctaagcagatggaaactctggctatctccttgggaaaggagaccataagaactccaggtcctaaaggaaggaacagcataagctttgaatcattagtctgctgccagatcacatgatggagcatgagcctttctcccccatagcacagctcacgtttccccctgagtggaagactaatgccatcacctctccctccctccatcccccaccacatcatccatctaccactcaccaccctttggactgtgatttgggacatctggcacgtacccaaggtcacaccatgagctgcagaacacaaacaatgctccacaaagcaactcgcaacagccattaagcataatttggatgctctcaactcttaaccctccttgtttctctctatataagacactcgatacacagtagcatcagatggtcatgctttttgacattgcctaataactctggctcatgctgaatggacatgactgatgaggattcaagaggctgtagctgtcactttgcagactaggggcaaag

SEQ ID NO: 58854 - DNA, 916 bp, Bovine  19866880955186
caccatgtgccccatacttcagcccccgtactgtccattaaaatgcatttattgagctattttattgttgatgtctctaatcattaaaatggcagaagagactatcctgacattttgaaatctggtagctagaaagcttcctatctagtttgtttaatgaaattgtttctgagctaacaaatttcatactgattttttgttttattttcataaaggcactcctctttatgctgctcactttcgcccaggacaatatgtggatgtcacagccaaaacgtaggtccacataacaggttttttccttttgttttccttgtatattaaaaaacagcagagtgagtgaaagaagtgcagtctttcaaagtcagtgaataaaagataagtaatcattattctcattcattattctaatctttaatgtaactgatggtaccagtttttaaattgcactgaattagttgtgcatgaagagtttacgttttaaattgagatgtgtgcttcttcagatgggactaagagaaaggttacaggtgggcccacatctatttgaagacaaaaggctgcgtatattctatcggtaaaagatacaggaagcagttaaattacagatatcttgtactgtagatcatttttggaactgtgttaaaatcctatcagaaactggaagaagaaaacagaatcataccttaggcctcttcagtagcatgacatcatcttcttggcattggaagggacaaaatattttgtcatatgtaaagaagagttcagatttggtagaaatgaacacttaatttgtcactaacagaagatgctgactttgaatcatactttaagttcagcactgactagataacttgcaggaaactttagaacttgtagcaagtagttttttaaaaatcagttgtgacaacctaga

SEQ ID NO: 58855 - DNA, 1480 bp, Bovine  19866881023089
ccacaccaacaccacacatggccattctgccatgaaaaactgaaatgacaacaagagttctctgtatcacactgttgctttgtcgctcagttgtgtctgactctacgactccatggactgtggcccgccaggctcctctgtccatgagattctccaggtaagaatactggagtgggctgccagctcctcctccaggggatcctcctgactcagggacagaacccaagtttcctacgtctcctgcaggcagactcttcactgctaagcccatcagggaagccctctctctgtatcatgtttgtgttagttattcagtcgtgtctgactctgcgaccccacaaactgtagccctccaagctcctgtgttcatgggattctccaggcaagaatactggagtgggttgccattcccttctccaggggatctttccaacccagggatcaaacctgggtcacttgcattgcatgcggattctttaccatctgagccatcagggaagtccctctgtatcatagctgaatacacacacacacacacacacacacacacacaaacatgagcattgtccaaatcacaaaaacacgagcattgtccaaacccccaaaatgaccagagactcctggcaggcccatatgcattagcatctttacctactagacctttagcctcatttccttccttgtacctgattagctgttttaagacaccaaatctaagacttatctcctgtttccaacagtatggaatcctgggcaaagtcccagccctataacctatacacaaactccagccctataactctttccaatattttaacgaaacacctcacaccttcccagtatgtgtgctccctgctacaaagagcaataaacccaacttgttaaaatacaggtttgttcttggtgggctttggctggagggtaaagacaaaaatacagactcagctaaagggctcatacttggaccaggaccctcaattcagcaatattgtgaacatctgggacaccttgtgattccctctgtaggagatgccagggctgataagttcatgtgcaagtgagttcctatagtttgctgaaacactgcagtgttgagtctgttttatttaccggggaataagagctcttagaatttgactgattagtgttctttagtaaaattgtttttagtcttctatttcctgttttcattattgttagtttgcttaataatcagtgttgtgtgtaagaggcacagtccatagggttagaggcttaataagtctgttttggagctgaacctctgagggctggctgagttcagaagttctcctcagatcatgaccttcggaccaattttgcttcgggtcagcatttctaagtcggatgaagacttcttcattcttgtttttgtgtgtctgagagctgttccatttagttttgtctgcctggacccacaactggtaatgactggccattggtcaggttctggggatcagaa

SEQ ID NO: 58856 - DNA, 871 bp, Bovine  19866881114083
atgggatagttcatgggatcgcaaggagttagatacaagtgagcatgcacacatacacacacctcttctagtttccttgcatctttgcatgtcgtatcccttcctgggtggtccttagaaatccaaaatcccccactccagatttattaggtttattgttcagagcaatcttgctacccatccatcttactgcctctcccttaagttgaagtcctatgatgaagagccttcagattccacctacaaagaaacaatcaagattgattcttaattctccatcttaattctccacctcttttgatgtaaaataaaactctccccagcctgaaaagctggctgctttcatttttctgctgtttaaaatggcaatttttctttttgtttcctgattaatatgacatcttccattctctgcacactgagatttagggaagcatttttttattctgttttccaatggaccagttctatgcatacctaaaaatagctgcttgtttctgatgccacaaatattcatttccaggtagaaatcttttacctttcttgatcagtgttattacatattctattctcttgaaattagaaaaaatgagtcccaataatatcagtatcaaaagaaagcagagcttctgcggaattggaatccagaagttatcatttggaatcgggtgccatccctagattgctgaaggtgtgttgagggtggtggatctgactttgcattgtgatctgaagctagaaccagaaaatgataaaattaaagtgtttcttcctttgtaaattggaggatttccagaccctgccatctcaccctcacaatatgagccctgtaaaacacaaaaagcccagcacagaattttctgaaacattt

SEQ ID NO: 58857 - DNA, 797 bp, Bovine  19866881138941
atattcctgaccgtgtgtcaaatagaacttgcttgggtgataaaagtattctgtatctatgctgtccaatgtggtagtcaccagacacatggtgtctctgagcccctgtgatatggctagtgtgaccgaaaaacccactttttaattttaatgaatttaaatttaaataaccacatgtggccctttgctgctgtgttggatggcacagctcccaaagattctcctgccctttgcacatctgtactggtggttctggtgagcaaagactgcttggagtcctcaggttaggaaaaggaaaaaaacatgaaagtagctggcaacaacagtaataacagctgcatttattcaccacctacaagcaccaggcaccgtgctgagctttatataggcccttcctctaatcttccaaagcgtgtatcctttaccccattttacaaacgaaagtctgcgacacagagaggttaagtaaattgccttgagtcacacagcccacagcttctgcctgtctgaaggtctgagttactttgcagagcagaaaacgagaggcaattcacgggttcctggctgtatgaaatgatatcagcacctcatctggtgctttatttatggtatattgaattcagagtagattaatttggataatgaaatagttctcagaatctaatttgaaattcaggaagataagggtgcgtgttgagctcctggtgctctgctctgtggtccacaggaagctaggaccctggggcagagggacagccagcccacccccttcctggccccattaggcacttccttat

SEQ ID NO: 58858 - DNA, 1565 bp, Bovine  19866881166427
tttgtcttcatgaaaggtccctttaaaaagaataaactttggggacttgcctggtggtccaggggttaactccacacttccagtgcagggggctcaggttccatctctggtcagggagttaagaccccacatgctgtgaaatgtacaaaaagaagggggtggggaagaacaaactttctaaaatatttcttttccatctctggctcagaacatcatatttataactttgtatttcttatgactttgaaaactagatcaatttctccttggaaacatcaggagaaaaatacatttctttcatgttccttctagaagccaccttctcagggttaaggtgtattgactaaaagagcttccttcttcaagagatcctaagtgtctgtagggcacttcattgcgcttagagggatggagggatgaaatcagtctggttgggcgcagcgccccgcgtcccgacccccgcccttccgtgccggtggtcctggagctgaggaggaaggcaggggaaagagttgagttgcgttagcgcaggcggccactagagggcgccggagtacaggcacgcccacctgtagcgcccaggaaagccctctaggctcgggagatggagatgaccccagcagaatcccaaggaggtgtctacagaggagggcttggtgcctgggtgcctgtgactctccggcccaaattacctcgcttcagaggagggacaaggtctgctttcagcagctggggcacttccagcctggcaggctgtctggggtctgactgccctttgtttttcccagaggaaggcctctggacccagaaatacctgccttgacagttttcaagctgcgggcctacacaagggttggcatcgggataacggggctggtgggcgtgagtgtggagcgtgtaaaagtggtggcattttggtgggtgggctgtgctcattcccgtgaccttcctcccccattctttcctcttcctttccgcctgagtctctcatcctctccccacaaccctgccctcagcagaagggtgtcactgttcacgctctatgtcaaaagctgtattaggtgctgggatcaatgtgaagttcccagcttttgaagatgcaggcttgaggggcagacggtgatgtaagttagggtcatgtgatgcaaagtcacatcatgtgatggaaagtcacatcatgcgatggaaagccatcacctgacataaagctgaggcacctgaagtaaagtccagcacctgatgtaaagccagacatgatgtagacagccacctcctgaagacagagatttttatcttggaccagcctattcagggagacttcagaaaccatcacttgccaggaaaaaaaaaaatcttttagcttccaggtacctcgtacctgtccacttgctgtctagtcaagtgataaaatatttttatgagcaatgggaactacagaaagcagtcagtgataaggatccttggtttattatccttggtttatttcctttttcattaggtaatctttaaattcattaagttcatacacttcaccagagttatatcaggatctcctgagttggaat

SEQ ID NO: 58859 - DNA, 2038 bp, Bovine  19866881238674
gtccgtctagtcaggctatggtttttccagtggtcatgtatggatgtgagagttgaactgtgaagaaagctgagcgcggaaaaattaatgcttttgaactgtggtgttggagaagactcttgagagtcctttggattgcaaggagatccaaccagtccatcctaaaggagatcagtcctgggtgttcattggaaggactgatgctaaagctgaaactccaatactttgatactttggccacctcatgcaaagagttgactcattggaaaagactctgatgctgggagggattgggggcaggaggagaaggggacgacagaggataagatggctggatggcatcaccaactcgatgaacatgagtttgagtgaactccgggagttggtgatggacagggaggcctggcatgctgtgattcatgggtcgcaaagagttggacatgactgagcgactgaactgaactgaactgaacatctctttacaatgaggtcacacttctgttttccccatgactattttttcagcatcctatcaggaaatgcatgccattcaacctcagagggtttggggaaccagtctattatgttttccattctttcagtaactgcaggaggcaggaggtagtgggtgggttgccagattccaccactgggtgaaaaggtttggggaaggagtgaaccgtgctaaaacatcccactgaaccatggctgacatcttggttgtgttcatttggacagaacacaagcttacatgttgagcccaatggtcagtgccaagagtaagccatctagatgactcatcaggcaatgaaaaagtgaattccaaaagactagagaaccagtctgtcaatgttgagaaatagaattaatgagtggactaagggtcttctcctacatggaatctgtaagcccatgggatttgtacactcctaataatgtatttggtggtgggctgggtcttttttaagtgtctgggtgggccaagattgtaaattcacctgcccttgaaaaatttgctctcagtggcttcatattcaaaatcctcctagtttccagtagacatgacctgcaaaaagagaatacccagatgacaaaaaatagatctattaaaacctgtgggaaaatcatgtggatgtaaacaagttgtgcagcatctgtgccccatcttacagaagtgtacttgtgaaactcagccctatttagctccctagacgggctcaatcatgtgaggaaggcaaagaaaatggtttgagcccaaaagagtcaactgaaccaatgtgttcctgagacaaaaggtagtgcaacccaaaggattagagggggctttcgcaaggggatgagataaggcctctccctagatagaggctgggcttttgctataacctacctatgtcctgcctaaacttaggccattgttcatttgccactgaatatttatgggagttaattatagattatggtcatttttttaaagtctaaggttctctaaaggcacacccatagagcaccccacccccatatacacactggcatgtttagaaggtagtaaccatgtgcattgtgggcaaacaccccgacctctgtctgtcctgggcacttggaggtggaggagccagcaatgtcacagaggagacagtgtcccatgatcttaggcaaaaggctggtttcaggaaactattcatagattttcaagtgaaagctctatcgatttgggtctgttttaggttctatagatcccatgcttttggacaactctttagtcaaccttcaggggcttgctttgcccttggagttgggctgcaaagagtcagccccagtgaaaactgaaaatttgagcccagaaggttccagctctacaccctggctcacagaggagaggggaggtcgtgtggtccccctgacccaaggagattattcttctggtgttgctctcccctccttctcacttttttaaaaagtgcttgagtaataagaaattacttgagtaataagaaacccattttttaaaactagttacttgccaattagctttttattt

SEQ ID NO: 58860 - DNA, 808 bp, Bovine  19866881504947
atttgtctgactcttttgaaaagctgaaaactgaaattgggctgaggagggagagtggtcatctttagatacctgagtgtgtacatctgggagtttgctagctgttctcctgttggttgtttcctgtattaaaacaagaaaagttcaatcatttaccttttcccagcttgtttttcaaccaaaaaagataagaggttttgtttgtttctgtttttgtttatccaagagaaaactatatgttttcagagcgaagagttctaatccataccatctttataggaacgcaacagggatcaattcactttagaaaataataaaactaaactgacctgaaaatttctaatctttgggtttctgagagtcactctgcaaataaaagaagagtcagcagggacaatccagatctataaacaccaaatatttgctcttatcatttcaagccagagggagtgattcacatgatatacatttgtactgacttctttgtccacactatttctgaggaagaaacttaccttcctaaatgccaactactacctctaccgtataatatcagcccacctcacacccaacccacgtgctgaaaggaacagttacatcttctttttaaaaaatcaacttcactaaagtatctggatgagttttgacaaatgtgtacacctgtgtgctgctgctgctgctgctaagtctcttcagttgtgtcccgactctgtgtgaccccatagatggcagcccaccaggctcccctgtccctgggattctccaggcaagaacactggagtgggttgccatttccttctccaatgca

SEQ ID NO: 58861 - DNA, 1117 bp, Bovine  19866881637923
taaagagtgggaagtcatttctttataaaagaatcctgtttccatgacttactttgaggtgaggtccttgacatcacattcatgttggaaggttcttttgagcagcagcattcaggtttagtcttcagtagaaacaaaggagaaaaaagaaagctgtgaacagtagtttaatacagtatgtcaaggacatgtcagttatggtagccaccagccacaggtagctatttaattttaaaatgaaataaaattaaatattcatttcctcagatgcactaaccccagttcaggtactcatggctgctgtattgtacagtgtagataaagaaaatatccatcatcacatatttctgtggggcagtgcagaactagaggttgtgttttataccctacgaggtagtattttttatactttgtaatctactaacccccttcttctttcccaaaacacacgatactgccctgtgctaactaagcaaaagcctattaatgctaggatgtcattcaaagaagaagcaagtcttaaacgaggtgcaggagcagaacaagacacatcagtagatctattatgatgctttttcaaggaaatttgattctggcttcttatactatctatagtgtcttctggtgaacataaaaataatgttgttcctctttgcttttaaacttagtgacatatatgagactagaaacacacaatccattttgtgagtctccagcttcctgttaatatgacattagtagaagaatccaccctgtgattatattagaaaggaaaataactgaacaaaagaagagtgggatttgatttttctattggctaaatttagttgcctgagaaacaggaggaaattatttcagtaccaaaataataaaacatcatctaaatttgctttttctcttttttttcaggaagctataattgccttggtgtggtgggaaaaggaagggctgttaaaaggaagagacaaccattcatacaatttcctttaacattttgttcatgtttcccttttaaaactttctgtcagcctttataatcatccagttaaatttgtctatctagttctcctaaaactgggtgacatttgagtgctataaaattaatatgaatgtgatg

SEQ ID NO: 58862 - DNA, 1352 bp, Bovine  19866881970093
taggtgagaaataactcagagtgtttttaactgtatctctcttataagaagtagaatacattatcaagctttagaattaaccttgcatcctctgatgctccaaagagtaacattcccctaggttcttcaggctatacctttgggagaggtgttcactagggctgaattagtagtagaaaactccttctctccttcctatgcccctattgtctatttctcatttctttctctactactttcccctttatcattatattgtccttgacaacttttaccaatggtctcttttaaggcagaaacaaatctgttaaggaaccagtgaagccagatggaagggcactctgatccctgatcactttagtggacttcagagtttagcatgggaggcagagatgggaaagaaagtaggcagacagtactgagaacattggctgtaagtacacaggacataaccagataattcaagtctggctttggaaagtaaaaaaggccagaacccatagaagtgtgacttttactagcacccaactgaaataagattcaaattatgtgacctgatcctaaagacagaccaaagcaccatatgcacaaaagctgaatcttcaccactaaaaagaggatcgctaacttatacttacaccagttgaaatagctccaggcctcctgtgggtttttgtttgaccatgagtagccggctggcctttaaatccccatcttttcatgacaccttgaaaacctttaccaatactgagcaagataaatcggttacaatttacataatgaagagaggtaaaatatccccaactgcatactttgatagtattttagagtttcagcgaagttccttatctaaataactagaaaaggccatataagtaaaactgcaaatgaacatgcctttatctttctcctgattgcaccccttcctggagtctcattctatataaagatcgtaagacaacagcaagttaagcagaagttctatcatcctaatcctatgtaacgacacagtaaaagtgggacattttagaagttcaaggtacttgcaagagatgccgcaggcaatcattaagctccccacctcctataaagcaactgtactccaataaaagttaaaaaagcaaaacaaacaaaaatcccctaccccccagcatgcatgcccctgtatgatgaatcaccatcccttgagtctgtgtagaccagcaactcacctctaagcaataaactatggcagaagtgataaacatcacctctgactctacattacaaagagactggcttcatctctgtgctctcagctctgaaagaagccaggtgccataacataagctatcctattggagagtcatgca

SEQ ID NO: 58863 - DNA, 757 bp, Bovine  19866882163291
tggcaatgaagtcccttgaacattcttcactcacctggctggtggctcatgccagctgtataatctacaagtgggctttttacatggtttggggttcttctcagcagggtgactgggcaccaagaataagtgttctgagagacagctaggcagaagttgcaacttctttaatgcctcaggagtcacagagtatcacttctactgtgaagttgacactatgatctgttgaacggtactcagtcaaaaagacatgcctaggtgcaagaaaaagggacaaagattctacctctaatattcatggatctggaaaggtcacatttaaagaaaaacatgtagggtgggagatgttattacagccttcaatggaaaataaaactttccagatgtgaagataaataataggaaatcaggaaatttctgagtcatttttccttgccctaagtcagacattttattaacaggcagttagaatcctactaatgatttacacattaaatactgtatggccagattcagccaggtcttgactagaacttgaaacttgcctgatctgagtctgcctaaaagtaccttgaaagttaatgagatcctttctgttggctgggtaccatctttccacacacaactaaatgatatttaatttaaaaatatgaactttgctgtaaagtactaacttcagagcacagtaattttactgttgtcagcctctgcctggattaaaaaaaaaaaaaaaaaacatagccaactggtcaactaa

SEQ ID NO: 58864 - DNA, 1354 bp, Bovine  19866880340823
catctgtcatagaaaagatcactgaaacctgttaccatcactatgtacggtaaactcaactgcccaaactgtaactctgcaattaaacgccgccacccctgtttctcacccttgctaaaatgaaaagtgttcacttctacgaggctttacaacatctgaatatgttgaaacagatgataaaggctgaggggtactgaaaatgtttatgtatgcatgtatgtatgcatagaggtttaaaatactctatgtaaaagatgggcttcaggaattactatataaactcagcttttgtttgtaaaatattctctccttgactcacgttatagagatatttgctctaaattttgcattggttttcatccagtagcagctccaaatattttggcattgtttttttgttctcaaaccccactaccaagaagatattgtttgtaaatgcctaatatggatgaagctcacaattgaatgctacttttaggtaaatgctatcatttgtaatgggatgggaatactttggggtgtttctgtttttcttaagaaacagaggcatgcctgtccacacttcactcatgttgagccctcctaataaagtgttcagtgagaaaatcctatcaaccaaatacattatcaactaaaaaaacaccatatgaaatcctcacatgatgcttattgctccggaagtccaccagcctgggaagtcacactgtttttaagtgagctcctgagcgttactccttgcttgataatgtgcagtccctcatgaaaccccaaaagcagttattgaccctgtcaggatgcctgattaatggacaaacgtagtaattgattagcaaagaagtgtgaattaaaagggggcacagcatcaataaccagcttctaacaaaagtggttgacgtaaaatgtaaaacaagagcccgcggctatatcttatcaaaggcacgcttttcttacaaaggggagagaccgggaaataaacaggcctagtgtcctgagccctgtgagtctttaacccttcctcttggtaagggtactgtgtggagtcaacaagcaggttgggaagtgcctatccatccacttgcagtccaccttcagatacctagcagatgagccacttaactgttcccattgtcccaagacttaagaaaaagcacgtaagaagtcctattctctcttcattttgtttactgcgacctctcttcacttatgtcctcatagaaaaataaattctgcttgctcaggtgtccctggagagacaggcaacattattcactagaatgttgcttccatctgcttctgagcagaaaaataaatttattcaatcagtcagtcagtcatccagcaccggtacaggcca

SEQ ID NO: 58865 - DNA, 1092 bp, Bovine  19866880426803
tttttgcgactctgtggactgtagcctgccaggctcctccgttcttggaattttccaggcaaggatactggagtgggttgccatttccttctccaggggatcttcccgacccatggatcaaacccaggtctcctgcactgcaggcaaactctttaccgtatgagccaccagggaagttctcttccctgggagtcctcctcaatctccttaattattgccatgagagctgacacctagagcatcagcatttggagtcagtgtcagctgatgtagagcaaaggctggattcagtgagctttttttagaatataaattatttattattttctttatttggctgtgccaggccttagctgtggcattcaggatcttcagtcttcattgcagcatgtcggatctttagttgtagcacgcaggttctttgagttgcggcgtgtgggatctagcttcccaaccgaggattgaacccaagcccctgcgttaagagcacagaatctcaaccactggaccactgtagaagtctcctgcattcagtgagcttttaaatttcattataattctgttttttgtgtattctctttatatatgaaaaacaatctttgattctcattgcctatctgtcagtagaggaaaatagcattgagatttgacaggggatttgaactgacacaatgaaggagtacgtcagtgtgtctgaaaccaggcatttgttgcaagggcgggggcggggagcgggggtggttctccatttcctctatgtccagaagcctttcctggcagaatgtctagcccacgagactcttcgtcttcatcttgcatgaaagctgcgatttggttctgacgcacgggttacaggagcctctgagcgtccgcacaatctgttatgctaaatcacacctggtgtctgcacagagaaggctctggcaagcgtccccaccactgggacccaggcctctgactctgacgccaagacatggcagtgttgcagggggccttccgagagcctggctcaccggcacggcagattaacctgcttgttctcacgttaaatgctttataaaattcaccgggtcagaaagagggaagaaaacc

SEQ ID NO: 58866 - DNA, 858 bp, Bovine  19866880426897
agaactcttgcaccgtcaagctgagaccccagcctgggccgagtgttgactgtgaccactccagagtggctctgagctgtctgaccctcaacgaatccaaggggcaacgtggtgcatctaggagcaaaccccagagatggagtccaaagtgaccagccactcttgagatggttctagaaagaacatgttctgcaccagaacttttgcaaatctcacagggtttttcttccttctttcttcagttattattttgaatcagttagtctactgaaatgcttcagtgattcagggcatgagatgctggcaggctcctccctccaaaatctttaaccttggatatgtttgcagagtggcttggaattgctttctattcctgctgagacaggaaacggaaaaatgaatggattttcattatgcagactcttttttttttttttttgcatttgaatcagatgtagcaggtgtcaaaatacagtacagaattcacaccattaatgtgaaaatttccactgtcccccaaagccaccagaccccaaagtcacctagattaacaaaatttaaaatgagccgctgactttaaggatgttcttggtgatcttcagggctattctgcggtggttttcctgtttgtcacacgatgctgcctatacttggaaggtcttgttggaaggccatgcgtctcacccttgagagtggcagagcgcgtgggagcggcatctcaatgtcctgggccccaactgagggtctgcatgcagaagacgtgtcagaattctgcttggagggtttccaacctaagctaaacgaccttcatgtagaccccaaaacaagcagagaagcaagttgcgttgggaggtttta

SEQ ID NO: 58867 - DNA, 2012 bp, Bovine  19866880502760
ttggcatctttgaatgcacactgcctcactaaggtcctttcacctggccaaggaagaatgtcactgtggtagttctcccacagctgtaactgctgtaatttttacccgaagcacttactgttgtccaaccctccagcctatggcctcgtgtgtcctaacaccctgcagctgggtagcaggaccagctcacggccaagtatagctgagctcttttggggcatgcccgctgagtgagtgccccaggccctggagttggggatatgccgagggatgtgggcacctcacagtcatggggaccagacgtcagtactctgtgaccacctgattcaagtatccagtgtgtgtctgcatgacttggggatgctgagaaagccaaagggattatcgacatacaaagcttgacacctttgtgcagaagccagctggcatctcacggggacaacctgagctgttccagcatcaggaaagctgggtttggctggatctggctggctcctgctattccaggagcgcggcaggcttggccccaacggagggagggggaagaataccctggggctgatactgggacccatttcttttgtttccgatgaggcagagaggaatagaactgcaaatatgatgacattttaataatcagggcttttctccataaagactttgtacatagcatttatcctccaaaaagtctctcctctttttgtgattttataaacttaaaggaaaaggagaaaaggtctgtggtcctagcacttgccttcatctaaatgaataactctcgaccactgatgattagcaacataaatcctgtttgagttctggactagtactctcagccagaagttttcatatgctttttagaattctgaactggccacagcagcttttaggaaagtaaaggatacaaataaagtttataataatttgactgttcacttctgcatttcaaaatatgtcaattgtagaaatttttttctctgaatctttggaattccctgaatactttgaagccagttgtgaaatgctgctttagaaagagttcatataaatgttcttctttatttaatcataagggagatttagagaaaggatgttttatttttctgtagttttgtttgataagaatatggaattactgttattatgattactaatgataccttacatttgcacagcactttagaatttttacaaatatgattgcacataattcttgaaagagtttgataggaagatattattatcctggttttatagacgaggaatcaataaatgcacatacatgtaacataccgtgtagttccagcattatatttccagaggattctgtgctttaggaaatacatttggtatgtaaaatggctaaaaactacaaatctaggactgaagaatttattttggtttcacatagtagctacaaaagatgacaaaaacaggactaaaatcatgtgataatgtgcagtgcccctttgaatgcacagctatctgaatttttgttgggtgattgctttgttttcatgtgttttgcatctatatcatagcatgctatgttatagcacaatactaaaatataaaaaatagtaaaagtatccctcatatttttaaagataaaaattataatcacaatatcatagcagaatagtgttttcccattaaaggatagtctgatttgtagttgattgtaatttctttcttataaggtctcaaaacagacaaaatatatatactcttaatattttcccctgcttgttaaagactaggtattcagagtatttgttttgagacgtttattgctactgttcagaaacagaactatgttattggtcaggaaaatctgattagtgtttctaagaactattatagcacagcaagacaggcaagcaatccgaagtgcaaggttaaaagcaatttattaaaactaggcaaaagacgttacttgttaaaaaaagaaatacatatttcttaggaaaaattaaaattgtcctaagtgatattcttgactactttttcgt

SEQ ID NO: 58868 - DNA, 839 bp, Bovine  19866880538810
cagagatctgtagcatcacagtgacccctaaataaaatctagccccacccaaccccccaacccgggtcctgctttaacaatgaaaacaatcatagtctaattaagcccatttcaaagttttcttaagtaatttgacatgccagggttttattggctgaaaagtctgtcatgaaacaaacacacctgtcagcaatttaaaaaggatgaactagggaactgttcaggaaataatatctgtgctaattaaaaccactagttaaaagcttcctgtctcttcctccagttgccctaaggagtgaccttttcctctcctcctttaggttcatttttttcctttgcagtttatgtgctttcgccatccgcgatgacttcaaatcaacctgcctaagagccatgcacatctctactcttccaggtggaggggtagggcctagctgtctctagtcctgggtaacctggtttccagggttgctctagaggaagctgttctgtctaaaccacatatctgtgccggcagcagaagcatcatttcaagtgtagatcgttttctgttgaacacttagggcaaagccaggttctccttggatgcaggatatggtcttttttggttcctttttctcggttccattttcctctgctctgtgtgtgcattttcaaaacctgaagcatccaaacccttcctttcttgctactccttcttagccgctccccagtctttaattaaagcaaagtgtatgagctactcacccactggatttcttcaggaccttcgaccttcgggagcatgaggctggaaggaaggacccgagactgcaggatggcctccaggtcttcttcgg

SEQ ID NO: 58869 - DNA, 1784 bp, Bovine  19866880543113
ccagcgtgtgtgtgtttttaaacagcactccgcagctgagcccttggaggaccggcctattttgacagctccccttagtccatgtatcaccaagcttgttctctgccaatacgtttcacatgattctggggacatgtgtagcacgcctgtgcaacttgcaaacactcatacattattacagtaataattgggttttgatgcaactggaactcagtactaccaagctgccagcatttccttttggctaccagtgctaggcaagaaaattatagtctaactgtcttcctgtttattgataaacaaagtggccagcccagcaatggagcctgattagcagtttgcaccctttgtgaaaggataaacagaaccctactgttttctgtgtttgactgcaatttgcatctttaaagaggttgggttgccctgagatgcatgttcaacttcccggtgcctggatagtctttgatatgttacatgtcagcctccttgttttcctctccttcatcttgaaacaatatttgccagcgcatctctggtcccatctggcctaccataagcttcccgatagtcacctgtctgaaggaggagggggtgggcaggggcaggagaagaaatatgtctccgtttcaccacccttgaattttacattcccagaaggccctttaatgccgactctactgcacttgtgaagagaggatgataggagagtgaacagccaaagacaaaagggaatctgctcactactctctctggcccacaggatcgtttctgggtcccctctctttgtcttatcttcacttaccctccagaaaatgccctccacctttgtaaactgaaacccagtattagccttctaccttgagtttggtacagtgttctgaaatttattctaacctaattagggtcttaaactaaatgataagagaccaagtagttgactctcttgctataattattttcaaatgaaagaaatgaagatcattttaacttgaatttgcatgatggaaaagggagcattaatacatgtaaacatggattaatctgtttaaataaactttccccataatcctcaccatatgtaaacaacatttgttctgccttagagagattgtatgattggacccacgagactcccgttatcccactgtatagtttccttttataacttcaaaaccaatgttacatatttattggaggttgtagggtgttaagtggagttagatacaaattgtacctcagctctttcgttcatgccagtagggattaaattagattttatagctgttgtagaactctatttggtagctaacaagtgggatttttaaatcctggaaaacataatcctattataaaacaggcagctgaattaacattacccaggaaggttctcttcatggattagcattttttgacaataacaaagaaaatcatcacattctatggggatattacatgcctttctcgaaagtcagaacagcgaattggggaaagggaacaagataaatgaccaaacatgctatgacttagactgtttcttttttaagaagagtagtggaggctgggaggtaacgctgagcatggccttgtctgtaattctggcacgtgccctcgaattggaaatgtggccttgctgatttctgtgtcggtgccccagctttggtcgtagacggtatctgcatcagtaattccctgcccctggtttccttgtaggatcactaaagggcacaaagagtccatgaattacaacacaaattgggtgggggaagacatattttgctactttg

SEQ ID NO: 58870 - DNA, 2727 bp, Bovine  19866880546179
taggctcttattatctattttatatatagtagtgtgtacatgtcaatcccaatcttccactttattcctccctcatttcccccttggtaaccataagtttttaaccaagaatcttacctgatagaaagtcaaaacccagaatttcatttcattcaaaaagtattttttcaggtcttgccatgtactcagcaccaagaccactgccttttgaaagcaggtaaaggactctctctccctccggaggtttaatttgatatgggggacaggagagggtgcacagaacacagtcacaagcgagcaaagccacaggggtgcaggggaagggcatgagccagccagggtgggcatgggggatcagtaagacttcgcaggggcaaggtgatatttgctctgcaggatttcaccaggtggaaaatggggagaagggccctgcaggcagaagaaacagtctgagcacggcagaaatggggctgcctcattgcagtaagaattttaacgtgactagaggatctggtacaggggtgggaaggaggtaattctggaaaggagatttggagtcagggtgtaaaggacagtgtggccacgtaaggtcttcaggcttcagtgttgggagctactggaacttgtggagagtagagcaatgagctctgaactcagaaagctccttttggaagatggacaggagggaggaggggccagccagaggcaacagcaaggggccacgacagcggcgaggaagagacggcagaagccatggccgagatacggaaaatcagaggggctggctggagtcaagggtaattccaaaggcatcagccacaaagcaaggaaacgtggcttcagagccaaggccttgaggggtggaatggccaggacagcgcctccccacttaccttactcctcagaagggcacctttacctgtggccaaaccaagattcaagctcacccctaagtaggaacttaggggtacaggttctgactcccaggcagacagaaatggtaaaagtgcaccaacactctgttctctgttacttcccctcttcaaacatttttcatgaagatttgagaacatttaacacataaatccttcatcacggtttcaaaattctcccccaccccttatctcctttaataacacataagatttgccaaagaaaggatgacatcgtaaaggtacatctcattgaaatctacttaattgttacatttgtttagcttttttgacacaatttttaagagtgtttatattcttcacagaactgcatttggactatcatgaaaaatgggtgccaattagaagtattttggctaaaaccagttcctgcacatcattgtcttatgctagaagtgagctggcatgaacaacaaagggttgctattaatagtacaacacagaacgcaagcggaaacttgagtgaaattatgttttttaaaacccactgtttagtgcccagaaaagggacagactgtgcagcatctgtgctggggggatatggaactaataaatcattgccatttttactacacacaggcagaatatgatagtctgttcaaagccaaacatgtgctgtccgagaaaaatgatttacgttccaggcctttttttttccacttgatttgaaagtttacgcatttaggcatctgaaatgattttattaatttaactctcctgtaatcattaacaggttttttctttaatttgagaagggttacatttatgaatgaatattactataaacatatatacatccttatgttcaaacataaaacattcattgcaaagtctgatgtaaagccacatcatacttatgactgagctggaaaaaaattggactttgatgcatgactagtttttaggaaaaaaatgactagtttttagaaaactccttgtgaagcaagatggctaactttctactatcaatccaagaaagccgtaagaaaagcctatctttttgcggaattaattttgtcagaatatcaaagcaagtttataaaagccttgaaacactgacgacagtacaatatccttcctcaataagtaactacccaaggctaatttcttaagccttaggcacacttggccatcctatctgctctggaatacattaatgtaataaaaaggcgcttctaaacagtcacacaggcacgccccactaatcagattatcacctgtaatgcactgacagtgagaggagtcacagagaactacactgacagaacgctgtcccagggctcacagagcagtgggcccctcattttggcgttccacaatcatctcaccgacacactctggtcaaattcaggaagcagagcctagaggggctaacatgtatttggagtcttctgaacagtcaacggcattcaggtttttgtcctaggacttgaaaagttaaaggcacggtcctgccaattgtgagatgccctctccaacatggaccacccacaactgcggattttccatctggtgaacaaaacagacagcttccctaattatttttaaaaaggattttttccccctaacatactttctttatttgtctgtgacctggaacttaatggaaaacctggtgcatgccaacttcatttcttataatgaaacatcccatttttattgttttaactagggtttttcaaaggatgtaagatagaaattattacccccagagctaacacaccaagtcaccaagacaattcccagaacaactattttctcgaacagagaatat

SEQ ID NO: 58871 - DNA, 1284 bp, Bovine  19866880554720
ctgatgttctatgaaagagtcttttaaggagtaagatttttttttcccctgcatcattgacacagaagagattttaagcattgccattaaaaagaaaagaacccaaccctcatgtgattacattttccgattttagatttcagcagcaaagagaaagcgtattctcctcgcttctcttctccacaggaaaggcaggaacgtggtgtaaaagtaccgcaaggaaggtgctaaatggtcacttgtaaacaccccttgttgggcacaggacgacagcctaggagtgacagtcctgccgtccgtcgtattggggtcgtaaactctggagttgtgactccttcttgttcaatgcgctgacagcccctgtctacaaggaatcacaacagacaacttttccacagcagctgagggtgcagaaggctttatgttccttttcacactgtgatgcttaaagacatggctggtcctggcttttggcgttttatggatggcctttcgaccaaggtttccacgaacccagctgtgtatttgccacagtaatacactttatgcctcaagaatcaacactgtaatactcctcttttcagtgtgaaggtatttctgggatcctgtcaatatattctcttgtctctgagcacagcacgaaggaacttgaaaacaagtgatttactgttcgttacggggaagttggatcttttttcccaccctgattgtcaagattcctttgttgatgtcagtttcagagcgcgtattttcccttctgagtgcacaggacgttgacactgcttccgtgatgctgcggaggatgatgtaagacagccataggcccgtgtctgttgtcacttcagctcagcgtggagcaagcgtagaggtgtttcagtgacagccgcgggtgcccttggtggggggaggtggggctcggaaaccaaatttccaaatgatctctgtgaccataagtagctagaggtcgtgtgaatactcatggcagcaatactgatagcagccttttatggagcatttagtgcacatggggaatcctcaccagttcacatagagtgtctcatttaattccaacaacataacagcagctgtgtaagattatccccattgtatcaaaggagtgaagcaggactcagtcatacctctggtaaatagcagccaacacttgaaaccaggcctgctagattttaaagccactttcacattcattcagcaactacctattggttctctcttatgtgttaggcagtgttttcatcacatctgtcttttaaatttgctttttta

SEQ ID NO: 58872 - DNA, 2632 bp, Bovine  19866880566705
cccaggctcctctgtccatgggttctccaggcaagaatactgggagtgggtagccattcccttttccaggggatcttccatagccaggaatcaaacctgggtctcctgcattgcaggtaggttctttactgtctgagccaccagggaagttttattgagatatcattcaaataccataaaattcaccctcttaacatgtatgattcaaagtttttcagtctattcacaaagttgtacaatgatcagtggtgcttaatcccagaatgttttcctggcggagaagaaactccacacccatcagctgtcacattcccctcttcccttccctgagaatccctgggtccactttcccaatctttagatttgcctattctggacacttcatataattgtaattatatggttgtgcctttttgtgtccggctgctttctctcttggagaaggaaatggcaacccactccagtgttcttgcctggagaatcccagggacgggatgtcgtctctggggtcgcacagactcggacacgactgaagcgacttagcagcagcagcagcagcagctttctctctatcgtaatgttttcaaggttcatctctgttgtggggcttccctagtggctcagacagtaaagaatctgcctgcaatgtaggagaccttccctgagttaggaagatcccctggagaaggaagtagcaatccactccagtattcttgcctggagaattccatggacagaggagcctggcgggctacagtccaaggggtcacaactctgacacgactgagcgactaacactactacattccctgttgtagcagagattgatatttcattactttttatgatgtctcattgcaagaatatactgcagtttatccattcatgcatcataaacatgtgggtcatttccacttcttggctattacgcataatgccactgtgaacattctcatacattgtggacatatgttttcatatctcttgggcagaactaggagtaaaaatgctgggtcatatgataactctgtttaacatgttgaagagctagaatgcatggcattttgtgcctatgttatgaaacttgttaggaagcagcttaacagtcagatatcatcaggcctgcatcttccactggcttttaagtttcttgagacaagggttgttgctgttcatccttgaaccccactcctcccagtccagtacccaccacgggacccagtaggttctcagaaagtttttgagattgaagctgaccagtgaaatccccagcacccctgagacgcacacacttactctgtctcttccctgtaacaagtgacagcttgtcaggaatggaagcagctccctaccgtccgtcaagctttccagctggttactgaccctccttatatctgctgggggcctcaccagggtcttgcgcttcctccaggctgcctcagccgcacagcagcagtggggacccactctggcttacgcagatgctttgaaagaaagattattttaagcaccactgaggtgcaagcagaggccgggctggtagaaccttgccattcaggggcccacgcctgtctgacacgacccattcatctactttatgaggatttggacaaggaggccctccagtgcctgcccaggctttgacttggcagcttgtgcccggagtttaagaaagcttattttaagactttctcagaaggtcagagcagcgtctttataattcatcctgctaccttttgtccagagccagctcttcctaataacatctatttcaggttggatttaagagacagagccaacctctgctgaacgggctacctttgatgttccagtgcctaccgaggaggggagggacggatggaaccaaagttgtaattgcccaaatttacaatagcttctcagcagaagccagcacaaaagaaatgttaatgcaataaactgtaaatggaaggaagctgagcgggatttatggtgggcgcaacctgcaccaggcctctgggacctccttctttcccctgggagacatttcaacagtcagaggagaactgggcccttggaaagccagtggctgctctgcaccctccctcccttatcactctccctgcccagacagattcctgcaaagacccggggaacctgattaaacagttgaggaagggggaaagtaatcagtcactgagggctcaaacctgaaatcctggccgtgccaagagcccacatcattggcaagcatgtgtgttccagctgcaactgaagcgtgtttctcttcttctcctctgagttggggatctctgcacatacaacagatggccggagtgttcgtgtgtctcagccaggaagtgagagggcggcgtgtcgttcaccagctgggcacgtccccatccttcagggccactgctgtaaagggctgtttttcaccttcgggttcctgcggctctcgctccactcaggctcacacgtacctttacctgggttgtaacgtgtggagtgtgcactgcttccttgtccagattgctggcccgtttgggttttttaattagctgaggagtaccaactaaatggaaaattgctttctgagatcccagtggctccggttccatgctgggaggggctccctgtaattaaacacatt

SEQ ID NO: 58873 - DNA, 1311 bp, Bovine  19866880577562
tacaccaaccaacaagcatgtggattttttttttctttttggtattttaatggtgaaatatgttactttgctagcaaacacacccatgccatctgttgggtgagaggaaggcagtttctaagaacaattaggtttagttctgggtgttcagctagagagagccacagtccaccagttgtgaaaagaaagaaattctgtccgcgctattctctctccctttctaacacggaccttacctcttgctaccggctctcttacatctctttcatctccatcacctcactccctttacgctttcatcctctttccctctctttttcctgtttgttcctgaccatccttccaagttccatctcattagggggattagtaagacttggcctggcagacaccaccttctcagaagggctatatggatgatctgctgagattactgggaggtaagtggtccctggagaaaggaggaaaaggaaatgaaggcaaaaaaaggccactaagaaatgaaatttttggcaggctgagggcctgggggcaagggtggagggggtcttacattctgttaacaaaacagtcttccaaaataaggtttagtaggagctgcattctaaatgtgtgaacactacaggacggccttggtcagcatttctcaatgtaggataaactcgtccttctaagacctgacaacctgaaaagagggaataatgaatttaaggccttgctcaacaattacattagatttttgcagagacttaattagcatcgtgtgtttggagtaggtctgattccagaggtagggtctgcaaaggtcacagagcaagttggcacaggtcagaatgttcacaggccccgggtctaaaaggtgatgttaccaaagttcccacatttcaatcgatatttcgtgccatgggctgctcagtgcagtggaccaggggctaataaacttgtccttatacataagccgacggatcatgtgactctgtctgggccgggaaccaaggcgtgctatgatttcagagaccgggttcttatcacctggggaagagagacacgctctgctgacgtaagaaagcgaataaatcaaccatccccgagacctgcagactccaaaatgaaaggagaaaatatgcgtgcagttggttcacttggcacccattagagctaataactaatcatcctcgcaagtttcgagctcagaatgatcaaatctgcaaagaaaacaacatccgtccacttttacactccagtggaagaaggtggtccctcgcggcagggcggcacagtctcgccatctggagaataaatcgagtgtga

SEQ ID NO: 58874 - DNA, 772 bp, Bovine  19866880651052
ccctgcaacaaacaagtccagcttggttgggtttgttgttgttgtttgtttgtttgttttctaagggggggggaaagcccaaatatcttaattaaattaattaaatgtaccaacaccatagggtttcatactaaataaatagggctaattagacctggtggcaagtctgagtcgagggtttgtctcaagctcagcattgtctcaggttaggatgcggtccaagggctcccacttattactttactgatagtgatggtgactgatcgaatctaatgtatcgtccgcacgacttcagggttcgcgtacatgtcctcgtcgtcagactcggaagtggttccgttgctcgaaggggcgtgcaggtggctgggggccccgccggcctggcatacgtaccactcattgaggttggtcacctgaggggacagagtgctcgagcgactcctggtggggtctagcacaggggacaaggggtcgcccaccggagtccccactgatgagtagcccagggctcctggagaaggtggcggggacttgcagtgaatcttcatgtgtttcctcagggagctcgggtgggtgtaggacttgtcacagccccggaccttgcagtagtagggcttatcgctggtgtggacgtgggaatgtttcttccgatcgctgctgttggcaaacttcctgtcacagccatcaaattcacatttgaaaggcttttcccctgcaagaaagcacagtggaggttaacaggggctcttcagagtcctctgaacttgagaga

SEQ ID NO: 58875 - DNA, 2933 bp, Bovine  19866880665821
ctggaagggacagaggagcctggtaggctacagtccatggggtggcaaagagttggacacaactgagcaacttcactttcaccaggtcttggttgaggcaggcgagatctttagttgcagcacgagaactcttagttgaggcatgtggtatccagttccccaaccaaatattgaacccaggccccctgcattgggagtgtggagtcatagccactggaccaagtccctctcccaatttttcatttcagtgtttgaaagaaaccttgcctttgggataaaggaacatctaggagtcttaattcctatgctctgaattcagtctctgtttcggactctaagacctaggtaaattccttactttttcaatgggtttgccagcccttgaaccaggacttgcagtaacccataatatctaaatgctgaggaggtggaaagggtaatttaagagctagtgtcagaattcttcaaggagaaaatggtcttttaaaatttttttattttgatcattgccttagataaagttggtatagaaaggctaagggtagaaagaactatttgtgtttgtttaaaaacaagcaaaaaaaaaaaaacaactggttaggccatttgctagtggaaagaaccctcagggcaaggcggggatgaactaggaatgagagaggaaaacccaatttctctgcaaaataaaatgagaatggagaggaagcaaggagggagtaggaaaggtggggtgattttggtccataacaatggcctatggagttttctgtgataggaaattttgtgctgtgatgtgattcccaggggctggcggaccagggggcggcaaagtggccatcatctagtttcaggttaagaaatactgaacgctgactgtaggccaggcactaggttatgctgtcaacgtgcatgctttttttttttttttttctggccataccactctgcatgtgagatcttagttcccctaccaggggtcaaacctgcatcccctgcactggcagcatgaagtcttaaccaccggactgccagggaagtcctgacatgcatgttctgatttaatcttcaacctactccgtgataagcccagggcttccctggtggctcagcagtaaagaacccccctgccaaagcaggagacgcaggttcgattcctgggttgggaagatctcctgaatggaggaactggcaactcactccagtattcttgtctgggaaattccatggacagaggaccctggcgggctacagtccttggtgctgcaaagagtcagacacgactgagtgactgaagagcaacaacaaatccccattctacagaggaggacttggagggttgccgagaggcagatactcagtaagtcagagtccaatctgagtttgactgattctaaaatccatcctgtttattagtcactggagcatactctcctcgtgaacactgaagactacagcactaagctatggagcagagattatttgcagtttactaattaagggtgataaaagcatcccagaaatggcaagcactgaataagtactagtatcactgtcttggagcgtgaccactgacatcggaaggaagcactgtcatctaaaacggaaacatgacaagccaacaagggcttattaatgtcacaggaaaatgatacagttaaatactcatgtttgcattccactggatatttacattctgaaaaccatgctctcaggcactgggctcttcattaaagtcagtcaggatcgtttgcaaatgcagtggaaaataccgccatatgacttcatttttttttccctgggacaataagaaggaaagcggtgcaccattttgacgcagatctgtaaagcagaaatcgtggtgcctttaccactcttgcttcaaagagaagaaattatagtctttcgttctcctagcagcatgtaactaaggtttagatgagtgaacagatgcatgcaaaaatcagccacgcgcatagaaaacattcattttcacaatctggtaaatctgctaggtacacatgaaacagagccaaattgatttcagcagaatgcagtgtcacagccctggcacgacagggatcctcctcagccgcgctccttgccaggccgttgccatcccagatcctgggtgtatcgatcacccagcaccaaggatgtataagcggttccgtacaccgtggcacgctttgcccagccccagctgactggctgtgttatttccatccctaggaatggaccggaataggcacctctgtccttgctttccccacttcgaggccttatctgagcttcttgctacccagcccctcgtccctcctgtaggtagctcacagaattatggaatgtaaaaacccaaagtgtccttagggaccatcttgtccacgtctttcactttatggatgaaatccagggaggagaaaagtcttgcccaaggccacatgggtcattaataatggcccaggcaccttctgactcccaaacccatgcttttttcaccgcatgcagtctccattgaaatttggactcagactatggaagaggaaatttccacaattccatcaaccccaaacatctctatggctattaaatatttatagcgcaaagggctctatttagtctgccctcaggtttcctaattgtccactagaccacaagtcctcaaacccacatcaatgcaagtttaccatcacaggttagaaagcctgggagacaaaggtattttagaatgaagaatcttttgggaaaggcaaaaggttacacaggcagcttatcttatgtcaccccacccagacctggagcaaaatgtagaactagtcacacacagtggatggagtcgaccagttgccccacgtcagtttagggcaggttttgttcccaagtgaaatcaactgaaaacttaattttttggctttcagagctcttggattttaaat

SEQ ID NO: 58876 - DNA, 1886 bp, Bovine  19866880724038
gctgcctagactactttggggcttgttgctcatgaccagcccaactcgcagacctcagtttatggagttccataaatgtggccagaatctgactgcccgataaatcatgaagtgactatttacctacggaaaaccgttggctggaggcagtgtttccacgtacggccaggaacctttccctccaggtgtcttacttgggtgcagaaagctgtattggaaattagtgggagccagcacagtgaagagcagggagtgagaagggggatgtgaatctgtttcatacagtggaaacttatgtcctaacaaataattaagaaaaaaatccgaggttgtttcctcagctgatcatcaccagcagagccaactttggattaaatacttctgctcagtggttttgacattctcagtcaggcatatcttgatgaaattagagatgcagaaaatattttttgatggagtgcagggggaaaaaatgctagaagggaagccaattctatgtgcaaacttgtgcagaccgagataaagagaaagtaggagaataagaagtgtgtgtgtgtgtgtgtgtgtgagtgtgtgtgtataaaataaatgaaggaagatgaaagcaagtgacagaagaggaaaaggggaagctggggtgatgctaattaattaaactttaagatcttggcagcaagaggtgtgtttataaacaatcttcactaaaacatacctttccaactattaactgttttatttgccagaaatagtctctaattattctgtgcttgtttcaatccaaaagtggagaaagaaatgttagtaagtgaacatagccactcttatgctataaaatatacctctgcacagaggttaatgtttcaaaaatgctcaattaatgaaatgtagctgattcaaactattttacaaaaaaattaagtggagggggctattagtttgaaggccttcgaaacagtggaaaagaaaaactagaccaaagatacaaaaaataatagaaggttaaccatttaggaatctctaaataacatgcttatactaggccaacagcaagtcaacttgttttcctcttgggatttaagtctagaaaagtctgatttgtgaggatagaataaagacttgcagacatgtcaaatgtttttaaaagattctctctcatgtatcctatctgaggtagttaataaaggatataccattaaaataagagaataaaccaagaaagaaaaagacacaagatccagtaaacagaatattcaactcatatattaagtcaaagaacttcccaggaagggagggaaggtcccaaataacaatctagtgaggcaccagctcaagactggagcagtagatggtgactctgttggagagttttggattcaactaggtgagagaaatgtagaaaataaagcaaattccgtaggtgaagggataaactgtcatacactcatacagtggaatactattcagcaatgaaaagaaaagccattaaaccacaaaaagacatgaaggaaacttaaatgcatattgttaagtgaaaaaagccagtctaattccaactatatgacattctggagaaggcagaattctgaagacaggaaacagatcagtgactcccagggattccctgggaacaggtggaatagagcagaggggactttttagggcaataaaataggattgccccccccctaaccctaactggatggatctggtaaacagaatattcaactcagaaattgagccaaagaacttcccagataggaagggaaattcccagataacaatctagtgagcaaccggctcaagactggagaatagatggtaactctgttgagaatttgggattgtattaggaaagagataggtagaaaataaagcaaattccatag

SEQ ID NO: 58877 - DNA, 1669 bp, Bovine  19866880738911
tgagatgcaaaaattctttaattaaaccatcgtgggtattccctgattgaaatatctgcctttatcttcatagttaatccttcatgattcatgtaacaactcaatcagggattgagtaaattaagggctccttgaaaagaacaaatcaattgtatgaaattgattgaaattatttctggagcagtcttcattggacctatttgtattgatcacagcctatttttggtgcattttctatttagtgggcttgtagagtaagagagaaagctgtttttcagcctgcaggggacagatttatgcctatggtatggtaaatagggcagacaattgttagagaaatttgtctgagaaaaggaacaaatataagtgtatcttggccattgagaaacccagtgttggtgacttggatggtccctacaattaaccaggaaggaagatggtaagcaagttggtccacacccatgagtggccccgagctacaccttgctggatactcatcaacttgtattagtgtccacaggccaaagggccgagttcttttgtatttttttattgaagtattgttgatttacaatgttgtgttagtttctggtgtacagcaaagtgatttggttttatgtgtgtgtgtgtgtgtgtgtgtgtgtgtgtatgtatacacatatattccttttcagattcttttccattttaagttattacaagataccaaatatagctccttgtgctatacagtaaacccttgttgtttattttgtatatagtggtgtgtatctattaattataatctatatagatatctatatctataatctacagaattatactcctaatttatcccccctcccctttggtaaccatatatttgttttctgtgtctgtgagtctgtttctgttttgtcaataagtttgtttgtataattatttaaagattctacatgtaagtgatatcatacatttgtctctgactgacttcacttagtatgtgatctctaggtccatccattttggtgcaaatggcattgtttcattcttttttatggctgagtagtattccattgtggagaaggtaatggcaacccactccagtactctcgcctggaaaatcccatagacagaggagcccagtaggctgcagtccatggggtcgctaagagttggacatgacttcactttcacgcattggagaaggaaatggcaacccactccagtattcttgcctggagaatcccagggacacaggagcctgctgggctgccgtctatggggtcgcacagagttggacgtgactgatgcgacttagcagcagcagcagcagcagcattccattgtatatatgtaccacatcttctttatccattcatctgttgatggacacttaggttgcttccatgtcttggctatcgtaaacattgctccagtgaacattgggatgcctatacctttttgaattagagttttctccaggtatatgttccaggagtgggattgctggatcgtatggtggctctatctttagttttttaaggaacctccgtactgttctccatagtggctgcaccagtttgcattccaccaactgtggaggagtgttcccttttctgcacaccctccccagcattcgttacctgtagattttttgatgatagccattctgacctgtgtgaagtga

SEQ ID NO: 58878 - DNA, 1469 bp, Bovine  19866880810137
taaggaattggtttttcacttttataaaaccaaaaggggtggtgagaaagggaaaagtttaggggcatggagaggaatgaagaacagaggttttattacctggagtctcgtgttcatttccaagaaataaaaattcttctttgagtccacaaggaattctacggttccagcagaagaataactcactgctttggcaagggctacggcttgttctcccattgctcttcgcgtctcagaatctagaaaaatgctgcaaatatacacagagtgaccacctacattttgaacaaaaattaagtaatcttttgtgtgcattaattttctttaagtttactcagatatgatcatctatgttgacttaagatttcaaggtatatgctttatatatgcttagaatatatgcttactgttaattaagcataacagtttgaaataaaccaacttcaaatttttatataaaactaacatctgaaccagtcaatcctaaaagaaatcagtcctgaatattcactggaaggactgatgctgaagctgaaactccaatactttggccacctaatgcaaagaactgactcactggaaaagaccctgatgctgggcaagattgaaggcaggaggagaagggtacaaaagaggatgagttgattccatggcatcaccggctcagtggacatgagtttgagcaaactccaggagttgatgatggacagggaagcctggcgtgctgcagtccatggggtcgcaaagagtaggataccactaagcaactaaactgaactgaatgatgaaaaattggagtttgtgcatgtgtatatgtgtgttcttgtttttatttgtttgtttgttttacctttaaagcagtggattttattttaattatgttggctacaatatgtaaatctctaaatgaaaagtaaaaatttgattagtgcctccaaatatctttacacttgataatgtattgactcaataactgaatactaagatgaaacgtttttcttttatatatattttgaaaggttgtagactttgaaagaaacagtactgaatgttctgtaatccatttgccctacttgttttaattattatttttaaactttttattttgtattggggtatagctgattaacaatgttgtgatagttttgggtgaacagtgaaagggatgaaaataaccatcccaactccctaactatttctccccccttttcccccccagcaaccataaatttattctttaggtctgcgagtctgtttctattttgtaagtaatttcattcgtatcatctctttttatattccacatataaggggtgtcatatgatattttccctcctctgtatgacttacctcactcagtgtgacatctctgagcccatccatgttgctgcaaatggcattatttcattccttttaatggctgagtgatgttcttttgtatatatgtaccacatcttctttatccattc

SEQ ID NO: 58879 - DNA, 1005 bp, Bovine  19866881225140
tcaacatgcagatccacagcactcacatccacatcaccgccaccaacgcttgtgaatgtatttttctgttagctgggtttacatgtgatgttttagtgcttttgcaagttcaatttgttagttcctgtatgaaagattgtggggagggggggaagtaaacgtcgtgccgttagctttttccgtaataacacccttccttctgtaaatacccgttaccatatttatccatttgtaattaaattatggtattaacttgctacagaggaaacaatatttataaagaatgtttcttaactataaatatgtacaattgtgggcataaactgtttcagatttttttatttgaaggttttaagtggtttgatcatttcttgtgatatgttttgagagtaatgcatacagaaatataataaaatgtgttgaaactgcacgaacatacttttttttttcctagcaaagttactcaaggaaatgggcaggagtaagcagagggctgataggggtctgggtcagctgcctcattgaatgggaggcaccacctcgaattcagggggaaggtgtatgcctagaaactgggccaaactgcctctctggcagaaagtctccaaattattttgtatgtcctttgtttctgtagctgagagtgaattacatttttggacagccactgcaaggacccgcctgcaggaaccttccgagcttctaatggctccattatctgaggcggtgcctttctttcggctgtttggactggactgaagagcactaaccatttccttattctttgtttcctctcttccctgccccctttcctctccctccctctgaaaagcagaggtacagttatttttaattgcaggtttaaaactgagctgagtcctttgtttttgaacttggttcaatgatgatagtttaagggcccctttctactaaaagttttttttttttttttccttccttgaaattttaaacagcttgctcaaggcatcctgcttatctgcccag

SEQ ID NO: 58880 - DNA, 923 bp, Bovine  19866881233586
ggatccatcactaagttttttgtaactcctgatattgtcttaaaaaaataggttttaaaaaagaccactggtgattttcaggcatttattcaaatatttccctacttctgaaatacatggaaaagtgatacgactgctttcttaaaggatttaccccggattactgtcttcaagcaaagggatcctgaattcagtccggttgtcagtttgattaagaaggaagtagctcatcttagtataaatattcgtgaacggtgctgtgtgacagtctggcccagagcacccagtgggggaagccttcaaactacagttggaaatattctaaataatttattttagaattagcggtggtaggtttgaagaaaagacttctctgtgggcttgtgattttcttggagagcagagtgaagtccccacatcttggggctctgggctggtgacagcgtgtggatgcccccgtggctcctggatcatcttacttacattccttactttatcctacgtgacctcccggtcaggaacactacacttacatatttaagaaacaggcacttacagttcctaatggggtagcagcaatttctttcctctcagaactaagacatttttgaaatgatgtattgacaagaaagttaagggtaagggatgtgtctagattcggtggttcaggcaagaaaggaggaagaaagttttgaagatgttagaaactgtcgttgccatttcaggctgtcagcttggctaactggaagaaaggaggcaagatagtttctttctcttaatggaaatgcgaggtgggctagaagaatatttaagaattaggggattaacatttgggggaagtgcagcagacgtggccaaattttgttgaagtcattcagatgaaaatctgaatcagaaattaaatctaagtgaatggcatgctt

SEQ ID NO: 58881 - DNA, 1602 bp, Bovine  19866881349004
ccacaatataatccttagttgccatatggattactaaaattggagaaggtttaatttagcatagccttttacctcaaagacaatggcttaacagtgaaagttaagtagtcgttcaagtgtatctataaatttaaaagcttgtagcagtaaaactgtgctgggagagattttttttttttaaaggaatttaagacaacttctgcattgcaggaccttatgatctggcaaaggagagtgtataaattttaacagatgtaatctgtaaagcagtcaaagtgacattactgggcaggaggcgatgaaatgttaaattttgtaccaggtactatcgaagctcagatcacaggagattcatctgaagactctggtagaagtgaaacttgaaacactgagtagcacctggagggagataaaggcacagaataagtgtggatttaactttaaaaactatccccacctgatttatgcattcttttaaaaggattgttcagtattcaatttctttcttatagagaaaacccacaaccacaactacagcaactaaattgctattaatagggagtgacctgggcagaaggcagtagaagagtggacattctggtctgagaggagaagagcaagttgaagttggcagtaagcaaggcatacaggagagacttgctttgagtttgggaatctttaggattcttttgtgagcccggctgcctttcctcggatattactagagaaactgaactgtgtagatttgagtatttgatgttaagatactgatctataaatcccttgagtagtaagtatttttaacctttcaatacactatacagttttttgcatagtttgaaaatatttaattgaattgataaagataactctgaactttcttcaagatgacttgggtgggttgtttttggtgttttttctttttttggtctcatttaaaaccaagtgcttctttaaaacctactttacagctggggaatataacttagcaatacccaaatgtattttccaccttagactttttggaagagggtaatacatgcccaggtatatggatgtgttccagtttttaatgactgccttgtaaaataaatttaaatacagttccttaacctggaaaactgttaggaaaagccatttcaaaaacattatgaatccctttcatcattttaaaagaatagattgctttcagaagtaagtaacttactctactctatgttgaatgccttgcgtttcttaagcaaaaataggtttgaaacactgtggacggaatagtcttaaaaatggagcacatattcttaaatttggagttgatgtagaacttaatgcatgtattggttcttttaggaagaaaggttaaaatggatgaggatcgaatgtgagactgtttaaacgattctcaaggttttctggcgcgtgtgtggtggtattgaactcttcagtcctgagcttcagtttgtccctggtgctgacctgatgctgagcaggaacactcaccccatcccttcactctgttcctctaattatctccacttcctggggagcttgcttagaactgggcaggagtgcttgttattagtatattaggctaccctggctaca

SEQ ID NO: 58882 - DNA, 749 bp, Bovine  19866881403686
ctgcattgagtattaaccctgaaccaacatactctgcagagcatctgaacttctttctttcgtggaggagacaaaagcatttctagacgggattgagcacagactcaaagggagcaggctaagaaagggagagggctccaggaggtgcccagtcatctccgaacagtttcctttctacaattccgcagccaaaaataacccaactcaagtgaaacgtggctgcgccaagtactttaggtatcagtgaaatttcctccccttctttatgaatttgcattatttataagacacttgacacatgtttaaacacttaacatagctcctctgtttcaggaaatatggcttgttcagctgaggggaggaaaaaagcatataatgagggagttaacaagggctgatattttttttacaacattctttaaaaactgcaaaacctctttaaacaccaggaacagcttaaataattcactctaggcctgcggggcccatgcggacggttccctctctggccacgttctcccccgggtttcggcctggacggtggccccgatggcagcccggagcggacattgtgtggccttgagacctcctggccgccttgcccccgtccccccgacccccggtgttgagggcccacggttgctcaggactccatggagagatcggaccccggaagatgggcccgcgccctttgaccttggacgcacagcacgccgggagcaggcggaagtgggccgcgagcggccagt

SEQ ID NO: 58883 - DNA, 680 bp, Bovine  19866881505154
catacactaattacatagacatcacgaagtcctatttgtcctcagtacctccccagacagcagggaaataataccaagggtaggcatgctaagtgatgattcccccccaccttactgtcaatcatcccagagcgctcacaggggcaccccactcaatctcattaccgaatcctaagggtaggactacaatactcaccaggaaccacagttcaaacagcaggctgcctggccaacatgtgagtcataatgactccttccctgattttaggttttggtgttaatgcaataaatatcaggtatttctcatttaaatccaatgttacaatacacagacaaagcaacaaaacattggtaagttcaatttaggaatctagataagaaatacagtcaaaggttgaagttcagagtcatttaatcccatttaaaaacaaaacctcacagccctaacttcatgtttaaaacaaatataacaatattttgctgtttcttaggggaaggtttactagtcttttcacctgaaaacatacatacatacataattatcataaaagtaaattaagttatctaacatgaattttgagaagtacaaacacaacaatctctaaattctcataattatttgttcccactattcaccaaactactgaagcaagatctgacttcccatttaaaaagtctgg

SEQ ID NO: 58884 - DNA, 903 bp, Bovine  19866881715752
agtgtgcatgtgtagacagcggggctgtttacttagtctggcccttcagggcttctcaggtggcactcggggtaaagaacctgcctgctgatgctggggacataagagacatggattcgatccctgggtggggaagatttccctagagaagggcatggcaacacactcaacaattctggaaattgttgcctggataattccacggacaaaagaacctggtgggctctagtccattgagtcgcaaagaggcgaacatgactgaagcaacttagcgcgtcaggtgcagccgcaacaattgcttagtgtcgaaacagcctctttaaggtttctcacgtggctccccctcctccttggagtggggacacctgtgactacatagtttgcttctggcagacccaacccaacctttgggatcgtcctttttaaacttgttttgttcagaaacttttgggtttttgttgttgttgtttatattagggcagaaaagctacagttgttggacagtagggttgggagtgctggaatgagccacagtggagcaaggaaataaggggtagggagccataggacagagcgtttgtaggtgtaggtagaccagggtgcagttctgggctgaccactagatggcactcacacattggcattaggactggtccatgccatgtttccactttgggcttttgtaaaatctctctagggactagcccaagctttgtatctgccatctccacccaaccatccacccattcacccctctagcctctcttggtcttctacagataggtagatgcgcctgtcggtctttctaaaaacttgccaaaaatatgttgaaagcctcccgcatttttagccacagtgctgtatttttactggtctcttagcacatatttacatggcagtaaa

SEQ ID NO: 58885 - DNA, 1276 bp, Bovine  19866880586633
aattactcagggaacacatcttcctggagacagggcggttgatgggagaagatggggcggaaggaaggtgggctgaggttagctaataggtgattcgttgcaaagaagctctctgcaagctagtgcacaaacatgatgcaggtgggaaagcacccaagtgtgtgacatggcctcgcattacttgaggtgatgccttgagtgggtatctcagagcgagtcaagcagagggcgatgatatttgcttgataaaccctggggccagttattccaccaagtggatttttctgtaagtggttaagtaaaccttgcatgtttttttccccaagggtatttcggcattcaggaaaaaaagactattggaaactttagactctggtaggagaaggcaaatacaaactttgctgtttgttttcgaagagagaagcacatatttcaatcttgtcttcactcagccataagattcttgaagactaatgtattcctacgttctctaagctgacttgatgttggatcttaggcagtaaatacgctttgtttcggggtatgaggggcagaggcttttgtgttaagaagaagctcatatggaagttcaaacatggtgtgatgaagggggataacagtttccaacattttattagaaacatttcaaacatgcagcaaagttgaaacggttttggttaacacttgtttcgacactgcctagattctatcactaacattagattgtacttgcttcgttatttatctgctatctacctattatctatttatctgtcatttattatctattaatacctgtcatctattatttatctatcctctatttgtttcatctccattcattaattcaacttacattttagtacacttgccttgcatgcatagacatgtgtatctttccgtagagttcagtatttattaactgatttttctttttctataaaacttagtctttgaaatgcacagtaccaagggtgtgcattctgagctttggtatgtgattacacctatgttgtcgaaccttcatcaacccatagaacattaccactgttaacccaggaagttttcttatgcatcttccaagttaacttcagctttcctcatgcccagagggaactatgactctgatttttttcaagggagagtctggtaaacacttatttctcttttgttaaatgtaccctaaaatacgattcacagattatatctactgcctatgttttagaaaaaaatagctatgccttggcaaagaatggcaatgccctctgacccacag

SEQ ID NO: 58886 - DNA, 823 bp, Bovine  19866880595480
aattcgtttgctgtggattcacagggcacctgaaaacatgattgctctttatgaagcaaaagaaaaactacctttccactgtaccatgtaggtgaaatgttaattctggacttcataagacctgatgaagcttaaacaagctaataatatttcaccaaagagaagctaataccaggttgatgaataaggccaataggaaagcattttcaattctgcatgacacactcttgtcccttgtactataaataagagagttggggacagtcacattgctgcaggctggaattgtttaccatctgaggtcactaaagcttattctggatcacaggttaatgacccaacttttttcttctagaaggaatgagccgtcggtgagtgtgtgtgtgttaactatgtcagcagctaattcagttcctctgttcactaggtctgggtctattttgagcaaatgatatcaataaagttgatagaaggaccacatgaggtcatcacccgtgatgcctgcatgtgagcggccacttggggttttctataccaagcaaagattttgtctttggtgatgagagatgcataaagacaaaaagcaagagaaagaaacccaaatactaggcaccaataacctaaaaagaggcaaaggaaggcttattcttgttcagttactaagttgtgtcctactctttgcgactccctgaactgcagcatgccaggcttccctgttcttcacatctcccagaatttgctcaaactcatgtccattaagtcggccatggaaccatctcatcctgtgtctcccccttctcctcctgccctcagtctttcccag

SEQ ID NO: 58887 - DNA, 2814 bp, Bovine  19866880571614
tgctttagaatcctgtactggagcatacagcttggattgttaaatagttatacagtataacaaaggaatactaagaaagaagaaataagaaacctacagacatattaacaacttttatgtaactttaaagtgtgaatgtttatatgtgtgaatgtcacattctcacattctgtttgaggactagggataatttgactgagcccaaggctgtgtgtagaatgtatttccatttcggaatagacagaattctggacagttggcaatactcttcaatatacttcataccagcatccatatttagaaaggagtatagaacacagcatctctgctaatttttaagcagtcacaattatattacatccataaagaacagaaaaactctaggacctaagtgatatttctactgaattattcaaactaaaattttaaaattgtatgacatggcctctcctacttaaaaccttctgataatatctcattttgtatcaaataagttacaagctcattttcttgacacgcaagggctttttaaaagtttgacagttgtatttccctttacttttgctgtacttgttcagtaagtcctccctatcattttgtttaactttcaggtagttgatctcactcatctttgtatcattttcaggcaactttagtaataatagaaatagtcctcttaatagctgcctgtctccataaactgtccctgaaatggatttcttgtgaaagtgatatattaggaagtgtttctgaagaaccagtcgcagtgtgtaaaagtagtcatgggatggaaggaaaactaacaagggtgagactcaggaaaaccccacaagggtggagggtgacatggctcaatcttgcaggagagtccttgagacagtgtgagacctctcatggagtttccaggttaggaagtgaagagactgtctttttcccttttactcctcggcaaagggctgaggcagaaggtggtattgactctggtgctcggcactctccatggtgtaagtagacgacgttctggcagctctgcaggcagccttgcaacagggagcaatggatgctgatgatggggatgagagtgcattggagatggtgtgcagaaagctggtaaagggatccagggagatatggacaggggtaccatgttcttttaacttctgtgctcagttactttctggattagaaattccttgaaagcaactatgttatttcttttttatcactaacctgcaaccccttatccaaaatattttaaaaagagtgtctttaacaatatttattcagtggctgaatggatgagtcagggttttttgtttttttgttttttcttttttctctttcttcaaatgcttctttatatctctgctaggcctatgtatcaagctgcagaatatatatatatatatatacacacacacacacacacacactgggaatgcgattggatgtgatcagaactctctttggtacttattacagaataccctcctgggctctgtcgaatagcagggatggcaggaatccagattagctgttattttgggagctgacttgcaatgtctgagggcataaaggactaaatcatgctctcctacataactgggaaggaccagaagaccgctgctgacatcaggacttgcaagttgccaaattgttgttgttgttattttttttctgagctgagggccaaagtgggtctataagttaatgtcaccaacagagaccaccattgtgaattgagacagtgaaaagtcaaagggcttcgtacctgtgcttagcgcgagaaatgacttttcactgcttagttgctattactcctccttgcatgaaccacacccattgtattttagtagaagcacctctttccaagggttcatgtcaaatatctctggtgtctttcaggtctttattatccatacacgttgccatagaaagccccttaaggaattttgggtatgtagggtagatgcggtgttccaaataaattttgggggccaagaaagaaacaagtcaaatgtgtgcttttaacagcattaattacataaaaataaaaagttgccacatcttttgggagctgtagaatcataacaccaggcattctgtaaatcagtatcatcatcacattgaatattatcactgatcccccctagaataaagccatgactaattcatagcccacattttcttatactgtgcaccatacagtacaacaaatgaaattacatattttaatgcaggcagcaatttgttgataagtttcctacaactgattcatttttctcatggggagaaggatttctactgtaacaatgagaatttagtaatttcccctatgaagaaacatcctatttcaccttaagcttacataccgtgaaaggatatgtgccaaagtttaggaaaaggcaatgccctttctatacataaatcatgaatctacagtagaaaaactcagtggtatcttcaacctgtaggtaaaggacatagtaaaaaaaaaatctgagtaagaattgctcaatatttctcaagttcaatggtcacaaagaagaaaaaacctataggaaatgtaataataataataaagaaagcacagagttagacctgacatttcactcattcatcccgcagacaggtattatgtggtaatgaaatcttggttgttgcattatcagataaatagaaacaaagcactatgttagaaacactagccttttcattgtatttatgaaaacataaggaaaaatatacatgcaagtgataagttgcacttatgtactggagtaataataaaaagaatattcagtagagaaaaat

SEQ ID NO: 58888 - DNA, 2349 bp, Bovine  19866880856868
ggagttatagcaactttcaagaaatatttatgtactttcaaaaaatattacctatgcctcactgagtgaagaatcaggaacaacctggtgacaattttggaagggctataacatctacgaggccgtaaaaaaattgagtttgcttggtgtgaggttacagccatcactgtgaataggatttggaagaacagtttgttcatgattttcatggatttgagatggtggatgaggagtccaaagaggtcttcagcaacttagtgacctcagcaagaagctggaactagattctgcaagaggatgacttcactgaactccttgctgtgcaatacatggagcttattaatgaagacctgatggaattggaggctcagagaaaggaagagaagcaagaggaagaagtaactgaagaatcaaagagattcacagtgcaggaaatggcaagaagattttctttatttaaggaggcactgatagtttttgaggtgtgggacctgaactcaacggtatatgaaggttgtggcagccattcagaatccagcccagtgctactgtgtcatctgtgacaagaaagaaagagctactacccagacatcactggatgattttttcaagaggatggacagatttgaatccagcaaggagccaagaacatgcgccatcagtgtcagacatgagtgagattgtagcttgtcctccgtcccctattgctgacgatccttcagctctaccatctcccacctcctctccttcctccagtcagtaactcttcattcctgttcactcgatgccagcccctgtgtgccagctattgtacggtactcctgtacttttcaaggtactggactataagattaaaaatgttttcttggggacttccttggaagtcccatgtttaaaatttcaccttcttgtacagagggtgccagttcaatcccctttgggggcactaaaattctagatgccccgtggctgaaaaacaaacaaaaacataagtgatattgctagaaattcattaaaggacaatttaaaaattgtccacatcaaaaaagtccttaaaaaacattttctttattttttgtattttttaatgtattatttacgtgaaaagtattataaacctgttacagtacagcactatataggcgattgtgttagttgcataccgaggctaactttgttgaacttacaaacaaattggacttaaggaacacactcttggaatggatcttgttcttatgtaggggactaactataaaaaagttttcttggacagaatgttttttccctaaaagcatataatttgaagtgctgttgttagtcaactttagtgtaaatgaaaagaattaccaggtatgattttgccgatttccatcaaagtcacattaagggataacaggactgtgagcaagaaaagggcgcagtagggacctctaatagtgtgctgagagggctggggctagggatttcattctgaagaatgaatcagaaaaatagaaacaagtttgtgtgtatgaagaacggtttcgtctcttctgaccactgaatgggaaaccaaggagggcagaggagacgcaatatagtgtgtgaaatgaaatgaggccatttacagtgaaaccccatgtagcgtaactcgtgtcataatttggattcctcagtagggaactagcttggctttaactctataaagagatattaggaaaccgattgcacagaaaatacattatctttctttcttaaggaactgtttctggagtctgttttgtgttttttatgcccatttaaaaatgtttcctatttgtacatttcatatataatgcttctctgtggtaataaaaaagtattgcagttcaaaacatgaaacactattaggatagttctctagtgactaatatgacagaaatatgacattgatgttttattctataaaccactatcatgatatacaaaaacatagacatatgagattatgcatagactttctgtcacacgcaagggagctggagtgaccaggatacttttagatatattcatagattgttaataaggctttgtgcttaaattcattgatattatggctattattattcataatatttttaagatttaatatttgggggtgttgtttagtctctaagtagtgtcagaccctttgtgaccccatggactgtagcctgccatgcttctcggtccatgggaatttccagacatggatattggagtggttgccatttctttttccaaaggatcttcctgatccagggatcaggatccacgtctcctgcattcaattcagttcagttcagttcaatcactcagtcgtgtccgactctttgcgacctcatgaattgg

SEQ ID NO: 58889 - DNA, 1749 bp, Bovine  19866881269245
ctaacttcttctttacagctttcgcagtttgtgaaagagtttctgctgtttttcttcagtgtttggttgaatcaaaaagtactttatgcaaatgttgaaaaaacactcagatatctcagatatttctcagtgaaaaatcagctctaatctggaggagcatagtttattttagtttgaaaagacagctttgctttcaagtaaggaaattctagaccgcccacatttttgtacctcagactcctatatgatgcaaagcctatgtgtcataaacttctgaaagaaagtacaaatttacactgaacagattaacacttgaaaatgccattcttgccatttgctctatgaagtactgctaacttggaacaggtgcaactaacaattagattagtacacgtgtgtgtagctgcgtggagaagcaggtttgaaacaattaagaatgatcatttgctttctactgcatagttgctaagcttttcggagttacacatttatggagaaggccttgagtgcttagatggactaaatataaacaattttatcataattatggagtacttcagtggcgtcaatcgtgattttatgccagtgtttatagttacaagttctttagttacttaaaacaaaataaagcattgacatgaagtgacttgaaaagtgcaggtagaatcttctgattttcctaggtacatatgataaatttgaaagttctctgaaagtgtagaatgttatctgtcacaactttctctctctccgggaatttaaaattttagagttaaatgccattggtaataaaatcttgaggtcattaactgatctgattcatggagaagactaacaatatccacataacatttcagaaacttatgatggaagaatacgttgagagtttgctaggttgtaaaataacaataaatttctttcttttaaatgttttctgtgtttaccccctgacatcatcatgtgtgtctctctctttaattcactcttccattgttattgagcatcactctgctctaacattgactaggaaaaaaaaaaaaaaaaagatgtagaaacttctcccagtgcccagctctgtttcttggttcacagaccaagggcagcttcttttctcatacacccaaagttgcatagaaccgatctctgcagagctgttttgccttctttctcaaataaaggcttgcatgggaagcatcccgtgcacaggatgccagagtcatctggctgggggcccatatgtgggcaatggcccagatatgcagatgggcattccaccagctttttcctctgatgctgctttggtttggggtcagatcctctacttgcccagtcaagaatttcagagtggcagccaggggcttcttaaaacaggaggtctgtatttcttggtctgtttcttttctgtgcatatgtgtacttgacagaaataaaatctgagacataaacacgttttaacacttctgtgtttatactaaaaatagcaaatattaaaattgtggtatcattaaatacttttctgtaagttgaaccttggtatttgcaggaaattggtcccaggaccccgcctctccatggatcttgcctctgaccctccagtgccttgtgtgaaatgagagccagctgtccattacctgtgggtttcactaaaatttcaaggatttatggtcagttatttagtagaatttcaagtaactcagtgtaatttttccaaaaatagatttgaaattactggtgctaataattgcttcc

SEQ ID NO: 58890 - DNA, 1119 bp, Bovine  19866881456706
catcagaccaagatatagtactgtacaatagtcgacttttgctaagatcatcattttacgtgtgtgtgtgtgtgtgtgtgtgtgtgtataaaattagatccttttatctttttacatattactgagaagtccttacaagagctgtccctggtggcctcatagtctgaaatatgttactgattagcaaatgagaaataatttttctgtttaagaattgaaacaaaaaacccgagcatattggaatagattgttcatttaccctaaatcagtgcaataggagttgccaaaataatgactaatataaatagaaaagtacattttatcacaaagatttaataactaattcaaaaccagtgatgagtgttttcctgcatatagttctagagaaagaagaattcctttaagagcatgataaaataagattaaaataagtattgtaaaagtatgtgtccctggagtaaagttctgaattatactaatgagatactgtttagggatttcatagtctaagatatattctttgatttttcactgtgacacaagaatgaattttgccctggagctcagtattattttctgccatgtgttaattttttgcatgaatgccttatttgccatcgtttagcctatgctgcaggtggattgttagccatacttattgcggatatttttgttggctgaagctgaaggacagctcagggtcttgcctagctcgagggttttgtgactgtgaaggcaattttcaagtgtgatttgtcatcgtagaaaaagactggcttcttaaatattatcctatgggccatggtttagattaacaaactttctcagtaggttcagaacatttggtgtgtgttttaaaaggccctgctttttatttaagacttcactgtaaccacgactgtgttcattcctacaggtatgcttatttacataacaatggagaattgagtcaaatactcttactaaaccattgttaggttttagctgctatgttataaaagctctttctttctctcttaaagcagcccagtcatttcatgttattcagtcccttacagaatttacggccataaagtttacaatgtggtttgctttaattcaaatgcatttactttggta

SEQ ID NO: 58891 - DNA, 1311 bp, Bovine  19866881562332
tgtatataggtaaatgacatcactatactttgattatatcttctgcatgttcccagtatctgatatatcaagaaaatatataggtctaacttcggaatcctatcctgaaatctgactgtattcttgatagttcatggtaagcagaacaaaattcaacagaatcctagccaattaccatgaagtgattggggctaagtttgaaagtgataaataaatgatatgatagctgccagagtcaactttctttttccctggtagatagaaacaccatgggccactcttaactaattccacagagaagaggctctgctaaactttgacactgaatattacaaaaacatatcatcagactgcggaaccttgatatttttcatcatttaatatttaatatttcttcaggtaactaaataaaatatgttccctcttatttttgaaggcatttaaaaatgaaaagcacttgtctcatttgtaaaaaaattaagttcggagtcatgacttttccatctatgttccaatttcagcttcaaggaacaaaagccaataattaataaagatctaatatggcaggggtttcgtgaaagacgtcagtagcattgtttcacattagctgttcgaacagccatcagaggataatgactttcagtcactatcaatccataaattattcagttgcaatttcccatagtcattgctattactagcagtcatcaagtctcctttgtttcttgaaattaaacttgaacaaaacagtatgactaattatcagttcatcttcaaaagatcccagcaataatttgccactttggacatttagattttattagtaatagatgaaggctctgtatatttttaagttgtggtgaactgctaagtaattgcacgcatttcattcaccttactatcagtgaagagcattatgctgcctagatgaagctagattaagccaattaaaaagatgagacagttttgtttatcatgtatttttataatttatctgacagctgtttcctgaataccactgaagaatgcatataaagcagatataacccctcggaataaagtgatgcttctttaaatctcattttggaatgtattatccccaaacggggttgttaaattaatcttcaatcataagattcaaaatgacactaaaaacttcctgatcttccagattctatactagtagttaattaggattaaccacatgactggaaacagtgctatttcaatatctgttttagcaaggccaaactttttagaatgatatttaatatgaaaatagtaagtgcaacatattaatatctacactat

SEQ ID NO: 58892 - DNA, 645 bp, Bovine  19866881596909
ttttgtatatctcctatggctagaagagggtcatatgaattccctaccatggaacatggcagatacaaccctgaccagccatcatttgacacatagctgtcagttaaaggatttgaaatgcctccttgttctgttgtccaattagcactttacggaggtacacaaagacttctgttagcaggagagatttgattcctccattccaaaccaagacccatttgttttcaaagaatacagcattgttggggggttttaaatgcatgactgttttcgagtgtatgcactgatcagaaaacaaaagtcagtatgaggactcttcaccacccggcctgcaaacatttagggcatgatgctggaagagggagtgtggttttagctgtaggatatggttttagctgtaggatactcctcctcagccatggcttctaaaagaaagtgcttctgcagaggtgctctcccaggcattctcaagctccagacatccttgaaactgcccacctggcatcctcctggcagcaacaccaggtggatttgactgaatttcaaagttaagggctgtgattttagttaccaaaatataacttcaagcagaacaaataaaacatattaaaaaaaaaaaaaaggcaagcagctgaaagcaaaggt

SEQ ID NO: 58893 - DNA, 1867 bp, Bovine  19866880378913
ccctgaaggcatcttttgttgatcttgctgtttaaagacagaattatcccggaacaaaactttttctatttttaggtacattgttgattgtgaaactggagtctccaatgttcatttcgtgaacataccagagactgtctccagagacaaatggactggagttctggccaagggcagtttgatggggagttcaaagggaccttgaagtcccagacatctaagggattgggggtttgtaggcacagagtcggacatgactgaagcgacttagcagcagcagcagcagggggagaggagggctatgtagaactaacctgggaacctgtgggctcttgggtgttcctgctttatactttcagctctttagggaaatgatgggctgctgtcaggacaaattgtgaacaccttctttatacagatggagagggccaatagacagggctctggtgtcatggccaaccccctgcccccatccacaccactggatccaggtcctctctgcacttcctgcctccaggcgtcctggtggaggccaaaactgccggaccagccaccctggtctccctgccaaaaggagaggccggcaagatgatactttgaactaaaagagaacaggacagacacaatcggcctctccagctctctaattcgtgtctctcttaaaaatgtctttaatcttcagcttcatttattccatcctggcccagcctgtttgtttccatgattcaggagaagcagcaaagagcttgtctgccgtccaagcacgggccgggctgcggtggctctgggaagaagccccagctagtctcctgctctgcgggggccctggctctgagcccaagcctgtcgtggccactctgtccccttgccagcccctgcaagttcagactttgttgtagtttacaggcaaatctccggcctccttctccacatcttaaaactcaaacttgatttccccgaaagttcatgtaccaggataagggagctgaaaccacagaaagactccaacctggaatattcagccctcacccagacatcccaacaccacatgcatgaggagaagaagcagaaatgtccactggtcctgaaatcctctctctttagccaccaccccatgtggcaggaatgggttaaactatccagacgaccaggactgccagacgactgtcgagaaaacagtactctaactggctaaagaacaaacaaggacatactgtctagcacagggaactcagtattttttaataacctataagggaaaagcggagaaggcaatggcacccccactcgagtactcttgcctggaaaatcccatggatggaggagcctggtgggctgctgtccatgggatcgcgaagagtcggacatgactgagcgacttcactttcacttttcactttcatgcattggagaaggacatggcaacccactccagtgttcttgcctggagaatcccagggacgggggagcctggtgggctgccgtctctggggtggcacagaattggacacgactgaagcgacttagcagcagcagcagcagcataagggaaaagagggcttcctaggtggtgctagcggtaaagaacctgcctgtcaacgtaagagacatgaaagacgtgggttggatgcctgggttgggaagatcccctgaaggagggcatggcaacccacttcagtattcttgcctagagaatcccttgaacagaggatcctggtgggctacagtccttggaatcacagagaggtggacaagactaagtgactaagcacagaagatatgaatgtataactttgctgtagacctgaaagcaacacaatattgtaaattaactatacttcagttaaaaaaaaagaagatcacaggg

SEQ ID NO: 58894 - DNA, 1416 bp, Bovine  19866880402891
ggtccttctttctggaacttacagccctgtcctgctttttggaacctgttctcttagccggatgcagttcacatttgttctgcagaaccataaaacaagtgtgaactgcacctggctaggagaactggtctgccgtgggaggtcagcttcctgctatggggtcagggaagattctggaagcaggatgctggagctggcctaacgtgtgagcagttacttaagcacaggggctggggtgaggcagtgaggaggggaaagagatcccacagaggcgacttctgggcatgggcaaaggcctgcagtgggagggaacaggtgcatctgagggtctgaaaagaggccccaggggcttgaccagaggaccctggggacctgagagggcagaggaagtgctagttgctcagtcgtgtccaattctctgcgacccccatggactgtagcccaccaggctcctctgtctgtgggattctccaggcaagaatactggagtgggttgccatttccttctctgggggaatcttcctgacccaggaattgaacctgggactcctgcactgcaaattctttaccatctttgcctttctttggacagcctgctggatacgcacagtgcacttcatgggcctgcgtgccacccaaccccacccctcctccagcccctagaagttaatgcagcacctgacactgtgtccctctctaccatcacagcctggcaatttaaaaactctcactgtcctggttctgtccactccctggctcagccctttggcctgactccactgcccgggtcaaaagtgtggcctcagtgcccaagacaggagctgcagtgcccagaggctgtgcccgcatcacctcgctctcccgctttccccttctccacttcctcctccaaaaccagcccttcctctgcaaagataaggctctcttctcaatttttgcatccccttcccttgattcccatttccctttcttcctaatgcaggcggccctttgtgaagggagggggcgtgggttttgcacaaatatttaatcttttctaatctgccctctgcactgcctgtcagttcccggggctgaaaccgctctgtttgctttagctggtaacaggatactgttttgaaaactgatgcagaagtccgattacttatgaatcctggctttattttgcatgaatgcttttcaaggccaactatagatttattttttcttccctgccaagaattatgctgccagtgggggcgtggtagtgggtgggtggggcagcctagagatgcctttaacttttcaccctgtgggctggaaatccagcagcgcggcgcagacctggtgaaacaaactcggcctctgtgttgctggcgggttccgtcagagaagatctccccctctccctccaggaaatgcattgtttcacccaaa

SEQ ID NO: 58895 - DNA, 825 bp, Bovine  19866880522546
actgcagcatggccaggcttccctgtccttcaccatctcccggagtttgctcaaactcatgtccatcgagttggtgatgccatccaaccatctcatcctctgctgtccccttctcctcttgccttcagtcttccccagcatcagggtcttttttaatgaattgtctctttgcaccaggtggccaaattactggagcttcaactttagcatcagtccttccaataaatattcagggttgatttcctttaggattgactggtttgatctccttattgtccaagggactctcaagagtcttttgcaacaccacatttagaaagataactgtgatcaaatgatacaaaggccacgatggaacaaagtctaagactatctgctaccccatcacccactgggtgatccttccaaggatgggctttgtaagccatgagtgaacctgaaattctagctgacctgtctttgagaaacttcccatctacgtgattggaatggagtcttgacatggtaatgaaatcattaatggagaaacgtaatctcagacatcagaacagtaagccttttagttcattttctcacctgaaagagaacttggaacaccttgttgtgctcagttctcttcaactgttatataagggatggagaaaacaatagtaagaagttcgatttttcagagtatagttgccatggctgacagaaatcaaatttacagcaccaggaaagtctggttttaattcctgccatcttcctgggatagtgggtggcttagttaataaagctgatctcctacttctgggaattggattgggctctcaagctgaaacaggt

SEQ ID NO: 58896 - DNA, 1893 bp, Bovine  19866880534988
tagactgtaaagctggcatttctgtcaactttacagggacctcattagcttgctcgtttcaacttgaaatggtcaggccaaggagtgttttgtcatttctgttttctcttcccatctcctcttccgtattttctagagatgcacagcacatcagatatgaatccaaagcacgctgagtttagctctaagccctggggagagtgaagaggcggaggggggttctctggccaggagtcttcaggacaatgccctccacccacctcttcagccagaggcagggccaccaatgtctcaaagcgtttgggaggagctagctttcttctattaatttgctgtgaatatgtaatggttttcgaaagaaatatattttttaaaagacaggctaatgcactttaactgttcttaccttactaaagagaatgacaaactggagagaaaaaaaaaagtgctaacacacaaaggtcatgcgacatgcacagaaacatttgctccagggtctaaaaatgttacctcttggttagaattcaaactctggtgtctctctaagttcatctgaaaggcagacaaaatcaattagcaagcctttcaccctctggcaaaaaaaggaatttctacaagaatgccttccagaagctcttcgttgcttgactcttggctgtgtttggctgatgtgaaggcagagacacaactttggggcttccccaggggacaggcgctggctccatcctgtctctcctctacctttgtcggctcagctctccgcccccagggggaggaccatgagcacgtcctgatccggggtcagctgtcaggagacagatctgtttaatatttagctttgaagggaactggctgaaaaaaaagatgaaagggatcagctccaagggatggggaaaaacaaaaacaagcctcgattatttcagtatttccagagaaaaataaaaagataaagtcaatgcaggtaagagagaaagaatgagacagtgaaagagatggaaggatggggagggagggagaaagaaatagagggagagaggcagaaaagaggaaggaaggagagagagcactccaaaagcccctgcgaagtagttccctaactcatgtgcattggccagtttggctctggtgcacacataccatcaagaaatacaggtaactgtccactctcaatgacagttctagaataaagaataaaatctgcaaaatgcagattctgagttagtagatctggggtgaaacctgccattctgcatttctacacaagacctacagttctactgactggcactctgtccccagggtatagagtctagaacacatcagcttgcttgcacagggaaggcactgggcaaccacagcttgtggactgctgcctgttctcaagccatccctataaagagaggaggaagtatcacataaagctgcatatgcctgtgtgctaagtcagttcagtcgtatctgactctttgtgaccctatggaccgtagcccgccagctcctctgtccatgggattctccaggcaagactactggagtgggttgccatgccctcctccaagggatcttcccaactaaggattgaacccacatctcctctgtcgcttgcattggcagttgggttctctaacactagcatcacctgtaaagtcccataaagctacatacgtgggaacaattaaatgagaaagaaaaggttaaagaagatatttacatattgttttttttttttaatagaagcttagtggaaggaataggaacaaattcagcatgattttgactcatcccaaatacccatttttcaggttggggcatttctgttataaaatgaagtcagtacagattttacggggatgctcaccatcccccaccatgacaagagcaaagcatgagcat

SEQ ID NO: 58897 - DNA, 922 bp, Bovine  19866880543283
atatatatataattatcaagcaaaaatctccttgtgcctttcaagcatctataaatgtgatgctcggtgaatggctgcctggggtgctgactcatccatgtcagttccctgctctgaacccccaaagtactgccagtagggaaagtcaggctatatataaatatatgtgtaaatgaatgcatgggtaaatgtcatactcctatttatgtctaccagatggctgagttaattagtcaattgagtgaattagatctaaagacactggattttcccagtctgaactttctcaacaggagaagccttttggattgctaggcacattcttttattatttcattgttcattcagcatgtattgattgattacctgtcgagcatatgcctggctccaggctaagtgctaaagcggtggtgtgaatctagatggacatggtccttgcctgggggaggcttactcaggccaggaggaaagccacactagaaacatcattacttgggttgttaatcactggggtgacagtgctgatcatggaaatgtacaagattcagtgagaacacggaacaggagctctaattacggaggtcagcttccctgtaaaagagacactgaaatcaatagctcactgggcagagggaaagaaaggtgtgggcagagtggtgtgggaggcaggagttagacatcgcttggcactaaaagatgctgacagccggggtcaagggagaggggaacaggattgtcaaggaccttatggaatattttaaagatttagagttttatgctaatgatattagggagtcataacggtttcaagaaatggtggcatgtgatcggatatggatttttaacagatggttcaactgtcctgcggaggctgagcggaaggaaggagaaggacacacagcgtcaggaggccccccgaaat

SEQ ID NO: 58898 - DNA, 2784 bp, Bovine  19866880643625
ttattcttgggtatgctgtctcatgagtatgttcaagagaggagcccagcgcaattttcaatattcccctagagaactcccacgaaagtttagaataacataaaggtcttaaattcatccgtgtctgttcattattataaagaatgctggacattttatatttcccatcctaattgaagaataatgtggatatcgcccccctcccccattaagggcacttagtgtgatgtaccataaatagtatcataaaatctggtattttatgtatcattttcccagtaagtaaaataatctgacttccaaccccaataaattattaaaatattcttttagagcaaatgctaatgttcctttgatattcagagtcaaaggaaaaaaaaggcaacttgaactagtttccattctctgcagtgattctttctccacttggtcatgtctgtctccccccaagtgctatattcccactgggcagaaagtcaatccaccttcaggtatttacttaatgtccattaaaaatcacattatgcacattataccctgttagcctgtcccatttattgtgaatttctcatatttcctgtcattcttctggtgattttttcctttatagcttctattttccccccattaatccttcaaaacccctgggaggtaagattgtgcatataatttcctctgtattctaaaatactgtttagagttttgctttgaaattgcttttaaggctggatgtttgactttcttaagtgaacctgtaataaacagtgttgaattctctccaaattacctcgaagaattacctgcttatctggaagaaccatcagtgtaattttaagggattttgtttttattcagtggctctgggtctttgaacttctctgcctcaattttttcagtctttccacaggaagagttctgctgagaaccagcactttgactcaaatgcagaagagagtgtttttgtttctactttggtacttgtgattctagctctaaaggaagcgagatttccaagattaggatagtttagtctggaaagaagactagttaaagggggcatgatgaaaaccttagggatttgagaatgcttgtgaaaactaaatgattcattttttaaaacctttcacaaaactcaacgaggaaatactccatgaactagaggaaatgataggcttaagcccagtgataaattccttgcacaacttctaggtataggtaccgttattagccctgttttccagggaaggaaactgagatgcagaaaaactctatgacctgatgagagagagtcgcagagtaagcagtggagtagagatcgtgtatatatctggattccagagcccaggctttccattattgtgctctatttctgtgatgtgatggttgctcttaaaaaccagcttgcagctaccatgattgaggcttccctcacagctcagttggtaaagaatttgcctacagtgcaggagtctgcctgcaaagcaggagacctgggttcgattcctgggttgggaagatcccctggagaaggaaatggcaacccactccagtattcttgcctgggaagtctcacggacagaggagagaggcggactacatacagtccatgggtggcaaagagtttgacatgacttagcgactaagcaacaaggataaagaacaaagcgggagccgccgagggctttcaagtcggggagagctatgatgcggcttgcattttgacaggatcgctccagctgagaggcagaaaatgaaaccagagtggaagcggcatgctggttggggggtctctagcagtcggccaggtgggcagaaacgatgggcggatttgtgagctgtttaggaaaacagacatgggaatgtcttgagggggcgtgttgagagtctggactctgggtcagagtctcagagggaaatggatgacccactcgaacggggtcttttttaatggggactttaaaaaaatgatttgtttgactgcgtcaggttttaattgtatcatacaacatctttgttgtggcacaagggccctcctagttgtggcccacggaccctccagttgtggcccatgggctcaggagttgtgacgagcgagcttagtctctcctgcccatgtggatcttaattccctgaccagggatcaaacccgtgtcccctgtattgcaaggcagattcttcactgctggaccacaagggaagtccctcacacggggtcttgatgagcgttttgctgtccaccctttctaagtccttcctagcctaaatgttcatcagaagcataaaggatgggcaggacttcgggtctgagaatacaaggacaccctcctgcccttttagccaggaggtcggggagggactggttcctgggacccaggctgtgcagtcaggactgactcatggagaccctgcagggaggccgctgggaccatagacacctgacttgccctcttcctgtcctgtagccccagctgggccttcaaggatgaacccagctagaggtcagagggcaaggagtctagtgacggtgtttctacagctcagcctgggggcacagagcagggggcagtgatcagggggacagagcacactgcggggaagggatgggtcattctaacaagggggatgccgtgtggtgcagcggacatttggggggtctcccgcttctgtgctctcatcagccattggaggtttcctggggcctctggcctctgggcaagtggaccgctcatgtccaagggcataagcttttgcctaccgctgcagagcgtgcccatctaaacacag

SEQ ID NO: 58899 - DNA, 1909 bp, Bovine  19866880704289
acttctaatccacatgttgcctactaatttacccttcattcatcatgaatattattttgtaagagctttttgatgtctgagaagctaaatgaatctcttaagccctttcctgctttgtaccacgaaattgtgtgcttccagcagttggggaacaggagccagaaaagctgggggctatgcttgcagcccttgcagggaggagcacacccttggaaacagtccccgcccagcctgaaggccagtgcaattataccttgtgacaagaaggcacacctcttttctagacatttttctttgggtcctgcctctagggagggtccctgctgctgctgctgctaagtcgcttcagtcgtgtccgactctgtgcaaccccatagacgacagcccaccaggctcccccgtcgctgggattctccaaccaagaacactggagtgggttgccatttccttctccaatgcatgaaagcgaaaaaataaaagtgaagtcactcagtcgtgtccgactcccagagaccccatggactgcagcctaccagactcccccgtccgtaagactttccaggcaagagtactggagtgggttgccatagccttctccaagggagggtcccactcactggaaattcagtatttcattccattcatctactccctccttgacccattgtttaatgaacactccccaatggcagtggacagtgggctggtgttggacatccaaattatgcacaatgctcagttcttgtccttgaagaacttacatcctattgggggcagataattagggtgtttgggatggacacatacacactgttgtattcaaaacggaaaaccaacaaggacctactgtacagcacagggaactctgctcaatgttatgtggcagcctggatgggagaggagtttgggggagaatggatgcatgtgaatgtatggctgagtccctttgctgtccacctgaaactatcacaacacagttcatcagctatactccaatacaaaataaaacatttaataaaaataaataaataaatctaagttggcttaaaaaaattgcaaaaaaaaaaaaaccccaccccaaaacagtcaagagagccaactggccctctctgccatgaggacacagcaggaagatggctgtttatgaagcagcaaatggaggctttcatcagatactgtatctgttgctgacttaattttggactttccagcctctgaaattgtgagaaataaatatttgtggtttaagcaaccccatctatggtaatttattacagcactaagacacttttcctctttcttgactttccctcccaattttctgaaacccatccccacaaccactcctgccctccactccctcacttctctcatccccaggagcccaggactgtctcttaactctgaggccctgccctcctccatgctgctccatgttccaaaatcagcctcttcacctactgctgaaacttttattcctctgttctcatggtctaaaccagaggaaaggcaggctaataaaaatgttctataatcagttagtagctcatgttactggcctttaatcatcctaattggcagttgaaaaatatgcttataaatgaattcatactgatggactggctggggaggtatcttgaacagaacttcctgataggttggtggtgctggaatgtggacaggacctgggatctcacaactgatgtaaccgagcaggactcactgctgatgtaacccgagtgaggccttttcaggacagacccggctcccacatgctctcagaagtacccagataataggagctcatgcctgagtttttcagatgctaaaaaaccaccaccatgcatgcatgcttaagttgcttcagtcatgctggactctttgcgaccccatggactgtagcccaaca

SEQ ID NO: 58900 - DNA, 2205 bp, Bovine  19866880743424
tgaagaggcagaaggaagcctcaagttactgagcagaggtttttttttttttttttttttttttggggagagtttcaaataagtacctttcattaatgttgatgtgaactgtactgccttacaccaactcgttagcaagttgagtaaatactcttatgggtctgaaacagtcctcactctttatatttataaaagaaagagaaagaaagaaaggagaattcaacggcaggatccagactcgccacacgatcttctccataaacaacacgttttgcttaagagataaggtggactctgggcatctgttaatagtctttctccggaagataaatgctgcaacatttgtagaaaatgaaactcgcagagaagccaagacttttcttgtcaaaacaaggggattattttctagcaaccaaggtcagtctttttgaccttgcctgccatacgggtgaatgagataataaaagagggagctggagctgggctgagatagctcatgtgtgaagggcctgggaaagagactcagagatttgtggagaactccactttatccaatggcttttcctaaaaagatgcctcctccacctctgtcaaccgtgtggcaatgacagggcaaggaggggtggaatcatgtggagatggtgaccattacatcacacacggctcctgagtctgccagccatggactccggttcaaggactgcagacgcggctgtgcctgatggaagggggcagccctgggacagccgcagacctttctcagacgtgccggcagcgcggggccccagctcgccttgtaaaagtagctccagagcaaatcattagcacatctaacctcaatattttgaaatccaaaaacaacattgagtcatgccggtcgtactgtaaagttttactgcactaaaaaaaaaaaaaaaaaaaaaacagtcaaaaacaagcagggatcatgtgaattatctctttacatgtgtcaagcccaggaatttgacacatggctcacgatggtggaatgagctgggtagtcaccaggaatatgtcgttaagaggaaacttgtcccacctggggctgtgtggcatctcctcgggcagcttctctatggtctgaaccacatacctggcatggggtgtctgatcactgaaaaaacagggctataaatacccttcatcctgtactaaaaatagattcagttaaagcaaaaaatccactgaggggagtactgaccactgcagacatcagtttatgtctcctagcaactgtgttgtcctggtcatgctctctgtgagcctgtggagtcaggtatcttataatttttaggagaaaaatgaatgaatgaatgaatgaatcctcttctggggaaagctcagtatgtgttgagggaaactacccatccacgcttcctagaggctttcatgaatctccaggtcaatcttccctggaaacagtccaccgattccacctcaagggtcaactttgtaaaaatactcaattggaggagcatcccagaacagttccttagcctacagcatccaaggccatgggagcagaccactctccaaggttcccaggcgacttagggggaacttaactaagctgaccataattcaaacttgagaaacactaaacagatgagaaaatccaataaagaatttcagaagacaaatgagcagacttacagtgccaggcaatgtaatagattatagagctacggtaattaaacatatgtgcactagcaccagggtggataaagaaatcagcagactgagaatcggatgtctagaaacagatgccaaagtttaatagtatatgatgaaggcagtgtgtccattttataagggacacatgattatcactaggttgtacaaggataattgtacatgttaagagatttacctcctggcctattccaaatggattaaaaagagaagtattgaacacaaaattataaaacaagacaatgttactgacatttatgcagttgttttttgagaagggaaggacttcctaagcatgatacaagtagaaactcagaaagcctataaacaacaaatgctggagaaagtgtggagaaaagggaacccccctacactgttgatgagaatgtaagttcatgcagccactatggaaaacagtatggtgggcagttcctcagaaaactaaaaatagaattaccatagcatcctgcaatcctatttctgggcatatat

SEQ ID NO: 58901 - DNA, 984 bp, Bovine  19866880777398
gatcttattatagggtggattctgattcaggaggcttgagctggggtctgagattgtgcattgctgaagagctcttggatgatgctagtgacaaggacaagcccttaaaagcttccttctttttgggatccatgccccagactaatcctgtaccagtggattgtcaacttaaaaaataatcataacctaaaagcggagagttatgttttactcagtgggaatttttaagacttcaagcccaggagatagcatctcaagtgacctccagagaactgctctgaggatggtggggatggcggtggggagccaggttatgtagaaatttgcagtgaagggcaggtagtctgaatgtcaaaagtatttttgtggattaaagaaaaccagatacaccaagttgaggaatttagcgcttttctatgtatgagaagatgcatgagagtctgggctcattgaaatcattcctttcatatgcagatatcttgggccagtatactgcatttttttcacatcctgagctcccttggggttcaccatagggagtggctgcagtctgatggctgttagatcgcaggtattcttctccttcctgaatgcccttagggtccaccagctcttattggaaggctgcaattgctggtgatgactgtgacatccttgcttactgatatggcaggaaatagttcatttctcaggatacaacccagatgtttctggaagggatgtgcttcttattactgatgacccagaaagacaatgaactcaccctgggctctttggatgggagggtctttttagatcttaatggttttcaatgttttgtctgagtgctttcccattacccagaaaatatttcccatttgactgatgttctgttttaatagaggcatagctacctcaaaggaacgccctgtctctaagttgagcagaagacttttctggggctttgtggtttgcttatttcatgtctctgcatgtgggttacag

SEQ ID NO: 58902 - DNA, 888 bp, Bovine  19866880863308
ctctacttacattgccatagcctgcctggattctacctttgtggtctggaaagtgcctctgggcagaaagtcacagcaatcccaaggctcacctcatctggtttctatccctcaaagattctgcattcattccctattgtctagctgtctagctgttacagtaggagagaaaatctctagtgcatcatggccaagcttgactttatgtgcagtttactaactgaatattgtccaatgaacaattattgaaatgtgggctaaatttatatttatttgcaagacaacagtggattctcagaaattaaaatgttagatggcttatagttagaggtgaaggatcagtcatatctgttttctcataaaaagagcttgggatttttagggaaagctttaaaatagaaaacaggatgttggttttatatcctaatcaccctccatgactgtcttcccccagcctcaggcccgagaggctataattagggacaatgtcattctgtcccatagattacagaagtagggctattcgtcatggaaacctggaaacaagctagcattggggtgtgtgtgcaacgtaggtggcatctcatgtgtgtacaaaatacacgcacttcatgcccatctactgaagctagtcctcctctcaatcccagaccagaccatgtgcctcaaattactgtcaaccttccccaaattatttggacatagtattttttatatagagatataaatatatctatgtatacacacacacatgcatataataatataatagccatttttgtttccctccaataacttagtccttattaaaatagactttaaggaagcagtcattgccttctatacctagtatagcccacctatattaatctctgtttctcctaccag

SEQ ID NO: 58903 - DNA, 1499 bp, Bovine  19866880877534
ataatgtctgcagggcacttgaaagtgtgcctggcacaacacaacagtttaataaatgcaacctggtttgattgtcagaagttggagaacccactaacttcctgttacagggcccctggactcagagtccacgatcctaccagcatgtgctgttcccaggctgctagtggtcccacctgagattccgtttttttacaaagcactttcaagagtgcattaaaaatgatctctgtggtggcaatagaaccagaaaattatacagctggtggtaacacagaagcaaacacagaatagaaccagacgtccaatctttccagtggtcagccaatggcagaggggggacacgaaactcatctgggtcctgcctggaacctgaaggcttcctgtgtgattcagatgatggcctttgctttctgattattcaaacatcatcaggcgccccacagagaactaagaaaaagaggtcaccagggttgaggaatagggactggagagaagagacataatagtttcttatcaacatgccttgcctgggcagccagaaaatttgtttgagccatgaaataatatttattctgcatgccactgaccaagctcagcctttgatctatttctctactggagattttttttttttttcaaatttcaactccttctgcttagagggtaacaaacatgtaatgaactcagtggtgaattcagaaaggaatcagaacattaattatgcccactggactctgaatcccttcatgctggtcccagggtctcccctgtggattcacttgtccatcatttggacagaaagattgcatctcactgggtgccagtgaggctccttccaagccagtatggttttgtatcaaacaccgaactgagggcagtctggctaaatccaaatagtgattgcattcttaaacatttttaatgatatatcatatttaacccaaatgtatccaaaatattatgttttcatataatcagtatgattattatcaatgatatattaatgatatgttgctcctgataatatattcaagatactatttacatttgttgttgttgttcagttattcagtcgtgtccgactctttgcaacctcatggaccgcagcacgccaggcttccttgtcctccactgctcaagttcatgcccattgagtcagtgatgctatctaaccatcttatctggtattttcatttgaaagtgagagtaagtcgctcagtcgtgtctgactctgcaaccccatggactgtagactaccattcccctccatccatgggattttccaggcaagagtactggagtggggtgccatttatctttaaagtccagtgtgtattttatgggcttctctggtggttcagacagtaagaaatctgcccgaaatgcaggggacttggattccacctctgggtcaggaagatcccctggagaaaggaatggctatccactccagtgttcttgcctggaaaatctcatgcacagaggagcccggtggg

SEQ ID NO: 58904 - DNA, 948 bp, Bovine  19866880893371
tgcctttgatctcaacacagaaagctccagcccattataaactcgtttacactctaaagacaaaaatacagacaaaagcaattagagatgaacattaaatggcttagcccggctccccagcagaaccgggtagggcgggcagtggggttgagtcaaccagcttgaacagcagaggtttgcttcagatggtccaggacgtggccttgctgtccccaaggtctttcctctgtagaaaatacctcaccggcagccacttcaacagaactgtgaaatctcccctttaaaacaggaattcccaagaattctccaaagctcttgcccctgtttcaggtgttcagtgaacaccaggcttcttctccctcccctctctgatttcaagaatgaactctggtatcagtcatgtacattttagtgagaattcttttctaacaattttctcggagcctagggtagactggacaatcactcttagcatcagcacaaaggagaaagagagtgtacaccgaagccactgccaactgtctcgctgggaaaactagaaaatctatgtcctggaaaacatgaagcatcaatttcacttacacactagaaggcatgtaattggtttctgtctgcagacacaccgtggatctaatgtgctctaacaggaaggctgcagtcctggctgagctccttgtacacaataacctgttattttgtgattggtataatattttcctagggctctgtgagattttatgtttaaactggaaagaaatattgaaagcaaaggtttttttcctccccacccccttttttttttaaaataatcaaatatgccactattacccatgatcccaatctgagtcgctctcagttcccaggaaagagatgaagttgtctgtaccaactttgcagctctctgctctgcagcctgaaccacgaccaaggccaagcacacaggcggcg

SEQ ID NO: 58905 - DNA, 1130 bp, Bovine  19866880901272
atgcaattatctgtgccaagaaaattgttaaagaaacggatggcatgaactactggtaagagtctttctttgggagacaagctgacatgggtgaaaccctttgtgtgtgtgttcatcaaaggtgcaggagatgggaacaagttcccctctgcagagtggtccagcaatttccacttgacctcatctatgtcatcctccattgctgtgtgggtatgcagtgaacatgggattagtatggggagtagagggttagggagtcagaattatttgcaattgcttttcatatcaagatgttccaaacaatgaagagagggttgttttctcatgtgaactggagagcatcagtgaagacaatacaccagaagaaaaagctcgagcttgctctaaatttggataagattcgggaagtcagtggcagtgagaggaaaataaccatgtcggttacatgagaaattgacaggaaacttccccaggttgtgtgtgagctatggcttagccagtgcccactggctctctgtggctgtgttttcttgtgaacgttgctgattgggtcactcacttgcagaacccaaattttaagagatgcggatgtttaactaaatgccccatccttataaaagttgtttgcttgttgctgaggctcatatagactaggagaaaaccagggagagggaagtcttaaggcaaaaaagatggagtctttagatcaggacttggatcaggaccagaaacaaatggcactaaacgctgggcactgctggttaagtgggttacttgtctatggtttttgagcctcagagcatttgggctgtcacactttgctctgttgttccttcttccctctcctccccaggcaaggctggaagaagaactgtgagggcagagacctgtctgagtggaaaaagggatgtgaggtttcatgaactggacagtaccaaggatgcttcatgacaggccctagtgagagtggtcatgtcatcttctcctccatcctcctgatggtccttctcaaagttggagagcgaaagttaagctatatttttaaggaaataaatatttccatttaaatgtcttgacttcaccctgactcagtttcaatgatgtcataatagcacaaggttaagacttga

SEQ ID NO: 58906 - DNA, 888 bp, Bovine  19866880953675
accctacaaagaaaggaaaacaaaaacatttcaaaaagaaaacaaggccaagaaaaccaaaagaagccaagaggcaagggcaggagaggacaacctcgtccctctgtccgtggtccacatcctctgggaccctctagagccagggttctcaaacgtgcatgtacagagggatccccttgggtctccacatcagggtgcaagaaagaagtaaacttccagtggagatggtgagcccaaggaccaagaaggagactgaagggcctgtacctgagatgctttcaatctcagaatctggtttgtccaaagacaaagggaaaacctcagtcacaagataataaaacttcagaatatagcatcaggaggaaaacaaaacaatatatcggtttcaatgcactcatgataacttgggggaaaaaaaaaagagcaaatccacagtcaggccaggatccagactaagtgacaggttgaagtttaattaaactagtcaagcctatataaaagcagaaagaatttcaaaggagaaggggacactgggaaaatcaatacagtttcattgcagcaggaagaggcacccaaactcaaggtcagacccagggggcttgtccagtctctccaacgctctttccatccttctaaagcatttcttactggtggaaaataaactgtcactgaacttgcagatgattatctctacgcaaaaactctgacaagactttgtcagtaattctagaccagttgcatctggagaggagactatggcagagaaaggcagacttttatctgaaggcttcaaaagactcgggtttaacaagaggtacagtggaggtgcccataggaaaagggatatttcagtgagttgtggtcacatgttacagtcatcctttggta

SEQ ID NO: 58907 - DNA, 1320 bp, Bovine  19866881001837
tgtgtgcactttcccaggcctcccagggcatggctttgtttctgtcctgcattttccttctcacttcctgtgcttcccaccccaccctttttttttttttttttttttaccttcttgatttttatttgttgggatgtagttgacataccagcttcaggtgtacaacataacgattcaatatttgtgtctgttacgaaatgaccacaataaatctagtcaacatccatcaccacgcataatgacacatttcttgtgttcagcactgttgaaatttactctcttagcctctttcaactaatccttcctccccttctgtgatggtgcttcctgagaaatagattctttctcatttgtttgttttaacccacacttcgcaggccctgctgcctttatcgtcagccagtcctgtttgaccgtcatttgcattggggataatcatgacatatgttatatgcactattacagtttttattttgaggcttgtaactaaaatgattcttggaatggaaccttggaaacaccagtcttgaaactggtctggtgagggcatttgaaagacttgaacttcgggggaaaggttttgaggtttattttggctttcctttcccatggcagcaccttggaagtcactgaaacatgaacttgtgttttgataactttttccttgaaaatggacattgtacatacacagaacagaattaatgtttgcttttttttccccccccttcaaattatacttttgaaagacctttaaaggaagttgagtttgtgctgggtggccagtctgtttctgtgtaaatcctgaaagattggtcatcttgagtctgtgctgttccagagggtcatgtcgggtacttcctagctatgatcctgcatctgtgaaaatacacaggagaggaggtccggggagatccttcacagattcaccccgatttgggactctttatttttctctccaaagcttcggtcacaaagaggcatcctcagggtcaggatgaagcaggctggctgttgggaggcagtggaacaggatgccttggaacaggtctgcaggaggagtttctggggttcggctcctgctcagtggtgatccccatgaattctggagccctcgcttcttgctctccactttttttttttaattctgcaaaacaaagggaaaggatgcttctctatgccaaaatgaagtttgcatatagatcttcctaattaaaaaggagcccagttttcttgccctggtagacaggggagcctgcttaaagcattggggtaggagcttacattcctacagactcatccagagcaaaggatctttgtttc

SEQ ID NO: 58908 - DNA, 1592 bp, Bovine  19866881007682
attgccggagaaataccaataacctcagacatgcagatgacaccacccttatggtagaaagtgaagaggaactaaagagcctcttgatgaaagtgaaagagagtgaaaaagctggcttaaaaatcaacattcagaaaactaagatcatggcatctggtcccatcacttcatgacaagtagattgggaatgagttgaaacagtgacagcctttattttggggggctccaaaatcactgcagatggtaactgcagccatgaaattaaaagatgcttactccttggaagaacgctatgaccaacctagacagcatattaaaaagcagagacgttactttgccaacaaaggtccatctagtcaaggctatggtttttccagtagtcatgtatagatgtgagagttggaccataaagaaggctgagcactgaagaattgatgcttttgaactgtggtgttagagaagactcttgagagtcccttggactgcaaggagatccaaccagtccatcgtaaaggaaatcagtcctgaatattcattggaaggactgatgctgaagctgaaactcctatactttggccacctgatgcaaagaactgactcattggaaaggaccctgatcttgggaaagattgagggtgggaggaaaggggtcaacagaggctgagatagttggatggtacccccgacttgatggacatgagttcgagcaggctccaggagttggtgatggacaggtaagcctggcatgctgcagtccatggggtggcaaagagttggacacgactaactgaactgaactgaacggggagcttagcctggtgctcagtgatgatctacctagggggtgggattaggcattggatggggcaggagactcaagagggaggagaaatatgtatacatataactgattcacttcattgtacagcaaaaactaacacattgtaaatgaattatactccaatttaaaaaaaaaacaacaacactcattttaaagatgatgttgaagactagaggtaggaagcagcctgcccaaggtcagctgactttttggaagcagacctgagggtcccgacttccaattcccaatttgagatcttcccactaattgtactctgatctgtggaaagtttatgcagacagacagcagaaatgtacactccttctgtgaggtgtagcttgagcaaagtggcaacaatcccactcaaggccctaaagaaactcttacttctcattgtcaagattaaaaaacaaaaggagcaaaatgcttccatattcccatcacaatatagtccagagaaacatagatgaggccaaaatcgaattatgtctttgctcagtcctacagagtacttggcatttctatttcagcatgttctggtattcccatatggaattaaacacatagggcacatttaatttcagacttagaacaaatcagatgtgccaaaccacatagctccacctcaagataatttcccccagtgggagaaaatgtaatacagcagcagccaaagggtgttcctgggctgaaaacacccacattcctaacctaggtcttacgacactatcatctgtgcatctccccacct

SEQ ID NO: 58909 - DNA, 1244 bp, Bovine  19866881019864
ttcatggaagacaatttttcccatgaacccacatctggtgggtggggctccttcccacatctggagtggttggatggtttcaggtggttctcaaaagtaacatgcaacctagatccctgccatgagcagttcacagtggggtccatgctcctatgagaatcgaatgaagccactgatctgacaggaggcggagcttaggtggtaatgcaaaggatggggagtggctgtaaatacagatgaagcttcacttgttcacccaccagtctgtggcccaagggttggggccactgctgctagtccattctccagagggatcctgacagcatgcttcccacacctggtgggtggggcttctctccctgtcttacctggagcaggtatctcactttttctgcccttttgtacattattcacttccaaccctttcatggtgttaagcttccagtattcggatctagtatgaaaattccttatctctcttgcatcattcccttgtgatttaatggtgtgtttttaggctattttctatgatttctaaagctcagagagtacatcatctttttttacagatgggtccttagtccttttaggggagggaggagcatcatttgagttagggttccaaactaactataaaagtcatttttttaaaaatccaggtgctctcctgttaccagccttacttccagactccctactgtccatttcctgccactgagcagctcacacacttatacattagattcattgtctggcatcttctttatcagagaatgctccccagcgttggaattttcctgaccagcggtttccttcagagtcatggtcaccaagaggactttctgggtctttaggaccaggcatctggaagcctggaccaagggccccactcagccagcatctgagatctccttcaggtccttaagaagcctcagtttccccatctgaaaaagtagggcaagaccatcagtcccagccaggaccaaaactctgtgattttcgtatgctcttccagatggcttctatctgccagtaatgtttgtaactgttcttcctccaaaaatgtccttctttccagaaagacatacagaaacaattaacagaatattttaaatacacattagatttgctcatttattcccctcaaggactttatcttttgaagtaaataggaggtaaattgaagggccagaagaggtagcttctacctgaaaacaacagtgatgacgaattccgacctaaat

SEQ ID NO: 58910 - DNA, 1986 bp, Bovine  19866881126462
acaccagccctcccatccccaagctgcaactcgaggctggtgctgggagtctagttctgtggtccatttttggtagttctggatacattttaaagttccagaccaatctaggacgccacaaatttagctggagtcaaccgccttgttctttgccttagcccctctgagggcttctgtgcctgatcagccagcaactggtggggtcagaagatgggccaagatagggttcagaaagctgatggaaaagaagcaagcagaggctgagaggtgggttctgaataaatactggatggatggatggatggatggatggcgtgagactgcataggtggatgaatgggtggtggaataagtgagggagaggcactgagggggattggcaccaatgcctgtcagtgagaggatgctgaataagtatttgccaagttgatgttgaagaaatttgagagagaaaaaaatgagatggaagaatataaagagaaaatagagcagggtggaaaatgactgagaaagaaatacaaagaaagaaaacagtagacaaggaaaaagtgacaataggaaggaaggataagagggagagagggagggaaccatgagaggtggatgtgacagacaacagactgagacacaggtgaaaggggggagtgtcctgcctatagttcttccatatcctttgctagagctgcctgaagttccaacactggaattagaaactttgtgtacatgtggtgtgtgtgtgtgtgtgtgtgcgcgcatgtgatgtgtgttaaggcactgacctctactaaaatccagaatttcctgaactagtacaaaaccggaaattattatcaggtcattccttcttaaagccaacctgacagcagtgtttggattcagttgccttgaaaagataagtaagtaagcccaggccaggtccgtgggctgcatttccagggcagtgatgggaaaggtaaacagcagagaaccaggtcctgcaacagggagttcagttcattcactcagttgtattcgactctttgcgaccccatggactgcagcacgccaggcttccctgcccatcaccaactcccaggagcctactcaaactcatgtccaccgagtcggtgatgtcattcaacaatctcatcctctgtcatccccttctcctcctgccttcaatctttcccagcatcagggtcttttccagtcagtcaggtcttctcatcaggtggacaaaatattagagcttcagtttcagtgttagtccttttttcaattaggagcagaaaatctcatctcacttttcttctttgaaaaaataagcctttaattttctattgaggaaaatctcttttccctacaaaacatttgttttgccttgtggtcccaaatgccagatatcaaccccatccccaccccagcccatccatcagtagatttaatacagaaatttcttgctgaggcaggaaatattcaatccagcagagctggctggtcttgccatggggctgttagagccaactagtgttctgtacctcgggtgaacccacaaaaccaagctgatttagagcagttcctcccctgcactggcttgaaacctgcctctttttgccacatgcttcctgctggcgtgtggcttaggagtttacaagtggctgactagtatacatagaaagaaatcgaatcaggcaacaacgagaggacagagagggagatctttattttccaggcaatttaggtgaaagccaacatcctaaccaccatcaccatgcaagcttcaacagcattttccatggtgttggggttgtgaacacagtatgtggatggatttgaaagttgtccacagtatcctgctggtctgtttatccccacatgttgtagacattctctgtgttctgctgcattttcggagcagttgtagagtgtagtaaggacagctgtcttgcttattccaccttgggagcagccttttatcacacgagtgtttgtgtagtcattcattca

SEQ ID NO: 58911 - DNA, 1466 bp, Bovine  19866881191138
atgccccaaggcagctgtagatagtattgtttttgttcagctttggctgggctggtgtgttacattattagctcatgttccaagtctgtcaccagaagaatgtagtgagactcttgtttccatcttttgtttctcacttctgccccttccttaaccagagcctagcatctacacagccatgatcgccaagacttgaaaacagcagttttgaataaaacctatcaggctctccacatgattcataagaaaaaatggttggtgctgattccacttgccccagacacgcatttgcaggctcttttttcctcttaccccaaaggtagttactgttcagttttagaacctgtggggccatcctttctggagtatctccaagtctccactgaagctggagctgggagagagagagcaccagccatgatggcatgcttgactttgtaattcatcttggtcacctctgcctagtaaagctcaagctgcacgacttcaccgtgatccagtggttaggacttcaccttccagtgcagggggtacaggttcgatccctggttgggaagctaagatcccacatgcctgaggaccaaaaaaccaaaacatgtaacagaagcaatgttgtaacaaattcaacaagactttaaaaatggtctacatcaaaaagaaaaggaaaaaggtcaagctggaatccagggaccacaaagccctttcccatccacaaccatctttcttcatctctcactaaacactgtattttaaacctgtctggaggtcagttttgtcatctgtgaaatggggaccggggtacttgccattgtggcagcaggatcacaggaaggcaggtggagtaaggcactttgtaaattagaaagcgctccacagtgtccagttgggggcagtgaagatgaaacgggatgtcgaaagctccgtgtctgcagttaaaggctgcatctgtggaaagtgatggggttagtcatctatgctcagcgctgggtggggacttgctttccagatacaaggaggtgcggaaggatgtgggagaggatgaggtgactccctctggaccctctgtgggccggaccccaatacctctttagctgaggcttcatttcttaggccctttgaggcctctgtggttggtggatgcctgaaatgctcccactgtgaactctgcatccggagggtgggggggaggaattttcaaaagacagatgacagatgggtgtacccggcacaacccagcttctcctggagaccccaagaagaagggtcacatggcacagccctgtgttctcagacatcagactcgctgcctgacccacggctataaagacatggcagctaaccctgcagacggcactctggacccttccctgaccatggccttcccagagatgagtccataggctatgggacagtaaggcaggaaagacatcccctttggcccacatggcccctgatcctagctggtg

SEQ ID NO: 58912 - DNA, 2529 bp, Bovine  19866881266032
ttaagaagataataagggggatttttcctgtctagagatgaggcccctgggtctttgcagatggtgctattttctcagattcagaaataactgcaggagaagagcctcagctggttcctaagtcagtacaactgggtcagtacacagaccctcctgggacaggaccaagctttcatgccttgagctttgtcaaaggctcaagtcttcacagatccgtgggactccctcgcagcacccagagtccttggcaggctgggctcttcctgagcctctcgtggctcgcccagcctctcttccctgttagatttgcctgattacttgaaatgtgattgtctctggaactgaaaattttaagtggattttcattctctgctgtctcagttggtaaggaatctgcctgcaatgcaggagacctgggttcaatccctgggtcaggaagatcccctggaggaggggatggcaacccactccagtgttcttgcctggagaatcccatggacagaggagcctggcaggttactgtccatggggtcgcaaagagtcagacatgactgagtagctaacacttcccactgaggtagaaggtaattactttgggtggtgcccctactgtcgatatgtaatttctcttttaataaatgttttgacaccttaagttgactagcgttgaacctgagtaatgaaagacaaggtattttgccctattctgtattttgttattcctatcatttctcctattaaggttcattttaggtctgagaagatcaaatattttcactatctgaaaaaaaatgtctgaatttttatacttgttagcatactttatttgttttggtcacaaagggtccagaagtaagtagaaccacaagagttaggttgatggctcaggagccttcgtttctcaagatgcccctggtctcttcccagagcatcacccttctcctgactgcaccatagccccggtttctgatttgcaagcttactcatcacaacacatgcagtgaaatggattcactcatcaaacatctactgagtgtctgtgtcactacgtgctgcagagagaggaataagcaagtccaggtctaaaaaaaattattgactagtcttgaaatttcgccttcagagacatctgttcaggaatttgtatgtggaaaagaagaagcaatgggtggataaccaagcaaaaaggatacagaatgaggacccatggaggaaatctagtccctctctctgtatcatagaccccaagcccagtgacatcacgtgaatgatgattatgaatgaaccccgggaacagagccccagtaaatggagctgtcgctgagtcatctagggctctagctgaatgccgtgagttttctagatgaaggagatccggcttacagagactgcagcctacccaggtatgaccacagtcatggaagaaaggaaggtgaaggccccagtctgcatccccaggccttgggggaagggcccccactccagcaggtctgctctcagaggaggcctgcctgggttagaaccctgctccccagccccgtctgtgcaatgcagcgaggactggctttggagctggaagggcagctttcatcactccctcgaagaggaggagggaagcatcatcacactggttgggcgggaagagaagccattccccgccccccgccgcctgcctcggggttctcaagagtcccgtttcctattccctggccgtcacccgatctctgatcagtgtccagtaaacagaaaagagcctgctttatgccatcacagattaagtgacaccagctaagggctccatctttcactctttctttgaaatgaatcctcgctcccgtcactgctttgtgtcccacgggaggaatgcggtggtggttggcagggggaccggggaccgagctttttcacatccaaacactgagaagtggcagtgctttggttgccaggggttgggaggactggaaaaactaaagccatgcttaattttagggcattttcatctttatcgtcgttttagcagtggaaagagcatcccagagggaagcagcagcctcccgagagagtggtcccagcgagatgagacgcaggatgtgggcagaaccctctccagcaaagggaggggatgcctttgctgtatttcacatcctgaggccatgccctccagtcacagctcgcctttgccatccctgatttctaaaatagcctatctaggtagttgttaagaccacaacgttaatttttctagtttgggaatagaagatgaaaaacccaccacagctgcttttcagtgtagtggagagacagcaggaagccctgggaggaagcctagaaccttcgagcttggcatggctctgagcactgccactgggtggagcatggggaagcaatttttatttgtgttggcagctagagccccagttactgaacctgataatgatacattgaacccatctatacagagcaataatttccaattaatgtactgcttcaccttacggaaacttcagtttgctcacagttttcccagtt

SEQ ID NO: 58913 - DNA, 1170 bp, Bovine  19866881356042
acaatgagtcatccccactgtgcttggtggcagcatctgaactgcctcttgttttgcatgtgaaccctctggggcagtagcaagttggaagcctggtccagcacctcggtcagctggcctggaaagcctgctgtaagtctggacctgtttcagccaacatactttctaccaggcaaagaatctataccagacactgtcttggaaaacccagtcttgagaagtagtttattgatctggcagatgattaaaagacaacagagatgagctcaagtgatgcttgggtttttccatcctgaaagggaatctgaaatttccttggggggttgtcagcccgtcctgctgttgcaggaggcagatggctcctccattcagtcaaagatcatgcgaatgtccccgtctcgggctttcttctgttctcggcaagattccctggacagtgacagggtccaccctggatgcaggcagtcagaatcttgttcccgattgtgcctatgcccaaaaggagctggcgcatggtccatcacccaggctcttgccctggcccctctgcttatgggatgggggtggggtgcagttactggaatggtaaaactgcaaagttttagggctgctccaggaggaaaggagggaaaaactgacgtgctcacattgcaaagagctgacccagatccaggagtccagagaaggcatggaatttgggctggtgtgtatgaagtcacctggagttgtcatctgaaacagacattgctgaggccaaaccttgggtgacctcacgtcctgtgctgctaagcagagaggccgtggctcggggagaaattacaggagcgtcaatgctcagccagaagattatttacagcctgttcctaatgcgagggcttttacagcagtggttttgtggacaaaaatacatattaaaaggctaatgtgatcgctcatgttggcagtgacatataaccaggttgggtttcacagaacacctagagcagtgaagcgtgcttcaatctgatgacacagaaagcagttctgtgctggaacaaattgcaccctgcccaggccagcaacaggagagcctgacaacgaatttcttcaaagcaaacttttctctccttctcttacacactttccaaccctgttgttcgaattgtacgtgtacgcttttatacaccagct

SEQ ID NO: 58914 - DNA, 969 bp, Bovine  19866881507387
acacatgcaacccatccagcagaaaagaaagagcagtagtaagttacctttcagcgaaaacttcctctttgtgacattctccaagtccaccttctcttcaaagagctgcctctccttccagtctgggcttgcctgcatggtgctctttggggtggaaaattccttcaggtcatcaccaagctgggcgatgggaggatgggcgagctccaggcttcctttcctcggaagggcatagatggcctctttatggttgtctccctcccggactctgctgaggacggggtaggacagctctgcttcctcgaaggacccatactttgtaaccccgccatctccacctgtcaagcctcccttgcgttctgtctcttcaaattctctcaacattgctttgctcccagcaccctcgaccgagggctgccagccttgggatttcaggatgcttctaactggggagtcggagttttctagcgaagaagcaaacttctgctcagtggcaccaaagctgtcatctggaagtggctttgtccgaagatttcctgcatacatgggggggacggtagatgccacggtggacacggaagtgttaatggtgggagagaaagccatgagcttgccactctgcacctgggaggagacagttcaaaaataaaagctgatttaaaaacaccgcttgggtaaatccccgtggatggactgacatggatggaggcactacatttggggcagttttcctgcttctgttggtgagaaaccaaacctagatgtagttgcacaaatgcgtctcgataatccaatcatctgggtgaaaggcaggttgtgcattctgtttttctcccctcgatggactcaacttcagatgatttcagccataatgtgaacaagagaagagaaacatccttggcatggttatcctccttaagaatgaagttatgaccaagtagcgacaggtaacacagagtacaagtagag

SEQ ID NO: 58915 - DNA, 1461 bp, Bovine  19866880011971
catataagttaaataagcagggtgacaatatacagccttgacgtactccttttccaatttggaaccagtctgttcttccatgtccagttctaactgttgcttggtactaaataaatgtctataaatttcttcctttaaacttcagaaaaattctatggtacagatccttattttacaggtgagaaagttgagatacagccagattaaggaacttctctagctgttacatcatggagccaagacttgaatctaggtcttccaaatccagtgtttttctaccttacaatattgagatgaaaccacttaagtctaaataccttttgaaacagaggtggttcttttccatacctaatattagtaatttgtagctgaacaaaaaatccccatgcccaccccttgtgggcaccagtccaaaaaaataaacccatgaataggatagacagccaccttttacctgatctataatgtcagatatgaaacatgattaacaaatagaagcaggacaagccaatgcttaataacagggggaagaattgacctatacaaaactcaaaatgcaaagacaaattacaaaagtataaaacctatcttactgccttttcacaccccacatggtcccctcagcacaatgtcatcccaacatgagtcccacacaaaggtattccaattagtaagagaccttagccatctcaacatgtaaaacagcattcaaaaggaatgtagttacataacatgtcatatcccccactcgtcaaggctgtatattgtcaccctgcttatttaaattatatgcagagtacatcatgagaaacgctgggctggaggaagcacaagctggaatcaaggttgcttggaaaatatcaataacatcagatatgcagatgataccacccttatggtaaaaaatgaagaagaactaaagagactcttgatgaaagtgaaagaggagagtgagaaagttggcttcaagctcaacattcagaaaattaagatcatggcatctgggcccatcacttcatgggaaatagatagggaaacaatggaaacagtgtcagactttatttttctgggctccaaaatcactgcagatggtgactgcagccatgaaattaaaagatgcttactccttggaaggaaagttatgaccaacctagacagcatactgaaaagcaaagacattactttgccaacaaaggcccatctagtgaaggctatggtttttccagtggtcgtgtatggatgtgagagttggactgtgaagaaagctgagcaccgaagaattgatgcttttgaactgtggtgttggagaagactcttgagagtcccttagactgcaaggagatccaaccagtccatcctaaaggagatcagtcctgggtgttcgttggtaagactgatgttgaagctgaaactccagtactttggccacctgatgtgaagagctgactcattggaaaagac

SEQ ID NO: 58916 - DNA, 1208 bp, Bovine  19866880350385
accccatggactgcagcctaccaggctcctctgtccgtgggattttccaggcaagagtactggagtggggtgccattgccttctccaagtagttgtgctacaactggtaattttcttttgttcacttatttgtttagaatttcttccactctttagagactttcttccttataccttatcgtgacatccaattgaaagcgtgatgatttcttgttgatttttctttcctacctagtcaataacctatcgctttttgtaagacattttataatcccttcatctactttcttggtcttctgacacatgttctcgttggttcccttctgtgcttgatgtttgccttcagctcctctagattcatttgtccccacactttctactctgcttggctttaatggactatatcagtggcctccattctgtcttgcttctgggtgaatttgaccaatagataatgcaaaaaacagtgagtatgaaggatttattcctcagctcccttcttatggggtcaccaggaccagttgcagcaggttaggtagacctttccacacagctcttgtctcctcattcagattaatacctgctctctccttcccatcagacctgagggtagctcctcactgttagtaggtcaagatctttataaatatctcccttttaaactcttctctaattacccaatttgagcatgctctctctatccagctgggctgcagagaaggatatactacctctgcactgggattctaccactcttgatctgatttctctatattcatatgagcacctatcttatatctacaatgtttgaaatttataagaaaatcaaagcacatttaaataatacatatgtcagtattgatcactctggtttccaggtttcactgttctaattattaggtgcctgagtgggtgagtttctaatctttaaacacatttttcatggcttaaagtgaactgagaacctggctaacaagataatacataatttagaatgtaatacacaatggtttcctttcaagagctcttgtttggaaagtagtagctggttgtcaatgggcttcacaaataagaagctctgacatatgggccttcaggataaaattataaggaagtttcatgttctaagcgtatttgttttgttatacagttatatcactaaccaaaacattagacaaaatgatagtttattttaggaaattctaaat

SEQ ID NO: 58917 - DNA, 3275 bp, Bovine  19866880423871
tatatgccatgcattattctaaatgctataggtctattagtatatctgggccatcacagtaatcctataaggtatataattttcttattcccaatatataaatcaggaaactgagacccaggtagattatcttgcacaggaccatagtcaataaatcaagagcctggatgcactgccaggaaatctggtagtagagctctctctcttttttttaattagttacctatttatttttatttttgtctatgctgggtcttcgttgctgtgagagggctttctctggttgtggtgagaggaggctactctctagttatgatgtacaaccttctcattgtggtggtttttcttgttgcaaagcacagactttagggtgtgtgggcttcagtagctgcaggcagcaggctcagctgctctgcagcatgtagaatcttccctaaccaggcatcgaacccatgtctcctgcattggcaggggattcctaaccactgaaccaccagggaagtctgagccccactcttaaccattctactctgctgcctcttacctagatgataaccctttaatagctgcaccattataactcttgctatgtttcaggtagtcttcaaaatgttttagaaatattactatacttgattatggcaacaaacctacaaggatggactatttttttctctctgttctgcagataaagaaactgaggcacggagagttttactaacttgcccaaggtcgaatagaaaggactgggccagaattggatccttctagtttatagcctgtgttcttaaatattaattgcttcaactcttcacatggtacgaaagttataaatttactagttatatgtaattttgaagtgttttatcacatatacacagttatacaatatgtgttttccaagggctctatgaagattattaaatcactgatatattaaacaattttgaaaagtacagagtaagaatgtggacttggatgtaacttggttgcaatctcggcaccccttctttctaattaggtgaccttggatagtgaagtatctagtcaaacctttgaggtctcaatttttctagtgatagtgcttactttactttttatatatttctctctattttgtttttctggttccataacttcaaataccatgtgtatattcctgaatcttagtgtataatttttgtctggaccttccttctgaacttcaaacacatatctaaagtagcaactcaacatctctgtttgggtgcctactggtcacctcaaactgaacacttctaataccgagcttttgatcaaatccatcttattaatcacttattgctcctccctttcaccatctaatacctgtttctttcccagtcttcaccatttaataaatggtacttccatctattcagttgtttaggccaaaatatctagaaattcatttttgactcctcgtttcccttatccctgggtactttaacttaccttgaacgtacacaattgtgttcagaaaccaccatctccagtatttccattcttgtccaagtcaccatcctcttgcacctaggctactcatttctttagcctttctatcatgactactgatcctttgaaaatgacaactgagggtcaggttttccgctcacacttggactagactccttacctacatagccttacgtgatctgaaccctctctctttgacctcacctatgactccctgccttgctcactctgctctggccacactgatctctttgtttttgctcagacatcaagtttgtttagtttttatggattttcatctttcgttttctttcactcaagattcccagggctagtttcttaatttcatttctgtgtatgctcaaatgtcactacctcagataaattcaccctgaaattctcactttctcagaggccctaagcttcccatccattatcttcaagttttgttcttagtactaacaaccactgaacattattatacatgtttatttttctattatctgtctcctgcatcagaaaataagccttccgagggtggaaactttgtcttattcattgttgtataccagctagaacatagtcaggatatatttgttaatttattaatatatcactttcttgtaagacttagtatgatagtttaatgtattttgccgctggtgattgaatagcttataggttgtctaggaaaaatgctatttcatacatccaaaagcattattttgcttacttttatatattctgtactaatttctggtcagtgattctgtgttctacttatggattgactatcgttctagtctctagctctgttttctagtttccattgctatctgttcatttgtatgtggcatcaatatggctgataaaaacctccttaccggatgtagcccagacctcctacctggagtattgactgctctcacaggcagcaactgctagaatttcctggccttctgcatactgtgaattgctaattatttgacttcttgtatagagatggtccaataaatcttagtcttattctttttcttgattaggaaagttttttaaacgtctttctaagaggtggataaaactagcagtctttaattgcttcctacctgaagtctctttttgcctgaattctctcttttaaccaatccttgcattgctgagaataaactatggtattttatcaggttctttaatccaacagcatgtgtattctggaattagtctgctacctttccctggtatcaggatgactgtctttattgctgtttcgaagtatatgtgactttgagcagatgacttaatttcagttttcttatctgcaaaatgaaagatatttgtaaaggtcatgggctgtgaagttaaaaagactcaggttttgatgcagtttctgcctctttctagctgtatggctactaatacttagttttataagtatgctaatggccaattcaatttgagagttgaataagaaaatttatatatagtaccaacatgatcatcaaaatttagctttcaccccatatgtccatgctcagtcgtttttctcattttcattttggtgccctgagaaacctccccagacaacttactagacccttactgttcttcttcccagaaagttagactttgctcatgtatctccagccaactctttggatctttttaaaattcaattatcctgggctgcctcgtttcttagtaagaattttctctgtccttaaacccctacttttgactcctttcacagtgctgaactcatatgtcattgttcactcagttca

SEQ ID NO: 58918 - DNA, 2102 bp, Bovine  19866880513478
gagatcttcccaacccagggatcaaacccttatctcttatcaactggagtgggttgccatgcccttccccaggggatcttcccaacccaaggatcaaacccttatcactcctgcattggcaggtggattctttaccattagcacaacctgggagtttcctacgctcatctgagctgttgcaaattcttaacttgattctggagcatattattcttgattggaggtctcagaaaggtattttggccctaatagcatttttaaaatgttcccagcaagggttaggttctcctatttcactatgttactgatatcacatcagagtttttaaatttttactataaaaataaacttctttagaagctataggattattcaggtcaactacttcaatttaggtgggttttggtagttggcgctttttgagaaatttgtctgtttcactaagttgttcctccttggaagagaagctatgaccaatgtagacagcatattaaaaagcagagacattaccaacaaaggtccatctagtcaaggctatggtttttccagtggtcatgtatggatgtgagagttggactctaaagaaagctgagcaccgaagaattgatgcttttgaactgtggtgttggagaagactcttgagagtcccttaggctgcaaggagatcaacctgtcaatcctaaagaaatcagtcctgaatattcattggaaggactgatgttgaagctgaaactccaatacgttggccacctgatgcaaagaactgactcactggaaaagaccctgatgcttggaaagattgaaggcgggaggagaaggggacaacagaggatgagatggttggatggcatcaccaacacgatggacatgagtttgagtaggctctgggagttggtgatggacaggtaagccaggtatgctgcggtccatggggttgcagagtcggatatgacagtgaccgaaatgaactgaattgaactgaactaagttgttgaaattatgcatttattgtggtaatgtttttttaatctatctctttatgtatcaaatattcaaaatatttcttaaatctttatatttgtgtgttttagtaaatacattttcattggcctaatagattattgactctggacaaagtagggcagggatttctgctgttaatattttgccaggatccctttacggtgtgttcccttcctctagatcagtggaacttatatttcctatataaactcatagaaggaaaagtaataatgtgtcacttagagaaaatatacttctctaggctaaaaagaattttgacacagaaaccccataagggtcagcaaatatgggctctaacatatggtatctttggcagactgaaagtgtatcaccttgaattgtggctttgtcattatacttctcaatgacccatatcagatctactatatcacaaagtcaggggaagggtaggggcctgagaatccttatatttaatacatttattttaatgcctagctagattaaggaccactggtgaaagtaacatgcctccttgggaagacagctggattttgttcctggagatattatagaaaaagtgttaaaccagaggttagatgatttggaatctgttaaagaaactcttgctaccattctagagaagaagttacctaatttagtttagctttagttttctgatttttaaatgattagtaaagaaaccactatttgatcttgaaggaacagttattcttttctatcatgaagtctcttcaactaataaaaatgtatttgacttactccattgttgcagctcagcttggaaagtacaaagaattatctacataaatactgcttctaatatgctttgagtctcatgtggtttcctataaagttgcaatttgagtaaggaagtactgcttatcagaacttgcccaattatggaaggaggcattctcaatcctgatgggaacaaaggggattcagtagagtaaaagtcccaaaacaagcaggtttattatgtagattcagtggcattagctgcgtccctgcttttctcttatcatgtaatattttgaaacactgcataatcttttcacaatgctcacatatatgat

SEQ ID NO: 58919 - DNA, 1681 bp, Bovine  19866880522185
tcgggcactcagccttctttacagtccaactctcacatccatacatgaccactggaaaaaccatagccttgactagatggacctttttggcaaaataatgtctctgcttttcaatatgctatctaggttggtcataactttccttccaaggagtaagtgtcttttaatttcatggctgcagtcaccatctgaagtgattttggagcccagaaaaataaagtctgacactgtttccacatctatttcccatgaagcgatggggccagatgccatgatcttcgttttctgaatgttgagcttaaagccaatattttcactctcctctttcactttcatcaaaaggctttttagttcctcttcactctctgccataagggtggtgtcatctgcatatttgaggttattgatatttctcctggaaatcttgattccagcttgtgcttcttccagcccaacatttctcatgatgtactctgcatataaattaaataagcaaggtgacaatatagagccttgacatgctccttttcctatttggaacaaccagtctgttgttccatgtccagttctaactgttgcttcctgccctgcatataggtttctcaagaggcaggtcaggtgggctggtattcccatctctttcagaattttccacagtttattgtgatccacactgccaaaggctttggcataaattactcgctagcaaatgaggataaggaataatctctctttcctcttctctcgttataatagaaagtatttttgcttctccatgggatattttctttctcaattcaaagtacatatgaagctaaactctctgcaacactagaaatgcaatttttaaaaaggttaagttttactcctttgactatttatatttaaaatttttgttctcttcattatttaaaaagttttattttttaaacagctattaatttataagccagttgaagttcatatatttttaaattttagtacagtttgtgtatactttcttctgagtccataatgtttttcctagttgttcaggatctttatatatgttcttaatatatatatatatatttgtatatataaagaatttaagcaagaatatgaacctttatgtgtcatagttcttgaaaataatttgttcagtttgcttttcctgttaattcagtttggatttggaagttcaaaagtttcaaactgtggtaaagttatatctatatatctttccctttactatttcctttcatgttgagaaatctgaaaaatatccacaaaaattatcttctagttgttcatggttgacgtttttacatttgatgttttgttccacttggacatagtttcataaatggcttgagatcaaaatctgaatggatttttatccaaataaccaactgattgccccagctctgtttattgaataagcttttcctctctggacagatttgttatgcctctttatcatccatggtccatgactgggctacttgccagtcatctaggaaccatatttaaaagaagatggaacagtgattgcaagatacagaaaaaatgtgtatgcacatgcctatgtcttatagtgtttagagttttctggggaagactgacctgctccagatttccttatagctttttgtcggttttatcagcatcacctcagctatgtacataatgcaattccatt

SEQ ID NO: 58920 - DNA, 3995 bp, Bovine  19866880522397
atcagtggtcacatgactggaaagattctgttcttatttcaatcccaaagaaccaaagtgccaaaaaatgttcaaacactacaaaattatgcttatttcacatgctagtaaggtaatgttcaaaatcgttcaagctagtcttcagcaatgcgagaactgagaacttcaagatatacaaggtggatttagaaaaggcagaggaatcagagatcaaattgccaacatccactggaccatagaaaaagcaagagaattccagaataaacaaccacttctgcctcattgactactctaaagcctttgactgtgtggatcacaacacattgtggaaaattcttcaagagatgggaatcccggaccactttacctgccttctgaaaaagttggatgcaagttaagaagcaatagttagaaccagacatgaaaaaatggactgattcaaaattgagaaaggagtacatcacgggagtatattgtcaccctgcttatttaactgctatgcagagaacatcaggcaaaatgccaggctggatgaagcacaagctggaatcaagattgctgggagaaatatcagtaacctcagatatgcagatgaaaataccctaatggcagaaaggaaagaggaacaaaagaccctcttgatgaaggtgatagaggagaatgaaaaaactgcttaaaactcaacattcaaaaaatgaagatcatagaatccatctctttattgcaaatagatggggaaaaattggaaacaatggtagattttattttcttgggctccaaaatcactgtggacagtggctacacccatgaaattagactctggctcattggaagaaaagttatgacaaacttagcgtattaaacagcagagatatcactttgccaacaaagatccatatagtcaaagctatgatttttccagtagtcacatacggatgtgagagttggaccataaaagaaggctgagcactgaagaattgaagcttttgaactgtggtgttggagaaggctcttgagagtcccttgaactgcaaagagataaaaccagtcaatcccaaagaaatcaaccctgcatatttattggaagaactgatactcaggctctaatactttggccatcagatgcagagtcgattcattggaaaagaccctgattctgggaaatattgagtgcaggtggagaagagggtgacagatgatgagatggttggatggcatcacctgctcaatggacataagtttaagtaaaccctgagagatagtaaaggataagggagcctggtgtgctgcagtccatagaatcacaaaaatcagacacaacttagcaactgaacaacaacaaatgaatcaccaatgtcagagaaacttaaatgtattcccttatatatttttgatgtatatattattctcttcagtctgaattcttatatttaaagatgttagtattactcttgcaaaattgggctggcattttttactaacagttacatatactatagccacaaaagatgcttatacaaaaagctaaagtgtttaattctgaaggaattataactgatatcaacaactagtctatagcatagctatctggctatagattggcaatagttgctctaaataattcttagaattttcacactgatccataaacaaaatagaactataactatttctaaaattatcactgtattcttgcagggagtaccattctttctactatatcactagtctgaacactagtgctagtaaacctagagtaatctatctgaggaattttacaaagtagatccccagatctcatcttcagagaatctgattctatagatcctcttggacactgtattttcattttaaatgttctctggtgatttgaggtgtactaacacttagaactactattataatagtgtatactttatctagattgagcataaatacacacatattttcttaatgtatcagtaaaatgtctaataacacattttgaaatttctattacagattgctctttgggtgactccaaaatatcatttgagtatattttcttcttaattttgcaactctgaatacattttttaaccttggatgagtgagcagaagaggaagctgaagcggcaaaaaaaaaaggcacttgggactttgtagaattaccatattctataacagctttctcaggaaagataacatgtgctgttgatacactgatgaattagttcatggctttgctgctgatgcctagaaattaaatgaagagttctaagttctggggacactttttggatggaacacgttggtcttccatggaaaatgccatcatctaaagcttgtatttcctaaattattgtgcaaatttattgttgtggaaaaaaatacttaatcaggtatttatttatggtgcttccctggtggctcagatggtagagaatctgtttgcaatgcgggagacccaggttcaatccctaggtcaggaagataccctggagaaggaaatggcaatccactccagcattcttgcctggagaattccatggacagaagaacctagcaggctatagtccatggggttgcaaagagtcaaacatgactgactgactaacacttccacttatgaggaaacagaaaaattaatgaactttttctttgcaaaagtaaggaattccacctgaacaagaatcaaggtaagtctggatcattacactaaaggtattttttccctataaattcaattttcttataaattctcatgaatttagcacaaggtgtatttctagatgttatgttctaaatgaattcttcaaagagtatcactgaattttattatcagaaagaagagaagattatgttatctacaaaaatctttactttattggcaaataaacagaggtttaaacaacctattttattcatagtcataactctagttgttgacattgaaagcagatcatttattgcctggaggaattttatttctaccacttcacttttcctaaactatgttcttaaaaaacacgggtgtctcaaaatatgtcactaagtatttgggaatggggaaggtataaaaatgtgagtaaatttgttttgaatttccataaaaggtaacagtggacagtctttcttaagtgtttaactacatacaattctagtcataatgagtattaaaattttacagaaattcataaaacactttgggaaatcatctttattctttgtggctgaattctgccagcatttctgtgtaattgtccccgtggaggctttggtgttaaatcatgctaacttggtgtaggttttttcctgttactgtttggacagtaatatccaaaacttcactagtgaatagacaagatattgtactagagttcaaagatgtaacactctgccctaaagggctttagtaagtcagaggttcttgggggaatatttttgtagtttcaatttctacacttgattttctgttgcagtctgcaggagctgttacatttgtgtatgagatcaggaactaagcagttacattattgttactactttggaaatttttgaccttggtctatatagaatatgcctacacttgctttaactgtgctaccattacttccatttcctctatttctatttttcatttaatgtgccttaaactacacagataaaaggattatcagaagtccaaagtgttgtattattattacaagcataaaatctcttcagttcatcagtggaagtttgatccattgaccaaaatggtctaaattttttgaagtatgctaccaacatatatctgaggacttataaaaattttgaaggacatatagagaagtgtattctgtcttttgaatgctcaaatgtcagtttctaggattatatgtttagtttctctaaagatattttgaatatagctttcccccttatctcctgagatggataggtttaattatgtctatcaggcttctctctaacagtagtcagacaaatagttaaagttgcttgtttcaaagaca

SEQ ID NO: 58921 - DNA, 2701 bp, Bovine  19866880617601
acaagtgattgtagcgttttgctaattttggcctacagacatgaaagtgttttcctccttgttcacttatatacagatgttttgatgatgaagttcaccattcgtgctgaagaaaggagagtgcgagaattttcccaagtgtttggtgttaaaaattttcttgtgcagagtctttcaatttcttagtgagatcattccagtgttattaaaaatattaatctaccatgatctttcatgtcttccacaggaatttaaaaaactaattctgttcttcaaaatgtcagaacattggatgctataactcttacttaaatcttcactttaaaacttaaggaattgaaaaatcatttcataagctattttttaaaactcatttccccacatgaatatctttattttccataatattctttccttttatggactaacttctgccaacacactatttgctttcattgtgtataccatgctgtttgagaattttgagcaattgtagatagctatttatgagaattcctacatccttcaccctcaattcattgagggtttcacaatgtcactgctttaccatcctaaaattacattatggcaattcacaagggtcaggagggaggataatgtaatgggtaagaaaatggaccttgaggtttaaaagaccttgagggttagaaatgttggacatcttaggcaaattatttaatgtctctctttcttccttttgtcatctgtaaaaaacaaaaataatgataataatcaatcccattgccatgagattaagtgagatttataagtaaagaatatcacacaggtcagaattcactaaatataagatattaataagatttggtttgtcactaaaaaggtgctagagattttatgcaaaactagattttttttttctgtttgacacgttattttgctttcctagtgtaatttattattttataactaccattataagttattccacaattagtcctcatttctgatgttgtcgctttccagttgcaatgtagaaatagcagtttatcacagtgaaattgttagtcactcatttgtgtccgactcgtttgtgaccccatggattatagcccaccaggctcctctgtccatggaatttcccaagcaagactactagggtaggttgccatttccttctgctgtttctgtcccaacccaggggttgaacctgcatctcctgcattggcaggtgccttccttaccattgagccaccacatgtacaccacatgtgtacatatatacttatctattctttttcatattcttttcccatataggttattacagaatatttagtagagttctttgtgaatatttataggtccttgttggttatctattttatatatagtagggtgtgtatattcggagaaggcaatggcaccccactccagtactcttgcttggagaattccatggacggaggagcctggtgggccgcagtccgtggggtcgctaagagtcggacacgactgagcaacttcactttcacttttcactttcctgcattggaggaggaaatggcaacccactccagtgttcttgcctggagaaccccagggacaggggagcctggtgggctgccgtctttggggtcgcacaaagtcagacacaactgaagcgacttagcagcagcagcaaaattataaattattttcatgggctttcagggtctcttgaaaattattgaaactgtgaatgttaaatccacaatactttcacgacccttatctcagctctaccctttctatgaatctggacaggttacttacctgagtctgttgaactatctgaaaatggccatgtcagcagtacctaccttacggggtaccttactgggcagctgggttgattagataaggaatacgcacagaaagcttagaacagtgtctgaggcacagtgagtgctcaataaatgtcagttaatatcatttgagcctcatgactcagaggtatttcaattcccgtggtttgcaggtacagcatatgccatatagtagaaagaacaatgaacttggaacccaggatctgggttcaggctctggttcatactgactgagcctcgtgagccacctgtcttcgggggccttggtttaatccgtaagatgaggacaatgatgctatttctgtcaacctacattcctgctgtaaactaaagagatcacatacttaaaaaagattctaagtataaaacacaatacaaattaatgtactgtgactatctactgggaggcagcttagagcaatggttacagatgctgagcatagacgcagactgcctgaattcaaatcctgcctctctagaggccagtgaccttgatccaatgacctttcttcattttcctcatgggtaaaactaggataaacagtactggcatcatttaactgctgatggacgaaatgagtggatacatggaaagcacttagaacagtgcccagggtatttgcagtgttcagcacacatcggatgactgatgacatcactactgtggttttggccatcatccccctggtagcagccccactgcctcccggcctgccccttggagagcaggctctttgccttacccgctgccccgcggcccgcccttttcggtgccaatcctccacgagggccaccgcctcctcaccgctctcagggggggcgggcctggacccaggcctgggcctcctggggca

SEQ ID NO: 58922 - DNA, 1365 bp, Bovine  19866880633158
ttctaaattactttttagagtgctggctattaatattttaggtagctttgatgttttactttatagtcttcaattttattttacatttcacaggttctagttgcaaataatcctacaggcaattttctcacactgcaactattccttgaaagatatgctaatgcagcacgacacttgcaatactggggggttaagttaatcacccaaaatgagttgtattactgtcagcagtgtataaagacatcccatagtgaattacaaggaaggctagctttaaagctgcatttcaaaaaacacccaaagctggagatgaacaaaaataagcatttatttcaaagtccattgagctaaagaatcaaacatttgttatttctggtctcaaagttacccaggataaataaagcgattcatagccttttcaaaatttaattaccaggaaaaccctcataaatagcatactccatttctgggcaagacaaacactgcagagcagcttctgtcttcagatttgtctgcagagaaagaaagaaatcactattttcctctgtgtttagctgaaccacacgccagttctaaaatcttggggagcaaattgtgatccgttcctccatcagtgaaagtgatactcatgacaacaccacagtctaaagattactttgccaaaaatcaggaggcagtacattgttgcatgtattcatcaatttctttccactgttcagtttttacttgtgcttttaatgtagtttaaataggagatttaaagacctgccaaatatatgaccctttcaaatctctgaaatccaagccacttgtaatgctattttgtatcaacctcataacagagaaggcacatccagccacttgaatttctcgtctgcaatattccttactttattcttaggagaggttaacaataccttgctcccatgcccagatgcccaatcacactgcatctttattttctatatgccttcatacatacaaaggcaagaacagccatcaccatcaggcttgattctgattggcagcatcgtacgcactgccacagcacttttccatatgggcagcagattaaggactttcaggaagctttaatcctttttgtcagagggtacttttcagttgactggctgctcagaggccaactgaggtagagttgcaagctgcattttaaagcagcagcaagtctgcacttacactgatctagatttctcttttctctcttgcaaaaatattgaaataagatttagttgcagtgttgtgatatgcatttttatgagagaagaaatatattgtgaaaagagcattacttcacttgaaaagatcaagagagcggggaaagaataaaggtttaccaggaacata

SEQ ID NO: 58923 - DNA, 1546 bp, Bovine  19866880711263
tcaggaaacaattttggctctgaagtatggtttattaaagttgtatgatagtgttaaaattgatggaacttaggacctagccttttccaaaggcctaaagagaagagtaaaacaatgaggcagtttattcttacagatatatcaatgggccagtcaaaacaatcatactctcttaatagagaaaacacctcacaaacttccctaaaaggtaaatagttaatcatttaagtgatttattcaaagaataagcagaaggtatcagggtaaaatcttgatcacatgctttgtgatagatattttgttaagtacttcatttatatcatatctatactccaaagcaatcaggatgttcatttcaagacacgaaatatggaactttatggcaaacagtctctattttcttgagtatttttctgcttatcaagcttagaacatagccaaatgtctcagataaccatctggtaatcattcattgaaaaccctgttttctgtcttggcagaagtagatgtgtgagtaattctcaatcactgtatctcttggacacattccctgtcaattgagataaccccacatgtagcagcagatcttcactagatgaagaaagttaaatcctcaccagaaatttagccatattagtaatctttttttttcaggcaatattctggaattcaaaggaaatcaggtcaatagctgttggtgttaaataacgccaagcttaagaaaaagccaaaagatgtctgagtataccaacttctgtagttcagccattgcagaaatcaagccaggttgcagggcccggggaagggggcagaggggaacatttttttttttctgatataaattctcactaaagtttcagcatgttttgttggcaaatatggcctaaagaactaacttgggagctggattctgaaacaattcttaggtcagaatatgcaatggaattgttacaggttaggataccagaaaaaaatattgtagatatgtactgaagatgatgcaatcacttggtcacatgtgctaacaactatgacatgtattaagcagactttctattttttaaccattataagatgatttttctcctctatggaaaaatgttgatggtatggctgtgtgtacatgcaggctctttttcttctctgctttcctcattagagcttcaaagttaagtaattatgatataagagataatggttaagagcacttatatatgggaacagaaagacaaaggtttgcatccctgttccttggtggctcaaatggtaaagaatctgcctgccaatgcaggagacccaggtttcatccctgggttgggaagataccctagagaagggaatggctaacaactccagtgttcttgcctggagaattccgtggacagaagagtctgatgagctacatacagttcattggggatcacaaagagtaagacacaaatgagcaactaatattttcacactttcacttttttccatctcttaatggctctgtgactttatcaaattgtttcatatttctaacttaatttaccttatttataaa

SEQ ID NO: 58924 - DNA, 1724 bp, Bovine  19866880859507
cttccatagctggaggtcaataactaatgactaagtctgaagttaagcaataaagtgactatctctgggaagaaaaagcaaggattgtggtgagggaggacaggaaattgatctttttcaaaacaagccttgtggaaatatctgactcttaaacctatgtgatgtgttagtttgatagactcatattaaataggaatctgtttttgaatactgaatcatttccagcctgataccattgtgattttgagattagatgctccatttgttattatttttcagtcgctaagtggtattcaactcttttccaatcacatggactgtaacccagcaggctcgtctgtccatgtgaattctgaggcaagaatattgggtgggttgccatttcctcctccaggggatcttcccccagccaaggatcaaacccaggtctcctgcattacagacagattctttacccctaagcgaccaggaaaacccatcctgttaaatatgtctgttttttaatattaaatagtttcctgcctgataccattgtaatttggagattagttgcacactttgatatttcttattgacacacattcagcaaatgctgtaaatcagcatatcattagtatttatattagcatttctgtgtaggaaattccatgaagaggctgtaaatttcttaattagtctattgcaaaatgaagatttcactgataaagtagtatatttgtgtttggagttgccaaatatgcaactctcttagaggtaacatttcaagaaaaacacagctttcaatgtgagagatcagttttcaagaatagttggcaaatgatctgtaggtcagttttctttaaaagaagattttatggatgcatctaagcatgacaagtaaaatgatgaaggtgtgaaatagctcctattagtaatgggaaaaacacataccctgttttatgtgctaacagttctaatgatctcattgagattcaggaaactatccaataagactatacctttgcaagctatttaatttttttttgcaatctcattggttttccataacttttcttcccacattccagttatgcagcaatggtgcttctagtaccttgtaggaatacaatactgaagctttattttagggttccctgctattgaaataccacattccggtttttaccacattgtagtactacagtctctctacttccacagaacattggaggcctgtaagggctacaaggtgggcattaccattaatcttgatatccaaggctaacctctctctggagtgttgttcattccattctttttccctaaaacttctactgttttccattttgactcttcaactttttcctgtccttaaaggtcaagctcaatactcttttcacccataaatagtaattcactattccagttataaatatcttactattactttgtaaattatttaaaaattgttttgagacttctcatgtcatagtgttgaatgttaattcatgtaatatttcattttcatttctatttgtacttatctactaaaccaaaaggtaagctctttgagggtaaggtgtattcccaacatatttttatatgaccctgtggttcctgcatactgtcaacactggataattttaaaaatttatttagcttcattatttattaatatatgtgccagacacaatctagggacatagtgtgaataaaagagacaaaactaatgctgatgggcattg

SEQ ID NO: 58925 - DNA, 845 bp, Bovine  19866880870879
cagcaccgtcatttcacaaacatacctacatgagatgggaagaaccaccgctgggttgattattccaaaacatagactctgaatactcaaggctgcttctgtactattttcaggatcagtgatttcaatattatgtgatctgaaattccttcctgccggaatctaactttccctttcagaagattctgtttctccacccacactaaatgacatttccttccttcaccaagagctgtacagctgttacgggctgtcatgttagatgtcatgggcctctagcatttgcctcccacccttcctgcggttacctggtgaatgtggagaacaacataattctcttagtctttcataaaggctcaagtgacaaatgaatttttctattcctgctgctctctaaactttgggaagtatcaagtgaaccattagccatttcatgatattcaacttgggtaaccagactgggagcagttgcaatttaatgccgttttaaatgtatagttataggttacactgtttctagttatattacagttttctaccatagtttcatttcattgtgctgttaataaatcattttatattaatcacattataataacttttacatttccattattgttttttatttctttttataatggttgtaaaattaatgagatctttgacactgtcttgggaagtcagtaaggttcccgaatggccctctgcaaacttgtcattatgcataccttgcccaagtcatatttgaacatttcctgaacacgtaagagtggacaatgggttactcagtcacttcaacatgtttttttatctgtaaattatatagaatatataaatctagcaat

SEQ ID NO: 58926 - DNA, 1125 bp, Bovine  19866880881218
tgcctctttattgtgaatgtcaccttacagttgaaacgagtttatgggacactgcttttccctggtgttcttcactcagtggagaactggagaacctctttctcagacactgtgaatccactagctttcatcagtttgaaatgcatttaaaatcaacatcagtctggttgcaaaatttatagtaactccagctgtccatatattaactctatatgtccaagactcatagtcctgtgagtacatatgccaattacatatgataaaacaagaaatgaacaaaaacaattatttcttgataactatgtttgagaaaagagatgaagatgcagaattaaaataattctaatcagtgtcatagagtaaaacaactgggtatattatcatgaatgtaaagaaagtatatacatatagaagctttatgttgctgcacatgccaaagtgaaactattaaattttgatatcttccctgaagaatgctgaaaatctttcattttcttgtgtttgatatttctgaaaccatcttttctcacatctgagtttggttagttactatttcaaacattattatactgaaactgttattatactgaaaattcaaataaaatgattttgctttggtctcagattgcacacaagattctccaattattaatgaagaagactcgattttttccatattgaagccagtctctttaatgcttcaggactaagccacaaatattttctggttttaattgcatgttactaatgtcatcaaagacggtatatttttggtttttcattatttccctgattggcaattacttgcccggaagtggtaagtacttcatgacgtagtgcttataaaccatctgcatgaatgtataattttgctgaatatggttttgctacattggcagatgggaacacaacttgatggcctaataatgtcctttcccttgttggcattgctggagaaagttgtagacaattttggttgtgctgaaagatgctttaatattgtctaaattagagggagaatcaagtgctggttgtaaccataaaagggaatgaagagagagcaaaaataaataaataaataaattgggagaaacaagaaaagggagatgtgctatcacacatctc

SEQ ID NO: 58927 - DNA, 1101 bp, Bovine  19866880924548
cctgcagtgattttggagccccccaaaaaaatctgtcctgtttccattgtttccctatctatttgccacgaagtgatgggaccggatgccatgatcttcgttttctgaatgttgagctttaagccaactttttcactctcctttttcactttcatcaagaggctctttagttcttcttcactttctgccataagggtggtgtcatctgcatatctgaaattattgatatttctcccagcaatcttgattccagcttgtgcttcatccagtccagcatttctcatgatgtattctgcatataagttaaataagcagggtgacaatatacaggctttgccatactcctttcccaatttggaaccagtctgttgtcctatgtccagttctaactgttgcttcttgacctgcatacaggtttctcaagaggcaagtatggtggtctggtattcccatctctctctttcttaagtcaagaagtcacgacaaaaatcttgctttaagatttaagaaaaattgataatggtctgcttattgctacaggataagaacttttcaatattcatttcattgagcaccatattttctcattaagcagagaaaatacttctcaattttagttttatctgaattatatatatatatatatatatatatatatgcattttattcaacaggaagaagtcatagctcttgctcttttttcttcatataaaaattttgaattttagagagaaaactttaccatttatactgccatctctgtcaaagatatcacttgtctactaaaagaacacatacaagatggaggaatctcttctgtaagaccaaatgataacttaagtactattgtctctgcctttgacgatctgtatgtgtggaacaaatgagggctttaggaactgctcactctacttttgttcagttacagctgattttagggttgtctaaatcctgagagatttgcttttctcatatatcacaaagtactgtcaattcatataaatatacatctttgttgggggacctggtggctcaaatggtaaaagcatctgcctacaatgcaggagacctgggttcaatccctgggtggaaatatccctg

SEQ ID NO: 58928 - DNA, 2611 bp, Bovine  19866880926264
cccagttgcactctgggcatcaaacaatagctattatgaaaaacataactagcacacatacaagagctcaaatttcacaaaacccacactttggatacttttatgaatcaaatctataaatatttagaggcttccctggcactaatcaccatcaatgctttcattgcaaggcaatacacaccaggaattttcatgagaggtatcatgaataggacagatgcctttgttcataaatcaggtagtgacctcaatcattaataaacaaatcagagccagagcagcaagagactgtaaagagtaatttggtaaggaattgaataaatttattcaacacaaatagtcaaaacaaagaatttatccttaatcctgccatgctaatggcttctgttaaaatgaaaatgattaaatcaaatttggctttaatttgttgtggctagattcagtttttcccaatgtgataaattactgtgagagcaagtcaaataatgtgaaatttactatcagcctgctcttgcatgaaagtgaaatgaaacaagaaacaattgaagagttatttagcatatagttcactgaattcaagaaggaaaacatattcttaaaacctaacatacctttactcttatttctctgttgttaaagaaagaattacttttacatcaagatgggtaatcttccatgccatggcttgctgggagcttcttggagcaaaccatatctgtgatctggacaatctttcaacttcacagcatcacagaatacttcttctgtgagacatgccaaaaatagtttgtgccaaccttctcagtttgtaaaccaggaaaatgaggccctgaaaaatccaacaacctcttcaacttccacttgggtcagagccagaagttgctttatgttctgtctggtccacatgggaaaactgtgtgtgtcagtcacttagtcacgtccaattctttgtgaccctatggactacagcccgcctggctcctcagttcatggtattctccaggcaagaatatcggagtgggtagccattcctttctctaggggatcttcctgacccacgaatcgaacctagtctcctgcattgcaggcagattctttactgtctgagccaccagggaagccccaaatgggaaagagagatagaaaacaggtggagagagtaagtagagaagagctgggttatctaaagttctcttctctctagttaagtaggtattaacttagtcttcagctacctaaagactctgtactaacttctatttcttcattattttaaaagttgtactaggatagaataatttggacttatgaactttatatatttttgaagaaattatttcaatgagtttgtctgtttttgccctttcaaactttcaaagaaattagtgggcaacatctgtctctttccatcaggaacagcaacaacaaaaaagtgggagtgtaattgaaaattgtgggaagagaaagctgaagtacctgtgagcatagcagaaggaaaggccacagcgggtgatgaagtgtcacagtagaaaggaggagaaagataatcagaatgactcagaaattttcacttggtatcgaaacagaatgtggtaaatttcatccgtcataaggaagcaggcctactagacactggcaaaaggtatttaaggagtcactctccaaagaaaactatttttataagtagaaatcaatgggtgcattccccccaccaataccgcctgccactgaatttgtggttttgcatttcacctgaagtggctgattaaatcactgacacttggagcagaatagggacttgtaatctttacagtgcgctgccctaatcaagtcagcaactgtgcaagggacagcaagacccgaatatctgtgctgacagcactaagtggagtagaaagagatgtattctatatctgaagctactctggtgccaggtaagggttatgtcagcctaagagtaaagtcaatacgagaaggcttgtcaaaggtcagggctttaatcgtgagaagtaaagatgatttgctcatactcactgtgccaacccttgccaagagcccttttttcccagctcttactcaaaatatgaactaaaaagaactgagggaaaggctagaagaggaaataaagagtctagattgacagcttagtgtcctggatagtgtaagctttgctcaaatgtatgagctggtgatacaggaagagccaataacagagcatgggtcctgtgtcttcatcgggggcccttctgattatggcagaagctctaatctttgcattggacatgtaagcttaattcttacatgtccatgtgcgtctttcttgaactcatccagaaaatccgtattaggttaaactcacagttaagaaatctccaaacaatagtttgtagaaactgggtgaacaggcttatcaacagcatgtgcacagctttcttcatctgaaatagtttagctccccagatattctcagttcttgaaacctgctcaaaactcactgtccatcacattcattttgacagtaacatatctttacattattcagtgtcaagcaacatgaatacatctttccttctctctctctttctttctttctactggtggttacaaggaa

SEQ ID NO: 58929 - DNA, 1849 bp, Bovine  19866880945405
caataaagagaccttgaggtttgagcagggaagtgaccattatctgagatatgtttcaggatgattacatcgaacagcagggtgctagatggattagaccagaggagacactgaagagagatccaaaaagacagtgaatcacacaagacatcaacgcatgaagaaaaatcaggatgagagaataaaacacttttgagtcacatccttagggattatagtcgaaggcttgcaaaggatgagtccactaaaaggaacagtggtagatccttaaagaaaattttcatttagaaaaattaatgggtaaagagaagccagagaaaagagaaggaagcaaccgccaaaagtaggtgtagtaataagagatgatatcaagtggacttttgctgtcctctttggggttgtcattgtgaattctagatttaatttttgatactcctgaaggttctagaagaacagggacgcatcctagagcaatggctacataagttgattttttttctccacccagtaaacattgcttttaaaacagtactgctttgctattcacaggtggtaaacttcagatcaagcaactgacagagctctgattaagatattttgtctttatcttttgccagctcccatcctctatcaagcttctgggaaggaggcagttgtggataagcagttttggtgtcgtccagagctttggtctaaatgtttatgatgtgctgctatagaagaggaagtgaaaagaacagctggctttattcagttgagattgaaaaggcttttaatgaaaagtttaaattactcttccatcttttaaaaaatgctttgtcagtagccctacaaatgatgaactcagtagcattttggattatgtaaaatataattctttaagttttaagaaacatattttcaagtaacttttttctcttgtgccaaacctgttttctggaattgtatcaattccatgctatattaaataaatcaccattgtctaaaaggcaacaagttttcatataaagtgatgttaaaaatattaatcatatttatcaacaataagcaaatgtttaacactgcaagtaaagaaacaaaagataatcaggggagatggggaagcaacctgtatcacacatggaattctctaattatttttccatttgctaccacctaaatttgatacattatatgctatgattaaggctaagcttgtaaacagaacctaggaaaaaaaggaagcttctattttgatgtcactttctcccttatcctttctggtaatttgaaaagtatagttgccaaaaagatttttgtatatatacccactagaaattggaacatgatcaataattctcataagacctaaacatcttattcactgcattgttcagacgctcagttgattgtatttgatgatgagtgaatatttatttttctatcaatgtgaatagttttgttaatcaagtaattttataggttaattatatcctgaaaattaggaaatcacaaaaatggttgacattacaattgcaagagtgactcagtgtagaaaaaatttaaatccattctttattctggatatgcagcaaggtaaaatgaacatcatttaaataaatgtggcaatattccttttttaacatagagtgccttgcaatctttcttgcttgcttactctcatacattcaaccaatatttattaagcaactactttatcccaggcatgcttatagatactggagaatacaaagcttaattataatacaatttcctctctccatgtgattagataatccatcaagggaagcaaacatttatacaactaactccaatacaatgtgataagtattgcaataacttacatctg

SEQ ID NO: 58930 - DNA, 1773 bp, Bovine  19866880962402
aagtatggaacaaaaaaagcataaagtagattttaagacttaattcaggtatttaaagtactaatcagaataaccgattccccatagctgagaatgataagctactgtactccagaaaataccaagctttctgtttccacagtctttgtcattgggcaacaggtttgtatattctatatcttttaaagaacgatgttgacgttatgtttagaatgagagctatatttgagttcctcacttaatgtttgtagctatgaagacttagataataattttccttatttttaccgcatttttcttattattaataatatatccacaaatatctaaatggcaaaatgtcacataaagttatcaaaatgaatatattattgtctggctcctagagttttattttttactttctaatacattttaattgcttctataatatcttgcattcatttacaggaaatagcgaccataaaatgtacaaaaattaatcttagatcagacaactttttggcatgcaaaaaatgtaattgacagattttagaattgtgaaattaagtaaattattctgataatgaaaatatgtagtctaattatctatctcaaaactgatagagaagaaatcatcttaagtctttcatagagaatagccattttagcttgtgtgtaacttcaacggacatttaaaaaatatgcttagaatctagaggatactgttttctcaaattaatactgttttctcaaattaaaactttctttttaaaggtgaaatttcagttttcaattatttgtagatcaaatagagtttttagtatgcaatggaaaacagtttcaagttgtcctctcatatgcggttctcaaattattgctaatcagaaggatcctatgcttgtcagtatcttattttaagattttattgtgtatcttaggagatcgactgagagaaaatgaagtgacaaatattaaccttgttataacatatttgtgttatatgtgtttaacactactaacatatgctattacatataacatatataataacatatatgtgtatatatatatgtatatcctattgcttttccaaaggtaatggagtctgaaacaaattccaaatttctcaaattttatgtccaatcatttctttccatactatcattgtactaagtgtgtgtttttaaaattctatcaagtcatattgctatttggttttcatgtccttgttataatttacatattgatcagacatctaaaattcttcaaaattaaaggtgaaaattaagagactataatacaggatttataattttccaacagaaaatatgggctagtaataggattattgcagaattatttgacttttaagtataaggcaacttaggctattttgaggaaaactacttttcactattatttccttcattatacaaactgaataatctgaacaaagagttaaagcacatggccattgaattttaaactggattaaatcttattattggttataaaatagtaaagcttttgaaagatagcaaccttgctatctataatatgcccgtgattttaaaaaaattgacaaataaaatgttaattataaaacttggttgtagtagatacgttaattattatgacatgaattggataccagcaggagctgggataattgatgtcagatgaatgtggaaactccctagaatgagctcagtcccagaagaagtgacgattggaaaaatagaaaagctgttgtgatgcatgtacttgtcccttgatgaaagccgattaatt

SEQ ID NO: 58931 - DNA, 1502 bp, Bovine  19866880967990
cagcataaagaatttaaggctgcatgtcattcatgcagaaaaggtgtgatggatcctaggatgcttccaaacagataaaatgatagaacaaaatgcttaaagttcaaaagcaataacaacaaccaacaaaacaactttggaaactgattggcccaattagcatagctatattgattaaattcactcagtaattccaaataacctgattatacacagtagcaagcatttgtagacaaacatcttaaaaactcaaaaggttaaaatagagttttcaaagagggaggaatggtaagtatctatccaacatatcagaaatattccccataagagaatggtttctaactgtggtctaacctgtttaagagaataaaatcagccacagctattctcattttaaaagacacgagcttagttgcttaatgctcattactctatatagaaatccatttctctctttgctgtctctttaggaaaccttttttaataatgctcagtaaattaggcctccatagacttggctttatcccaccctgccagtttcttttcctttttgtatctctgtaaaatatctgcttagagtctctgatttgaaatgttaattaaggtgggcctggcctcaggttacagtgtacatccctttttacatgcaaaggagatatgctaactaggttactaagaatctgggggccaagagggagtcatccagaagacaacaaaagtccaagaagaatggggcacttcccagcatctctcaggaagcaatcggtaagagagtgttggctgaaatcagttatctggcacacaggagggtctgatgttgatttgggccattcttttttcttttgtgatctcttaatgttgagtttatatccagttaatacagatatagtatgattatatatgtgagttatcttatctactgattttaaacagataaataacattaaatctacttgaattcaagacaaagatcccaagattttaaggtttctgagtgggatattcatttcaaattttctggccacctgaaaacctaaacatgatgcctactttgcactgaaaagagaatatctgttttcctgtgtgtgttgtgagagtgagcgtgtgggcatgaatgagtatgtgagaaaatagtgtgtatgggagtgtgaatgcctttcatatacagctcttccagcaagtgagagttagaaaggcaaaatctacatttgaaagcaaggacactgtagatgttaactttaaatcatctaagatgtaacacaaagaaataaattaatattgttgtgtaaaaagtaccctaaattagcctccagagacatgaattgcaaaataaatgcaaaagttacacctttaattactgtggtggaacctttgagattttgagacatttatttgtataaatcaatttcatagttattatggaaagtttttcaaactcttttgattataatgttgcagatgagaaatgttagtttcattattctcacacttgagatatataa

SEQ ID NO: 58932 - DNA, 1164 bp, Bovine  19866881001392
tgtccccacaaatgaattactatgatttattgttcccatgagaattttaaaagcactgctcaatattttttataaatgcttaaaatgctctcgacaaaatgaatattattatgttgccttgagattaactgtagataaaaatgcatatctagttcttttaggttataatacaatttagtttctgaacttatcaagtcaaagaatagtagatactctatacaagatttagactcttgtcttccttttggtaaatagtaccagtgaagttataatttcaaaaaaagcaaagtacacccaattttgatattattttaagacattctttgaaagtaagttccaaaggttttcttttttcaagctgttccctgaaattgggcactgattttaggattgactagaataaattatgaaagtggtattttagatacataaatacaaaaaaatcattaaatttctttccactatctttttttctgagaaatatatttaagatatttttaaattctgtgtattggtcaataatgtgcacctttacaaaaaaaaaaaaaatacgagagagagagagagaaggaatgggaaaagggaggaagacgttgtcttcagggaaagcttaagttttaccctgcttctaaacctccaatgcagctgattcaattgtcttgtctccaaacactgaagcatcttgcaggagttctaatttttaacttaaatgtttatgtataaacactacatctatatagtcatcaattccttttttacagattaatcacaataagttttgcatgtaattaataatgacataatttttaaacagttacaaccttaaaaccaggaagaggtaataatctgggaaaaccaggtataaaaaggaagcatctgaggagtggttttctggggcagctctttggtttcttgctggagtaaatggaagtgtatgattaatgaaatcttagatttttaaaacaaagtgactagctagataactgtcttaagtcttttacccaaaggggtaaacttaccaataggttctctttacactgtcagagaatacctccattctcaaatgtattaatatgtgggcataattttaaaattttatggattaatgcaaacagggacaataaattaagcaaacttaaaagtgaaatacttccttttatccct

SEQ ID NO: 58933 - DNA, 1434 bp, Bovine  19866881078313
tcacctataacaggtggtccccaagtggccgtccatcttcccttgtggtctctactgtgaattgtaaatcatgtcaggaagtgacagcctgttaggcaatgtgatctatcatcattgcgagacaccagtcacaacatgcatagacttgatccatcctatgtgcaagtaatggatttggtcaaaagactgccatttcacattttggaaaacatgaactgatgtgagttcataaatgaaatattttaacctgtgatttcatgtagatgtcactgtgtcatcacccctggaattcagctgccaaaataaggatgaaaaagtagttcatgtcagtttggatggcagtgccccataaatactgactctgaatccctagtatctatagatatattcattcattattccacaaatattttgaggatttacttagtgtcaaacactaggtctaaagaaaccaaaagtaataataatggtaaactcagagtctaagaaggggtgtgtgtgtgctcagtcactgagtcatatttgacactttgagaccccatggactgtagcccaccaggctcctctgtccatgggattttccaggcaggagtactggagtgggttgccatttcttccttcaagggatcttcctcacacaggaaaagaagcaatctcataaataaatagctatataaatgtatgttgttcagtaattaggaggtattatatgagtattagagaataattttctgagtttagggagttggaaggatagcatggaaatcaaggtacgtttctttgcagataggtgaatgcatgcctggtatgggagttagtgaggagtggcatttcatgtataggaggaaatgagcaaaggcttaggctcaagaaacagcctaaaaggtgaaaggaactatcagcagtaccacaatgagatactaggagagaggcaggcaagagacaagagtaaagaatatcctgtgaataacatataggaacctagactagatcctgaggtcaggatattctccagagtttcttgttgaattttgtatttttttagatagttttccattttttttttaatttctcaagtgactttgttttatcttcttcaaaaaaaattcaccatattcctttttattttatgctttttctttaactataatttttttttaaggttcagagtaaacttaaagaaggctgagtctcaaagaattgttgcttttgaactgtggaggtggagaaaactcttgagagtcccttggactgcaaggatatcagaccagtcaatcctaaaggaaatcaaccctgaatattcattgggaggacttatgctaaagctgaagctccagtactttggccacctgatgtgaagagccaacccattggaaaagaccctgatgctgggaaagatagaagggaggagaaggggatgtcagaggactagat

SEQ ID NO: 58934 - DNA, 1524 bp, Bovine  19866881101153
tactggaatttcagcttcatcatcagtccttccaatgattattcaagactgatttcccttagaatggactggttaggtaactcaggcctaagcaatcactgcatgactttccatggttccagggagaaatggaggctaaagggatggttcaaaacccaagactttctccttgcatgttagcactggggcactctttctgaaggatatggttacagaagcctgaactgctccagccattttgctatcatgaaagaagtgatcctgcagatgcagctggcacattacagagggcagaagtgagagaattacacaaaaatagtaccaaagcctcttctaactatggtttctacagtgataacatgtattacaaatatcatttgaacgtaggattttttatttctatcctctattaaaccaagttaaaaaaaaattttttaacaggattactaagaagataaatgaagatgttgtagatgcagaaaaacttttggcaaagcctctcacaaaacttaaaattcctttggaaacatacggtttgaatgaataatcaactaaatgccagtctccaatgccatgtcacaaggtacctggatgttcagcattcatacaatcaactggagagaagaaatagaaagtaggcttagtgaatctctaaatttgagagcagtagataatatgtttgatgagtaaatcataattttacatgatctctatggtctagaatgaataaaaaagataaatttacacatatgaatattttcacattaaaagttgtttaaataacaatggagaagactcttgagagtcccttggactgcaaggagatccaaccagtctattctgaagatcagccctgggatttctttggaaggaatgctgctaaagctgaaactccagtactttggccacctcatgcgaagagttgactcattggaaaagactctgatgctgggagggattgggggcaggaggagaaggggacgacagaggatgagatggctggatggcatcactgactcgatggacatgagtctgggtgaactccagaagttggtgatggacagagaggcctggtatgctgcgattcatggggtaacaaagagtcggacacaactgagtgactgaactgaactgaagtaacagtggatgggtggggagaaagactaagtcaatgaaaaagtcttggggttaagttggctaccaactttatagaaactcataaagtaatatgatatcgatattttaaaacctaagacattttaaagttttgattaacagaagcataatgcctacagcaagaaaacaaagatcaattctgctttttctgtggttagataatataggaagaggcttcaaaggtgtctcagtggtaaagaatccacctaccaattcaggagactcaggttctatccctgagttggtaagatttcttagagaaggaaatggcaactgactccagtattcctgcctgggaaatcccatagacagaggagacggtggctacagtctaggggagcaaaagag

SEQ ID NO: 58935 - DNA, 579 bp, Bovine  19866881171511
atgtatctgtgtacactaatggaatacctgacaatgcaagcaattcattctcaaatcactctttgaaagggcagaagccacagatttgaaaccaaatgagtctgtcacattctttcttttttgaatttttattttatattgtagtatagttgatgaacaatgttgtatttgtttcaggtgtatagagtcacattactattttgtttggctttatctaccaaaaactggataattctaataaaaagtattcaccttagggcctaaaattatactcttaaaattaacaggataattacccactttgtatttctgttttactccaaagacacaacctttgtcttccaattcccacaaagaaatgctaagaatttgatagagaaaaaatgtatcaggttgaaagctccctacattcccatgggtcccagcatctaaaagccagattgagaaccaggggtccggctctgcaaaagccatttaatgcctcttttcattggtgattcatatacacttacataagagtgctattagacatgaagttttaacctgacggttgatgtaaatctgtagaattagtttagt

SEQ ID NO: 58936 - DNA, 717 bp, Bovine  19866881224846
tatagtataaaattgtataaaagtattacggtattacaccactacctacatcaataaaatgccagtttgacatattataaagaaaaatcagttacacttcaataagcccaactctctaggaagaaaaggaagagagaggtatatagtatggctcatccacaacaagtcatcagagaccatagaaccacataattctactctgccacagcagtctttatttcaaaaggagtggtttccagcacaaggaaacatgcttccttagatgctacacttcaacagtgtgctgagacaggtaactctaagaaaaaagtagtgaaattaaaatgagaccatgtctttcatataattttcttctcctatcccaatcttgtctgcccatacatctgaaatcttacttatatttaaatattcataataagcttttgcttagataataaaaacagccttttttgggaagcctctgtgactgccaacatttgatcattaaataactaaaatgcggggtctttccatcttgatttacagtatctgaagtgcatgcagagatgccaactgcaaatttaatattcatcaaggccctggaagaataacgagataaaaataatcagacaactgtatataaactataaatctgcttcctgctttctctctttctattggaagtttcataagagaacccaggatcttgtgggggcatatctctgaccttttgaagtt

SEQ ID NO: 58937 - DNA, 1434 bp, Bovine  19866881258604
acctcttgaaatcctaacgtggagaatacttccacacaaatggccttgctattatttttaaaaatcccctgtaatatcaaccaaaatccagaagaagaaattttgcaatctatagccaattcacacttgccctggatagtaattatagaaaacttatgacttttcccatttgtaaaggctgaagcttttgaggaaataagtagattccaaatgtcaagcactcaacagagccttctcctccactaaagaggcagctgcagctgtgtctaaggatgggaaagtttctgatattagaaaagggatttactctgtccaagcttgaattgacttagggggcaaagagtcatttgttcagtgtccttctctgaaagaaagagaacattttgaccatatttctgccaaacttttttattctctagtctgaccctgtttctggacactcagctaaagaaaagcaagttgataaagacattaattgtatttttcctatttttttgactcataagtgtaatgaaaatcattctctagaaaaatatcttcttcactaaaggcatcacagaggtttgaaaaaaatatcatgctaatctgatgatcataatactaaattaaccagtattgacaatgcaaacactaagtgaattcacctctcctcccctctttacttgccttgtttctcctttctttgccttcctttttcattttcctttctcttctctttcctctgcccttctgtctatcttcctcctaataaaggaacattacatgattcaagttaaaactcatcatcatcatcataaattgattcaacatcattaagtacaatcatgtggcattatcatcatcattatctcgggcggtggagatgccaaagcatgttcctcccctcctctctttctttcccacagcttccaagataagaggatctttattctcaccatcaaactccctatttctgaacacaagcaaaaagattattttctctttccttctccctttccccaatactatacactgccaatgtaatttctatagtttcttccctttatttgttttaccagtaattatttagagctctttaactgaggagaaattggcaagaaaatttggcattggaccgcattttagatttcactcaatggtgtaaagatgtggaaatgagttcctgtgaagtaccaatgaactgcatttttctattaactatttaagcaagcatgcaagattattacttcaaagcttcatctactgcaattacgtctaagtatgccttcactgggaagatcctagatgtgatgtccaagggtcatttccaagttacaatcatgcctcactttccatagcaaaataaaatacagtcacagctcactgaaggagaggatgtgtccatcgcagggttacagtgcaagtcgagagatcttctttcagacaaatagctta

SEQ ID NO: 58938 - DNA, 1977 bp, Bovine  19866881292750
tatggtgtccatggctatttctgaatctacccttcatttttgagacagggaaccttgtagactggccaaaagaaagctcatatagatacacagacctacttcctgccatgcacccttcccttaccctaaaattagaaaagcgagcaagagtggtgtctgtatcatgtctgctatactgacataagggaagtctgcaacatcatacacaaatactttcttataacttttaatctctctcctttcaggtaattaagataaagcttatatattcaaatactcatacctgaaaattgatactacatctttttattaagtacaaattgacaattatatttataaaatatgagagtatgattgaccacatattcatttttgaacaggaataagtcagctatatcaattagcacatgtccacaagtttgaagcattaaagaaatactgaagctttgaaaatgcaaggcagttacaaaatgctaactctgactcaggacacctaacttaaagaaaccatggctttggaatcagacagttccctcttctgccgttttctctctttgtgacgtcaaataaatcactaaattgtctggtctatagtttcattattggaaataatgaaatattggaaataaaggaaatagcaaccactccagtatttttgccaggataatcccatggatagaggagcctggcaggccacaacctatggggtcacaaagagttggacttgactaagcactcacacgtagattcattatcatcaacagaagagtattgtattaatttcaaatgtatggcaaagtgtttcagttatacacacacacacaaataaatatatatatatattctttttaaaattcttttccattataggttattacaaaatattgaatatggttgtctgtgctatgcagaaaatctttattgtttacaaagttggctttaaaacagacaaacaaaaacacaactacaacaataacaaactttggttaagatcaagcccaccccaaatctttagggtattatcacactcatcctttagttcttctaatatcacctgaatagaagctataataaactccagtcacaaactcctatcattagaagtctctcatctcctcacttctaatgaagtctgttcttcagtctcattattacccctcccctccccatcccttgatagctcactattgtctcagttcatcaatccctttcctggcctcatttgcttgcctaaccagccttgacactagggtcagccactttattagattttcacactctcttgccccagagctgccattccaatccccaggaatgggtaaatgccatcatttgccttctcagctcccagtcccaggctgccaaatattgcctaagaaaatcacaaagccaggttgactggttccactacagttccaagctctcaaagtaagttgggcctgcactgctgtttgatggtactggttctcgtcaatgatttacagtcctctgtattctctgtagtgtcaattccaagatttcttatgtaatttcttctagttctcttggtttctagagaaattcaaggtcaaagcttgattcctcctctttccttctctccactaaaaatctcaacttttcatgctgatctcataaggaagtactcccatctcccatattaactttttccctaagactttatcatatcattcatctacatatccccataacgaggggcttccctggtggctcagtggtaaggaatccacctgcaatgcaggagacaaggatttggtccctggatcaggaagatcccctggagaagggaatggcaacccatgcccatattcttgcctggagaatcccatggacagaggagcctggtgggctacagtccatagggttgcaaagtcaaacacaactgaagcaactttacatgcatgcaggcccccaaacaagttttttcctggcctaagcatttccttgattttttatttt

SEQ ID NO: 58939 - DNA, 741 bp, Bovine  19866881310137
acacacttttgttttaaacacacatgaaaatttgtggtaaaatgcattttaattagtgacaaagacaagtacttaccaatatgcaacctgaaagaccatgtaaatcaaatgaaatactttaatggcttaaagaacaatttaatacagtttgccttacctttttggttaatatgtgtattatgtatgtgtttcctaaaatgtatgattaaaggagaaagtctaaggagacttcattttcatacacatagtgaataggaacaagagaaaattttcaggcaatgtatttggaaagtgtcttgctttttcaaatagaaactattggtttagaatatctctgtagcattctcaattgatttattcatttgtagggaattttggaaaaatacattttcttttaaggaaaaccagttctaccaaaacatccaaatgtattcactgatcttacaaataaagttaagacagaaataaaacagtaatttgagaaagggctattgataatttggaaataagatcagtataagtattgaggatagagtaaaacatttagaagccaaatggtactttaagagattctttgaaaagttaaacaaatacctcttttacaaactttaaatatataatttacatagagatgagagctatcacttgctttcctctggatgcctcttcttaattcatatagaattaaactaaagcctcaagttcagtttaatactagtctaaataaaacataacagaaat

SEQ ID NO: 58940 - DNA, 1354 bp, Bovine  19866881310766
gatatgttctctgtgcctttataattcaaataatagagggtatagataaaaaaagattagaaatcagaattattggtaattatctttatttgatttacagcatctatgttcagagttcagaaatataataccaggtctcatttaatgtaaaagttaacatcttggagttttagaaattcctataacgacacaactttggaaaagattcctcatgacaccctgaaaacaaaaagtgaaatagagcagaataaattaatgagacaaatcttcatccttttaaagggtcaattctatttcatagaaagttgacaggctttagaatatgcttttatttttagtcatttcgtttatgaaatagatcttattggtcaacagaacaataacaataagaatcagtaaatgaaaaagaaacctattcttttcttaatgttatcttagggcaatcagctattttcagggactggttttgtagtaacagctactacttataccagtgatgagacagtgaaaacccaaatttagaacattcacattgaagttcagtgatgagacagtacctgtccaatataattttcatacctatgcacccagacagggatttgctttttttagtttttatgctatagaacaatggtgaaactgttataaaaagctcctgctcctacttctgaggtagctgtgctgaagttaaaaagttagctttagaactctaagggagttttgaaatttagttctgacactattaacagtttggcattgagaaaggcatttaaccatttaattcctgttatgttatttgtaaaatgagaaacttttggaaagagaaactaaaatttaataagaatgtctttttttctggacacaatatcaggaattcttcatacatcattatatgcaatttacacagtaatccaagagttatgtgtgattattctcaacttacagatttagaaattagtacttccagaagttaagaaccaagtttaaggtggtattgctactaagagtttacatccaaggtgtagtctatctctaaaactatgctcttttctctgtgtctattgtcattatttcagcaactaaaactatatggtgttcaaaatgctgtaatctgtcttcaaatatattttctgataaaatggtgtataacatcagatcagatcagtcactcagtcgtgtccgactctttgcgaccccatgaatcgcagcacgccaggcctccctgtccagcaccaactcctggagttcactcagactcatgtccatcgagtcagtgatgccatccagccatctcatcctctggcgtccccttctcctcctgcccccaatccttcccagcatcagaatcttttcc

SEQ ID NO: 58941 - DNA, 1276 bp, Bovine  19866881490075
cactacttgcgtaagaagctagcaaaatatcaaatgctatttttgcccatgttggagcacatattcttgaaaaaacacaaaatcccactataaggcacatattcatttataatttggaacacaagtgatgatgtacactactgagaggttttctaatttatgtatagaaaaatatttctttttcaagggacaaaattaagagaattctacacgagagatgatgaaggagatgaatagtgagggagactggttgagaaagacatgaacttctaagtaaattgaggatctcaacacacctgaacatttccttcttttagaatgtcctttaacttatacgatgagaccaaatataatgaccaaaaaataaaagtcaaagaaagaagcctcaaagtctcaatgatagagttgctttccactgaatataaagtaaggtaagtgaaaataatttcctaaaactatttgaaatgtagcatatatgagatgtcttgttccagctgagtggctaaaatgaaaaccatacagagcagaataacaaaacaatcaaggaaaaaaaggatcgatatgctatcccaaattaaaaatatatgacacattaattgcaattacactagtcatagtcccttctttataagatttcattgccttactaaattcccctagtatattgtgtaatgagggaaaatacaaaacacttttaaattataaagaagaggttaatttttgtttctagaactgtggacagcatacatttgaaatatttagaatgatttacaactgcttaattattctcctaatatcccatggagtactgggattgtaggttgaaactgagaaagggaaatttaaggcacttcctgacataggaacatttcaggttacaagaatagtcttgcagaaaaagtgagtgatagaagcttagtcaccagggacatacaaaagccaacagtactaaaatattagaaggtttattttgggaagcagttttcccctgttggggtggatatgtggactggattgcttacttgatctttcctcatctctattgtctattttcatgccttcatttgagtacataaggcaacatccttaacatttgagattgcatctgatgctgcccaactgtagcaattacatttttccactcctccaaaatgaaaaaaaaaaataaattaatgctgcactcttctgtcttgatagctgtccagttaccatcatttacctgatgctcaaagcccttaaaattacaaaataatttataattctctgatcaaacaca

SEQ ID NO: 58942 - DNA, 1309 bp, Bovine  19866881510135
ttgaaagttctctcttggtccctttctaatgtcttttaaaagcagagtggttatttgagactgtaagcgaccatgacacttacagtataatttcattccttctttccattttttagctgtagatatgaagagttttcaagttcaaataacagataactaggtgattagatgctatctgtaattcatgtacatttcttcatgaatgttcagtacgtaaaagtatgtttctgtatggtactacaaataaaaaaatgttcaagatataataaatgcacctaatgagcatgaaataattcctaagaaaacaaaataagctgtcatgatgtgtttgtccccagtgattcttatacattatcagatgttgtcacctctgctatagtgcacagcatatgaataagttattcttgcttgagtaactgcaactacttttctataaacagtctcactagtgaaataagatgtcataacaactccagaattttcctctctgaggaacatcttctcagattaaggaattaaggaaaacagagaacataggttgaaggtatatgagtaataagagcacttaaaatctgtgaatttttagtgtaaacaaaaaaggcaaccaagcaatagtgttacagattgaaaagttagagaaacagaaagaaaggttgggtcacaaacaggcactgtgctagcacatgggaatcgaaaaaagtgatatatatcaggctaagtaaaaagctgcagagctttgcatacgtagaacatgggtcatttgtcatgggcagagtttctggaagattggatatgatctagttctaaggaaaagggctaaaatttccaacagcaaatggcataaaccagagagtaaaaactatgtgttttcaatcagagaatatgttcgaatcgaaaaatatgctgaagacctttaactatagcaatgttagcaaggcctctacactacttaacacataaaacaaattataatgatatcaataagattaccccacaaataatggtactatataaaaacacataaaaacaaaatagacatataacccagacttggaggatatactgtttggtgacgaagctcaagatacatgtcttctagccatttgagactgaagaagaaaacaatagacaaacttcttcctttaccctgggtacagggttataatgacctcaactaaggagtggaaggagtcaaggagagcagggttatgatggaacaacaaacctctttttgatagctttttttttttttcctaaaaataagaaggaatgattcttttattgaaaactataaacacacatacccaga

SEQ ID NO: 58943 - DNA, 838 bp, Bovine  19866881557888
caggaggtaccataagtgtaataaacaactgttagaaaggagaaatactaatctagccactggacataaggaaagtatgaatggcctcgaagtggcatctaaaatcttctaaaattttgttcagaactgctttatatgtgtttagcatatttttctggttagactatccacagcttttatcagtctcagagggttaaagaaccactgtctataacaaaaagaatccttttcctttgttattcttgaatcagattaacacaagacaacactgttcattcaaatagtgactgattctctgatttgtcacttcatataaacatagctcgtgtgcataatttatatataatgctatttggtggaggctgaaaaatatgagaagcattagatttttttcagaaaggaagacataaattagccaattggatttttagttctgcaccattttcagaaatacagagtggttcaattttctttccaatactcaataaaataatcatatgaacaatgtagaaaaaatctttggaatggtacaggattcataaagttatatcactgaaatttggaagactaagcctaacacacttatcatagtgtctaccattctgagtttatctctgaaaactccatcccagccccccaatctcacccatgccacaatggttccatttattctacattctatcaataaaggaaatatccatctctctagaatgaaaacttacatttctctgtgcttccaaacatactatttataccattaactcttcaatgacagtagtctctcctctttcagttgttggcatatgtctggcatatgtctcattacccaatacctgct

SEQ ID NO: 58944 - DNA, 1199 bp, Bovine  19866881602828
atattttatatgacttcaatacttttaaattttcttaagattgttttatggtctagtatatgattgaccttacagaatattccatatatgcttgagaaaaatgtatattctgctgttgttgggtgtaatgttctagaggtgtctattaagtctacttgttctatccaaactcctactgaatagggattctattcaatatccccaataataagggtatcaaagtcttttactattatattttaattgtctgtttctcccttcaattctgtcagttattccttcttgtattttaggactctgttgattggaatctatttctcgtgtggtgtatagcctgtaatgttacttctcagagggtgcagcttggggcatgcacagttaccttaactccctcccttcaccccaaggagaataaggattttatctgagccctttgacaaagtctttccctgatctctcttatcttcttgtaagtttctggctggtctctatattgatatcacaccccaatgttactcctcactaactgctggctgtttgttctcttattatctacaacaatgccttagagcataaatcattccacagtctgatcagattaatgtctgattgccttgtgaggcttgcttagatctcagggggatttctcttaagtaaaatcatcattgtttggacagtgttaggctcaacttcccatgttttgttccaaataaagttagatctcttagaatatcccattttctggtctgtacttgccctgaataagacttccatcaccctgagctagacaaacaaaggaagctgggcatggcttgacttccataaactgtcactattcctacaaagatttaatagattttttggaataaataaacctccatttgcataaggcaatttccagagacttcatttggtgtgtttgtttttaatttttaggtattacagttgtctttctggggggaaattttgtagtgctccttatgccactatttttgaaatgcttctcctccctaggaagtatttaatagattcactgatgttgttcatattatttaatgcaattatatggaaaatactttttatcatataatttttgtcttccacaaatgttctggtcacatcaggctgtgagattgctccagtcagcagcccaatgacctcaaaccccagagaagctctggagctggaataaagataag

SEQ ID NO: 58945 - DNA, 1553 bp, Bovine  19866881606910
ttcctgttaagactgcctgagaagttttccgaagtatacaggacttcaaatctcacgtttccaagccatacagataaattcacccccaattctgcccttagcatcatccaaagggattatgtggaaaatcatgtcctgttccagtctccccttcaactgagggaaattttgaggtcgacaagccctatctttgcctaaacaaacaatattctgactcttctactgctctcacatgtctgtatccctttcagagatacaagtaagtcttctctgcttcagatctttcactctctcttatatcccccctcctatgaagcattgattcctaaagaacctaagcttcagtctctttcctgcccaacctatcatttactctagcctctgactgtccactttaagaactctttcttacaagcagtggatacttcttttacatcatagcctaagtcctatccaccaaaggttcaaaacaaattcctatgttcagacctgctgaaatatggactctaggactgttaattcataattctcctgtgttggatttccctgctttattgatcctatgacttctttttaaaaagtttatcctatcactgtacctaaacatcctttaatatatttctaagaaagaatacaaggaaaaacaatttgtttctgagaatttccaggtatgaaaagtctttatttcaaccctcatgtttgattgttagcttgtttccgtttatataggatggaccctttttttcctttggtatatgaaaataattgttacattgttttctaactcaatgtgctgctaataagaaatcaaataatattttcccctaatcttttatatgtaactagttgctgatggtttacttttctgtttctccctttgagcttctaggtcccttttccatctctggatgtgatagaggctgctagtttctcaccaatatacagtcttcctttcttccttttgtaatagaatctctcagattgaacaaaacacatggcagtccaaactaaagactataatttccagcttcctttggagctggggtgactatctttgggccaactgaatgggagtagaaattaagtatagcttctggaatggaccgtgaatagaaacagagatagtctcactttttatttctcctcttcctgctggtggtaacacagatgtgatgtcaagaactcaagcagcaatcttcaactaatagaggaagtcacattttaaggatgacagagcaatgaaataaaaggagcttgggttctcagaatcatgaagcaatcatgcagcttgtgcttggactgatataaaaaagagaattaaattttcatctgtttcagccactatatttttgtcttttgatttacttaggtttttccttcccttttctattttccatctctgttttttgttccaattccagaaagatgccctcaactttatctttaaaacctattgacttttttattttaactgttatatatctaaagcccctttgcttttcttttattgtttgatttttgttttcagaaccctattttactgtatagataca

SEQ ID NO: 58946 - DNA, 1054 bp, Bovine  19866881763818
acaatagcctaaactttagggtaatgaacaatttaataattaatttagctcagttttctaacacattatctgtcatcatttcaagctcatctttgcaagttataaatggctacaaagacaatgtataattgtcatcctgttactatgtttagtgtagtgtcacttgaagttctaaagtgtcccattaaagttattaattaaagtaattaaaattataatctgggtgaaatgaacaagaagggaaagtctccttttttagcccatttatttatgatccaaagttacaatcatgctaatggtttcttccatcttcctgtggaaattctgtagaccttctagatcactatacaaggtgatttgctttagcttgggattcaccagtaagcactgcccattccaggtatccaggagtcacatcactactgacagaccatgcagacttgaaacaatgggacaccttatactgcctttactagaagctagaatggttcttctcaacctcttgtgcatttggtcaaactcatgaccaactatgtcccaagactttgacctaagactttgctcagtatccacttgtctaactagtggtcatctggaagaagaagttcctgggtggtaccagcttatgatacctcctgtgctggcacagaggtaaagtgcgtcttactacacagtttacagtattgtgaggaagatgcacatgacttcaattatagaactgcatgtctttgcaaattttagtgtagtaaaaatgtgaaacctaaatattatcaagtatggtgacacttttcttagttttaaacttcttgagtaatgctttggataagagtgaccaggaaagctctattctttaattctttagcctaggacacatcccttctttggtttattcatcttcttctggagactctgtatttccttatgaagtcgtctgttctcttcttggaatccttcctgtagtagtcgggactgttcctaaaaagatacaaatggaaattgaatagtgtatatcattaagtaaatctctaactactatctagtttccacattcaag

SEQ ID NO: 58947 - DNA, 1328 bp, Bovine  19866881512039
aatggagggcctctttgagcatcagggtgtatttctgatatagtggggcagcaccctgaaggtagaattagaagtaatgtttgagtaattagatagtagctgaaaaaatctgcattagatcttaagttctcgtcttactctcaggtacaataaccctttggggttagattcaaagaattgcgaatagtattttggaattgctgtatatgagtcttgctcatttgtaacattctttctaaggcggatagaacttgtgcagcacatcacaagttcccttatgatctggaactagtaactgtataatcaaagtgtgcatgtatgtgtgtacgtgggtgttgtgagtatctggctttgcctgtcacctgaccttatcccatcccttgcaacttggtacactaaattaattgccttgtggctgctgatgaggtcaatagccttggggatagttgctgctcggagagtggagagtggggtatgagacgttcccagaggacttgcattagtatctgtcaagttcacttcacaggattctggttgctggtttctcctaatgaggttcctgtctgtcctcgactcctggtctacacctgccttgaactctggggttccccagctcttgctactgtaactcctgacctcccgcctcttctgacctctggtaactgcttacttcttgtaccttctttgatgtgcatgaatgtctaatctatggtgctttcttcctgtttatctatattgtttaaaattgtaattttttatgtatcctagatgtatacaggtttttaagtaaaaaaaaaatgggattgcattatgcatattattctgcaactttctgtcattcctcttactagcctgtcttagaaactgtttccatgcctatccatggaaatctactttactctttccaacttaaacatagaatttccatggtatataatacaataccaagtaggggtagaccatactttatttaagcaattctattatggctgtactttgagttgcttccagttgttattacaaatgatgctactgtcatccttattgttaatacatattattgtgcattagtttgggtatagcataggaataaattcttttattgggtcaaagaattattgggtcaaaggatttgtacttttgaaattgatggacactacaatttgagccttcaaaatggcttgtaaagtttataaatcccaccaacagtgagtgtgagtttgtttatccatacacttaacagcaatgggtattctctcttcataatagtcagatggtcattaattcagtttgcatttttctgataactagtgaggctgtgtgtgtca

SEQ ID NO: 58948 - DNA, 1099 bp, Bovine  19866880348395
ccgcagtccccctctgtcttctttcaggattctgtgattagattgtgcccacctggatgcacctggatactctctcctgtagttaaggtccctaacatgaattacatttgcaaagcccctctgccatgtagggtgatattcacaggttccagagattgggatatggacatttggaggggtgttattttgccaacctggcatctctcacctggcccaatatatgcccagctcccagggcctgtaatacatcctcctttctgtcgcccggataacaccagtcctctgctcaaaatcctcagtgatgaaaccactcactgaacaccaaatggcttagcctggcgttcctgtcgaataactgaaaacagtcccttatcaactgaataaaggaataaaagcagtgtactataagggagacctgaaaaagatgagcgtgaggcagaggcaatggatggggggcggtgagcatgacctggagttgagtccagtgtggctgagaggcatgctggggcttcaggcagctgtgattatcttatgtcttccctttgagcctcaattacctggtctactaaaacggggatacaaacagtatcttcttcactgggttgttgtagaggttaatgaaatagacataggtaaatacatggcaagcacttatcacacagtaggctctccataaatgttactttcctctcctttcccaatataagaacaaataaagcaaccgaattatagtgaatgattcatgagaaccatccaagacatagaggtattaaatgtttggcttagttcaagataattcctctttccacgtgagtaaaaaatgtcatattgctcctctttatgatgtgtgaccatatttctatagagaaataatgaaaaaatgttatcagcaatgaatacttcattgaaaaattataatctggagaaacagagcctaaatggaagcgattagaacaaaaacaaagttctcaaatatgtgtatgtggtatgtatactatcatcactaaaaaccaaatgtattcataatgactgagcattagaaaattcatgaattattcatttagtcattcatacaaaaatactcatgggagcactggga

SEQ ID NO: 58949 - DNA, 2918 bp, Bovine  19866880446332
gaggatcaattatcccatcatatttcagtggacttatgcttctctgagtaaaaataaataaattcctagctcataatgtctataaattacccacctttcttcactcatcagacctcattttctataatcagggacctcaaagggaacagagttcataccacatggttcaaatggacaggtgattattaaatgattccttacggaggtatgggcagggctgaagaaagaatgtacagttagacacggaaaaataacaacagtgggcagccattactgttcctaggtctgcaggggaaaggggaagactggagccagagcaactgcatcttcataggtgcgggcatcagcaggaagaaaggaaagaagtacactgccttttctcctcctgtctgctgatcttcagatgctactttctgttgcttgggatatcctgaggtcaaaggagcctgggtgattaatatagtgtgatgtgggagaacaggagggatctaactcccaggacacatagcacatgctagaaggcagtgcacatatctggaggggtggaagattaatcagctacgtgcctatctcattcataactatccctcctccttattgctctctaaacttcatacttggtgtgtgcgtttaacaggaatttgcacaggttttttctttctacaggtaccctccctcttcctcttgatatggctagctcttcatcctccttcaagtcttaaatatctttatcaccctatcaagaagcaggtacctccttcttctccttggaatacaagggcagtggtgatgtgtctagcagatacctggtacctagcaggtactcagtaaatactaacggagtgaatggtggccaaatcatatagcaaaatcttaagagtgtgtctacagacaataggtttatataaatatctgcatgaattctaaactgaggcagcatttagaaaaagctacttaatctttatttttctatggttttagctaaaaaaagaagatttgtgtaaagtaaaaatctacaatgatagatgctcaatttcttattcacttaaaaagagaatgtctattatggcaccaacagtctaaaagaaaataattgaatcatttaaaagcaaggtttatactcatttcttttactgctgtttctatagcaatagcacaaaatcacctgttttggtctgttatgttcttggtactagaatattagtcatttcaacatctttttcttttaattgaagggaacaaaggaacagagagtagttttaaatgtaggaacatttgtagataacatttttttagatgtgctaagttggcaactgcaaagcacaatctacagtggtgacaacacttccgtattattgtatatttaaagattcaagtgcttctcttacctcctctgaaagagcagcatcagctgatcctaaatttcagagcattttaaccttcattatgaatgacaagggcctatttgcttttgcagaaacaatctgtaaagagtaacctttggcttcacttatacagcattttatttttaaaggcaactgcatttataatgggcaatctctacttcagattcattcaaccaagtgcccctcaacatctaagcagttaactgagattaaaagtaattttgactcttggcagcagagggaaagtcaggaaatactctaattccagaaggaggtgaaagtggaagtaaaactaggagaggaaaaagaggagggtcaaggaaaaacggagggctaaaaattggatgagaaagaatgctgccaagacactgggtcgctgctagcagcaggtctgatagcatcaccatcctggctgaaggagcaagagcagagcacaggctgagaagagttgagctgtccatgctattagaaccattaacatcttcacctggcatcctgaaagaccaactggagtgaccacaggccacagacacataccaagttggctttaaatccgggtcctaccacttactatctgtgagacttcagcaagtaagtagttgtaggaatattagttttttcatctgcaaaatggggctaatatctaaattaccaggctactgtgaaaacagcaggcttgcagttttaaaaccatttgctcctatgcttgaccaaacccttgctgcccttcctttgtttgatacttaaattagacaacattacccaaaccaaactcaacattcaaaaagctaagaccatggcatccagtcccatcacttcatggcaaacagaaggataaaaagtggaaatagtgacagattttattttctcgggctccaaaatcactgtggatggtgactgcagccatgaaattacacttgctccttggaagaaaagctatgacaaatcttgacactgtattaaaaagcagagacatcactttgcccaacaaggctatggttttccagtagtaatgacagatgtgagagctggatcataaagaaggctgagcgctgaagaatttatgcttttgaattgtggtgctggataagactcttgaaagtcccgtgggcagcaaggagatcaaaccagtcaatcctaaagaaaatcagccctgaataatcactggaaggactgatgctgaacctgaagctccaatactttggccacttgatgggaagaaccgacttactgaaaagaccctgatgctgggaaagattgaaggaaggaggaaaaggggatgacagaggatgagatggctggatggcataactgacacaatggacacgagtttgagcaaattccaggagatagtgaaggaaagggaagcctggtgtgctatagttcatagggtctcgaagagtcagacatgactcagcgactgaacaagaggacagggtgcagagatgtccacacagctctgttctgaagtgagtagggagagaccaaaaagaggacacaaggcagcttctt

SEQ ID NO: 58950 - DNA, 899 bp, Bovine  19866880471188
ccccagtgtcaaaataccactcagtcctgtctgactctttgcgaccccatggactatacagtccatggaattctccaggccagaatactggagtgggtagcctttcccttctccaggggatcttcccaacccagggatcaaacccaggtctcccgcattgcaggtggaatctttaccaactgagctatgagggaaactcaaaataccacaccaattcccaaagaatataaatggtatgattctatttgtggaaaaaataattgttacatcatacagacaatctctgaaggtactcacagaaaaactattaaaaacagttacctctggagaatgattctccagattttcttattatgggcatataatgtatgcccataaataacataattattaataaattatatgtaatttataaattaaagagttttagttcataaggacaaaacaatgattagtggttaactatctgaaataaaataaatattctatgcaagcagtaataaaaaaatgttaaaaaatgctttacttctgggtacttcaaaaaagacattaagcaacattttacaactatcacaagggaattgtcgctagggttgttctgctaggcccagactagtgtggggaatcaacagactatcctttgaagtaagagcacaacaatttacttatagtggtttattgagtgcttagttcaatacaagtggacattttgtcaataccattctaatgggtgctatagatgacagttcaatgctataatatacaagctagaaggccatataataaaatctatatgcccctggagtcaagggatgatcatttgcagaagacctaaagaaaaacaccaagacatctctctgtgcagggcctatagtgctcgaagtaaaaaagcaaacaga

SEQ ID NO: 58951 - DNA, 884 bp, Bovine  19866880732316
gatactggaagggaggatgagaatggaatcaggaagccagttgggaggttttgtaggcaaggaccaatggtgcttgagctagaataggagatagagaaccaaatagattcagtacagaactgatagacttgcagagaggacctgtgaatcgagggtgactcttaactttctggtttgagcttctagggagtggtaagtatggggaatttagactcttttcttaataaggtccatttgaaatgtctgtgaaatatgtaggaaaagattcaagcaggcagtttgaagttcaggaaatgagtcagggctagaaatgtagattgaactgtcaacatagggataacatttagaaccagacataggaatggaaatagtcaccaaggtaaaaaaatgttttaggaaaaaaaaaaaacaactgaagaaaatccaaagagctccctgattgaaagtcttcaggagctgtttgaatgcacatgttagttcctctcaaatattactaaaataatatgaaaatcagctttagataaaaaaagaattaaaatgatgaatgcttcagaaataaaatatgaaagttctgtgtttatacttctccttataaaataaacttaatatctaagtggttatattttttaaaagaacagtagtcttttgccttctaggaacattgctttactcctgctgtgaacattggcacacatatattaacatctcatgtatccactttagtcttgtgctagaaacttgtcagttgaccggagaactgaatgagttaatttctctcctcatctcaagctcttatttctgaccaacaggattatgctcaggtggtgaattctgcatactgtctaacctaactgggaaatgtgtttacaatgataagcttctag

SEQ ID NO: 58952 - DNA, 1857 bp, Bovine  19866880752019
gagttttgtgtatttacttctatcttactattgaggtatactttccttccttttaatttttttaatgtctttgataggcttagtgggaaagaatagaattaaaatgtcttactctattatctttaactgaaagactattgttttggagatatgaccttgatatagagtcaaatacatggaaacagattatagtaattagttatagtatatatccctttgtgttctaaaaatacactttatattcataacatatcactaggagtattcatcctagtcgtaactgaagttatgggctgagtagaatgtatgtaatgtatgtgattgtgaaatgtttacaaagggcatgaattaactaaatgaattagcaaagaaatcaataaggatcatttcattttgaaggaacatagaaacacttaagtctctgtggcctttattgcattgtggttaaggacccatgccactaacaagacatcctgtggttaagagtgaaatgtccttttattctgatccaatagcctttcataaaaatttccccattgaagactttacagggaattttctttcttagctggagaaaatataagaattgccaggcagggaacactttgatcccaaagattagaggttactaggataggactggattaaccacagtaacaataaaaagacaatccctgtctgtgtaggatggttgacgcctgctgtctgggcttctgggtctgaggttggcctgttcccggacttattcatttccctagcttgtgttaccattcccctgcccattgttctctgccatcttccatgtcctgagatggagcgttgatattttagcaatggtggtttatcccttagtatatgcaggatggaggaggccagcaataaataatagtgataagcctgtatgccagctcttccttgcacacaccaagaaatggattaaggaaacttcttttggtggagtggaaaggaaaacacagaaaagaaatacagtggtgtacatagctgtcatacctgtgtcagaaatctagacaagaaatgtaaatgtcagtggctcaaagactttccaggggagaacaaggtggctatagtacgtcaagcagctgacccaggagtggagcttgacaagtcattttgatgctggtctggaaaactccttggaaagaaacacattgttcaaagaggacaaacccccaaatcaatacagagaagagagctgagggaaaaagtaaaagtcagtgagtgaagggaaatgactgcccctgccccctctcctggtcataaccaggatcccagcaagtagagatgtttgatttttcagttgccagactgagtggtgcaggagaaatgcagcctgaagagtcaagcagacctgagatcaaacttaactacttggacttgggctcttgggcaagtgatttctctctgctcatagagaaattctcagctggctctgttctgtggcactattctgagtttgggtttatctgtagtttacagataattgtatcttccctgtgatgtcatttgcagattgaatgagatagtgcctgtgaagtgctagtccatagaaagtgtttagtgaatgctcatttctaattctctggagcctgtcctctgtcccaaagctcttggaagtacagccttaccccaacctcctgactcctcctctttctcctcttcttccttctttttctgttctgtaaggaaggtgaagccctgagctggcagataaattgggctccagctcgggtgaagcagagagacttcttgatggatttgtcccgcacctgaggaaggaaactgtgcttgtgctcctggtttccattactgagctggtcatattttatcttcccttaa

SEQ ID NO: 58953 - DNA, 1000 bp, Bovine  19866880899897
ttatgattaaaatatccttatcttgagtcctgcattttttagcaccttttgaaatttgtaactgtagagtgccttgtttgcctgactccaatcatggctctggacccaagacaaacttcctcccttttaaagagaagctgacaatctagatcttgttgtgaagtctcatattttaaatgtgttggctaattattcaaaaattttaaaaacatattgttggcaaccagagcagtagaagttctaacataaagcatcctagtaagtccactgaactagccatcggaagacttgaattctagtcttagttttatcctaaccacatggcactttacctttcctgagccttattttgtcattattaaaagtacacttctatgacccagtgtcagacatgatgattagaattttatgaaatactcagttcagttcagtcgctcagtcgtgtccgactctgtgcgaccccatggactgcagcacgccaggcctccctgtctatcaccaactcccggagtttactcaaactcatgtccattgagtcggtgatgccatccaaccatctcatcctctagcacttattaaatacaatgttagatggaaccatatgaaattactaataactggccattttgggtctacaaaaacattaatttcaggtggttccacctacagttttgtttcactgttgagtctgagagcatgatgaatgaatcaggcagtgctgtgccaagccatagtacagcctgaggaaaaaggaaaaatgtgttccgctagattgtagagcaagatcagggatttggcgagaaacctctaatcagaggacaagggcatgatggacaagcaagcataatgacttgctttttttcctactatcagatcagatcagtcgctcagtcgtgtccgactctttgcgacccgagctcctgttcctaggggttctctctcagtcactcattctctctacaggcctccaagggcttatatagagtccatttaagggttt

SEQ ID NO: 58954 - DNA, 1296 bp, Bovine  19866880910828
acattatttctaatcatatctttcttttcacaatttcacttagcctgtaagcttgctttctatgtatcttccaaattaatagcagaaaaataaacttttaaagatgaaaacaaagcttgcttttggcctcataggaacataaaatattggtctgagaaatgacttggctaccatcctggtgtatctcaaggggaaattcctttttctttttttatttgttaatggcagtataaaaaggattgattataaggctgaattttaagtatccagccttggagatctagccagtaatgactgtaggaacttttaggcaaagatgttggtaattagttaaaaaaacagatgcctacaggtccttcgcctatttaaaaaattggattgtttgttttggatattgagttgtttgagttttaaaatgtttcagatagttacccttattcgacatataatttgcaaatatattctcccattctgtaggttgccaatttgttttgctgatgatttccttcactgtgcaaaaaggtttaagtttgattcagttccatttgtttatttttgtttttgttccccttgcctggggagacagattaaaaaaaaaatactctaagaccaatatcaacgcacatactggctatgatttctttaggggttttatggtttcaggtcttacatttaggtatgtaatctattttgagtttgtgtatatggtgtgagaaaatgttatgattttgttttttataagtaactgtccaattttaccagcaccaattttattaaagagactgttttcccattacgtattcttgcctcctttgttataaaattaaaagatgcttttaatgaaattaaaagacagttgctccttggacgaaaaactatgaccaacctggatagcatattaaaaagcaaagacattactttgccaacaaaggtccatctagtcaaagctatggtttttccagtagtcatgtatggatgtgagagttggaccataaagaatgctgagtgccaaagaattgatgcttttgaactgtggtgttggagaagactcttgagagtcccctggacttcagggagatccaaccagtccatcctaaaggaaatcagtcctgaatattcattggaaggactgatgctgaagctgaagctctaatacttgagctacctgatgcaaataactgactcactgggaaagaccctgatgctgggaaagattgaaaggcaggaggagaaggggatgatagaggataagatgattggatggcatcagcaacttgatggacatgagtgagtaag

SEQ ID NO: 58955 - DNA, 831 bp, Bovine  19866881071399
taaaactaatgaagatatttctactgtggacgaggcttctctcttttttcatgctgtgcagattttcagctctgcagttgaaatctgaatccttcccacctaaatcctgatgtaccttcccaactaaacccacatgagctggaattgcatttctcaaccatgtcacaaaagaaaaagacacaagggtcagtgaaaccctgaaatggttaatttagaatgttgttcacaaagtgcacggctctgaagctttaaaaatttccctggagatttcagacaggagtttcagcaagtctggcatttcgcttcattctcagcctctttctcagctcctagtcctgggggttggccaggaacccattgagctgaaagagagatgagggaaaaaatggcagaatgtttctgagattcatgtagagggccttctcgactctcagaaatgtcattagagtcccccaggagactcaggtggtatctccatctaattattcttttatgattttataatcacagagacatttcttaaccgtgttgtacagcaatttcttgaaatgtcttctctccctgtgcttacatgaatgaatttctttcacatagtgtaggagattttttttttttaatgttctttgtttctttcctaagtccaacgtgcagtaaattattgggtaacagctttgcttagtaaaggaaaaaacaaacaaataaacttgaaacttctagcttttatgcccaaaatagacacctaacaaatcacaactgcattgtgtctcctgggatggtaactcagatgtaacaaatgtagcattaggaacaagtcagtattataatcactaa

SEQ ID NO: 58956 - DNA, 926 bp, Bovine  19866881099264
ttgacatgagaacctcgatgactagaaggaatcagtcttctgaaaatctagaggcctcacaggaggaacagatgatacacaagccctcaggctggaaagagtttggcgcatttcagaaaagtaagacagccagtcagcttgaagcacagtagatgggaagagggacaaaatgaagaggcaggcaggggcaaggtcacaccatgcctcatggttaagagtttggattttgctctaaactagggagttacatggtttgattttgagagtgaattacggggagaagcagggagactgctggctgctgtaggctacccagatgagagaaaacgctgctttgcaccagagagatgagtggagatgaagaaaggataatgaatgtgagatgtccttggaacttgaagtcaacaggactcaatgaattgatgtaagaggtgaagagcaaagagaggaatcaaggataacttgaggactttgggcttgatggggctgtcagtcaccagcactggcttctgtaaatgctcatgggagttagaattcacatagtgctcactacatgtttgccaggcattcatttaatcttcaagatgatcctataaaatagatactgtctccacattagaaataaggggggaaaagtaaagatattgaggaacttgacaagatcacccagctggtgccctgtggagtgaagataatggactccagtctccaagtgttgtaacaactcacctacactgtctcattagcctcatgcatgtgaattacagacccatatatccaacgtcttaatctccagatggctcacaggaacctaaaactcaaagtactttaagttgagcttaccttcctccctacctttctccttataagcttcaataaattatatcaccatccaccaagctgatcaagttagaaacgatgccatt

SEQ ID NO: 58957 - DNA, 2436 bp, Bovine  19866881104682
caagtgcttaatacatactggttatgactgactgactacctgactgaaggaacgagaggatttattattttatgtcactaaatggttccttaattatgtgatgctgtctgaaatttatctccaaccgaaagtaaaaaatgcccacctcttaattcaaagctcatcaccttcactccagcttgctgaatgcattgttaaaattctcagaaaagcactttaaaaagaaagaaaagcagaattcattttctgcagagcttttcactttgtatccctgatcttgccacgacctcatcttgctttcggaaagggcggttccctcgcagtgctttcatcaatctttggtccctggacccctgctgttggagaccgcaggaaaagcaagcacaacatcacctttaattagcaggagaggagcctgcctgatatacacagacagcaccttagaaacaaggaacagaaaaatgtaacacaggaccaggttcttgggaaagccatgaaatgaaaaagagtaattatcctgctttaacataatgttgttaatctgtattgcccattatcatctagagtgtcttgcccattgaagtatgtgagctgtggcactggtctttgctccagcagtgtagctaacgttagggcctggctccccatccatcataataattagtttgtcataattttctgcccttcttggctctgcagtaaaaagatagaagaggcatttaaagttactcaggaattgttcaccaaatttcctccctgttctttaggggaatggatagctgtatttctgccctatttattttatgtttggcctgtgataatgaagcatatttcatctggaagtatatagctttaattttcatgttctacttggaaacatctcatggtttcattttgttttagccatacagtatataaagagagcccacacttctttctgaactcacccatcacccaccagagttaattctagtttcaagaccaacattatggttttatgagctgactacataacaacacacactggttctatagtcctttagagtctgcaaagtgctctccttgttttatcccttaattctcacaactgcccggggatgtagaaaaggcaggatttatccacatgttccttttgtagaatgaggagctgaaaggtcaactgacttgaccagtggccaaggcttgaatttaggttctctcattgtaagttatgggtctttgctattactctagcaatatctccttttgctttagtctatgcttctgctgaaatggagatggggaaattttcagttattctttctttccctcagcatcatgagcacaataagctttccttgtctggtagaaaaaagggaaagaatgtttgcatagaaatgtagagctttaaaggaattattttttggcttagggcagaggttctcaaagtgtggtccccagaccagtagcctcagcagttgtaggaagcttgttaaaagcataaatttccagatatactagaatatacatcctagatatactagtcagaaactctaaggtgaggctcagcagtctgtgctcaaagaagcccttcaggcaattctgatgtaggctcaagtttgagaatcactagagaaggcaatggcactccactgcagtactcttgcctggaaaatcttatggacggaggagcctggtagggtgcagtccatgggttcgcaaagaatcagacacgactgtgcaacttcactttcacttttcactttcatgcattggagaaggcaatggcaacccactccagtgttcttgcctggagaatcccagggacagcagagcctggtgggctgccgtctatggggtcgtacagagtcggacatgactgaagtgatttagcagcagcagcagcagcagcctagaaaaaagatgggtagacacaggaaggacagagaagagaaaaatagcattgtgtgctttggagaggaaaactctcttaggtttattatcagggttgtgtagattaaactaacacaggtagagtaatggaataaaaagcacataatttttatttgatgtacattgtcatttgtgtgtgtatgttgggggtctcatagaaagaacatgaaaacccaaagaaacagtagggcctgagagcttatgcactgtttaaacaaaggagccatacatttgtgaagaagtgataagccaaaggaaaagagtttggatttctggggcagtaaggtgtgagaaagtaaatatatgggggaaactaatggaagatgagatgtcagtgataattgtttatgcaatattcaagtagaaactgcctccagtagtaaaagttgtctcctgttcctggtgtgggagaaggaaggggacacatcttcacaaagggaagtttatgccctgcttttagacagggagagtagagtgctttccccacatctgttactcagtcac

SEQ ID NO: 58958 - DNA, 1565 bp, Bovine  19866881128933
ctgtgtatcaggatgctttgttgcaaaagatactaatagagccctttatatccaccaatccaatctaattcaacggtttttgaaagctgcttcttgtttctcaccacagtcttttgacacgcgccaagtctctcaggcttctttctcacccccacctggaaaatgacccccaccctctcacacacacacacacacacacacacacacacactccctcactgctccatcccaggtttaggcagcctgaccatcttaaatgttgacaatccacccaggggacattctatatattcattttatttccaataataaagctgttctacttgtaatgtgaagaaataacatacaggaagaaccagtaatgtgtagaaattctagcctttcagtcctgtagaagcttagatatgacttaggcaatagaccttcacctcgatgtggagactaatgtcgtctcggcacatatactatccactaatctcttcagtgatgttctgatctttaaatagggttttcttctttgtttgtcagtctattgcccgcaaacatgtcagatatttcccctgcatacaatggacattttatatatgactgatcactttatttttacttctcaggcaaagcaagcttttcatatactaaattgtttggcagatataaaagagggtgctatttttattctatatcatattcttaatacaatcaacaagcacagtgactaattctaatttaatttataaaggttacaatggtctgttgggccccctccctcaagattcaaggagcttactaataataatgcagagttgttgaaccataatatctcttggtctgtaacactaaagacattttaacatttgcagggctccagtctgctgcaattaattctgatcagatgtccacagtccagagtcattattagttgcagagtgtcagaatgtgctggccattttgaaggtgaatcttcaacgaatgccctttgttgttgccaaacaatgaggaattaacattcaagtttatataaaagataggaatggataggaaaaagtgtttcagcaattagtcattttttgctgttctggatttatttaggagttgaaacccaacttgcttatataattcatatatatcaaatagcataagtgttttcaagctataactgagttggctaaaaaggagcccttcagttatttggggaaggagaatgtataagtagagaggtgaatgtgcttaaatctctctttaaccaggacattagcatcatgactggcatcagaagtgagatgtcagtgttccagatttcatacagatcttctccctgatgtctccgggacaggtggagcccaaagtccttagggagttcaagtccaaggaccaagtttgaagtggggccagacaatgtcacacaggtaaggggaagcaagcaagccactggatatgattaggccaacagatctgatcattttgaagacttctgataaagttttattagtcacttacaagaggagaaggtcagcaacacagaagtcacaaaatgccatgaaaaattaccagccctattctgtaca

SEQ ID NO: 58959 - DNA, 884 bp, Bovine  19866881498907
actgttatgtctcagatagaggaatccttatctaaaaaagaaagaaaagaaacgctgtttcttttctctaaggaaaaactcccttgcaactcccaaagccaattttttgagtaaatagatcaattcaatttctattttttcctttcccaatataatgggttctttaactgccctgagtcaacaccgcctaatcatctcattgaggcacctggttaccaccctcagggcttccccatttctcttactggataactgagcgatatgatgatagtgacaaggtccctgggcctcaggatgaccttcgttgccatatgttgattgagtgttcatcgtaaagacttctaaatatcctaaacagcagtgcaaaggccagcaacatttatttctcagagaaatggttatctttatcctgctttgggcaaaaacatcccctgaactgaggttacacaccctgaataaattaaatcccagagatacataaaggttaaatgaaaaaaagtcaaaataagtaggtgatcctagtaagtagatcagtttgagaaacatatgggaagtgagggtaagaagtaggtccttgtcctcagccgcagtgtagacttctgttctccctggacacagccattaatcaaataggctatttttagaatatcctagaaatgaaagtgcccttctggattgttactgtcctctcataggtcaatgaaacatgacagacatatcatgaagtcagttaagaaagaaaaaaatctgtgatattctttatgtcttaaagcaaagaaatttgaaccagctgaggtctataatttgtcacgattcctttgcaaacctcttgatggaatgccttattttgatgtttcatattgtgtccattttgatgtgacacg

SEQ ID NO: 58960 - DNA, 1529 bp, Bovine  19866881501044
attacaacggctggcattttatctgttgcatttatcaacaccagtgaaagtatgcacgcttgttacaactccaagtagcagaagaacaaacacctgcacaaattcaatattctagatgcttaccaggaaaggcagggcaaaccagatgctacttcccttcttgcccaaatattttccaaatattaagctatttttgttactgcaaagaggtaacaaaattcacagaactaagcatttaacaattggctactatatttatgacagatggctacatttacaattactaacagtcatactactgtttgaatataaaaaccaaaaaacctacataaattacatgctcagttgccttacttctaatttaacttaagggaacaagaattaatttgatctaactattttcaatatttgccaacaggattaactcaatgacgtatggaaggataatactgtattcaccatcttccacttcttaccactaaacaatgtatcagcttgcttttctactaaaattgcataaaatagataggacagctaatttaaacagttgtttgcacattcaatatttataacctgaatcttgcatgactgactgaaagcagtgagttagaaggtttagctcagctcctgcctggagtgatggatggcctcgaagaatttcttgttcactgaccagatcaatcacataacagaattaaaaaaaaaaaaatcagccttaaactagattcccaacatttccatctgtatgcaagtgttacaggaagaaatatatcataaaacacaatgtgaaactacttaaaaataacaaaaatccaccaaaaatgctgtagaatgcaaatacagaagacaaggcaactgaatgacagtccccattttaactgaatattaattcaaactttgttacataaacaaacatgttacatataacccaaaaggtactataatttataatgatatcttgaaacagctcagactcgtaagtaaaagggtttgataaaccgaaagagctgcaattttgaaagtatttagagttgattttatttaattaaactaaaaggccgtgttgtggcaattattatatactgtgccatttttaattattccaatggctgtcccaaaaaatgaatgttaaagagtaaacaaaaaactgatggttcaacttagagtaattcgttcattaatggttaactcccaaacatctacagtgatgagggaatgagctgtactgtatacggaccatggctagcaaggccctcctcagtgtgtgctacaacaggtttgactggtttgtgagaggctcctgtaagcttctttcccagctctgcattcagtaatgtcaacttggtagcttgaaagtggtcatagtaggagtatatttgtactacagatattttgttgttgttcagtcactcagtcgtgtctgactctttgtgaccacatggactgcagcacaccagacttccccttccttcactaactctcaaagtttgctcagactcatgtccatcgagtcaatgatgccatccaat

SEQ ID NO: 58961 - DNA, 1415 bp, Bovine  19866881598051
caggctcccctgtccttagggttctccaggcaagaacactggagtgggttgccatttccttctccaatgcatgaaagtgaaaagtgaagtgaagtcgctcagtcgtgtccgactcctagcaaccccacggacttcagcctaccaggctcctccgtccatggggttttccaggcaagagtgagtggggtgccattgccttctctgtataaggtctatactaaggtctatatagtgtgattacttgaaattcagaaagctgtttactctcaattttagccatagaatgctgctggggttctgcaatctcttctccagttactttaatgatgaatttctaaggagaaacctgtactcatgtcatcatcctttcctatctttccatcataaaaacaaacaaacaaaacaacaaaccaaaaactgttttcctaggttactacagggaaggaagaactacagaaagaacaacagagaagaagcacacacaaacacacatataccagctttaaaccgcagaccttacttttacacataattctaagtcaagggattttgctttcttaaagcatgcactctcctggcttacaggcctttttctgcctgcttctgagaatcattacagatggtcgagactggaagtatgatggctgggtaagtgggacattacttgatcttctatcattctgataagaattctatgaggcagagaaaaggcatatgccattatcctcattatttttttaaatagagaaactgcagcacacaaggaaagtttagtaacttgcccaaggcaccaagcaaattagttttagagaattcaggtctttaaaatctttactcttctcctcatcagataacaaccttgtctccccccttcttggtctttctcacacataatttattcaagtatgatatatatctaaatcgtattttatgtgctgcatttccagacacctcaaccaaatcatcaaattataatttcctattatgttttctttgaaatgttagcttttaaaacgatacccataaatctttcacacatgaaattattagtaggaagaggagagaaagattggaagcaaaaaataaacacagtttcaatgacttgagtaaataaccaaaagataaaaaaaaaccaaaaataccctggggttagggggagaaggttctgactgacagtattttgcctctttgcttctctatacagtaggtggagctatagtactattcattagggttacaagaggctgtgagtggaaaacaatccaattcatttctaggatatccattttcttttgcactttcaaatggtcgttttctgtttttgaaacatttttcctccattccccaagaaccttcagcctacactgcctacattcctttttctttttcggaaggcagaggactagacctcactg

SEQ ID NO: 58962 - DNA, 1679 bp, Bovine  19866880392619
cctcaatttacttatctggaaacaagatggtaatgtctacagggttattgtgaggactggagagcattgctacaaaacttgatagggtttggtaggtgaaccttcccatccttccctatccattatctttcctcatcttattatcaggtatcacttttctaacccgttcttgtctccagtcaaaatgactggcttgtttgttcagcaagcatgaacaagtcactatcattttcatctccgcagctctgagaggtgatgccattaagcttgtataagaggctattggctcagagagagcttaagagctagaaggctactaggtggtagagccaggatttgatgccaggtctttaagaactatgggagccctagtctgctggtttccatcaaccatttctctgcctagaatatccttccacctcctttcctttctggattccatttgtcattcagggtctcattccctccatctcctccaggataccttctgaatcattgaggacaccttttattgcaagtgatagaaaattccattccaaagaggcttaagcaaagaaatggaagtttgggggcacaagtaacccaaaagtccagtgagtgaggttggatttagagctcaaataatgtcatcagtattttccgtattttctttcttcctaaatcttggttttgccttcttttctgaaggctgaagtttcaggctccatatggtagcaaaaaggcacagcagtctagcttttacattctcacgagtttcagacatagtggaaagagtaagtcaatttctccatacctcaaacttagtctgaaattaagacatgttttctctgatcagtgtgacatgggtcaagagctcattctgagatcagtcaatatgtttcgggggctggagtccctgggttagcttagacctgaatcacctgtaccttcagaggtgcagaggagtaagcttcacttgcctctagagggaaattgaggtaacttatcagggggcaggcacctggatatggatagtgaaataagtccacaagctattgatactttcccccttttgtgaattcctgcattcctgctgttctggtgggcgtctctgctaggcagtaaactccttgaagataaggactctgtgtgaccttgaggtctttgtaaagacctggaaaagaatgggtgccaatgacatgcttttcaatcaactaaagtaactattctgaactcagttcatccaacctagaatagaaacactctagctattccaaagaggagtgatttatgactggatattattttcacctcagagaatccatgttttgaaagacttaatctgagaggaaatagttaagggaacagatttggacccacagtatccgggctcagacgcttgcatgtgagcctgagtaagttgcttcacctctgtgtgcctggggatcttttgtcttaatagatccacctcataagactgatgtaaggattaagagaaattattcacataaagctcttgacagtgtctggtgtgtgtttctgctctaattcttagtgattaactcaaagcagccttatcacagataggattttctgttaagccttccccctcctgacttcttcttttggaaaatctcaacctgcagaaaagatgaaaggatcagtacaatgagcatctctctacttttcacctgaatttt

SEQ ID NO: 58963 - DNA, 778 bp, Bovine  19866880496715
ggtcagtgcttttggtgggaggtctagacagactggcgtcaaaagctttagtaaacttgctgcataaattgagaccaccactgtataccagacatttctttgcaaatatatccgtttctcatcttcggttccttctgttcttaagagatcgctgataacagtttgtataataattcctttatactacaaaaagtaattacttttcctcatgccctgttagttcttgcaagtgcacatgtactaatgttcctccttttttccctttggcagaggagattgaagtggatgttgaaagcacagagttctcccatggagaagtggacaatatcagtaccaccagcatcagtgacattgatgaccacagcagcctgcagagtattgggagtgacgagggttactccagtgccagtgtcaaactttcgttcacttcctagaacccagcatgacatgacagtgcagggcaaagtattcactgggccaattcaatccaaacaatctcttaaattgggttcatgatgcagtctcctctttaaagctaagcaaaactatacttgaacaagagtcaagagacctctatttaagcaaatacttagcaaaaagtggggcagagcctcccctgcagaacaaatattcatatttgaaaatcacagtttctaatggcagcagaaaatgtgtgtgaaattttctcaatttgatttagttgatttgaaagaggacactggagattacatcctctttttctagtttgctcctatcatattgattgagtagacacatt

SEQ ID NO: 58964 - DNA, 1411 bp, Bovine  19866880497626
tctttcttattaactataaccttcatagaggcatcagaccttgtcttaaaaaaaaaaaactccacctgcataatgctgtgcagttccaaagccacatctccttggcctccttgaggtcagttttaatccccttaaaaatcccatcagtaaatgtgctgtgttcacccaacccaatgaaaaattccaagaagtctattggaaaagcaaaatataaaacacaaagtcataatgtgtccatggagaagctcacacgtacacttataaatcttccaggactttcaatgtgaaagaacgtttaatctgtttcactccaaaagctctcattcacttcaatattgttcatagggaaagaaaagcctgtgaggtttgtaaagttggcttttgcaatattcattttttcaggctccatgtaaaaatgtcccagagttgattcaaatctacttttacagggcagagactggaaaatcatttaggagtttacacgtgttagttcattaaagaacctggcaggcctccctgtagaaaagaccaaataaaaatcctagcatccgaatctcgagaactttgttccaggagttctttgcaaagaagtcattatattttataaagctttagagtaccataattgccctggtctacctgggaatgaaaggttttgccaaagtgtcttttggaatagctttaaaatctcatttctaggttgagtttattggctcttcattgggaacattttgttttggggggacaaaggtgccatctgcttgcacttaaatttgttctgacctgagttgttaatgacatcccttcctgagaatatgtgaagaccacgatttatcaagattaactatgcagttgactgatcttagctcaaatactatataagcaacctgtgtacaagcaaagaaagccctgggttgttcatttaattccaaacaaagggaagatacatttaatgaattcacttggccacatcaatgaaacttttactgaataggcacagctttcttctatgtttaggtagaagccatttcaagccctaagagagttgaactcttggaggaaagagaagaacacactgtgctgtggaggagagatcaggagtcaagtctcctgcagaattcttgtctgtaattgcagaagctaataactcaggtcagacaccacggcaattatttcagcccagttcctgcaggaacttggtgccctctgacattaattcatacccaaatcctatactattcaccacccagggatctagagagctgttgatgggaaccacaaatatgaggagggagaaaaacagcgaaagacaaaaaggaggagcctaaaagccagaagctcttcttggcaatgtgttaagatactctcctcttctacaacctgagggcagaaagagcaaaggatcgggcat

SEQ ID NO: 58965 - DNA, 1331 bp, Bovine  19866880533085
cttgataagccaggcccatgttgaagaaactcacttttgcaaatagatgaacatgagtgcaaatgagaattcccaaagtaaatactgcttagatgtagttgactcaaaattaaaacccataagggcaagactccaagtccacatatgttttccagactcttggaaactcttgcattttgttgttgtccttagccttctgcgatccctaacttcctcctgaagttattgaagaaatagatacttggatgattagaatgtgatctagctggcattcatttaaaggcacatgtctgtttttacaccccaaccgagtttgatcagaaaaaagaaactgtgtgggagttggcaccggggctcacttaggatgcttcgctccagagtttgagaaaaagcaatgactgggctttaagaacatcaatccaagcctctattttgggcccaaggtcactcttcaccattctctggctcttagatttctcacctatagtgtctctcctacccctgaatctttttgatgtaaggaacttggttctgctggaagcctttattttttaattattattttttagaagtatttttatttgtttatttggctgtgctgggtcttaattgtggtacacaggatctttttagttgtggcatgcgatctcttagttgcagcacgtgggatctagctccctgaccaaggattgaacccaggccccctgcataggagcgaggagtcttagccactgggccaccagggaaatccttctgctgggtacctctaaacaacacatggaagtttattttatgtatcagctgactaggctatgctgtccagttgtttggtcaaacactagtctagatattgctgtcaagatagatgtgtttaacatttacaatcagttcgctttaagtaaggcttcccaggtggcgctagtggtaaagaacccatttgccagtgtaggagatgtaagaaacacggattcagtccctgggttgggaagattccctgggggagggcatggcaaataagcgaataccctttataatatggggtgggtctcatctaatcagttgaagactttaagagcaaaaactcaggtttcttggataagaaggaattctgtctcaagactatgatagagaaattttgcctgaattgaaactttattgaccagccacacatatttagtactcaagcctgcaacactggctcttacttgaatttccagccttctggctctctctatagatttttggagttgccagcccctacaaatgcatgaatcaatttctgaaaataaacctctctatctcctctttctcttgatatgaattatttccta

SEQ ID NO: 58966 - DNA, 1328 bp, Bovine  19866880584591
tgggggtggattgtgggcaggaagggatcgacctaccactataaatgaatactaccaagagtttaaatttagataccctgattgataatatgaggtcatttacgagaggtaggacaaaaggggtagggttgagttttactgtgcccaggctatctggtcatctccaaggccgcctcatccaacactcagtctttgggcattaattaaattctttagtggcaagctaggcaagtgtgtggcaggatatccatcctttctaactgaaactgctctgtctacaaaccctgctcagggagtctgaggtaggcaggtctctgaacttaagaggaaactgactggtgccagggtggacacctgacccaagggcagcccacccatagactgacaagtgaccaatgaggtgatgtggtgacatggactctgaccaataggatagcagtaattaaatctaggaaccgtgtttctttcaggagtggtaagggattcaaaagtggcacctggggttaacatgcttatgagcttatgtgcagaggatagcttgggctttgagagagatggaaagagcaacttctggttctgacagcatttatttcccagcttgtcattcattcactccttcattcaaccaatacttattgaacacctactataaatcaggccctgcactagatccctcttgaaattcaatataatctttgttctcctggtgcttcttatctgaagacaaacattaataaaatataattacagataaatgagtatttcttaggcttcgataaaatgtgaagaaaagctataggtaggaagctatgagagactgaatgggaatgtctgacctagtttggaagtctgagaagtcttgctgggagaggtgacatttgagctgaaacgtgaaggacaagtaggagttatttaattgaagggtgaatttaggggagaaatgtgttccaggcagaagagccagtgtgaacaaaagaggcaggagggagcatgacttattgaaaggactgtcataaaaccactgtggttggagtagagtgcagctggacattaaatgccatttgtatctatacacaaaatgtctttttttttttttttttaatgtggcctgaggagactgtcttccttggacacaaaagttcaatggcaaaagcacttgctgtatatcccaggtgctgagaggggtgcgagatcaataaaatagcttcatcctgggctctgccatttactagctatgggacctagggcaggttacctagtatctctgaggatcagtttatgcatctgaaaatagagacaataaaagcatttgtacagggaattccctg

SEQ ID NO: 58967 - DNA, 993 bp, Bovine  19866880656675
ctatgtatgaggctcttattggaatatcttatttacagtagttgtttattagttttttgtgtattacagttatttgtttagccattgtgtgttagcagttatttgtttagccatgatgactccctggtagctcagtcggtaaagaatctgcctgcaattcaggagaccagggttcgatccctgggtctggaagatcccctggagaaggaaatgggaacccactccagtattcttgcctggaaaatctcatggacagaggagcctggcaggttacagtccatgaggtctcaagggtcagacacaacttagtgactaatcgcatgataatcttaaaagactcatcaagtggagaatgaataaatgacaataaataccttttggggaaaaagggaagactctgagggtgatattttataaacgttacagagatgtatcaggcctggttacttaagcagttgtataagaaactgtcaggcatttaactgaggcaattcctttaaaataaaccatatggtcacatagtactattaaaatatgttgatacatccttgagtatcactctgattatgtctccctggggagtggggaactcattagcatgagttccatgtcagtccttccccctctgttccccgaatactttccacactctcttggcacaaaggggtgatcaaaatgtatgtagcatggccaagtttccaaatgaatggttcatctaaccccacggacagaatacatgacattaagaagtatgaaaagactgttgcgcttctctgagtttacttttctgtctgagagctttaaaaatgtgaattttgggggaaatgatggtggagggctctctatacaaattcttagctcttcattttacagatgctatttcccagcccaagggaaaagcatcaaagctgagaagttgttaaactgggagcagcagggtgcatacgtgtgtgtgtgtgtgtgtgtgtgtgtggcacgcacatacaggaagag

SEQ ID NO: 58968 - DNA, 991 bp, Bovine  19866880671054
cctgtgaagaaccactgaaaattgttgaggtgtgatctcaggaagtaaccgtggtagacagtaactcggaggaggagttttcatgcctgtgagtggcaatataatgcctgcttccaaaaaataactgacatttttttgactggggagataacagatagtatctgtcatttttttggtgccttctgtgttatcaaaaactatgctaaatgcttttcatgtaatacctcctctggcctttccaacatcctaagaaagtagatgatattatcctcattttgtagataaagactaaggcttgcagacaacaaaaaggaggtgctagtgtttcactttgatatacaaatttttacgattctactgctgtgtgtgtgccaggtcctgagtgtacgcttcctgggggagtagtagcttacttagtgtgaactcttaagtccacccatcctgaattcatgttttgatataagacgggctgtagatttgggataaaacattaacttttgatttagaagacttaagtttaccccaagaattaagaaattgatgaatgcctgaaaagtgggaacaacctgtggtaattcagtcctttaggataaagaatcagctcttgaaccttcatcatgacacccagaagacaagatatctatacttttgcataagatgcaaaaaagagttgggcagaagctctttatcttggcttaaaaaaattttttttccaaagttgggagcacggagagacattctaaggaaagttatttttaaaacctggaaagactgtttagttatagaagtatttttaaagataaataaactgtaacaacttaaatcttatttaaatggacatacttgggagatgatcttccttggagaaaaatgctagaatatatgctggagatcagaacaagaagccagcctttgggagttttcagagatttcatttctaagagatgaccattagggggcaatcctgggtctaaatttagttttagttgat

SEQ ID NO: 58969 - DNA, 1801 bp, Bovine  19866880681779
acgactgagcgacttcactttccttttcctttcatgcattggagaaggaaatggcaacccactccagtgttcttgcctggagaatcccagggacgggggagcctggtggctgccgtctgtggggtcgcacagagttggacacgactgaagtgacttagcagcagcagcagcagcatacttcaattaaaaaaagcattttagtgtgtagttgaaaaaatataattagcatatgagaccatgtattataaaaattatttcttaagagagagttgatttcaatagactgttgattcaaagatcatctaaagaagagtcttaagtaaataagggtccagcgagtaggcaacccaggtaagccctgtgcagatggtgtgagagtgtctgaagtttgggaaacactactctatatctgcctcccccaccatattttatagttaaggagacctgaggcccagggatttatcaaaggtcaagtgatagtgatagtgatgcccttgactgaacccctgctgggtggtgctaagcagctgacatgtacccctctcattttcactgaggcctggggcaggagtccatgccgccttagttgagactttttgattgtcctactctgggcctctggctgccaagtggcctttggcaaagccagcaatatcctgtctcctccactaagcaggggccatgctgggaggagtccaggcctggccttctagcccggttttcccattgcacccctgtcactatcacgctgtgtgatggagttcctcagagctttgcttcctttggggtcatgcctgcctttgtttcacgaggggcaggtatgcaagagagagagaacaagcagtgtggagagagggaagctccatgcaggcgcaaggtgatacaaaattactccctgctccctgtaacacagggctggattctgacttgttctcagttgggaaggctcttccccagccctttaagacctgactttaatggtagctgatgcctgagcatgaggtgggaaggaacaggagccccccccacctcatgggtcacatgcatccccagacagtgggaaaggcctcctttgtgcagccaggaaggggttatttccgtcaagctttgatccgttcgtgaaccctgaccatgaccacggaggtttgaaaagcagcatcttgctgctggctggcagccagctgtctcagagagctgagcgggtggggggaaagacgagaaatagcttgtttgatgtactttatctttttggatgagctcaagcccctttctccagcccagagtcaccacccaaaaagggcaggtctttgggccccaggggacagcagggagggtctgagtgggagctctctgcgatctgtctaaagtgaggagtcctggctggaggggtgatcttggtctggggtgcgtgagtcccacagtaccgcctcccgccccaggatcatcgctgctgtatgccttacacccccatctgcatcgccaaagctgtgaagaattctgctgaatcagaaggcatgaggcgagctcatgtgagtaaagcagcctgtgcagaagaggggtgtgtgctggtcagaaggcccgactcccttacctgctttgtggctttgactgtggtgcaggtgggaatgtctctgagccttccagagttaatgagagaatgaaataaatactggaggggtcatgggaatcgcttgcatggaaagccctgactgctggtggtgtgtggtcctctgtgttagggctgggccttggatctgcccatctgattttcagtcacaactttaaaaaatgtctctcttat

SEQ ID NO: 58970 - DNA, 2995 bp, Bovine  19866880681786
cagtctattgaaatcactctctcttaagaaataatttttataatacatggtctcatatgctaattatattttttcaactacacactaaaatgctttttttaattgaagtatgctgctgctgctgctgctaagtcacttcagtcgtgtccaactctgtgcgaccccacagacggcagccaccaggctcccccgtccctgggattctccaggcaagaacactggagtgggttgccatttccttctccaatgcatgaaagtgaaaagtgaaagtgaagtcgctcagtcgtgtctgactcttcgcgaccccatggactgctgcctaccaggctcctctgcccatgggattttccaggcaagagtactggagtggggtgccattgccttctcctacacaatatattatatgtcttagatgtataatagagtgattcacaatttttaaaggttaaactccatttaaagttattacaaatatcggttaaattccctgtgctatataatatatccttgtagcttctttttttatacatagcagtctgtacctctgaatctggtaccccaatcttgccccacctcctttccctctccacattggtaaccactgattcattctttaaatctgttaaaatgctttaaaaatagatacatttaaataaacctaagtatgaatgtgcaccacctaaaatcatctctcatgccacatcttggaaaacacgggactcactgggttccaagagcccaaagggctcattgcggggatgacacctctgatatgacacccagtcctgggaacctgcctgaacaaccaacctctctctgcttcagagagaagccgcacgatgccaggacttggaagggcctggtagccagagtggcaggttttgatcggctctggggctaccaaccttggggatggcctcgctcacagcatagctggccttgtcactgacccacaccttctcccttggggaaaggctggcacacaggatcttgagctcgctcaggatggacttgtacggaagcacctggattctgtactcggcttccaggcccaagtcaagcagtaggtgttccttcacaatgggggcgtctatgcggtcaccatcaatgaagagcctgcagaggggccagaggagaggtgagaggaaaggtgggcgcaggaatcagaggacaagaacacagacccacactcaagagacaggctctaccttccagcatcccaaatgagcagcttctcttccctccatgcccttcccaaacctgtgctccctgccccatgcctgctaccttccaccctgtcccccaagccaggacctgggcactgtcctccttgatgccctctttccctccttcatggagatctttgaacttacgtcctaagcacccctcaaacctctcctgctttcactgtagccttgcccacttgctgcccaggtcagggttagggttaaccactaccaactcccatggatcagtgccatggcctcctaactggtctccctgccactagtcttccctatccaccctattttccaatcatcataatccaccccataatttcactccaatcataaattctctatgatttacaagcctgaccatgtggtttcctgtggaaactcacagcatcctcaggacaagggcccaagctcctgaacctgactcacaaggccttgcttatgtggccctgactacctgccggtctcccgctccaggtttcaaccacactggaccactctgggtccttcacctgcactgcactctctcctgcccagtctctgagaatgctgctccccagcttagatcacctgtttctcttcctcctcattccctcctcaccgagctaactcccaagtaccctgaatctctgtctcaatattactgtctcctctgatcaggtcaggcccctccaataacatccatacctgccccactgacaagtgagtgccaactatgcatcggaatccccaactctaacccaggaccctgtctgcctcattcatcccaacacctagtggagactctagcgcataataggcactcaataaacatgcctgaatgcagaaagccactcaaacaagaagagcaatggcaggaaggccgcaagcagcagtttaaaagacaattcaacaaggcacgactcaggggtgtttcctgcatcacttctgactttctgaatggtgaggtctatttgcattgtggacccaggactgtgtataacaaagcccatatccctctctgccttggctgcaaggagtccaatgtgctgcctaaacaagtctctgcagcaggaattctgtgaactaagcttactctctctggttttgttctaatgtcctcgacacttatttttttatcttctagcactaccaataattttcaggattattagagaggcaggatataaattaataagtattgttaaggaaggcagaagggaaagggaggcaggaaagggcaggagaaaagcaggaccctggcgcacatcaggcggagaccagtgggcccgggccagggtggtggactggggctccaaggagctggggaagactttcaggtgcggggccagcactcacatgatcgtctctagtcctaagattgcataggagaaaaatacaggattgtgctctacgtctgatcctcggagattgaatagccctggaaaaaaaaaattcctgtcacccgcctgactgcgagttaaggggcagctgggaggatgcagggagcgcttccactggccgggaagggcagggtagacctctcagagaggccaggagcctcccttccctgtctcgcctctgagctgcagttgcacatatccaccagatgagggcaccagaactgtgtctttcgctgccacatcaccatcccgggaagggaacggaaagagttattagtcagaacacccgagaattgccctccagacaaagagttgaaatggtccaccccagcgggtgacccgccaggcctggccttgccgcagaaaaacctctgg

SEQ ID NO: 58971 - DNA, 1669 bp, Bovine  19866880705012
cctttttgaccctggcgagtccctcccctctcttacttttcatttcattttattgctttttattgtttctcggcttccctttctcccctcccaggcctttctagctccatttggagctgacagtctttagtcttctcactctttttcacctctctcccgcgccgggatcatcccctggactggtcgtgggccagagctggggcacctaacacggtctcccgggggcgggcggcaggttggccggcgagccaggacctaggagaggggccacagggtgcttgtgaaggggactgcggtgcatttggtttgagaccctccagtagctgctttaccagtctgcacgttacacctgctgggggagatgactttgctagtgggtgggtgatttactgtcaaattacagagtattgatttctgtatcacttcctgtgattgctgccgccttttatttgagtccgttttaacctcaagtgtatggaaggcttatcctgtagggaagagacgacgaggactcagcccagccagctctgggaggtcgccttgagatgtaacatagctggcattcagaactcaggtgcggtgagctgagagcgtgagggcgctgttttagaaccgtgcaacgtgtggagttttacatcttccagatcgggagattccagagattcaggggcagctcccacctcgattagcacctcttgcaggctgtctgtccccagttgattcctgttagggagacaccagaggcagaagatctttctcttgcacccagcctcagcccccaggagatggagagtgccctctaaactctgcagagctttcacacagagcccctgatttatttgtcttcctgataccctttttggtctcttcttagctgtgagtacagggaaagcttctgcctctccagcagcatgaaagatatcttccaggaaaccccttctggtcctacctctggtcttcagccctctccaaggggccgtgcaagccatttgaaagttattgccacaggaagtaggcagctctgtagactcacatctcaagtaaaaatgattttttttaaatttttaatgaaagtaacatgctgtacaatgaaaagtggatcttctgcacaccctagaacccagttccactccccagaggcaacagtcaactatttcttgttcatctttagataaattaattttccatgagtatcttttaaaaatagaattattttgtgtatttcctgttcctgcctctttcacctaactagattttgagagacttgtccatatcagagcatacatgtcctattcactttttaaactcatcccctgatgatagccagtaagtagattgcttcatgccttagaatttgaagcagtgtgggagagtatggcatcactgactcgatggacgtgagtctgggtgaactccgggagttggtgatggacagggaggcctggcatgcttcatggggtcgcaaagagtcggacacaactgagtgactgaactgggagagtatatctctgtccaaatgcttttgtgtgtgcactatcttctggtaaaattatgagaatcgccaggtcacagtttatgtctgttttaaatttcagtagaaattgtttgatacttagccttacaacaatgctgaacttttaagttgttgccaaagaaaataatttcttca

SEQ ID NO: 58972 - DNA, 1338 bp, Bovine  19866880736344
tctctccctagccccaacaccttgtttctcgattcattggcctgttgtgcagtgagcagagcgagcttggactcggtaacagcacaacaagatctttagacagtttcaatctattacatttattttttattacttaacacccacatgattccaattccacctaacttcaaagaaaggaagaaagacctggttggtgatgaggtcatatgattgaatactttgttttcctctctctgttgacgagcagttcctcctatgctcctacttcctgaagccactccatggcttctttgtgccagagagctgggggccgccagggggacgggctgttttcacagctgtgctgaactcccacccgagctgtccatcccactgctcacacacttgggctaccccagtgaagaggggaaggatgtaaatcatgctctcccacatgtgttcctggctcatttgtctctgagcctcacccaggggcctcttaagttctgactattaagtggtgagccaaaactgccaggaaaggtgagtctttagcataacagtggggcccaccccgcgggcaagtcgaccctggagtctacaggtgcgcctcgctgtacacaataggggcattgatggaaccctagactgagggaccacacacgaatcggggccaccgcctcttctgagggaggaggaaactgctttccctgtaaagcagggatggtcttctcaggttttggcagttgtgattttacgaagatgtatcgatatcagttttttaaaatgcactgtgggagttcaccagtaataacagtaccaacactgcttgtgttctttccgggctccagacacagtgcaaagtgcttgtctggagcccagagcgttcttttgtttagtcttcggaatcgcctttagggtcctgcgtattcttttccctgggtcaccagttagcaattgattagaagagaggagagtgctgcattgcagagcaaactagatggcactttctggaaatgagcaaagcccagcgcctcaaacctagggggtgggggggtggtgaagggccccagctcacgagatggcctgctgttcccaagagtttctcttgctctgaggctacataccatctccatttctctttgaaatctgtggcggccttgcagcatctgctgcttattttatgaactgaggcaaaaaggaggccccgaagcccccccacccccgactctgcttctcccagcactctggtgttcccgttttgattgtcggctcccctgaaaagtcctgcaaagatctcagctgcccaccagtatttggctggctgtctggtgtgcatcttttctcttaaccagggtc

SEQ ID NO: 58973 - DNA, 1203 bp, Bovine  19866880768104
tatcgacccccatggactgcagcctaccaggctcctccggcccatgggatttgccaggcaagagtactggactgggttgccattgccttctctggcaaaatactagttcctggctaatctctataccttaaaatcaatagcattgattttattaatccagtttgtatgttcacaggaaaattatttttctaagaaatcattcaggctctcaccttttgaatcggactggattctgcctgtggaatgtgtacctctctaaataaacttgcttttaaacacacaaaagtaataataaattcctaagaaatgattctaaaatgtttaatatgcttttaaaataatagacaagcaattagtaaaaaatattgtaagagtccgtattacatattatttcaaactcttatagacaagatttttcctcattgtttgtccctttatattcgactttcactccaaagggtcagtagaatgagccctgtggaaggaccaatttggagtgttaattattggatgtcttagaccaaagaatgtcctattgggctgatatttagacttgagatttttcaagaaaaaaaaaaaaaaaagttttccaaagcagtaatatcctaacagacggggatggaaatgaggaagtggtgtggttataagaggcagactgttctgtggatttcccactggtcctcttgacttaaatgatattttctgggttaagaaaaaaaaccctgacagtcccagcctggacctcggactgcggtgctgccagacgctttccagtgagttgccagactagcgtgtgtccttacttcatgtacgggcactttgttttataagcaggatctaaactaattgttttttccaagagcaatagcttcagaagattcttactgagcaggagctatggaggaagtcgttgcagtactctataactcacccctttcctgttgagtaatgctctgggggctggatttcagcagtggctggttgggcagactttgactttagagtaggtgacctcctcagttttatgagagaacatgtagatacagccaacttgctggcaggcacaggcttactcttccaaaggtgtttactggactaacaaggttaaacattacttcttaccctgatttctattttggaaatgttggcttcaattgtttcaactgaatgaaggtcattttggggctattaagacaaaccaaa

SEQ ID NO: 58974 - DNA, 1044 bp, Bovine  19866880785986
aaaatacagaacttggccagacttactgagaaggcaaagatttatccagtcccatggataaatccttcagagagagatggagagtagcaacactggaggatgtatggccttctctccatgtgtatttatatatcacctcatcccataaatgaattgtggtatgtttaatattcattactcaagggttattctttttttaaagtcactggggcaatggaagcaaagaaaaatacagttggaaaattttaatggaaaccaggtggagtcaatacccaaaacatatgccataaagtcctataaaattgccagaggtaggctaaacatttgggtctgaacagcctggtggcctgagcaaggagggaaacaggggcagtcaccagctatggggttgggaagataaaccaccaccaactcatgcggccttccagggtgctgagacctggcgtgctttttccctgggtcctcacacgaaggagcgcaatgggtacacggggctccggtgagcacactggtgtgagctgctcttacacttcctgcccctaggtcaggtcgggctcaggagccagggtagacctgaggggctcaccctcagaatcagctggcaaacagcttagagaatgaacatttctattctcccagacacatctcctcttggagcactgcggcagaccaacagaggtgttgcttcaaaacctggggatgaaggaactggaccacaccagctttaattccgcatctggcaccggaagcccgtgtaaagttggctttggcaaaaatggaagggtaattaataaggagactggtaagggagtgagagttacagaaccatccccagctgtggggcttcacttggcttacccgccagtgactcacgggcttatgagcaatcctcatatgcctgatttagaggacttactcacccttcagagaaagaccttaatgcaataaagcaaatgtcagcaagtgggacgcggcttaaccgtatcaccccagcctgcacccagcttccccctccctgcctctccctgcctgaggcccctccag

SEQ ID NO: 58975 - DNA, 1212 bp, Bovine  19866880840474
ccaaacgatccatttaatatcttttgacatgtttatcaccccatgttacaaagaatgtattccaagttgaaaacatctttctctcatctatgaatagagagataaatagatcttgtggctaaaaacaaagtcactcttggttaagtcccacatcttttcaaaggaaaaagtttccagagcaaactattaggaaaaattactggcaattgtttttggacacatgtaaaatgttcaatataaagttagttgtcacataataagcagttagaaaagtgttgagcaggacggggtagtgaaggggagaactggggctatgagaaaagaacatgcaagtatcacagatttcttaagaatctgtgtcactgagtaactacccttaccccacctcttatcaacaaaggcatcaaaagattttgcaaccaaaggaactcttgaggaaaccattggaaactgttaataacctagtgtttccttataacactgaccacaggaatctaaacaactttctaataaagacatggctctggaaagaagcaaagtaatctaattataattccatcttcccactagtatagccactgtccaaacagtccctttggaagctgaagaaaacccatcacgagttctccatttgttctagatatatgatgagggtacctctgaggaagatcggctataaagtaacttcatcaagtacacttgggagggattggagataaggatcttatatcttaaatctatgccagtggttttaagttcaatacttccgtgaatctattcagtgttgactagatgaaaaatctgatttgtccatttcccactgcctctgttaactcttggcaccctaaaccatgaagttcatttttcactttctatcccaaatctggagttatttaacaaaaaaattccatttctttccaaagcataaggaaaggtattcccctatttctaaaaattatatctactactgtttgtgaagggggaaaccctcaacttcagctgagctgtaatcttcaaattagttttaattctcaatataaaaagaggtcaagactaactttttaaatccttagtagttcttacttgcactctcttgctttttataaatattaaagtataagtatatataagcacataaaaaagtgttagttactcagttgtgtccaactctgagacttggtaaactgtagcccgccaggctcctctgtccat

SEQ ID NO: 58976 - DNA, 3036 bp, Bovine  19866880902418
ttcacgggaaatagatggggaaccagtggaaatagtgtcagactttatttttgggggctccaaaatcattgcagatggtgagtgcagccatgaaattaaaagacgcttgctccttggaagaaaagctatgaaaaacctagatagcatattaaaaagcagagacgttactttgccaacaaaagtccatctagtcaaaagctatggtttgtagtcatgtatggatgtgagagttggactataaagaaagctgagtgccaaagaattggtacttttgaactgtggtgttggagaagactcttgagagtcccttggactgcaaggagatccaaccagtcaatcctaaaggaaataagtcctgaatattcattggaaggactgatgttgaagctgaagctgcaatactttggccacctagtgcaagagctgactcactagaaaagaccctgatgctgggaaagactgaaggcaaggagaaggagaaggggatgacagaggatgagatggttggatggcatcacctacatgatggacatgagtttgagtaggctctgggagttggacagggaagcctggcgtgctacagtccattgggtcacaaagagttggacacaactgagtgactggactgaactgaactgacccacaagtgaagacatctcttatggtgttcccttctgggtaccccaaattcaaaacaatttcccccacattagagcaaaaatagggaaattgagccttgctggagtcagtggtctgagatgaggaagctggatttaagcagttctcatcttgttgcaaattcttgaacttgactacacttcagaatcaactgggtagtttgttagactagcatcttcttaaagactgtgtctcgaagtaggtctagacatctgaactttaaacaagcatcctggggattgtgatggattgctatttgaggagcatgaatagttcagactacgtgtccacactgaactcaggatgatgactgagttttagtacaattcaaacttttcctggaaaaaagaaaaaagccaaaaaagtggaggccctgctatctgtgacagtcaaacgtcaaacagaacaattcccctcccctgctataccagaggtcaaacaggatgtgtctcagatggagtccattgatgcaaacaggatctggagagaaatagcaatttttccttttcattctgaacctccatctgaccagttccggaaacagacctgattagagcataattgatttggactcggcgagcagagcaggcaggcctgcacatggccttcccgcacagtgcaagctgtgcaggatcacctgactcttcaccgcattaaaaacaatgcgatatgacatgtgctggtttcctaacaacattcacaaactaagtaagattatacagtcaatgactgtgccaattacactttagaggagcagcagagcacgtctactcagcccccaacgacagcaaatgaactacagacactgccgttgcatcaatactgactctggtcacacaggatttggggtcttttgctggtcaggaaatgatcgtgtattactttccaaagttgaatctgctattccactttaaacaaggattctaaacagtttgcctttttgtttttttccataacacacatcatagactgactataattctaatttatcagagattgaaaagacaaaccaaataaacaacacacaaaaaaataacccatcataccagaaggctgggaggaaatgagttgcgtcagagaagaattccagcagggactttttggtcggcgtgttagacttcttactttcatgcagttgtttcctcttttgtcctagtctctgtcaagacccctctgaatggcaagcaggacaaccagtcgaccaaggaataactgctggttggaagcatctcttaggtccacaccataaatcctactccttgaatttttcattccctcaaattaggtctgcaccatccaattatcccagaaagtgagaaaaccaacggtaatataaacatttaatctgtgaatttacaggaaaacgtaggcattctgccatgaaatataatgagatataagatgcttaatctgtagctctaaatggcttaattttgccagtgtgccatttcgttttgttctgtgtatacctgagatcaatgtcctttatgattaagaaaaaaaaaaaaacatatattctattagatcctagtttgtattttttttgcaatataaaataaatgtatctgtgataactttgatttaaacctttgtattatggaaaattttaaggtagagagactattataatgatctctaagtttatgaccagtccccagcctctgctcccagattattttgaagcaaattcacatcatatcattcatctgtaaatgttcagtatgtagtcctaaaagataaagtttcttctaaaaacataaacaatgtcattattatagtatcaaaattaacattatctctttaatatcaaccagtatccattcatctattgatttttaagcagaaatattacagaaggtcatgctgatgaaaatctaacaattcccgcactgctacaggaactgtgtaattgtccctcacccccaacaccccaaggcaaggatgcttaagaatcagatgcacaaaagttctttcaaggacttgaggctgaattcatgtgtccaaaccccgctggctgcggagaccgggttggattccccagcactgttgactttggtctggatgtttatccattcatttttcagacctccagtcgcttgtttatcttggccatccctttccagcctgagacttcccacactctgccatctgggcaccctctctggtttcattcccacagcccccgtcctgagtagaaaccttagcggaagcccagatcttgcaaaggtcccaagtgctgggcctgtgttttggtaccctagttttcctgtagaaaagagggggccaaaagggcattttggagagtgttctcaagcttcattaccaaagactacaactctattgccagttgatagattt

SEQ ID NO: 58977 - DNA, 1893 bp, Bovine  19866880912327
aggcctcacctggaggtgaaggttcacaaataaagcaaagctattaggagtttggctggggctccatgacagcttgtgagactctgaaaggacagacccgatttcagacaacagtgtgcgaggctgtgagggttaatattaggtggccttgactgggtgaagggattcccagatagcaagctggtaaaacattatttctgggtgtgtctgtgaggttgtttctggaaaagattaacatttgagttggcagacccaataaagatcaccctcagatatacaggggcagcatccaatccgttgagagtctaaaaagaacaaaaaggagcagaaagggcaaatttgctctctcctgtttgagatgagacatccatcttttcctgctctcagacttcagcattcctggttctcaggcctttgatgtgaaaacatccctggtaccctctgcaagctgaagaaccaggaaagccagaggtgtaactccagttcaaaccgaagcctgagaaccaagggagctgatgttgtgtgagccactgctcaaaatatcataatctctctctcttttctctccctctctccccatatgcatgtgtttcgttctgtctctctggagaaccttactgatacagggacttatggaagaccctataccaactgctacctgatgtgctccaccatcccacccaatactgagataggacagttacagtcatatcagtccagggcaactgcctgatgcttaaaaggcaagagaatgaaaaacaccactgatgaatctggcagagaatccatgtgacctgaagcccaagtccaaaggctgaactctgggacagacaggaagcaggtaagggcccatcagaagtacccaggcaggggaagaagaaaggagttccctgaggataaggccaaggtctgtccttcttaaatggtggatgcccgcctcctctgctacctacactcctgagacccgacttgtgctagctctgctacctactcacgttcagtcctcagtcaagacgaaagatgaaactctgaatcctgttcatctaaacaacagaggcgaatggaagaattccattaccaaacccccaccctaaatcccacgtctctctctatctccccactgcctactaaacttaacattaatgtacccggccaccacgtcttcccacatccaacaactccctgtcctgcttgatcttctgcttctacacttaacacctgctctcccacctcctcctccaacctttcaaccactttcacttgccagattctcctcttcaacggcctctcctctttacatactattctcccctttctctcccctcttcaaggagcaagttcgaacccattattgtatagaaactgctactgaagatcaacagacaaaggaattccctggaacatggagtcccctactccactctgagatgactggaaattccacagacatttaaatctggaaaatgctgagtatttcatctgcttcttagagttacacagtgcaccctagtatatcaaaggctctgagaaatcctatggttaagaaactgttcaaatggacacagttccctgtgccgagccctggaggacacacttaagatgtggtttgacaactagaatcctagagtacaaacacgctgaggggggaaaggaggaaaccaaaggaggggttgatgaatcccatcaccagcccatctccactcagtacctgatgggcgtctcccgacgggatgatgtaggcctggattggttccgtcacatactccaagttcctcatggcttgtctcagctgccgaagcagctctgaagttacctttggagccattctgatgtctgcaacaacaggaagaatttgttccaaaaccagtcagactgcccccacgtaactcaatg

SEQ ID NO: 58978 - DNA, 918 bp, Bovine  19866880986153
acgttttagttttcccatgtttaattattgatgacagcagtttcagtgcagatatcagagaactgtatccctgcttttagtcatgaaaatcttggtatagcttggcttttaaatataatttataccctctgatcttcccccagaaagagtcctttgtatttatttttttttaacaaatatttgttttgttttgttctttttatgtggaccattttaaaagtctttattgaatttgttacagtattgattcagctttatgttttggctttttggccccaaagcatgtaggatcttagctctccagccagggatcaagcctataccccatgcattggagggtgaactcttaaccactggactgccaggaaagtcccaaagagttctcagttgtatgaataaatatatttgtgaaattttcttgggattcagtttttattagcttctcaatgtctttttttttttttaaacaaatataattctgtttttggttttgtttttttggtatgcaggatcttagttccccagccaagaatcaaacccatggccctctgcattggaagcttggaatcctaaccactgggctggcaggaaattccctctttctttttttatctcagaaaaaaatcaagaagacaatgaaaaatgatccatactcctactagtcgatgaccccttacttctgcttatgaaatgctcatggaaaatcgttccagtgctacaggaagacatagaatgagatgcaaaatgctctcattatccctccccctataccagtttctcctcccaaaggtctgtgctattcatggcttcttatatatcccttcagaaactattgacctcgtttatcagcattataaatgcattatgtacatcctcttctcagaaggttctgctggaagttaagaacattgctctctc

SEQ ID NO: 58979 - DNA, 1375 bp, Bovine  19866881018020
ctcgtcttcacaccatgcacgtcatccttgccttcactatcaggacaggtacatccatggagatgaagctcttggaaaatagctcatggttttctataaaaggagaggatttttttgttattttatatagtcaacatctttgctttattttacaaaactgaaatgcttaagcaatgtactaaggcattactttgatcccaataaagacagatgattattttaatagactatgggcctattagcatgaagctaatgctcttaaatggtataaagggaagaaagttgttagaacaaagaatgaaggctagataagtccagtttgatgacttgacagtttcattgtaaatcaagtcagtataaatgaggaagacaatatacatatatttttctttaattctggagtcatctggcaatcaaagttgagaaaaatttcatgcttctgattggaagacatatgacaaaccaattttaatttcacaaattcttaagaactattatgttgccaaaatccagattaaggtaaatgggtataaatgctgaacaaaagtagcaccccataataataaaagaaaataaagtcactgggaactgtaagtaaagtgcatggtgagaaacttactgtatcaggtgttcaatttctttatatgaagacaaacgacagagggacagactctaaagattaactgggtggaggctgtgggaaattacattgaataccttctaatttttcagggatattttgcggtgactgagtttgagactgaatttgtgaaacagatgaagcgtcatctgagagtaattcctgctcagcatctgttggataagagtttagttaaaagccatgcaaaacaaaaaagcattaagattttaggaaggttagtgcatacatcaaatacctgcatacacagggatgataaacgcttcagccatgagctgagcatgctcacagttatcccacacatcaatcattatgtgtggaaaagaggaggttaatgtgttaacactccggctgctactgctaatttgacatacatgctttaaggaagcatggctactggcagcccaggcaaataatacaagcatttagcttttgctacagtgttagaaaaccaaaaatacattgagcagccaaatgaatggaaatctgaaagcctcaccaatgatgctacattaatgaggcaaaatgcctcactgaatttttgaacaatatccaattagtgattcctactggagcaatattagtgagctaattcaggtcacaatgaatgtggaagaaactacttataaagttatatatatatatacacacacacaaggagatggttctattgtgctatatttgttaccggcatctttaggctttcaaaaaataaga

SEQ ID NO: 58980 - DNA, 670 bp, Bovine  19866881122435
gattgaacctgcaccccttgcattggaaggtagagtcttaaccactggactgccagaaaagtcccaagagccacttttctaatctccttatgctcactcagtcatatcctattctttgcaaccccatggactgtagcccgacaggctcctctgtccatggggttctccagggaagaatcctctcctataaattggacctcataatgtactgcttaccctgatgggtaagatgattgtccaaggatacaggctgagccaccaaggctgccacccggtgacccatgctctggggctttcctgggcttcagtgaaggggaaagagtgacatcattgaccctgagctcagggaccctggtgagtcatcagagtcagagggggcttcagatccatcccctgaccggcaaagcaaagaggacaggtaatgagtaggaccaccggcagggtctccccccgccatctcctgcacccagactggagcccctccactgcttggccaggcctctgagaggtggtctgtccttcttgaaggtgattttcaccaatggtggtggtttcggcttgctttcacttagcacgtctctcttttatttaaaaatagcaaagtacttgaatgggtcagaaaaatcaatggatccatttaaacttcaaacaaaaacaattcaggtaaagc

SEQ ID NO: 58981 - DNA, 1195 bp, Bovine  19866881173447
ttccctcaacatccttcattgttcagcaagttgtatggatttctgtgtccaagatgtcccgttcctccctttctatctcaaagccactgccttagttcatctgtttatctctaaatgccttctaacttgtctctctgccaacactctttatcactccgttcttcacaataccaaatctcagacacatctgattatgcctctcattagctaaaataagtgccacagaataaaacctaaatttcttaaaatagcacccaaggccttcatgacctagtgctctcaaccttatctttcctgttttctcttcccaccacatccatccacagacccacatgcccgtggcatagcctattattccagtcagtaacttagtctcgtcttcaacatttaagagatcttctaaagctcaagtcaaatgtcatctcctctgtgaattattactctccagtgggataaacatttcccttttctgtgcccatctgcacttcctataaatgttgcgatagcattgctctcaggctagtgttggagtcagttacataaggatctattttccccactatagctcttgtctggttcacatatgctttcttaaaatgctgaaaacatatcaagccaccaaaaatattattctaatagaggaatatatgaatacatgtattgttgcttttgtttagaactaagtcattcgtgtgtgactcttttgagacacggttgtagtctgccaggctcctctgtccatgggtatttcccaggcaagaacactggaatgagttatcatttccttctccagggagaccccatcccaggaatcgaacctgagtctcctgcattggcaggcagattaccgctgagccaccaggaaaggtcatgaaaatacatatgtgtatatgtattctaataaaattagggggtgaattttatggtaatcttaatttaaaaaaaacattagggtgggtggtacatgaaagttaaagaagacaatcccttcatgtacttcctcaacaggcaactctgatggtaatatttttaagaaggtaaatatcatcttgggttggctaaaaaaattactgggaattgagttcgccatactttttaattataggtatggagaaaaaaataagccatcttacggacttaagacctaataaagttatttataaatgagttcctgctttctaagcccacaaaacgt

SEQ ID NO: 58982 - DNA, 1085 bp, Bovine  19866881188379
acggggctctcagctctgggtgggaccctctcctcagccggacgatcagaatcacactcggcaaaatattaattattgttgcttccaaagccccactactggcagatgccaggccctgcccaggaagttcaaacaatcagcgtctctggcattttagtcacccccctcccccccgttggagagctgggtcggtcgtgtgatccccgtcccctccttagatgaaagccacttcctggaacccagcctaggacccacaggtgcctggaggctggtgggggctgggtagagttggggtgtgtgtgtaggtggggaatgtaaggtgaagacgagaagaataggaaagtctccaggaaaagagaataaacacggtgtaagtgaacttatctaggattctctttttttccaaaagatgtaagaaaatcgccctgagtcccaagctgccaaaaggcagagtggaggcacttcctactgcactaatggcaggtaatttcacaggcaggatgaaccaccccagtctaatcagtggttgagcatattgggaacgtgagaaagcagtgggcaggccaacccctttccaggtgactgtggggctgtggcgctcatacttttggtggcagtgaaaatgccctgtcaaaattcagtgaggtggtacaggtcctgtagggtcttgtcccctgacctgcatcagatttgtgggaattttaggaaatggtctcttgaaagtttcttgggacaaattgcttaattgatgtcaattaagtatcagttgatactccaaagaagcattccagaatcagaaacagtttctgaaaaaaaacactcataatttgtaaatgcatgtcctcctgacccctctaaaaactggaaacaatacttggggaatgagcctatccactccacaggatatttcacagctcctaagaatgatgattgcaaagagtctttaataacataaggaaatgcagaggctataaagtaggatacacaactatacccacagggtgatcacagctgttcgaaaggaaaaaagggaagaaagaacccaacccaatacacagaaaacagggggcaggaaacaccaaatt

SEQ ID NO: 58983 - DNA, 1026 bp, Bovine  19866881205791
gatgcaaaaagatgccaacttcatctgtgcataaagcacggagcttgagtcgagtgttactgttaatccaaaatgagctgaaaatgcaaaacaaattgcccccaaagcagtttgccaaaaaccgtggaaagctgctggggccccgggggttcagtgcgtaagtaatgctctctcgatccttctgtttgcttttaaaaatatcccaatctacgtagaagcacagtctgcgtggttctttccctcctctgcgtccctggcatgcagcatcactcatgcacgcactctgcttcccatccatccagaaacactaacagagcggtagtgagtactgccttaagatgatattaactaatacatttatcctgcaaattaaagctcctattaaacagcagctcaaatcctcccctctgtccttctgaggtgaatctcttcttggctcccacttgtggtggttgcgcaaacaagatgcttttcttctcagcgatggggtgacctccatcagtacatcaaaatccaagaacagcccccccccaaataactgaggacggtggcacgtaccgatgaagtctattgcttcttgaaagtgggagctgatgtcagctgcattgctgtcttccacggggatccatttgtagtgtaggtgcattgtgcaggcctcggaggtccgccgggagacattgagcagggctgtgatgtgcaggttggcaaggaactcgcacttggatgcgtggtaggcacttccaaggtaaaggaaaggaaggatttcaactgggccaccctggaagcaggggcaaaggacaaccaggaaatattgatcagcttgctctttggggagaagaaagaaaacaatcctgacctatttgttttcaattcggaggttccctctctggttcccaggtagagagttgagagcagggcagtttaaccaagagtttgggtagagcctccatcctggtaaactctctaccctatgccactgccttgggactcagggacagtaaatcccacacagctagattttcattt

SEQ ID NO: 58984 - DNA, 919 bp, Bovine  19866881265383
acagggtaggcacagaagtattaggtgggtgaatatatcctatctgcaacccacagagactggagttggtctgggcaaggccttgtcctggcttccaggggtacagaaatgacctaaataactgtttaccctataaacttatgggggagacagacagacctgcatgctcaccacagacttcatcaaacgaaggaggtggccatcagcaggggggctggacctgcttgttggaagggtgcaaattgagtttagagagacagttgttgctgagtccctggtgcgacaggcagacgtgagcctgtggggaatagagacttaccatcagataaaagtcaggcacacacaggctctggagccccactgcctgggtttggtcctccactactcactagttatatgatcttgcctgagtttactctaacaaaaagtgctgacttcaaaacctgctgcagagattctgatctagcaagttcaggctggctaggagcctgtgtagtttttttgttgtttgttttcccaagcatcttgtgattcattatagatgggccacagaccatgtcttgaaaagcactggcttgcaggcagagatcatgccaatcagcaaactggagtgtcagacttgtatctcagtgacgtttttcagtatgagatcatgaattgtcattcgaagttagacatttaaacataataccacccagtaggtgccatggagaaggcttcaggacagcagccaaggaggatatccaacaggctctgtctccccaggccagcccaggatactccccaaaggcaggtagcaagggactctgcaaatgtttattgatggtctatcaatagacctcagagaaggcaatggcaccccactccagtactcttgcctggaaaatcccatggatggtggagcctggtaggctgcagt

SEQ ID NO: 58985 - DNA, 1450 bp, Bovine  19866881420124
ctatcatctaagaacttgacagtaagttaaatggcactttaacgttcgagtatgttttcaattgtgtaattaacttacttttgagcttgattttgtgattagtccacatataagagatcaacattatgaaacaaaaaacacacacacgtctttttctctaacattttaaactttcagttaatttcaattaaaactgttctatgcatgcagttgatattcaaataatcactacatgaatgccaggtgaatcattttgtaattcacctgaaaggaagagcatcctccaagtagtatggttacacatgtgtgtccataactagctactgctagaaagaaaaaaaaactaatcaaattcatctaacttattagacataagggatatacaagggataacaaactttttctttcaagccatagtcaatgaaacactgctaacctgtatgatttagagaggattcttagtatacacaacccactgcagtaaaaatttgaaactgtcttggcttttggccaaaagaattcagtcactagtaagacctgaaatacctcataacaatctcatctagaaatactagggcacataccccaagatcaaatgataaagcattaacagaagacatgaaataaagtattagggcacccattttgaatctcaatgactagccacagtctacgactgctcaattaatttcaaataaggggtgtttatgtttaaaagaaagtactcttgattaaacatcttaaatgtattttattcaaattctacatgtttaatgtttccaaaggaatctgaaacagcactgaattttaatatcagaaaaatgagtattttagtgtgagaaacattattagtaaccctgtgtcttcaatacagtttgagctttcttaattcaacggatgctgtttttaaacactgctccctaatattacctttcactaaattgccaacaaaggacatatttgatctctacaatagtaatcctaaacattacttcaaacagctaccaatttaggttataattaactggcttgacctatcaatgacactggtgaagcatcaacacagaggtccttgaggaatgggagtgacaaagtaaaagccacttatagctaactgtaaaaggtaaatcaggtggaattttgaacaaactgaagttaatattcacctcaggttgatgcagtgttgataatcagaagatcaagacttagtgcagaactagaatcaacaaagagcctgttggaccagctggggccctacacatctggcaagcttaaagaacaacaaaaaaagacttgaatcttcagtaattaaaaagataacatggtacagcccacaatctagcatttgagctacacgtatgtcatgtgaaaagagaatcctcttccaaagtcaaaaggtgattctactttatgcagattggttactgccgttcagatttaaacgcatctt

SEQ ID NO: 58986 - DNA, 796 bp, Bovine  19866881514959
ctttaaagctttacttagaattgaatgattctctttggagcattaaccaaagaaatcttggtatttaatcttgaacaaaatctgaacttcatttcattctttcagttactttatcctatatattaccgtaattctttggctaattagttagttcttcaaagtggagtttgcccttcaagtatttataaacacagaaacttgtttgcataaaataaggcactgaacatttactctctcatgataaattttctggttaatctcctttccatcgggaaaagatttctttaagggtttatttaaaggatagctttatatttaagctatacttaaattcctgaaagcctgcactgcttttataacttctatttgcttttatctaggccactgatacaggagaattagtcaggaatggaattcccctttggctttggactcaatctctgtgattaaatccacaagggcacaacaaaaatgatttaccagggccacctcaggcagttctatgtcttggtgcttattttagtacctaagttggaaatctaacacaaccctatcctgggcatcgtgtgtctatgtatgatgaactctagcttacggggcccatgatcttccctatacatatagttacgaattcaatctgcgtgttaaatcaagttgttcagtcattttccaatacttacatgtgacctttacaatttcactgaaggtatgtaggaaacttatatcatttgaacgtgatttacaaagtctggatatgactgtgcagacagaattttcagcttgagttaaggttaga

SEQ ID NO: 58987 - DNA, 1072 bp, Bovine  19866881607844
gaaatggcacccctcgagtatccttgcctgggaagtcccatggacagaggagcctagcaggctacagtccatggggctgcaaagagtcggacacaacttagtgactaaacaacagaccagactgtaattgtttttatttgaactgggaggagaaccaaagatttcagtaacccaagatactgccatgtaattagttctatgaaatgaagctttgagactgtcaatctagacaatgacactctaagaataaacaaataacgtactgtttcaaagcctactatttctattctctaaccagaatatacatcagggattttaagcattttttgcttttcatgaatttcttaaatgacatctgagaattttttaaaatgttacagctaaatgtggatcttgaatcatccccaggttggaaaactggaaagttgtttcatatcatgagtaatagaaaatactaaatatattcaaacttcccagtgtgagctagtgcatacattaaattaaaccaaaaaagcttaggcagtcatgtttcaggttttggaatatgtaatgtataaatataacctactacaagaaaagaaatagctcttaccattaaccaccaaaccaaaccatgagacagtattttattttcagttgtatttggaagaccatgtatttgttagctttggcttgccatttgctgaataactaaaaatggcatttatgactagaccatcaaaccccaaatggaattgagggagagattcttttactgaaatataaaaaaagaaatttccctttagtattatgttagtacaagatctttaaactagctctcttgtggaacataaggtaattagttgtcttatccacagtttcctttcatccataagatactgcttggtgagaaagccaaaagattagagtgataactcactccaccagaaaggaactgctcagcaacagaaacggtatcgaaaaatttcaagccaaactagacaagctgactaaaagagagactcacttgtggaactaaccatcctagctacctgggcagggactcactctcttaccatcagtgacactgtaa

SEQ ID NO: 58988 - DNA, 1014 bp, Bovine  19866881935070
gaaggtatgtcgggacctgctctactcaccgttaggccaatggagactcttccatcactcattccatattcatatatggaatgaatagattccataaaagcttccttaaagcattctatttttaatttaggtaagaatgttactaagcagagcccatgtaccaattttatgacccagactacaatgctgtaaaagtaaatcatgctgaaattaataaatcttttctctctataacccctgtattgagtttaccaaccttcctataactgaaataatgaatgcaaaaatatttctcctcacataaagcagactgccaactgacactctctgcagcatccacctccacccagttgcacagataaattctactgtcgtttttatagcacctcttgtataaatctggatattttattatttgagattttgcattgacaaattttcaaaattagctcattttatgtttctacaaatcatcatgctggggtaatgaagaatgagtgttcatgacagggaatgacttagcagatgcctcagggaacatcagtcatttctttgtcctcttcctgactcttcctcttcctggctccctcctccactcagtttccttcctgaacggtggtaaaagaattagattaaatttctagaataaagattgcaaataggttacctctcatgagctcactctaattaacagtgttgcccaggctgtgtgtcgagaagagctctgaggtctggtctgggctcagttggagagagcacttgggttgatcagcaatgactgccatgggtgtggaaaggaaacgtatcatcgcacatgccagatatttcctattcctgcatctttcaaaagagacaaggggccaataaaaattcataagccaaaatagagataaaatttcacagagcctggtatctgggtgagtgctcttgctactatgctggcattaaattatgtagaataggttcaacatgatattctgacagagatcattagagtaatttcaaacccaccat

SEQ ID NO: 58989 - DNA, 1138 bp, Bovine  19866882027088
ctgagcgactgaactgaactgaattgatttcttcagagatggtctgtggctccccagtggagaggacagcctgcatctttgctttcaagtattggtactcttccatctcttcctttctctacccatgtccagggaccttaatggccactctttcagttggacctttgaattctgagtaaacggacattctctcttgcactccagtttcatttagggatcacaagtaaagagttctggcaaataaatgaaaagtcttccaggaatccggaaaacagttatgtaaggaacaaggactgttatcttagaaaagataaggtggggaagggacaagatgaccatcttcaaatatttcagagagtctagatttacacaatatttctccagacctggaagcaaaaagtaggtgatacgggaaagtcggcttcagttctttgtccttagaaaatgaagtcactcagtcgtgtccaggttatttgcgaccccatggactgtagcctaccaggctcctccatccatggattttccaggcaagagtactggagtgggttgccatttccttctccaggggatcttcccaacccagggatcaaacctggatctcccgcattgcaggcagatgctttaccgtctgagccaccagggcagcctgtgttagttattattttgcttgtagtcaattgattgtgcttttacttcacatgatttctagggactataagcataactttaagctgttctttgatgatgggtgcctcatgccttgtacatcccaggctagtttgagccattccatagcagtagtgcttggctggggtgtgtaccccccaccctttttttgttagcatggcagttaccttagcctaattccatagtcaagtagttgagaggcttaattctgagagtaggtttttttttttcccccaaaatcctggtgcttgtggtgtgtgatcaaaggataatggctgagattacctgtgcatactgcctctggagacatgatgttctatatattttactgtgacccagcagaatttgtatttgtcaaagcatatattcagacctgtatcacccaaaacttttagtcatggccactaagatcaattatattcagtattatttagataaacttcagataatt

SEQ ID NO: 58990 - DNA, 1486 bp, Bovine  19866880681174
tggaaagaacacaggctttggcacttatgctcactgaagcccagtgagccagagaagtctggggaaacagggttagaattaagagccatcagaaaaatcaattgccctgggaggtgaacacagggagctctggatatatttaaactatgagtcacatgactagacgctacttaggcagaagtaaaacatgttttcctttaaatgattaaacttagttgaacttagtacaagaaaaatttcttttccctgtgaatgtttttttccccgggcttaaagaacttcaagatgagatttgttttcttaaagaaaaacttatatccatagcttcaaactagatacatctgtggactcagaacacccaaatgacaccagataaggtagcccatctcctgcatctggatggttaagatagcacattttaaaaaaagaaaggttagccaaaattcatcttaacagttattctgcagtcccatctggattcaggttaatgtcaagatgggagttaaaactcaccatgttggagctgtcttgctttggagaggttggatttttttttaaataagtgacaaagggagagaaagaagtcttaaattaaatgcaagcacaaccaacaattacaccatcggtttcagtttgaactggacacgtctggcctgtttgctgttcttcttttggggttggttcacttaaaaacaataaacgtttttgttctttcttttttactatccagtgaccaaaagctagaattaattatgatcagtgcctactggctttttccctgcgtggagagagaatgctttctgtgtctccttttaaatcttttctttctcaaaagtggttacctttctgaggagggtttctaatgaggtaccagatcgcctttggggcaggagccgcgggacaggaaacccagggcaccacttcctgctgcccgctccctgctgaaaggctggagggggtagtcggtccgagagcgtcgctcctttccctccttctgtcctgtcttaggtctgtccatgcacgcgagggagaagggcagaaatgaaagggtgcgaggccctgcacctgtgtcatcttactccatcctcagaggtatctttaccgtcctcccccctcccccaactcaatctttgaggaacaggaggctgggacaggtgacgtccccatgcgctccacactggggctggaccggaccgtggagtcatctccgcgcgcatcatcaccgcaggcaagccggggtggcctctgcagtgctttccataaaggaacgaaaaagcgcggccgagttagcccgagcgccggtaggggctccagggtgttcagttcttaactggttgcggggagtaggagggtccctagtccccaggagccagggactggagggcagacccccgcaagaaagcgcaggacccaaggtggggaggggcgaggaggaaggagtcggaggaggagaggatgccgggctccagtgccctcgtccccgagc

SEQ ID NO: 58991 - DNA, 1221 bp, Bovine  19866881337035
gtaaaggaattctctgtcggacttgacatcactcccatcctctgatactcgcctactctcttctcaaagaagttagtcttcccctccagtgaaatattttccataaagtcaaatggattttctactctgaaaacctgaaaaggttcatagcaaaacataagcacagaacaccggtttcagaaagaaccagagggctacccacaaaatactttaccttgctaaagcccagctccagcataagtctatctgccacgaactcaatgtactgcttcatcaaagtgcaattcatcccaatgagcttcacaggcagggcctccgtgaggaactcctaggggccagagcacagcttctcaataaaaccgaagcattaagaggtcttctagcaagcacaaggcctccctgtgttacccacctgttctatcctaactgcattgacgattatttcttttactctctgttccgaaggtttgtgcaacaggtgtttgaacatcaggcaggcaaagtcacaatgcaaaccctagaagaaaaaggtttaaagtcaccaacagagcagtggcaccacactccagtactcttgcctggaaaatcccatggacagaggagcctggtgggctgccgtctatggggtcgctaagagtcggacctgactgagcgatttcactttcacgcattggagaaggaaatggcaatccactccagtgttcttgcctggagaatcccagggacgggggagcctggtgggctgctgtctatcggacacgactgaagcgacttagcagcagtagcagcagcaacagagcagtagacttctatcattaacgtggaagaagaaactgttaggctggcattcttgttagacatcctgtgtggtcagactaaagcatttcaaatgtcaaggggaagatgactcaaatgctttgtcactaaggcaggctcaggccccacgctgggccccagtgctgcccctagaggacagcgagacaggtctggtcctcactctgtggttgccaaggagtgggaggaaatttttctcagcattcttccttcctacagccctgagctttaacattcaccaccactacttccagcagaaaaggcaaaactctgaataggctggttagtttttagatttataacctaatgtctgggaaagcagtaatagtaatgcaatttcaagtgaatcaagtctgcaagtctcagtgcattaaatcccaagtaatg

SEQ ID NO: 58992 - DNA, 997 bp, Bovine  19866881522197
tccttcaaggactttagggcccgtgaccggagatacgaacaccagtgttctgttaactctgcttcctgggagggagggaggagcaagacatatttgcctgaagattagaaatagagaaaccagcccccagcaggttctgcaacttggctgagatcttatcactcgagagcttgaaaactcctgacttatttaagccacactctgagcgcctcacatgaatcttacaaggctgttttgcttctgtttaattggggctgtgccttctggctgttgatgtcctctgacaaggcagctgtgaatccagaggactttattcaatcatccacttactcattcactacgaaaacctttatgaagcacctactctgtcagcagaaagagtgggccctttgaagaagggagaaatgaatgacaaggtaccccctctgactcttgctggccatgtgacctggtttgacctcctgggcctcaatttcccttcccctctgatgagaagagatgatgacctcccagcccagtgatgagataacctgagtaatgggccttttacaggcccatcgagtattcatttctttacccttctccccagctctgtgaaaaccaaggcagtcttagcctcagtgatggacagtccagggtgaagcaggccttggagccctcggtggtccacatttgatttcctcttcctccagcagaaatatcaatggagcccaggggagaggggaggctcatgcatatgataggtgtcaaggatggcgtttgctctttagactagcccggtgctttgttattagcatttaataggtccccagaaagctttgaagataataataggtctcccctccctttcaactgatgatcttgacgtgatatacttatgtctgtaataaaattcaaaggttctcacaaggagccaagacttgctcttatctttaaaaaaaaaaacttaaaagtctagttagaaaattaaactcacagagaggaacggcccaggaat

SEQ ID NO: 58993 - DNA, 2168 bp, Bovine  19866880669653
tactaattcagtagcaaatacattaggaggtgctcagagcagtgatcccatcagatactatcaaagagctgcacatggagacaagcctcttcataattcatggggcaatttcactgtctttccggggaggcttcttatcaatagaaatgtgctcttgtgagtgaattgttaggaataccaattatgtgcttgactatttaattctacagatattcttagttgagtcatgaaagtgtgtagctgatcaaaatcgaatttcagcatcttcttacagtgtcattcttcaggagctccagccttgttaaatgtgggttaatataaagtaacatttattaggaatttcttctttgatattcaaaatagctttaagacctcttccctccaaatcactgaagtgtcaatactccagctcccccctaaattcttctaactttgatgccacaaaagtaacatttattttttattcagtgtttgatgttctctttctcttgacttacaatgaaaatgattcccagctaacgctactgatgaaagcaagtgaattcacctacaatcagttgtttatatattttaaaatgttgaaaagaaaaaaagcttagggtttagattgtgatttcttgtgcatatatatatatatatatatatatatatatatatttaacaactctgtgttttaaaaaaaaaacaatttcccatctaacactaagagttactgagttttaagtgttcatttattggaattcatcccagtgctaaattcagcatttaagtgcatagtctcgtgtaatgttagttcagttcataactagacagggccaaaaaagtaaactttaaatagaaaacaatgaaaagcatatataatccttgagattaaaaaaaaacctaaatattggatcttcaacaaaatatgaaataaaggaactgattctttttctccacattggaataatcctggaaaaccaaaaagagctttgaaatgaagatacttaggggaaagcacccagtcttccaaaaatttatagtggggaatattttactggaacacactcaaatacttttgcctttttattcccgagtgtatattttagaattcttaaaatagaattcttgaaaaagacatcaaaatcatatgcagtcactgggaaaatgaggtctctaagatttatttatactttgagaactgaaaattaggcattaaatagtcagggagaagtttgggctatgaattttctctggaagatcttccctggttggctcagtagtaaagaatctgcctgccaatgcaggagacgtggattcaatccctggatgggaaagattccttggaaaaggaaatggcaacccactccagcattcttgcctgggaaaccccatggacagtagagcctggcaggctacagtccatggggtcacaaagagtctgataagacttaggactaaacaacaacttttctctgggggcctctggcggtgtgacctagaaatggtcagaaaaaaaggggatttaggggagagagaatttcccaagtggatggaaactagcagtgcctcctttcctactaaaaatgctaaaggagtaaagattctggtgttatgcaagagggcagattttagcatccatgaagaaacagcagttttaggaaaggattctcactggtagacattgaacgtggtaagctgtccaaatccaacaagcaataggaaaatctgatccggatcagaaggatgattggtctgaagatggagccgcaaaggtaaagcaaatcctaggttagcatgctttagtgagaggaccagggattcaagacctattcaattttaggataaaggaacgtgggagcagagtacatcatgtgacatgccaggctggatgaaacacaagctggaatcaagattgctgggagaaatatcaataacctcagatatgcagatgacaccacccttatggcagaaagtgaagaggaactgaagagcctcttggtaaaagtgaaagaggagagtgaaaaagttggcttaaaactcagcatccaaaaaactaagatcatggcatccggtcccatcacttcatggcaaagagttggagaaacagtggaaacagtgactgactttattttcttgggctccaaaatcactgcagatggttactgcagccataaaattaaaagaca

SEQ ID NO: 58994 - DNA, 1132 bp, Bovine  19866881528085
gtaacttatgctgaacatcaaagggaaatattttagggcctcagagctccagactttcttacatttttcatatcatttcctatggtgcaaacacatttaatagaaaaagagagagccagtgttctggagaagtggcattgctttttcacgcttccttgaaaccaagattgaagtagcccgagaggcatttactttataggttcaggtggcctgggactcactagtccactctagtcctgggcagctagttaagttcacaactttgctaataatatcatacgcaggactggagagaaactccctgaagacacagacatttaccaccctgaggagtgatctgctttttctctaatttcccaggagtaaacaaaggtgatggtggctgaacccttagcacagagtgcttcctcctttaaaaaattttttttctataaaacttttccagcaagtcacagaataatagaagattcagggacataattagatagagtagaaaaaaatgtattccagatcactaatatgaaaccaacagtattttaaatccaggaaacataaaatagaatagaaaggaaaatggcatagagtctagttacaatgtctatattgccaaagctacagcataggggatacctaaatataaaactaaatacatgttcttgtttatttaaaaatagagggaagttaaaggtaaataaataaggttcactaagagactatatctcaccttacaggtgaattttaatttggatataaatagtagtagttgtataaacagaggaaagtgaaagtcgctcagttgtgtctgcttctttccgactccagggactgtagcccgccaggttcctgtgtccatggaattctccagacaagaatactggagtgggtagccgttcccttctccaggggatcttcctgacccagggatcgaacgcaggtctcccgcattgcgggcggattctttaccatctgagccactagggaagcccaataggcagaggaccctggtccaaaccattctattagcaatatttccttgttctagaaagccaccccatagctttccttttgaaaggagaacaaacttttcttctggaaatagcctgtatgtctttttaaaaataaaattcatcag

SEQ ID NO: 58995 - DNA, 1163 bp, Bovine  19866880473181
cccagcttagcaaacactttcccatgttcataactcccgcccaagcaaaagcctgaattagatgagtagccgtagaagtagaaatgtaactgaatcaaaactcatacaccagctctcgtatatcacgccagctgtgcagggcctcaccgcacagggcgaccccagctactgggagttgacccaagtgggcttatggcggggctgagaaactgagggggtctctgtctccctgggcaacctcggtgtactatctgagcctcaccctggagactggctcgtctactgggctcgcgtccactggtgtttttactgagcagcgctggttgggcatgggttactcagctctcaaggtgagaatgagggctggtggaggcatattttaaaaaccaaatcacaaggatccagggcacatagctgactcctgctttcctttctccagaccaacggctccaaccacctggcctttcctcccatctctagcacagcaaagctccagggtggggaaatgaaggcatatgacccccggggttgactatcacctgggtggggcctgagggctgacctgacccatcccagcctgactccagccttcgcttccagctgaccctgcctccctgggccttcttggcccagaagttcacctcccaacctctggctggctttagtccactaatcccaggattcatgatggcgagatgtactcgctctcctctctaaaacctcagtcctgccctcctctgggtctcccttagttccctccacatcctttccactctgccctcctgctccaagtcctcaaccaggctggggaccctcaggttcaggggtggggctctccttgctgagagctgagagaggggaagcctgatgggagccaatggggagaggcgcatgagtgtgctggcacgcacgtggatgatcatgcgcatgacacgtgctcctgcccgggttggcgggagcgggagttggcgggggagcggctggacagccggctggccctgggaggtggcccggtgccatgggaggtcctggcagcgcctggctggcacactgggcagcgggcctagtgcttacaggtgtatacaagctcctcccgcacacactgctggcactccacgtagcagcaccactgcacctggcagtggcaggagaaggccgtcagg

SEQ ID NO: 58996 - DNA, 1341 bp, Bovine  19866880486367
cctgacacgccgtggcacttacacgtggtccggaggccactcttcacggcctgcgaggagaggcaggagggaggcgtggtcaggggcctccaggctgcagcccccggagtgccaactgtggccggggagccgcaggaggatgggagaggacaggggaggcccacatgaggcgggcagctaaaactcaagctggcccatgtggcacattagtgcaaactagctctaggcaccccttctcctgggcagagacagtctgaggaccgtctcaccttggtgagagcagcgggggctggatctcaccccagcacctccccgggcccaaagttcctgtggagcagacagcttgcacaactgaacacagcagccctggtttacaccaactcagtgatgggaacacaggacacagaactcagtctcttaaagaaatggagcccgagcttctcccagcttcccggtcccaacagacctggatactttttaccctccagtctttccactgctgtgtgacctcagctaagtcccttctgtcttcccatctgtaaaatggaggagggccaggggttgtaccagatcagttttcaaacaccattggctcctagggcctccaggaagggcagtgcttggaatggagacccttctccaaacacgttcctgcctcaccaagccaggctcccacctggtacttgacaacagtccagagtagatgcccaaggaacactggttgaaaggatgaggttcatcctggacggcctctgtgtgtgtcctgcaggggggtagggtgggtactggcctcctagagacctggctccccggctctgcaaccagcgatgcactcaccttgatgcccacgtgggtgttgtgggcgtctgcccgcgcccgcaggtctttgcttcctctcttgggccccagaaagttgttcaggaacttggtgctatacttgaggttgtcaccacacacaccccactgccaggcttgccggctctcgaggcccggggagtcatcacaggtgcaccgctccatgcggccagcgctgcaggcccgggccagagtgtgcgtaagggcggctgcggacaccgcatacaggaaggccgtctccttgaaacctgggccgggccgggggggggtgggatcgggagggaggaggagagtgggctcaggggctgtgagctgccctctgagggtagacaggctggagggaggggcgtgttaccccaaggacacagttcagggcacttgccctgtcgcccaccccttaaactcaggctgcaagttgctgtctaaatggagcttcctgtctccctgcggggtgtgtgcccaggttctcagggcggcaggatgggg

SEQ ID NO: 58997 - DNA, 1219 bp, Bovine  19866880884004
cccagaggaggatggcgcacatgtgccgatacacctggcccatccttccaccctggcacgtgtgcccagcagactcagtcccatgggaatgattccttcacaagacacccaagaggtagatacatgcagtcagccccatgggtgggtatagcacacagaagcacaaaattgggtgtgtggaggtgccttgaacatgggacagaaggcctgaagggtggggccagacctctgactctaaccatagcactctccctggaaggaaaagcctttggtcatgagggaaattcccagtatgtgtgcgagcgtacatgcttggtcacttcagttgtgtctgactccatgaccccatgaactgtaggatgccagacttctctgtccatgggattcttcaggcaagaatcctggagtggattgccatacccacctccaagggatcttcctgacccagggattgaacccatgccttctgcatctcctgcattgcaggtggatcccttacccactgggccacctgggaagcccctcctagtacatagtcaaatgtctataagcagtgaaaagatgggatgggagccaaagaagtgatgctggctaagggtgacacacaacttctaaaggaacctctagggtagagctgccaataaggcaaatcagaagggttatgatcatgaatgggggagcccgggcactttaaccccaggttatgcatgtccctgccccccaccaccagcctttctcccaatagatcaaagactagacagcaaggacttcccttagtagagaactctgctgggttgaggtgacagcaaagacaggcaggcctgatggtccagctttcccctaacgtctccctcagcctgagggaagggacaggagacggaggctcgagtgacacaacaaggcctcaagacccagcagctcccaccagagctgctcagagtcaggcctgagaaccagaaatacagggtaaaccaaggtccctgtctctggaacgagaatcctcggccctgccctcctcttcaagagactgtcctgagaaggaaagttggcttcccactgaggtaataaagaacacctgctcagcgatgtaggtcaccctcaggttaagcagggaaaactccctgaaggaaggaggccttctgaggacaaagactgaggagcttcgctcatctgggacacaggttttaaattatacactcccccacacgtatcacacaca

SEQ ID NO: 58998 - DNA, 744 bp, Bovine  19866880916062
ttgactacactttcgtcctgcaaagatcaaattgatgtttttctgggatagcttctcagtcatcagccccaaggaaggataatcctgtaaaaagggacaatgtggagattagttaagaagtaagaatctgttcacatacatccctggattctaaaccttaggacttggttgattttggccatggcccagacagtggtggggctttaactttttcaccccatgacaataagaagcaaacacaaactcaggcgtgaactcgggatagatgaagagatacaggcttgtagtatcaaaactaaacacctctttcttcctactcagatttgaagcatccacatcaaggagcagcttcctggaccaggtactgccaggcctcgtcattttgaagcttactcctattttgtggctcctaacaaatgccttggcttggtgctcacagtactctgccatgtgatctcaaccttcctttccagtcatcatgtagcctctcttcccctttcactcaccactgatctggaaccctgtctttctcccacctgaagtggacttctttttgttaatcctccttccttaggatccagctcaggcctcaccttttccaggaggccttccttgaccaccccaattcacgatgagctttcttcttttgaatacctaaagcctttatcaaatgtttcacctagttagcattaatcatgcactttctgttattggtaccatatcttcttgactaaaccaaaaact

SEQ ID NO: 58999 - DNA, 893 bp, Bovine  19866881224987
ctgagaagggaccctaaagtcaagagagtgctgcagaagaaaaaggaatttatattaggcagggactgtggtccctagcaagtacgacactgatggaaatattcagtgctcagtatgccatagggttgacagccacccaagcctatttttcccctaaagtgttcaacttaaccttttgtacgtatacattttgtaaatgtacagaaatagattttctattgcagaggtcactcgtctctcacctttccagagagttattctataaagctgctataaaaacttggaataatgttttttgagaataaaataattgacttctttttaaatttgtctggatctttcttctttctttttggtggaaacaattttttttttccccagaatttatgttcctaccatgacttgtgtataaaaactgggttaagtataaatatgattgcatcaatatttgacctaccatagaaggttactcagtttggccgtgtgttggtgctaattcacataaaattcacgtgtaaagcaaggccgcatttaggtcctatgagagtagtgcccagcactctcccagtatgtatgtaaattgtatcaacttgttttcctcttactaatttttgtatttcaggctgaaagaatattctcagaggttaggagaattgagaattacagagtcgaaggcatggagatctactctacaacactttggcatcttcaaaaggatgttgctctttcagttctttcaaaagacttaacagatatggataaaaattcaccagaggtaaattaactgaagcacttcgttcatgtttgtttttcttttcttttttttttttttttgctgcatcggcgtggcatgtgggattttagttccccaaccagggatgaacccaggccct

SEQ ID NO: 59000 - DNA, 1327 bp, Bovine  19866881246610
tactgttttgtacctaaatatgagaatctgttttctaaaagaaaatttcataaacaaatgtatttcagctaacctgaatacatttttgaatgaagaccaaatagtcaaatggtattgatttatcaatttagctatatatatatgtgtgtgtgtatatatatacacacatttttacaatcataaaatatatttaggaatttctttttttctactctattgaatagaacaatttattaaaaagcctttttttgggagagtggtaatcatctaacacaattttcctgaataaccatcttcaattctaagttatttgaaaatggtacactttgaatctgtgttagatgctgtccctgtacttcttatcccaagccaaaagtattccttcactatctgttgctgctgctgctaagtcgcttcagtcatgtccgactctgtgcaaccccatagacagcagcccaccaggctccacccatccctgggattctccaggcaagaacactggagtgggctaccatttccttctccaacgcatgaaagtgaaaagtgaaagtgaagtcactcagtcgttccgactcttcgaaaccccatggaccacagtcttctaggcttctctgtctatgggatttccaggtaagagtactggagtgagttgccactgccttctccaccttcactatctaatgagctctaaaacaatattatgtgtaaaagcaaccagttactatactgcttattaagatgatttttccaaggcttttttttttttctacaacttcaacacttccgtgatgtcttaccccccaggaataattgataaatctatataaaattgattttttgaaaaatcaatttcatcaggtggattttatacacatccaaattagcactgattcaagtcacttaggctagcaattattccttcccaaatagttactttaaaaattaaataaatgacagaatttctgcctcataataggagagatttttgaagactcaaagtaatacttttttataagagataattttgaggaagtgcttatatttaggcttacatggtatatcaaactgggtatcccatgtttaagctttaaaaaaagaaaaagcaaaaatcagttgctcatcgtttctctcaacttttttctatgcctaataacaatggcaccccactccagtactcttgcctggaaaatcccatggacggaagagcctggtgggcctgcagtccatgggggtcgtgaagagtcggacacgactgagcgacttcactttcacttttcactttcatgcattggagaaggaaatgggcaccccactccagtgttcttgc

SEQ ID NO: 59001 - DNA, 1314 bp, Bovine  19866881260513
cagggggagagcatttcccatcactgggggtgcctggctctgttcttccaacccccaacccccatccatgtttctgcttcagagggtccgatggttccagaggaggccacccccaggatgtgggtgggtgagcaggtaggtgccacaggacaagactggcggttcccagggtgctgggtaaggccaacctgtctggacccttagctggagggaccaggaggtgtgcctggcacccgggccggtgccaactgcgggcagttacctgggaaccaggaaagccttgtcctgcctggagcattggccttggccctcaaaaaccctattagatcctcctgataacaggtttccgctgcagggccatttgcatggtaagtgggccttttgtgctttcatctcaaatatctcagcccacctctcctgccctcactaagccccctaaatatacacacacacacacacatactccccacctcttcccagaaggggagagttagtgagggcagtgtctggcccaagaagagggcacatggctccaggcagtcctttttcagagcagtgttggggggaaccctcaacacccctggctcctctcccctcttgtcatctgaggggcccccgaggtttatgctcctgagaagcacctccctccctccatccttcacattcctctctccttgacaagactcactgtcacctcatacctcctccaagaagatgtccttagtgagcagccttaatggcaaatttggcaggtaccatttcccacctttattccaagtccttctccccactcctttcactcactcatttatttaaatttcaatattgagcatcagcttcaggccaaagaaaaccaaaagccaccagactgctcacaacatccctgtctgggtcgcagccttcctttcctccccagctctctgtctcagaaactctaggactgaatcagtacacctccccttgccccaccctggagcccacccctggctcagaaagaaaagagcctggcccagctgtgggctttgtctctccaagaactgctccacttcctgttttccaggggatgcctgcggaggatggcatcatggactatgtgctcaggagctaagtgggcagcaagcagcccgcccaaccagcttgctttgcatctcaacaatctcggatatttagagcgtggctggtgcaacatctgtgcaggaaatgctttccgcttcctcctcctgtctccctcccactccactcaggctcaggctggagatgaggaagggggtctttgtccctggcacatactgtacaaatcaggtggcatagtgg

SEQ ID NO: 59002 - DNA, 1348 bp, Bovine  19866881523003
atgcgtgggcactaaaagtgcacgcaccacaactactgggcctgcacgcccagagcctgtgctcagcaagaagccaccacagtgagaagcccaaacactgcaactggagagcagcccccactcgccgcagctggagaaagcccgtgcacagcagtgaagacccgtccagtgtagccaaaatacataaaacaaaaatttgtttaatcttaaaaaaggaataattaaatatatttaaggaactcagaacagtgcctagcacaaagtcagagctcaataaatatcagctaccgttattactggtatccctgttatccgaggctgttttcccaatttatttacccagttcctccttgagtttgagctgggtatctgagttagttaccctagttcagatattacaacccccgtgggctgggaacctgatgacctttttaacatactttgaaactaggaggtctaccaaccaagacaatattttgggtttcttcccaaaatatttagtcatctaaaatcctcaccctgttgagaaccaacttcctgttcaaccccagtcaacaaccaacataatcagaggtgcgacatcagccctctgagggccaagttgagtatgctctgaacagctccgttcccataaaccacagacgtctgatgagtgacctcactccagtaacttctcgggtgttatataattaggtgtttgcatatctgagtattgatgggtctaaagagatgtcacacctactttccacactgtctcccaccttcttctctaaacatacacactatgctcaccacacatgacccaaaaacaaccaccaccacaacccaagctagctatttcctatcctaccaaattacaacctgtctataattaaaggaatgtctggaaagaggctatgagatcccaatgtctgagttcccagggatgaagggtcccagttcttctgggaaaagcagttatgaattctctggaagactgaggtagggctgaccctcaaacctcaaagtggaatcgcttcaactttacatgtcagtatggtcaggacaggtagaaagccagatcttcaggggaaaaattaaacctgttaactatctgtcctaaaaggggtggacggcaggtttcctggaaatagatacaagaccaggtgttctctgaagtgcctccccagccacagtgatgatgacccatgatggatgatgacctaaagtcagggacgactggggagggttagcagaattgacaaaagtacaggaagtccagttaaattagaatttctgataaaaaataactttttaagtatgtaccacatcttgcataggacatattggacttttttattgaagtata

SEQ ID NO: 59003 - DNA, 1150 bp, Bovine  19866880538681
agtctgccttgcaatgcggggacacaggtttgatccctggtcccgggagaatccacgtgctgagaggcaactgagcctgtgtgccacaactaagacccaatgcagtcaaataaataaaccatttttatttttgaaggaacagtgcatttatagagctgggatttttaagaaaacaaaggatgcatagtaaacatgtctgtcttctcctgaccctcaacccctccaaaatgccccagaacaaccattattgtatacgtatatactgtctctcccttctttccttatcaacacaaatggttggttactattgcgcatgttaagtcgcttcagtcatgtcgcactttgcgaccctatgtatggtagctttccaggctcccccgtcccttggggattctccaggcaagaatactggagtgcgttgccatgccctcctccaggggatcttctccagccagggaatgaatgcttgtctcttctgtctcctacattggcagggggggttctttaccactagtgccgcctgggaagctctttacaaagtgccaattcaataaacagttaccttgttcttcacagctgcatatagaaacaattctaaaaggaaccatgtgatattgaattaggccctgttgatgaacctattacatggtccagtattttgctatgacaaacagatctacgctgactactcttgtgtgtatatgaacttacacatgagcatgtccacctataagataatttactttaaggggaaatgctgggttaagggcaaatgatatgtgcatttgtaattaaaatttttgattactgaatatttcaagcattcagtaagcaaagagacaagtacaatggacttctaacacatactccaccacttttcaattgttatcattaatccatggctgatactatatcatacatactatatatatatatatatatatatatatatatgtatatagttaggtcctacttatccccttcatcccaaattattctgaaacaaccctgacatagtattttttccatgggtaaatatttctgaaaagtaagggcttaaagaatgtgtgtgtgtaatttcattagcatatctaaaataaattaatattattttattaatgtcatcatttgttagtatcacatttcccca

SEQ ID NO: 59004 - DNA, 2848 bp, Bovine  19866880798964
tttccttctccgggggtctccctgacccagggatcaaacccacgtctcatctggctcctgcactggcaggcaggttctttactcactgagccaccagggaagcccctagtttaacaagtcaatgaatgcaacaaataagtaaataacttgtatcctttaaagtacaataataaaaaaaaaatctctgattcttgtgagttttaactgacatctaacatttcatttaaaggctttactgttaagaagccatgtttcactgaacaatgttagaaaaacaaagatccgcccttgttcccgtgattcccagaacaaacactgcacttacatcaacatcctcctgggtaaaggtttctgggtcctcccccatcatgttggccaagtgtctcttcccgatgttgaactcttcaatctgctttttaataaagtccaccgtgtaactctcacgtcttaaggctgcaacatttttctttgttgttacagccggggaatgtttgagccttaatatctagcagaaaatacaaatggaaagacaagattttaagttaaacaatgatcttataggccactgtctctaaataaaagaagacatttcaaacaattgtctttttaggacggtactcaattgataggagcctggaaacgagataaagcatgcttttaaaagcctatgctcacaaagaagtttaaactactaacatttcaacacattaaaaataataataaaaataactgggtgatatgctacctccattatctgctagaaatatccacatttgataccgactggtcaatgtcagctgctatgggacttgacgtatagtgaatgagggttaaacggtacagtgcatcctccgtcttgtctgactctttgcaccccatgaactgtaacctgccaggctgctctgtccgttgggattctccaggcaagaaaactggagtgggttgccgtgccctcctccaggggatcttccaacccaagatggaacctgtgtctcctgcactgacagggggattagcgccacctgggaagcccagagagaaacaccactccccttaaaataagcctgtgtacatgcagacagaaagcagcaagcagaagacacagacctggtgtgcgcttctcatgaacagaataccctgacaaagcagaaggacacttctgaggtcaggttacaagaagactctcctccccctcttctctctcttgatcagaccaaggaaagcaagacgtggtgagctgccccccaggggtccacaggccaagaactgagggtggtctctggccaacagccagcacaacagctgcaaggatgtgaatcctgcccacacccacactgagcatgtgggcagcagatttccgcccctggcctgagatgaccatgggctgctgccttgcaggagaccttgagcagatggcccagtgcaactgtgcctggaatcctgactcacagagtccacgagggaaatatctgttgtttcaagctgctatatttgaggttaatttgctatacagcaataagtaatcactcaacaccccagttcagagaaggcaatggcaccccactccagtactcttgcctggaaaatcccatgaacggaggagcctggtaggctgcagtccatggggttgctgagggtcggaccctactgagcgacttcaccttcacttttcactttaaagcattggagaaggaaatggcaacccactccagtgttcttgcctggagaatcccagggacaggggagcctggcaggctgccgtctatggggtcacacagagttggacacgattgaagcaacttagcagcaacaccccaattacaacaataaagcggagtacaagaaagttcacttactctgttttataaggaaagagaggtagcaacgacgggcataccttttatcaagttttctttaaataagaacttggtaaactacatgaggaaaacgaaaattttaatgacccagtattttccataattaaagtgacgagggacacactgaaacatctttgctaccaaagggctttctttcctttcccattgctaacaaaatcgaattttaaaaaattcaaaaattatctgggggaaaacacaactaatgcactcagctgtataaagcatctgctacaaacaccggtcaattttcaaatctgctttgcaaagacttttgaggaatttgccagtagtattaaaactactgaaaacaaactggatgctgtgataaacacagaacattataacctccaggagcccacaagatgagagatgaaaagaacagatccttaagagagaggcagcaatgttttttgcagtaaaagcaaaatacacaagggctaagccatcgagtatcatccagcattcttctctggcggacagtccgatcaacaaaggcttgttggctcagtacaaacttagaaagtgctcagtagaaaatcaagaggacatactgatgtttatagtaacagttttcaaaatagagattggcctactgctttttcctattgtgaatgtcataaatattacagaaagctaaatgagcattcttacagaaaattgtattgataggcgttaagaattcatggataacctttgtattacaccgtgactgtcaactacttataacaaagccaaaactacttttatttgtgacagtaaaagagacacgtgtaccccaatgttcaatgcggcactgtttacgatagctaggacatggaagcaaccctagatgtccatcagcagacaaatagataagaaagttgtggtacatatacacagtggagtattactcagctataaaaaagaatgcatttggagtcagttctaatgagggtagatgaaactggagc

SEQ ID NO: 59005 - DNA, 925 bp, Bovine  19866880942650
tgtgatgtcctcggcagccgagccccctgttccattgtggggcctgaggttggcggagcgtggtgctgggctctgcgggcaatggtggggtccactcccggttggcttgcacccttctctctctatgcctcacaaactctgcccctgtgattgcaggagcggccaactcgacgtgcgggagctcatctccctgtacccactcctgctgcccacgtcctcctcattcacccgctcccacccgcccctgcacgagtttgcagacctcaaccagctgacacagggtgaccaggacaaggtggccaaatgcaagcgcttcctcatgagttacctgaacgaggtccgcagcacagaggtggccaacggctacaaggaggacatcgacacagccctgctcaagctgtatgccgaggccgaccacgacagcctgctggacctgctggtcactgagaacttttgtctgctgcctgacagcgctgcctggctggagaagcacaaaaagtgagtgtctttccatccccactccagatgctccccaggggctccccgcctggcccttccctgccccctaccttcagatgctgttgtgctactaatgaaccagagcgacttctgagtcccacaccttcctccagggaccacctgtcacccttgggttcgtcagccccatcacggtctgcagaccagacgaaggggtctcagagaccactcagctcccatgtcaatcactcagatgggtccatctctaggcgacctcatggactgtagcccgccaggctcctctgtccatgggatttcccagacaagaatactggagtgggttgccattcccttctccaggggatcttcctgacccagggactgaacccgcatctcctgcactgcaggcagattcttcaccatccgagccaccaggaaagcccctcca

SEQ ID NO: 59006 - DNA, 703 bp, Bovine  19866880963957
atatgtacccggttgatgacagaagcaaagaggaacccctaataccagacagaatggaactcagggagcttagggaagggttcagtgaggcaggaatgttaatttatattgataaaacctaatatccattaagtggctttgacgaccatgaacctttttgcaccaggcatttagcatggaaacatttaaagcaaaaagctgttaactaacgctctaaagaattcgagtaacacagcatgattttatagctacagattgaagtacaaagaatacattttctatgcagatgccagtggaatattaatagaattatgatgcagtaggttgtagagaaaacccaacaaattataaaaatagaaattatgtggattagaactgtaaaactttggggttaaagtgaaatcaaaattgagattacagactgctgaaaaatatatgacagttcatattaaaccctatgggatatggacaatgtttaacacagaggcaaacgtatttattaagctttgagaaagactagaaataaaatgaacagtagtcagttcaagaaggcagaaaaagaatgaaatggatgattgaattaaaggaatttaaaagaaaaggtaggacaaataaaaccaactaaccctttgaaaattggtgaaattgatcaagtgctagcaagtctggtgaatggaagaagaaaacctaagaggaaacataa

SEQ ID NO: 59007 - DNA, 581 bp, Bovine  19866881055756
atgggaggcatccctggcctccggggaggctgactcggtgccacagaggctcacagaccgccaccttgtcccccccgcaccctgtgacgtttatccacagaggctacatgggtccactcacccatcagaaagtggactcggtagagatcagattcctggagcaggcgtcgcagcttcgcctgcgtctcagtcacttctgcatccttgtcgggggtgcagggcctctgctgcagcacctcgtccaggtagaggacagccaggtgcgtatggtactcctccttctgcaggacaggggtgagcagacgggcagcatgtgcagggggccaggagaccaccccacccccgcccctgacgacgtgtgcaggagcccagagaccgccccaccccccgcccaggatggcatgtgtgggagcccagatgtgtgatgtgagcaggggctccaggtcaacagaatgcaagtactggagagaaagctttcagaaagcatgatggaggacctgaatataaactttttgggagactgccctggggtcccggtggtcaagccttcaccttccaatgcaggggacgcaggtttatcc

SEQ ID NO: 59008 - DNA, 1920 bp, Bovine  19866881127679
ggcaggcggattctttaccctgagccccagggaaagcccatattatattatacatatatctatatataataatgtatttatatcaattatttctaatttgcagaaaatgtgcttttcaaataaaaccatcagaacattgactttgttgccacgtgattgttataatcattactttaatttaggggtaggttgacgttatcacaccctgtatttaaaaataatgaagacacccaccgaatttctccttttgctgattctaggcattggtgctttgcagaaactcacaactcgtccaagtggccggcctgttgggcccctgtgctgggcctggcccctctcggagttccaggagtgagacggtaccagggttcccagagaaacacaagcttgtatcaagggttgctataattgcctgagagggccagctgctgccaggctgggctccccgtttgtttccacggggcctttcccagtctcagctgactggctttccacaggagacctcataggaagggcgctcagctccactgagtcccgtggccaggcaggcagcgggcaggctagggggtcgggggaggtgtgcctggttgcagctgggtgcgtaggcaggagtaggaagcatcctggagatttcagagaacaaagatttggctaaaaatctaaatgttcatgcgtatacatttggaacaggggtaaatagagtgggatcagctacccactccagtattcttgcctggagaatctcatggatcgaggagcctggcaggctacagtccttgggatcgaaaaaagtcaggcacaactgatcgaccaacactttcacttttttcactttcgaaagagtaagcccaacactcctgtggccctgccaggtgcctcgggtcaggggtgcctgggagaatgctcttgacacaaaccccgcacggctgaaccgtatcatggtgtgtcccagaagctggctccacatgtgtcctttttagtctcaaaactttgcaaaaaagaaagacgtcctgtgcggctggccatccaattattattttgaaatgtttcttttctctttaggaattaaaaaaaaaatccttgcgcacattttttaaagtttttttttaaacaaataaagtgttttcttcaagtatattatctatatcttgactgtataatttccatcagtcagtacatttaattatgataaactaatacattcaatcacaacaagcaaaaaactgtggtccatgggttcctttggaaaagttacatagaagaagccagataaatgtacattttgacacatttgactaaacccaaaatttcaacagcctttcctatgttttctccaaattgccaccttttccaatgactggctctttctctcattattgccctctaatctctgatctctgtgctgaggtggattcagggtgtcccacccccagagtgtcctgtttgatcgtattcttcaggattctgtaagggccacatcatagtcactatacttctaaccacagtcaataatttaaaacccagattaaagatgacatattcctcgtcaaccgatatttggaaaatgtatgtattacttgaacaactgtgtcccatttcggtctttgtgtcccattttctttccagaaaatatatcatgagctggatttcaaagtaagatttctggtctttgactaagcaaagatcctcatcctttttgtttgaaaatgggggagttggggcagagggcacatgagttgaaacatgcatggagtgatacaaaaattttgctgtacaaaaaaatatttttttcttaaagaatacaactctctttattaaacaagaagtaacttttcttccagtttttaaattttttaaaaaagcaaatgattagctgtacaaaaatgttaaaaatactttatttaaaatatcctcccagga

SEQ ID NO: 59009 - DNA, 819 bp, Bovine  19866881166618
agttggaaagtgtgtgtttctgactgatttttgtcagatgtgttccgtcgttgtggggactctttattggacaagctgagcgtggtcaccttgccttcctggctatttacctttacctcagcatggtcaccttggcttcctggctgttctgagctggcgaccagctgaaaagcctggaaggccagattcggggctgagtccagcctcctgcccagatgcctgggtctctgcaggtgtacaggctgcagccctaggcaaggccgtccccgccctccccaaaggtcccagagcccttctgcagcccagatggttccaatttgaggccttcactcggtgctggagctggattgagtttcttccctgaaaccaacaagacctgcttcagcattttgcttggattaaaatatttgtcccccctttttttttttttcacagggcaggaggaggactcctgaagcctccgaaggaaggaaattattacagggccctacagaagtaggtcatgtgcgacagctgctcatagtttaagaggaagaaaacaggggacctcaaacctggagcacaactctttcaaaatgcttgtgagcagcccaagaaaaacatccttccgaggcttatctaataaccagcctctataatcgtctcaatgtgcgcgcgggggtcctggagtttgcacctacttcccggggctgccgagatgctgaaacagaacacagcagcatttagcgaaggggatttaatagtttgtgttagagctaatatggcccattaggggctgtcgtttttataaacaacaaagacacgttaccctcttcttgg

SEQ ID NO: 59010 - DNA, 1704 bp, Bovine  19866881199691
tctgtgtctggctgttctgaaggtccggaagattctttagagatgcgttcaccatatttgtcttgaggtcagttgtgtagactgtctagagcaaggttccccacccttcattagatccacctgtcatgaccgtgatgtggacaattcatcctttggggtgcagctgctttctccgagatcagacgagatcgggcgccttcaggctgatacggcctgagactgctttctccgtaaggggggtgttggcagcatgaggagtaagggaagggagaagttggtggggttaagtcttagctctgccacttacaagctctgtgaactctggaaaattattgaacttctctttgtatctcagattcctcctctgaaaaatggggataagtataaaacctccagagaatcacattcaaatgcttagaaccactcacagcactccataaatgttactggttagtattttcaatgatttccaccaaagtgccctaaacagtagaagaatatgagtaaggatctggggagagaccccaaattagcctctatctgctggacgtttcttttaagcatcctgtgtgtgtgcatgctcaaacacttcagtcgtgttcaattctttgtgaccccatggactatagcctgccaggctcctctgtccatgggattcttcaggcaagaatactggagtgggttgccatgccctcctccaggggatcctctcaaaccaggaaatgaacccatgtctcctgagtctcctgcattgcaggtggattctttacccactgagccacctgggaagcccttaagcattctatctcatgttaaatatttatgcaagtcttgcattctactccattataaggttgagtattttttttaacacattttttactgagggacttttgcagaaactaacgcctgcggctggagatttattacggaagtgaacaatgaaacactctggtcgataacgtttgggtaacaaaagatgtattaatatgtctgtagtcataagaccctgatgctggggaagatgggaggcaaaaggagaagggggcagcagaggttgtgatggttaaatggcatcactgactcaatggacattaatttgagcagactctgggagactggagaacagaggagcctggcgtgctacactccatggggtcacaaagagttggacacaacttagcgactgaacaacatttcttctgcaaatgtatttaagaaaaaagtacactctaggtagacacctccatgttgcccctcgacatgggcttgagtgaggggcacagccaggggaccttgagccaatgatacagagggtgggtgcccaggctggcactggaaggtgcatttcactggtgagagccatgcagggcccccgcccccgttccctgctcctccctcaactgggagccacaacttcagtccagcttttctcatttcaagagctggccttttcttggacgcctgggatctagagaatgtgagcgtggaaataaaaatcttggcttggatttcctgagctatgatcatcaataaaatagggcaaaagagagctataatctaatgtactatattactgtaattagagcttcacgcatggagctcttacccgccctccctccaaaataaccaaacagttttagcatagatagtagcgactttattctccatcacggggcactctgtgattgggtaattatggta

SEQ ID NO: 59011 - DNA, 832 bp, Bovine  19866881235829
gacgcaggtttgatccctagtcggggagctaggatcccacatgctggggggcaactaagcccacaggaaagagcccacatgccacaaggaagatgccacgtgccacaactgagacccaatgcagccgaataaataataagcagaatgaaacagaatctaggggaaagtatctcattctgagaagtaagggccacaggatttaggtaagggccacaagatttagctgcctccaaagaaaggaagcttcactcacttcctttaagaataataacaaggaagaaaaacaaagaagaaaaatgaaagtggacgggacaagaggtggagggtgaaaacaagccacctgggcctccggtctctttcacaaatgtctggttccctctctgacctcccgcaagtacagattgagcgccaggaacataagacgttcagttagacccactggccaagttcaggttcccatagggccccagcaaacccatgatattggcctgagagccaggcctcacctgcagtctcctttctgtgacaagatgctccaggtacttaaccagggcttgagggtatttcttaaggcaactgatgatatcatctgggttaaaaccactctgctgttcatctagtggtctcttggtgaaaacctgaactccgacctgaaagaaaagtagccatttggttagcgcgcttttcaaagaccccatcttatctttattgtgagcgctgcatgctttgggtaaaagcactgtcaaaatcgtgatgattcagaaaaccagagcagtgtggagtgctgacagagacaggaaatgacccagagctccagctgggccttctaaaa

SEQ ID NO: 59012 - DNA, 976 bp, Bovine  19866881348478
cagacccccactgacagacaacctcccaggactaaggaaggaaagaaagagcttctgaaagcagccaggtctgaggctctgcagccctgctgagaggccaacttcttccttccaggagccgtttattcagtcacgccttcatttactcatccaacactttttcagccctaccctgtgctgtgcagtatttgggaagccccaggatgcaataggaaccccctcccatccgtctggtgggagacgcgagtaggggagagaattcatacaatgctgcgccccacaggctctgctgggtggggagggggcccgatgggggccacggaggagtgtggatgtcaagcaggaaagacgatatattcccacacgacccctctcccacaaggaaacttcagaggcgacgcaaacgacaaaaggaaaattagactggacgttcaaatttacaacttttgtgcacccaaagacactaacaacagaatgaaaagtccaccgatgggaaacacttataaaagcaaacacccagcaaggaattaatgtctagaatagacgaagaacccctacaactcaacagtaaaaacaaacagcctgattccaacacagacaaaggggctgaaagggcatctctctgaagaagattcacctattttcatagtgtttagctttccttttttgttctgttgttttctggttttgacagcagagaaatcatgcgttcataaagaggcccaagaagagttctctctctttctattttttctggaagacattagttagaattgatccactattctttaaacgtatggtataattctccggtgaaagcggtctggtctggagattttaaattaggaatttaattcccttaatagttgtaggactgttaaaattatctgtttcatattgaggcagttgtggtaggttgcactctttcagaaactggtctatttcatcccacttgccagatttatgtgtaaagagt

SEQ ID NO: 59013 - DNA, 3244 bp, Bovine  19866881362144
ggatgaggcaggaaaccggtgcacagagatctcagcactgtcagatgccacttctgtggcgctggagcaagcctggtcccgaaacctgggcatacaccgattagcaagctctggaaactgccatgcagccgggtgggacagcacaggctcaggtgcagcagacctgctgcacgtcaaaccttgatttggcacaggaattcttttaaccttaaaaagtcactttgtatgcagtgaggcatggtaacattctgacaggtggggacaagatctgattacagagcaggattggccctctagtaccgcgtgccctgccgtttccacagggagccgttgggcttgctgtctccagctggatggggggaggggagcgtcttgaaaggatcttggcgtctgtgatgctgagagaggttgtcctcctccatacccatgttctgactcaggcagttacaaagttctggcaagatgaagacaggaagccattgtttccttttctcttctgaacagagtagtgtcagccacacagacaacgtactgtgcaatgtggcctcctcgcccaggttgctgtctgcaggtaggagctggatttgcttggatagtggggaccatcagagaagaccaaggattctgcatcttaccctgcaggaggcagtctctgtactcagtgacatttacctcctgatgttaaagcccttgtaatagcctccttttgagggcacaatggacctagtcccttgctcctaataaagagaatatggggtgggactttcctggtagtccagtggttcagattttaccttccgttgcagggcatgcaggttcaatccctggttggggagctaggccaaaacaccaaaacataaaacagaagcaatatgtaacaaattcaataaggacttgtaaaaaatggtccacatccaaaaaaaaacaaagagagagagagaatatgggaaaagtgatgtcatgttcaagattaggttacagaaaggctgtggtctttgtcttgggtacgctcttctgcatggtccttctgtccatgctgaggggagtcatgggccatgatgtaagctgaccaagaagtagtccatgtgggaaggaactgagggaagcctccagccaatagccagtgaggagtttgaactctcaactcaacagcctgtgtggctgaatcccaccaaccatgctggtcaatatggaaactgggagactgaaccttgtaccccatcagatgagaccacagccctggatggctgcatgaccatgccctcaggagagacctggctcagatgcacccaggaaaccgttccaggtgttcatccacagaaagtgtgatttcacctgtgcatgtcactctaagtgttacgtttgggggtaatttgtcacacaacaagagataactgatacatagcctggggcacagcaccctgatcggagatagaaaaatttcaattgtgtgatacaaggtttgcccagaattcatcctacagatatttcacagggcagcacggaagactcaactattgtcccacttaataattctaataatttactccactaaaagctttttattaattaacaaaccatccccagatgacctgctttcctttttgttgttgttgttgttcatattctacccaccctttggtagaagtagacaatcatcagagaaccagagcaaaagcagcttgaggaaagagacatggggacttattcatacaaagtgaataatcagaaaagttggcaggtctgattcagacagtgactgaataatgcaactagatcccgctaggtaaagcaaagctgggacagtaagacaagagtttgtgtgtgtgtttggtatatatgtccatttgggtaacatttctgtcttcttgtttaataattttggaaaattgagaggttcaagttcaaattagaggaacagagtctttagaattgaggaaaaatcaattaaaaatcaatttgtggtcatgctcagtcatttccaactctttgcaaccgtttgaactgtagcctgccaagctcctctgtccatcggatttcctaggcaagaatactaagagtgggttgccattttctcctccaggggatcttcccaacccaaggattgaaactgagtcttttgtatctcctgcttggcaggtgaattctttaccactgagacacctgggaagccacagaaaccaacacaatattgtaaagcaattatgcttcaattaaaaataaaaaaatttaaaaaacccagttagtctaaggatttcaaaatattttcccccagaagtatcttacaaagataaaatcttaagtaaactctaatatgttaaacaaaaaatatggtattttgttaacataaatttatttacacattggaaaagactctgatgctgggaaagattgaagacaaaagaagaaggggatgacagaggataagatggttggatggcatcaccaactcaagacacatgaatttgagcaaactccaggaaatggtgaaggacagggaagcctggcatgctacagtcagtccatggggttgcagagtcagacacttacacattcaaatccataacactgactcataaaatcaatcactgagatctatagaatgaatacagagtttaggattaggacttatgggtctcagaggcagtatgccctttcagtatagctgaacagaattcaaatgatgataattcacaaagacaagtagtttcaaatggtaaacattttaaacacaactttttagcaagtgaggatacatatccattaagccaattcagaaacttgatggagaaatagtaaggcattttttatctaacaatatcagagaagtgctgttagttcttaactgatagttgtttaatttgatggtggttgatcaaacacttagctcatgttaatgatcactgggaaggaaatacttttcaaatgtaaccttgaacaatataaaattatattaatttgaaaaaatcagacacagaaatgcagagtcctttgtcagatggtcatttgaagtttctaaataccatgatctgctttgttttgcatgctgagtccaaacttaagctctcagtttcaatcctgacattgtaattataatttaaggcatgctagcatagggggccctcagttgccaaatttagttctttaaaaatatcagcaagatgtgcaaacagcacaggcctgctaggtttgaggattttagctaaagatactcctgttacataatagtaatggtgcctctcag

SEQ ID NO: 59014 - DNA, 1101 bp, Bovine  19866881404293
acaccaaccctttaaaataaccaaaccctttagagccccacacagctgtgtgtgcaccggagaggcatcactttagaggtaaagacccattgatgcgtatcacagccctgtaacaggaggctcttcctatgaatccactaaagatgaattcttatgtgcattttaaaaaggaccttctacctaaagttgggcttcccaggtgactcagtggtaaagaacccacctgccaatacaggagatgcgagttggatccctgggttgggaagatcccctggaggaggaaatggcaacccgctccagtattcttccctgggaaatcccatggacagaggagcctggcggggtacagtccatggggtcacacaagagtcggacaggactgagcaactgagcacacacgcaagtgtatgtatacatacacagatacaccatttatacacaccacctgtatacacatacatgcacatagtgtgtgtctatatacctatcctatggatcctataagagcaacagcaacagttacaagcgaagtagggatctggagagggcagggtaggtgggccaggagcaggggtgggggggtaggagggtggtctgggtctccagggcattgcctttgtaacatcttcctcaatcctggactttctaacagctgttaagaattattgagggccttctggatgctaggcaattgtccccttttacatgttctttttcctgaatgtttatttcctcaacaaagctacctgaccatcaagacaagatcctgacctcaaatcacctgcaagatttcacagcacgctcagtgactcctcctgcccttctgcatgaggcatttcagctcactcagggtagccccagattaacttgcttcttctgccttcatttagtagtacagtgttttttaataaagaaaaacgagtcaggtttgccacagaagagatgagttgtaaagtacgggccaaattattgggtagtctccaaacacctggccaccacaaatgattactttaatgtatttctaatgagaactgggctcaggccaagatgaagatgcttaacccattaaggaaaatttcctcgagttttcttaaaggatca

SEQ ID NO: 59015 - DNA, 1001 bp, Bovine  19866881410804
gtgtattaagcatggggatcatgtcagaggctcagatcctggcttggcctctgccggcatcgcgacccgctcccgcagcctgcatccttatctgtacaacgtggacgcacagagaatttgagtgacagacacaaagtggtctgcagggcccggcgcccttagatccgaacattttctaatcagcagcttggaggcacgcttccacatggctagctgactacaaacctgaaatttttcctttgggatgttcctccgagcgcctttcgctagaactagagcctcctccactcggtggctggctaacaggtcctgtatttgtttttccagaggtagcggagccaagatgtaaacacctttactcgtggcaacgatcactcttcctgggaagaaatggaacaggttggagaggaaacggacactgtgctggcaagaaaaacaccccgctttcaccccacacaggagcgatagctgactctgaacaatgtcatcacagttctcccaacacagaatcgccacggcaatcagaaattaacgcttctcttatcttctttccatcataagaaaaaggcaaactcttaacactacatttttgaagtataagacataaagatgctttgcctttttttattctatgatgctgataaatttaaagccagttgaatagatccaaatgagtctgtagagctccgtcacagaaaatgagcaataagaattatgctactcctcatataaggctggggcttccctggtggctcagatggaaaagaatctgtgtgcaaagcgggagacctgggtttgatccctcggtctggaagatcccctggaggaagtcatggcacccatgccagtgctcctgcctgggaaatgccatggagagaggagcctggggggctacagtccatggatcacaaaagtgctggacatgactgagcaactaacactttcactttttcaaataaagccgttcaaaattcttttctctccaggtagtcagttacaag

SEQ ID NO: 59016 - DNA, 1056 bp, Bovine  19866881451131
atacatttagatagataatgctgctgctgctaattcgcttcagtcgtgtccgactctgtgcgaccccatagatggcagcccaccaggctcccccgtccctggggttctccaggcaagaacactggagtgggttgccattgccttctccaacgcatgaaactgaaaagtgaaaatgaagctgctcagtcatgtctgactcctattgaccccatggactgcagcctatcaggcttctctatccatgggattttccaggcaagagtactggagtgggttgccattgctttctcctattgatagatatgtagacagatgatagatgacagataaatggtagatacatagatagatacatttagatagataatagagggtaggtaatacctctatttcaatatttcatagtttatcactggaagcaaaggcttgtgaaagacacattcttcagacacacttaaataacctcgataagatgtatcaggatacaatagtgcttgcagtgaattaatggtacctgcaaccagcttctctattgtggcaaatatgaatctttttaagtccttcatatttttgaggtgggggaagccatgtcttgaagagaacttgcatagaatcatagatttctaatttaggggagataaaagactcctttcgcagaagatgcaatataccgatctttattttcatcaggagaaaaccatgctgatagacttaattacagtaaacagtttggcaattaacttctgtctctcagaacgagatctgagtaattctgatggcaagagggctgctcttgaggcagctgtttcttcttcaaatttgagtgatttaattcttcaaattggtgagggttcctggctttcaggagagagaatcctttggaaccattttaaagaggtctttggatgcattcagagtgaattacttggtttaatcatatatgaagatctgtgtttccataatcttttcccaaaagctgtcctttgatgagcatcctcagatgtacatgtgttacttatcccaatatctgagctcatactgtacatgttatcggtg

SEQ ID NO: 59017 - DNA, 946 bp, Bovine  19866881548261
ctagatacagatttcaggaaagcatcacgtcttctgccaacttagcagctgaaacctgagatggccttaggacagatgatattcatacactgggtttcagcacaaagatcaaacactcaagagcctcatcttgtgatgttatctcaagaatatcccggcaatgttttctttaactccaggaagagcgatttagagggatggatctcgccacatgtgtccagctgcaagtttaataactttcgggaaaaaagactgtcctataaacacagaaggcaccaagtatgggtgcctgaaacttgtctgtttctttgcttacagtcgtcagaatcttgtatacacaaagtacaaaattaataaacacggtggaattcactattatcgtaaaccagccagcaatattttatgtgcaccctagggtttcattttggaatttcactcttcagtggatggagatgaccgaaaatcaagttgagtttcatcagtttgtgaaacatccctcaggagttgtatggtcaacctgtctccagatttaatcatttataaagcttttcacttttcagtcaattaaatattgccacctgagaagctatttctgaagaagctggactgtgtttctcatggcgtggaggcatttctccacacctgggcttcccagggtagacgggctctttgtggggtggctctgacatgttggtgcaggaaccgcgtgggagggaggaggggaagtcctgcctccctctatccccacccagtccgttctgctcatgcacacgccacactcatcttggaaacatgcaagtcggggtgtcgcctggggagacggttgattgcggtcactgagtttcctaccgtgataatccctgtgcctggcagccagccttccctgtaccctgctcgctggctgcccaggctgtggcagagggcaggggtggctcctctcgtgcaa

SEQ ID NO: 59018 - DNA, 839 bp, Bovine  19866881713919
ctccaggggatcttcccaagctcagggatcgaaccccaaagtctcttacatccccctgcattagtaggcatgttttttaccactgggaagccaggcacacaccttccatacctcacactcaccagtggtgtatcggttctgccaattctccgccatcaggaagggggtgaggttcgttgttttggggtctcactggcatcataaactccctaattagaattcagatttcttaaaccagtgagttcacctcacttgcatttgtccatcgaggagagtttccaggagtcactgaatgctcgatcgcctctttccttccaatcactaattgaataactttctgtatctattttatcttctggttctgctgttggatacctgttgccttattagcaggaattccatgaaaaatttaactggaaaaaaaagtgtcgattccccaagtggatgactggaatacattctctccttatcctgtggttattagcttccaaaatgcttaccttttaataagcattttaattcagatagaagaggtacagaaagtgcgggaaataatcttattctaacactttaggaaaacacccaaaagttcaagtagaaaaaagtcagtttctcattttctaaagatattttttatctggacattttattagtaagatcaacctaaagaaccactgtggcataatagtcatagaatatggtaagaatctgtatttagattacttatatgtaatagaaattctagtactgactattttacatttttttctggctgcccggtgtaatatgcaggacttcccgaccagggatcgaacccacatcccttgcagggaagttca

SEQ ID NO: 59019 - DNA, 601 bp, Bovine  19866881946851
taacaagaaaaatgttgcagccttaagacgtgaaacttacgtagcagattttagaattcaacataggaaagagacatttaactaacatgatgggaaaagattcagaaagttttacccaagagaatattgacagactgattactttccttttccccaggggtttgagaagtgagcccagccaataatgaagcatcctgaagagatttttccaaaacaaagagcatccagtggggagaagatggccgcccatttcattttctttttatactggcaaacaagcatattattcatgaatgcatgaggcacacagaaagctactacatgtgaaggagaaagaaaaacagccaaaaccacttgtgagctcaaggtctgttttcagaaaaaactaaaaaccaaagatccaattggcagcagatgactgattaaggaggaactagaagaaatgttagtggaaaaactgtcagatcaagaataagctcagtccatttggctgctgaaaagattatcaatgttgccctctggtgctattgaagaagaatttgtgttcataagcagaaataatgacaaaccataaaaataatctcagcctttagataaaatg

SEQ ID NO: 59020 - DNA, 1828 bp, Bovine  19866880459497
ataaagactttaaaaatggtacccatcagaaacattaacaaatcttaaaaaaaaaacacatgtgggagattcgaagatacagaggagaagaaaaggtttaggcagaaatgggagtgatgttgtcacaaactaaggaagctagagaatgccaacagccaccatgagctggacaagggagggaaggacacccctccagaacttctagagggagctcagccctgacaacacgttgatttcagacatctggtctccagacccctgagaggatacatttctgttgtggtaagccacctagtttgtgatcatgtataagggcagccataggcttcccgggtggtgctgatggtaaagtacccgcctgccaatgcaggagacacaggagatgtgggtttgatccctgggtagggaagatcccctggaggagagcatggcaactcatccagtattcttgtctggagaatcccacgggcaaaggagcctggcgggctacaatccatagagttgcaaaaagtcagacatgactgaagtgacttagcatgctcgcaggcacacaatggcagctgaggaagctaatacagggagtaaaagtatggaagggacaaaatggacttacaccaagcaagcgagagccatacacaccaagcatgtgtatcaccgtgtctagaagctttctcagccgtctttctccttactatttggagagctcacacattgatagcagtcagtaaataacttgctgatgtccagtatgaataatgcctgtttgttttacccacagagtttgcttagcctgcaactgatccatcctgctggtggacctgtaatgaagtaacaaaggtcagtaggcaaagcatctactcctggagaaggtgaaaccacacaaaaccagctccagactgtctatggagcaagacagtaggaagcattctaccaaaaacagctgtgctgctgttagctccagcagggctacctggtgccaccagtccctgggcctttgaggtttctgcagaatagttaggtggcttcttcactttccccactgctggttggaattcaaaattttcaaggctgagaagtcagtttcctgttgacaactgcttgccagccccgaaattttatcgatctcatctccactgctattctctttgttctaaagccttttaaaacgtatctttaaaattcctttatcatcattctagaaggatgaaggtgggagggatggagagaaggaagcactgagggagggaggaagggagagaggctaaagttaacatatacgtttaatccaccatctttaactagaatgatgcaaatttttcatctgaagatttgtaccttgattcagttctggaaaattcttagctattatctcttcaaatcttgcttctctgctgagtcgttttttctcttcctacagtaacaagtcaccataaacatagcaccttaagacaacacaaatttattatctcatagttctgtaggtcagaagtccaagtgggctctgctgtcaaaatcaaggtgtcagcaatctgagtttttatctggaggtcagaaaatagaggaagaaatctgctccctcgtccattccagttgttggcaggcactcagttccctgttcctggggctgaggttcacgagtccctatgggctgttagcctccttcagctcccctaggatccctgttgggggccagagtgaggtactccgcccatggcaaaggtcatgaggaaggaggctcgacatacgcaaaggcgggatcgagcctcaggagtccccctggaaatcctcgagcgtctacccccataaccagagcctgccgactttacta

SEQ ID NO: 59021 - DNA, 2454 bp, Bovine  19866880494796
ggagattggtaggagaacaaattttggtgataaacaccatgctttgttcagactcaccttgccttctgacaactgcggcttgtaactggtccaacttacagtgaatttcccctccctatccctcgaagctaagaccttaatatccaatgtatccaattagttagtgctacccactgtaagatacacataattcaacatgagtgaatcccaaggacacacctgactcagagtcaggctgagacccattcagcagtttgagaaacagggaattatcccaaagtgacctatagacaggctagaaaagaggaaaaaaaaatatgaaaaaacaatagaaatctctgctttgggaacaggatgatagtagaaactactaactatgaaggaatagccctaagatccatacactacagtaatataaaggatatatactggttctattacagttaactggtgttacataatcaatatcttacttcattatataagacacttagtttatctctttctgctgtcaataatttaacattggactgtatatccaccatgtgcttttcaaatctttctagcatacgctgaagttcgtctctttctcttgtgatgagatggatatccgagtcgtaatcaccctgaaatataattcaagacagaagttatcatttgttgtaattatcaccacatggttgccacaaggatgctgatgatgagactgactgaaagatgtgaacagacaaaaagaacacaacttcctttaatgtaattaaagaatacaattattaatctataaggagagcaggagagagaatgctggcaatactggggcaaatttccaggctttcaagttcccagcaagagacccagctgccactgatgctacttaaatagatcccatcagatgcttcaattgtcattctcccccagttgtttatactggtgttgtaactaaagtataatccccagaccagaagcacacagtatctggggatgtgcaaggcatgcaaattttgaggtatatcccagacctactcaatcagaaactttgggggcagggcccagtaactggtttatcaagccctccaggtgattctgattcatttggaattgggaatcactagtttataaccctctccaagggaggaatcaagagggtatgtgtatacctgcttacctgctcacccagtacaagtaactctaacagcctagcacattcctcagcgtttcctaagactaaatccaagatcaatttcccaggcataccagcccccaactgtcccagcaccaaacctaggtgaggtcttttttttatgcaatcagataaatataaatatttctaccagacggtgtacattaggatattcactgaataagcaagtacttccaacattcctaaaacaagattatgcctattatttcattataacttaaaaaaaaaaacattaacttcctcctgtagaaaataaatatggtaaatgtatacctggtgtctgtggtatattaatgttcaagtactatatgcagaagccccagatagtgacaatctggtattctgctacattggaaagcatcctgatctaggtcaatatctactatgcacatgccatgtccaaaggacacttggtaaatggtaaatatccatgaagatccttcacctgccacttggaaataagttatcctcttggttaagcaagaaaagtcaaggaaaaatgaatgagaatagctatctgtacatcttaaagggtaaaatgtatctgtacaggataaaagcaattagggtgaggacttaattaacacttaaataatgataaaagaaaacctataacttaaccatatttaaataaaaatatttttacagaaaggaggtggtatgcctagattttagaaaaggacagctcaatgaataaggatttgacagtctgttttcatcattgtctcggtctcagcttaaacgccactctccgtaaggagtccttccagattctccaatctaatttagatctccctctatatactctcatagcattctgaatatttcccgtattctttcttcattaacacttactataaatgaaattataaagttatttacacaaccggatatttaatgtgtctttatcactaaaaccagacatcaaattgccaacatccactgggtcataggaaaagcaagagaactaaaaaaaaaaaaaaaactctgcttcaccgactacgctaaagcctttgattgtatgtatggatcatatggatcacagcaaactgtggaaaattcttaaagaggtgggagtaccagagcaccttacctgtctcctgagaaacctgtatgcaggtaaagaagcaatagttagaaccggacatggaacaatggattggttcaaaattgggaaaggaattacatcaagtttgtatactgtcaccctccttatttaacttatatgcagagtacatcatgcaaaatgccag

SEQ ID NO: 59022 - DNA, 2859 bp, Bovine  19866880637418
tatagctggtcagtgagaggtatgcgggccccagaacttgtgacaggcatctgaagtaggactgtcctgtgggactgagcccttaacctgtggggtctgtactaactccaagtagtaaatgtcacaattgacattgagttttggaccagttggtgttcagagagttggagatgtggttttggaaaagataccatgtatttggatgttaggaggagaaaaaaaaaaacaaaaacaaagtctcatttggtgtttaaaatgttgtgagtaaagataactcaccaggaaagagttggctgtatgcaggtaacattaaggagaaatctagaagtaaactgaggcttctctttcaggtttctgctctatatttctgaaacatattctatataactggatgttgctgactctaatgttgtcacagactattctgtttccccttttagactgtgagctcctgacagtatacagaagactaatgggttcttctttgtgtccataactcaggcagagtgtctggcacttaatgagagatcattgaacagaactgaatggaactgggtgaacctggcctccatacaagtccagcatatagcacagctgccttctttcagtgactggcctgaagatgggcctaaaaaatatcagcattactgccaactaattcaggtccttttgtttaagcagcagggacttaatttccctgttgccacaggtataggtttggctggcaatctgattatttcctggcagttaaggataatggtacttaacaagaaatgtcaataacctcagatatggagatgataccacccttatgcaaaaagtgaagaggaactaaagatcctcttgatgaaggtgatagaggagagtgaaaaagctgcttaaaactcaacattcaaaaaatgaaggtcatggcatccggtgccatcacttcatggcacatagatggggaaacaatggaaacagtgagagactttatttttctgggctccaaaatcactgaacatggggactgcagccataaaactaagagatgcttgctccttgggagaaaagctttgaccaatctagacagcatattaaaaagcaaagatattactttgctgacaaaggtccatatagtcaaagctatggtttttccagtagatgtgtatggatatgagtgttggaccataaagaaagctgaatgccaaagaattgatgtttttgaactgtggtgttggagaagactcttgagagtcccttggactgcaaggagattaaaccagtccatcctaaaagaaatcagtcctgaatattcattggaaggactgatgctgaagctccaatactttggccacctgatgcaaagaactgactcattagaaaagaccctgatgctgggaaagactgaagccaggaggagaagtgggcgacagaggatgagatggttggatggcatcaccaactcgatggatatgagtttgagtaaactccgggagttggtgatggacagggaggccttaggttctgcagtccatgggatcatcaagagtcggacacgactgagtgactgaactgaactgaggataatggttacaatagttccagtctgtctggagacttgcagtgagcctctgtagtgacttagctacaaaatgttaagaaaagctattcttcagcagcagagacactgggaaaattactgtcaaaaagggtgagccccttttaaaagcacgatgccaaagcattttgatgatggaatactttattttgtaagacatcagaatgctcatttcataatgttaatgcaaggagctacttcttttaatccccttttgtagatatgcatcaagcaacaaaggtttactgtttagcatagggaactatagtcaatatcttataataacctatgatggaaaataatttaaaaataaatgtgtatttgtgtaactgaatcatcttgctgtgcacctgaaacattgtaagtcaactatatttcagtaaaaaaaatatatattaaaaaaattcccttttggagtcagtaagagtaaagataatagtgggggttctgcatgaataaaaagattgataaacattatatattttgaaaatattccacatgctctaactttcaaaagaaccttcacttgttctatggccacaagacaaaggataaactggggaaaatgttccaactatttccatagatctaatatataaaaaactcctataaattgatagtaaaatgactaacatgatagattatatcaggaaaacaatttttaaatgggaaaggtatgaaaattcaattgctcaagtggttctttaatcatgtgacaagagaaactcactgaaagtaagagatataaattaaacaatagacatgtgaaggatgagtaggtagccaaatgaaggatggagtaagacaagtgaagaggctaataaactaataatagccattgggtattgagtgcttgctaggttctgttctaagtgctatgcatgctttacaggtattatttcattttatcaccataataacccaataaaataggaagtattgatatccaccttttacaaacaagattaaaaaatttactagaaatcacaatgtaagtgataaagtcttgacttcaattccaaaagttaaaacaactctgaatttggcagactatcaaggaagagaactctacaggataatggctagaaagagaatattcagatggtgatcaattaaacttggtggagatatagaattgtcagggtcctaaaatctcaaacagaccaactttctaaatcaaatgcaaatttcttctgcaaatcctccaacagatggccatcgcagctgccaccgactatttccaaagacaagaggactca

SEQ ID NO: 59023 - DNA, 2037 bp, Bovine  19866880715629
tatcagattcatttcctcccattctcttcctagggcttcctcccctcattcaggtcttatggtgaccctaaaagctcccatgctttcatattcctgcttagacatccagaagttccttggtcttcttgcctccaatccatttccaaagttcctgggtaagaaaaggtactggcccaatttgaaaggtgctcatctttgaaacaatcaacagggacaacagcattggctcaactttactaaccatgtggatggttgggtataaagagtgatttctagaaaagaagtgccaggcatcaaacccactgcagtccattacagcttctctaaatcctgcatttccccattcatatattcatcatacctaagtataactattgatttaacatttacctttcaggttattctataagctcaaggaaggtggaatatgtgagtctttcttggtctctatctcttcaccaagagtagtttctggcacatagacatcctccaatatatttctgctaaataaattcaactattttaaaatgaaattttaaggtgaagacacatagcaaatgataaactcctcattaagaacttttcatacaaattaatgatagactgtaactctatcagcccatgaaataaatcctcctcctttataaacagacacctggagcaattcaactgggaatccagtgttggagaccataaaagcctttaagaccctcaccaaaaccactcttgtctgaatgactcctgcacacacactaggtaggctccctacaggaaggagtgcccataggcggcaacttaacagtagatattctatcaagaaaagtgatagggctcagggaaaaaaatccgcaaagtgaaccctcaggtaacaaaagcagcaagagaacagtgagggagagggaagcatcgtgtttacagcttcacaaaacgaaggataagcagccctgtgtctggagcaatacaagctcctttcacttagaaagtgacccaatttagctggcacacaaaatcctacttcagcatgaaggtatgaacgcttcaagacatgcacacttgtactcccagaccttggtagggcattctaaatgttgtactttaccggtgatactaagtattaatttatgtactactcaaaactaaaggaaaatatctctaaatatgtaaagaggctgaggtatattactccaaaacaataaaaataactctccagaatttggtctctgagatttatccacacaggtaaactccaatgaaaaactaagtaacgagtcctatttgcataacgctcatggagcacttccacatgccatatatggtttgagcaaaggctcggagggaagaagtaacttggcataaatcagtttggctaaaaatcgctgaaacaatacttcggctgaggcctttgatattaaatctattgttcttttttttttccttccagttttattgagatataattggcatacagcactgtctaagtttaaggtgcacagtataaagatttgacttacggatatcatgaaatgtttacctcagtaagtttagtgaacattcatcatctcatacagatacaacacaaaaaaaatgtttttaagtaagtttttctttgagaactcaggatttactctctcaactttcatatataacatacagaatgtgttagttagtatgcatttatcatgctgtagagcatatccctagtatgtattatcttataaccggcaattacacgtttatctgccttcatcctattcccccttcccccacgccactattctttctacttcctcaaaaagcacggctaaattttggtaaagtgagtatttcttaaatttacaactgcaaactattctttcattcaggatgtataaccagcatgtataaatgctaacaaaatcccaactctcctgctacactggcaatgtgacattgagcaagatagttatttagcttcttttgagctttagcttcctcatccatagaatgcgtataacaatgtcaactgcacagggttatcataactgtgagaaggaagcc

SEQ ID NO: 59024 - DNA, 1149 bp, Bovine  19866880749529
aaaaaccttacccaaagaaaaagtagtttactggcattttaacattattttaaattatctgaactaagtaaatgttaaagacttgagtaaagaatggttcaaaaagagagaattcccctaaatctctacgattatattttgcctacacaatttccttttgtaaaacacattcaatctgactttctattcttattagtatctacgacgcagcattttcagagcaaggaaaaaacaaaacaaatttaaattttattcataattacttaattttgatccactgaaaagttatcttccccaaattttaggtttctcttttaattgtaattactattaagaactgatttaaacataatttgaatccttgaaaaggtatctttaaaaagtttacattctacctatttagaacttctgaagtcatttgtatttacttgaaatttatttttaaatgttgaccaacaagttacattttcaaagacgaacaaaatagtttttatcctctgaattctgtttattatttagtttttcttttcttgtaactgataacatcaaagtaatagaaactgtaattttttggttactctcctattccttattgcttaatagatacatataagagatgtaattttaaccctgttttaaaagtatcttctaaacttgtcttaggttaagtaaaatttttttaacaagataatttaagaacttcaagggataagaaaaaaaatcaaggttttaggttaatgcaatgataccattaagatactattgtacttgatttaaattatatttcaattatgtcatttatctcaatgagaatcttaggcttgataaattaatattatgatagtggcattaataacctcccaaggaggtagttttagaaagatttcccttttattgcagtaacaagtgatgacaaatatactaaatgaaaacattaaacacgtaactgtattaatatgttgtttactaaaaagaaaaattgatttaacatatccatggtgaaacattaacaaggatataaacacactgtttaagaacaattaacctttaggatgagttagcatttctgtttccaaaagcctattgtcccaatatttttatcagtatctttaccaaagtataatacacagattcaaaccatttaaaaat

SEQ ID NO: 59025 - DNA, 1342 bp, Bovine  19866880883992
atatatataaggatgtgcaatctaggtagggttaaaagaactaaagcatacctgaagtaagttctcctcttcacataaatgtttatcaacctttcttgtagaggttatcgagaccttttttcacttcttttccaggatactctttaataacttttcggagttcttgcttgttaaacgcaagttgatagctcacttcctcctctcttataccctgtgctacccgggcttcaacaccttcaaagaaatgcttcaaggaaatgaaaagtaacaatggctaagaacggctctcattaccacttaaaaaaaaatctgattacaaaatactatatatccactgtgtaaaaatcagacagtgtgtgaaaatataaaggataaaataatcatcagcttttatcaaactactcagagataagcactgtcaaaagactagatttccctctagtcttttgatgtgtgagtatgaaaatgagattataattttgtatgctacatttttcatttaatattttatgttttccccaaaatatatatttcaatggctgcatcatgttccatccaatgactatactatgtttactcattcctccagtattaatattttttactttttttcttgaagttggcaaaatctattcatcaaaaacaaaatctattataaatacagttataaataactttcatacataggtatttacccacattattgatgactgtccagcatacatttctaggactataattcctcagttgaggagtgtaattgttaagtattctggagattcttcatatacacaaattgcttcccaggaaacttcaatcactttatacttctgtcagcagtgtatgagactattttatcataccatcatcagcattatcataattaaaaaaaatctttatcattttgaaaagtaggactttcctggcagtccagtgggttaagactctgcccttccaatgcagacagcatgagttggatccccggtggagagatgggaaggggaactaagatctcacatgccaagtggtgtagccaaaaaaaaagtaagaaaggtttgtcattttatttcaatattcttcagctagaaatgaagtttatctgcttttcatatgctcagtaagtacattcagaactcttaccatttctatattgggatcttagtgctttcctgattgattttaaaaagggcttttatattaagtatactgactattgtgctgttatattcttctcaggttgccttttaagtgtaacttgttttttaacatgcatattgattggcaagtctttacttgaatacaacaggatttaatacaagtcaaatcccctcactactattct

SEQ ID NO: 59026 - DNA, 983 bp, Bovine  19866881025910
tgttatttctgttcgggccctatctacccaggccacggcatgatgttcgttcgtaacgactgccaagggtaggaggtggggagtggggcgcttttagctgcgctcccgccgggctgaagccgtgcccgctcggcgcggggttactctgcgcctaccaacttggcgtggggtttggcctgggatttcggcgcgtgaggctggctttactacggactcggacctccagctcccgctgggggagtttctcctttaggtggtccgagcagagctggtcactaggcagctcttgggagaggccggcagtaatgaggttgaggaacgattccagccagagcccacggggaagctgggagtctgttggcccactgttgtatgtgggccacattcttcaattccgtaaaccttgctgaacgcatgccgggtcaagcatctttgctgaggtccatctctatacagatgtataagacttgcggtcagccgtagtgtgtagaggttgatagaaatgttgggtatgacttgatagcagagttacgttttatgaagtgattggaggtgatttggagaaggacgtatgtgaaaagacactgaaaggaggtgcttttatcctgtatcttgcattttgtttaagagcaggaggggaaagcattttaggaggaagggaaatgaacaatttgagcaaaggcacagaggagcagttacttctctgtttaaggaagtgacggattacagatggtgatagaggcttggggtagggctataaatacaaatataaatctatattaaaaaggtacgtctgaaaacaagatacatacagatgttaccggactttcgatggagttgtttctgggcaaacccattgtaagtcgaagatgcaaaagcctaacctactgaatattgtatatagcctagccttctttaaacatgctaagaacacattagcttacagttgggcagaatcatctaacacaaagcctcttttataa

SEQ ID NO: 59027 - DNA, 1227 bp, Bovine  19866881159571
agtttgaacaaactctgggagatggtgaaggatagggaagcctggcgtgctgcagtccatggggtctcaaagagtcagacacaacttagcagctgaacaacaaccaacaaataaaagtgtagagcaagagttattcagtcaaacagtaaacaaagacaatgcttccaagggtttggtctgtgccaggtcctgttgttggtgctggaatatgagaacaagcatacagccagggcccctgaactacagagacattctggtgggagagagggacaagaaacagtacgcaaatatgtatacaacacagtgtcaggttgcaataagtgctaaaaggaagtcatgctgggtgagtggagtgagaagtttctagacagagaaacctagagaactttgaatgaagtggaagaagccttggaccaatatgacatttcttccagatctcaaattaagtgaaaagttatagctctttaacattgattaaagtcagtttccaaatagatgttgttcttccagtttcatttaggtctaccagtatggatgggcagactctttagcattgcatctttgaaaaagcttgactaagcacagcataatctcattttaggaaacagttttcttcatattctggaaaaaagcctgttgtgtgggtgggtaatcccaaatgttatccctcagccctttatcgatctccaagtttgtggcaagggaagatgcttggcatttaagccactagatttaggatggctgttcaatatatcgaatgactcttctattttaatataaattaaaattaagtgagagccctgggaaagctctgttttaattagagttggaatgcatcttaggagaccatttctgccagttataatcataacagtggcgttatgatttttttttttaaagaatccttacttaataagctgggtctttcctgaggtcttcaagtttgttttatagatgatttttattgaatcaagtgaaaggcagaagaatgcaaacattcttcttggaccctaaacctttttcttgggagatgtgaaacaactgagcaatagtctgcagacgagggtgcttacgactggcttgttcttgaacatgaaccaggaggttgggaaatctggatttaccatttattgaggaccattccatagagtggttttttttttttttaattttactcgagtatagttgctttacaatattggggtttctactggacagcaaagtgaa

SEQ ID NO: 59028 - DNA, 1130 bp, Bovine  19866881515803
attatctcagatcttcataataaaagtctggtatcacttttcttccatgtttgtggtctttatttacattttatccccctaaacaacactttaaactaattgaatgtatgattagccttctatagaacattaaaaacatttgagactattttttaattccttagatgtaaagaaaagtgtacatctatatgttttcattttttatatagtaatcaagtagttctgcattcaagggagaatatcaaggcatgaaattattgctgtaatttgacttaagagacatgtagagagcatactgcagttctctcacatcagttgaacttctttttcattaaaataaggccaccagtattttctacttttgaaacactcttaattattctgtgttttcagaattgaaaacaggagcagtccctgctttccacctcatgtattcttagaaaccacactcgggtataggttgtattttttctcatatgttataaggaattagtgtcaaatcacagttatgaataacagcacattattaaagaaaaagtgtaactctgaaacccccaaaggcaatttaaaaagaaaaatcaaaactcaagaccactgtcatcttacaaagtaggaagctgaaacacatgccgttaagtagacatcctgtactttcacgtatagacctaacggatatagaagggaaattgccaactatgttgtttttaatccagcttcttttgggaagcaaataaatttttgctataaattgaattttctgaaccattttctacaagtcacttagttgatttttaatggtgattttagctttttgttttattgaaatatagatatctattatgtgtttttattgcaggaaaatcctgaatttgatttacattttgaaaaaatatataaatgggttgccagcagcactgctgaaaagaatgcatttatttcatgcatttggaaattgaatcagcgatatcttcggaagaaaattgattttgtcaatgtcagctcacaacttttggaaggtaaagttaaataaaagtgtatatgtaaaataaaatatatctgtaagtgaatatataatttggcattcttcaaagtaattaaaactcgaaagatcttttttaaaaaatattttc

SEQ ID NO: 59029 - DNA, 1317 bp, Bovine  19866881770445
atcttttatcctctgtcagtgggaatgtaggttgcttccctgtcttggctactgtaaacagtgctgcagtgaatattcctacaagttactgcagtcaccggttcccccttgttttctttcttattctctttgtccttaagagtatcttatttaaccttgtttactgtcattttagcactgtttctagaggaagaggagataaaaatgtgtgcggtcagtctgccatcttaactggcagacttaaatttatcactagtatttcttggttttgagttttatagatagaatttgtttttgtatataaaatgaaatagaaatctaggatttgtttttatatagaaaatgaaatagaaatctagcttattttttgtctccaatgagtggctgtcccaactctagtttttaaagagtttattcttttcccactttcttaaaatgctacctttttaaaatttacatcagggatatgtttaccttgtccacatgtgaaattcatactgttttaattatagtagcttttaaatttattttgatatctcataaaacaagtctagctgcattctttttccccccagtttttactgttttttttcttaactttcttttcccttaaataaatttaagaatgaaatctaagtcacttatctagtttaaaaagattttgttaggattcttactgaaatttcatggaatttacaattattttaggaaactttaatccatttccaatactgtgttccccttctgaaagatggtgtgtctacatcgtcaggttgtgttttgtgctcttgaggaaaatgttcactttctttatataagtcttgtccattttgtgttgagttatagtattttctgtcctgacttttcttcaattcagtcttatctactttttttagaaatttttttatgctggtgttttcccttcctgtttcattgctgttatggacatattcttttcttcttttcttgcctttccttttatctttgatttcagtgatattgaagaggagagataaatttgtttatctgctcttacatctagaacctaaaggggggtacattaaaacatgacttttaatgtatttttaaataaatccaatttatttccttagttttcatccagaaatattattaaagagtgcttaaggaaaagaaactgagacatatccctattaatttttaaaattatagcttgaaaacgaaaaatgtgaattaaagtctaaaatatttataatgaaagaaacaatggagtctttagagaaaaaagcaaaattccaagctcaaaaacttagccatgtggctggtgactcatctcat

SEQ ID NO: 59030 - DNA, 3864 bp, Bovine  19866880511060
aaaatgtgggagaagctgggtaggggcatcatctctctttctctactcaccatgtctcctctaactagtttctgacatacccatggttgaatccaagtgggaaagaggcgctgggttcaagcagccatacaggaaatgctagaatcaactagaaataggcccctctcggtgaaagatgttcagatgctcatatatttcatcagaaccttagtgagttttctagaggaataccccaatcactgcaggcttaatccctacaattcctgcaatgtgacaaatacacatattcttttggtagccctctcttctttggccctcacattcccaggaatccaggtaatctatgccatacaaaactctttcttcgaattctcaggttctctgagaggttctcttggacagaattagacatggcttcaccatttctgtctggagaaggcaatggcaacccactccagtactcttgcctggaaaatcccatggatggaggaggctggttggctgcagtctatggggtcactaagagtccggcacgatggagcgacttcactttcacttttcactttcctacattggagaaggaaatggcaacccactccagtgttcttgcctggagaatcccagggacgggggagcctggtggactgccatctatggggttgcagagtcaaacacaactgaagcgccttaacagcagcagcagcagcaccaccaccatttctgtctttcctatgagttctacccttggtacatgggaagaaggcattctttgcacaactgccactaagagtgaactacatttcagacagtcctctgttttcttcctttgccctgctgccaccagttgacagcaacagcgcctcacctggatctgcagatcttacattttctgagttgtcctattgaggcagaacaactctcacctctttctcatggagaagtgggaatccaggccagagttcacaaatctcttcttttgtcttccctggatccttttatgcaattgacctgggtcatggtacctgagaggtccaagagtcttaaaaaaaaaaaagtccttctgctttgttcatttcaatacaggacctttgctttgtgtgtagttcccattgcatcctagtacctcaggaaagttacattttatcattgcaacattaacgttagttggtttctgttactctccctcccctatccctaacaaagaaccataaatgaagcacccccagtatttatggtgaatatctacattataggctttatgaacatgaaggtaaatctcactgttgaatgactgtgttaatggaaggtaactgttctctgagccaagaatttgaatcacattaactaacaaatgagctagcaaacaattctacatccttatccatgtgttatcttgaatttctttatctagagtggactacaaattaaaccttgtgaaatggcttaaggaaaagattattcttatttagaaaatagaggttgtgaaaatgtcaaaagtataaaaggctaggagtgtagaatatgactgtggcttaaatctatgactattatcatagacggagaaggaaaatgcaactcacttcagtactcttgcctggaaaatcccatggatggaggagcatggtaggctacagtccatggggtcgcaaagagtcagatacaactgaggacttcactttctttctttcttttattatcatagaacccatgaaatcattgatattgaagaaatattaactgggtacctaagcatgtacctggaataggacatggcaacccactccagtattcttgcttggagaatttcatggacagtggagcctggcaggctacagtccatggggccacaaagagttggacatgactgagcactccatccaccaccacttagcatgtacaatccattatgatgaatgctaagtacaaatgctgaataaaacgggcatgattcctgcttctttgaagctttcgatctatattcattctagctaaacacaagaaaaaaaaagaaagattcatgaaattatttccgccagtgccctacttactcatcaaggaagagagaaaattgtgatgaaaggtaaaatctgcttaatttatgatgtgaaaatatgtacaggaaacatgtgcctttagtcataaatgtgaatccttagaaagccaggtgcttgtacaaattttttccatgaggcaaaaataaatgaactgacctttaacagagtaatggtaaagaaatatttttgccatttataatatgaagttaacaggaaaaagaataaggtaaccacatttatgcagaattgctctcctccaatctctgaaaaaattaaaggaagatgagggaggtagcccaggacaggagctcaatgtctgatgaggaaaacaccctgtaaatacatacacacacgtcatgtgtagtacacagaacagccctcctcattcaccaaggctgctttcatcttgcacattcaaggaggatgaggttgatattttaaaaatgatgacatgtaagatactatagggtttattttgccaacagaaatccgattttaaattttataaactaccttattccgttatttatgatgttcttgaatattttatttacattttgctttattagagatatacagaacatggattctgaagaattatctctcagattgtcaatagacctactagttttacctaaagccagctgatttacttcctagctgacacccatgggccgtcagacagccctgtaaaccatgaatatttagaaacctgctttaaaagactttatcagaaatgaatgatgataacctgctttgttacttctggatactctgcaatacttagccagtgtctactactattcaacactaattgatgattcttttctagatttcggaactcagaagagtctcttgagaaatgacttacaatgagggctaattcataatccagctcaggacactcttgagatcaaaaggaggaattattccaagacagggaaacaacctaaatgttcactgatgaataaagatgtggtacatatgtgcaatgaaatagtgtttagtcataacaaagagtgaaacactgccatttgcagcaacatggaagtgcatgctcagcgaagtaagtcagacaaatatcatatgatatagcttatatatggaatctaaaatactacacaaatgaacctatctacaaaacagaaacagactcacaaacagagagaacagacttgtggttgcaaaggggaagagggggtgggggagggatgaaccaggagtttggaattagcagatgcaaactattatatatattaatagaatgtataaacagcaagtccctaccatttagcaagggaactatacttaatttcctataataaaccataatgaaaagaaatgtgaaaaagaatgtatgtgtgtgtgtatatatatatgtaatatgtacatatacatatatatatgtataactgagtcactttgctatacagcagaactaagacaaattgtaaatcaaccatacttgacattaaaataaaaaatttttaaaggaggagctattaataaatatgccaaacaagagatataaaccagcaaatggaaacccatgatcaccctagctgagttttcaatcaaactacctaaatacagagtctaggacatttgcttttcttgaatagaagaataaaaatgtaactctgaaggaagcagatgtcacaatgtgaggagatacacgccatgtgtggagactcatggctgagccgtgtgtctcctcagctgcttaaactgctaaagatagaagcaaggaagagaggaaaaagatttgatctgacacctcactgcccacacagtgtccacctcccccaga

SEQ ID NO: 59031 - DNA, 1284 bp, Bovine  19866880511413
tacatcggcagatgagataattaaaggcacacggcttctatgtggcacaaccagaactggaatctggctctgattccttgtccaccttgtatcagaaatgtatgtaacacacgaattatctattgactctctgtctaaattccagagtgtgggataagtaagaattccctaggcattccaattcaacactgctaagctgaattcataattaagtgatttttcaaactccccctcaccatcacccagtgcatcctatctccttcttcactggccatgtatgaggctgtctctgaaagtttaaaaaaacagtagcatcataccatgtctaacacccaatatgtgggaacagatggcatttcataggacatgatccttttctataaatgacagaaagtgaaaagtaaaccctcaaagatagcaggctcttctgcacaacgataacacgccagagagtaatttttcatcttagcaatttcaacttaggagcccgtttcaactgtcaagacttatccatttctcatgtttcccttatgaactgtattctcacatacattaacaagctcccacggaacgtcctgaatgttactatttagtatttaagtagctttctgagaacacaaagtgtcctgccaatcatgggtactttgctactaataccatctctttggaggcaggcagaaatcattctcactttaacagctgagaaactaagttggagtaagttaataacaaaactgttcaattaataagcccaggtagaatcaaaatgtatttacccagtttgggccattctcttgtgagactcttttaacccttcatggactagctctttttgaaattttcttttgggctaatagaaacctcactgataaactagctcaaatatatacatggagaaggcagtttaaggaacagaaaactgggagccttgtcatgtcagaaactcagcaggtcaagctggaaaaaaaaaaaccctgatgaaaggacctgaagtcctgataagctgttaatagattaactattactcagtgacagtacaaaattccaatttaggaggttattcactattactgaacatttctgattgaatagataaataaaaactgaactgtcttgatattcacctgactagttcatattaatttcttcctaagtgaaagtgaaagtcgcttagttatgtccgactctttgtgaccccatagactcgtccatggaattctccaggccagaatactggagtgggtagcctttcccttctccaggggatcttcccaacccagggat

SEQ ID NO: 59032 - DNA, 1549 bp, Bovine  19866880726223
caggggctgtgctttgagcagtcctgagaaggggtgaacaatgtgggctgtggaagctgacttcctgccttacaatcctgctgtgaccaccgcctggctctatgaccttgaacagcagtggcacagtttcctcatttgtacaatgtagataataatacagtgtctaagacatggcatttttaggagggaaaaatgatattatgagggaaaaataacacaaaaacacacagaagaatgacccaaggcaaaccattgataagggctagatagcatgtattgtcaacatcaactctaacctacccaagggcacacgatgttttatttagctgaccccaaattccctttggtggttaggataattgacaactacatcatcaaatagttgaaaaaacctatctatagtctaataacaaaaggatggaaatgcttttattagagctctaatgcactggttctttagatagatccacagagtggatctattagctgtcagggtcaatgttaaacagatgaaactcctaaatgaaataccagtaatggaagtgacacaggtagtgtcaaatggtattactactataaaatcagaacttgttaggggaaaaataatccagaataatagacagcctttgaacttaagataaaaaaccagaaaggtaacgcctctggtataacacatgagaaaatgaagcttgaattattcaacagctcattcattttgatggtaggggaaattgcctgaaatccctttcacattctgcaaagatcaaacatattaggaatgtcaaaataatattagacatcccctttcaagagtcaaaataactcctcagaacaaaggaaaaaaagggcaaagttcagggctctaaagaacacaattaaatgctgatattgtggggaaaaaaacatggaaagtcctgctggtactattaataaaatgccagccagtcatttactaaggggtcagttttgacaaagcactgaaactgaggttctggatttcttcacttttaaatcaggttaataatttctattttatacattcatatgagaattagaaaaaactaatgtatataaagtttcagaaaacattaaaaatattagtttacccatctttgatcagtctggaagtcacaagtcataagcaaagtttcctatgtattttgcttggtcttcacatagttctgtatcccaggttgatctaactatgttttaaagagaatattgtttgcagagcttctttatgttccactgtgctgctgctgctgctaagtcagtttagtcgtgtctgactctgtgtgaccccatagacggcagcccaccaggctctcccatccctgggattctccaggcaagaacactggagtgggttgccatttccttctccaatgcatgaaagtgaaaagtgaaagtgaagttgctcagttgtgtctgactcttagcgacaccatggactgcagcctaccaggctcttccatgccaatgccttctctgctctaggtttatccaaaaggaccggaatataaatccaaggcttccaataaaaacaccc

SEQ ID NO: 59033 - DNA, 1573 bp, Bovine  19866880774898
acataaaatataatatttgaggtatattggtaaggcactgttttataatttagtaagtgaaaagtagtcaatatttcaaactcacagatgggataagttttcatatgttcattgccttaacattttaaaagtattagaaaaatattctacatttcatgtatttaaataccatatatggaacaatgtgtatttatagtacctttgcatatctttttgttagaactaaacagtaggaatagcttttgttatgaatactcagttcttgtcaaaaaaaaaaaatccatgctgaagtctttcacatatttttcaacaaaatgacagctgtgaaaaatcaattttcaaagtcctagcagatttaaatggctgttgactctctgtggtaagattttttgttgttttttcaaattatgggtaaattattttttataaaatatctctggaggcttgtgacaatgaagacagatgcttgagaagcctattataaaagaattccaaattttaaatcccctctctttcatctcatatattctggctcattaaatcagacatgaaggtgttaaattttaaaatgcaactccctttactccattaagaatggagtagaactcgggcacagagggggatatgataatgctttcatacctttgttaaaccaaggataacgccccgcatgtttccaccataattgggttagactagatattttcaagttgggaaggacattctaaagatgggctttagagattttcagacgttttttttcactaatgcaaaaataatgtaatgtaaccttccccatttgaatcattttcaataattttccctaggtttgcttatgacaagaataatcttttttaatgacttgtttcatggcactgtctttccatttcctcaaggctacaatcatagttgctcacatcacttttctgtttcagctttgcctttaactttcaagtaaaggcctacttatattatttagcatggtgttgaagaccgtttggtttgcagcacttcctcacctgcatcccgttttctttctgtctctatgcgctttctgcttttcctagtttacctctgcatctattaaacacgcccccaaatgtgtgtcaacacacacacagcacatgcacaaaccatacgcctttccatctaccacattacagctttctactggaaatctcaattgattctcaaacctcctttcctttactttttagggcttccctggtagctcagctggtaaagcgtctgcctgcaatacaagagacccggtttctattcctgggttgggaagatcctctggagaaggaaatggcaacccactccagtacttttgcctggaaaattccatggactgaggagcctgataagctacagtccatggggtcataaagagtcagccacgactgagcgactccacttcctttactttgcattttattgtgcctggaattatcttccactttttctacctgatccttccaaagtacgttagttgctcagctgtgtctaactactttgggaccccatggactgtagcccgccaggctcctctatccatagaattctccag

SEQ ID NO: 59034 - DNA, 1760 bp, Bovine  19866880810388
taaaattaaacatgtacataattttttatacatagcaaaatgatttcattggcaagaaaaaggatcccttctacagaactgactaagaaaagtgatgggataaccttcaaaggaggaaacaaatgcagtgacagctaagttgttttgtactgtgatacagaaaaatagtgagagaatttctgttggaaataatgagacagacacgggagaaactgagacaacctgtctcatagacgataactacagagacaaagtaggcgatctagtaaccttcttctttatccagttttgttgtttctgcatgatagtggaacaaggattgtagaaatccaagatcacgctgtgtactgtttgaagaatgagacatacaactattgataggtgctgtatctgtcagaaagagtagaaatcttgacatcaccccacaggtttaatttttaaatggatgtgaatggctttaagtactttttattgttctgtttgtgtggacaatgtgagccataggtcttcctatattgcgctgtaaataaacggtgtcactagcactgggctcactgtgatggatggtgtacctttctcaaccctcagttgtctcattatccaagttctattatggcattaaacagccgtaagaaatgtgggcagttgcactcccaagaataaaattactcacttgggactcggctccaaaatgactcagtaattgtttaatagaaccctttgtaaaactgataggttacagagatagataagtaaataatagattgtagcacctttatatatatatatatagagagagagagagcaattatttcacactgtatatatatatatatatatatatatatatttcacactgtatgtatgtgtgtatatatatatatatatatatatgtatatatatatcatgaactatatggctaagtacataaaatattatacctcttctttttctcctagttataaagccttctgattttatatatactgtttgaattctggctagcagcatcatcaattcaatggatattagtttgagcaaactcctccaagagatagtgaaggatagggaagcctgctgtgctgcaggccatggggttgcaaagagtcggacacgacttagcagctgaacaagtgtccattagtttattcagaattgctgtttctatttataattatcttcctaatactaattgttaacttagtaagaggcttcctcttattggtagaatatttcagagaaaattgaggagttttgaattgtgaaggattgtgagaattgaattgtgaagacttacatgttgtacaaagctgccaatcacatctaaaaaccaagaaaacacacagaaagcaaaagtaatgcatttgcccctttttcttctgtggctatgagacttggtcttttgtcttcagtcattcatatacctttatgtccttagatgaaaattaatgcctgagaagtgagaattgaacagttcatattgtatatagataatttttgataatttttacattttggggggagaaataaaggacgttttatacattttaatacattctgattctggctggtagagtcatgaaagaaaatgctgtagtgtccatttggaagcagaggaaattccacaagctttatgtaaatcaaagcacaattttgtgttattgaaacctttaaataatctagtcactattgcatatcacagggcagggactagccttttaaaactcccaggaacatttccattttccaatctgtttga

SEQ ID NO: 59035 - DNA, 1905 bp, Bovine  19866880843727
ccagtgctgtttaaatcaggccattgtcctgtttttgagatatcaaactaagatcacatggtttatttgaattttgtggattaataaaaattgtttattttcagtataaatttctacaagtagagattatcacaccccaagattagatgtaattataaagagtttttgaagggaatgctaaaggctggtaattaatactttgaacagataatgataaaaattctcccctggaaaaaatctcactgcaagtgttggcattctttgcagatgactagtcaaaaatggcctgaaaatactattataactaaatgctaacttaaactgaatgtgtttgataatgtccatgtaccttctttaattctgttttctattttccgaaactcttaaaaatctgaagctatgcatgtacacttagtttaattctcgtctccttctgaaatagatatgtttaatacaaccgataataacatctcctagtgttcacagtacttgaaaatggctccttgtacctcataaaatcatgagtgtctcctttaccttatccattttatttccttagtaataataacggcatttttagcttttcctatctgaggtttattagaatactggcatagtcaagtaaggaagttttaagaacatttcatttcaagtatcctaaggaaatcatttcctgacaattaaaatctaaccaggagctcataagtgctgttgtaaaagaaaatgacccttctgacagaagaaaagatgggtgtttttagccattctgttgaaaacctgaaataaatgatagacatgattagaacactggttggaattttatagcttttgatatactcattatctaaaaaaaaaaaaaaaaaagtcttttgtctttcaaacatcctaagattaaaagcaaggaatggacaacattgtcaacattgaccacgtttcttacagtaaatgcctcactgggaaaggtgaacgattaatcctgatagttactaaattcaagaagagattttgctgaggataagaggtgtctttattactgccatcagaaatgcccccaaaatagatggttgtcatttgataattttttttaaaaatcaagactaaaatcattaaagtgaaaaatattaaacattttcatagatgctgattctgtgaagacaaacacagttccttctattcttagaagctaaaaactgatcagtaaccaacaggtaaccttcagtctccctgggccattggtttatagcctatgataagaatctatgcccggtgatgccacaattatatctaattctgatatgcaacagaattgtccctgacaacttttcatactttgtttctctcaagattttaatcagagagaaaaaacctccatttattaataactgaagttatttcctttaagtttccttttcttctttcccttatcaaaaatggtacagtaactcataagtactacaaacaaacgattttcatttgatcgcaaaatggaaatttcctgcagctgtttcacaaatatcctaagagaatcatttgcagcatgtaaggagcctttattagaaataaggaacatagcaggcaagcagattaaatggctcttgccctaaagctgcatctgcttttaagtcaataaaatattcagattgtttaaaactatagaacatgtggcatacaatagtttcaagtgaatacaactttgctaggataatcctttccttaaagttgctggagagttttaggaaaataaggactcactctttgaaacttctcaggcagccagtgctgtcctcttgcctgggagttttacaaggtcgcagtatactggaagattcataggtcttgaaacagatcagaattatggtgaagtcacaactctgtctcaagtagaaaacctgcctgccaatgcag

SEQ ID NO: 59036 - DNA, 1764 bp, Bovine  19866880844752
acgaggaggtgtccttagggctaaaccattttagccaaggccatagaacccagagacctgggttccaaagctacatattctcttactagctgcatatgatagttattaacttctctaatctccaatttccacttctggggaatagagataataataactgtctcataatgagtagttgtggagataatgtacattaagtgcttggtttaattctggcacatggaatccacttaataaatattggctattatttttatttgactccagtatatagaatattggtcctctgtagaattctgatattttagtgaggctgctctgggaaagaggcaaaatgcagtgttcgagtattctaagaataataagcttgggaaatgtcaaacgctgatattataacaaatgatgtttaatcttgctcatgttcttaataaaagagcctgatgggagttaaagatgtataagtagataggtggtacagggtaatgcacccagggagtgcagacagagctctccggaatctctgatagcctgctgtttcatttacacctgagtcaacagaaaattgaatcgcatttatattctcatcgaatgttgtctcttgggtcaaatatttcataaacttttgagctgagagccgggcctacctcattctttatggtgcatagtcacattcttcatctgacctggcatttgaaaagtcactcctgtttgtttctttgagtaatggatgatgcctgtatttctcagctagaacgttgccattgagggcatttcatatagtgaaataagttagtggttctgttggtttatactctgagttcataagccatatggtaatttatattacttgaaatgagacctttgttagaaagccttcttccctgactttcatttacagtaaaaaagattcatctcacaacctattcatccacagccagctgttgactaaaatcacatatgtatccctgtagctctcttctgatttggtgccttgccagcattcatatgtcttgtcatctctggagagttttcaatattttcaacttctctgacacttagaccttttttgtttaaaattgcaaattacttgactgtgtttatggcctgttatggagacaagacatgaatcctttctttactaaagaataagattaacaaagttgagtacttttcctctttgtctttttatatcattgtaggtgttcaacctgtgtgttatagcatcacaggaaacacattctaattgagctgagactttaaacctaatagtgtagtccttaacaacctggacacacacacatatacacacagagatagaatatacatgaaaaatgttttagttgaaatccaactttaattttccaagctactatttttgaccagctattatcagcaaaaagtgacaccagtctccattctcagcatgtttacagtctagtattgtaatatgtcactatttgctgcaaattgctggtttaaacagaggggaaatttgaaagtcacttaataaaaagttttgagataggtctgtctgtgggtaccacagaattggttcattcagcagcctggagatatcatcaagagccaatcttccttttttgcaccattgtgtcatccttggtttgggtattgaactcattctggtgactaattatctgctgtacttctaggcattacatcttgatatcagtgactggaagaaggaaaatatactatataatctttacggttatctttcttaagacagaggacattttttcctgg

SEQ ID NO: 59037 - DNA, 1126 bp, Bovine  19866880983928
atacgtttgtgtactagtggtagaggcaaatgagtacatacgcaaaccacatcacttataaacgtagaataacagactgctaatagaaaagtgtcttatttttttagaaatgactttgcagccagcattttattctttctgtctctttagtcagtattttctgagtgttgcagcaggaaggattggataattataggagatcatctaatggtggtttgttcagttccaggcacttatcaatattctcctgtgtgtgtgtttaatctactgaattcaagctgtaataattaacctacatgaggaatgctacaacactgccatactttttaattcatgaagaactcaaaaatattcccaaaatattttgttgacagcagcttttattactatactatcataataatgttcattgcgtctttaaaaagaggataatacacataataacggcaacactgttttcatttttttttcttttgcataaactttgtttgtaaaatccagtgaagtcattagagatttttgaaaacattaagaaaaaagaaaaaaaatgggggaatgacaattttgttcccaccaaaataatggagtgaaaaataatggagaacaacatggatatctatgagagaaaatactgctcgtgaaatgcaacagaggaaaatgagttaagttctccacatgcacactaagaaatatactgtacacgatatgcctaggcagcgattctcaaaggcactagagcttcttactgttaagaagaagtaattcatcactgctgggggctgactaactgttatagtttggatttggaagccaattttaacttttctcctttcagttaacttcatatcatatttacagattgatagatgatagatatcggagaaggcaatggcatcccactccggtactcttgcctggaaaatcccatggacggaggagcctggtaggctgcagtcgatggggtcgctaagagtcggaaatgactgagcggcttcactttcacttttcaccttcatgcattggagaaggaaatggcaacccactctagtgttcttgcctggagaatcccagggacggcggagcctggtgggctgccgtctatggggttgcacagagtcggacacga

SEQ ID NO: 59038 - DNA, 617 bp, Bovine  19866880985496
tggggtgccattgccttctccaaaataaaacagaattctcaacttttagactgtgcaattttttcagccaataccttccctgagatatcatcagtcaataatgttcctaaagcatcttatctgtgcttgtacttaagtttgtttggaggcatatgtttatgtgtatttacatgtttgttggatctgtgtcctctttattctcaggttcctggaaagtagaaattatgtgttcctctttctttccagtgtttccacatcaggcttcatacatatagattccttttcaattagccattaactgagaaccttaggcatgttaaatactgaaaatgatgtaaagaagaatgaactgaaggattgagggagtaaaatccagaaaccttatactgtattagttaataatctgaaactaaaattttgagctgctccctcatggttcaattctgatttgactgtaaaacagtcccctctattaattagtttgagaaatagctgctatactctgtgaaatagcctagaactgtaaaattgcattagtctgaaactataagcatttcccttgaagttactttaaggaaatccctctactgtacctcataataggagatacatgtagg

SEQ ID NO: 59039 - DNA, 1357 bp, Bovine  19866881017241
aatctataaaaaatattcttcttgcattctgaattttgataattttatctttctatcctttttcctgattggtttataagggtaattgtgtttatttcatgctcatcaaatattccctatactatttctaattatattttataatactatatttaaatcttcaagtattatatttattctacagttatacataggctaaatcaaatatactatatatcatggcaaaaaaaaaagctaattataataatatgtttcttgttcaagattttaaaaataatgattgttggcccatttttagaatttataagtttaaacagatgtcttccttacagtgttaatatttattaacaaatatttctacatttctacattaacaaatgatattcatttctacaaatgataatatttatacaatttaacacaaaaacttgagctcacattacatattcataggatatatttctgcctaaaatataaattattttttaagttgatgtagtttgtaattaaaccttatatagaaggcaattcattaacaagctaattatcttttcctatgaagcatttttattttattcataatttttgtgttttaaggtagtaaagggagacttccattcatatctcagcctatactgaaccatgcatagtcattattaaaatgtagtttttataaaacctttttttcaactctttgttttagtattaaaacatctattgttacttgatatgaaattctaatgtaaaaagaaatttcatggagaaaaaactgtaatctagatgtttgaagatagagcaatggacatatctttcttagtatttttgaaaggcaaatggttatacttaatattacatgtctgaaaattactttgaagctgcacagggaaaatgcctaaaagaaattaatgattaattgtggagatttatatgtgctattccattaatcataagctaagaaagaaataagaacaaggaggttataagtccgaaatggaagaaggctctatgggcctaaagccattactctagaaaataaatcctgccacacatctaagggaatgaacacagtaaatttcaggatttggaaaatgtttcttgtgggagagaatctcattaaagtagatatgaattactttgaaagaaggtcatggcagtgtcaactgcctttaacatgaagaatacttccctcctcatttcattatgtttatatcaaattctgtgatttttgtttatgatcaataagcaatttcttctaagaagactggaaaggttacagccctggtttgctcacagtaatggatgatttactggaatggtgagtcatccctatttatttcagcatattgaatcatcaatt

SEQ ID NO: 59040 - DNA, 1380 bp, Bovine  19866881128052
ttcagtgcagtcactgagtcatgtccaactctttgcaaccccatggcctgcagcacaccaggcttccctgtccatcagcagctcctggaacttgctcaaactcatgtccatcaaggtggtgatgccatccaaccatcttgtcctctgtcgtccccttctcctcctgacttcaatctttgccagcatcggagtcttttccagtgagtcagttctttgcatagggtggccaaagtattggagcttcagcttcagcatcagtccttccaatgaatattcaggactgatttcctttaggactgactggtttcctcttcttgttgtccaagggactctcaagagtcttctccaacaccacagttcaaaagcatcaattcttcagcgctcagctttctttatagtacaacgctcacatccatacatgactactgaaaaaactggagctttgactagacggatctttgttggcaaagcaatgtctctggtttttaatatgctatctaggttggccatagcttttcttccaaggagcaagtgtcttttaatttcatggctgcagttaccatctgcagtgattctggagcctaaggagagtatccattttaaaatcatccatgtaaaagtatccattgccaaagataactttgcaccaattttttactccaactcagggaaatccccaagaagccttctctttgggttgtattcacctcaggaggatttctcacagaatttgctaacaatagaaatcatttcttggttatgatacagtaccagcaggatgttcaaaatgccaccggccattctgtagtcctacctggccaagcctgctggtaggtaccatatgagccatatggaaattgctaaaataggaaataaagcagcaggttctgaagccaccagcttcccctgccatggtagaattagcattagtctatgatgcaaaacatttctgcctttgaaatgcccaatatccatggaatatcaccaatccacggtgctacaccaaatagtatttcaacatattctgattaccttttcacctctttggtgcctgaaatagctacatttttaaataagaaaatttacccagaaaaacatccatacaggccatattttgctcagcagaattaacattctatagacactaatgttgtgataggatggtttgaagatgcaatctaaattccttataactgctaatgtatgtctgtacttcctccctgagagataatatcaagggatcttttgttctaacataaaaatgttcagacttgaactgtaatgtggggataatacagggaagcaattgcactaacaagatggacttagaggaatgaaaatcacctaccagaaaatccacaataaggagaaaaacagcaa

SEQ ID NO: 59041 - DNA, 1813 bp, Bovine  19866881145286
cccagtctcataccaggcattctgggagcccccttatcccatccaggcacccagctggagcattctggatagcaagcaccttctgtccttcctgtggaattctgctggactgtgaattcctgttcacttcactcttctgagtgttcaggtcctaaaaactattgaacaaaaaatgtgttcaattattttttccttgaatgaataacacagtgatgaaacagaggaacttctgtcatctcagtgaggaagccagtgagttccacttgcagcgtatctataatctggccactctgaaacatgagaggttgaatatgctctggtaatatcagcatttggggattcttgggaaagaggaaggcttattatactaaaaacatgtcttgatacttggcactaaatttattcgttttatgtaattgaaagtgtcttttacccatttcagtactaaatatagtgaataagacaatgctgtgggcttcatgagatctctgtagttttgataatgctttgaatgtaaaacataaagaaagttgagatgtaaatagttctttttttgctaaacaaaagaagagcagaacaaagaattatctgcttcagattcaaacagtatagtaattatctgtgggtgtcaagaaatcacagatgcacttttcctctttgagccttctgtcggcagtgcagctggaggtggaggttagagctgagctgttaaaaggtcacacgaggggtggggggagtgggggaacaggaatgtctgcacagctttccacaatgccctacaatttattgatttttttttttaagatatataaaaggtatgtaaggtaacaaaactagacttctaccattctctcttggttcttagcaaaaaaaaaatggcctgccgttggaataaggtagctgtccccattgtaacttagtactttggttcttatataaattagtatctcttagtttaatgtttcatggtttgtagtttaatacttttaatatttaacaatggcttcaggctcagtctctttagtcgtatctctttgcaaacccatggactgtagcccaccaggctcctctgtccatgggatcctccaggcaaaaaaattggagtgggttgccatgtccccctccatgggatcttcccaacacagggatcaaacctgcatctcctgaatctccttcactgcaggcagattctttaccaatgagccacaagggaagcccacagatgacttgaacagagtaaattttaatgtagtacctgctgttggttttagtctttggggacatgcactaatggaaaagtgatatctattgactgttctgacggatatgtctactctttatggggaggaaactttatatgccaaatttccataaacagggctgaattcaggctgtgcatgttcagaggacccctttgagatctccatggcaactgactcatccttctacccactcagtgggaacactgttaccatagtttgtagatttctcatttttcatgcttgttctctaaaaaattcgtcctgttaataagatagctgctcatcaatccactagaagtcctcttcagttcagaataccactgaaacttcccctaaccaagatcaccaatgttgcctttattgctgagttatcagtgtcctgtccttaaaagtgtctccttccttgatttgtaagacttcacccacaattccttcatgtcttttcttccttttccttccccaagtcctttcttcttgccaaatgtatctgcgcctccaagattctgtacttgcctgcctttgcctcacatgttgcactttaccaggataac

SEQ ID NO: 59042 - DNA, 1087 bp, Bovine  19866881384487
aatctgtttgtacattcattcttttttggcatcctgcatcattatcctcatatttattatgaaccaaactgttgaaaggcatgggggcttggcagattttaaatactccagtgataggtaagcccactctttaatgagcaacacacctgatgcaaagaactgactccttagaaaagaccctgaggctgggaaagattgaaagcaggagagaatgacagaggatgagctagttggacggcatcactgactgaatacacatgagtttgagcaagcttcaggagacggtgtggataggggaagcctgatgtgcagcagtccatgtggtcgcaaagagtctgacacaactgagcaactgaactgaactgaagccatggaaacagcaccaatcaggcactatggtaggaagttatctgtactataatcagcaccatcattttcaagtatcaaaacacacacagagatctgtatctactgatatctataatacatcactacttaacgtgttttgacttctcttgggaaatttttatacaaataccttagtaaacacttaaatttaaattcaattttatttagttttaaataaaatagatatttaagaaaattcaagttaacaacacttatctagcatatgatttagactaattatgtccaaatcatttggggcttttgacactgtttctactccagaaagcaaaatttggcatcagtatagtcatcagttcagttcagttcagttgctccgttgtgtccgactctttgcgaccccatgaattgcagcacgccaggcctccctgtccatcaccaactccaagagttcaggcaaactcatgtccatcggagtcggggatgccataccaaaggtgaattcctaataaagacaacaaaaattcactataaatgttaatagataaaacaaaagattccacaacactgatgtttgatttagcacagaaatcctcttcctgggaagtaaataatgttaacattgaaacactaaaatatagatttctctagaactgtttactgtttgggaatttaatgaaaagttttaaaaagaagtaatttaacatataaagactggcta

SEQ ID NO: 59043 - DNA, 1538 bp, Bovine  19866881430208
tgggattctccaggcaagataatggagtcggaaaccataccttcctctaggggatcttcccaacacagggaatgaacccaggtctccctcattgcaagtggattctacacacacacacacacacacacacagatatatatatatgtgtgtgtgtgtgtgtatataagtttatatgtgattgatatgtgaaaataaatataccaaatataattggtatttgtatatagctacagtatggtgattttattctgctaaatagtttggcaagcctcactagggaactggggaaactttcctaactgggaaacatcataaaaaaatacagattcctgttctcaaggctactgaacaaaattgctgggcatggagcccaggaatctctagatttaaaatgctgcccaggtgattctggtgatcatccaagtttgaccaccaatattagactactctggcttctggcagaaagagaacagctacttcaatatctctaagcccattaatcaaagaaatgtctctagggtaatttcttctaccatatcatgtatcactgttgaccacagctgccaagggctctgccgtataaccacttgatgctccttgagccttcgtacatctgtgcatgactgtgtgatctagacacttcacacttgggaagcttatttgcagaaatactgtctgctggaaatcagacactgctatagaaggaaaaccaattgctaaaacatgcttgatcaaatctctgagacattgcgacaagtgttaaataagtttttgaagatatgccaagcagcaaatgagaaaacagttgctagtttcagaaatattttgcaagtgtgtggtaattcaaatttagcagggaaggtaattttacttatgaacaaaagtgatttataaataatcctggaaaattaagcagctgggctagcacagggcttgcatatttcatgatttttaaacgaattgcaaagttgactcaaaaataaatctgaacaatttaaagcaattttatttatcagtgtaatcttactcaaatgctacaagaacttcaatatttgcttttattttgtgtataaagtagattatctttctattgaaatatttttatatttcctatgtgaaatggatcacaaatctgatatttatgtatctgaggtctctcactcaacttagaaatgtattttacattgagttctgtaggccttcaaataaacaaatagcagattatttcaaatgtgaaaaaaaccaaagttctagaaagtaattgttaggctttccagcatagcgggtatgtgcataataatacattttaacatcattgaccctttgaattttagagtttgttcaaaagaaaaatgtaaaaaaatctatgctgagcaattgagatagtagcatttgacaagtgggtttggagtagaggagctgaggtcagagtttaagaaatgattgcaaatatacaatgagaatcgtgaggatgatttggggggattcaaaaaagccatacattaatttttagtttcttgtcccccaaaaagaggaaa

SEQ ID NO: 59044 - DNA, 1587 bp, Bovine  19866881551129
actttggatgataatgatgtgtcatgtggtttagacactaagcccatccaactctttgcaactgcgtggactgcaacacaccaggcttccctgtccttcactatctactggagtttgcttaaactcatgtccattgagtctgtgatgccatccagccatctcatcctctgtcaaccccttctcctcttgttcttaatctctgtatatccatcaattataccaatgtaccaatctggtgggggatgttgataatgcaggatgatacatacgtagggggacatggggatataaaaatctctgtatctcctccttgattttgctgggaacctaaaactgctccccaccctccttgcaaaaaaaaaaaaatcttaataaaatgcacaaattaatcttttaaagaaaaaaaagtacccttcattgttaccaaactttgattttcagctttatgtcagttatgtacatattaatcagaaattagttagcatattattggaaattttccctcttaattttaaaaaattgcccatgctatttttcatgaactagttctatagaagcttctgtagtttaatttatttgggaaaatatgttttactcaaacttacattctatctttttcttacactttgttttaattacctgagatcctcagagcagtaaaggtagaaaaaaaaaataatgcaggtaacaaattactgccttggttttattatctattacttcactattgcctgaagtacactatttattactttcagtctgcttgaatttcttatcaggtaattctctgagtcttaaatagtttaatgcattggaaatagagagacagtaaaggatggttactggttatttttattttctcagaaccatgctgctcttttagtaacatgctaagccatcatgcttaagaaaagaaaaactaaaaagcattttagcaggtaaatatacttgtttgagaaggcagactattgaatagagtagtagaactacagctatagctgcaattgaattaactatgaaattttactcaatcacaattttagaacttagaaaatactgcagagattattttctgtaatttgttcaagtaatgaattgtatatgcatggattcattaaccagaaaatatttggtaggatttccctgaccaataaactacagcacttcatgtggataagggtaaaaacatttaaaaacaaaaatattttacagataattgttaattctattttgttgttgttgttaattggactaattctgttttcaatgcctccccaaaatggatcatttcctaaggttttcaaactttttaaaattaaacttaattttatttccttttatgacattataagaaaaaagatgaatgctttccaattcatagtcacaaagctgacaaaaccttcccactcatggagtcccatcagtcagtcactgtggggcagacaaaataactcgtcttagccggtttctccataatagtcatgtctactcacatggcttagctatatgttatttacatatggggtatgtctatgtatatgtatatatacagatatatggtatgtgcacatatatttaactcatatg

SEQ ID NO: 59045 - DNA, 1780 bp, Bovine  19866881895999
aatatagtgagaataagcaatgttaaaaacaggcacttgagagcccaaactgcaggttgctgctgcccagatgtagaaaaacactccagtttgacagacagataaagcgttttcctttagagtctgaataaatgctcttcttgaatctggcaacatgaattctcaagagaaaacaaacccagcaaatctcaggttcatagttgatttcaaattatccccttccatttattgcttatatagtgcggccatatgggaatttagtataatctggacaggtatgatttgccatcggtgtgaaaatatccccttaagatcacttcctaattatgtcattaaaacttaataacctaaaaactgcctccttgctggacaaggggaaaaatcattttgctgtttttgagtcacattttttacacacaaaatgcttccagcctcctctaagaaaatccattttgaaaaaaatttttgtttttattgctgctttctcaaaatattatagcctgtttaaatacttaaattagtttatttttaggtcagagactattactttgctagtttaattttttaaattacaaaagcaaattataataaataatattttaaaaattaactcactttccatatatagctataatatatattttaaattttattttcatgccatactctttttatatataaattgatcaaataatacatgttattctatatcagaatttcttcttatgatgttaaattataaacactgatccacactgtcaatagaatactgaagagaacattcattgaaaaaatatcctgcagtttacttagtcaactttgtttgtagacatttagataatgtttagattttctccgcctgtattattacctgtctgcttgatctttaagagactccatgcattttaaatattaaagttttcttaatgattctagaaataaactatgggcaacctctactagtgaacttattttctatgtctccatattttaacatggatcatcatctaaagcctcagctttatttggatgcatgaaacaacactccattatttttaaaacaatatttactattatttaaatagtatttaatatttgctattgctaagtcacttcagtcgtgtccaactctgtgcgaccccttagacagcagcccactaggctcccccgtccctgggattctccaggcaagaatactggagtgggttgccatttccttctccaatgcatgaaagtgaaaagtgaaagtaaagtcactcagtcgtgtccaactctgtgcgaccccatggactgcagcccaacaggcccttccgtccatgggattttccaggcaagagtactggagtgggttgccattgccttctctgatttaatatttactaaatatttaaaacatatctactacatagtcatcacagcaattctgcaaggcacaattattcttgttttccagataaactattcaaagtgtttaagcaatgttctcatagcttgttacaaggggtgtctgcatggcagtacaagtgataagtattaaaagaaattaacaatacaggtttgtggaaaggagatggaattttgtcttgaatatattcagtttctgttgcatgtaggatgcccaagcgcagttatatggtaggaagatgaacacacatctggaactttgaagagagggttcctctgaagacacaatttggaagtccttagcttataaatgaatttcaaaccatggaactgaaagggttatcctggtaaagtgcaacatgtaggcaaaggcagg

SEQ ID NO: 59046 - DNA, 775 bp, Bovine  19866880522117
ctgattgtgtgacatggaaaggtatacatttgaaatctaattttcccagcttaattagcatgtgacccattagcacagacttatgaggaaagagcattctcccagcaaccattatctaatttccgggccttgagaccaactgctccgctaatgctgggaagggtgagcacagctaggggtatgtcaccaggctgctggctggctgccagaaagtccatgtagcattagatctggaaaggctcactgcaggcaaccagaaagaggcttgcagtgtgagcattcctctggccttggtcctttgattctctttgaggcaggtactaaaggcggacagttgtccacacacaagaggtgcagacatgaatgtggggcagttactggtgcctttcaagtgagcaggctgtgtaaaactagaatatgcagggctttctctttctttctttttttttaaggattcaagtttatagaaaattttggcattttccccataaccctctctttctcctttcttcccttctttctcacttagcttccttatcatcttctctcgattattaatatttatggaaggcctgctctgaacaaggcgccttgctttgtcctctgggggataaataagtgactcataagtgctctctctgccttgcatgttttattctgataacctagtccctgttctggttttggttatgctttcaggcgttgctctgctagttcttggcaaacctgaaagccactcagttaacagtgtccagacctcacacaccctaacaca

SEQ ID NO: 59047 - DNA, 735 bp, Bovine  19866880569951
accctccctgagcctgattcctcatcaccaaatgggaacagtaacactggccttgcttacatcacagggctgtgtgagggtcaactacggtgatgcctaggaggtagaaaagcacttgaaaatgtgtttaaaaatgtaaacacatggaagagacattatgcaaagacatgcctcctccagaatgcaggagcaaagtctcaaaacttgaggatttctatacttgctagatatttgaagaagagatgagtttgcttgtaattcacctgtagaaataagcaaatgccaaatggttagatcacagaggagggaaactcagagcatcagattgagaacatgcagaaaagatctcattgcaacagctggtccagtgatggtttgtaccctgtcctggtagcagccttatacgtgttccatggttttcaaaggtcagcaccttatgattgtgctctgtaatcaaggaaccttgtccctcatccttgccaggcaactgcattcccatctcaatgacatgcagaccaacaacactgttgctgcactggatctgagtctcacttgaagaggatttcatgggaatgtttcttgtgttattaaatcctctctcagctttgttcttcacactggttgcttctgtctgtaaaacctatctgtaacctccatgcctttttttttttttccctgaatccagtttagagacagataatacaattattatcagtcagaaaaaggtctcaggca

SEQ ID NO: 59048 - DNA, 1528 bp, Bovine  19866880580374
atggctggtttgtatcatattggatttcacaggtcttgatgatatctaggcttcttatcatctgttttccaattaactggtttaaagccatgctgttgccttattcttaagctagaatgatggtgaaagtgtaagcttctgctgtgaataatattctgtagaacaactttatagcatctttctgccagtgttaccactgctagcttggagatggtcagtgatggttcccaccggggctctacagttacttcagagtaggtcgtctctctgatgtgtttgtcccctaggcacatccctttcctcagcagccccagtggagagtgtgttcctctccacttccacacctggtggaatgtctcccctggcccccagcccgtggccgttcaaatcccaccttattgccaggccccacctcttctgtggaccctccttttacttatccaggctccactatcttctcacagccccagcaaccgcactgcacacctaagcattttgctccttcccactttgcttttctgtaattattcttccaagtcaccattcatgtctgtcaacccctatggcagcctgcttcagtgaatggatcaagcctctccacctcacatggtacagcagaggatacatatctccttctctataaatgctcttgaattaaaaaataacagccagtgagtgacagaataagtagtgaggtcttatttctccctccatacagtcattctggggagggttgaagacacgatgttctaaagaaaatagcttgatctagttaagaaatacgtgattaatctattcatttgcgcaaattggaacttgtgttaaattgccaagctgaaaatggttactgcagcagtgccaggaagaagatgctaaggagaaagactttttcttatctttaaaaccttctcttcacctgatgagagcagcacagtggcttaaggaaagaacaccagccaagaaatcagatgacttgggtttgaggtcagcctctatccagccatgtcttctctgcaaagtcagttaacccctggagtatccattagacatccatgaggcaagagcaggacctaccctgcccactttgaatcagaataaagagtctagtgggttcaaagagaaagctctacatggatacacagtggctctttcacagaggcgggatttggcttatgctcaggaaaaaaatggcaacccactccagtattcttgcctggagaatcccatggacagaggagcttggtgggctacagtccacgggtcgcagagtccgacacgactgagcgacttcactttcagaagaaaacaaaaaacaaaaaaaccctggtaataaacactctgtctttattagcctcaccacctctactggaatcccctgtagagtggggctcagcagtagttcgggacctggaataagacagtgctgattctgccatattttaaaactgagcctgcaggagtgaagcctattttcaaaggtagggaacagaagtgctgggggaagttaggctaagataagaacgaaaag

SEQ ID NO: 59049 - DNA, 1301 bp, Bovine  19866880645027
atggcaacccactccagtactcttgcctggaaaatcccatgggcagaggagcgtggtaggctacagtccatggggttgcaaagagttggacacgactgagcgatgccactccatgtcttagctattgtaaatggtgttgctgtgaacattgggtacatgtatccttttgaattatagttttgtccagatatatgccaggagtggaattgtacctagctttgtctttactagcaaatttcttaatttctctgtgctccagtatctgtaaaatagacctggtaatcctttatggatttgctttctaagattacatgtgattgtaaagtaccaactgttatctgttaaaattctcaataatatcagaaagaaacttgacaagaatgaatgaggctctatgagcacatgttaatatcatcacaatagatctttctttaatcttttttttttgctttgaaatattcatattttaatcagcctcagtcttagcacagtatctggcattttgtaggcgatcaataaagtttgttggatggataattggatgcattaatgagccagttttcatcagtttctaaggtttctgtgggattgtattgcaacgtaaaactcttggcttcctgtgcaggctttattctttatcagacttgtcctcttcacatccatgatgagttcttctctcctttgaaggcaggaatcctgtctgtttttgaccttagctactgaagagcctgacctatccttgctgtcccccactgtttctattttagctacttataaccagccttgtaccagaaaggaatgtaaggtggttcccaaatgacacggattaaaacatgaaaaaagaaaattaaaatgacagagtaaagacagggatgaaggggacttgtaatcattgttctaaaacatgtacattccttgagaaagatctactggccgtgcactgcgttgctccaaaagagaaaagtgcatccatatgcgggatcctgggaggagggctgtgaggagatcatttgagtctttgcttttgttggctttctgctacaaatgtgggtctgcgtaaaatggtgattcgcaagttatcacttgatcctgtacaaagaaggggataatgaaagcaagatattttataatactataatctttatggtagtaaatagattaaagcataaaaagaatacctgaatgcaaaataccagactttgtaggcaaattatttatattgatattcacaggttcatattgatcaattatgataactttcaaaatcccttcaatgagttggattttgaacacatcatgat

SEQ ID NO: 59050 - DNA, 3080 bp, Bovine  19866880722841
caattctttcagaacttgagtgctttatttcttgactgtttcatctaatcctccaagctgacataagaaaaagtctgaaacttcttcacactaaggtataaatggctgataatagtttataaccaagtctctcaaactggggcagcagaaggtgccaaggggcacctggtaaagctttggaaccaacatggcacatctctgagacaacaaacttacttgaagaattagtaaggaaacattattttatgttaaaacaaacacaaatataatacggaatgaaatgtgaaatgattgaatgaatgaatcacactaaagtaaattgttacaaaagaaataccatgcatgaggctgaaaccccagagccctggggatggcaaatcctcttctgtctcctctgccctagtgggtaagcccagcagactccagctatagacggatggatgaggctcttgaagagccctgtaatgggagaccttagggtcaagaccccactccagtactcttgcctggaaaatcccatggatggaggagcctggtaggctgtggtccatagggtcgctaggagtcagacacgactgagcgacttccctttcacttttcactttcatgcattggagaaggaaatggcaacccactccagtgttcttgccgggagaatcccagggacgggggagcctggtgggctgccgtctgtggggtcacacagagtcagacatgactgaagcgacttaacagtagcagcagcagtagaggtaattcaagcagcaagcctgaattgaaagtaaattcagcaagggcctaaaaattttttgtaacttactaaaattaaacaaaggaatactaaacaccaacactatcaactttattatacacattttaaagagtagctatagggtatggcatatttcactttcaaaacttttcaggattgccgaccctcatggtttgaaaaagatgcttgtaaacccatgttgctttgtggcagatggatgcacgaagaggcatttttaaaacgacatatttcttttagctacgttcaagatgcttgatgtatggacccctctggcagtctggtgaagtttacggactccttagaaaaagtgcttttaaacacataacataaaatatacaagaatctgattaactagataaacagttcaaaatatttaaaatccaaatttgtgacctaataagacattcacttctttctcaatatattaaataacaagctctaggagtaggctgagtgccaaatttccaaaaggtgataggtataaatagccagtgaaaattatttttttaaatctctgaggtaactgtgatgtggtagaaaaatacctgtaatttcttttgatggcaaagtaacagttaatgtgggtacttctgtggtttcttgccaacatttatacttgaaggaggagctaaatttcagttagaagttggtgaaaaataaaaatgtatttttctcatgcatgttcatgaaccccaaatgatatgcccttagataaaaaggttctagattctcttgacttcagactgaattatttccagctattctgatgccttagatccttgggacagaaaaagcagtgagcaacttttatttaagtgataagtagactttgatgagcctttcgcaacccctatcaccatctccaccgtgcagatcatccaagttctgctcttgggcacaaccttgtgttccaactccatgtccctcctcctggtggtcacagaagaaaggttctaaatttctcagacccacatgaattctccaaactgcctttcccaacagaataccaccttctccttcacctccattatctatctttagcccctgtttcccactgtcttaaaggtcctagcaaaatgactcacaattcacatataatagatttaggatgtttgcaatgtctaagcacaaatccatgaagtaagaggatatggtcacagaaataggtcttgaaagccacagaagcaaccttctaacagctttagtcctgaattggaaccccaccagcgtcagtgtttgagatgccacttttcctagaaaataagaaagaaagaaagtaaatatcattttttgaacacttaagtttcctgtgaatggtgctgcatttatattttctcaatctcctaaagaaagaaaaaaacagggagctattaatatccccatttatgaatgaggaaagaagcttgaaaagtttaagtaacctgcccaatgtcatacacagttctattaaactgattaattaactatagggaaatctctttttgctatacttctgcagacttttttagagtgcacagatcaacaggtgattttttatatgtccaaagaaaatgaataagaatctagttggaatttacaacagataaatggcttgaacctttaaaccaaagaatttgaaagaatcccattctactttgcctctacttagataaaggaaggaatgaaacaaagtttccttgtgctacttatcaatgtctgtcatcaaaatgcatggctaaatcatttatatgcctgctggtttccaaatgaatcattaatcactgtcaacagtgatgaacggtaccctcataagaaaacgttatcaccatttgtagtcaccttcatggctgtaaaaatgtatgttctcatacaactataaaaacaagctggctgacaaatgaacataccttctgctctgtatttttcaaaacaggttaactgtacatttcttttttttttccatttcacaccccacgtttgactagtagcttccaggtaaggccccccacacagcagaatgtggtttagaaggatcagaaagatgttcagctagactaaaacagcagatgatgtaatgatctgagcctgtgaaaaccaggtcaaaccaaatttgtttctgccagtttgacaaggccactggagccctttacatgtgccttcagtttgtctctgttgtgtcagcctctaaataagggatttttctcctgtgcaacatgcatctttcttggtcaaatgcaaggtacctattgtagccaactgttcctttcttccaagcagtttactgtaaatagtgtcctaagatacacgt

SEQ ID NO: 59051 - DNA, 1573 bp, Bovine  19866880849950
tcagactttattttcctgggctccaaaatcactgcaggtggtgactgcaggcatgaaataaaaagacgcttactccttggaagaaaagttatgaccaaccttagacagcatgttaaaaagcagagacattactttgccaacaaaggtccttctagtcaagggtatggtttttccagtagtcatgtatggatgtgagaattggactataaagaaagctgagctccaaagaattgatatttttgaactgtggtgttggagaagactcttgagagtcccttggactgcaaggagatccaatcagtccatcctgaaggaaatcagtcctgaatattcattggaagaactggtgctaagctgaaactccaatactttggccacctgatgcacagaattgacttactggaaaagatccttatgctgggaaagattgaaggcaggaggagaaggggacacctgaggatgaaatggttggatggcatcaacaactcaatggatatgagtttgagtaaactcctggagttggtgatggacagggaggcgtggcatgctgcagtccatgggattgcaaagagtctgacatgactgagggactgaactgacctgaactgaactgaatgacagaaagcaatggagtattctgaaattgtgaacaaattttatcttctttacaaccttgcccatagactgacatgtcagctaacaaagctctttgtttagcttactgggttgtacatatactgccatttttcatctactcagagaaaatttttgtaacccaaaactgaataaacagactttttaggatcgtgatgtattttctctggggtaggtgtcttgtccatgctgaatcatatgatgagttatattaattaagcttggataagaaggagcttatagtaattttttaatttcatgttttcttctagagggaaaaaaatattttctgatttttgcatggagaaagaatgcagaggatgtaggaacagagaggtgttggggatttatccttggacatgtagttctaccggaatcccctaaagtcactcttcgtagttgggcactcagatgattaaattgtctcagtgggccacttagactcaatttgatataatcatggaaaacttccagtgtgtactaatactcaaagtcaggaagtaggagttgagtctacttgagaccatcaaaaccaggcaacttctaaactaaaagttaacataggcagtaaaagaaacccaacatttatgtttaattatttgtgtatatggcatctgaaagtatttggtaagaaaggggaatactattgtacttttcctattttagacctcttctaggaggttgcttctgtggtttcatttactgagtttgatcagaaacaagcaggggaggtgaggaacatggtgggcattggttaacagaatgataacaagaaaagatttttcctttctaccctatagtcttttgtttcagcttgtctgtgatgctgatctaggggatgagcattgccttattgaaggacttgaaaccatgatagtttaaaacaattaatggaaactccaagagactgattactaca

SEQ ID NO: 59052 - DNA, 1312 bp, Bovine  19866880876932
tgatccccagttagggggatggaagagctgagtgtgttgggcagggtcctgtgcttgtgtcttgagttagaagggagtggaacccctcctaagacacatgatctgagcttgaagttcttgaggaaaaccaaggtgctgttggataagaaaaataaataaatatttgtaaaaaaccgaaagcccaagaaagtaggtgtctgctaccgcttgtgaccaggagatgaggatactctggaggagaggacactaaggaagtctgggctaatggcctctgttttgtgtgtgaagtgggagacctgactcacggtgctgtgcaagctttgcagcaacctccacagattccatcctcccacccagatctccctccccgcctttcctcaggagtgagggggaacaaaagttgacaagatgaattgaccctgaatgaaagaaatgcctactgtaagatggaaaaaaagtctcatacagaggtggaaatgcctgtgagtgtgataggagttgtttagggaggtacaaagaaaagcaagccataccaatcaagggaaacagcttttcaagttcactacctatgggggaaaaaaaagaaaaaagcctagtaaagattccagaagaacaagctaagctcatggaaagtgctgagaatagctggtttattctcagtgtgtctccctatttttataacttacctcaactgttcctctttctcagtaatgttgggtggcgagggacattgcagtgtaaatatttacagaaaagtcttcaggggggacctatggaaggtgctggtaaatgtggataattagccggcctggttttctgaacaaggagcattaatgtgcctgtggacatgcagagaggcgttatcttcagaacatatttcaggaatggaaaaacaaacaaagctgattatgaggaaaatggatctgccaggaccaaattataggaacagacccgggggcagaaataaagcttacaagctctccagaatctgaatgctgcagagctcagaagtggagatggtacatgtttgggtctgccaaccagggcacctccatggtcctggaacaaattgggaggaagtaagaacagaagccattgttccgaggagctgccccacccttagagtccacacagaaagaaggcagacgtgtgcctccagacctgaattggaggtgggcccctgaccttcctcatcccagaattttgcccctagattttgggcactgaactatggatgtttaaatgtcttcagtaaacctgatccttgcattggcctgtctcttctcaacccttctaagccagtttcaaccct

SEQ ID NO: 59053 - DNA, 990 bp, Bovine  19866880891841
tctgactttgcctctacttgacaatgaacatcaggcaaattgctgagttctctgggatcttgcctggtcaccacttccacagtagggagcaccctgttcactgaggtgtcctggaattcctcacgatctgaggctttatagattgaacaatgattaatcccaagccagtgtcccagaatattgttaaatatctatccacttcccagcatatgtaaaggagtagaatccatcttttcactattccttacagaagcctatgtttattttttatctcaaccatgcttattatggattttgtatctcaactatagcataaatgggcccaatttaagaaaaaagttcctcattactatgcatgtgggggtaaagccattttatgaaatgtatcttcctggtatatcatcatattccctaaagttataggtatatcttgttacacagagaattatcgatggtaagtgaaattttcttactttttaaaatgattgaatataaatgtgggatcctaatagaaaggacttatacaagtttgaactgtcgacaatggttgtagatgccctaacaaagggtttgtgttatggaagaacagcaatgttttaacccacagaatgaatatgacacattccacatatgtgagcatgcatacatacatatacttaagtatttaagagaaagctacatttaatactgttacaaattgttttcttattgttatttagtcactaagttgtgtccaacccatggaatgtagcccgctggtcctctctgtccatgggatttcccaggcaagaatattggagtaggtcgccatttccttttccaggggatcttcctgacccaggaatcaaactcaagtcacttgcattggtgggcagattctataccactgaaccaccagggaagcccatacaaattgttttacccaaggaaaaataacttagcatttacatagcactcatatccttttaatgccttttcaaatctattcag

SEQ ID NO: 59054 - DNA, 2053 bp, Bovine  19866881168528
aatgcaagttctaggtgatatatgtatacttattgctgattctgttgttgaatggcagaaaccaatgcatattataaagaaattatcctccaattaaaaataaagaaaaagtaaaatggataactaacaaggacctactgtatagcacagagaactctgctcaatattatgtaacaatttaattgagaaatgaatctgaaaaagaatagatgcatgtatatacataactggatcactttgttgtacaactgaaactaatacaatattgttaatcaactgtactccaaaataaaattaaaagttaaatgcaagttcttagggcctactccaaatctactaaatcagaaattctggggaaggagaccagcaatgggtttccacaagccttctagatgagtcaaacaccactcaagtttgagaaccactgatctaaaccaaatatggcagcttgtgtccctggctgtgtgattagtttgggtggaggcctgtgatgcagtcccaataaatgagatggaaggggaaactggggcttcctcagtaagggaagatatatttcccccttttctctgcttctggacatttacatgtccagccagttaaacttaatgtttttatgtatcaagagttgtttataaagagttttgacaaatatttgtcattactactttgaaaaacataaaatgttacaaataaaaacaaggagggactaaatgtagtttctgtgaagaatttatttggaatattctgaacccaattagaccttactctgctgcctatttgtagcaagatcataccttagtcaacccagaactggacacactgctatcacctcagggttagtcacggactacagggatggggctattcactccatatagatccctggctaaatgctctgtctcccatgtgtgctttgctgggggtggtggagaatggttatttggacatccatttgctctcccatgctaaagcaaagagggtccccagagttgtcttcaaagctgctcagtggccattgctcaggccaagatcagtgtttgcagagctcaaccatttctcatcaaggactgtttgctgttctttccaggcttatatgaagtctcagtgtggactcctcacaagggcatcccagtatttgatatttagttacaaaggctcactgctgaaaatgtgacctttcagttggctctgttttcctaatggccttaaagcagatgaagcattattgctaagaactgaactgggcctttggcttcctttccatctcagtgagagaggtaactttgcaatggtcattctgatttcactcaagcttctttctatcctccagtcttctggaacatcaaaatctgtagcatttcctgatttggcctttgggcttaagtaatacagcctataaaggaagcagactgatttttttcttttcatttttaataccaattgccctggtagaaaggaaactgctgtgagttacaatggcagaacttggagattaattagtaggctccctctccttcccttgccgagttgactgtgtggggcccctctctgtatggcacattgaattatggaacattcagccgattagttggaagggcttttagcaacggtggcctatctgccccagtatgactatttatagcttactttgttccagcaaaccactttcattctagctcctttgcctggttggtattgaactatttccattatccatgagggtgctgtgagccaaattttatttacagtttgaagccattaatatcattggttgaagggatttaatgtgggacattaggtatgaatgcactatagattttaccatcacagaaacaaatcgggcacagacacaaggcagtaagatacagcagctattgacagtgatgctcaaaataaaaccacaaaaaacacatgtaacattcatcctgaccagacatggcactataggagtccctattacctcataaatagagctaagtgagctggtatttaagattctctataatttgaccccaaacctctatcccactccatctcccgctaacatcctttt

SEQ ID NO: 59055 - DNA, 1874 bp, Bovine  19866880574063
cagcccagagctaatatctgtctctgaccatcccttgcttgcaaaggactcttatatctgcagcacttattactaatctatgtacatcccagagtttatatttgcattgggaattttcctttcttgtggatttgtttcatcgccttatctatggcaagccctactccacttttctctctcttttatttaacacggtatgaggcatactcaaatatttgttgagtcataccttaataatcactgtggtgtatctaacctatgtctgtctctggagtatgtacctgccatatattatatcattaaccctcaccacttcctgcttcacttttaacaggtgagaaaactcaaagactcaaagccattaagtcacccagagttgatattaaagagtgtgattcttataatgtatcgaagcttatataaccatctgaagagcagagaagaggctcatagtcaagtttgcctgactctagccctgcgctcttaactaattactgctctgctgtctacctctctgactacgaatggcctaagtctctgccaagataccaagttccaaggctttctctgtcttttatattgttccttgttattgtgcaaggaataatgcacagagaggtgtgtctatacggagacaagggtgatacagaggggtgcaggctttggtgccagatccatatggattcaaacccacatgtctgccatttactactagctgtgtgttcttggccaagaatttcagcctctctgaactgcagtttcctcatctgtaaaatggggacactgacgcttatctctgaagatttgtaagaatacatgtaaatccttaatgcaatgcctggattgaggtgggtactcaaaagatggaaattcacattatgataaatactggctgcctctatggtgcagtcccactgagcctatagatcaatgtgtgatgtgattggttagctagttggggaagtaaatcaccttatttccctgagacttaggggctccagatgctccaagggatggtaatcaggccaatggtacatggaaatttagtagctaatgtctctaataattgggcttccctggtggcttagacagtaaagaatccatctgcaatgcaggagactcgggtttgattcctgggtctggaagatcccctggagaagggaatggctacccactccaggatgcttagggcttccctggtgactcagatggtaaagaatctgcctgcagtgcaggagacccaggtctctgataataacgcatttttagcgataaatacaaaatgttcaaatccacagaccagagtcctttttttcttttctgtttcccccagtaacttactcttctgggtaactctgaattagaaaaatatcagcagataggggagggctggttaagaacaagttcttatctaagggtgaaggagcctctcctaattaagaaacacagcacaaaaagagatctcatataaaacaatagaaaaaaatataacttacagaatctagaaggaaacaaaacaagcagataattcccctagaaacagataagaatgaataacaggcacccacaggagtaaaacccactctgccttcaaggatgaaaaccaggggaggtggggggaaaggctttccctgagaagctgtgcaattccaaaacatcagattatgattcgggtttatttcctgataggattaaaggtagattgactgtcaaattcaaaacatcctcttttttttttttttaatctgaagattcaaccaggggaggctttgccttttctcaattgttttgcaaattgattactcagggaagttatcacgtctgccagatatgggcacctctctgcatgtctgcacgctctgctcagtcagcgg

SEQ ID NO: 59056 - DNA, 2497 bp, Bovine  19866880632536
atggacctaatccttcccctgacactccatcaaagcacctggagtcaggcattgagccaatctgaatccttccttttcctgcctaactctagacaaataggagatcagactacctgagagggctgacttaaggcatctgagataaacatactgtggtttctcaaagcccttatgtaagagcctgtgagcctctgcagtattcagtgcctattctggcgagggccatggagctgcatgtgtttgagaagaacggaggattttaaaggcgttttgttagcaagtgtgttcgcctgagggtctgcatggtttgattttccccaagcccctccagaagctctgtttcctcatgatcagtggtgaaatccccagaacagaatgggttgtgtgaaattttagattttatgcaagttcacagctagaacccatgcacaattactgctaagcatttgattttgtcccagtgaaagcccctaggattaggcctttcagaaggaaggaaaaaagcccccttctgaacttctagtctccgttggctattctacgacagaatagttttcatactgccagcgcttttacaatgtaaacggtttcttttcaaggttaagttttaagagcccaaagccactattgaaatggcaggggcagagcgggaacaattctgctggcattctaaaaataataagctttattttcacactgcaggttggggtttaaaagagtctcaacactttacttttttctgaccgccacttgcagctcttttctgtcaatccggcttagggaaagaggctggtccccatacgtttattgctcagctgctaagtcaggtctgactctttgtgaccccacggactggagcgccccaggcttccctgtccttcactatcttccagagttgctcaaatttatgttcactgagtcagtgatgttatctaaccatctcatcctctgccgccctctccttcttttgccctcaatcttcccagcatcaggatcttttccaatgagtcgtctctttgcctcaggtggccaaagtattggagtttcagcttcaacatcagtccttccaatgaaagagcagtaatttctgagaatcacataagatgaactctctgggatgaatatccccaacctttccctccttttaggactcaggtgatgaactattagattcgtggtggctgaatcttaggcaggagcatgcctctgccaactacaaactggcagctgccatccacctctgcaaggattgaatcatgaaccacagcagttgctgaccctcaacactccctgaaggagttcaggacgaagagcaggaatggggctctctgtactttgggagaagctggcaggacaggtcttcagatagttagatatgtgcaggagaaggttttatgaggccaattcttgcatctcctcgtacctagaaaagcactaaaatcactaacagtgacgtctgcccctcatgactagcagcaagtctttgccaaagtgtgtgcctgactgcatgtaaccccttcactaacatcatgtataacactgaccttccccttgcctctttagaccagttccttagagctatctgagatgctgtctcctgggtttatagtcttaactgtgccccaaaataatacgtaactcacaactctcatgttgcaattttttttttccgcctccattagctacatcagcagggagaaaattctgaaagggaatcaaagctgcagcaattgatgaactgagcattgaggccttagggaagagcttccctttgccgttctagagggtaagaggaggcaggaggcaggcctggggttcttggtgcttttccttccttccttcttccaaaatcttgtcctcagtgggcaggagaaagtgtcctttagcagaagaaggcatccaaattattccatgggagagcacactattaacacccagaaaatttatttgtcctgaagatgcttttcttattaggggtcatcttgaccctctctgcatggcgcctttgccttaacccttaggaggcatgaagctggggcttaggggaatgagtttcttggaggaggggagacagacagaggtcagagaatctggaagagtctaggagtgaagcacactgttccatgagcatatgacgtgtgggtgtgcatggactggaaacagacccaataggaagagcaagcacctgtcacaggctctcagttggttggcggtcagtaatcagggagactgcatgctttctgaattgaattgaaccagcagacccacccagactgtgctgggcattacagaacactttcacagatttttaatatatatagaaaatgaaaaaaacacttttggatagttatatatatacatgcatatgtgtgaaaaagtgtgaaaatgttagtctctcaattgtgtccgactttgtataatactgtgggcaatgacagcatattaaaaaaaacaaagacattactttgccaataaatgtccttctagtcaaagctat

SEQ ID NO: 59057 - DNA, 1685 bp, Bovine  19866880777637
ggagtgttgggaacttcttggctatatacgtttaagtcggcttcttctgtttcaaattatgcttacttcctcccattcccgcagcctctctcgctgaccttgggctcacaatactagcgcagacccacgcgtcagttctaacattcttctcctgccctgtgacacctaaggcttgtgttttcccagcccttcaaagggtgccgcacacaggtcacgagctggggttcaccctcgtgtggcgctctgctgcatcttaacctggtcttgcctcctgcctttgctcctgactgtaggcacagtgtcctgagggcctgcaatgaagggcgctttttgaatccccaacaccccaaggggtcaggtgaaagccctgttccatttaacgtcccatcggctttcttgacactcgaactctgtgtctgttttacatctcatttcaggagtccttgtgagtctcttataagtcagtgtcacgtctagctcctggtggcatcataaggatgttcgtagggactcatagttgaacaccctgccggcacgtcgatggctgactctactcaggtcacctttgagccatttacttcatctgggacatttctctttaacatccttgttatcaattcgcaagagtgattagtctgaaaacacagtgtgaaacctattgattatcttccctctaattcgaggggaatcgatctatcagacaaacaaggttttccattccaaaacaaaccagatggtcacaaagggattagttcgatgggcaccttcaaaatttgagaagggccctggagggacagctggacctttctcctgaccacaggcagtgttccactcatagactgccccaggcagcctctcttgccccagtagaaagaacgtttgcccagttgtcaaggcaaattcacgcccatatcagcaaatgcttacttatatctccaaaagcatctggctggccttgatgtttcagcttcagccgaggccaagggcagtcaggcactcttaagtagattgttgctcagagttggcagagcaggatccacctgacagatgccctgtgctgtgcccaggtcagccattgggcccatagggcccccttggaacacggaggccagagcaatgccttgggtaggctttcttctcccctgtcctcgagcctctgcagcggtggcctctgccaagctcccaaccctaggatgtgccttccttgtttgcatggaaggacagtttgtacttaaaggagtgattagatagattcttcttgcacgcttccatctctgatgacgaccagcttcatcgatataattatcattagttctcttcatctttctttaatggcaccagctggacagactggttctctttactgcccagattggtggtggggttgcctttgtggggataggtgacaggcaccatggaataacagatggtaaattcagggcttgttggcaatcagcaggtttttgctaatgacttaattagctatgcaaattgtcaaatcagtgtgaacattgtttttatcgaaaactttacctaaattaattaccataattaagtagcagaatgtcaaggatgttggctgcgtaaaagggcctggctgagtaagaaaaaagagagatctgtcttcaattaaaacatataccgtccttgggacagagaaaatgccgtttggaatgagttgcgtg

SEQ ID NO: 59058 - DNA, 1819 bp, Bovine  19866880799205
cttggcccccccgacactgagacttggccccggtgtacaggacacggtgtgtctgacccaggtcccccagcgcctcctcccgctagtgttttaagtgggcttctctctcccaaggttccctgtaataatgtcagctgctgttcacaggatgtgatggtggtaggagagccaactctgatgggaggtgagtttggggacgaggacgaaaggctaatcactagattagaaaacacgcagtatgatgcggccaacggcatggacgacgaggaggacttcaccaattcacccgccctggggaacagcagcccatggaacagtaaacctccggccactcaggagaccaaatcagagaaccccccgccccaggcttcccagtaagagtgaccggctccagaatccactgtccatagccccgtgggtcacgctcactatttcagatccttacttacaggagaggaaggagcaagacgttaaaactttgccacgcaaataccgatttctaaaccacaatgatctgagtttctttcttccttttttttttttaattgagaggaccattccgaataaacttccatgacccctccctggaggccttcgcaggtaacagagatactggcactgatgataattaaaacaagagcaaatgctaacgcttctcctggctcagtttgaaccatgtctgttaatttcccttcgccaaccccgcatccaaccatccaacgaaggccatattgtcagtaaaccctcagtgctcaggatcccattctatgccgaatccaactacagatgactttttaatattgtaaaatattttctgctttttgacttgcatctgagagtttcttgtttcagtaaaaaaagaaaaggaaaaaaaatccgcttttgaaaagtaatttaaacgtacctttatttttttctctctctctttcaccttttctttctttgggtaacagcgaagagggcccagcagggtaatttatggccaagctaatgtcagttggtcctcgagcccgagttggttcaatcgagcctgagtgcagaaacaagaaatgaccttttgtcatcagagacaccaaggcagatttttacgtaaagaaaggcacctggccccttgagaatgtatttgtttgtataattgctgttgatccaaatattttcaagccatgtaatccattaattttgtgggcagtttaataaatctgaaacttctgggtttcttttttttattgtatctgagttgactgttgtttctcttcatagtatatttcctgtataatattttgtaaagccctcacctggttcttttatggggactttcccttgggggcaatcccagtgtatttatgtgaaactttataaaagaactaatttttccattcgcatattaatatgttcctctatacatgtaaagactcagtggctcgtgtgttataaaacagctgtattttatgtatgctttactgataagtgtgccaataataaactgtgttaacgaccaaagcaaaggagtctgcatatctgtgatcctggcagagaaatctgcccacaatgatgagaagtactgagtgtggatttatgacccaaatcccacatggagtgggactgtgaaaaaggctcatctttataaactacagtttcttccacactcactgcagtttacttgggcaaacacaggggtgccttctctgtgctgggcactctgctgaccacagacacagggattggaaagcaaggattgacctcgctctgtggctggtcaaatacaagggcagtggcttccactcactgagtacttactctgtaccaagcatctcaattt

SEQ ID NO: 59059 - DNA, 1253 bp, Bovine  19866881423941
atgcataatcgtgggtctacgtatgagtgtgtgtgcacacgtgtgcatgtgtgagtgatgaataaatggcaaattataataaaacagacgtgtgctaaggactttgtatgcacctagaggcttgaggacagttacacagttatgcacaggactctagctggctctgctaaacctccaggctaggatgtgtgttctccactcaggtgggcttgacttgctatcttcacaaaatgagtggagacataagacacattttgtgtgcatgctcagtcgcttcacttatatctgattctttgcgaccccatggactacagcccaccaggctcctctgtccatgggattctccaggcaagaatactggaatgggttgccatgcccacttccaggggatcttcccaacccaggaatcaaagcttcatgtctcttgtctcctgcattgtcagccgagttctttaccactagcactgccttggaagcccagtgcacatttggggctccttccaactgggggtgttggcatcgttttccccacacacccccagtctttaaaaatccccccacatcattcaacatccacagtgagagctgaacttcctgccctgtcttgtgggaccgccccgcccaggaggcgatattggtccacctgagggtaacccatgtggtctcaactccccacaaggcagacccctctgctccttgctggagaccctgggatgccaccagctggtgcccatgtacctcttctcactaagcccccgagcgaggaccaccaacctctgaggacggggagggactcctttcagggcccctcaacgcttctgcttaaactggccagcaggggtcactgctgtggactgacacgggtctccatccctcccagggttgaggctgcggttcggggtcgctcctagcccctgctcttggatggagtgagacgcagaagccaaggattaaacccgagcccttgccggacacacacgctgccgtccggccactgggtggaccacagccatggccgtggtaacacgaccccctgtccgtgttttcagatagggcagataaggccagcaagtggcatttctagttaaacaggaacggggtgtgagtgattcaggacacacaaaagatgttatccttacgagccagtcggtgcttatcatctgacatccaaccagccgggggacctacagaaatggacacgtttgcctaacctggatacttccctgtttctctcagccatctgtaagtttcac

SEQ ID NO: 59060 - DNA, 1612 bp, Bovine  19866881533744
cagagatagtggtctcagggtgttggatgagcaagagaccagaagagaagggtttgatgtggaaggcatgtagggctagtcaggcccaggaaagaagcttggttctcaggccaccaaagatctgacttgggtgttaagagctctttcgggctgctgttagaagactggatatgagaaaggcatgaggggaggcagagagattaattaagatgcaaaattatgttggggagttggactcgtggtctggaagtgaaagagagcagcagccagagcccttgctgacggactggaaaaggaaggtgagagaaaagcaggggtgagtgatgatgcctaggtgtccatgtgggatagatggggaattgtggtacctcgtgctgactcgtaaagacaggctgagtgacagcatggtggtgaaggcagattggggcttcagtttacactgatccagctgcataactgggattgagaaataccagctcagaagcagcaggatcctcttccccaggctggcacagcgtgccagttcagccgttcaccaattccgaggtctctgtgaactgtaataggctggaaaccagtgaagtttaaatgaatatataacccgggcgactcctctgggtcagcatcttaaagtatggccatttttctcacatttctaacaccgtttcaagggtatcttacatctcagttcagatttgccattctatccaattggatttcttttcaattcaacccaattttaaccccaatgttcaagctattttttcccattatgcccataaatggaagcaaatcatagtatcttgtataaatgcagctgtttttccttgtcttctcttttctcattttagatgaaaatcttctttctcctttctttttattaaccacagcaccctccctctgcaccccgctgacttccttttctgttcctcacctcctgagctctttcctgtttcttcagagagcccctgctgagatgttttcttatatgatcaaattataggtcaaattcgtcaaaagaatggcatacaggtacatatctcatgaagatttcaactaatccagtacgtaatacctcctttgtttaagtgggaacatcggtaaataatgatgctctttgataatgaagaagtaaggaatggggcttaaaaacgtgccaaagttccatgctaaactgaaaagattccaaacgtctgttgccctcgccaccaataccgtgactaggtttgggtattagacatggtgtagcatagttcatacgtttgatagttaattagttgatttcaataactatctccaggtgtgtaataggaggtacacactcttcaaagcacaggagatgcagagatgatggaagatggtccctctacggcaaaggcaaagaaataaagcatggatacatatacacaaacatgtgtaaatagatagtcagtgggaatttgctgtaagaatcaaggaactcaaggttattactggggctctgtaataacctagaggggtgggaataagcagagggtgggagggagaataaaaagggaggggatcaatgtacacctatggttaattcatgttgatgtagacagaaatcaaaccaatatgtaaaccaagcatc

SEQ ID NO: 59061 - DNA, 1180 bp, Bovine  19866881836236
atttaaatgctcagaaaatgtttacggggtggcttcttcccttccattctattctgcaactggccctcataatttgtgataagaattcagatggtacctaacacaacctttcttcctgttgtattgttcagagagaaatgaatgattgtctattttgagtattaatcttccgttgtctccatggatacctgattcacttagaaatgagaggcttggaacccagaggacctatatttggttcctcatggatggagagtctgaagctcagggaggggcaactgtaaaccccatcacggtgggcacggattggctaagcaataaaacaccatctacagcgtttgagaaagagggaaacatattcaatcatttttacagctgatgtaatagcatctgagtttctgctcaaagaaggaatccattttcagatcacaccccagtcaaagggattctctcactgctgagaaaagggaactataaacccactgccatcagactcagaaggaagaaaggcgactacagatgctctcagagactgagatgggcagggccatgtggacgcatggggcaacccctcctggaatgaagcttttgcagaaatgttttccattaagtgcctgtatttaaaatcttattttgtaatcacagtatgcagaagctaagactttggactgcagtctcaccttatgtaagtactcaagggaaagcacgcaccctggcaactgacctaagtcaaaaggcgcagagggcaaactgctgagaaccaagagaacctgagtaaagagaaagtgggaccagaacaaatgcagatgattctttgattcacaactggtccagggacttcaccggttctctgtacaagaaaagaagagaaaacataccaaaatccctctgtatttttttttgcattttaatgtgtattgttacacttaagttgaccactttagtacttgagcgtctgaatatcctgatggttaagacaaagagagaattatgaatgatgactcttatgtgctggagcaggagggtcttaatccgtaaaggagtctcatttctgaccaggtttggaatcaattcagagttggatgcagataatagtacatgtatatcagactattacgtcattacggactataccgatgtggagaatgggcttatatctgcatgcacgcggcttccaaga

SEQ ID NO: 59062 - DNA, 1534 bp, Bovine  19866880476204
tactggagtgggttgcctttcctcctccagggggatcttccccacccagggtatggaacccgtgtctcctgcattggcagacagattgcagattctttaccactgagccaccagggaagccattatcaatgataggtgtaagtttgtttttttttttttttccatttattgttcctaaaaggagagcattccccagaaaagacgcagtcctttatgctgctggaccttcgcaagggctgttccctctgcctggagcaccgttcctccatatctcacggaagttctggccctttagactgtagctcaggtctctttcctctgcacccttgggctgcctcaggtatccaggtgtcttccaagctctgtgttggggaccttcattttctgcccacatggggctcaccacccccacccccctgccctgcacgtgtccctgcagtggacgggctccatcagaggggcccactgccacatggccagcagagtgaaggagggcagtgtccccaagctgtcaccgctccaggcagcccggaggaccagccccaggggctcagaaacacaaatcaaatgtgtctccttcaaattaagcccacattctggtctagtgggggcagagctatttcttagccaataaatattaataagaaaaataaaccaatcttctaggcttcttcccctcagctgccaccccagggtcataaattatgtactgcctgtgtctgttttgacaattgtgataaagtgagcttcatattcggaaagcgtttttctggtaagactgcagcattgagtgttttacatatgatcgtccctccttcccacccccagccattttccatcttggaggaggatttgactgcagattttctactctagggttttgttaccatgtttttgcaaaacaatggttttaaaaaaaaatgacctgtatcacaagatcttagaaattctcctggcagtggggaaatgggccatgagcgcccccatctaacagcccttgtgcatggatttcatccttcagggccagttcccttgtccaaacaccaattacccccaacaaaatccagcttcttcttaagagccctgggtgagggctctggtttctttcggcctctcctggcttttttccttcactcctgtagacacttggagtcaggactaagagaggaatcttctcatctcccctgctttccatctagaatggtttccagtcttgcttttcccactggtacccacccagcctagtctcagcccccagctcagcaagccaaaacgttgagacgccaaggtttgcagccaagagagggttgttttcaggaggaagacaagagaggagatacaaagacaaacctcagaaataaacctctaaggcaggggttgggcaattatgggatgaagactaaagcagtccggcggtcccagcgtggggaggtttggtgggtgtggggcggcgactggaaaaagatgcggtgatggtggtcctcgttctgctgaggcttatccaagctacggcattcacgaggtcaaaacaggg

SEQ ID NO: 59063 - DNA, 1833 bp, Bovine  19866880859285
agtcggacatgactgagtaactagtactactactatgggcacagctaggcctgctccttctgcccgctgatgcgggaggcggccgtctgtgcagcagggggcactggagagggggttcccagagcaaagggagagagggaattgagaggaccaaagcttctcatgcaagctcagaaccagccaaggatcacaccccaaccatgccacctcaccctggcatcaaagggcaggtgaccctgaaaggcacggtgttcttagccctcccagctgcctctcctctgcaactcccctccctccaccgcccctggaaccttccactccaaattcagcgagctacgtaccaccgccagatcctgtgtcctcgtgtctggccctttcattccctcattcggctatccttcattcactccttccacaaagatgtgctggagctctgggttcagggcaaaggatctgaggcacccctcctcagggagttagcatctccataaggaaaatgctaatgggaagggcagactgttgaacacgaagtgattgattacgcaacgattaattacacccatgtgagtgccttgcctgagactttctgggtgatgagggcaaacaatagggaactaacccagaagatgcctctaagggtatgaaggcaggccgggcagaggaagcatgtgtatgcggccaggagcggtccagagctcccagcatgtggacgcaaggaggaaggtggtcccaggaggctctctggatggtccatgtgtcttctgagaccacagtcaggaactggtgggatggagagatgaagtgcacttaatgggaccccaccctcagttttcccatctttggcgtgaccgggctcagctttctcacatgtctctctgggacttccaaggtggtccagtgcttaagagtctgcctgccagtgtggagacccaggttcgatccctgatctgggaaggtcccacatgccgtcaactaagcccatgcactgccgcagctaccaaagcccatgcacctgccgcagctaccaaagcccacgtgcctagagcccgtgccccgtaacaagagaagccactggaatgagaagctcacgcactgcaactagagaggagctcctgctcgctgcagccggagaaagactgcacagcactgaagacccagcacagtcaaaaataaacaaagaaaggttaaaaaaaaatgtaagtgcctttccccaagaaaatattgtgattctacacaattcatggaggaggctccaagtgccttggggagttatcccaggttttcctacagtgacgacaaaatagcagccattgctgcccgtcagttgggtgaaaatatggccacatgtatgaaattgatttactaccagagaaaggggcattaatccagctgcaaattctctctgctgggacacgaggcggtaaatttcagctagccggcagcagctccgatacagcatgaaatatggtgcttgtgttgtgtgtgtgtgtttaataaagggaactctttttcagattcttaattgacaatcacattttcccatctgaaaaccagagcagatgatgagatcataaaatcgtgaggcaaaaaaaaaaaaaaaaaaatgccttttccctgctcttgttgacacttcaacacacggagtttattgagtgagccttttgtctgtagtcgggacattcttgtgtttctgaatatcaaaagggaattaaaccatccagaataatttattgaacacatattaaatgcaagttggcttttaagaacaataatagcttgtagtattattccttgttattattgtcattaacatttattgaataatcaccatga

SEQ ID NO: 59064 - DNA, 2166 bp, Bovine  19866880129645
ctcatctttgcatgaaatgttcctttggtatctctgattttcttgaagagatctgtagttcttcccattctgttgttttcctctatttctttgcattgatcgctgaagaaggctttcttatctcttcttgctattctttggaactctgcattcagatgtttatatcgttccttttctcctttgctttttgcttctcttcttttcacagctatttgtaaggcctccccagacagccattttgcttttttgcatttcttttccatggggatggtcttgatccctgtctcctgtacaatgtcacaaacctcattccatagttcatcaggcactctatctatctgatctaggcccttaaatctatttctcacttccactgtataatcataagggatttgatttaggtcatacctgaatggtctattggttttgcctactttcttcaatttaagtctgaatttggcaataaggagttcatggtctgagccacagtcagctcctggttatggtgaaagtaattcccctaaacccccagtttccagatcttgcttctttcactgtttgttcctctgctacttcaggtcttgtgatttctctctctgctataattttactgcccagtaaatcttgttcccgtcaatggttttatctcccctgccagacactgagacattcatggatcacatcacacacccagtttcatcacggaattggccttaatcaccccctgccggaacctaacacggtgccaggcacatggtaggcgttcatggtctttctcaccatctcctggcaccatccttcttgacctgaaagctgttgttgttgttttaagtcatgtttgactctttacgaccccatggaccacagcataccaggcttccctgtcctccactatctcgcagagtttgctcaggtacatgtccatggagttggtgatgctatctaaaagctataccttggccctttcctcactcagattatgtccttcttaccaactttcctcagttggtgaaaagctgctattgattcattctcacattaggcaggaaaagagagtgctgaatcccctacatgcttatggcttatcacatgtcctttctttttcgccagaggtaatctagtctatgtcaccatatttattgcccgaaaatcaaaaccagttgctagagtaatgaaggtctattggtttgtgtcggcttaatccatgtcaggggggctttaggggcgtataaggataatttgaccagcaaaaggaaagccataaaaatgatcaaaaagctaacagatatgctgagaacaccaagcttattttgctgaggatttatggccaacttatcagaaaactatttggtccaagtcgacattcaaatcgctccctctgtaattcagcaaagattccagcctccggaaaaaaaaaaaaaagaaaagcagcctctataatgagataccctggaaacccctaacttgcagcacatggagtttaattttcaacagttgtgagatggcagtaaacccagctttggaataaccagctccactgatgcctcagacctgcaataaattaatggagtgcggagacggactgccacgcctcctctgacatacccacatccgcgtttattcatcaaatggagcttaaatgtccgacctccctcagatggcactggagccagggcctgcggggtcccggcagaagtgggtgccaagtcactgggctctgccacacgaggtcagctgtgccccgggcccagccctggaggctgtattttattgaccagactctagttggcttccccttgtgtaggtgataaagagtggcatcaagtcacccgtgtgaaacacatcactttaactctgacagcttgtcattgaaggccttgtttatataatctattgtgccatttactctattcttattttaaaaagcaaacatagaaataaaaaccctaccttccagtgtttcgtggatggatgtcctgtaccttctcttaaataatctcagaagtagctatttctattgtcactgtcagtttacatcaactgatcagactttcagtttcagagttggcctcgcagaagatgaaagctggattgtgcgctttaatgagaagtctttcagggcatagcttctcccttcgaaatcgtttgagaattgctatgtctaaa

SEQ ID NO: 59065 - DNA, 1810 bp, Bovine  19866880522344
gcatgagttgtgtgtctttggtcacttagtcttgtctgactctttgtgatcccctggattgtagcccaccatgctcctctgtccatggaattcccaggcaagaatgctagagtgggttgacatttccttctccaggggatgttcctgatccaggggcgggactctggtctcctgcattgcagacatgtctttactgactgtgccaccagggaagcccttatgtgtgagttaatccccatcaatctcttaagtgttcaggcctgcatggggcaagaacaggaagctcctaagctctatatacctcctggaaaccatgctgagcccactcacttttttcagtgactcctgtcacaagggcagtgctgtaaaaacatgcaccttgaactgagagagcttggtctcacaaaacttctgcaaatatctgaactcaagaatcatacatatatgaatgtgaagagttgcttatatgtagagaaaagaatatcattaggaacataatttccctgtgacactttcaaatgtcccataaagtcaacttgaatttaccaacaatgactttttcctagcatgcttttttttctatttttccttttccttttactgttcccacagcctttggttttgagaacaaaaagcatcgatctgaaggaaacaaaggttcccatgataattaagtggaaagggaatagaagtgagaaacagagtggatctcatgtctgctggctgatttattttagaacctgtacaagtgatcttgtgtttatttttaagcctgtgtacatggataaaatataaatgtggtctacatttaaaatcctaaatgatgtcctatatgttaacaagagataacatagaaagactacaaggctgaagttattttcttgattttgacagtctttaattataatagtatacctaacagaaattatgtgtaatataaaaatccatccacattttttttctgacagagtgatcacaaaatgtgtgatgtttaaaataactgatcttcattttgtgttttttcttacacgtggtactggaagcaaaacacttaagaggaatctagacaatccaaatgtttgaacttccaagtgattttgccagaatctttgagtttcaattttttttttctctcactcctgctgagaaagtacacacattttgaaagttagtttattagagtgcttttcccccctttaagctgatgataaacatatgggagtgggattgaattagagacaagctgttggtttctattgaatattcaaaaaatgtaagttatcaaaaaatttttaactatccagtgattggccaaagtttattagaagttcagtaaatggatataaaatcatcctgatgtggagcttataggaagaaacatggttggtgtttatttcataattggggctatgactatttggcttagcacttagagttataaagttatggtattcaaggaaaagaattaaccagaaagggatgctgaaattcacacagtggcagcaagaatattattattattttttacaccattttttgggttatctcttggtttgttatttttggaaccacatatctagaaaaatataaaatgtgttctatatattatatatataaaatagaaataatatatctataagaaaatgacacatagtataatatataatggtatatatatattatatatacatgctatataataattataattatgtaatagtataattataatataacatatatacatgtacataggtatacatgtgtatatgtatacatatataggatattataattattattctattat

SEQ ID NO: 59066 - DNA, 1759 bp, Bovine  19866880669280
aaaatgtcatattttaaaatgtggacagcttagtattaaatatgaatataaacatatgcacacacacacacacacacagtttatagattttcaagttcaggtaaagcccagttggtcagaatagagcagtgttccaacagaacacgcctatacaagaatagaagattttttaaaaaatcattgttaactttatttgtcactctttatagacattggtccatttttacataaagtagggagtatctacttacacttaactttctatagaatgattttgtaccgtaaaccagagtaacttacacaagggagaaaatgactgcaatcatgccccaggatgtcccccaaatgtttttgtgtatgtgattacaagtgtctataactccacaaagctaattccttcttatatcaatgtagtatgttcagtatccacacttgaccattcagatcaccaaactttcagaagagattaaaataatagctattatctctcaatcagatgcaattccagatctgagtgactgtgtaagcacattcatagttaatagctgctcaaagttaaaaaccttttcctgtttcagagatatttacattaagacatttagaaatggttcatagtatataacagcccaaatatcacttttaacctgtcctgtgtaaggaagttaaacatttcaaattcagcacattttgccaaaatgaataacacaaactattctaaatgttatttattacagtgcatattttaaatagtaaatggaatgaaactatattaaatggttatatcatcatatttgagcatattatggaatctatatcacaagggtcacctcacatcaatactatataattcactctaaaagaacaggcacacacaaaagagaacaaaatttgattttttataaatttaaagtgtactatctagtttaaggagaaggcaatggcactccaatccactactcttgcctgcaaaatcccatggacggaggagcctggtagcccatggggtcgctagagtcggacacaactgagcgactttactttcatgtttcactttcatgcattggagaaggaaatggcaacccactccagtgttcttgcctggagaatcccagggacggcggaacctggtgggctgccgtctatggggtcgcacagagtcggacatgactgaagcaacttagcagcagcaatctagtttaaactacactaaaagatttattttaatgaaacagtcaattctaaaccttctttttttctaagtttggcataaggaaagttcaatccattcaaatgacaaataggtttgtcatcctataaatgatgctatcattttcaggatccatgttccacatattgtaacaggtgacaatcagagtcaaggccaagccgatcattatccaaagtacgaggctgaaaaccactggatattcaaaattatatttataggcaagattatagggagttaaggggtcctttacttgttttgtctcaaggatagtctttgtcttcctcataagggatatgtcaaatgatctgacagtcaccaactctaccactgcgttcccaccatagagattgtacatgacatctgcatacttttgcagagcatcagcaaggatcttagaggcatctctaaattgttcagtcttccccataatttttaccaatttcttccagacctggcaactccagtgagtataaatcaggagaatgatccttggctagatgcttatgtcgggacaacaaacttgaaatatta

SEQ ID NO: 59067 - DNA, 830 bp, Bovine  19866880793406
cgacaaaaagatggcagcccctgctacccagcctgcattctactgtcacaggactgagagccagcatgaagctggcgagagtccagcacttgtggctcaagggctgtataaaacttctctggttggcccttcacaggaaacagagcagcattctcaaagaaaggctgcagtcacaattcaaaaagctttccgtaaaatggttacaagaagattggaaaaacagaggcgtgctgccgtgcgaattcagtccttccttcagatggccgtatatcgcagaagattccttcagcagaaaagggcggccctcacgttacagcggtgcttcaggacacagcaaagcagaaaacagttcttactgtacagagaagcagcagtgggtttgcagaatccccacagaacctctctgcctgcaaaacatcaaagagaactgtacttacaaataaggagcagtgtaatcattattcaagctagagtgaaaggatttatacagaaaaggaagtttcgggaacttaaagatagcaccataaaaatccaggtatttatgtatttaagtataaagctttcattcatcctttgaccaatatttcatagaattttcaatttgagctgtagcaggttataaagaataagagttagtttatgtaaccatttcatttaccttccaaaatggaagatttttgaagttgggtaaaaggtgccgataattgtctacccaagacagcacagaacaagattgttctggacatgatcaccctaaagttaagttatgactgcatagttaaaagtgaagactttgagaccataggttgcagcggcaaccttacatgttt

SEQ ID NO: 59068 - DNA, 1051 bp, Bovine  19866881420842
cggggcagtctttaaggtatattttttttgacctcaacaacacacacatttgcatcatgtgttagagttagtgggagagaaacatgaatccagaagtatttctaagaaagaaaaatatcacatttcccatttttcagagacaaatttccctagttaaagtcttggctcataaagtgtccttgactttgacctcaagggtaatttttcttttttattttgactctggccagacctatactaaagcacagattttcctctgggaactgagacgagaaagcggacaagaaacacacttcgcatcgtctcactgttgtccggcccggaagggtctcccgtaaagctctgctgcgactcaccgttcccccgtaaaacctggcccgcaggcacatttcatttctccctggaacgccgtgcagttgcccccgttgtagcaagtgaggttggccttctcattcccacagacggtggagggtaatcggaggtatctagggagaaaaaagcaacagtcactgcggttcatcttgttcattccgttcaagaacacttttttagaaaagtccgcgtatcttgtccttgccaaactaatgaggtgctcaggcggactgagctacagatgcttaactgtgctgttttgtacaccaatcactcttcggtccacaggtcctgctggagggcgctgtaaggagcgtggctatccatcttccatttctacccagtgctcattcatgagataagatctgtgccggggggttggcaataaatttagtgtagaaactcgctatggctagattagctgctgcttggctaataaatcacatcaggccataggaaaattgcatctctataatcgtcaggaaagaaaggccaggactgtagtacccaagcattcgtgtgatttctccgctgcctctcacagccgaactccggttgccccgccaacacttgctgccctcatccaataattcatgacttagcagaaggcaagccaaatgctgtccaggaggtttgtatacagcactcagtggaaagtacatgtgaattcagagtgtgg

SEQ ID NO: 59069 - DNA, 786 bp, Bovine  19866881481965
actgtggaagacccgccggagccgggcctggggcggcgcctgtccacgtgtgttccctgggagaaagaagggaaagaagctccagagaccgcagaggggtctgggctgcttcaggaggtggtgtccttgtgtcacatcacgtctgctttccaacaagacctgcacgtctcaggagggagggcgagcggaaaccaagcttagtcagtgaacgaagtgcctgttgcaggcacccagccttccacggagacattcaggagcccaccaccccgtgtcgtaaacaagcagtggtcggaaaggcgactcttcctgctgtctgaagttgtttttcatttgggacacttactgtccgcgctttcgtctcatgctatgtcgatgatccattgattttttaaacgtaaagctaattctcctcttgtgctcttcagtcaggtacgagtttgtatgtatgtatgttgcaagtatatattgaacatccgatttcccagtgtttggtgcttaacgccacttatttaaattaagtatgcatctaacccgcacacataaccaggagctactgtactaagctggttgagcatgacctggccaagatatcaaaacctatcagaactagcttgaaactgttgacccactaattgccttaatcttaagcctatattaagcatacttaacctaatttatgggatttccatgtaaattctgaaagataagttatgtgttctgcagagcaataatgcctttttcaattcatcaaatcaaggacagaattcatttttttcaaagtttaaa

SEQ ID NO: 59070 - DNA, 733 bp, Bovine  19866881535785
tttatttagttccgattttcttaaatgcaatttcactgttcttggataaggaaagatatattattaatacttagttattttttctttcagatgcatgtatcatatctgaagatagaatgaacaaaaataacatacagttaaaatggagaaaccccccaaaaagatatgctaaaacaggggattttattgaatttgagtgtaaacattcacataaagagagaacacccatacaatcttttcgagtcctctgtcaggaagggaaatttgaatatcccgcatgtgaatgaaacaagcacaacttccctggatgtacgcttaaaagtaatcttagaggtgggctgttagtatttgttatgtagtcactgctacagttattttctttatactttcagggatggtttatcacagttttaattagaactctggattttcagaggttcttaaatttgtaagctgagtagccaaggcttctttcatagcaggaccatgcgtatccgagtcctgagtccccctctcctgtaacacacgcagaaacatgcccgccttcagcgcttagttccacacaccctcttctcgttgaaatttacagcttcaaggctttctgagtcaactttatttcagaggaagtggtgttgttaggataatctctttccttacattattataatttcataaaaacacaaacactgtcaccccttatgtttgtagcaagcattagtaagtatttataaat

SEQ ID NO: 59071 - DNA, 1971 bp, Bovine  19866881734601
cctttagaatgaaataggttataaacaatgctagagatagaggagaaatttccagatcaaagaattccacatcagggaaggggctggttgaattttcttgagcctggctttctgcagagactgaaccttaattccagggttgggactacggtgggaggtggggaagggacgtggcaggagatgcatctttattcgggaagtagccaaaatggcccacacgtggtgggtaatcaataggaatcttgaataatggatgaatgaacaagaaaacctgtattcccgtttaagcctggctgtgaagctctcactctcacctcttttgataaaatcaagtggagcaaatcagagggtaaattgctcactttgatatacatgatgagaggatcacacgggacagttcaagaagtagatgtgccctttaagacgtttcttttctctgcattcctgtagcctctaaaaaattaggcattctctctctcctacctagctatctctgtagacaggttttaaattctaaattgaggcaaattgactgtaatggcaaaagcacaattgtgtggtaagacagacagaggtttaaattttggttctgctgtttcccatacctgtggtcttaggatgcgtgtcattagcctgcctcctcatttctgagggagaccagacccgcagagcaagggctttggaacctgggtttaaaccctgatgctgccacttacagacagtatgagttgtattaagacacttaacacctctgtgccttagctctcatttttataaaagtgatgcccaccccacagttttattggtgatatttagttaatacacataaaatgcccagcagtacttgtaagagcgagagtgttgtcagccaattcatattgttgttattatcatgagaggtaaaaaggataacatacataaagttctttataaaaattataataaagtaattatctactcagtattatttgtttttcctttcagtgcagagttcaaagcatagatgccttggtccccttctactgacaagcacaatgccaccacatggcgagtgcctggtaagtgcttgcatgcttaataaatgagtcagtgcaaggaaaatgagagtgtatgtctatcctggaaagagttgttagtttctgagttctgggaagtacaagtgtactgtcatcacacatccctgaggacctttccttgcgatcaggagggagctaacccaactgcaaatttagcgcccttagctcacaggcaaactctgcagcacgactccctgctgagcagactgcactagagctcgctggcatcacctgcatctcacctgctctagagtgtccgtggactcaccaaggacttttcccacaaagatattttaaatcccctgggtatgggtgccatcttgctaggtgccttttacgtacaatttccgatcgttaacattggcacacgtgagatcggggcctgcttctccaaagcttccttttgctctcaaagcttccccgtgagaacagaagcctctgggtcctcatctacacagcctacacacctgagcacaggtctggatggggtcagcgtgagggaccaatggatcacacacgcgaaccccagaggaggggccctgccctttgtcatccttaaacataactaaagaatgaaactgtgaaggtcatttttactaagtgtcaatcactgacgattgcaatgagaatctaattatgtccctttgacattaaaatcatctaaagctaatcaggcctgggcactctgaccttattataatccatgtacactttaataaggataggcttgtaaatgaccccttttatttaaagggatacttacattttactaggtccttgcctctagcgaattgaaattccacagtaaagctaaaaatgttctaacgaagagaaaaataaaagttattttttccccactccttcagttcagttcagagctcagttgtgtccggct

SEQ ID NO: 59072 - DNA, 1192 bp, Bovine  19866881870185
gtgcttcttgaaatatgtagtggagaatcccacagaaatgcatgaggaacctgacactggcaggatttcttcttagttttccttttcctgcaattccaccattaatattggatagtttatatactgtagactttacatctagtgtccacaagtatgtctaaagagtgttcaagtaacttaaagtcacatgtattcagtaacttaaaggtcacatgtattcagtgttcaagtaacttaaagtcacatgtatatttcagtcacacatatcaaatcatatgaatcaaagttaaactgttcaaatgcttttctcaaatgatattttttcaaaaagttttcatagtgtttctgtggaataaaagcattgctataatttatacacccagattgagtatctggtttgcatatttatttagcatgtctggattatgaacatgctttatgagcatacatagactgcaatatgctagttcaagaagagtaacagaattagtaaacacgagtctgctgtaaacactattcttttttcattgtttaagaatgctaaaataaattatataacaaataaaagatcattcagtgaaataagtttctgcattagctggatttttcagttataagacagacaatgtaaccataatttatgcaatatttctacagtagggaaagtaaaatcatgtgctcatcctcctcaacttctcaatgggaaaggaaaagaaatgcacaaagaagaatatgcacacaatgaggtcatggaatatgcttgcaaccccagatttctgatgaagggttctcataaaattcagtgtgttgatggagaatggacagctttacctgtgtgtattggtaatatatttaaaaatagcaatatttcaaggtaaatcattactcttatttgtattcatatacacatttaaataatattttaaagaagaacatgtttttgtgcattttcagaggaggagcgtacatgtggagatatacctgaccttgatcacggcgatatcaagccttttgtccctccctatcaccatggagactcagtagagttcagttgcagagaagcatttacaatcattggacccagatttatcacgtgtattagtggagagcggacccagcctcctcagtgcattggtcagaatacacatctcaaattgaccctttagtatttgcagccatactgttgaaattt

SEQ ID NO: 59073 - DNA, 701 bp, Bovine  19866880576169
cagaaataggagacttggtaagttctcacccttgtgatgaatttactgtgaagctgctggtgtttaccctccagggcccctcactgggagtaccctctacataattgatattcacaattttatattctttttcttagagaaagcccctcaaatgacataaggtagccctgcaaaacatggatccaccttgacaacttaatattttaccgcaaaagataattacacttagaaaacaagtagacaactgcttaagatggtataaaaatgaaactctaacactttctacagaagttcagagaaacatatcctacttattttgcttcctccgcagactttggatttgtccatatatatacaaacttcacgaatatttcttcctcactctatttcctactcactcatatcctatggccaaatgtcaatctctgattttaaccaaaatgcagattctgtgaaacattgggatcttaaactggttgttggggattttaacgtctgtaatttggaggtaagcaactaagttgcataaatttaccttttctgaagataagctggataaactgttttcttattagtaaattgtggtcaacttgtttatgggtctctggtggtctgctttgttttttctaaaaatgatttctcttggattcttaatagcagattacttatcctttggaaattaacacgagaagttattatag

SEQ ID NO: 59074 - DNA, 1246 bp, Bovine  19866880654003
taggcttttaaatcctttgttagagtaggtgctgctttctgtctcatttgagtttcagattattataggtagtcttgcttctggttggtcataggtaaaatctcagacagagttaagaaagactccagtgtctgaagccaggaaaacacctgtaactcaaaccccaagtcaagcaagtaactcccagttcatccccattcatcaccctggagccttccctcctcttcccagccggccaggtaaatacatgttttgcaatgtcttctgctgaattccgtctgtgtaggagtttctgttcacctgctgagaaattctagactctgcgggacatgactaaatccttaatatcaaaaggtataaggagttctctttcccctaaggtttcaatgatttttgagccatttgcctgtagtttatgcccaagtgcgtgctcgttgttatgtaggagtgcctgtcattaaacatggcatccgagaaacctttaggacactccagttgcctcagtggatagaagtagcaggcagtaatctgtatttaattcttgaaatcgggttaaaggttgacacttgcatcttacttgatgcttgatgcctgtctttcgtgatttattagaaaacctcttctccaccccagccccagatgactaatttttgtctttcgtttgctaagtttccttagaactaaaacgatgttcttctgttttgaagggttcccgcccccaacatatgttatcccccctcctgtggcattttctatgggctcaggttacaccttcccagctggtgtttctgtcccaggaacctttcttcagcctacagctcactctccaccaggaaaccaggtgcaagctgggaaacagtcccacattccttacagccagcaacggccctccggaccagggccagtgacccagggacctcagcagcctcagccaccttcccagcagcccctcccacctctgccagctccgccagcagcacagactgcaggccagctgcaggttcaagctctagctcagcagcaacagtcccctacaaaagctgtgccggctttggggaaaagtcctcctcaccactctggattccagcaggtgagttagttgtgtgtgcttccagctgaggtgaggagaggagcacctggaatcattcagtgtcaagttcattcaaaatactagttaatccacctccctcagtcaaatagagagctaatgggaagttgctttatgacacagggagctcaacctggg

SEQ ID NO: 59075 - DNA, 931 bp, Bovine  19866880675320
caggggcctccctctcacagaaggcagagcctcccaaggaggggctctggcaccaccacaggtaaagaaaccaacagacgttgcccacatcccaagaccggctcctattttagatcagaacaaaggctctgagctcagaatttgatgctcacagccagaaggagaaaaaaacccagcatgttcacttaaacagtaagatattacgcttttatccagaatggaatatgcattcatgtatattttcatcttcggaacaggtggtttgaaatgcaaataaagtaataagtgtcagagccgtatcctagcagtagctactttgcaaacgttaccatggcaccaattcaacagtgtttttagacccagccacacctcggcaaggtctttctaactcgcgacagccaagttcaaaggaactaacggacgcaaactgcaaaaagagttccgaaccgatacaggaggtgaatcttaacaacacagttggcctctgaaacgactacttgaaacagggcatgagattgaagggggaaagagaggaaatggaccaactcctagaacacctggaatgtgatccgagcgtggagacaaaatgatggtaattataactgctaacacttgtttttagctgctaacagattgcgcacagattgggaagggcagactccattttccaactactccggtgcaaactgtgctttaccactactcactaaatcctggctcagtgaagggaaagcagactgtcctcgtgtatggatcatcggtgttaaactaaggaaggctatcctcccacagccgtagcccagggggccactcacaaggagtggagactgggagctgggttctgcagctctccacttcctaccgccaggagatctgctcagctgagggcggcatgcatttatttctcaagtgcggacaaagcagaaggaag

SEQ ID NO: 59076 - DNA, 2632 bp, Bovine  19866880781830
atgaaattattgacacaagctcccctccagtccgctcttcccgccagactttcttgtctcatgaagccagggcgctggtctatcaggcctcacacacaacccgtggaggtgtccgtgcctcctctgtctcacatgccgcaccctctgcatctgtacatcctgtcagcaacacctttgagggctctgtaggcggttactactacccgttgttactcccacgacaaggacgactgctgttattactcaagcccgtgctgcctgagcccatgaaagggtcctacccaggctcctccctgccactcttgccccgtccccagtgtcatggtctattttccacacagagccagagtaggtcttttaaatataaggcaggccacagcactatgcttctaaaaccttataagtctttcttatattccttagaataaaattcaacatgcttccccaggccctcaagtccacatgtgacaaggggccccgcgaccctccggatgtcctgccccagcacttgtcacttccttcatgtggcggcagcctcatccacctctctactttttcttgaacactgttcccgccacagggcctcttccatagtctccctttccagacactcacaaggccctgtctgcaccatattcaggtttctgctccaacgtgtctggatcagacaagaaagcccttttctgacaccctatgtgactcaaactccattggaatctagccctcttgccctacttcattcatttctgtgtggattctctctctctctactaaaacataaccttcgtaagagctgggacttacttattttgttatagctgcatcccttagcacagggcctggcaaacagtgggtgatcaatacatttttactggatgaataaatgaatatcattttagatggtcaaaaaataattctatgactttatgcattatggaaaaaaagcatgacaacattccaaaagaattttaaaactctactaaattatagtcttttaagataataagtcctgacagagagcttgtaatgcagaggagaggcacactcacttcctgatcacggtcttggactctgatgaactttgacctccatcttcttcacagtttgggcttgtcaggttcccatacctttacagataaaaacaaacacacaaatatgtaaacaaaacacacagctggtagtgctggaaagcaattctattccatctcaattacaaggtaacagttacacttttcaggagtatttaaggaaagtaacacttgtgaaatagcatccaaaaatgatactgtattttttatatttatttaatgtgtatatatgtgtatatataccttttccatatatatatgtgcagaatttgtatctgcatgcatatatacacacacattattttactcctacagaaaagtgatttaatgatgaatcacactacttacaactttctcaaacattctcaactactcaacatttctttgactattttagatgaacttgggcttttccccttagcaggagaatcagtcattacatgaggcacagatcggagattcctcctgagttctggagcatcaacccctaacctctgcccctctgtgtatccactgaaggaacatgtggctttgcttgctcagccttcatgcctgcaccacatgtgagcacaagctgatcactccatgctctgcttatgagtctggtctccttgaggataagttctattgaagaagcattacgggaatgattctgaaccctcaggttaggctgagatagagacaaggactgcagaacagaatcctcatgtctcaacaaccatgagagcagcagtgtatacagtgaggctggtctaggcttccccagccactgggggagggggacataggggcacaaagcaaccggtgcttaaactttaaaatccctctcattaaaaaaaaataaaataaaatctctctcattacagactcaaaacttgctcaataattgatcagtcctagtcacactgttaggtgtccttccaactccataggtaatgcaagtctatttcatatagaaataccatgtttcatttggctcagaatatacatttagtaaattcacttcaaattcttaaggagtagcctatgttattcacttagaacacctagactatttctgcagtttctcttcccatcagtggagcattcagagattccttgtagtttcacaagctggcaatctgtcccaaagttttggtaacagaaattctaaaactggcagggtttacatttttaaagagcacatttttgtcttctactaatgggattaagggccccaggacccttatggttccttgttctgaggatttacaagtcctttaaaacataaaagcccgccatctggtttgaccgaatgccagtccatctggtctccccactgccctatcccgggaggttccagtgtacgcccttaggctttagcctccccctgcctcccttccacctgctcctttctcgagctcatcagccttatggacttcttggcctcccaaagatattttccactggcctccgccctccctgttcctcttcattctacacctgctatttagaggcttccagggctaccctttgctttccctgagataagaaccaggcagatt

SEQ ID NO: 59077 - DNA, 2142 bp, Bovine  19866880795597
atgcagataaataagaagatcacccatgttcctaattcatgttccaaaagaagagaaaagagaagccaagaatatttttaaaaataatgaacaaactaaaatacttcaaccaatacagagagagacagagatggagagagagaacaaaagcgataccaaggagcacaaagcaaatgacgtaaaatgacgtaaacattaacaataggtgaatctggataaagggtctaggagagctccttgttactatctttagttatgcagcttttttctaagtttgaaactatttccaaataaagtatgtattaaattttttatgaaattacggctattttccagaattaatgggaagcaaaaattagcaaatttgagtttcaagcaggataagtaaaattaaatctataccttaaatacatcacactggaaactataaaatatgaaaggcaaagaaagtgttttaaaagttatcaaagaaaagataaattacctataaagaacaaatcaaagccacaatgagacattgtctcacacctgttagaatggttgctattgaaaagacaaagaatagcaagtgttggagagaatatgaagaaaagggaagcctacagtattggtaggactataaattggtgaggccaccatggaaaacagtatgcaggtccctcaaagaactagaactattatataactcagccattccattctgggtatctaaagagcaccaaaaagctaattcaaaaaggtatatgcacccctatgttcagtgtaggtttatatataatagccaggatatgggaacaacctaaatatctataaatgaataaatggataaagaagatgtagcatatatacacattagaatataactcagtcataaaaaagaatgaaattctgccacttgtgacaacatgaatggaccttgaaggtattatactaagtgaagtaagtcaaatacgatttcaattctatgtgaaacccaaaaacccaaaacaaatgaacaaacaaaataaaataaaaacaaactcaggttgtatgacaaatgcatctcaagtttctaagaactgccaaactgttgtccagagtggtttgttacctgatattcccactggcaacacatgagcattccagttatgccacattcttgccaacacttgatactgtcagtgaaaggaaatgtttaacatatcaatttagaaagacacgtttcttttttaaaaaatatttgtttgtttatttggctgtataaggtcttagtggtggcatacaggatctttgttgcatcatgtggagccttttactgatagaagattagcccactagagatcagattagtggttaccagaggggaaggagcttggggggtggatggaagaaatgggtgaaagacgtcaactgcgaatggtaatggatagtaaatagacctgtgatagtgatcatttcatagtgtatatacactatgtcgagttacaattctatatacctgaaacttatacaacaatcaaaacaatattataaagacaagtatattgataatgaaacaacaattagactcgataggtttctcaacagcaaccacttggagcattttcagagctcaccttatcttctactgagtctaagatcataatactttttctcagctgccacatactctgtcctaattgagggagaagactgaactgagctcagcactatcaatgacttcatttggaagagaccaggacaacagcagatggaagcagtggtatcaaatttcttgctaattatggtgcccttggaaattcattgggcattaactatccagatgaagaaacagaagtactacagaatctcatccactattcattcccttcttgtccaaggacaagcttaaaagaaactcgtttttctacaggacttccctgatagtccagtggttaataattctccttgcaacgcaggggacctcaagttcagtccctggtcggggaactaagatcccacgtgctatggagcagctaagcatgtgcactgcgactaccgagcccatgagctctcgagcttgtgtgcctccaccagagcccatgagccacaataaaaggctccacatgatgcaacaaagatcctgtgagccaccactaagaccttacacagccaaataaacaa

SEQ ID NO: 59078 - DNA, 1765 bp, Bovine  19866880832037
atgaattgtttcttgaagatgtcttcagaattgccttatgggtggagttactttctaagaagcagggtggtttcttaaggaccttggagccaggctgtgttagacaagggatctctttgacctttagatcctccacccaccatgtcctgttgaaatcagaagaggctgtactctcctgtagcctcacaccatcctcttccctcttcacggagagaagtcctgtccttacagtatgcaagatgcacagtcaccaggactgtgtcttgggctgggttctaaataaaggacacttaaagccatagggacaggagggagaaaaggctccaaatgcgattacttgggtcttgtgtttattctgacagttgtaaaaattctttggggctgacccatttttcctttcttaattaaaaaaaaaaaatctggcaggcaagaggaagaaatgtaaaacatgtgactaatacttcagctttttctcctggagccagattctttaaaattataccttagatatgcttgatgttttgaaaacgattgcccacaaaagccaccaaacatttgtttctgaaacttgtaggcttagatggcattcattttcagtaaagagtccaaaagcacaatatttaggagttactgaactgaaatctttggagatttcgctctggtgaatcagattaccccaggaactggcagagggccaggcagcctttcgcctcttgcctgagtatttccagccctgttggtagttacccagagtctgtgagggagttagactaaacgacctccaagatccctcgtagatggaaagtatatgatcgcagtgcggtgacgtactgaattggcaagcaggagctgtgtgtatgtgaacctcttattgttctgtagccatcacaaatagttcatcctttcattccttcactggttcactcaaacttgagcccctactatgtgcctggtattgttcttggtctctctaggaagctcatggaattttcaagcacttgtcacagtagatttgaaggtctctgaagttcagttccaatctctctcgtgttatttcctgtgtctcacctttacacacaccacgcttaactttactaggctacattcctttctagggccttccccccgtacccccacctccaacttcattgttgactctatctgaaatgccctctttttccctaatctccagttcaaatcccagccattgctcagattccaactcacatgccattccttccacaaatccactttggtttccccagtagtggtaagttatccttttctgagttctgtagcactttgtactgatcttgtgataccacatgtaatcatatcaggttgaacagtatgagataaccctattagtcagttaaaaatggttgaatattgccatgtaaaatggcaattatatggttctttttaatattaggagtgttcatgtatggaacttaaattagatctctttacacatgtactatactcatgattcatgtttagctaagattccttggtctttttattttttgtaatattaaactaaatcacgtttgacttggagaggagatttttaaaactgttttaattgattgattgattagttttgttcgcactgggtctttgttgctgcactcatgcttttttttctaattcccttgtgtgggggctactctttgattcagtgtgagggcttcttactgcagtggcttctcttgttgcagagcatgggctctccggctcgggcttcagtatttgtgggtcaaga

SEQ ID NO: 59079 - DNA, 1097 bp, Bovine  19866880906967
aaaatgatgagtgtagttgagctgttttagagctaattcaggggtattagtattgtcacattttgcctgaacaaaatgaaagggaattgctggaccttgaaatgctaaatttaaaacatgaacatttgacttaaaaacataaccaacagccaatttgttaataatttacctaggactgagcaaaagaatctgatttttaaagctaacttcatggtcaactgaacacatttttttatacccgcagaacagtatcttgaaagaaaaaaaaaaaaaaggcctctgataaaggatccttcctgtttgtcacctgctctctgctttccctcagggctggtaagcagggccctgctgagtctcaggtcctccagctggtacccaggttgctatggagatcctagaattcgaagagagaggttgtctgaagagtccctgcttgggccatggaaacagctcagcaggagcttcagcagatgacacagatttttccagagttaaaatgaaagcccaagggagcaaggattcacctgcctcttttccaggcagagaaaatctactcgtttaagagtttgtctccatttgactttggcgaatgacctcagcttcccttgtgactcagagagtagagaatccacctgtaatatagaagacccaggtttgacccctgggtcgggaagatcccctggagaaggaaatggcaacccagtccagtattcttgcctgggaaatcccatggacagaggagcctggagggctacagtccacgaggtcacaagagtcggacacgactgaagcgactgaacaacaatgtcagaataggtgagatgctctgcggtggtaatttctctttccctcctttttctttctttccttggctgtgtcgggtgttagctgcagcatgtgggatctttgtcgtggcattaagccttctctctgtttgtggcagggagactccagagtgcacaggcttggtagttgtagtgcccagactgagttgcctctgtgacatgtggactcttagctccccatccagggatcaaacccagatcccctgcattggcaggtggattcttaaccactgggaccaccagggaagcccc

SEQ ID NO: 59080 - DNA, 3639 bp, Bovine  19866880941366
catggaattctccagacaagaataccggaatgggttgccatgtccttctccaggggatcttcctgacccagggatcggaatatctcttgcacctcctgcattggcaggtggattctttacaactgagcccctgggaagccctacatgttactgcttttggtcagtttttgagctgctggggacaccttggctgtgctgtcctatcagtggagattattgtccagagggccaacatggctggagaattaggtctggacctgtgaccacccaggggtaagacgaactagctacatataccactacagcaggcctcaacgctcctagccaaactgttcaagcttgtgttttgaggctgtttggaaatgtatgactcaggatgccagaatcaaaccaacactgaagccagacatacctaaaaatgggacagtgtgaaaaaaatctggccaacatgggccttactgctggcaccaaggcctccagatagtactaacttcagtagtggtcaagtaagagactggtaaaggatgaagagacagttttggaatattgtaagttgtactgtgttctgacctgtgcttcatcttacattaaaatgtttttctcccattggaagaaatgaactttgtagttctacctgcctaagctctttcttgctcagtggcttttgtaaaaccacagagggaaatagtttttgcttattatttatgctcccacctactcccaaaaaggatctaagatccccaaacaattttgctaaccctcggccttcattctctcccagaccatctgttccttttcaccatgaagtcatagtactaaatttatgacagtacaatcatttccatggcaacaggatatggtcctcatcaccgaatccttatttcactctgaccaagatcaagcagcaggaagatcaggaagtatatgctcacattttctattctttttcaagttttgtttctctctgaagaagttcttacttttgattctaaaatcttatactcagcctagataatgtttttgcatagcttatatacaaaacattcttccagtaaataatcagatacgtaaaccaaaaaagaagttgagaaaaatcacacaagcctacacacacacacacacacactatgatgtataaactggcttgacagtgagatgactggtaaatacctttctagtttgtacagaagaaaagagaacacagaatccgtttaaaagacatgagactttgaagcctgagaaatctgctttgatgactgtgataagcaatggaaggcagctgacctagttcctactcaatgctttccttatcttgctgagcacaaataaaacatcagagggtcttcccacgtgagctcaggccatctgaccagaggaacacagacagatgttcacctttatttatagagatgactaatatctgggtatttcgtccatttgtgttaaccacactcagcttaattacacaatctttggagagactccctagaataccatttgctacaccgtgaaactgagtgaagggcatgaactctgaaaagagaactagttactggaatatcagaaaatacctgattgggggattaagttagcagtcttacaggacagacagcaaggtatgttataatgaggttctactggacagtccagataacatattaatatataactatatatgtgtaatatgtcatattatataatacacacaacatattaaatatgtgggcttccctggtggctcagatgataaagcatctgcctgcaatgcaggagacccaggtttgattcctgggtcaggaagatcccctgaagaagggaatggccacccactccagtatttttgccatggagaatcccatggacagaggagcctagtgggctacagtccatggtgttgcaaacagtcagacacgactgagcgactaagcacgaagcacagttaaatatgtaccataacatacaccatgtgttatgtgtattatatgtatataagagaagaaaagtgtaacatgtaagaactttcttctcttttctattcttccccagcttccatgtagacagggtaagtgggggaagggagtgggagaatgggtgataagggctagaaagaagagctggaggaaaaggtagagtgatttatattaatctttttttggccactccatgtggcttgtgggatcttagttccatgaccagggattgaacttgggccctttgcagtgaaagcacagagtcccaaccactggactgccaggaaattcccctatattaattctttaaaaggtaaaaaatcacctacagtggaaaagatttggattgaagaggaagtggagagacacagtagacaagtgagagagaagggaagtgactggaaagctgaggagcggtattttgacagcagttcctctgtgatatacgtgctttgggggaaataggaaagcggattaactaagttctgttgtttgttacatgatttaccactttgctacatctccaaaatttcagtgaagacaaacatttttcagagctcattatagatgaattcgtaattcttctgaaatgagataaaatgttcagatggacactaaggctggagtaagccctatcctaattttacaaatatgtacataataagactctcttgaggaaaatgaccagcagggccaccattacagcttttacccttgggaaatatgtcccattgccatatttaccttgggaaatatgttccactgccaagtcatgtcatattcgtagtaggtactgactggccagagatgggtggcattctacaatctggagtttttaactctaatgaaattcaattttagccttaaagaatctaggaacttagatgatcaaacatgaaagagtggggggaaaaggcactatgactgcttcagggaggcctaaggccaagccctaaacctagcctttgaggactgagagaaggcaagaccagactccagagagtgccatgacacccgaaggacaggcctcactgacagtgagatgtcacattcaggcttgctccaatctgacactgatctctctgtcttgttacagatagtgatgggtcggaaaatgcagaatctcctgctgtactcatgcataggattatggcagtgagtggtaaggaaacctttgcaagaaggtcatcatcactcttgatgacatcaacattttctaagcatagacatcataatggagaatatgtaatgattttggggaaggtaaggtaaaacaagatggaagagatcatcaggatagaaatgggaggccaggggaggaataggaaggctcaactattccctactctcctgtataacattagttcacaagatgtgctgtgactttttttttaaggttctgtggaaagctaattttggacattgcctagtttttttgcatgtgaaaggctctgagatgtctcaccaagaaaaaataaaatgttaaactattgtttaacaatagttgcccaaacttatttggtgaggcattgtatgtgccaagttgcttcagtcgtgtcggactgtagcctatgcgaccctatggactgtagcctgccaggctcctctgtccatggtattctccaggcaaggatactggagtgggttgccatgccctcctccaggggat

SEQ ID NO: 59081 - DNA, 906 bp, Bovine  19866880968004
aatgttttttctgctatctattgaaaaatctattcttttttaacattaatattgttgatgtggtatgtcagtcacactgattgatttgtggatgttgagccattcttgtacccttggaataaattccacttgatcatggtgttaatcatctttctatagaaaagaaaggttaagcttgctccttccttcataacacagaaatcactgtgcaataattcccctggcatcttatctgcttcccaacctaaaaacacatctacttgcatattactctaatctttcgaatttttttattcatttattgcataccctaccctcatgagcaaagacattcctcctcttattcaaagcttatttctgtaaatgtgctcaaaacactccatgacctctgtgaaactctccaagtttactatttcttgcttatatattccactcatccatctttacttactccttcctacaattcacaagcatttttttaaatcccttttcaattctatattttcttctaacgatctccatgaatctttctccttcaattcagagaaagcttttaaaaacaacaatatgcatttcatttactccactttccatctctcataagtcgactccctgaaatctggttccagtgccatcgctccatcaaaattattccattacgatctcctatgactttctagataacaaatctaattgatgcttttgagtatttatttttgtgaatttttgcagcatttggcccttccccattcatctttcatgaaattttcttcatcactggcttccatgacactgttcttccctgttctctaatcttctgcagtgccccctcacagactttttcatgggatctgctttcatgtccagttccttaaacactgctgttccccaggggttctgtcttgg

SEQ ID NO: 59082 - DNA, 818 bp, Bovine  19866881022274
tcacagcagcatatgtgaggaaaaaacagtcaatgaaccctataatcctgggctattgacccagaagtgaggtattagaggaccaggttgccttgcctcagaaataacagtactattggccagatatcacagtgcacagtatccaaaaatgggcacacaacatatgtaatgaataagaaggctaaaatctttactattcaactaaatgagagtatgaatgtcaaatcttttcctgttccaaagcaaagcatccatacaagtatttcagaggagaccattttggttttgtattgctgccaaagattctatgagttcacacaaacctaacatggttatgctagatattttatcagtccaagtacaagaaaacaatttcctctttctacaaagggagcaatttagtgcagggaattccttataaaagtgatcaaggaactgagtcctaaacagtttcttacagaagagtgtggtctagagatcagcaacagctggaacgttgcccactgctagactggaggaacaaaaggaggaggggctgccaccagaacccccccacccccgacgaggccacagaaatgtgccggtgaatgtttatcgtagctctctgttggaagaggcttccctggtggctcagatggtaaagaatctgcctgcaatgcaggagacacaggttcgatccctgggtccagaagatcccctggaaaagaaaatggcaacctactccagtattcttgccccagtattcttgcctggagaattccatggacagaggatcctgcagtccatggggtcgcaaagagctggacacaactgagcaa

SEQ ID NO: 59083 - DNA, 1988 bp, Bovine  19866881075080
tgaaaaagttgacttaaagctcaacattcagaaaactaagatcatggcatccagtcttatcacttcatgggaaatagatggggaaacagtggaaacagtggcagactttattttctggggctccaaaatcactgcagatggtgactgtagccatgaaattaaaagacgcttactccttggaagtaaagttatgaccaacctagacagcatattaaaaagcagagacattactttgtcaacaaaggtccatctagtcaaagctatggtttttccaggagtcgtgtatggatgtgagagttggaaagctgagtgccgaagaattgacgctttttgaactgtggtgttggagaagactcttgagagtcccttggactgcaaggagatccaaccagtccatcctaaaggagatcagtcctgagtgtttatatgttgaagctgaaactccattattttggccacctgatgcgaagagctgactcattggaaaagaccctgatactgggaaagattgaaggtgggagaagaaggggatgacagagggtgagatggttggatggcatcactgactcaatggaatcagttttggtaaactccaggagttggtgatggacagggaggccttgcatgctgcagtccatggggtcgcgaagagttggacatgactgagcgactgaactgaactgaagtgacattttagctcagtagtaatagtatgaatcccccaggttgtatagttggttctgatttattagagtccaaagacacagcaagggttttacattttgttcataatgttcttctttgtttcttgctgactatgaaagtatctaatatactgtatggaggttttgagtgtgcttgcatgtaaaaatcaccctatttcttcaaatcattggccataagtaggaggtggctatcctttagcagggactaagaccttgggatctattttatttagtggtagagacttcttggagaaggaatgcttgaatgttctatgggctgtggaccctcattcattgatatttgagagttttatctccagtaggtgggtcttgttagagcattttggaaactttccctgttctagagagcaaatatgatcctttaggatattgcaaataaataatgtcgtggatgtaaagccctcaaagttgaaattttaagtaatgatttttcctttacaaaaatattccttcagtattattgttctcaagcagcaaccaagggcattataatatagaaacattttaaagtaactttattttgcaactattatgtgtttgtacaaaagaaactctcccagttttattattaatatgccctttgtcagtttaagaagtgaacatcagtatctctttatggttatattttgtaccttttcattcctggtgaaaacgtagtacctttttacatgcttattgatctgtagtatttattcttctgtgaaagatgtatgattctttaccactttttgtttgaggtttgtttgcagtaacttatgtatcaagagcattagctgtcatattttttgttaatattttacctgctttatagagccttttaattatgctgatggtatttttaattgaaccaaattttatattttatgtggtctaattaatattatgattttttttttactattgtatttaggaaagacttctgcatcaaagaggagtttaaggattccccatagtttcttctactatgtatgttttttacatttaccactttgtccaggcaacaaaatggataaagcagaaaatttgaaaaggacaaactgaccattgcaacaaagttaatttctcacttttcgaaatttatcacttcaaaagtgtttattccagcctctcctatagaagcagtctgatcaacttctgtcttctcaacccaggtcccctcagtcattgctgtatttgaaacggcctgatctccaggccgaaacctgcagaggtcctttactaatcccttcctgggcagaaaat

SEQ ID NO: 59084 - DNA, 1482 bp, Bovine  19866881078925
atctgcttctttgctacttgcaaactgtcctgtgatttctactctctccctggcatgccaatgggagactttctgagatcaccggtttcctggaatgatatttgaggcacatttaaatgccttatgatattcctgggtttatgtgggcttggtcctacatggattggtggtaggtctctataaggcaccagcacaaatacgacaggaaccctggggtcaagggtcagattgggttgcagctgtccgcttgtcacttgaaaagactgcctaggaaagacactgtttagggggtggccctccaaagctgcctgaacttttacgtccagattctcttctgcctggagaagaatatcggtgaagtacggtttcacccctgttatggcattgatttcatgcgcgttgtgcctgtccgccagagctctcccggttaaaatgggctggaaaacacttgctccctggacaccactcacaaagttgctgaggagagaataccatatcccaccacttatcgggctcaaagtgacctgtggccataaactggccaggctccggagagcttcgcggttccacggcgaggcaggaaattcagcctctgtgtgatagagctgagaaaagtaaacactaagagtgatgtctggatactttgccaggaagttatacattttgctgatgcagcagtggttagcttcattgcacggggagttgctggagtacagaataatatgccggatgcagtcgttattgtgtatggccgagtcaaagtaaccgttcacctcaaataacattgattccgggtgggtatcattcccagtgcagctgctagcatgacccttttgcaccaggcttccagaagaagtttttagctcatagaacgtgaggtgtttcgttggaggatatgttggcccataagggaatccaaaaatctgataaaattctgtgtagggaactcttgcttcttcacctgtccgaatatggtaaggacaattagagcaatcgagagagaaactcagccagtaataaggttttactatcgttccgtgattggccaagtattcctcatataagggctccattgttagttttattgtcttctagctgcaaccctaaacaaagaagagaaatgacatataaaaccagtgcaggaaaaatgaaacacagcgctttaatttgccgagtcatatttttctttagaggaagtagcacaataaccatggtaacatcttttgactctaaaagatagtgctttactgtatacccatagtgaaagttcaagatactaatcctgagaattagacaaatgctgggggaggagacagaagggaaagacacaagaacatctttgtctgtttgatagaatctgaggcagaagaacaaatgggttaacagtgcaagttctagaaacagattgccttatttcaaatctgggctctgccgattaccagctttgttacttttggcaagttatagaacatctgggagcca

SEQ ID NO: 59085 - DNA, 1977 bp, Bovine  19866881126677
gtgatggacagggaggcctggcgtgctgcgattcatggggtcacaaagagtcggacatgactgagccactgaactgaactgaactgaagatgggtatcttctggaactttgtaggtcagtgcacatgcttggttgtgtgagatgtcatccacacactgagagtcacatgttcctttcaggataaggaagaaatttctcaggttccaggatggggctaacactacacatctctaaattgctgatgtatcaagtttatttatttatttggctgtgtcagatcttagttgcagaatgtgagatccacgttgggagcatggagacttagccactggatggtcagggaggtcccaagtttcttagtatttcattgtaagggctattacttactttttcaatggattctgtcgagagttccaaatcaattcttgtccatgtttcaaagtcctggtttggggactgaactctaactttttccgtatcttgtccggctcttctcctcatgattgtgccatcggcactcccctattcccagcgctcccatgagagtgaaaaaatgctcttgttccctgcagtggtgactttgtcccaaggctcttctcctcatgattgtgccatcggcactcccctattcccagcgctcccatgagagtgaaaaaatgctcttgttccctgcagtggtgactttgtcccaacagaggtgcgcagtgacacatttaaattgggcatatggaatcttaaaaatatgtgtatataacaaataggtcattttccttatggaaatttccaaatatgccagagtaaacagcgcatgggcttagctgcttcaaggcatgtaggatctcccccagaccagcgattgaacccatgtcctctgcattggcaggcagattcctatccactgagccaccagggaagcccccaaagtacttgtcacccaacttcagtaattacagatgcattgccagtcttgattcattaatactcctacccctacccctgccctatattcttttgaagcaaatcccaggcatcctattgtttcaaggtgaggtcctttcaactaacgcataattgcttctctgtctatatgatctccgtgtgcagactggagctttctcctcttcatttcttgtttgtttgcttgacaatttcagttgcagacagggctggtatggggacaatgtctaatttccatctttgagcagatataataattctttcatcccagtaaacagtaagtgactctttagcattggcattacttttactgcaagggatttatggcctctccattctttctcacatcatatagggcctccaagtctcccctccagagtggagctcacactgggcacaatgagccattcttccatgacatgcaacattcggctctttattccttgtcattcagaaccatgaatgtctgtgttagatgttccttctcacatcagtggttcccaacctggggactctaaacaaccagggtttctcatagaccagaataaggatctggggactgttttcagtatctcttaagcttataatcaccctcaatatggcacaggctatgtatcgagtttctggacttctgcttgtattaatattattgttagtttggtgagatcatctcataatgatcaagagtcctgcttggtagctagaaatgttttctatgagcaaaaaaaaaaaaaaatagtgattttttttttttttttctcttccatttcttcaatagaggaggaaaataattaaatgcattctgtctggggacaagtttggctcctgctatagcatttgaattctgggcttctatttggtctgcctttaacctctgcagaaacattaaaataaaacccttcttattggtctcttaatccttcccttgtgctgctttaaatcagcttttcaaagtgtattgtcatgcagttgtgttatcatttgcatttaaatgtagtgaataaagatttcccagctgaa

SEQ ID NO: 59086 - DNA, 1411 bp, Bovine  19866881204529
attgatattagttttattcagaaaaggaacacacacttacgttgatttgttcctgactgaaggagatcagaggacatgaacacataggttcatcagtgttactacacaagttcaattctgactggacaagttcagactgggaataatgctatcttttgtgtggccctaatattcaaagctcttggatatacacaacctcatttgattctcacaataagcccagtttatagatgaggacactaaaggctcaagggctaagtaactgctgacccagtcccattcatagtaactgacagaggacagagtccagcccagacccttcagactccaaagctatgttcaaaaagcagtgccacaacggctccagcagctcggacgtccatttgctctttgaaggtcccccatgtgccaccctctgcctcactccacacacgtcaaatagtgacagcgaactccacaccaggttctatgaatgaatcaccaactctcaagtcctgtgctcaacagcaagtcaaaattccccctgtggggtattgggagggaaaagacaccatcacaggcaaattaggacatagctgctccatgtcaccaaaactatttgcacacaaatatttaggcttcaaattaagagagtagaggttacagggctctaggaaattaaaactgacttaatcaaacaaaacataaacttctcttgtcaaagaggtgtaatggtcacattgccagtagtaattgtatgtctggattttcaaaaatgcattctcctctccctatttaaaaaaaaaaaaaaaaactgcaacattcccctttccaggaatgtgatttaacttaatagctaagctaataatcactggctgcttatttggtacaaacaaagaaaccactgtctctccaaggggacacaatggttctgaatgtgatttaagtatctggttgtgagtgaccattatgttatgtaatgaatgaagctgcatgaatacctattacataactccattctgcttgggcactctaattaaagtgaggggacttcccatcactttaaaaagctctcctcagtcacttctataacgtgtaagattaaaaaacttaaattatactaagccacggacacagtgtagccagctgttgcatccaaagtaaatcatgaaagaggggaataagaaaaaaatatgcttctggaagaagcagaaggtacctagggaaaatgtaaaatgtgtatagaagaaggtggactgaactgaagagctatgctttgcagcactgtcttaattgcagagaagtgtattgggttggtcaaaaaagttcattgggtttttccataacatgttacagaaaatcctaacaaactttttggacaacacaatagcttcttccaaatatatatatgtattctgataaacatctagca

SEQ ID NO: 59087 - DNA, 1243 bp, Bovine  19866881297557
attttaagagggcagttgatgaggtcagatttgcatgttttaaagatccctctgatagcaatagagcaagcagaatgaaaggagacaagagtgaagtggagaaaaaaatgtggtggctttgcaatagtccaggcaatggatggttataacttgaatgatagtgactgaaaaagaagtaaagggagaattacagattcaggatgtatttagtaggtagaattctttggcattgataggttatccgggatttgagagaatgttgtcgtggatgacttccaggtgtctgcttttcacaactgggaagccatgatgcatttagtaatgtacaaaactctagaaagagaaaccggagatgagggtggaggtggatcatgagtttgtttcttgaatacagtcaattcttgaagaatttgggaagagagaaaagaagcagcggttagaggagaatatgggatagaagattttaaagtctgtgaaagtgtagggcatgtttaaatattctgtgagaagcatccaacagagggaagtttttaaattgttgaaaaaggggggaggtggtaattaaaggatcagaagtttttacaaagactagaaagagcatacctaagtggaattactggtcttaaataagatatacgcttcctctagtgttttaacaagagtaagaaagaagagggttctgtgaatatagtaagcctttatttagtaagggcgttgttttccctgaggtatggaactgtcctttgctgaaaagaattgagactcgggaagagggcagaaatcagcttgaggaggatggagatttaaaatagttaaagtggctagtgaattgagaaacacagaatttcctggcctcattgacagaaaaattttaatttaataaatgtcacttaaatgttatctttaaatgtattagatttgggagtaaacagtaagaaagtgaaccctacttggtagaagagttcatgatgaccctgtgaacgtctaagcaatgacatccgtttgctaagatcttactattctggatgttaaagcagggtcactgtttgcagtgccacaaatagagctgctatacattctttttttttaatttgcattcttgtcatacaattttacttaacttttagtgttacttacgttgggtaggcctagtttgtttctaattgatgttctttttcccttttttaggcaggcagaagtcctgaaggctgacatgacaggtactgtctgactcatttgtttt

SEQ ID NO: 59088 - DNA, 886 bp, Bovine  19866881347579
ttcccttggtgaatttgcagaaacacccttccgcttttggtgtggtttaaggaaaaggaaccgttttgaaatatactgagcattctgctcctcttaatgaggcttgccctcgagagaagttattttaccagagtttaaactactggggagcataatactagagatcatactagagcatactcaacatggagaaagggaaacacccaactccagccctctctaattatcctttcccatttaagggggaacgatgggggaagaggctgagaagaacttgtgaaattcacagtccaggggtacagacccattaaagactcagacctcatcatgagactatagaatgctttcttttcccaacaccttaccctatatcactaaaggcctatttactgcagttccttttacccaatacatcatgtcctgctaacaaaaaaaaaacttcaagactatcaaatagcaaaaaaaaaaaaaaaaaatacacctgccttgaagagacagaacacacatcaaaaccagactcagagatggcagagatgatggaattatcaggctgggaatttaagacaactatgattaatatgctaaaggttctaatggatgaagtagatactgtgcaagaacagatgactaatgtaaacagatgggtggttacaagaatgagtcagaaaaaaacacccagagatcaaaaacactgtaacagaaatgaagattgccattagtgcattgactacatgaaagcctttgactgtgtgaatcacaacaaactgtggaaaattcttagagatgggaacaccaaaccaccttatctatctcctgagaaacctgtatgcaactcaagaagcaacagttagaaccctacatggaaaaactgcctggttcaaaattg

SEQ ID NO: 59089 - DNA, 1284 bp, Bovine  19866881348673
taacacacattctgttcatcagctttcaaacttttttagccattgagatctagttcagatatgtagttaattatataattaaaaaattatgcaatcaagacaaaagtttcatgaaaactttactacttgtgatacactctgatactttctattctattccatttcttttcctcctcccccttctccttctccttgttcttcttctttccctgagggaggcagtaaggaagtaaggcaaagggaagaaagaataaaagagagagagagagaacagaaagagggagaagaaaaataaaactaaatagaatttaagtgtttcctaagtaaattaacgaattttacctccccccctcaaaaaaaaagtctaaaacccaactttcccaatcccaacaaaaaaatcttgcaccaagagtgcaagattcctaaatgccttgcattgagaaaaaaaaagaaaaattacatctgaaaattactctggactctataatgagctctcctggttttctttcagatcattctggatgatcagatcggaagagaagagcagagactgcctcaggacttgatgtataaaatagctctcagcagggtttggtcaatcctttctgacaggtatacacactgcaacaatcttcaaaggtcacttctgggagaccctcctaactccttttgatgatgctgccaagaaaggaaagagaaaaagtaagaagagaaatctaaataagaacaaaacaatggaaaggaagacactcacatgaaccccaaaggtgcaactgatgaagattaaaaatgctattagacttcattgaccatacaacccacgattacatggggttattactagcagagagtgctctctcatcaccagatactttgtttaaaccttagagccacattcataattgaatgctaacaccatcggtacagggctaggggttgttctctgagtaagaggtttccacaggacttcctaaaagaaataaggaaatccaactggggcaaatgatctatccaatactaccaagagctcagtggatgctttacaccaaatcgatttcctcagaaggtctcggaggaaaagggcgcagggaccacaacagtcacaatccagccacagctggctgcatttggtaatacagggatacggctgcttgtgaattaagcaaacaaaagtaaacaaaaggatatccttaactgtaaactcctctttctgacaaaacgagtaattcagcatttactctcaatactataagggatacatattaccaacatgtaatagaaagt

SEQ ID NO: 59090 - DNA, 830 bp, Bovine  19866881356272
taggtgcttcataaatgatactttctctccctcccttatagactccagttgaatattattaatatttggttttaatattccatttctcactactgatgataatgtctaccctgttgatctcagtaaaaatatttcaaagcatgtttatatgttaataagttcccaggcaggacacgtctatccctttgcctcatattaaagtttgcggcagagagaaaaagaaagtcattcagaatcacaaagaagaagcctagcactatctttgaaccacattctttaaggtcagcaaagagctggctcttcagagaggaataaaatgcacacccactgcttgtccaaatagtcatccagtttctctctctctctcttttttttttaattctctctcttcctgtctctcagatgagaatgatttaatctccaaactatgcatgatgacacatactatttcttcctccaagaatgtgatgttacaatgtgaggccccattccagaactggattgagagggagaggtcatatgtccagtctccatacaggcattcactagttgaatttcacacagagaacatctctgtttcacagccacagagaatattgcttatcttggcaggctcctcacaaatgcaagacactgagcccagataagcagtgcgtgatgaatgagtcagtgcaattgcaatcagtaaagacccaaacaaacaaacaaaaccccaccactgaccacgacccaacggccaatgaaataaatcacctttgtaccagagatggcagtattttggttgctgttaacctttatagaaacaacatgttactagaaatcagatcaca

SEQ ID NO: 59091 - DNA, 1028 bp, Bovine  19866881390035
tctcaatgatctacgaactctgcagcaaaggcaaatattataaagactaccagcatcatcgtcttccccatgatcattttaataatggagttaaccttatttgagcctcttaaactctactaccattaaactgttttccagtaaatctatggcataattctcttttgttctgaacaagtgagccaaccagggaaattcttgtaattttggtgataagggagtaaaaggaagaggtagaaaaggagcaaggctcagaggctaacctggaaagtggtaacagctaaattgcattctttttctgctctttctccttcatcaggttgcctccacatgggtaactatgctcagacatattggcctcatataatatttaccagacagtaggagagggagtgaaatctagcccctagataagactaaatgcttatagtttttctctacccttggcccaatattaaattctcaacaaaatagctgagtgatccttgtaaaacgtaagtcagatgtaagtcagatcatgttgctcctctgctgaaaactctccaacggttccctattttgttcagggtcaaagtcattttaatgatttacaaggtctccaagacccgccacctttccccccttgtctccctacatcaacacatctctttgccatctcacttttagccaacctcactgacctcttgttttatccttagagccttcactgaatgttctcactgcctagaatgcccttccgccatataccccatgtctatttcactctctttgtccaaatgcaacctctcactgtctacttgacaggtcctgcttccctgatcacataatttaaaatcacagctcatacactcccaatcccctttatcatactctacttatatctttttctcttatctcttgtccccttttaacaaagacaaagtgaagtgaagtgaaagtcactcagtcgtgtccgactgtttgcggccccatggaccatacagtccatggaattttccaggccagaatactggagtgggtaccctttc

SEQ ID NO: 59092 - DNA, 1532 bp, Bovine  19866881538128
tgaatgctgcccggggggaaatgggaaggtttcttagagaaagtgggatgaaagagttgtccttgaggctgggtagaactcctcggatgtataggtgtgggggagggaacagcctggacgagggcctagagggggaatgtgctggtgtgtggaggaaaaggggcggagaagacgtgcctggagagcctgtcagaattaggttgttctggacttccctggtggcgcagtggataaaaagccactggccattgcaggggacagcgggttcaatccatggtccagaaagattccgcatgctggcgagtaactaagcccatgctccaggactgctgagcccgtgctctagagcccctgagcccgaactactgaagctggcatctagagcctgtgctcggcaataagggaagcaacctccgtgagaaggatgcgcaccacagcgaagagtagccccccactcgccaaaactagagaaagcccgtgcaaatcagtgaagacccagcacagccaaaaatagataaataaatttaaaaaaattttttgttaaagattagaaaaaagaattaggttgtgctggcacagagcaggtacttaataaataattgtcaaatgattgcataggtaaatggcagcatcagacatggggtattgttttgtttatttattttggtaagaaatggtgaagttttaaaaagaagctggtataattgtattatgatgatagctctgtggagaacaaggtcaaccacaggcagggacatgatctaagaaaccatggtgattgtcctaaacgatggactgcgtgccctgccccccacttcccatcatcccggaaagcctgcttctctgcctctgtaagaagccaggctccaatgcttcccctcttttgaaatatttgtgggtcagtgaatgtcaacactcaggttacatgcagagtgtgtttaaacacacactgggaacatcaacacatatcctattcctaaggagaggaataaggtctcctaattgcacttgtgtgaaggttgacatggctcccaggaaggatctggggaggtgacacatagtgtggccgtcagccctgaagtttgtcgaagcctctagaagtcctgggcttggcgattctggtccttgcttcgcagaggaaagatggaaaaccatctgatattcctctcttcgtactcctcgtctgttccatattgatatcaataaacaatgaaatcacaggatccagattaagtaaatctattttccttgcatgtggtacaacacagtttgaaaataaaaaaacaaatcaaatgctctggaaacaaaatgaatgcaaattaagccccaaagaaatctgtcagcatctgaacattttattttgctttcttctcccctttaaattaaaccaacaccattttccaaagctcaaatatgaatcacagccccttctggaatgaatgattctggctgtggcctagtttaagcagatgatcccctacaagtgtggggagtgaggctctgctccatgaggtaggagttttgaggataca

SEQ ID NO: 59093 - DNA, 753 bp, Bovine  19866881758978
gagtcgacggcatttaccttcgagaagatgaacctggtcagggctccagggagtgtcttcctgagtaaatgacgttaaaagaccttaaggatagggaggattagcagggtgaaggctctggggttatagcataggctattcctcaggctaaaggtcctgaggaaaatgcaaaacacttataagagtcataaggaaggtctgtttaaagaacaaggaaaggggagaaatggagcatgatgagatttgctacactcattcaatttcttagccaaataggaatcacacttaataatatttgactggaagacactggacaaatgtcttaggtgagaggtgtaaggcaacagtacaaaacttctaatcactctcagggaccttcaggtatgcaatgcagaataagaaggctgactgaggtgagcattaggctgctattacgctcaaaccacagatttttaacgcatatggggattttaaggtaaatgcattaaatcatttaaaaatcccacaggtaataaaatactctagaattggcaaaaagtttaatgaaaaaaaaacttctaggcatgaagtcattgctcccatgatatgaaacttccaagccaagaaataggattattatgacaaaaaaaaaataactgtccatttagagctgctttctctccctagaaatctatgtgagataataatttattggtacttaatcatcagcagaaaataagacatggaaacattttttttaaaagcagcaaaaca

SEQ ID NO: 59094 - DNA, 901 bp, Bovine  19866880139426
aactctgggagatggtgagggacagggaggcctggcatgctgcagtccgtggggtcgcaaagagtcagacatgactgggtgattgaacaacagcagcaagaactctaacatgaaacctccagcaaattccatgcggccatgccaggcagaacaaatacggtgtggggatggctattagctgaggtggagtaggaaatggcaaagctggagttacttctggaactcagctgagaactcagttcttcaggggtccctgagtgtagatcagggctcataagtttgcagcaggcagaggaatcaattttcctttggaaatctggtccacttaagggtatgtcctgtggtaccctaattcacagagtgttccaccctgcaagaaatgccccatcccaagtgtggctttgcacggccctacctccattgcctctctggaggatgggtcatcctgggagctgtcctcccagcccatgaatatgtatacattagctccgagcagccaaggcagattcctcgtcttattcatcttcattagcgaggcctggactccccagaggaccttgctgacagagtctagattgttccctctctgcagagtgggggagataaataccacattatgccacccacagggcttgtgcattatgccttgggagcccacagcagctccagcctcccccagagctcgatgacatcttcccggggtgtgagacccccctattcagccacagtgggactcattgtggtgtcctggttgaggctgccatggccggggaatggcctgaggtggggctgagcggggagccttttatcccaggagtcaggacccgtatgaagctgctcctttgctttcattccttattcccttctggtggggcctacactctccctccctgcatacctc

SEQ ID NO: 59095 - DNA, 1665 bp, Bovine  19866880507896
taatttttggaatgtgtccagatgtgtcaagtggggagcaaacattacagatgggcaggagttgaagaattctgttgctaatgcccagagcagaatggaacatcaccattgactttgcctcggagctgggaagggctctgatgaggggttaggtgtacctgaaaaagccagtaagaaggtgcagatgcagctctagtgtagaaacaaaaaaagctacctgatgatcgtgttctgacacttttttttctgccccccccacccccgccccgcaaaaagccttttttgggggatggaggggagaaacttttgcccttctaaaaacatgtccctttagtggctttatttatttttctgagagtggtttcatcttgttgcccttttcttttccctgagatgctgccaggtttggatgaacaggggacacactgctgggacgtctgatagtttcatcactagagagaagaggaaagaatgaggcaaatagaaaggcttacagaggcgagcaggagctgcccttagtatgtgatgcaaagtcaggactgagcccccacctctaatgggaatcacaaagaaacgtgcttgaggggttgacaggaataatctagaacaccagcatgctcagaaatccattctgttcacccttaggctttctaaaagcggaactcatcttcctaaatgtttatttggagagagaaaatactacgtgtaaagagatatgtatatatacagaaatgaggacatatttctacctacagttttgttattactttgccataaaataaatgttcattaatttccataccacatatggagggaactgccacatgtgaatatctgtcatcagtaattgctgtgcctgtgactccttaagttatatgtgccacagggatggtttccaaataagagcctggagagagggacagattcacagatgatagcagaaacgtctggaaattacagaccgattgaggtcagcaagaaacaagttattcaatatatcccctgggggctaggaccagacttttccccatggttccaaaattacttggcagtttcattaaggtgaaaggtagcacagcctcacaagtgaacgatgtcacttaaaatgcagatggacttgtcaaccaaacacttagagaggatggcattttgatggtctgtctcttcctgctcataagttgctcaaatttgtggcatagatgaatgggagtaatgaggattgtaattgaagtatttgaccgtatacgtatgtctctatctatttaaaaattcaggaaatcagtacggctaagaagtctgatgtccaggcagaattatttacaacgcgagggagctgtcctcaagttctggtgctgaaatatagagtcactagtttcatttgatgtgcctccacaatatgaaggaatgtctttttctggctctgagtagagttgctgcacaaccatccaggaccaatgtaaagctaagagaatacttatcccatggctagaggataaagttttagagaacattacagggaaatattctttggacctttttagtgcattaggaataagtagtgtcattcacatctggttcttctttcctttacaggcaccccaacactgagctttccagactccatgcagttatatgggctcctgcagttatgtgagccctgaataa

SEQ ID NO: 59096 - DNA, 1398 bp, Bovine  19866880558398
ccccaatggccagactctgggaaataactccctctggtcaatccttgactgcccctcaggccagtggcacagtctgaacagggaaggaacgtgggaaggagtccacacactgaatggggaaaggaacgttcatgcacatttgctgaccagtggttggtcccaccagaatcaccttctcttcttgcaatttccaatgaaaagtaggataagaagcaacaaaggccatggtcaagcccttggtttctggagtcagacccatctctgccacctggctatgggatcagcctctcagagcttcagcttcctcctctgaaaaggaggactggaaccctttccttccagtcacgatcgctgtgagaattaatggaagcaattgcaggtaaatggcgagggaaaggtttcataacatgactgtcttctccccttccctgtgcttaaaaatatccagtacttctgctaaaaggcatcgtaatggaaacagatcttaccagtcaagtacgttacaaaataatgttgggaggagaaatttcttggtacagggacaagtatgtatgaaataccacttcccaaaatattgctcaaacatgaaaaaaaatcccaaattccttaaggttttccactcatatatgtgaacatctcctgctcccacttgccaagatgcttcttggctttcctatgatgtcttcaatttccacacttgttttcagctcttctgccagagccatgtgcttgtttatttttactacatttttatgacgtttctgctatagcaataagttttgcattattagctttatcaaataacagaatgtctgggtggctggcagatattattggcctggtttttatggctccatcccagaatactttttgtgattactttcttaagttgttcttagatccattcttaactatgtgtttgtgcccttattaacacatttaagggctaattattatggtacaaacttagcatccgtgcaatgccaattgctataatcttattgttattacttaatcacatgttagtgtactcaattccattccacagatgtacgtaggaaagttgcttgtaaatctaatgtttatgaactgaatttctttttatattcattaggaaccttccccatccaacacagagtattacaccttgaaatatctgtttggcaagttcagtgtgtttggggtatcgagtttcctgaaactggagggaaaccttgttacaaaacaaagagaaacagacaagcagatctcatctctgcaatgtgtagcttcttctactgttcttatttgactggttaagtctatgaatgacttggttctatcttgagaggcatagaaagcatgtactccctccactaatcaagtgggaatctgaggcagaggacagggtgtatcttg

SEQ ID NO: 59097 - DNA, 1866 bp, Bovine  19866880744349
tgccaggtgaagagcttattcatggcagggtactctgaaccattgtcacaggtcacctctcatcctgccttacccactgatgagcatttcctacacacaaagcattatgggaggtttaacagtatataaaattatatggtggctcagacagtaaagaatctgcctgcagtgggagacccaggttggatccctgcgttgggaagatcccctggagaagggcatggcaacccactccagtattcttgtctggaaaagcccatggacagagaagccgggagagctacagtccttggggtcacaaagagccggacacaaccgaaggactagcacacacacaagagaccagtggatctgtatttagagacgtgtgaaatgggaccattggtccacatgatcgctgaggttctgtaattatcagtggaaataatttggagaacatcaacgagaaacccacatccaggaagtggccttatcggggggtgtccaagggtggcctaggtctcccagttctgcccaacgaggggctcacatagcctcaggtttgtagcagccctgaacttctaggcccaaacacaccctgggaatgaacgggagactcagccccagccattcttctagaagtccctaggttttcatttgctttccacctttgagtgtggggatgtagacagaggccttttgttagccaagaaggaggctgccaggtggcccttctactccccagcagcatcctgtatccctaagaagattttcatccaggcgtcttccagtttcaacactggctttgttgactgactatcaccacgcatgttgaattacctctttttttcccctgaacaaagagggcattcaggtgaagttattggtctggaacagagaactggtcaatcattgttgttattatattaatggcaagtattctccagtaattacaattattagaaatagaatgcccaatagcatatgtcgtttatagtcactgtattccagttacaaggaatgattttgtttcaactaatgatggcattgtgataacaagcctgggtctttagatcagctgccagatcccaggtaccgacaagagtaggaagaggaagatgagggaaagctgaagatggatcacagttttcagtcttgttcttccagtatcagctgagactcctggcttcccactggaatgggctttcaccaggacagctaccaacaaggccatactctcgccttcaccaaggagggaggggctgctggtctccaagtggttttggaatcctctgctaggtgacctgagccccccatcaagcccacgcacttaataactatgattcttggggaacaaaggcaaacttccatgggaaagcacatgcattgagaagaatttatcctcaaaggactattttgatgttatttctcatctacactgaacgacagagtcagctatacttgatgctgtgttgttctggctccagcctggctgagctttgcgaggaaggcgaggctcacctagcgcccatgagcaggctcatagaggagcttcctgcagcccctctcttcctgaagttcaaccagagcctttctccagagaaccgctgtgagatcagaagaggcaaaatgaattctgatttccaaagctgtgcttgaaagcctctccccaagtcccctactaccccgatagcgctgagatgaatccattgccaggacaggtattgggaaacctgcagataccaaggtcagtcctccccaggactgcagaattagtaaggcagggaaagtccaggcccaggacaggctgctgaaataagccccatgcccagagataaggcaggccaagggcctgtcccccagcaggacttgaagaagctcaggtca

SEQ ID NO: 59098 - DNA, 950 bp, Bovine  19866880791245
agaaggataggggaagcacttttcctcttaatgagggagagggagccccagagggcagcagggagcaaagaggaaaagcctgggttgtagctctgctttcttcccagctgtcaaagggtattgaggactcagctctcttcacagaaagtcaagtttaaggtcagtgtcagggatgttttgacatttctactatccctcaaggcctgtgagggcggaagctgtgaatgtccaaaagcagacaattgaccttagaagtgatggggaaatggaggggaagagtggattccttctgggttcttacagggtctggtggggtaatggctttagtgcttctggcactctgatatctcactagcccaggcaagagctgggaaatatgaaaagggttaatttatgacccctggtagggaggtggtgctgctggcttggatctttccttcaaaggaactacagggacttcccagagcatctttttgcattccattgtgggggcaccttgtgcatggcggaagaccctgcttcatccgttttccaggcaggactcaaatagagcatgccgtatggctttgagtttctagacaaccattcctgacagcaccagggctgcccccaccgaacacagacttgcaagaagtgggctgcagcaagacagcccaggcccgggattggagtccgaccctgctaagctcctcttccctctcccccttactccagtttctctgcagagggtcctccagccccattccagaggtgctaaaagcccttggggacaaaggccctggcccctggaggggttattattcaagtcagtggttccaatgagattatcctgtctaatgaagcagctcctaccgcctcccctaagcctgaactttcactgctggagagttcccagccaagtggaaaattagaagggagaggaatggaagaaggaagggggtgaggggtag

SEQ ID NO: 59099 - DNA, 1149 bp, Bovine  19866880837472
ccaccctgccctgagttcctttaatccatgacagccagatcatatcatggacaaacataattgggatgatggccaagacaccagaactttttcaacaacacactacggaagactggggcttgcctcctgggctgttgtctcctagagctcacgtctgaagttttagctttcagtagagtccctgcccaggagggatggtagactgcagtgaggggatggacagacagactgacagacagaaagggcaagacctagagtccagagacgtccttgacatcttctacatctcctgatggagagtctgtaaaagtataacatgatggtggcctttctcagccgaacctgggggtggggtgagtgctaggagagggcaggccagaatgacaatggtttcatgatcaaaaggcagcacttcgacccctccttccctgaagccaatctctctggcctccatctcataaaccagtctcccacatacagcgaacagaatgcaatcctgccagagctctcctctgctgatgggaatggaggtgataattccacgattctcccatggagggcaaagggcgaggctgggtctgttcccagctgtccgtatgatagatgaggtgacccaaggccatctgctcagcatctccatccttctcttccccttagagccaggaaaaacatctctgcttccttcttcctcctcaagatgccaggtgggaaacacagtgactgctcagtagctgctggaagagcccagaaggacggctggtgatgcttgtgtgatacttcaatgtctgttcactcggtaggactttcaacccagttggtaaggaggaaatgtgagccctacaaagagaacaggggcatggggcagatgacacagcctacttttggattttggtacccatgggggctccggggaccaacacttgcaaatcccaaggatgactatgcaatctcatgagattatccagttgtggaattccacattggaagggacctgagagatccattcatcctcttgtccagggtaggaagccagtttagtatgtggattctcctcatttctcctcccctgtgaaccatccagctgcagtgggattatccagaaagggggaagacatcaacaccacatcaacacttcattgccagataaca

SEQ ID NO: 59100 - DNA, 870 bp, Bovine  19866880896129
atgcctaaactcttttatctgatggtttgggtgagagaagaacaaacaacgagatctttgtttcctaagttgagactcgtcatttcacagattatgtcagaactcatcaatttaaaacttaatatagggtggccttatgccttaatgctaaaaaaaaaaaaaaaaaaaaaaggttctattttggcccaggaagccccagaatgaaagtatttgaaaaccacacaaggctgactcatttaaggggaatttaactcaagtgctttggggcagtggggcaaggagggcggagacttggaaatgaacaccctctggagcagaatgctggcttctgagtcacaggatcagagaataattagactttggtgattttagccatcagtaaaccaacccccttattataaaaagggaacactgtttatttagtgttctcctgccagactcagaatattcctattgttcatcgtccccagacttaatttctgataaagctcacggtcactgtggagggagtgagagacagaactgctgatttatgaagtctctgcttggggaataaggtgagggttttgtaatattgtgagtcactagaacacagatctggggcaaggggagatgcattttctaaaagattaaaaagaagcaacaagttttccttgtcctttatgctttccatagaataaaactatgctgaatataatatattttaaaaaaaatgatctggaatccatcaggatttgtcctgtgctagagtaatcatcccaaacatgaacccgtcaatgtaaatgtacagatatttctggtcaatagaaagacccagtaaacagaacagcaggaacaacataaagtactgcatattttattaatgtgttt

SEQ ID NO: 59101 - DNA, 1041 bp, Bovine  19866880934875
aaaacagggaacttttcatctgtgataagaaacacttacggctctgattaggctttcggctcagtcagggaggtcccctggctttaataaaatctcattttccccctaaactctcccatgtggtaggggcccagagtttaatggggatataagagatgatcccaacctgaggctcaggtggctgcagccccccaccctccagcccagcagctgggattgatcgcagagctgccggtacagccacacacaagccgctgcacatcagagaataatcatgagccgtttgatgctgacctgggccaggccaagatggcagccgggctcctgtgcatgcctgcttggaggatggagacgctcatcctcctggtctttattaagaggggacccaaggagtatgccgaccagttccaacatgtgatttattaacggacgtctgcatttgaaagcctccctggctttaatctacgcctgatcccttaaggttcccatcagcactggctgatcatgttcatttggaccggggcacagtggtccaattcatctcccctgtcagatgcaattctttcagggggtctcactctcagttctgaaaggctgattcacaatgcttaataccacccgacggactccttcacgagatgggcaggatgtcacaacggcggagctgttgggagatgccaggtctgagccagcagagtctggagggaggtggggtatgagcagctggtaattagaaatcaccggtgggtatcagaacacatccatcagaaacccacagagatgaacacgccccagtgtcttcaggagagatgggagctggtggttggttctgagtttttattccactattgcataaggagcaccacttgttaagcccttgaaccccagccctaagactaagactaagaaatatcacggctagcaacatgatcttcacttctggacaaatctgtgtgaagcgctggcaccaacagggaccatatcacttccatacagcaattttatcaccaattcaaacaggcacacttgctcttaaatcca

SEQ ID NO: 59102 - DNA, 1595 bp, Bovine  19866880958624
ccacatcctcagctgtcaacacagcatccgccttgtgggactgttaattaccgccttttattatatttatgctgcttaatttttttctccgcaatgtactcttccctctaattaggtgtagtgattagaatctcttttatgtgtgccaggcgtgaggctttgaatgttggaggcactcggtgacttgaaggaaagctgcagacctataaaaagccaaccgcctccttctcctcctgccagctgagccccccagctgggaggggggcacgaggagagtgtgaagccgggttcctctcggagaacattcggaagaaggaggaattagcggtcacacagtggcttccggctcaggagagggccgtctctcgttggtaggaggaggagatagagcaaagacccgtaggattggccctgaaggtattttcaggcatgcccagggccggctcttgaacattgaaagggcaaactgggtccagggaaggcaacctcccgaagacctgacaatgagccaggccatacccagtcacagactcagaagaggccctgcctgggccctcgctggcctgacctttggtggtataaacacacatatgcatgcacacacacatacagacactcggtactcaggtggtcactcatgccctcacacacctttacactcacacccacgcacacacacatttccagagatagacacacacgtgtgtgttcctcactcggcacacacatgagtgctcatcagggcttttggtgacagtatttcccagaaaggcttactgactcccctttcacacacattggtgtaagctcacacatattggtgcaggttccattcagttgtgttagggctgctctgccttctgaatcacttttcttggcaaggatcaccctgctccccatgtcagtgtgaccaggggtgcagagagagagcaacatcgaaggggtctacagtagcttctgaggggtcctgggacctccccgttgttctgtcaagcaagaagcattggtatcctcaaggctctgagctccagggtcacaggcaggaagtcagcacttctggggggcagtggggcccactgacagtgcctgggcagctgtgttatgatcatgtcatctgcagagcccactgggcacaggactggcatttcaagggccctggacctacactgggcttgtgaattccttctgagctcacaaagcatttttttcatacttttgtctgtataaatagaaagaagcattgcctaatcaacgtccactgcctgttctttgcacgtgtattttaatccatcttggtttggtgtgtgtgtgcatgtgcacacacatgtttgcatgcatgtgtgtacgagtgcatttgcacgtgctgagggagaagatggaggcaggaaggaccaagcacattaccgctgacagcctcctggagaggagggctgtatccaggacagagtgtgatcacacggctgtgtgataatgggtccatgtatggaactttctcggggggccatggaggttggtcttgcaacttcaggaccgtctggaggtctgggctgtccccacaggcagggtacccatctaagatcacgattcaccaccag

SEQ ID NO: 59103 - DNA, 1416 bp, Bovine  19866881101563
ctcagatcggccctccagccttatgttccttctgaaggaagagagctgaagattacttgaatgtgtcatggcaagacacctcccgcgtctccctgagaagagagtgccaaagccaccctggccaggatcctgggctggagacggctctggtgctagcgttagtcgctcagtcgagtctgactctttgtgaccccatggactgtaacccgccaggctcctctgtccgtgaaattcttcaagcaggaacactggagtgggtagccattcccttctccacggaatcgaacctgggtttcctgcattacaggcagattctttattgtctgagccaccagggaagcctagaaatggctctagtggggtttaaaatggcttgaggtagaggttctggaggcaggaaacccaggcctagcactgcccactgctgctggtgtgtgaaatgcacacacacacacgcgcgcgcacactcacgcccgactccccaccactccctctgtaccttccttgcactccagggccacgcgggactccaggttgtccatctgcatttgcagccgctttagagtcaggtcactctcgcgggacttgcgcttataggcgatgagcacggccacaatgaagatgataaggaggccgccagccacggcgatgctgacgatggcaggcaggctgagcgggctgtctggggctatgtacaccatccctggggagtactccatgccaccgactcgggcctgggggggacacaccaggggagagggagctgggtatggggacagagcatcccagggaacagacccaagccaccagtgagctgggcaccagggccggatgagggaaatggctccagggaggaggattatcactggctgtgaaagcagatgagcggccatcggggcagagggaggatggatagctcagctttcccccagaactggaaaaaccacacgttattttattcgggaacaaacatggccatcttcatgaggaaatggcattcaactggaatctaaaaaaatcctgctactgctgctaagttgcttcagtcgtgtccgactctgtgtgaccccatggatggcagcccacctggctctaccgatcctgggattctccaggcaagaatactacatgacctcaaagactggctccccgaagacacatcccatcctgaggactgatgactcaggcacaatacgtgacattatgtccagcctgggtcaacaacactcctccccgggaagcacctcttgcttctaacaggtgacttggcgtgcatgtctgctcagttgtgtctgactcttttcgaccccatggactgtagcccaccaggctcctctgtccgtgggattctctaggcaagactactggagtgggttgccattcccttcttccaggggatcttccgaccccagggat

SEQ ID NO: 59104 - DNA, 1679 bp, Bovine  19866881117989
caagaatgtggcaatctgcaagctgaggaaaggggcctcactgggagtaacactgctgacatcttgctcttggacctgcagtctccaaaagctatgagataagaaatgtctgtggttgacgccacccagtctgtgatatttcgttacggcagggaaagaagacaaagacctcatctcaattaagccttacaaaaccctgttgaggatgtcttttaataaatgtactggacttccctggtggttaagaatctgcctgctactttaggggacaatggtttgatctttggtctgggaagattctacatgccgtggggcaaggctttgtgccacagctactgaaggtcaagtgtctagagccagtaagagaagttaccacagtgagaagcccactcccctcagctagagaaaagaccgcttgcagtaacaaaaaccaaattaatacataaatattaaaatgattacttaaaatgtgctggccctaatgaaatgaccacatcattccactgagtgcctgccccacatcaggcaggtcacagacacgtgtcaaagctctctccttcgctgtctccgtatcacagacaaggatatgggggcacagagaagccaagatgcagccccgagtcacggtctgtcagtgccagagccaggggctcagccagatctccaccgtgctttccgctgcaaccttcgttaccatcttgtttctgactcacacaataaactctaactaaatgcaccatgctttactccccctaaagtaacttctacaacctttccagcacagtcactcttgcagcccatgtgtgcaaagtcacttccgtcatgtccagctctttgtggcccccatggactgtagcccgccaggctcctctgtccatggggattctccaagcaagaatactggagcgggttgccatttcctcctccaggggatcttccagaccctgggatcaaacctgcatctcctgcattggcaggcatattctttcccactgcgccacctgggaagccccataaatgcttgctcaggaaatggtctggggcagctctggccagggggttgccctcggtgtcaccccacctggcccagggagccccgggggcgagcggtgcatcatcctggagggatgtccagtcttccccttggtgcaggcgctgctggctctcgcccttccatccctgtgcgttgctatgtgaataacacaattatgaagacacaggacagggataagcagaaaacattctgcagcagagacagcggaagggagagccagtcacaatcagatattttgttattgactcatttcagggaagagtagaattctttaaaaccctgtgctattgcagaagggaggcatgatgaatgattagacagattgctcagttttatttttcaacattagcttttatcaaggatctctcccagcccacagtctctgttgggctccatcaccatctctagaaaagccagacagaagtgtgactgggactctgtagtcctgagtctgcaaccactgccctgccctgctcatggactcagcttacccatcagtcaaatgggaggtggggctgtccctgcagtatgtctggggcagaggacagattggttagagtgggcggagcagggtctgaatccggctttatacttcccaacggatgaggtgggaggattactttag

SEQ ID NO: 59105 - DNA, 1695 bp, Bovine  19866881169938
ccccctggtaatcattatcttcagtgccagagctcagcctgattgaccgtcatcatcatctttgtgctcgagagtcattactattcccgtccctgtctttacacgccgccttctttctccccggtcagtgggaacacacccatcgccgtgtggggtactcacctggacctcatacagaacccccagatccgggccaagcatggagggaaggagcacatcaatgtgagtcccgggctagtgggctcggagagggctgtcctagagggtgtggggctctctgggggctcaggcaggctcatctcatacactgatgactcatcgcgtgcaacgcccccagacactgggatagtgggatgcgggagcaggcatgaggccccttccacactgtggctaaaggcatggaggagccattgctcctgggtttctgaggtttcagatccttcttccttcctcctctgatctcctgtggcactccttagcttagagatagcctagtgcctgccacagctgccatgcagagcagaggtaaggaccagcttctgagcttgtccttgaatttccaggtcaggctgttgggacctgtctataacatcccgtgtcaacaccatgctgtacaacaccatggagggaggcctggtgggtggctggggctgtgggtgtgtggagacctgagacataaaccttctctggctcctccccagctctgcgaggttctgaacgccactgagatgacctgccaggctccagccctcgctctgggacctgaccaccagtccgacctgacagagaggcctgaggagtttggcttcatcctagacaatgtccagtccctgctaatcctcaacatgaccaacttcacctactaccccaaccctgtgtttgaggccttcagcccctcgggaatcctggagctcaagcctggcacacccatcatcctgaaggtagattgatgagggaggtaggaggtgtgcaaggggaggctttccatgtcccaggaagaggccaggagtcatggccttttgccagatctcacggtggtgtcactagctagcagaggctgagttacagcccagactacggtaaacgctccctacgagtctgtactaagatgtgcactctctttgtgggtcaccaaagcctagtcagggcagccggatccacgctggccatctgactcccagctttggctcgagtccaggacttgggaggtcaaagactcatactgcttcctcttgcaaagctctttgcaaaccaccttctaggacttctttgcagcatggataataaattaattttaactcatatgacaatttgaatcgactggtagtgactgactacagctctgtgttgagaaggatcctgaggctgcctttgggagaagctgaaaagagtaccttgattattgattcccactgaggaaacgagaatagtagtatggtagtataggtgttatgaattttttggacttaactagggaaagtggcctctccaccagctccccagatggatggggcctcagggtgggaggacatggtggccagccaatatctgtgctcctgactggagtgagaactcaggcgctcctgtccatgcagggcaagaatctgatcccacctgttgctgggggcaatgtgaaactgaactacaccgtgcggttggggagaagccctgcaccgtcacggtgtcggatgtgca

SEQ ID NO: 59106 - DNA, 1539 bp, Bovine  19866881211351
gtttcaactgttaactagaagcctggggttcctgcaatgaaagcttgactgggaccaagttccactgagtgggacccaaactactgatggttttgccagtcagcaatgccaaggccaggggtctttggatcccactgagaaaggctttcagctctccgcatgtgtctgggtggttatctatgcccttctttcatcccttggtttatttatcaggatccgtttgcctccattgcacaccattgccttctttccacttctggagagtcaaatggagccagcaaggaagaggcacagggtgggagtggcaacaccagggcagagtttcacccactggtctcgtaaccccaggcacagggcactcggacagccagttgaatattcggacagccccaaggagagcctttaggtgctacacacttgaacttaaccttcaaataccagaagattctggggagacactgaagtctgttcagtgactgttgaatcactaatcacataaatgatttagcggcccatgtaagcctggagaaaaagagtccaatacctttttcttgctcttcagccctggaatatcagtctgcagtcaaattgcaaccacaaatgtccagagatctccctccagccccttagagtgtaatgatcccaggtgaccccatatcctgactcatcaccattcccacattgacatttccatacatttttatgggaagttaacaatttaaagtgaagtcagaacacaagaagggagataagatttacaaaggatataagggaggaagagtaagaaaagagaggaagagaagagagaggtcaaatggtaggagagcagtgacagagaagaagacgaagaggaagagaattacctggggatgtgggaagcaggaggaaactgcccagaggtactcacgtgttgtggagcacacaccagccacagtgggggtcgcccgagccaaggcactcgctgcagctctgatactgaccacaggactccacagggactctggtgagctaggacaggaccacaggagagacagaggtcaagattttgtagaacagcctgtagtctaccaggaattgatattatctcatcgggtgtatcatctaagactgtgcggtagcaggtaggggcctagaaccccagatccaaaagagacctggagggattgtatttgagcagatggctgcataagcttcggttattttcttagaagtccctgggaatagacgccaaataatttatatcacattgttatcaaagatatttatatcctgtacatttaaattttcccaccatccaaaccctcaaatatcgctacaaacatgcaattcatcacacatttctctcttatcaatgtaatcaccatagatgcttcttctttctccattcatgtttctctttcaccccccttcccagaccttctccttcaagtttcatcattttttgtggttccgggagagcattgcacccaaatccagtaccttcctctctctctgtaacaagggggtaatccactcgcttcatgctgtcatctgcccact

SEQ ID NO: 59107 - DNA, 1075 bp, Bovine  19866881219415
agttattatccagccatgtccttgttcctggatggtagattctatgataccccaacctgggtctcacttccattatggtggccaaccacagtgggctgagatctgttctcaccaaacagttaaaacagctatgatgataaaggaaaaaaaaaaaaacacaaaaactaaagggctactcccttgcaggcttcccaggtggctcagcggtaaagaatccatctgcaatgggggtttgatccctgggtcaggaagatcccctggagaagggaatggcaacccactccagtagtcttgcctggagagtcccatggacagaggagcctggtggggtacagtccacggtgtcacaaaagagctggacacgactgaagccactgtgcacgaacacacacacgcccttgcaggagtgtgctattctgtgtttttcttgattcagagtagaagtgagaatataggaatatttaaaacactaacccctccacttttgttttctaaaaacagcattgaccgaacgcaggaagttcatctttaatatcactgtttataagctgttcagcaatgtttacagtggttataattggtatcattaagcttgggtgacattattaatgctgctgattaaattgctgtaaacctaactttaccattaacacagacagccacatctgagctgccggtgttcacactggagcactggggcagggaagcagactcggaggggtgcagtcgggaaggaaaaggaaccccactttctcacctacctgtaggagcttctaagaagttccagttctaaacatctttgctattagtaaagtgttttcactttctgtagcaattcttttgagaactggacatcctgcttctgtaaaagtgaaatgaaaatgttagtcactcagtcgtgtccaactctgcaaccccatggactgtagcctgccaggctcctctggccatggaattctccaggccagaagactggagtgggttgcctttcccttctccaggatatcttcccgacccaaggattgaacccttgtttcctgcattgcaggggagcatttaccgtctagccaccagg

SEQ ID NO: 59108 - DNA, 1747 bp, Bovine  19866881249942
ctcttggtctaaactggtctgtgagaaatgaattcaaagctcaactgtgctgattgttgggcttttctattggctcaactggtaaagaatctgcctgcagtgcaggagacctgggctcaatccctggtctccaagatcccctggagaaagaaattgctacccactccagtattcttgcctggagaattccatggacagagtggctggccagctactgtccacggggtcacaaaaagtcggacatggctgaggaactaacactttcaaccttttttttttttttttaattatttgactgcatcgggtcttagtcgcagcacatgggacctttcttagcaatgcacagactctctagttgtggcacacaggtttagttgctccacaacatgtgggatcttagttcccagaacccgtgcgtcccctggattgcaaggtagattcttaaccactggaccacaagggaagtccctaaccagttgatcttgaatgggcaactgttcctctgaatcccagttttcagatttgtgaactggaggttgtgaattggaggttcctgaccttctcaggtcatgaagtttaacagagaacgtagaggaagcagccaacttgtgaagggtaggcacacaatcctccttccttcccttcccccgcccctggtgcctagacctccactctcctgctggtacaataggaatgatatgtataggtgctcttctgattttataacaaggtcaggaggaagcatataactttaatgagagaaagaaggtgatgatggattgagttcggacaaagcaaaagagcgtttgatgccaagataaagaaattgaagttttttttttttttttttaacaaggagaatcaaaaggtgaggagtgacataataaccatcttcaatatgagagaggttattacgtgggatggtgaccagctgttccccatctccactaaggacatcagaaggaaaaatgcatttaaactgtgagaagcagtctgtagcttagttattaggaagagctcctttgccgtcagggtcgtgaaacattggaatgggaatttatcaaatttcctgtccctgaaggcctctccaaatatgataaactgcatccgggatcatgaatgagatgccctgaggcaggtccttccatcacaaaaacactgcaattcctggcagtgctcgcccgtgacagtgctccctgtaaaccccccatttgcaccgggtagtgtggtgctgacccctccactccccactccacatccctccccgtcttcactccatcccctgcccacctccacctccatccccccaccccacgcccagtttcagccagatctgcctgctctctctctcctcaccctaagtcatgggagagtcactgctcactgtttcaatagtgagtgatgtggtttctatacataatcctagcttataacttctttggcagcctccgggttgaaaggtgcttttaacagagagggagaaagagagctaaataacccttttatttaaaacacacacttttaagacaagctcaaatgtttggtcctttaattgatggcttactgtggccatgattgtccttggcagatcttttgagtttgggaacttggctggcaacttctgtttcaaggatgagcagatcaaagtgcatgtttggggaaggcacagcattaggatcaaagagggaacatctccaacttgggtactgctcccactgggaatcctgtccctgtctctctgtcatgg

SEQ ID NO: 59109 - DNA, 1302 bp, Bovine  19866881263159
cccccccaccagagcacagctcccaagaaaacccacagggaggagagaaaggtaactataaatgcaaggcttggcggctgaaacctaatacaaggagccaggaatcccagcactgggtgagaccttcaggccacctaatcctgtcttctgttggatgaaagcaccctgcacagctagttactcaatatgtttgccagttataccccattcaaacggcaagtgataagagttgttcacatcattaaatgtaatcagacgtgacttatgaaagagtttgacgcagcattaaaccatgcttatctctactggggccctaatttgttgctcgtgtaccgtgataatctactcataattacaaaaacaaaggactgggagcattccttatgtttcttggttcctcagccttttaaagaggcctctcctctgtcactagcagacagataccaagagccctctgagtgcagggcgtgggctagacacctgtggagtgagctgagttctccaaggtccttctgccaatctggactccttgaagtctttgcacctgagtcttgggtcttctccctatagtggatggtggtccagagggagatgaaaactcagacctgtgcatggatgtctgtagcagctttattcataattgccaacacttggaggcaaccaagatgtcctttagaaagtgaatggataaataagctgtggtatatccagacaacagaatattatccagtgctaaaaaagaagcgagttatcaagccatgaaaagacacgaaagaagcttaagcgtaatttgccaagtaaaagaagccaacctgaaaatctacatattgtgtgattccaactgtatagcttctggaaaaggcaaaatgacagagatactaaaaagatcaatagtagccaagagccagtggggagggcaggatgaataggtggggccctggggatttttagggcagtgtaagtattctgtagggtactatcatggtggtcacatgtcattctacatttgtcaagacccacagaatgtacaagagtgaaccctaatgtaaactctggacttggagtgataatgatgtgttaatgtagcttcattgattgtaacaaatgcaccactctgctgggggatgttgatcatcaggaggctttaggcagggagaggagagcagggggtgaatggggactctgtgtactttctccttaattttattgtgaacctacaatggctctaaaaattaaagtctattttttaaaaaaacatacctatgctggaaaagaggcaacatattgtccctccgtcatttt

SEQ ID NO: 59110 - DNA, 1805 bp, Bovine  19866881539608
tatcttgcacataggaagcttaaagtcatttgatagactgaatggaaacttagaatatgctttcatctactaacttcactttcctagaggggcaaaaggggagtgagggattaggttactaattgtaaagccatggcaagctcttttgaaaggaggaggaagagaattccaattggctgggaggaatggccgcctgttacgtggggctccaaagagagccaagctgtggactcacagctgccataaccaataaccagacaaagcccacagcctagagccccaaatatctttggtgatgttaactagcttgtcctatatggagaaggaaacagaacattatgttaaagccagcagagctttttgagatcaggctctgtggctttcaaactgtgctctagggaaccctgggagttccatggagcttttctggagactgtgtgagacgtgagggattcctagacagaggggtccaggtgcccttaactctcaaccatcttctacttccattcattttgtttctcgggctttcacacctgattttagttgaagaaaggtttctatggtgaaagaaaggtttgtaccttctccgtatggtccaaatccatccttttagagaggaaataataatataataacagtaaagtgcacagtgcctaaacaatgggccagacatggatctaagtgccatccttgtaatggcttttttagctctcacagccaccagtgggggctggcaagcaatcagcaaagtaccagacaatgggaccgagccctcaccatgtcagctgttaagtatgtgggtgacatccccaggaggagaactaccgcttcctcgtttacagaagacactgggcgcagaatagctatgtggactagctggcctgatgccacagcccgagcctctgtcctccgtggcttccctcaggaagtggatgctccagtcaaacagagccagagctggaacctgagcaagagccagaccccgccccaggccaaagccttcctctgacccttgccagctgagtcttgacccctctgcagggaaactgtgcaagctgagcattcgggtgacttgtgggaccacctgctcacacacatgggacatcctctcactccccagaccccttctctcatctggggtgctggctgctctgttctgcaggtgaaaagcaccccctcctcaaccgatggtggaaggtgaatcaggttagacagatttatgccagagaagatgtatgggcgagggacctggagctccccagctcacaggctctcactctgctgattctagcctcttcccattaaccccatgggtgccagaggagggaggtgagaggtcaccttatagggccttcggatggtaagacggaacaagggtggggcctcctatctttggatgagctttgaccccagaaacagggagttgagtgagactgggggacacttacgaattgtggacgctgcagttgtagaagacaaagctagtgctggcgaaggtcatgcctgtctccttcgacttgagctgcagctggacaacgtggtggtcccctgtgggcagagccggccatggggtcaggtggagggccacaatcacgtgtcaggtcccactgagagcagcacaccttgggaaagggctgcccactccccaggaggtgtggggagctctaacaggacttggaatcagctgggcccagtccagggcagaatggaataatccaagaacagaacagctgcagacagtagttctagtctattcctttttcctcactctagtcccagcatccacctctcatttacttaccagg

SEQ ID NO: 59111 - DNA, 708 bp, Bovine  19866881597617
tcctgggccactacattcagacgctaatttcttttttctctgtctcttactgttttaccttctccatccgctcctgtcataattcttttcttctttatgtcaatactgccacatgcttttctctcttctctttctctctgatctctcttgccctccctctttcttactttattcccatttcttctcccatttctctcttcttctctctccccacactgggctgttcacagctggtcctggagacatacaatgtcccggagctgacagctggcgtcaactgcacctttgaggacctgtcagagatggatgggctggtgataggcaatcagatccagtgttactccccggcagccaaggaggtgccccggatcatcacggagaacggtgagcagtccccagaggcaaagctgggcggcaagtccttcctcctgctgcctggaccatgagaactcaggacagatgcaggggattggggaggggggagcacgcaggaggggagggttggaggaaaagggtgtaccttggtggggatgctctaggaagacggggatgggagtgtccctccactgcctttggaattgaaaccgggtgagcatccaggagtcagcctcaccatgggtgaggagcaatgccaagagggcgagggagggaacagccagcacagcatcagagagtgccagctttaaagatcttgctgcagcatgggag

SEQ ID NO: 59112 - DNA, 585 bp, Bovine  19866881677162
ttcatgaatataactacatttatacacatatacaaccttacacattatgtacatacaacagcatttgtctgtgtatacatctgtgtgtgtatttatgctgttctatgcttagtcgctcagtcacatctgtctcttttcgaccccatggattgtagcctgccaggctcctctgtccatggggatttgccaggcaaagatatttaagtgtttcagtcatgccctcctccaggggatcttcccaacccagggatcaaacccaggtctcccacattgcaggtggattctttaccagctgagctaccagggaagccccatgtgtatgtatatgaatatgtaaatgtaaatacacacacatatgcatattcacacacacacctacaaactgcactctcaaatatattggtagctcagccattatatgctgattgtgcagtggaaaataagcacttattgtaccatgttagtagcgttgtctttgaatacaaaggatggcatgtcactgcagatcatttcaatggcaatgattgcagactatgcccatcctctcctttctgattaatgagtggatgctgtagcgatctccat

SEQ ID NO: 59113 - DNA, 736 bp, Bovine  19866881480260
tagtggcaagcagggaaaagggtggaaaccttatgacctttgcccccaattttttagaacagtgataaaataaatagcatgaaattattttaagtgtaccagtcagtgatattaagtgcattcatattattgtacaacaggatgtggaagatataaagaaaaattgaggctcagagagggtacataccttgctccaagtcacacagcatgtgaataacaagattgggccttgagggtttctgcctgagctgggagctgctttcattagaaatgtggccaagtggggcattttggtagatggagtggggtcttaatattcccttcatctcaaacagtcaggaaagcccatctacccacgggatgctgccaagaaatttccacccgaagctcagcagatttcatattcataccctggctagcctcttctacccccaggatctctaagatgctgggaaaatagaaatgactcaaaaatgagttactttaattggatttcccccagtattggtatgcagaggttatcgctgggtgatttactgagtggcccatctcagagtttactgtggcatcccaagtgtgcatgtgtggtgtatgtgcgtgcgcaagcacatatatggatatgtgtggtgtgtgtgcacttgtgtgcttctctgcctggtgtgatgtagacgcacatacttctgtatggacatacatgtgtgtgccccacactttcagaagtgtcacagactgctct

SEQ ID NO: 59114 - DNA, 1126 bp, Bovine  19866880739274
ggttataaaagataagtggcttctatataatctctatctctttcttcatcacacattctgaaagaaaccggttaccatgtcatgaatagactaatgaggtgaggaactgaagcctccaattaataaaatgctaaagtatctagtcccttcagtttatacatgtgactaatcgtttatgtcttttccattaatgttttcatagatctgcattcaatgccactgtttccttaataataataatacaatagttacccttattctttaaaataaagtaacatatcttccccagtatattattacactctgcattttctaatgctactatgctacctttatcaacataagcactgatggtctttaattttaaagtagaatttaatttaaaaatagtgcctatttaagatagatgatttttgagtgtgtgtgcctgtgtttgtgagtataaagtgtagataatattctcaactgtaaaaaatagaagcaatttcttgtcatatatatttcatctttatgtgaaactgtttacacgccaaggtaaagaagaaaataaaaacaagaggaatactttagttaatgtcaaaactgtgtaaattactcatttacaacacatctaaattttaccataaccaaaaatatcctagattaccttagaagaagataagagctagttaagcatttaatgaagataaaaataggattgacctacaaaattagtgagatgatgatggagataagaagttatagttgctgctttaatgagcttttcaaatactcagatgacacagatctattaaagcaggtatcacaaagtcccagtatcatttaccctagctttatgagtttcatgactgagctaaactcaaattttactctctttgctatttgtcactttcatttttaatttgcaagctctaagagataatatttgcaatattaaattatatgtttccctttttaatgcagaaatctgaaataaatttaacagtccccaccccaaattaaatacgctcattaacatctgtgaatctacatgatctttgataattttgcatatttttgttcaaaatgaaaatggcagttgggtaacatgttaagtgtaacacatattttcagttaaggataccat

SEQ ID NO: 59115 - DNA, 1066 bp, Bovine  19866881023078
agctgagtgcatgattattccttttatgttggtattgttattaatagttcattattcattactccagtaaatagtgtttgtcatttaatattattacttcatgcacaagagaaaattttctgtctggagtctgtggtctgtttcccatataccaatgaattatctatctaccacttgaaaacctgggtatgaatgagtcactggggttaaaatctatagaaaattaggtgtaggatcttctttacctttacaaagacttctgctagctaagaaactgaaatgaaattattgggtaatgtacaggaagttctttataaaattgatcattggattatgcctggtttctacatgggctgtcaaatattaaaaatggcttaccctttttcttatatctctgttttcaagtcactttcacattcactgtcttcagtgatcctcaaagcatctctgtggaaagtgggtaactttctcagttgcacaactagtaattggtttttttagattaaaatttgtttcctgtttcctatattagaattttttctggacctccactttgccacactatcagaccatttcactaatcattgttttatacgcaccaagaaattgtttcctccttctccataatacaaatgcatgtattttatgtcatgttctggggccaaatttgttttaaaacaataagtaaaacatctgatataggtgaaaatcctcatacctcaattcatattgcacactctatagttaatagagaccctggcctaattaccagatgtttgaagatattagtttcaggaaaaattgtctcttgacacactaattgaattgggaaagctaaacatggtatgagaaatactttcaatgttgctccctacaatgtcacacgaacaatgtgaaatgaaacctgtaatattcaggaaagcattactgtttaagacaggaatctccatttttagttttcaaaagtagtatatgaaaaaaatatgtttttgaaattgttgtatttgaagtggatatcctatttagaaagagtgaagtcgtaggcacattacaaaatatcagtgca

SEQ ID NO: 59116 - DNA, 1358 bp, Bovine  19866881106745
tggcagagatcttgatgataagagatgttgatgcaaaggaaattttcaaaattccagatttcataatatagtcatttcaaaaatagaacacacgttcacaggcaaattctgactatattaaagcctttacttgtgggaatttcttcttttcagagaaagagaaagagacatatttccaagtgtttcatgaactgatattaaaaacaatgtataataaattgggtcattcaaatgatatattcttttcactttcagttttataggtccaaacctgaatgtaaaacttagagagctataagatgaaatattttgattaatcagttttttttctaaagtcaaaaattatttccataataacttctgaagaatctgctttttcagtcttccagaacaaatatcctatttgctttgtggaactcagtgattaactaaactaatacaaacttcctgttgactctacatatagcaacaatatattaaataaactacctagcaccgagatacatacacttataaagtttatcctttctttttgatactttgctggtgagaaaaaagtaagaaaacagcttaaagtcttaaagatagaaagtggctaaagatgtatgtatatggctctaaatgacctttgaattgagtctttctcaattaagagtcactcatatattgttttagaataaaacaaggacaaattatggggtttatttttaaactaaatatgttgaatttaaaggaccttattaattttttaatttaactctcttctcatttttctatgtagacatttatttgcttttacagtgcactagggttttgtgtgtgtgtgtgtgtgtgtgtgtgtttttaatgcactcacttgttaaaataacaattgagacagagtaaaagggcatttctctgtatttattctgtgtagaattatgaactttccataagttaaagttctattctaagttttgtgaactggtagatctatcatgcttttctttttggagccatccttgttaaaacatatggacacaagagagaattacagaggaaacttgttttctactaccagcccccccaaaagaagatggccaacccctcctgctgtgtagactagagcacactgaattctaactggcaattcacaaaagagctttctgtaaataggagcttaacatttaactgccaacataagaaatttagagtaaattgaattttctatggcctcccaggtctagcaatgggaatcaacaagctgaagaagccacatttagctgttgctaagttacagtgaataccattgtaatgtacgtggatgtacattattccaagtgctgtcattaggcactgcggtatacaaagaagaacaa

SEQ ID NO: 59117 - DNA, 817 bp, Bovine  19866881578146
catctgaatctattaaataggaaaaactagcaagagttgatagggcacaatatttatgtgcttatatttaaatggaattttaagcactattaatagagcactattttcatgtcacagtttagcttaatggaatagagtcagttatgtaagagcactggtagtgtgtgactgataactagcgtattttaggaataaaaataaattgtaaggaaatttttgtaaaaaaatctgttttgaaaggctgaaatatggtgatttaaatgaaaattctgtagtcataatacttatatctggttagactgagtacaatttttaggaaaaggagactgaatcaactttgaaagtctcttaagaaccacatcacttttaatcactgaaaaaattataggaataagttactgctaatgagttcaacttgtataatattctgaagaagttaatattagcagttttgagtattattaagccaaatgtatacagtcctgcaaaatctgtgtgatgaaaacatatctgaatttaaaaaaaaaaaaactattagtcctgagatgctgaaaatcttaccttgttaatacaccctgaggatggtgttaggattgaagtttagttgtactcatctgaagtttccaatttctaagttaatgaagagatcccaacagcttttctgtaatgtcagtaaagagctttaatgacaagagattaatcagtttccaaggcagcaatctttggggatatctaccccattaagacaaggaaaagaagtggcaaaaatttatgtcattaacaaacaaaacaaaacaaagaaaaacaggcgagagca

SEQ ID NO: 59118 - DNA, 1697 bp, Bovine  19866880420587
gaaaccaaatcatggaaagaaatccccaaggagcatcggttagaatacccttccgatgtacacctttaatcaagattcaaaaggaagacagccagttccctttggaaagttttatgtaatgaaatcaaccctgctttgtactcccagactaattattggatttattcttcttactcaatttattgctaggtatttgggcatttttcattaatattctttattttactcaagaataatatataaatagtaataatgatctgacctgacctggtgtgagaatgattttagagctaatattaaagactaaaatattaagggagttttgtgtttcttaaatatatttaactataaagagacttttctgatctattttgtgtatcattgtgggtctaggacttgtaataataaagctgtgtgcccatgtggtgactgtcatcctggaaagaaaaaattgggttttaaagcctcatggtgataaggcggacagtaatgcctgtatgttccacctaacgcagcataaacattggcaagtttaatttctgtttccacatcagagtcttccgcctttcaccatcttttccattcactcacactttgtgcttccctctcatcactcattatttccacagatatttattggtaccatctatgaggcacactcggtgcgaggaactaggggaagcagacaaaagccacagtgctgtcctcagtgtgctcccaggctggaggaggggaaggacctgtaaacagtgaagtcgagcagatgagatgtgaaagcacagaggagcaggcattaattctgcctagggtagaaaggagccagagaacagtttacaaggcagatgcttttgcaaggatgtaacatatttcctgaatgaccagcttatgatggagggaaggaagaagagactgggtagatggttgagattcatgacaaaaaggtctttgtacatgaaacaaagggatttggatttaatgggaagccattggaaatctttagcaggagagtgacataagcaggtcttagaggggaggaactgagagagaggagtctaggataaatgaaggtggggtgaggggaaatcagtagagggggccacttaggatgccactggtatccaaaagggtgataagggactgatgtaaagcttgagcttgtagggggaggaggagggggaaagaagaccatactccctctaattgtattccttttaaaaatttgattttttattggaatataattgctttacaatgttgtgttagtttctgctctacaacagcttgaatcagctatttgtgtgcgtgtatatatatcccctccctcttgaacatcgctcgccagccctctatgtcatcacagagcaccaagctgagttccctgtgctgtacagcagcttcccactcgttatctcttttacacatggtagtgtgcctacgggcttcccaggtggcacagtggtaaagaacctgcctgccaatgcagaagatggaagacacaggttcaagcttaggtcgggaagatccattccctggagtaggaaatggcaacctgtttcagtgttcttgcctgggaaatgcctggacagaagagcctggtgggctacagtccgtggggtcgcagagtcagacatgactgaacacacgcacaatgtgcgtctgtcaatacaactctctccgttcatctcccctccccttcc

SEQ ID NO: 59119 - DNA, 1765 bp, Bovine  19866880452391
gcccagtgcagcccaaaaaataattttaaaaagcagcagcagctccaaacactctacaattccaagatgggccactgaaagcttggcggcagcacaatgaacctctttgatgattatctgttgcctccatacctccctccttcctaatcgcagggattcagaaggtcaggagaccatcctgtttgtctctggggcctatggatctacatagtgcttggcttattggaggtccttgaaactcaattgcacagatgtgcaaagcggatgccgaccatcttaaccgtagccacaagacagatggacagtggagtcagttctagaactctgacctcacagtccattgattttttgcaaccacttggtgtcagaccaaacagaacaaagactctgatctcatccaggggcgtatgcattcctttccaaatccgtaccaaacgggaactgccacccgacacagagcatcccatgtccccatcctccctctcggcagcggcatccacactttcgcatggagaagcagacacaacactcgaaacggctcttaagacactttcctgctatgtgatgtataaacacaggaaacggcagctggctgggttgtgggtaacatttatttgccagtcagggtgctagagctctgtgtgtgagtttcaagcagtgatccaggaatgaaaataaaccagtaaagcagaaactgaggtgtcctgattgtggttctaatggaaaaactcagattggcaacccagctctgccatttaaatgcatgttagataaccttctaagctcccattttctcatttgtcaacaggtctattaataataggctttcagtgaagagtgacttagtgtttgcaggagctgaggctagtaactggcacataaaggaggattaaaaatggtatttaccatcatgttccttgcagtttatccaaagcagttgaaaactctgtccacacagaaatctgcacacagaggtttacagcagtttagtcataattgccaaaaattggaagccaccaagatattctttgttaagtaaatgggtaaataaactgtggtacatccaggcagtggaatgttattcagggttaaagggaattgagtaatcgagacgtgaaggaacattaaatacacacacacatgcatgctcagtcatacctgactctttcatgactctgagaactatagcctgccaggctcctctttccacagaatttttaaggcaagaatactggagtgggttgtcatttcctcatccaggagatctttcccacccaggaatcgaacctgtgtttcctacatctcccacattggcatgggattcttttaccactgcgccacctgggaagccctcattaaacacatgttagcaagtgtaagagaagccaatctgaaaaggctgcatattgtctgattccaaccagatgacattagggaaaaggcaaaactatagagatagtaaaagatcagtggtttccagaagctgcaggggatggagatagataagcagcaagtggatcatagaggatttttagggcagtgaaaatcctccgcaggatactacaataatggacacttgtctttatacatttctccaaacccataaaatattcaacaccaagagtgaacctgaaggtagactacaagctttgggcgattatgatgtgctgggctccaaaatcactgcagatggtgattgcagccatgaaattaaaagacgcttactccctggaagcaaagttatgaccaacctagataccatgtt

SEQ ID NO: 59120 - DNA, 1691 bp, Bovine  19866880542294
tgttttgcatgaaatgttttcaagacttgaattcatttctaaagcaaataattttggtttttaagtaacaaacaggccatttctcctcatgaggtgtttgccagtctctttgtggagtgtacactgtagtgtatgcaagccacgtgtgatgactaagggcaaggctattactgcccttgtgtatactgtagtctccacgggcatcaagatgaaaacacaggaaacagttaaatggtggttcaggccttgtgagggaggaggccaacatgtgccctaggaattcagaggagggacatggctccctgtgggcaacagtcgtcaggacaggtcttgaggtggaggagggacatttccagtggaaagtcacaaggaaagaactggtccaattctcagccctccatccctcccactctgaccaccctacgttccttatgagcagcaagtgggctggtgggtaggtgctacggtgttagtgtggacgcaaccctgtgactttggggaaacctttatgcaactcagggccttgaggtgcatgtcaaaaggaagatctccttgtgaaaagccctgcgacgtcggaaactgtgagtattgcccaaaaagccacctgaaaaggcttccatcccatcaggtcaccagcaatacttgccgctgcaccggccttgcacttgttaataagacttcattttattgtttccatgctctgtaatttctcccatggccttttagatggaacagttaactttccacatttgcgttaattacatgggggagcctccaggctacactgcacaataaaaagaccaactagatcttttcccaccaccatctttttgtttctttataatccaaacacaatggatcctgtccttagaccctcccgagaaacaaccagatttgttaatgccttcgaacaaagatgcgaagaaattcaacgcagatggagcagaatcacacagccatgcagatttgtacaggcccgcgggctggacagaattaatacactgggagctggaaatttttaatataaaacagaaaatatcacctatggcactaaagttccttttgtgatgagacatgatgttctggttaaagtggagcaaacaatctcccagggcctgtccccaaggcacaaagccccttgttaggagcagtttacagttttccccaaggttaagcttcccctcacctgtcaacaataggcttccaaatcacttttcaaactgctacctcaagatcaggagtaaattacaagagctaacaggataaacacacaaaaacttaaattgaaaaaattaaacgcaaaaaaatgtggtttatcttctaaactctaaagtttaacaaacaatccttaacttagagaaagatttaaaaaacaaaaaagcatccaccaactgttaactctggtcagggcccaaaccaaagtggagacaaagttctcttgtccactcagcactgcagcccccacacttacttccaggtcttgaggagtcagctctcaaaccaaatctgcagaaaatcacttctggctccccagctaaccaccgaggactaacttctcactcacacagcagaactgctcaaagaagcatcatggcgggtatagggtcttccggcttcccaggcgcatgcgcgctgggcgttctctaacaaccttgcctgattcctaataccgcacacttgttgccgggctg

SEQ ID NO: 59121 - DNA, 1515 bp, Bovine  19866880888543
tgattgggttgatggagaagagagaggaatcacttggtgaagatgtttaatactcacatataaggtcaattaattctccatcactgttggaaagaggcaagatagtgtcttgtgtggtactctgattcctatgcgtgcctagtgtgggctgtcagccttaaaaaggaagggttaagaaagtcttctgttgtttttcactctgctgcattcacattctctataatgagataatcagataaggagagtggcttgggcacacatctaaagctggctggcccctgggaagagaggtaaagacacataccaaaagactgcaagggtttccctgatggctcagcggtaaataatctgcctgccgatgcaggagacacaggtttgattcctgatccgggaagatcccacatgacatgaaacaactaagcccgtgcaccatgaccactgagcctgtgctctagagcttgggagccgggaagcccaagcagcctagagtccacgctctgcagcaagagaaggcaccgaaacgagaagcctgcgagtgacaactagagagctgccctgcttgcctaaactagagaaaagtggcgcagcagtgaagacccagcactgccagaaatagataaattaataagattactaaaaaaaaaaaaaaagactacaagcacagattcacctccaggctcaaattccctcaggattattgttgtttagttgctaaattgtgtccgactcttttacgacctcacagactgtagcctgccaggataagctaagctattataatgggaatgaatcttaagtctacaaacccaggtgtgcaaaacatatcaaatttcttaatttcctttaaatcaaattgcttctgactcaaaatcgctaatcaatttgctggcaggaaattaagctgcagtcattactggagttcctctccccaagaacatacacaggtccaaaggtcaccagtgctaaagcactggcgaggcccttccggtcactgtctgctgagtagcccagtgtctattagtttgtcccttcaggaccattgcccacctgtctctacgctacatgcagaacacaggaaaaacttctaagacttgagatctcagttattggggttcagcctctttaggttcacattggaagcacattacaagaagcatctgatacatagttggagcctcgaaggcttcttgaaagaatgctctttctgctaaagcattctgctttgtctgttagactcccttcttcttctcttgaactagctaatcaatttttcacttttttccctccccttctggtcactccagctctggtccctcaggagtcatctggcccactgctcactcactctgcagcttgctggtatcattcctgcagagataaagtaaatacctccaccatgcaagcaatacattttttccctagggaaaaagtattatagaccttccttggtgggccagttgttaagaatccacctgtgaacgtaggggcatggggttttgatccctggtcgagtaa

SEQ ID NO: 59122 - DNA, 730 bp, Bovine  19866881066657
taggtagaaattcaaagaggaattgagacagccccaaggatcctgagatacctacatcagagcaagatgctgtactctcagggttaactgagttttttacgtaagatctacatgaattcagagggaggagaaatccttagttttgagcaggagcatgataatgtataagcagtaaggcctcgctgaatacttcgtacacacaactctcctgactaatctcaagaaaatgtgtttgtattttgatgtgaggacttgctatgaacaaggttatgggacggaagaaacagacacgtgccagatgtcaacaaccagaggaaacgatgggaccttccactctccagagtagggacagtaaaggcaaggagttggaaagacagaaagtgagcaaaaggtaccctgctgggcaacatgttgaggaaaaatagtgccagtgactaattctttttttttttaatttggttgctttgttactttgtaagttgcttaaagattactcaagcctttgataagttcccaacatatccaattttctaccatcacatcttcactctatcttttccagaatttctggtcttccttagagacagaagaatattttgttttaatatttatttagctgctccaagtcttagttgtagcacaatggatcttcaatcttcattgcagcaggcagcatctgtagttgcggcatatgaattcttggttgcggcctgtgggatctagttcgctg

SEQ ID NO: 59123 - DNA, 1837 bp, Bovine  19866881230787
tccctcaagcctccacctgggcttcccttgcctgtgcagagacagcactgagctctaggggagtggtgtgcagcacaagctttctgtgtttccagagcccaccagttccacctcccaaattccccaggatgcacttcctggggccaactcccaccctcatcacttctgctttagtacctttactgtcccagttgtggcctggccaaggtcggctactattaactgcagctcaagatcacagagttctggaggcaaaggttggggaccctacaaccagctggacaaggatttcacttctggctccaccacttttcagatagggagcttcaggtatggggctacatgtctgagccttctccttgaaaaatgggaggaggctggagctgcccagcagaggggtggggacacagggggagaaaacacacgcgaaggacagcagcaggcctggtgtggcatcagcctgcaaacctcggcccccaccatctccccagctcacagcacaatcccgggcttgttcttcctcctgctcccagatgtcttctctaaactgcattcataccttctaactttacttctgttagtctcaccttcccttgttgtggggacctggaagcccagactgtgtcatttactatccatcatcttacatctatgagtgagaattctctctcaatcccagacaagtgaatgaatgaatgaacacaaacaaaaaatggcttcaagctccagttttctgagaccttgtgataatctcttccaagtctctgggagaaaaagctgggtggggactcaaattccccatttgcaaaagccgtggactagagaattccactcaggatgccagcagttcgtggtgaccgctgagcacaggcacgcacctggacacattaaccatcagctgctgaagttattttcaccatccttaacaaggaatcgaagcagcaggacacacaatgactctctagtccttcccacacccacacctgttggccttctccttctgagttactgaagttaaagctcatgtatcaggcagcacacatggccagctctactgggactgatctgtaagtgatgaatccctgctcgtccctgacaccttcactcctgaaatcccatcattcccaaattcttgtggaatagatagcagtgttgccctctgactgaagcttctcttcaagcagcctacattttacagtaaacaccaaggtctggtagacaaaaaagcagaccccccaccagaaaaaaaaaaacaactggcttaaaactcagcattcaagaaactaagatcatggcatccagtcccatcacttcatggcaaatagacggggaaaaagtggaaacagtgacagactttattttttggggctccaaaatcagtgcggatggtgactgcagccatgaaattaaaagacgcttgctccttggaaggaaaattataacaaacctagacagcgtattaaaaagcaaagatatcattttgccaacaaagttctgtatagtcaaagctacattttttccagcagtcacgtatggatgtgaaaactgtggtgctggagaagactctggagagtcccttgtactgcaagattaaatcagtcaatccttaaggaactcaaccctgaatattcattggaaggactgacgctgaagctgaaactccaatactctggccacctgatgtgaagaacaggctcattagaaaagactgatgctaagaaagattgaaggtaggaggagaaggggatgaaagaggatgagatatatagcattactgactcaatggacatgaatctgagcaaaatctgggagacagtggaggatggggagcatggtg

SEQ ID NO: 59124 - DNA, 986 bp, Bovine  19866881411478
tagctataaatatttggtgcatggattgggaacagtgagggtgatgagacagcaaatgaggagtgaacaataggaactgcaggtgaagagagccaagcagacctctactctgagaaatagcatgaactaaggagacacgcagagtgcttacacatgtgcatgccatggcagataaagacgatcatgtcctcatctccagaccttacacagcaaaaaggacttcacagaagagtaagccaaagatcttgagttggaaggatgtactcataatggtttgtaagggaaagagagagggagaaagagaccgatgggagataagatgacagaagcacaagttggggtgatgcattttgaaaacggaggaagcggccactagccaaggaatgcaggtgggtctagaagctggaaacatcaagaaacattctctcctagagcctccagaaagaatgcatctctcttgaaatcttgagttgagcccatactgccctgttgggacttctgctgtccaaactttgagagaataaatttgcattgttttaagcccctgaacttgttacagcagcaataggaaactactatacatgtttttggtcacatgtgcttgagttcacgaaatctctcattttcacaaaagacactttctaactcattatgattcatgtccctgcttcctaaaaaaggtgaagtaaaaactcaagtttccagaaggacatgtttaccctgacggaactggcctctcaaagggcttctcatgttccccactgtgaattagcttctctgggagaacggagcttggttagtgaagattagaacaacctaccagaagtcacacaaaaccaacaggtcacagactttctggaaaagcctcaaagtaccaggacccaaccattgataacaaatagtagtatcgctttacatgtgcctgcctttttgggtttttattacgtttatatacattgctttatttgattcatccaacgtataaa

SEQ ID NO: 59125 - DNA, 5110 bp, Bovine  19866880493873
gctggatagaaggtatgtctgtggtatttctaactttttgttttaaagacaccttacaacagagcaatttccacttgaaaagaaatgcttacacaaacaaaaaagacattttctgagatgactttgatcccttactcaaattattggcttaaagattttgtatcctcaataactgctctttattgtccttgttcagctattacttttcaacttatcatttattaaccttttctttgtaagtaaccacacctggccttatcaaaaaaaaaaaaaaatggtgcaacaaatacttgtcttctgtggtaatgggtttccctgggggctcacaagaacccctggagaagggcatggctaaaagaaagctgagcaccgaagaactgctgcttttgaactgtggtactggagaagactcttgagagtcccttggactgcaaggagatcaaaccagtctatcctgaaggaaaacagtcttaaatatacattggaaggactgatgctgaagctgaagctccaatactttggctaactgatgcaaagaactaactcattggaaaagaccctgatgctgggaaagattgaagacaggaagaaaagggaatgacagcagatgagatggttggatggcatcagtgacgctataaacatgagcttgagcaagctctgggagttggtgatggacagggaggcctgccttgctgcagtccatggggttgcaaagagtcagacatgactgagtgaccgaactgaactgaactgaacccactctagtattcttgcctgaagaattccatggacagaagaaactagtggctccagttcatggggtcacaaagaatcagaaatgacagagcaactaacactttctcttttctgtggtcataagacacataatttagttcatctaggctatctttccatgagaggtgatcctgttattaaatgccctcacagtaaaaggaatccatgccagacacctggaaggcagagggagaaccacttacccagcatgtcgctgcttcagaccaaccttgacatgactgtgtagacactcctgccccaggtgttcctcatgtttactcagcctcccaatcacaactgtacctttcccttacaaacatgacctttcacttaagataacaggacacattgccaggctgaaaggatcaccctcagcccctgtgaaaagaccttgagaaacagactctgtgctcctcctgtgagaactctgacaggactgttacattacctggatgaaatcaagaaatgtcaggggcagcaagtcatccatatggccaatgtctttagagaaacgattcaaaattcttcctgcaagaacaggacacaagaaattacttccccagataagccctttaagagaaataattcatgaacaaactaaaacaatatttttaaactatatgcatttattatagcgtcatatgaaataagctgatgtcagtggtaaagaaagagaaaataggatgatatctaaatagagataaaattctaccaaatagcagtgggtgggatgttgaaattgagccctgatttttaaaagaatggggggaatcttgtggcagcatcaagaagagttggtggatttgagaatcttctctccttttagatccatcctatctaagactcattccaagtgctaagtcagtgaataaacacttgcaaaatacttcaattaatcccaatcattatactaattttgctttagttatcaaaattaattttgacgtgatacttttaaaataaacactattataatctctctgtaattttttttcccccacaaaatggttcccaacaactcacctttcaggaaattgtagattcctgtcgtcttcatgttgtgagtttactatcatggtaatgtcattattttcacaggtgtacccgatgtgacaaacatagactcatgcttaagcatccaagaagaccagagggacgtaggcaggaaaatggcaatattatgtaatgactaaagatcacttatcattattgattttatttcccttctcaaaatccactaaaacagtatatcctaaaggctgcaagactggaagattagaattgatttctaatgaatatctagtcctttcatgatcaaatttaaagaaattgaagctacacacatgcgtgcagacacacacgactttggtatagcaactcctgttacctagacccctgaatttcttttataactgagactccaggaagccaggctgcaggtgagacgtgggaacctgacctgctcttcctgacctctgtcagagatgacttcctcccgaggcctgcacagcaagccatagcaagaccatgaatgagcagcagctgagggctgaatttatgtggcctgaatgtggctctgcttcctccacagggcatctagctggcagaagcacagggtgtgcccatgccaggagctggagctgctggaatatttcacccttggccaggccatcacagcctgtgtctcaattttcctttctcaggtttaggaaatacagactccagaaactgtctctcagtgacacttttgcaggcccagtgacaacttttctgagcctctaggaatgcctgctttagagggcaaatctcaggatttaacaggctcatgcaggtgaaaaaacccagtcatgatgccacataaattaccaagtgctcaaccaccaacgtgagatgatgactctgagccccaggttctgcagcatcacgtctcctgggaaagtccaccaggagctgcaggaaggtcaacctggtaaaatgcagattctgactcaggagtgctgggggagccagagagtctgcattccctccaagctggcaggtgacgccctttctgctattgcccaggcggttttgaggggcaagaaactggttattatttaatcagttgtgcttcaggaacattaaaatcagatgggcagttttgcagatactcttacaaaagttgtgaccactctggtcatttttatacttctcaaagtagcaatttttaaataaagaaaatatatgtcaaaaatatttaaaatgtggtttaagtgcttgtaattctttgaaaaatgcaactttttaacactggcaagattcagaaacactacaagtatgatttggcttagaaagtgttgaaggaagtattgaaaactttttaagattaaatgaacagtgtgtaagactcagcactcagctaggtgaagagcctttcccctatggctacagaggcactgggaagaagtccaccaatagctgctttgaaaactatggagacaagtttgcagagaatgatgtaattggctgctttgcatggctcagaggataaagcgtctgcctgcaatgcacgagacccaggttcgatccctgagttgggaagatcccctggagaaggaaatggcaacccactccagtattcttgcctagagaatcccatgggtggaggagcctggcgggctacagtccatggggccacaaagagtcggacacaactgagcgacttcacacacacacacacacacacacaccactttatctttctctggatatgtgaaccttaaggtctgagagaccaagggttggcaaagagtgcaaaatacaagaacagaaacaatgagaaaaaaacatctccccacacggtgaccacacaaactgaacctaatatcaaagctcatcaaaaaactaagcacttattcagcagtgagctgagtgtaaagtaatgtgagatcaggaagttcaacagtttcttccttgctctaagaaacattaagagaacatatggtgtttgcagaatatttcctctggctttgggatagactgggcttcctaagtggctcagtagtaaagaatttgcctgccaatgtagggagaagcaggagacaggggttcaatccctggtttgagaagatcccctggaggagtaaatagcaacccactccagtattcttgcctgaaaaatcccatggacagaggaacttggtgagctacagtccatggggtcgcaaaaaggaggacacaactgagcgactgagcacattttaactacagctgtgatttcaagcccacagccttgtagtaataaagttttctcagaagtctccaaatgaaatattaaatccttatcatgaattcctttctcatatatgccataactcttcatccaaataacatgaggcccctgatggaagatctccagggatgtagagggaagaggaattcagatgaatggtgggaacacaatccatttttggactgttctgtgttcgaggatttctcacattaaactgaatcttgtcttcctggaacatccctacttattctgcctttatagccgcacaaggtgaatctaatttctcttgatatgacagcctttcaaatacttgaatgaaatgaatcatattctttctagcaactattccttggtgcctcaatgctccctcataaggcatggccctatattgtctgcagtctcttgaccagactcagagagccagtctcagctaatgccttgtgcccaagtcttgattactttagggtaaagtggtatcaccacctcccctcgtcctgcatagccggtcacaaagctacaaccacagtaaattctacaggccagatcacttccatctgtaagcacaggtcgatttttgggaacaattgaacaatatgtgtaaatcattctaagagtgcatcccttctgacccagaaaattcatgtctgggattacatccccaggagtcagtaagtgcatcaatctgttgaatgtggcatatttataaagtcactagtagaaaacaacctgaacaagtctgaaacaagtctgtaatgtattacgcacaattttaattttttttctttccattcttatttctctacactgtattacttgtgtaaaaatgtaaagtagaggggggacaagaaggaggagaaagaaaggggtgatatggaggatcaggggaagggaagagagaaaggcagagagaaacaggggtagagagataaccccccttgaagaccatgacatccaagaaccaatcaaggtcctcctaactgctctggttcacagttttctgtcttgtccataagacagaatatcacaaaagatgccattgaa

SEQ ID NO: 59126 - DNA, 797 bp, Bovine  19866880541216
tgctggatgaaggtgaagcctgggaggacggaacagtaaggctctgcccgctgcccaaagttgaactccaccgcacagttcttcaccaggacgtgagggtagagggcctgaccccctaaggcttccttctggattcggaaggcaatgcccatccacttcccatttttggtgaaggaaagttccacgtcatttccacattcaaagtcctaggggaaaaaagccaaagaaaggtaagttccaatgctccaatgcataaggtaccaggaaccatgagtcagggagcagatgtaaggggtggaaacagcttgcgccccagattcaagtgcagccctcctcaacatataaatgtgtctgccagccccaaggaatggctcagaccatatgcagcccaaggccctctttggccataacccagaagtgaatgtgaagtgtgtaacgttaggaagttccaagtatttgaatcttgtgcctagcctgagatggactggaagctgtcctgtccattctcaactcccacaagataatggatggaaagaaattcacagcagggcctgttaagtcaagcctggctccacaagtgcatccatttatatgttcaacacgtgctccctgagttcccgctcttcttgatgcacattctagtcatctgagcctgacaagcgttcagagcctagtggggaaccagacaaggacattatcctaattcagtgagaacacccatgcaggatcaagattctctgaggaggaacctgtaagccaagtcctgaacaataaatggggaatgagccaagtttggg

SEQ ID NO: 59127 - DNA, 1252 bp, Bovine  19866880602164
cctggctttagaaatctagtctctccctccattgtcttctcacacagctcatcacttccaacagtaaaacatgtcattacatttgttactgctgtgttcccagtacccagccaggtgtaatgaaaagttgtcagtcgatgaatgcatgctcatctcaccttcgtgcttttgtaggtgctggtctctctgcctgaaacactgttcccctaaccctgagtctcagctcagactccccatctttcaggaagacctcctggacaggctgggccaggtgcctcctccgattccaccagtcccagggcttcctgcaggccagccctgatctttctggactgtcactatctagtgacaagtctgtctcctcctgacctgtgcgctctgggaaagcagggccgaggctgtttattcactgctatgttccctggagcacccagcactggcctcctgctttcaatcttaacacagagactcgtttgtacattttgagagtttgcccactaattcccagtgtctcaaacgctctcccttttcctcccaaccctgcggcttcccctggagcagcaataactctactacaaccagataactgagtgctgactttgagcaaccttcagtaataggtaataggcactgttatcattccattttacaaatgaggaaacaggcccagagaccctgaaccacgcacagaaggccacaggccaataaatggtggcaggctctgagtgaagggacccagcagcctccagctccccttgtgactcaccgtggctatcaaaggtcccgtccagcgttgccaccgtcccccgcccgctgaactcctcggcctgacctcccagggcctcctgcacagcctcatgcccaaccaggaccaccacgcgccgccagggtcccaggtacacggtgaacactggtccgtacttcttactcagctgggagcagggagcgaggagcgtgagtgatgcggggcaggctgctgcctctcaaagtctgtctccatcgcgaccccttgtctctggatgaaccacctaagaggaaccccttctgcttctgcctcaccccaaatggaaacagtgcctttgggagattcagttcttgttttgtaccaggctcccagccccctgcccccgaaagctctgcatccccaaactccatcacccaacacactctctggtccccatccccttaccctgcagagccctaacttctgatgccaggatgacccaagacccaccattactcccacaactca

SEQ ID NO: 59128 - DNA, 1358 bp, Bovine  19866880672548
gtatgcaccttcagggaaacaaaggtgagaagcctttcaagataaaacaaggaggcagtggcagaaccaggcccggggctggggaattgagcaagcagtgctagctggcgacaggctagcgggatgacagagggaggagtcagtgtcctcagggagccggcagtcccagggagaggtgtggccctggccctgtgcaaggtgagcacaggcctgagtcagacagccagccccagctcagtttcctcaagtctctcctccccagggcccagctttacagtcagccagccccacctctgccactgaccctccattatctcccatctgtgaagtgggttcacagtgctcctcttcccccatctgtgaagttatctgcccaacgcagggccacacacatccacaaagctgtctagaaatgcccatttctgggcctctgcctcttgcacccaaaccgcagccacattccaaggctgagctgccgaaccaaaggctctgcctgctcggggctcctgcacttgttgagcctcaaatccaagctcagggtcagaaatgaggtcaaagccataggctctggagtcagatgggcctgtgtgtgaattcagcctctgctgccttccagctgtgtgaccttgggtaagcgacctcccctctcttggccttggtttcctcacctgaaacatgagaccaggacccagctgctaggggccttgagctctagaaccacatggcttgggcttatgtcctggcactgccagttactggaagtgtgagttgtccgtgctgtataaattgcctgacacagtaaacgctcaagccgtgtttgctgttcctacaagttgacatctgtcaagcagactaggagagggtgtgtacatggccatcggcaaggagggcaatcagtgagattctggaggacttcctggaggaaaggatacagagccagcatcgctgacgacctgcagtaccacagttatggaggtgcgggggtgcagcgctcccagcaccaccgcttcgcatgtgtttctgatcagccgctcccggctcttctccgctacgcctgcggaaatcaggggtgggtttgggctgtcaggctcttcctgtccagctggctcacctgtctccatatgccccacccaagcctccagaaaagggcctgcagtcttggcccgggaagaatttgcgggaatgagagaggagtcccagtgggagggaggcagggcctaactgccacccacttaatgcctgccacctccagcgcccaccaagggagcctcccaggggaggagaacctcagagctctcccatgtccagtgctgctgtccattcccatcccagtgcacccagccctggggagtgagggg

SEQ ID NO: 59129 - DNA, 1067 bp, Bovine  19866880745378
tccctgtccctcaccatctcctggagtttgcccaagttcatgttcattgcattggtgatgccattcagccatctcatcctctgacatatacctgctcttttttagattcttttctcatataggtcattacagagtattgaacagagttctctgtgttatacagtagggtcttattagttatctattttataacagatgttttaaaatttttcattcatttaagcactatactcagaatcaatgcattgtcttagcaaattatctcctagagagcaggcatggaaacattattttttttaaattgaggtatgtttgacttacagtataatgttagttttgggcgattctatagttttatagattataatctaagggagctgacctaacaggtgttttcctctttgtatgattttctgagattatgaaatttgcattaaattgtgggtcataggcatctcttttggaaccagctaagcagataagcagaaaaggttttctgatactccagtgctatgtggtaaagccagaatttaaaacaacaagaaacaaacaaagaaaaatccatgcacgtgctaactatttaaaaccatgtgaactaggctaatgtgcttttcctactgtgtgtgtgtgttggttgctcagtcatatccaactctttgtgaccctagactgtcgcccaccaggctcctctgtccgtgagcctccagggaagccttttcctactaagtcattacaaaaatattatttatgcttttcacagtagcagcagcaggcctatcgcccagaagtgaagacagagatgaagcaagaagcacccaccagcttcctcccacccgaagcatctcaacacaaaccagacagcaattccagagtcgcaagaggccttatgaagaaaaccggggacgagggtactttgagcaccgagagaataggagggggcgatctcctcagcctccggctgaagaggatgaagatgactttgatggcacccttgtggccattgacacatacaactgcgacctccacttcaaggggcctgagactggagtagtggctacccgctcacg

SEQ ID NO: 59130 - DNA, 661 bp, Bovine  19866880777369
tctttacagcagctggtcggggcaaggggcatctcccaagaggccctgagtgtgagcaggagtgtgagggcagcgagggagtgagccaggggacagctggggaaacaggaaaaaacgagcccagaggggctgaagtgatgggggtcatgctgctgaccttgaaccacacacacacatacatgcacacatacccacaccaaggctgagggatgaagagacctgctcaggtcccagggcaccattttcccatcccccacacaggtcacaatattaactgatttctctctcttccctcctagtctccctcttaactttctggaccccgcccaccactgcccagctcactattgaaacgatgcccccccttgctgcagaagggtcggatattcttctacttgcccacaacctgacagagaatcctctagcctatgcctggtacagaggagaaagggtagacaacagccagctaatcgcatcatatagggtagacactaacgcaactaccaaagggcctgcacacagcggacgggagacactttaccccaacggaaccctgctgatccagaacgtcacccagaaagacacaggctcctacctcctgctcattacaaaggatgatttacagacagaaagacaaactggacacctccatgtactccgt

SEQ ID NO: 59131 - DNA, 682 bp, Bovine  19866880783053
ccctgatgacctcaggtttctactgaaatgtcacttttttggcaagaccttcactgactgtccacttaaaactgcagcctgatccccataccctcctccttccctcttaattttcctgcacagctcttggaaccacctaaccctcttatttttactaattatgtttccatttgtctgctttccccactgaactgtcaatctcttgcttcgggtggtctctctaggtctagaacagtgccaagaatatagcaggtgctcgctaaatgtgaaacaagtgagtgagtgagcactcattccctgccacccactctctatcccctctcccatccctggagtgactgatctcccctctccccacaggccacacagagcccagtcctgggcattggggggagctgagctggacgccggtcctgcccagaccccaggacaaggcggaagcagcagagggaacgccaagggccttagatgctgacccccctgaggtggaggaccccggcggtgagtgccatgctgcacgcggtggctgccagccgcctgcccgtgtgcagccagcagcagggtgagcccgacctgacggagccggaaaaggtggccatcctgggccagctgtaccacgaggaagccggttggtgttcctggagcgcttccgcacgggcctccgggaggagcatctggcctg

SEQ ID NO: 59132 - DNA, 3136 bp, Bovine  19866880828284
ccttgcctgggctggggctcacagccagctggaatgaggcctcgaatgagtgccttgggagccctgccttctcctcccctgggctgaccttacctcttctcactgtggccagtgctggccatctgtcctggattggggggtgaagtcttctctattttttgttgttgttgccactggggatcctggatctagttctgggtctggtttagaactgtagggctttggccaaatgaaggggtagggatgaagtcagggtctctgtactggggtgggaaaggattctcattttctggggccccgttttcacagctcttctcacccttctctgtctcttgcggtttgtctctgaaattctgtacgtgtctccgctttggcctctgcatcttcttgtctcttttttatgtctctgttgctccccgtctctcttcctctgtgtctctgtctttcaccatctcttctgccccctcattttctttgtggcctttctctttgctccctgcttctctctctccacagtttttctcagtcgctctctcctcctgactgagtgtctgtctgtctctcacgcctccaagaggtggagtgcagtggacaggactgaagccagactgaggatcaaggaaaacttgggagaagggcagggcaggcaggaacctcactagacagggcctcagatgtgaagggtacccccgctactgcccacctccacttctgcctctctcctaagccccccacctgctctgattctatccttgtctctttacccccagaaactgaccacactcaactcctagctaggtcagaagggcaggttgcaaaaacctgaagggggctaggactctagttccttggagggtaaggtgtgcgagagagccccagaggttaagagtctgcaaggccaagtggaggttttgttccgccctccacctcccaggcaaccaggtccattggtaaacaccatggtggttgtttttcacatggagggtgggggaggaagtgcttcgaggtcctggggaatttgatatcccagatctcaggcccctgttagggtggaggtggggcctgtgttactgtttcagtcccagaaaggctggttagggcaggtcctggaggaggggtaaaggcttgattatgggattatggatctctagtttcccttggcatgaacccctacttcttggggagaggagtagtacttgatgtatgggaaccccacaagtgacttttctctgaccccagaactgggttgagaggggcctcttgggacttgccttagtggggaacttgagactcctgagaaagggagttttaaggggctttgagttcttcttatggtctgacttgctgccctgctgcagaaggaaggtagggtagggaggggatgtattgtgagtttccttagcctcaacactgttgacatttgggctagtaattctcttggggtggaagctgtcctgtgagtggcaggatgtttagcagtatctctggtttctacctcctagatgtcagtagtaacccccctgccaggtgtaaaaataaaaaatgaccccggatattatttaatgtccacttgggggcaaaggccaacccagttgggaagtgaaggtgtaatgggagaaactgaaagacacccaagggcagctgaactttcctgatctccaagtggcctcttcttgactttcaacacatacatttaaatttttaaaaattaatttattttgtttttgggtgctctgggtctttgtttctgcacctggcttttctctagttgtggcaagcaggggttactctcttcgggttcgatccctgcagttggaaagaacccctggagaaggaaatgacaacccactccagtattcttgcctggagaatcccatggacagaggaacctggcaggctacagtccatgaggttgcaaacagctggacatgactgaagcaacttggcatggcatcgggttactctctagctgcggttctaggcttttcattgtcgtggtttctcttattttggagagtaggcccgaccagggctcagtagttgtgaatagggcttagttactctgtgtcatatggaatcttcccagagcagggatcgaactcttatccccagcattggcaggcagattcttaaccactgaaccactggggaagtcccaacacttacattattctctgccctctcaaacctccagaccctttcgtccctctgttgacggtctcatctcttatcccatagaaaaagcagcatgctcacccacctaccagaatctgagccacatatgtagccttgctttcctgacagagaaaaggcaacatttccttcttctttttttttttttttttgtgtgtgtgtgtatgggatcttaattccctgaccagtgatggaatccgtggcccctgcagtgaaagcgcagattcctaaccactggaccaccagggaattcccaagtgcagcttttcctgaaggtgacagggcatcccacccctgtcactagctggatggctttctttctctttattgcattgtgttttgtgtggatgtgggcagatggacttttttcctggtttacaattctttaaggtaaaatttacatgtaatgaaatatacaaattgggactaatagatacaaactactacatataaaatagataaataataaggtcctattgtacaacatagggaactatgttcaataccttataataacctataatggaaaagaatatgaaaagaatatatatatacacacacacttatatttatataggggcttccctggtggctcagtggtaaagaatccacctgccaatgcaggagacacgagtttgatctctggtctagaaagatcccacatgccttggagctactaagtttgtgcaccacaaatattgagaccgtgctctagagcccaggaaccacaactattgaacccatgcatcaccactactgagcccgtgagcctagagtctgctcctcaagagaagcccatgcatcacaacgaaaagtagccctgttcaccagaagtagagacaagccctcagagcatgaagacccagcacagcaaataaataaatgaaattatttaaagaaagaattgaagattgaaggcaaaagaaaaagaggacagcagagg

SEQ ID NO: 59133 - DNA, 1349 bp, Bovine  19866880857919
caccacctgggaagcccacggattacattattaatacatgaatagatcatcaatcaggaaatcatgcctagagagcagtgatacaggacctggtaaacactccagtgtcagctactcattgcacattaatgtttatgattagtaagagctttggacttggcctctcgttccattctccctccctcctcctctttgtctggcgctggctgggactaatctttgtcagcttttgttgccagaggagaaacctattgacaggtactaccacctcttttctccctctctcccaagtctctgccttgggagaaggggacagaggagcagggatttctatacccctggctcacacccagacacctcttcatgcccgcctaccctctccagggacagtgcccacacacttccatatgagcaagggacacctctgactgcctgatccaccacacttcagctccacatcccttcctcaccgaacttcccacagcccacccctgagcctagaagggtgcctcacatctgctggtgaatgatccccaaggacggaggcaaggagccaccctcagatcccacccacctgagtctcaccctcaggaaggatttgagcaggccttttctgtccatctgcagaaggttccccaggaagggcagaggacgggggccaggcgggaggcggccatgggcctttgggcggcctctggccaggaggaccaagagtccagtgagcagagcaaagagaaggagcacgctgagctccatggccgaagtctgacggtcttccaacctgctgggcttctggctgagccttttatactaagcctgcgccaacacccagttatgtaacaccatccattccctggtgtccttcgagagtctgaactcaaaagagaaggagcacacacttcctgctctgacagtcagctgaccttctcccctgatacctctacagcccttccctagatactggcagagacaccatggtagcaataacaaggtccgcataagcctgtttactttgtgggtatggagagaactcgttgtctccttgctttagctgtgttagtgggtttgtgtttacatactttggtacatacctgcttgcgtgattcttacacatgaaagagggtttgtatttatgtgaacatgcccatgtgtgtttctgtacatgagtgtgagtgtgcttactcatgtgtctctgcacgtgtgtggacttgtatgtatttgtgtggtgtctcacacctgaaggtgtgtctgtgttttcatggtggtagtggtggggtgggtccatgtgtgtgagtctgtgtgtatgtgtgtgtgtgtgtccgcatcagacagtccctgtcactacaggg

SEQ ID NO: 59134 - DNA, 1701 bp, Bovine  19866880960105
tgctgccctctgaaggtgaggaagctgaagctgctgtctcaccggggcaggggagagtccgagaggaactccagtgattgggttggctcctcccttcccttctcagtccagccaggtttgttcttacctcctagcgctaaaaaagtctcaacccccagccatccaccccctccagggccctgtttccaaccacatccaaggcactgaaggagagattcatgaggagattcacgtattctcctttccttcctaaagtggccacagactagctaggcagttaacctggttttcctatcctgtgataagcaaactgaggttcagagaagtatcccgccttgggctattcagttcttgtggtctccccctaacccccctcctgtaaggatggatgaccctggggagaaggtgctgggcaccctgtggctagggagattcccactgacctcctgcccctgaagggctgcctctggctctcaactaccaaggtaacaggagggagagcaaaatgggacaaattccagctggggtggggagaccagcatggtttcagcctggggggagccctggtccctgagccagttcctgcctaagaggaaagctgcacagaggcagaacccaagatgggatctgagggaagagggcggggacgccaggagcacagcctcatgcctggagggcagagcacggcctgtgccatcatccaggcatcactggtgcagggcagcgggcactccctacagtgccttgtccaaccaccaccaaaccatgaactccaggccagggccctcacacccctccatgaaagacaagtaatgtgctggcaggctgaaagggcctatggactattgtcttgtgcagggctcctgaccccagattcctgaatgggcagctggaagcccagaaggcctgatgactgcccataaactccaatcaaatgagcatttttcttaagacagggtttggttttgagcagattaaaaaaaaaaacaaaaaagattagtaactactactctaaaacaaaaacagggagtcaagaaaagacccaaagacagaagaccaagtaaacagaccagagccagacaggaatgaagtgagggacagacagaacagagaagatggaggacacggactaggatggggcgggatgggcgggatggggtcgtgacctccacctgagccagcacacagccacccctggggaagccggcgtgaggcagacatcacagtacagcatacaggggtgcagtgcggcccagcaccaggcatgctgggcatcttccctcagcctggcacggacctcaccactgccacccacccctcccggttcctacctgggagacagactagacaaacaagacatgcacagtggacaggatggcctagatacacttggatggatgaaaaaataagggaacaggaagaacacaagacgggcagacagagacacaaaccttgtctgcttgctctaaggcccatgaacagacatcacggggctgctgaccccaccagggctcagacacagatgcagggctatgaatggcggcacctctcttcagggtctttgagaggatccccggcaaggtcaagaatcgcggtgactgtgggccaaacccacagcttgcaggtgcacaaactaaggcccacagggcacaagagcccacagcgagctctgacactccctgcaccagggctgcctaaact

SEQ ID NO: 59135 - DNA, 3190 bp, Bovine  19866881005012
ccccagcttgcacctactctgctctctccttaaagaggaacgacagtgttggaaacgctgaagatttatggcaccacatgcacacttcctccttgtaggatctgaaagatgcaagcgggagggtgattgtcatcttcactacataaagttactgcagatagcacatgggaacatggggtctctggacagtcccccccaactcccacgatagacaactgatgtccccactctgagctttattttcttcctgagctgtgcaccccacctgacttagcaagcactcagtaaattccacagataacttgccaagtacctaatacacaccaagtactgttgtggtataggatacacagtagtgagtgaaatagacaagctaattgcagatgctgagttctgataggaatacgactgacatgatggggtggtggagctggggaacagtaacgggtgatcaagggaagcctctgggaggcgacgtggatagagctctttgatgctcgcatggtacttggtgctggatgttgcatgtgtggagacagcttaggcctagtctttgaccaggaggaatccttccccacctcaagcctgtgtgtgtccatcttcccctaaaactaaagtttggacttgctggctagaggtgagaatacctgaggaacgagatgggtcttcaggcaagtgaatctctgaagtgtggttttaggtaggagacttgagttcacatcctctgccactgtttcattctggccttgggcaactgacagctccaagcccagtagtgatgggtaagcctctccgcttacactaaccttggacaagttccttaagtttctgtgcttccatttctacctaaaatgggattatgacggtcccccttcaagttgaggcagggtatgcatttgagctaattaaaaatatgcatggtgagttctttactaaataactagtatcccagatgagaaaggtgaggctctgagagtagtttagcacagtcaggaagtggtttctgagaagaaatagtgattgtggttggacatcgcctagcctaaggcccgacatataatattcactccgtatttgagagctggggctatttttggcaatcaaagggctgccttgttctgctgctcctcagcacaggaaattccaaggtggtttttccatactggcttctcttgttctgtctctggggacacagccgaggggcctaggtgtccaagccaactcagaaaagatggaattgaatattttaacctgcctgtctgggcccttctgttgaggggggtgacttgttacttggagtggcctgggctgccttgggtctctctggatatttccttgtgctggcaactctcaccctgtccttgaaatggttctgcctgggtagcagcctctaggtggtgtgggtgaaatctgggactggtttaaggaggggaccagacccagaacacaggtttccttatgctactgccaagggagggcaggaggaagctggagaccccattcctgccttagccactgtcttgctcagagtccgtgatggcttggtccttggtgtttctcggtgtcgtcttgctgtctgccttcccagggcctagtgccgggggccgccccatgcccaagctggctgaccggaagatgtgtgccgatgaggaatgcagccgtgagccttaggggtccgggggggtggtgtgtggagggcttgggttgctagcctgtgtggggggtgccttcactcccttctatattccttctccagaccccatctccgtggctgtggcccttcaggactacgtggcccctgactgccgtttcttgaccatacaccagggccaagtggtgtatatcttctccaagctcaagggccgagggcggctcttctggggaggcagtgtgagtcttgggagaacagaggaggaaagggtagagagctggggtgggagcgtaccctacttttttacctacagggcaaatctgagggagtgaactgaaatagagtcggcagggggtggctgctgtgatccactctttttctttctttagcaattattcgggcatgtcctgtagtgccaaattgctatagacaccgaaggtatgataaagaatgacgcttttattctaatggaaggagacaagccatcaaaataccaactcgtgtgctgctttaagaattagtataaagtgactgggtgaataattcacatggggtggtcagggaggactttccagcaggcgactttaagctgagattggactgacaaggatggagccagctaagtgatcagggaggagtaagtgtgcacaggacttgagcaggaatgagcttgccatgttcccagaacccggcttttaactccttccccaggttcagggagattactatggagacggagctgctcgtctgggctatttccccagtagcatcgtacgtgaagaccagaccctgaaacctgccaaaaccgatgtgaagacagatgtgagtatcttgggggctggcaggaatctggaaggaggatctttgggttgtagtgacaggcgaagatgctcctaacctcggctccctggcagcctagctgcgtgcactggaacagactctctgccttttcttatctgaaagatgagtgatttctaaatcctagtttgagagctgcagagttgagggctccaggctaatttgcatagcacttgtgcagccagacctggtccctgaggctgcagcatttgctaaaaccactagatcctttgtggtgtgaccactggttttctccccactgtttcccctttctctttttcagatatgggatttctactgccagtgagctcagtctatgctgtcattgctgttgtttctccccgactttatgcaaatacatcagccaagtgcaaactgggtgtctgtggtctttgtggtggggatctagaaaaaaatgtttcccccgggtttctgaatctagccaatcaacccaccaactgtggtgacaaaagtggttactaggcagagtttcatggactgaaagctccaagctcggtcgagttgggctcctaagcttagctattacagacaaataaatgagaagatggaataactgaacagccaaattggggaattatagtgtcctctctagaccaatacgagaactattgaactattgggaatgagccaatgggaccatgaggaagacaaatcacagag

SEQ ID NO: 59136 - DNA, 1208 bp, Bovine  19866881103204
ccagcaagctctatttcccaggttcccctgccagtttgggtgtagcgggaatctggtgggagacaagagaggaaggagaaagcagcatctgggtcctcacaggagtttgaggcgtatcacccaccacagtcgtcatggagaaagggtggctgtggacctcagcagccaggccagagccagactgtctgttttcatctagatctgactgctcccatgtccccaacagcacccagcaggagctggcttcaggcttctcatctcagggggggcctcccttcttcccttttgcttcttcagctcttccatcacggctgttgtgaccagttccctgcattcagttccacttgcccaccccccgtctgaagctctcaaggggtttctttctgctttcttgactggatgtgactgtcacagtcctgagcagataactgggaataactggagcctcagcacactgtgaacttgagccactgaagaagaaactcttaagtttttgcttttctttttgaacctcttaaaatcaactcccttgtcactttagcgggttagagctggtaccagccaactgttttggagaagcgaggcccagaggaggaggagagggagggtgcctgtccagggcctttcaccaccccgcccttcatacttaccttttcctgtttagcagtagggtctagcatgagggtcccatcagagtccagagcacaagtgaccccacagaagagggcccgcatgggcacaccagcgtccaccagggccatgcaggcggcattcaggcaacaggccaggagccacaggcagtggttaagtttcttttttcatcttttgtttttctttgaccacactatgtggcttgtggcatcttagttcccccaccagcgactgaacccaggccctcagcagttacagtgcagagtcccaaccactggatcgccagtggatgttaagagtttctactgaaagttggtcagcagaacacatccatgcctccggttcaccaggccagtgccgtgaacaccagacatctaatgatcacagaaagccagagtaatcctgggatctagtatccttgggttccaaacctgaactgccaccctaagctgtgtgaccttgaacaagctacttactctctctgagtctcagtcagggatcacaaggatacttagcaggtatgcaccttcagggaaacaaaggtgagaagcctttca

SEQ ID NO: 59137 - DNA, 1088 bp, Bovine  19866881196645
tggtgaaaagagctacagaggcagaaagaagctgggagaggaagggggacaaatacaccaaagagatggagagacggattgcaaccaagcaaggctgaggcaggagagagatggttgagcatagaggaaggaaaaagggccagatgacgtgagacccagaaagaggtggagggacccagagacatgtatgtgcagcagggccccagtctctcctgacatgaaccctgcgcctctggacccaggagaagtccatcttcaacagcaagtgccacgagcgcaacctcatcgtcactgctctgttgctcttcttccctggccctgagaccaccagcaccacactccgctatggattcctgttcatactcacatacctgcacgttgcaggtgggcggactggggacagccacttgggggaggggcgttctgacccctctgggggctgcagaaatgggtctagtggtcttctgtgaaccagaaaggcagtgttcccctcttataccagaagcactgtagggtttctttccctctttggccgtaccctatagcaagacaatcatatttcccccaccagggattgaacccatgccccctgcattggaagctcaaagtcttaactactggaccaccagggaagtcctggagcactggaggttctgaatgactccaaaactaagccagcctagttggtggatggatgatgaagaatctgccaatgtagggggttccttggtggtccagtgtttaggactcagtgcttttactgtcttggccccaggttcaatccctggcagaggaactaagatcctggaagcaggacagcatggctaaaaagagagaaagagagagaagctgtcaatgtcttttcctccatcacttaaggatagacccatccatttatccatctgtctattccttgattcaccaattaaactaattcatcatctgattctttcatctatgattcatctaaggacatacacttccattctttatttggataattgattcctctgttgatcttttaaaataattattcactgaatgaattgtcatcgatacatggtcccttattcattcattcatccaca

SEQ ID NO: 59138 - DNA, 1175 bp, Bovine  19866881201341
tgtctatcttggtgggggttaggtctgtgtcagggtggtgttagctggcctgtctttgggggtggaggtctgcattccccatacatcacctctctttttgacactcccttcaagcagacaccactgggggctggactgatcctggggatggagtgtggtggggcatgctcagccgggccccaaccccctccttcccctctctgaccgagccccccctcacatgactccccaggcctgaacaagactgcgtctttctcctgtgaagcccacaatgccaaggggatcaccacatcccgcacggccaccatcacaggtgacaggagagggagctgaggagctgggtgttagagggtatgggcttggggtcagaggtcagagctggggtagagggctggggaaggagcttcgggcacaggatcagtccctcccctcatctgtccacagtgctcccccagcggccccacgacctccacttggtttccacccagccgacggaactggaggtggcttggaccccaggcctgagtggcatctaccccctcacccactgcattctgcaggtaggtgagaccgcagcctttccttgcctccatctcagccctccttccacccagagccataagccctcatcttctccctgggataccagcctttcccagccattcatttgagaggcagtagaaccttgggataagccagatgtcctgggtttaaatcctagctccaacaagctgctggctgcatgagcttgggcgggtgactcaacgtccctgggtctcagttctctcatctgtaaaatgggcataacggtagtcccaacctggtagactggctgtaggaattcagtgagtgactgcatttaacaaacttaaaatagtatctggaacttggaaagcatgcaataaactattggctgcttttggaaattccctagccatccagtggttaggacttcatgcttttgctgctggggggaacgggttcaatccctggttggggaactaagatcctgcaagtagagcaacgtggcaaaatacaaacaaaaagctattggccgttttcattttttaaatgttggtgaaattgattctagccagaatagaaaccctgaaacagcagggaccagggccatctttcaccactgggtgctcacagcccttgggcttctcccatcc

SEQ ID NO: 59139 - DNA, 985 bp, Bovine  19866881413634
agctcatgcacagcaggaagtgagacctggagagggaagagggcacacttctgcttttcttgggggacattggatggatgtgggttgggggtacagctggtgtctgacctggcatttgaggtcttcccaaatcagcccagcttctgggattgaaacagttttagcctttttagccactggggaaggcaggtcacttcccttctctgggtctcaatttcttatcttgaaaatgggaagatgaataatcattactttctggggttaaaatatcaagtgaatgtgaggttgtccccagggccagggtcttataagaaaggtagctcctgtttaatcaagccccactggctctaaatggcctttcagaagtgccctttgggtttggcaagacaagggtttggatcccacctctgccacttcctggctttgtccttgggcaagttgcttaactactctgaaacttagtttctttttgaattttttggccgcaccatatggcatgcgggatcttagttccctgaccagggattaaatccatcccccatgtggtggaagagcaagtcttaaccactgggccaccaaggaagtccctgagccttagtttcttcatctggaaaatgagtgtatccatagactctactttacaaaacactcaaacaagtatgtgttaagctgcaacacaaggcccagcacatagtggctgtgttattgtttttgttctttagttgcgtctgactctttgtgaccccctggactgtagcccaccaggctcctctgtccatgggatttcccaggcaagaataccagagtgggttgccatttccttctccaggggatcttcctggcccagggatcgaacctgtgtctcctgcgttggcaggccgattcttcaccactgagccaccagggaaacctaagcacatagtggacatgcaataaaaattggtcattgggaatttcctggtggcctaatagttaggatcctggg

SEQ ID NO: 59140 - DNA, 778 bp, Bovine  19866881549982
ttccagaaggtatagtgtgtgtgtggtgtttcctactcaggctgttttcagtatgtgtgtgtaacagttcccagtgtgtctgtgggccagcggcttctgggttacattgtttcgtgatcagtgtgtgttgctggtatttctagcatgtttgtgtctgtggggtgtgtctgccacatgcttgctgtcctcgcggtgtgtgtgcgtgtccgtctccgggaccggtgttctcagcctctgtggtgtctgtgagcaggtggtgtctgcattgtgtccccacatgtgggctgatgacttcagtgtgtgagcagctgcgtgggtctctctctattttgtgctgtcgctttggagttttcagtggagtgtgtgctcacgttcacgggcagctgcctgtgcagggctgcatttgtgctctggtgtctccagggcaggggggcatcctgtgtccccagtgaagccgctggcgtcccaagcgacacgcctggcggcctccgtgccgagtggaggctggctgtgtctgcggccgcgtccccttgcaggctggtgccacgttggctcggggctggctgtggcgggcagggcagggcaggggctgtggtgggcactggacccacgcccagacctcggtataaatatcttgagttgccggcggctgtgtttactcggccccagcccgggggcggtagcagcccggcaggtccttgggggcggggggtgaccaggccacagcagagtcacttccttctggccagacaggccacagcctcgctgccccttcccg

SEQ ID NO: 59141 - DNA, 1699 bp, Bovine  19866881556753
cctcgcgtggcaatctccacatcgtcaccccaaggaccactgtcaggggacagaagggagaaaattagagggtctctcctgcacaaagacgccctcacccaacacacagatacacacacacttacatgtacacagatgtctttgtgggtgcatcagagctagtcacagaaacactctggtgcacgtacacacttacagaggcaatttgtgtgcacacctagacctgctcacccatgcacacacttacacactccatggacacgtggtctagggtcaccctccacaccctagctatacacgtgtatacacttgccactgcctctcccaacctaagctgtctgcacagtccatgtagcaacctgtcaccatgcacacatagccatgtgcacacccccccccgcagcatgtccacaccaccgttcacagacgcccaccacacacggtccatgtggacaggcccctgctcagggaagccctcgtgtccccaggagtctgggtcggtgtgggatgatcgggccacgccctccccctactcctgccggggtacacgtactacatcgctcttgctggtatagacacggtccgccaggctctcgatggcaatccacttgaccggcatcttggcgatgcgtccctgacggtagtagtccccattgtagatcttcttggagagcccaaagtcagccacacacaccgacatgttctcattcagcctgcccagattgggggagaggaacggggtcacagcattgccccctccaccaggaagcctgccctcactctcagacatgtctctgtctcctgccctggctgtcctgcttcggggtgaggatcggtcagcccccaaacctgggagggaactatgttacttcttataccctctgtgaaaggtgggtctgaaaagggctgctagggggccttcccagctctggctttttgccagattctaaggtccttcccaggctccttgggttggattctctgatatttttaaaaaatttttaaatagttatttgacttcactgggccttagttgctgcactcaagatcttcactgcggcatgcgggatctagttccctgaccagggatcaaacccagtgcccctgcattgggagaatggaatcttagctactgcaccaccaggggagtccgtttaaaaaaattttttgacgtatactatatgtatacaaaaacatgcacaaatcttaagtggagagctcactggattttcacaaacacacctatgtaactagaaccaagattaagaaagaggatatcatgcggcagctgtgcaatggaataccacacggcaaagaacaagaactacagatacgtccgagaacatggactgatctcaaaaacttcacgctgagcaagagatgccagacacagaggagtcaaaattgcaattccatttacatgacgtttaagaacaggtgacagaagtacagaatagttgttatcccttgagggcagcggctgggaagggcaggagagagcctgtgaagggccaagaaatgttctttatcttgatttagtggtggtttgtttccatgggtctgtgtgcacgctcagttgtgtccaactctttgcaaccccatggactgtagcctaccaggctcctctgtctatggggtttcccaggcaagaatcctgggttgctatttcctctaccaggggatcttcccaacctgggga

SEQ ID NO: 59142 - DNA, 750 bp, Bovine  19866881579172
cccaggggcaggctctgcaagatgcctccagggccctactagtggctgtgccaggaccagtgaggcggaaccatggggaaggaaagactattctgctgcttgctaactgactggatcctttctcagaggacaaatgtatctgggcacaaaccaggtgcggcccaaagggaggaaagtcacacagatcacgtggttcgctacaggtctgtttaccagggctgaaggaagggttgcggggggcataaaaggggctcaaaggattttgctgtaatgggtaggagagaaaggaagacacagaataactccttaattagaacacagggggccctttcataccatcgcgttcaacacacaacatcgtgtgttgttcttgccacaaaagcctcatatctttctttccgagaatctctcctgcgctcacagaggaagcctcgcccagagaagcttatgattctggggcccttctctgttctctaaaacatttacctcctaataacaggcaggcccagtgctaagccccttacacatgtaatctcattcatccccaagcagggaggggggcactattattatatcccaattttacacacaaggaagccagagctcagaggtgaagtgacttgcccaagacaaaaatctgagtctagagcctgtgccgtaaagcatatcacttttctttggagacatttccagccactggcattcctgccagggtcttgcctgccctaggcaggtacagggccactcctc

SEQ ID NO: 59143 - DNA, 3242 bp, Bovine  19866880116122
tctgacattgtttccactgtttccccatctatttcccatgaagtggtgggaccggatgccatggtcttcgttttctgaatgttgagctttaagccaactttttcactctccactttcacttttatcaagacgctttttagttcctcttcactttctgccataagggtggtgtcatctgcatatctgaggttattgatatttctccaggcaatcttgattccagcttgtgcttcttccagtccagcgtttctcatgatgtactctgcatataagttaaataagcagggtgacaatatacagccttgatgtactccttttcctatttggaaccagtctgttgttccatgtccagttctaactgttgcttcctgacttgcatacagatttctcaaaaggcagatctggtggtctggtattcccgtctctttcagaattttccacagtttattgtgatccacacagtcaaaggctttggcatagtcaataaagcagaaatagatgtttttctggaactctcttgctttttccatgatccagcagatgttggcaatttgatctctggttcctctgccttttctaaaacttaaaaagtgcttttttaatttatcattgtttagagtaccacttaatgccccattctagaatttaacaaaactaagagactctgttgtaacaagctgggctggtagcctgatgataaaagccctctcattttcttaagagtgttatgtgccatttcctctcaagcagctgctattgctactgatgcttagctttgcctgtttgacctgcgctaattggctgctgccattcaggtctggaagagtagattaatgttatctctgcccttaaaataagagagaacaggcactgagggagcctaaggatctcttctgtgttgaagacacaagtgcggttgttgttcttgtttagttactaagtcatgtccgactctttttgcaacgctatggactgtagccctccagtctcctctgtccatgggatttcccaggcgagaatactggagtgggttgccatttccttctccaggatatcttcccaacccagggattgaacgcacattctcccatgttggcaagcagattctttgccactgagccaccagggaggtccatgcaagtattagcgcatcgtatttgtgtacatacactcatgtatcttctttcacctttgcttctacctcttcatttactttgctggctttttagggtgttgggtatatttttgacatgtacttgaacacatgaagattagcaagtttagtggagtttcttttctcagtgatggaaggaatttaacttaaaagttcctgatttggttgcttatatccagcagatatggagaaggtctttttctgacacttggccttggcctggcttggaacccttttctcaattcatgaaagttaatgaactacctgctgtgtgcggggcactgaattagcttcagtgatggggcacaagatgagtgagaaatggatcctgtcctcatgcagcttaaactccaaaagaataaagacaatgcaaactgagcacgcatgcatgcaaactgtcctatgtggcaaagttggatgatttttgtcatgaagtcttaagttttagaagaactcaagagaagaaataatcaattctggaggagaccctcctgcaggtgtgttggggtatttctgaagcagctggaggatggctgggtctctgtggttactggttaaaaagaaggtgggccaaagagagagtcttgaaaacagaagctaagatgtagggcgcagaggtgcacatttgtctagggaatgaggagaattttcattcggttgcagagcagactatttacagagtaatagtgacagctaaaactagagaaatatgatagaccaggtctgaaatgccagcctaagcaagatctgtcttctggtaacttcagagcagatttaattctgcttaaatcctggggagggggaattgaatgggctctacataagcaaatggtggtgctggacagggtgtgtgcctgtgtttaggtgactgcagaaaagagtgtggagccacacacccttttcaaaggcattttagaggaggaatatctggggcagcctaactaggatgctagcaaacttgtgaatttcgcatagaattacccttgtaaatgtgtctgttccaggaagaacaacatacatttgtgtaaagtaccacataattaacttaattcagactcggcatttggatcttgatgttccttctataaacccccatttctaatgcctttttttctgttttgttttggtttctttatcattattaaagtcaccttttaccttcttctacctttgaggttatagtctcataaatcgaaaagtcttcttagagtacttagcagaatatttaatcaaaatgctgaaagccatatttcagcttgaaatggtattagtgtcactgggaatgtgacccagattgttgggggaatgctattcagccaaataggggttcatgacactgttctagacatttagaaagtaatgagatatatttagcatagaaatagaaacaaaaaccatactcaaaaaaaattctgtattctagaacatcatgagaaatagtttgtgtgtgctctctctctctctgtctctcttgatctctctttctctcttacgtatatatatatattttttttattatatatttatttatacacacctatgttgcccactcacatataatgaagcaatatggtaaagtatattcagggagtttgagttcaggagttgtgggagtttcattagtttgaaggctctgaattagtttgaatctcaattaggattgtcaaatttggtataattacatactgtcataaatggcaaactctttagtggtgagaaatgctcagatattcagctattctaataaatattttagttagagtttctaaacagaacctacttctaatgctggttttcaaataattggtacatcaatgtgattgtgtcttttaatgatctagaagagacaacttatttatttagcacatcgcagtgaccattatacaaattactattggagctctctggtactaaccaattcacattgctggtaggaaaaaaaaaaaaagatatttagatgatgtcactttcttgctccaatgctttcgatgtctgcccattgtactttaaaatctaaagtccttaacttgacctttaagaccctgtataatctggcccctgacatcct

SEQ ID NO: 59144 - DNA, 1184 bp, Bovine  19866880276695
acgtaaatcttgaagctggatggagtcaaaataatagaactgttagactatttccccatataagtaactgatattaaatctgagcagcgagaattcatcttcttttgtgttttgtttctagttaagaataattttttggaaaaaccatagccttgacttgaccgacctttgttgacaaagtaacgtctctgctttttaatatgctgtctaggttggtcataacttttcttccaaggagtaagtgtcttttaatttcatggctgcagtcaccatctgcagtgattttggagccccaaaagataaagtctgccactgtttccccatctatttgaataattgtataatttggggcaaatcatatgatttctttgagtttgatcatttctaaaattgaagataatacctttcccatacatactaattaaagattgaggattaatgaaagaggaaggatagaatgagagatgttactaaaaatttctagtctactatctggcacatagtttgtattccataaatattaactgatataatgataatatttcaagaattttatatgattcatgctttataaatttcattgactaaaaattgttaagtagttaacatttctgaattcagttttccttttttaaagacactaatttcataccttggccacctgatgcaaagagctgactcatttgagaaaaccctgatgctgggaaagattgaaggcaggagaagaaggggacgacagaggatgagatggttggatggcgtcactggctcaacggacatgagttttggtagattccgggagttggcaatggacagggaggcctggcgtgctgcagtccatggggtcgcaaggaatcgtacaagactaagtgactgaactgaactgaactaagtactaataatatagcataaagtattttctttgataaaaaaaacatttggtaaaatgtacaccagaaacaatttattttttttttcagaaacaatttaaatggattctttcctaacttccttaattacttccttaattactctcagttaaattcaacaggtatttaccaaatgagttcatgaacctattatagataaatattgggtaaaggaatctaataaatgcattattttaaaagtaaaaaaaaaaaaagaataatttttgaaggaatctaaagtctttaataagtctt

SEQ ID NO: 59145 - DNA, 1104 bp, Bovine  19866880391746
gggctaagttctttgtcaatatgaatgatgtaaataaaatttagcaactaacgataaatttaacaacttaataattatagttatttaatagtataacctagaacaggaatgagtttatgtttaaaataggttctatgacttaaaggaagattcatgttttcagattgtaatggaggaaggttttacagctgggactcctgaagaagaacttctccatcctgaattcccatatcgaggccagactgaataattacagtttttattatatcttgcaacaatgaaatcataacatacatttttgataactctttttgattctctaaaaacagcaacgatttatagttacatataatgaatcttatccaaaaggaaatttattgcacaataatgtggttaggatttcatttataaagcttattttttccttcccatatgatataaatgatgattaaaattctacttctggatttcaataggggactgaaatctttttttctgggttttttagagtcaatattttgattcctgtgggtaatgaggaagatgcttggtacaattctccatgctaggttgggagggtctctgtctagagacattgtgcaaaagttgttaaccacttcaaccatggaaattcttgaaattttaaaaccacaattttggttttagtctgattattcagtaatccccatatctgctaatctgtggaagggaggggagtagttaagatttcaacatcttctttactcttgtttataatttcatatacttaaactttaaatatgaattgctttccctttttacacaagttataaaaataagaggccctgtttacacagtttgcatttttatgaaatttgcagtttgaaaaaaaagctttttaaaaagtggcaattaatgcttttctttgaatatgctgtaactttagatttttttttgtttgttttctgaaacagtttctgaatttaatccactaaacatctgaagatagaatttttatttagcactagagtaaaacataccaaggacgaagaaaaggaagtttttttttttttctggtcctgcttaattttctttgtgcgtggcaccccctttagacagctaaca

SEQ ID NO: 59146 - DNA, 3575 bp, Bovine  19866880401437
ggctctttagttcttcttcactttctgccgtaagtgtggtgtcatctgcatatctgaggttattgatatttctcccaacaatcttgattccagcttgtgcttcatccagtccagcatttctcatgatgtactctgaatagaagttaaataagcagggtgacaatatacagccttgacatactcctttcctgatttggaaccagtctgttgtcccatgtccggttctaactgttgcttcctgacctgcacacagatttctcaggaggcaggtcaggtggcctggtattcccatttcttcaagaattttcaactttgggggtacatcatctaataattatggcagaacaagagtcaagcttttgatgccatcactcttgccactattaatcttgctggtactcattgctgtgtgtataactaggcaagttcccattttaggatcttgacaaacaggtcccactggttcttcccttcttaatccagtatccccacaggtagtgtgtgttattaagtaggctgtactgatgccagttcctatgcaccttgaatgaggctggtgaggataaagtcagagcttggccctgctgactggacagtgggagggtaattgctgctgacttgcagcaatcctcagagactccttgatcctcggagacttcctactccctggatcgctcccctggtgaggttttcagtggggctgatgtttgtacttctcctaccttttaattatcacaaaagaaaaataagagtgcagagataatattgttgctgttagtggttatttaatttaactttactttgttattttaggtttgtatcattggcttaactaaaccaaagcttaaattttctcagcatagccccaagggatagaacaaggatcaaagagaagaaacggaaaaggaggcaagctttagcatttctaaaggcaccaatctaagagtgaagaagcaacttcctgaaaacaaagttccctctctctaatagaagtcaagtactagcccaaggatcctctgttaggattttatcacctgcatggaaagatttggggtaaagtcagatgtgacttgggccacagagctagttgactaactagagagtttaccagaaggtggcattaattaagtataatcaccagatttccaggaagggttatactctttaaaagctcataaattgaattataagagcaccaagatatgattgaaagctgagagacatatatatgaaaactagtgtgccatacactcactccctatgagaaatgtaactgcacaacatatggatatgaaaaccaattgactgcattatcagttgtgggggtaaaaacacacacatttagacacatctacagaatcctggaaatacactgtcaagactatgtataattagggattttatcacactcctagttctctaggaatagaaccagcctcataacatgtaagactatcgagcgattttagcatagtcaccttctggaacatgtttccaactttcaactccagttaactttcaagaataggcatgcctttatgtgtgtagtagaaacatttgttttgaaagaggagggctcacagtctctctcttaggtcatttcctcagttcctgagtttatgcctcacattttgattctcgctaatgctcttctcagacagttctgagttgagtcaactgtgagaaaaactggcagctcacccgcctattgaccatagggtgtgtgtgtgcttggtcactcagtcatgttcaactctttttgatcccatggactgtagcccgccaggctcctctgtccatggggattctccaggcaagaatactggagtgggttaccatgccctcctccaggggatcttccccaacccagggatagaacccaggtctcgtatcacagtcggattctttactgtttgagccacgagggaagcccattgactatagcgtagcactcagttgttgaatgggaacctgtacaaatgatctctatggtccttctcaaccctgtggttttacagtttcatgaacctattcataagggaatggaggaagggataggaaagcttacagttgaggcaggggactaaggacagggttgaatctgatttaactaaaaaaactgtttttactgagggcagagatacgggattatatgtgttgaattttctctactttcattcctcacaggcgcttccatatttggctaaaatccaaggagagtttcctatgggacaaggtaggcagcagctcaagaaccgcgtctgtgcagcagcctcactgtgtacgggcccacataccttgcactgaattattgtacactctaattccacacaaaaattggtttggccacagtttcactcagctaagtaccttgctctatctagtcattcctttgttcaaacaacttttactgagcactaagccagatgctggcagagagcaataagctggatactgtccgctgctgctgctaagtcgcttcagtcatgtccaactctgtgcgaccccatagacagcagcccaccaggctcccccgtccctgggattgtccaggcaagaacactggagtgggttgccatttccttctccaatgcatgaaagtgaaaagtgaaagtgaagttgctcagttgctcagtcatgtccgactcttagcgaccccatggactgcagcctaccaggctcctccgtccatgggattttccaggcaagagtactggagtggggtgccatcgccttctccgagatgctgtctactcacaatctaacgaagaagtaagatatgaaaggaatagttttaaaactaaaaagttttgtgttttgttaaaggaacatgcaaagtactggggaagaaatccctccaagaactgctttagttgcatttcacaacaaaaaagttgtatttttatttatttcaagtgtactatttaattcttcttgagacttccttttttaacccaggaattatttgagttgatttgttttaagtgcttggagttttttctgtaatcttttgtttattttgatttcactgtggttagagaatggactctgtatgatttcaattttctgaattttgttgaggtttgttttatagcaaacctcataggttatgtctctcttgatatataatccatgggaactcaaacagcatgtgtgttctattgctgttaggtaaaataccctataaatgttgattagatcctgttggttgatggtgttcctgagttcttttatatccttgctaattgtttgtctaggtgcactatgaattgttgagagaagtatgttaaagtctctaactataattgtgaatttgtctatttgtcctttcagttttataggttttgcttcacatattctgtagcttgttgtttcatgcatacatatttagcactgctgtctttttagtgcagtgtcccttttatcattatttattgtccctctctgtctttggtaattttctttttactggagtctactttttctgacattaatatggccaataatgctttcttttgattaatgtttacatgacatatctttctctttttgctttcaacctacttatttcatta

SEQ ID NO: 59147 - DNA, 1470 bp, Bovine  19866880484933
ttcatcccatcctcccttccctctctgtgtctacatgtctgttttctacatctgagtctctattcctgccccggaaatagatttgtgatttttaaataatgtggtcaggagaggtctcattgagaaggtgtcttggacaagttgagagagggtggcagtgccagtatttgggggaagaggacagctccagggagccatggaggagtggggtgagaaggaagagtggcaggtgttagtctggggtcatgggtgtcgccaccatgaaggtcttggaggccactgagaagactggcttcactctgctccaatgtaggagttctcagcagggacatttagtcacttttgattgctcagaagaggcgctgatgaaaaaagaccagaaaaatgccaggatgtgacatatgttgttgtttttcattactctttggaagcttgttttgattcctcatgtaccatgctaaaaataaaagatgggcttcacatgggctaggaggtggaaagagagtttcaactaggcaaagcagaaatcggtccacccatcttgctttccctctgtgttggccacttcaggatgaatagctcagattggcatccgtggctttgcaccactgctgtgctggtggctgatttgaaacgatagttcctaaggtccatgggcagttagtggctgtcctttagacaatataagagacagaagaaaatctcaccttcattcttttaagaaatgaaatttcccccagtctctgaggaaacattttctgatataattaatatgggtgattcatactccaaggtttttttctaaaacaattaaaaagtatatccattgctgtagattatttctggcactaaaaaaaattctccttaggaaaaaaggaatagatacttttttcttatactgctatacttaattttatactattattcatacatgtgtagaaactacttagtataaaaataaatataatagtataagcgagataataaagtatccatctttccttctcaaggtcaaggaccataagtgactgaattctgagacttcaggtaagaaaacagatatctcattaggatgtataggattaggggaagagaattacaacaaaaaactggcctccacagaacacaacacattaataaactttagaaaagagcctacaaatgactcctgtaagagaagaaacagtcgtttgtattgtttatccatccaataattgagaaaaacttggctttaattgaaggggaaagatgaaaaatttgctctctgtacaaaataatgcaagggatataagttgcattataccacaatgaaacaccaagttccatatatttcccacagtgaagagcttccttttgtctaatcaaccagcaagtattgtctaagtacctgtattgacatgccattcaatgtcatagactccagaggaaaggctccttcaaggcaagagtaagcaaacttcgggtgcaggg

SEQ ID NO: 59148 - DNA, 946 bp, Bovine  19866880495599
tctgtagaaaagtggtaatgataagaaatgtaggctctgaaatttaaatctagctagtatttaaatctagcgtctgtcccttgctagctgtgtgactctgggcagatcattttagctcaccaagacttgggtttgtcatctgtgaaactgcccttaatacattgagttgtttttgctgtttatttgctaagtcatgtcttactattttgtgacccccatggactatagccccccaggttactctttcagtgcgatttcccaggcaagaatactggagtgggttgccatttccttcaccaggggatcttcccgacccatggatcacacccaggtctcctgcatggcaggcagattctttaccactgagccactggggaagcccaccagaaagttgagttactacagaataaaaataaataaggtaacagcagtattgatacccacaaatgcccaattgatttgaagtcttattgattctacattttactatttcttttgtcttggatctcctccacatttctagtgcctagaaaaaatatacctcattacatacatgcatagtgccagtgagagaccaattattacatattcaggctaccccttgtaagtacacagagaaactgccttacttagttttctaggaatatctttttttttttttcaatatattggttgaagcttgaaataaatcctgatatcaacttggattgatataataaagctcaagaagtctttctttaaacatttagaattataactactatgtacaattatcatctacaatggtgaaatattataataaatattttataaaccagtattcagaatactaatctagcatactgtaactcataaccattatgaaatatacctatgttgacaaagcttacatttaatatagattgcacacatctaagtcaataaaaataatgctttaaaacttcag

SEQ ID NO: 59149 - DNA, 3363 bp, Bovine  19866880583436
atctcccttttctgtgtttgatctttctgtgggttattgtaagatctcttttctcttactctaagcttcatggttttcacctcttaccactgtttctgtcatcagtttctgtatgaaacactaactgatgtaaacctaaaaggtgtgaaatttttttgacacttcttccttttaacccttgggatgtgtatgcaaatgtaacttggcatttaaaaaaaaatactagtaagctttttttttttttaattactgtctaaaactgagcaatgttattatgatagagctctttctttgcagtcttggctactcaaaacagcacaatatgttatctcttagtggtttgggtgcagttatttatagcatgtcagcagtgaatgaaggcattattcactccatatgccccttcccttgtcattaaattaaactcttgtcacagtcctccatgaagaacactttaaaaatgaccactaagtaaggggtggaaggaaacagatcacattcccatgcttaggaagacagtccatcaatcagtatacgtcaaatgtgggcctgactgggaaacgagcagtcatattttgcttctagtgggaaaacagtcttgagtttgggttgcatagtgtcttcacatgcctgagaaaatgcccaagtactggggtacagtgcttcctcatcattttgagcacccaggaggagactccaaaataaaggtgaatgaaccattccttagagctatattaacaattaagtctttctgcctattaattcttcatcatttttcagtgttatttgtatgtttggtcttggtaaacttgaccgtggacagttaataaaggaagttttaaatgctcatactagtgccagaggaggagtcctcctccatcatggtgatggcataggtaattggtgagagatccccaaagagaggaaaaacatagctgcagccacccatcttcccattgagaagctagacaattgttcattcacttgtgattttaagcaattgctaggataggttgctgctgctgctgctgctgctgctgctaagtcgcttcagtcatgtccgactctgtgtggctccatagatggcagcccaccaggctcctccgtccctgggattctccaggcaagaatactggagtgggttgccattgccttctccataggataggttaggcgtgaacaattaaatactagaggttattttaccatctgttagtaagcaagatgttaagtctagcttaagagttagcaagtattttctataaaggtccaaagctgaaaataataaatattttcagctttgcagacctataatctttgtcacaactattaaaatttgctgttatcacatgcaagcagccattgacagtctagaaatacatagacaaaactgtatccaaaattttatttttgcacactggaaacttgaattttataaaatttttatgtcactaaaaaggattcttcttttgattggttgtcaaccatctaaaaatgtgaaagctattatcattagttcactggctatatcgaaacacagaatagggaaccagtcagatttggtccatgggccatagtttgctgattcctaaattagctaaacttgaaaatatcatgcttgtatctttttgcctaagacttgaggaaatgagaatgaatggttatttacctactaaaggggcttagcgacaaacattttcattagagggaaaatgttatgtttgagatccaatgagtgtcactaccctcttttcttcttcttgtggcctctcctaagctcaacacctaccctggaagaagtaaatgcctaagcttaattatttgacaagatggtaatcactccaatgggaagaaatgcttttcatgaaaccctccaaaagaagccagtggggagtaaaaaacacttctctggatggcctgtaaggaatgtatatatgccaggaactatgccaggtactcagatgcaatgataagcagtcagatcctcagattcagggacttactgtctatcttggaacatcagggaaaattcctagaagagatggcaccaagaataagctgcaaagcccaaagggaatcttatggccttctaccatctggagtatgcggtctccaaggtactgcagtagaagggaagagctattacctcctagaagtacttgcttctcttgagttctgtgaaatctcttctaccctgttggtttttcttctaccctgttggccaattcttcctagtcttttatgctggccatctttctcttcttaatctcaatatacagggctttgtactgggtctctttcttttcccagctgacctcattcaatctcatggctctaaaactagataggtaggtaaagagaaagaaagaatatagtttctgttctggagtctctccagaacttcagatttgtactccaatcacgtattctacatcttcacttagatatcaacagatacactaaacctcacatagccaaaaaaattgttttttctccaatgcaaaatgctttcagaatgcctctgtttcagtctttcctttcgtggttaatgactctaccatcttcctagttattcaagtcaaaaaatggagaaattatccttaaattctccttttctcccattccctcataccagcattgagtctcctaaacatattcaaaatctattcattgcttccactgctactctgactatcctagtttaagctactttctcattagaaaacataacaacaaaatgaacacttacaaactcatcattcaagttaaatgctgtaaaattactgatgtattcttaccctgtcacacttccccacaggtagccactaccctggattgtgtgtttatgtcatcatcacacttttctcatagttttcagaaatgtatatacttctaaacagtgattagtgtcacttgttttaagcttgatcaaaattatatgcagtatataatcttttgcaactcactttttttccccatcaggactctaacatgatgcctccattgattttaggatagaggaaacatccctgcttctgttaagaaataggctcttcacctgtgatctggatgttgaaagattatctttcttaaaaagaaaaaaatagatggtggagtattcagctatgtcagatgttcccagtaaatccactgaagtgagaatagagaagtaatcatcagatttgacaaagcagcatcaatttctgaccaggaacagcataagtagagttggggggcattgaatgagagtgaatgtgaggtgaggaaataaagacagtgacgattcacaactcttcaagaagttctgtgaaggggagcagagatgttgggcagtagctggagtaggatgtagcattaagaaat

SEQ ID NO: 59150 - DNA, 2591 bp, Bovine  19866880652600
atgctgttggagactcagaagataggcagggtgaaaggaggaaatttctccaagagctggacatagatggaaggcttcagacacagacatgacattgatgatgtaatgaccacagagaaggcccagaaaggcatgacccaaagttggagacaaaagttactgaattaaagaattcgttgaagtaggaaaatgctgggctctagagccacactgtgcaccttattatgattatttttaatggtttgtaccccaaagatgagctgtcacaagactgtctgagatttctctagccttcatgctgacttatactctatggttcccaagttcttatttaggaaccactcctggatttgatccctggatctagaagaccctctggagaagggaatagctacccactccagtattcttgcctggagaattccatggacagaggagcctggagggctacagtccatggggtcgcaaagagtaggacatgtcttagcaactaaacaacaacaatagcaatgctatagttatcaatttgggagaaactaagggtagaggtttggagaaggcaatggcagcccactccagtactcttgcctggaaaatcccatggatggaggagcctggtgggctgtagtccatggggtcgctaagagtcagacacgactgagagacttccctttcacttttcactttcatgcattgaagaaggaaatggcaacccactccagtattcttgcctggagaatcccagggacgggggagcctggtgggcttccgtctaaggagtagcacagagtctgacacgactgaagcgacttagcagcagcagcaagggtacattgggcttccctggtggctcagtggtaaagactctgcctgcaatacaggaaatgagagttcgatccctgggtcaggaagatcccctggagaaggaaatggcaacccactccaatattcttcccccggaaatcccatggacagaggaacctggcagattgcagtccttggggtcacaaagagtcagacagactcagggactgaacatgtatgcaagggtacattccctaaggtactggacagaccaaaaatttgacaaacctctactactgtggctaaataggtaacattggcatcactggtggattaaaaaactagatcttttgtcatttttttcagtaatcataagtattaatatgcctttcacacttaggtcattaatatacaattagatgatcattaatttcttactttgttaattatatttctaaaagaaaagtagcaatcattgacttaaagtttacaaactaaatactggtaatatttatatttgatgagtaatctgtggatttaatttttttatcttataatggaaatgtgtaagagagttcagtgagtagatcatacatacagattttgctactactgtgtgataaaaatagtctatttttaagtcaatctactactttggctcttttatttcacagatgtaatatattgagcactttttattgtgctaaattgtgctatatgttgggatacaataatgaatgtaagtcttttaaagaaaattttacactttctgaatttattaggatattcagactttgtaattttggcttataatcagttatgtaatcagtttcttttgatctttgactcaatctattgtttggtatgctgcttatttctgggcatggaaacctaagaaatgccaggacaatgttccatgctaccaaatgtcatattacccagtgacagcaccaaacatttctttacatctcatgctatttcagaaagaattttaggaggccagaagttcagattttacccctaacattgcaacagagtactaagagaaggaagtgtataacacacaaggacatctttttgttaggtttaaatactattattgcttatagtaaaaacttctatgtagttacttttagaatattttgccattttattttatgttttaaactacttagccttcttgcctcaatagacagataacaaagactcttttccttaatccacaggggaaaaatgatacaaatcccataatgttccatgaggctggatatgtacaaatgttacttttgacaaaaaataggcttcctccccattttatgaaaaatggaaatggcagcccatatgaaagatcaaatgttgttttacaaagaaattgtgaaatgcttaaatctgtagctagagatcaatctattactccttccaaaacccaaagaactctgcctacaacacagaagaaagacataccagcaatatcttttaaagtcagcgatagggttgtagatgataaactaaggaagaaaactaggaagcagacattcaaaaacatatcatgggataaactctataatttttcacagacattttctagcttaacaaaaaaatttgtgggtttccttgataaaactgttattcaagaaatgagtgctaaaactggaaaatttgaaaaaatgttttctacagtaaaaccagtgagcgaattcagtgcctcacctttcaaatattactcaaagccttcaagaaatatactcaaagtccataaaataaataatgtaacaccactggatgat

SEQ ID NO: 59151 - DNA, 1937 bp, Bovine  19866880714398
ccccacggactgcagctcacccggctcctctgtccatgagattttccaggcaaggatactggagtgggttgccatttcatatagtagataataagcaaatatttgttgagaatcaatgcccacatccaagacatttaaagtcaagggaaaatataaagcccacactagcatgaactagaattatcaaagaaaactttattgaggagggaaatatacaaagggtagattttctcataatcagagaagaggatgacagttactgaaggttaaagataaaaagcataacgtgtagtgtgtgatgaggtggggaaaattaaatgtgttttgtttgataggaaggagaagcagtgaatgtgtgacataattaaatactttgttcttattaaaactcttctctttggtactatgtccagagattgttaatgaaggcaacgatcctaaaacttagtccttttggaaacctcaaggtgcatcaaaaccatataaaaatgtttcatttagacaaattatattataaacagtttccctgatgactagtagtaaagaattcacctgccaagcaggagacaagggttctatcctgggatccgggaaatcccctggagaggggagatggcaacccactccagtatgcttgcctgggaaatcccatggacagaggaccctggcaggctatagtccatgaggtcacagaagagtgggacacgactgaacgactaaacaacaaagattataaaccgtataggggaaaacatgagctttataggagggcaaatctacatttgaattttagtttttcccacttaacgatgttattagggcaaatcacttagctctttgagccttcagttttctttctgtaaaatgggaatatattgcctatctcccactgggctgatgtggggcttgaatgcagtaattcttatcagatattcagtgctgtgcttggtatatagtagatgtttagtacacatgagcactactgttatttttaataatgtgaattgatgcattgatgtgtgtgtgataagtcaaggtggacattttgggttgcgtatgtctggggataagcacacttgagtctacttgatctgagggtaatcggaaatggaaacaactcaagaaaaagataatgtataacatggtgccccatagctgtttgcctctttaaaatgaagtaatgccaacacctttgagtctattggcaattgtatgatgtgaatgctcaaatagaaagctaataattttgtctactaactacctgctgtacaaactgtcatgcaaatactgccttatgatttatgtaaacattgaaaaatcccatgactttattcttatgcttggatttttttctatggtagaatacctaattcgattaatttcaagtgtgtttgtctgtaaaccagccaaatatttccttttaaatacttgagctctatgttgaatatacagttatggttcttagcatattactttgtttcagtaattagatttcatcctataatcacttaatgaggttttagttccacatatactaggctgtctccaatccatattaagcgaagatttttcatcttatacaggttcttccaggggacccagccccctaaccatgggagcccaggacaccctccctgttgcagcagcatttacagaaacggtcaatgcctacttcaaaggagcagatccaagcaagtaagcctggggcttagtccactacattctccaaactctatgctattcagcggggaacgctccacatataattatttcattccacatcctaagaccaaaaaaaatctagtcagcaataacaggtgacatacttagaattaaattaattataaatattaactcactgctttctttaaaatatatacccttctcatgctgggacccttggggaagccagtgccccactgggctcccccaaggcc

SEQ ID NO: 59152 - DNA, 1185 bp, Bovine  19866880784849
ccttgactgggaataactttaagtcaaggcagcccagtaggttgatatgcaggcttccggagcagtgtttcaatgcatctttaaactttgctgctgtttaacttatcaggccttgaaagcattaatacagcttctgaaagagtccagcataaatgaggagggccagaggtgccagcagcagaatggctctcaggtccccaccaccagtgatgcagaagaatgagttctctttctggattgttcaggggaactttggcctctagcttctacttctgcctttagctggtaactgctgccaaaaccagggtcagattagccttttggaaagacaagtataagaattagtgtcatttcttacatgcttttggcctaggtagtaacagtttgttcatctgtgaaataaaaaattataataattgcactgtctatggaagcaatgagatgtttgtaaagaatttggcacaactctcaataaatagaggtcactggcattaagaaggttgctgtagtagttacctgaacagagtaattttaattgttccttgtctaaaagaggacctaccctcctgatatgatgcatgatgttttataactaaacattcacttttggggcttccctggtggctcaggatctctggtggtgagcagggccctaggcaaatgggtcctgggcaaaccagccctttttggagggagtaagggagggaagagaggcctgaagagggcattgttgtgagggaaagaggtcctcacagcccgtgggaggatccctggggacagatgcctcccccacctttgaatggccttgttctttcagcttttggtggaaagatctctggcctggagaccatctctagtcctcatttgctttatgaccttgggtgagtcactacttctctcaggacccccaatatccctaaaacttccaccaacgctaaaactctttaattttgcagaaaagcttgtgcagttacaagactggttgatctactcaggccacttagctgaagagacccggacttgagtgaacctttcttcagtcatgggtggaatgaagcaacctatttattgagtcacttttattcctgtatcatcagttgcaaattacatgactcaggctattaatatttttctaaaattatcatgggattcctgtcctaattccggctgtctttaaaaattaga

SEQ ID NO: 59153 - DNA, 1947 bp, Bovine  19866880789260
taatgagaggaagaaggaagagaaagcattcaaacttaagtctaattctgctcatttttatcaagtttgcaaattaaacgttaggaaagaaaatgcattgtaaacatttgctaaagggaaatggggacacaatgtgagtgcatgctcagtcactcagttgtgtcccactctctgtgaccctatggactgcagccagctaggttcctctgtccatgggaggaggcaagaatactggagtgggttgccatttcttcctccaagagatcttcccgacccagggatcgaaaccgcatctcctgcattctgcattggcaggctgattctttaccctgagccacctggaaagccctagggacacagcacaataaataataaccttaaggattctccatacctcattaagagttgcctgaccatatatttatacttccagaatacatatcttttgaggaatttcaacagcttttaaaattagaacatttctagctcaagggaattctggattctgttaataatttaagggctctatttcctgctttccctcaatcaccttttacccctttcccctccagctataaaatgtcccttgcaaacagctttttaaagatgcatttccactagtaaaatccatgagttctttttttgtttattttgagaggaaatggttaagaaagtaaaataaaacagagaaatattcagtccccttggctgcctgccaggaaaaatgccaaatgtcagatgagaggccttgctggaatctacccagccacaaaaccgaggggttggcccaccacaagataatcctccagggaaatttataccaacagcctaaaattggatgcttttaggactcttctccaacaaggtcttgcaaccagacttcatagtaaaatattagggtcctaagctcccagatcactcagtaaacaagagcctgagatctcaggtcacataaaaaggattcaaatatgtgaatactttaatccatttgggagaccatatagcataatgatgaaacacaggccctggggctagagagacctctgttttgatcctggccctcttatttaccttcttgatgatttgcacaagttgcttattctcaccaacctatttcttcacctgtaatatcagaaataaaacagtagttagagggttgatcaagaattaaatcaaaagcccctaacacatttaaattccttgctcactaaatgttaattaccactgctactagttttgtcagccttcaacattgataggtggaaaccagcaccttctagtacagaggctgcaggactctgtacaccgttagagtgttcacattatgtctacaccagtaagttgccctaaagattctagacaggtctaataactcaaccatgaatttggtaaagggaacctaaaaggtaataacctaaatcaaagacaaatgatacacttaatgataatggtaactatttgagcacctaatacattatccgacttcatcctcacagtagcccctaagggagtatcattgttgtgttgattcgctaagtcatgtccagctcctttgcaaccccatggactatagcctgccaggctcctctgtccatgggatttttcaggcaagaatactggagtgccatttccttctccaggagatcttcctgacctagggattgaacccatgtctcctgtgttagcatgtggcttctttaccactgagccaccagcgaagcccaagggagtatcattagccttactttacagagaaactgaagctgtcagttttccctacctacctaagtgatgaaactgggatctgtccaagaagtaccaaacactgcacctcttttctttcatctccaccataagaccttgggtttgaaacctgcaaaatttagcaatgtaatctagaaaagctcagtatttttactcaacatgaactgtggcagaaactcaaaa

SEQ ID NO: 59154 - DNA, 885 bp, Bovine  19866880824859
atatttcttaccgctgtgtgacttcggaagttgcttaaccgtctatgcctcaattcctgtctgtaaaatgaggctaattatattggtcagggtaaagatcaaatttcaataacttattttaaaaagtattatatactttaaactataatattaatgtgcctaagcccttttaaatggaaccttttgataaaacatgggattattttgatacaattccctgctcctaatgtcactgccccaattgtgaatcattgtttgttactataattattaagaaaaaaagaattgttaattttaaaaatacttgctaaattcaatgtgtgttcatagtatcctgaaggtgtttaagttactatagtaatatgggctggcttgtataattatatacttaattcttggttctactattacaaaagaaaaatgttaagttcagtactgttttaatctagagtttcattccctacagcatctgggcccattttcagtgaaagatagagggctttggatctttgctatgttccctttctccatacttttgagaatccaatctgagttcttcctcatctccagtcctcacctagacagaccaagtctacctggccacctctacctgtccctaaagggagaagaaggaggcttttttgtttaaagtaaggccattgtcctgctgggcacctgaccaacttgcttcaagaaagaagagctgtaggaagtagcagaggtgaactgaggaaggaaattaataggttttggagttaaagaaaaaaatttaggccttaaaataataataacatgctaaacttgccctaaattgtgggaactgaaacctcaagtagacatcttatctgatgtctgaggatttcttagcttgtccgcatcctcagg

SEQ ID NO: 59155 - DNA, 1387 bp, Bovine  19866880852120
ctcgtggatctcacaacaacacacatcggatgctgatgaatgaggcttgacgacaggacacctaattttgcaatcacaaatgaaggctggttgagctacaatgttaacagctgacaccatttgacaagtaggtaggagaagaaaccttttcatctatgcatgcaggatcactaaaaaaccaaatcagaggtaacctaataacatcatcattgattgatactgcatgttgattgggtgctctaaggattagcagtagttgagtgaggggaaatagtgtgtgaggaatagataatgtgtccattattttcctgtctcttcccatataccaacaccgcactagaacttacaaatgcacaaattctgtcctgcctccaccaaccaacacactgggacaaagggcccatgccccatatccctcttctttgtcttgctcctgacaaagattatatgattaatcagactacatcattttaagcttctcatagaattgccttcattgcattagtgcttcagtgatattctttgctatttgaacgaaggttgttttaaaaacttgccatatcaactttgcacctatataagctatgaagctacttttgaggacatgccatctcataataaaaaaatctctctcgtggtgaatggcatggttcttacttcctttttgtcatacttgttttcttttaaaatttctactttaacaatgtttgcatatgtcttccttgcaaaactctccaaatcctcccttataaagctgctgctgctgctaagttgtttcagtcttgtccgactcttagcgaccccatggactgcagcctaccaggctcctctgtccatgggattttccaggcaagagtactggagtggggtgccattgccttctctgccttataaggcatatataatatattcaaaatacaaatgtaatttagggtaatgtgaaatcaaatgaactaagctgatctcaaaaaactaaacttatgaattctgtgatcagtatagtactattaatagatcttttagtccttaattctttattacaaagaattgctatctaaaaaccagagattagataaattattgagttcaaaatttttgaagttctacacgtttgcttccatgataatctcatctctgtaaccaaagcctttcaagaccaggatagttgataggttcagctaaataaagacaaaatgagtgtgtgtatttctttactgacaatattagaaatacaaagttcctcaattttttgaattttctagatctgggctgagggaaagtttctcagtttccatggaaaccaatggaagattgtgataaagagaaagcaaagcctataaaaagaaatttcttttaaaataataacactttaaacataaatactaca

SEQ ID NO: 59156 - DNA, 894 bp, Bovine  19866880859172
ggccgaatccttgaagtcaatcatggtcattcttctctttaaaacactctaatagcttctcatctcaactgacagaagagctgaaagcccacgcagcttgactctatcacccaccgccccccttcatgacagtttcttctccaacctcatttccttctgattttatctcccactttcatctccccttgcttactaagctccttctacactggcttccttacctgtactcaaaagcagcccagagcttcttttcttaccctatctgtcccctccactgttcttcctgtctgaagcacacttcttcaaattaaacccacagcccctcactcaagcccaccagatctttgctcaaacatcacattcctgcaagaccttctctgagcacattgaattctgtctgcatttcccactttatttctctccaaatggtaacacgatctaaaactataattcacttatttattttacttactgtctgtctccccatgctagaatataagcttcatgaagactagacaatagaacatagtatgttttcttatacactgaattttcaagtccattcctgcattccttccagcactaagttgaaatgtcactttgagaaactgatgaatgttgagtactggagtattaaaatggttgtcctaaaagcataatttagaagaacatgaatcagtgattgaacaacaacagtcattgtttggatgtaccagcaaatcccccctgagcacataaacataaaaattgaagaggagtatttaaatgatgccttttaaattaaaaataactaaatattaaaaaagaacaatgtggtgccactggcataaaaatagaccaatggaatagaagaaatatcccagaaataaactcatgcatatgcgatcaagtagt

SEQ ID NO: 59157 - DNA, 1063 bp, Bovine  19866881011790
cacatcactctcactttccaaatgagaaaacatgttcactgacttcctaaggtcacacacatgagatttaacctaggtctgactgactccaaagtcagggctcttaaaccttctgctacttggccttgaagagttagaattaagaactaagtcagcacagggcagggagcacctcatcctcaacctaggagaatgtgggaagacttccttccttgaaggggttgcttttgtttgaccttgaatgatcagaacagactgtcaccacacagagaaggaaatagacagtgtatgcaagggaaagagaaggcaaggagctcctgtctggcccaggcgatgagacacgagggtgtacagtagcccacaagtgaaaatgttgcccagcacacaaagacatttggagcttgcctttaaagcatgaggaacaatcaaaggcaggtgaggaaagtgacctctctgatggctgtgaagaggatggattggaaggtagaaacagcaagatcttgtcagacgtggtagcaggggaagaaaaagacagatcggagtcaggaaggataatcaacagctcctgaggacctcctgacatgagggagtcagaaaggaagaattggaaatgaatcccaacactgactctgccttggctactttgtagacacagttctttgaattaggggcacaatgaggctaagagaaacttaatgattaaggtcaatagcacaggagtagggttctacctgctgcagggcttacagaatactttctatcatcgctaccatataccagtgctgtgggcaatttttcatacgtcatttttcagtgactcactaagggcatttataaaggctgggtgtactggctgcacagctagaccaccagtactctagttttaggccctgtatttcaacttagggaaactgctcattgtaggaaaagcaaagtaacatcatctcaattggcagaggtgccctggaatatgatgttgagataagtgctgaggccagagagaaagatgaccatgattgattagtgatgtctgctacagccaatgaagggatagtacaggaca

SEQ ID NO: 59158 - DNA, 2007 bp, Bovine  19866881015410
ctgctttcatgctataaatacagagttgaatatctgagaaagagatcttatggcctgaaaagactaaattgtttactatttggcccttgaataaaaagtttgccaataccctgatctagcttcatcagagatttgctgcttctgctgctaagttgcttcagtcgtgttcgactctgtgcgaccccatagacggcagcccaccaggctcccccgtccctgggattctccaggcaagaacattggagtgggttgccatttccttctccaatgcatgaaagtgaaaagtgaaagtgaagtcgcttagtcgtgtctgactcctagtgaccccatggactgcagcccatcaggctcctccgtccacgggattttccaggcaagagtactggagtggggtgccattgccttctccgatcagagacttgagtcaccagtaagtcatttacttaaacttatagtcaagacttccctactttactgtcactgcccttggaaccattaaaggcaaataatcatactaatagttgatgtgtccaaatattatccgtgtgaagcagacattataaatatcaatgtaaaaacaaaaatgattatggaatagccctgtcttccaggggctcacagttaaaagatgaggaaatacacatgtaaactgagcaaatgctcctgagatagggcgcataggagtgtgcaaggattgccattgagaattgtgagctcaaatttttatgcaaatttaaggtgtcaggaagacagctgatgaagataaccaaagcagatattctccccatggcatcagccttgcaggttcacctgaaggactggctaataccttgtaatatgtatgcagcttagctaaaaacagctgaaaacgccctcaatgcactgattttgattttcaagtgggcatccttggctcaaccacacctgctatgtggctcttctggaggttaagatgaagaagagcagtaacaatcagcattaactatattccaggttgtgggctagcttctctcatcatttggatcattcccacaaccacatgaagaaaagtatggcaatccactccaatattctttcaggagaatccccccatggacaaaggagactggtgggctttagtccctagggttgcaaagagctggatatgactaaagcgactcagcatgcatgcttgcatagcatgcacaaccatatgaggtgggtgtttatcttattcttcttttaagtatggcagtaatgagactcagaaaagctaaggaacttgcccaaggttgtacatttagaaaatgtcatagccaggctttgaactctagagcctgtgcacttagccacaaggctttctgtgtaactgcccaccactttgaagtaaagaacttccttccaacaattatctgatgcaggcagagctgaggtggaagggcaaatccgtagtcctttgtatctgcctattcttcatgactctcatttcccatctccttacaaggaggcaacaataacattttatgcatgatccagatgaaattgatgggtaacacatgtggaaaacaaagcttcattctggcttttaccaactggacttgggtcatctctgtgagtagttacatttggaggaattatggtaaaagggataggatacagattttagattgaaaccggttccttcattttccaaaaattttttgtgcccaaagtaatatagggtctatgagaggtacttagttactgtactaacactgtaagcttggagaacctggctgaagctctttcaagccctatgtcttcatttctgtgatggagctgagattacctatcactaaagattgtgatagagattaaatgaggtaacaaatattctttcagctccttcatttgcctgcttctgataaaaagaacattttgaggagttcaaatttacctctaagttaccaagtttcacagtggcacatgtagcaccaccaggggggagcagagaacaagagtttcaaccaaaaaatggtttctgaaaat

SEQ ID NO: 59159 - DNA, 1812 bp, Bovine  19866881093588
ggcacatattgatccatttaaattagcaaccctccacaattttaaccatactacttgactgtattagtggcagattcttcaatgagttggatttatattgctcttcttctggacaatgatcacagaaattataagaagtaattggaaattccacaatttttattggactatgccatatgtgaaaacacccacccaattacagttgataagcacatttgtatatgtgcacacacatgtacaaaccacacataccacatatgcatacaggcacatcacaaaacagaaagtgagttcaaggagtgtaatttacttccagctgaaaaaccaaagttgttttcaattcacaggaggggccagattgccacggaagctcccaaggctcctcccacttctgtcagctcccagcagtgctcccctcgaatgggatctgttgacaaggcaccttctggacacttgctgactgggacaagaagcttatgggttttgaatggaaaggatttgctaaataaagcttcaatccaagacttcacccctttctcctagaggtcggggcactaaagtccttggtagctttgaaaatcactagatgaaccaatgaattatttacattttagagcctgctccttgacatggatctctaggtaaacccagttaggaaattaaactcttgcaattatatttttgcaatgaaaatgcagactgaggaagcttcttttttacaaccatattagtgtgcctctgcagtccattgtcaaagactaattctcatttaatctaaactgcaacacatcatcctggtgaaattaagtctactcagagccaaggctctttttcatctctgagtaaattttatataactctaattcttggccagtatgaggtattatacatttgaatatctttgatttcttttagattcctctttgcatctagtatatgatttatttagtttgtaatggtcattaaaaagaaggtagtgaataccagtaaaaaaaaaaaaaagctacccttttaagatagggctggcttaattctttcaaggaatgattttatcttataaaattctgattattgctcttactcaatctatgcttttgaataagctgacttattggctgttatttggctaatgacctttaaaaaaaaagtttcaggtctcatagagctcttgaagaataaatggtctcagtagctttaatttcactgtctctcatctccggatccactctcagcactgtttgatttgcaacctctcggctttgtcttttgcttccaacacttcatttgctccttcattgtgctaacaggtcttaattttaccgacttttgaccttcagcacttcctgggttgggctgaatcatttatgactcctttgcaaatgagaaaaagcacttgcttgggcaaaataggaagttattggttcctgtaaccatgggaaggtcagaagcagtaaaggaaaaaagggggattgcaagcaatagggctatctctccttctctctctcaccatgtcagttttattctctcttgcacacagtcttctttcaggaggtgagggacatgccatggcttcaggtttacattcttctaattggaatacctaacaggaaaagactcctcactcacaggtttagtctcttgactcttgaagaagaatcttcactgggccagcgtgggtcatgatctggaaatcaggcggtgctggctcagcttgagtagccatctattcctcaactaaatactatggataaagaggcattgtcatgttgagagatgatagcaaccattacttcatgatggagtgtgacggga

SEQ ID NO: 59160 - DNA, 1137 bp, Bovine  19866881269653
tctttaagaccttatgtcagtggagccagtccacttttacgtggctaagtaagctttaaagtgatttctttctgaatatctgaagttgaaatttatggtttcactaacgtggttctacaaactataggtgttggtgtacccacttcatgcttataaatgactttgtcaacacaggagttacacaacaggtttaactgtttaaattcagtttctgcaaatccagtgaagcccatctttggtgacaaggcttttgaggttttgtctacagaggctctgtggctgggctgcatgtagcgagatgggcttgccctgctctccactggtcgaatatgcccactcctggccaagctgtctgtctcgaagtttgagactttaggcatctgtgtggcaatgcagtctaacccagagacaaactctgacttgtgcaggacacactctgagtttttcctaagcagttcagatttccatccacccctagaccaggggactggatgtcacgttcattgctatggggagatctcagcttatcctgaacacgtgtgcaggaaagggtccagatttggagctggcagctgtgtgtgctctgtcttggtgtctccccagaaggctatgatccagggaaatatacagtggagctagccttttcagactgccattagaaatccaactatctttattcagtctctggtgtggcccagtgtttggtctctacctatgaattaagtgctggctgaataaggactggattcacatcacccctggtgccggggacacctctttccccttctcccttcttctcctggcctagccacactggcctgctgaatagagcctcattatgggccccaaagtccactcttttcttcgagaaccctgccaagattggtaggccctccaatttggcctagatgttgtttcctctatggtatgtttgctgactccatgtgattctttatatgtgtcttgaagaacaaacagatcctttaacaacttttttctacatgaaaacaatcaattccagcagcccagcccacatgaaccaccctacaataacaaagcagagtgcgcgcgtgaaggaggaaaaaaagtttcggtaaggaaacagattttagtttaaaatttccaaggggttgtaga

SEQ ID NO: 59161 - DNA, 1510 bp, Bovine  19866881346485
tggtgctgggcataggagatcttccaaatctaattgttgcatttttagtaaaactcacacagaatagatgaagcaaacactatgggtaggcttgacatcaatatgagcttcaatcatgatctgctatttttagaccagggagcacagtctgtcacaggtaagaagtcagccatggaacttaggcagtttttcaagttactgaattactgatttaattactgaacatcttcagtaactagcttgaatttgatgatctgtgaggtcatcagatgagattttgtttccttgagttctcgtgactagtgttttcccagtatttcttatgttgaacatagctggcgttttcacatcataccagttttagaacatgagtcaactacatccttcttggcttcctttttgctaccttctgaaaggcgcttgttcttgccaaccaccatgttgctgctcagcatcctttccctttgatggcctctacacctgaagtgtcccctgtttggattactcttcctctagctcttttaaagatatatactatgggatatatcattcacaaaagattatactcacttataatatgcaaactgtacatattcacatatataatgtttaaaaatggtatagagatgaacacaatacaagtttagtttttgcgcatttgaagtctaatgaatatcaagcagctctttgccatttggaagggaaaaaagaggtatggagagcatgtagggtgtctgtaaaggccaggcctgggaaattccactgccttatttcattcatataactccatccagatgcaaggaaaaccaacaaatgcagtcttcctgtgtatttgatagagaaaatgctgtgattaatacatgtcactatctttgacacaattttataatttttatccttaattttttggccagcatccataaaacagtattaagtattaaataacaggcataatttaagtcttatttctgattttaataaagattgttttcaatatgtctccatttaacaagatgacagatttagggaagagatttgcttatctcatcataccaaggaacttttaaaaatatctttctataatagatttttatttatttaatgagtgataaaagttgaaatttatcagatatctccttagcaattatggagataataacataatttttgttttcaatagcttaacattgtgaataatactttagatttcttaatgttgaattactttttcttacccctaagataaagtctaacttattagcatatctgtaatatatgtgtattaaatatatataaatacatataatgcttttgaaaagctagatttcatttactgttattttatgtaaaagttttgcatcaatattcagaagcaagattgagcttttttaattattttttgttagattttataattcacgaatgaatttcagagctttatctttttactttctcaaactgttaaacctttatctgagttaactgattcttcaaagagaaaaaaattcca

SEQ ID NO: 59162 - DNA, 1293 bp, Bovine  19866881526926
acagaataacgtttaaatgactagaaaattaacagaataatattaagagcagtaaaatatctaaaaataaacaattgctcagctatgttatactgagaagagaatttaaaaatctcatgttgaagtgttttaattttttatgtttactttgcatatagtaagtaatcaatctttattgaataattttgtgtctcctaaggagaatatatgttatcagaatggcctaaatagtgtactgtaactcttattaaactcttttttaaaacaagggttagggggattatatgcctgacaattacccaggatatttgacaacccccatcccctctacctcagatcatggactcagacactctgggagcagccatagtgaacatgcataccaaacaagcacccccagctggttgttatatcttgaaatatttgagaaccattacataaattgtagtcagccttaacaaaatcaaagcaaaataacaatttaaatgttatcacctgccccagtcggttttggtgatggatagggaagcctggcgtgctgcagtccatgggggttgcaaagagttggacacgactgagcgactgaacttaactgacttgccctagaatagttttgtcaattttgatagaaatcagggagaaaaaaagagagaaacttagaagagagacaaaagtcaaaagaaaagccaaagagattaaatatagaaatacactcacctatttcaggagttttatgaaaaaagggtgaactccagggctgccagtactttttacctgtttcttgacatctcacttgaaatacatacatagcatttggctgcaagtagaattctgactgttgctcgtatgtaaaattggtatcaaattctttaacctaaaatagatgaataaccatagtgaagtaccataaagaaataatgcagtaggcttttaaaacaaacaattattagcggaaacatatggggcacatattatgttccagacacttctcaaccctgggaaaacagaaatataatactttgtataaaagatagtcataaataatcaaatacatgttacttaaccttaaaagtcaaatacacattgcttaatgtttgacaactctctcaagcttttaaatctcaagaaattccaacatgtaatatactcttaattttgacctggctgattttaataggataggaggaggggagacctgatagctactgtttgaattcagtccttcttcctgcccccatctgtctgtccctgtctctctgcagttgggtatttagatcaaaattctttctaaac

SEQ ID NO: 59163 - DNA, 992 bp, Bovine  19866881557872
cttacaactacaatagttggctgtattaaggtgagttgaaaaggtactatattcttttcggtgcctgctttatttgaaaagtgttcttctaaaataagtctgactgtggccttcaccctttcattcttatttcctcacgtgttgccttgctggtttgacaaactgtggtgatggtttctaaaacaatcctgaagaactcagggagaacatgatctccactttcaggcagcttaggtctgaggagtgagaaaaggagaatgcgtcatctcagaggggaggaaggagagtgatattcagccctgtttctgacaggaaaggtgaccagcttgaaactggtgggtttgtccctttaactcctgacgagaattattctcttcctcgctgagctctggctgcgttgtagaaggatgcctgccagaagctaatcaagagttttcctaagcgtgagccaagccttaaatggcccactattaaaagctgtgtctgacattaccagtgatgtcatttcctcccgatccattttatttgagggaggctcatttgtcttcagccaggagagccacattgacttgaatattgagctgcagttagcagcttgaagcctgaggcctctttcatctgaatttgtgattctagtgctttaagatccaagaggccgcagcatccctgaattccaaaagcattagtgaggtaggcttgctttctttttaaattttttttaatataaatttatttactttaattggaggctaattacaatattgtattggttttgccatacatcaacatgaatctgccacgggtatacactttctaaaagagcacaatagagagaggtaggtccttgatcatttggaggaaacagcacagttccccttggggcttaacttctggtgcctcatttgtcagtcatgagggaagggattgcagagtagagtttgtcctggtgtgctgtgtttccctttgtacccgccaggagttgtattcataga

SEQ ID NO: 59164 - DNA, 1404 bp, Bovine  19866881701820
ctagagaatcccgtggacagaggagcctggcaggctacagtgcatagggtcacaaaggtgtcagccacaactgaagcaaataagcatgcaagcaccacatatgtagaatggatgaacaccaaggtcctactgtgtggcaagagaaccatattcaatatctgtggtaaaccataatgcaaaagaatatgaaaaagaatgtatatgtatgtataactgaatcacttggttatacagcaccaattaacacaacattgaaaacaagctatacttcagtaaaacaaattaaaaaaaaatttcccaatagaattgtttctaaacctaatataatcatcattattgtaattctacgagctaaataactataacaaaaatggtcttggctacatatcaaaagattaacaaatggatgcatattttcatattctaaattaaaataaaatagttatgtatgtagttttctatgaggcctgtcttaacagactttatgagaaatgctagtgcttcacacattcaataaataatttttactgtattgcctgtaaaacaaatatattattttctttattatttccatatttaaagttttacataatataagaggtgaaatcatttaaaattttgtccttctgaatcttaaaattcatttgaatttcagatttgtagaaaaatgcataaaactattagagataatctgtatttctattaaataactgttatgtatacaaattaaacctacctcaggtatatccttaagataatgaaaagatctaatagatcttgattttagatattcttctactggctctaaagaaagaaatccaaacataaatgatatttctatattattagattacttctaatttaactcaacaaaccattttctctacttgtaaatatttttggaaatgcagcttgttagaactaaatatattctagaataattttcttttaaaacaaatttctattaacagaatataactttcagttacttactgttacataataataaagctctattttcgtagaaaaaaactgatttctaaataaacagaatcatacttgatagtcaaatcaatctcttcattaatttctttgaaaagagaattattgccttcaacatgaatcccccaactccaattaggaattttcctaatttggattatcatttaacagattttttaaaaagtaggtataatgtagggtcaagcatacagactttggaggaagatagcctgggacttcttgggtttgcaggagacacagaatcaatccctgagtcaggaagatattctggaggagagcatggcaacacactacagtattcttgcctggagaatcccatggacagaggagccctggtcagctgtgggtccatgggattgcaaggagttggacatgatgaag

SEQ ID NO: 59165 - DNA, 1036 bp, Bovine  19866881953273
ctctttgtttggaattgggcagtccttttttttctctgatgttggttttcaatctgtcaaggaagattctggactaggtatgtttaactaaggtctcttcttgctacaacatagaatgttcctccaaataacccaggactcagccaaatggacagccccaagtcgcctggcctctggaacacttctcagtattgaagtagaaacctcttaaggcccaaccctgcagatgacgatactcttactgactggctcctcagtaccttcaaggtttactgggtggggcataatcgttttaggcacatcttgttcagatggtctagtgtaaaatcaaattcttgatgtgcttttccttttctaactcatttttatttcctctgtacttcatgctgatatttcaggacaatgtctgcttccccctcaatgtcccctaaatattacatattaaagagtagtggataatagattctaacaacaacaaatagagagtaataatgcaaaggttatattattactaagtgggttacttaaaggggtttcccaggtggtactagtggttaaaacacacacacacacacgctaatgcaggagatttaaaaagagaggtaggtttgatccctgggttgggaagatcctctggagaaggacacagcaacccagtctaatattcttgcctggagaacctgatggacagagtccatagtccatggcctatagcccataaggttgcacagagtcggacatgactgaagtgacttagcatacatgcagcttacttaaaattgaattttaaatatttctactcttaaaaatcacaagtcattattatcacagagaatcttccttctgtcagatttcttcattgttcctcagctcctcagtctattgcagatcatagctcactacagtcctttcaaagtcctttcctgggcaattcctggatatttgaattttttccaacttccttttatagagcaattcagttccctctcttttctaatgatgctccttggtattccctggggccagctttccacat

SEQ ID NO: 59166 - DNA, 1528 bp, Bovine  19866880418921
tcagccactccacgggagtcctgggaggcagtagctcagcatcggcatctgtgcaggctcagggtcccccatggtggtagaggtggtggtgcgagtcctggggatgagccgcagtaaaccacgtttggtggctggcactggctcttggactgctttctcgctgcagacggacgtgctgaaggcctgtggaataggcgagggaggagccctggggggtggagggtggcggcggtgggtccccactttacaccgccttcccacctaccactggggcctgggcaggtcggaggaggagggaccctctccgccaggacgggtcagggcaggagagaaaacgcagtgtctgggtggacagaggaaggggaaggagggaggaaggggcagagaccagggacagcctgggagttgatgacgatgatgacacggaagcacaaccacaggacaggcaagtctccaactgcctgggttcaaatcctagggttcccctcgctgggcctcagtcttcccacctgtgaattggggatgatggccatgcctgtctcacaggttaggggcaagggtggaatgcgattagacacagagcaggcccgggcacactcgtgtctccgaggatgtggctgctatcgttccgagaactggcggggcccggactcgggttaggccagcctggtgtcttgagtccactctgcttcccaagctgtgtgtgccctctctgtgcctcattctccttgtctgtaacacaaggcccaagttggccccttcctccggggtcgggcgtgcagactgtgggtcgagtgcttagcagaggggccggcgggaccgctgttactgtcagggtgaccgatgtctaccgcccgctcccttgttgtgtgcaccggccctggggccaggccatcgcgctgggttctctgtgactgcttgcaagaactcctggaaacaggtactatctcggttctcctctaacagaagaggaaaatgaggcatagagctgctggcccagggccacgcagcgtgcttcccccgtgggctggctcagcctcgcagcagagccggcctctgggccctgtgctgtctgactcctgagttctgggcgtgcctgggaacccagcgcccactccttgacaccctgctgctcctggccaggcccctcccttcacatgtggcagctcctctccctcccctctgtggctccagtaaagtcaggtgcttggggactgctggaggggtcaggggagcccgcggtgctcagagctgcccggggtggggctcccgcctggccattataaacacggccagttcctctgtttgtcctgccctctgtgcagcgcccagagggaaggggtggccccaggcaaatatccggaggtgtgcccctctctccccatccgcagggggcgggggctggggggcctgggggctcgcgggtgggcatcctgggttggctgccccctctagcaagctgcctcctgcccaccccgtttggatcctaagctcctccctctcccgggtttagtgaggggtcatgcgg

SEQ ID NO: 59167 - DNA, 1041 bp, Bovine  19866880422794
tattttacactaaagtacatctcaggccacacaagccacatttcgaaccctccacgaccacacgtggctggtggctgccgtactgagcagaacagcacagcgagacccttgttactcaaaacactggcctcgcttgggagcttgttagaaatgcagaattctcagtccccctccccagacccactgattcagaatctgcattttaacacgatcccaggggacttatatgtacattagtttaagaaatatgggtccagttctgcctgaaacacttctgtggcttcccactgccctcatgagaaaccccaggtactggccctggtagtcattcattcattcgctcattcattcctgttactgcgcgcctgctgtgcgccaggccgggtgctgggtgatcctgggacacagcaggaacacagacagacctgagtcatggagcccccaggcagttaaaggtaagtacccagatccctgtttcctttagaccgtgttaaacacactgtgctgaggtgaagttacggtgtgcatggggtgtaacgggaggttgacctggcttgagtggaggggcggccagaaacgaacccaaataaggaagaggccactatcgcggcagagagccacacgcaggtgaaatgtcccgctgcaggggacgggctgccaggcaactctgccggcctcggtcactaagagggatcgttttcaggcttcagggccatgtggagaaatgcccggaggggatcgggttacggggaacgagccagtgatggggctgcaatactgtcacaccggcagagatgcctgcatttggaaagcccacggggaggagctgggctcgggaagatggtcagtgtgcccacagcgggaggacttagagcaaggaagttaggtcccttttgctttgaaggccatgtcttctgataaaacacctgaattgctttaaactaactgagcagggagggaacgtgtgcgggatgtggagggaacaagaatggccacgtgctgtaactgctgaagctaggtgatgggggcacgggcactcat

SEQ ID NO: 59168 - DNA, 1124 bp, Bovine  19866880440357
ggacagaggagcctagtgggctgccatctatggggtcgcacagggtcggacacaactgaagtgacttagcagcagtagcacttagcagtataaagacttgctctagaagttgacagactggctggtaccaagcctgcttcctgcacggcagccatccctagagctgaacaatggtttccactccgagacggcaggctctacgctcggtcacagactccaccccctccctgctgccttcctccttacagctggcccttgttcccatatatattacctaactggcctccagacatttgagtttacaacccctaaacagtgtcatgtgtaaagtatgtggcacaagcctgcacatagtaacaccatttataataatatccatccactcatgtaaccctgactgtaccagacactgtttcaagtgctttcctcttatttattcatctaagcctcaaagaaccctatagggaagatactattattatcccattttaccaacaaggaaactgaggctcagagaactgcagtgacttgcccaaggaaagcacagcttggaaatggtgaagtagggattgaacttgggaagctccggaacctgtgtccttaactcgtaaatgttcaacagcctctcactctctgcacatctctccccacgtctacccaggcctcactgccgaacctcctttgcctctctctccaggtgagccaggctccatgactgtaacctggaccacacgggtcccggtgccctctgaagtgcagtatgggctgcagccttctgggcccctgcccttccaggctcagggcaccttcagcctctttgtggatgggggcattctccggcggaagctctacatacaccgagtcaccctgcaggggctgctgccaggggtccagtatggtgagaggtgccctggggccgggtgttgaagggcgaatgcgaggagaagtgggatgtgggctaacagctactattggcaggtggctcaggcaggctggtaccctctctgcttacctgcaagcctattgtatgagaccctgggatgaaaacggaaggctggagacctggggtgaaggtggtcagaaggggcatgggttagacccattcagtccccccaccaattgaa

SEQ ID NO: 59169 - DNA, 2174 bp, Bovine  19866880593656
tttgtgttggtatctgaagagtggggttgtgtatgttcaaatacgtacatgcaggatgatatgtgtacatgtgcctgtgtccttgacataggttgaccccacttatgagcccagtgagatgggggcccgtgtggcaagacctgtggtatgctgggatccatggacacaagcgtgtccacatcctggaccaagagcctccagagggcgggggcacatagatcatgctactctgtccatgggaattcagatacagagtcatgggttgtgggcccatgtgggttttggcatgtccacatgtgctggggtgaccatggtctgatggcgaagatgggaacttctgatcctcccccagctcctgctactgtccaggtctttgaagttgggggactgggatgtggattctggaaggaggaggctgggagcctagcatcctgggtttgaaggagacaagagagctgagggaccagactcctggatcttgggaaaggaggaaactgagacctggactgttgggtctaagggagggggagtgtggggatctcagtctcttgagcccccagaggacaaaggactaaagtcctagactcttgggatttggagggtgaacagtctggggctcagactccttgatttccagaggtgacttcctgggtccacctgagcccctgtagaacctacagcaggagggctgagagagtgatcacggcaggggcttcctgggctgaggtggtctctgaggagggtctcgggagaggagccagaagaatactaaccgtgtgcttttgttcctttgcaggtactggcccaggccctgactgcctgaagagaggtgagtggggtccctccggctggggatagagatgtgaagtgattgggtttactctgagagagccagaggcttggagtgatgccttgtatgaattttagtggcaagtatggtagtgtcctgagggccaggtgccctgcaggctggggttggtgacaagatcaggaatgtcttgtttgggtaagagcttcatagaacgatggtgtggtaggtgggctctcaggcctggaggtagccccttttaggctgagtaaagtggtcagaaaaggaggcaagagtttcctgacatgaaatgaccctgcatttggatggtggcatgggtatggtttaccattttgtgtgtgtatgtgcacgtatgtggggacatctcctgataatcagacctactggtggctgagagagagccagagcaaatgatcacttaacgctaacagcagctaacatttatatagtgtttactccatcagcaactactctaagcatgttgcggcagattatctcatttaatcctcacaataatcttatgctatcatccccatttgacagatgaacacactgaggcccaaagaaaggaagtcacgtggcaggaatttgggtgtgaacctgggcagttgtgggccagattctgtccctcaatgccatgctgcctctcaataaatgttagctgttttcattattagtattacattgtttcaacttgagtcccaccctggctgtgggccttctggtttcatagatagtggttctgagccccagagagcttacagccatgcaggtgcagagctgcgtctcctacttcaggagcaccacctcccaggccaggattttctgttggaggtagagccgtgtccagagggagtgcacaacaattagtggggcggggggaggggggcgtcgctcagagatgaagcgatgctctgactttgcctctttttctttttgcagccccatcactgtcttcttcagtctctttcttctggtcttcgtctgtgtaacactcttgtttcctcttcttgtctctccctctctccatctcagtgtctcagtctctcttttctgtgtgggtctcctccactcaatttttctctctttgcctccgacttgctccctgtctcttcacctgtctttcagattctttctcttgttgtctctttgtctctctctttctctgttgctctccgaatctgtctctgtgtccacagtccccctttgcccgtgggctgaaggatcagggccacatgaggccacagcccccaaactgcagattcctgggaggtgggccagcagggactggggcatggggtggggtgaaaacagtgtcagggacacccccttcccatcctttcct

SEQ ID NO: 59170 - DNA, 1609 bp, Bovine  19866880658563
cgggtgcggtggcttccccggcggcgttagaggcgatgcaagtgaaggtgccgctgtcccgcaaggtggtgatggttacatccagggtcccatccccccggacccgggtccggctcgagttccccagcaggcgcccgtcgggtgccacccagtgcaccacgggctcagggtcccccacggcgcggcaccgcaggctgaccgcctggccctccaccaccagggcccggccgcccgcctgccgcgtgatcagcggaggctcacacagaaactcctcctcggggatagaccagaagtagcggtcggtgaggtgctccggcgtggcacacgtctccaggtcgtcctccctggtcagccgccgcagccacagcagctcacagttgcagtgcagggggttgccgccgaagctgaccgtgagcggcgtgggcggcttgggtcccggaccttgggacctcaggaagagcccatcagggggcagtttatgcaggcggttggaggtcatgtccaggcgaaccagtttgtgaagctgcacaaaggtcccttcggcgatgtgatcgatgaggttgtggtccagcgtgagagtgttcaggttcaccatctggcccacggcctcccagggcagggcctccaggttgttgtaggacagatccaggtcctccacggtggacaggaaggcgtcgaaagcagccgactccacccgacggatctggttgttgcccaggatcaggtggcggaggttgcccaaaccccggagctggtcgcctcggacctccgccagccggttgctatcgaggtgcagggcgcggagggcacgcaggtccgcaaaggcgccggccgccacctggccaatggtgttccgggagagggtgaggtgtaccaggctggtcatgttggcgaagtctcggcggcggatggccgcgataaagttgtcggtgagccgcagctccaccacgcgccggtcgatagccggcggcacgaagagcaagccggtcttggcgcacagcatggtcagcgtgggcgccacgttctggcagatgcagcggccaggacagggctggccccgtgatgcccctgcccagaggagcagcagaaagggcagggcagtaggcggcagcgagaggagcgctgaggagaaggggcccggagccatggtgcagaggggaggcaggaggagcgggaggtgagatctgcaaggaaggagaagggtcagccaggcgtagggcttgaccacctgcctggccaccctgggatgtcccgctcggagcctgacccacatccgtcccttcctgacaatggggtcctcttggacagtaacaggactgaccatcaactggcatgcactcatgaacagatcacatcacttccatggtgcttggtaaattaccactgccccacctctgagtgtctaacccccacttctgcccctcttccaggagctcccagacctctcatgacctctcagccagagggatgacatctggcctggcctgcaccttctagtacccactaaatattttgaaaaatcactgctgactagggtttaaagtcatgaatttcaaagccatactccctgggttcaaatcccagctctgacacttactagctgtgtgat

SEQ ID NO: 59171 - DNA, 1525 bp, Bovine  19866880665682
aatctggtgagcctaaaatttggggatccgtggtatgaggatatgggtgagacagaagggcattctggctagaaagaactttctgagcaaaatccctgagatgagtgagaacagggaccagaaatccagggcctgtaatgctggcagagagctgggatttttctcctgagggcactggggagccatggcaggtttaagcgggggagtgactacttgtgttgaacctttcataagacccctttaactgtggcccgtgtgtgtgtgtaagagaaggggctgaggaccccaggagtgagatagtgtggacaccatggcaggaggggggcagacagaggaggggtgttgatcctgattctacagatttcctgccttttttttttttttggtctctggctctgagccactccctgccctggattctgacctggggacagctctgactccactagacagacactcctcctcctgactctgtcctttcttcctcctccgatgaagacaggcaggcagccaggcaagggtgtgggtctgtgcgcttgcagtggtggtgggagtgtctccagttatgcatggatcatgggctctgcaagtatttggaaacctcttggggacttctgggtgagcaggaatattgcacataagttagtttgtccccttctgtgggtcctgcctccccccagggccctggctaattcccagctttcccaggataggtcacttcacctctcttgcctctcagttccccaatcagtcagtggaggaactattaccagtgcccacctcccagggttgttgtaagacataatgagttaaaggcagacactcaataaatgtaactatgttctcccatctgtttccctgtgagccactgtctctgggggtaatttgaatctgtatccctgtgtatcacatgaaactccgtgtctaatttgccacataccagctgtgcaaccttgggtgagttactagacctctctgagtttcagtaactgagacttctactctcagttacggagacttctacaaaagtagaagtctacaaaacgggtataacaatagtacctatttcctatggaagatatggagattgaattaattactccacctaaagaatttagaacaatgcctggcacacgggcgttaattacatgagcatcatttgggtgtgagctccactctgtgtgtctgcagaatgtgtctgtcagcatcttgtgggaacctggggcgggaagcatatggggttatctggggtggtatgggaccaggcctgtgagggggccctctagtttttcatctgtgaaatggggataacaacagctccctactcagggttggtgtgcaagctggcccgcaactccatgttcattcactattatcttttcttatgtataaaatgcccgtaataatagcacctaagttgttagaggatgaaatgaacttgtaaaagcttaggacaacatctagcaagcagaaagcattcactgtggcacttgttactggtaacttatgtgggactgagcctgtg

SEQ ID NO: 59172 - DNA, 858 bp, Bovine  19866880692694
tggtccgactgctccaggaggcaggagccgacctcaacaaacccgtgagctgccccacggagaagatgtggcagggtgggaggtcgtccccgcgtggggcagggccccagtgacctctctgctgcacccctcaggagcccacctgtggccggagccccctgcacttggctgtggaggcccaagcagctgacgtactggagcttctcctgaaggccggtgctgaccccgccgtccgcatgtatggtggccgcaccccactcggtagtgccatgctccggcccaacgccatcctcgcccgcctcctccgtgctcatggagccccagagcccgaggacgaggacaagcctggcccctgcagcagcagcagcagcagcagcagcagcagcgacagcgagagcggggatgagggcgtgagtcaggagagagcgggcagcccagctggggggccagggtaaaagcgggcaggtggaagggggagaggagacattgtgcagctcactgagacccgctgatgttggggctgctctgattggagagctcaggcagccatgcaggcagtatcaggggagacctggacaggggtggtggggagagctcaggcaccagccggtgagaagtgaaggcagtggcagaggcagaactcaagcggagagagagataagacctcggtcgtagtggttggtaaacataggcagcagaggatggctgcaggagattttttttcggggagcaagagcgggagaacgcaggctgtgggaaggtgaccttgggcagcagtgattcgaacactggcagcagtggggaacgacctcagccagtggtgaaggggcttccttggagagcccagtcagcgagaca

SEQ ID NO: 59173 - DNA, 1584 bp, Bovine  19866880715929
acctgccaatccaggggggcatgggttcgatcctggatccaggatgatcccacatgcctgggagcaactaagcctgtgctccacaactactgagcccatgctctagatccagtgagccacaactactgagcccaagtcctgcgactactaaagcccacgtgcctagagcctgtgctccacaacaagccaccacaatgagaagccagagcactgcaaccagagagagccctcgtgaagcaatgaagacccagcacaaccagaaataattaattaatttaaaaagaagatagaaagatgagctaaagactggaagaaaatacttgcaaaccacccgtctgatgaaggactagtatcttgaatagataaagaactctccaaactcaacagtaggaaaattaaacaatccatttgggaaatgaacaaaagacattaagagacatttcaccaaagagtgaaagttgggacataagtatatgaaaagatgttggacattgttagccactagagagatgcaaattaaaaccacaatgagataccattatacaactatcagaatgcctaaaaaaaatagtgacaacatcaaacgctagtgaggatacaggaaattgatcactcattgctggtgtaaatgcaaaatggtacagcccctctggaaaaacagggttggtcgtttcttaaaaaactaaacatgcggggctttgctggtggttcagtggtaaagaatctgtctcccagttcaggagacatgggttcaatccctggcctgggaagatcctacatactgtggagcaactaagtctgttagttggtaattggtaaaggactacatattatttaatagagtgttattaaatgatatttattcatttactaattataaaactattgttcatttgctgttgaaaattggaattgcagacatgtttttctcaaccattgttaacaataattatagctgatacatgctgagcacttcctgaatgaagaatcccatggacagaggaaccaggcggactacagtcagtcagacatgattgaaacaacttaacatgcacacacatgaaataatactctaaggaagacagaatttttctaagacccagatgaggaaaaaagctgaaaaacagaagggagggatgtttgtgcaaggaaagagaaagaaaaagacagggagagaagacaggatgtaatgacaaaagagcgtgatggaagagcaagcagtagaaaccctagtatgagctcctggagggcaggcacttgtattggtacctctgccaagcttgctgcttccaattgaaggcagtggtgtgttttcagttcatcactagagagccaaagaaagatcaacacacagaaaatacagagtcctcactgaggaaaccagaagggaaagagacacgtgtaccccaatgttcatcgcagcactgtttataatagccaggacatggaagcaacctagatgtccatcagcagatgaatggataagaaagctgtggtacatatacacaatggagtattactcagccattaaaaagaatacatttgaatcagttctaatgaggtggatgaaactggagcctatta

SEQ ID NO: 59174 - DNA, 956 bp, Bovine  19866880728731
ctgcctgatacttgtggggtaagtgcataactcttcctctcactccccaaaggcaagggtctccccttacccactgattcatatctctgttccccgttttcctttgtggctttaccataagcctggcaagatgcctgatcacaaaggacgcgggaagacagtgagttcccatcacgctttatggactatggatcatcatggctatatggacagtaaggccttatcactccgtggtatccgacacgtacctatgtgccaggcacaacacattggctaaactgggaaggaattaaaattcttgcgatcagaacgccccctgcgggacagtatcttgtaagcccatttcgtccgtaaagcgaacagccaataggcaaagcggaccggccccgcggtggttgggccgcgcaagcgcactcacgatgccgggcagatccttagaccgcaactcccccttgcggagatccagcgcgcgcgcggcatcttccgggtatgcgcacagtgattccatatccagcagagggagcgcgctgtagccctcacgcgcgtgttcgtacaggaggttccggtcctgtctctccgtagcgaaacttctcttgaagctctggttacagacacagcctcctcgaagccgcaggccccgaccagctactagaggacccaagcgccgcactatggacgcagccatcttggaaggcggacaaggagtcacgcacccccctcgtcccgcccactactcatttagaccaattacaaagctgctgttctgctcgagactagccaatcagaccctgggaggggtgaagcccttctatgcctcaaaaaaacacaattcaatgagaacagttgcccgagattgacactaccgttgtccaatcgttctctgttccccgcagatcgagctagagatcggtttcagcgtgtcggcggaccgggctagggtcggtaaagtctacgga

SEQ ID NO: 59175 - DNA, 1138 bp, Bovine  19866880752265
caggtcacagaggcctcctggggaagtccctgggccaagacaacccctctgttctgtgtttctgggtctgcccacccagccccacagaggggaggttctggaggcccagagagagcctctatacctttgcggatcaaatgctgcccaccctgtctgccctccctggtgctgcctgcatggcccaggcctaattccagatcctagctctaagcccgcctcctccatgaagccttccctgggtctccctttctcacaccctccctctaacttgaatactgagtgtttgtcactgtccccctcactgagctctgcttcatcccaggctcacccccaccaccacgtttgctttgcctaggccactcatctggtctagcttctccaatcaccccccatccaccaaactggacttcagaagcccagccccagcccatctccaggaagtctctgatggtcacccatcccgaatcctcaacccacctggtcccaccacacttacctgagccctgagttgttccctgccccacaggatccctcagcattcccacagccacaactttagctgccacccactgggtctgctctctccaacccccatcacctcatcctacttcagggccccagatgcaggctggagacttccaggaagccctccctgatagctagcctccctgaggctgctgtgtcatggagccccagacaggggactccccgagtaaagtatggtccaggatgaggcaggagggttgatactgacactacagctgcccccattggcacacgggttcccatcacagggcccaggcccaggtacgaggcatccagtggtggcagacgatgggcccctggagctgaggcagctgctgctggagacagggattgtgcagaggggcccagtccagccctccaggcatcgacactcatcaggctgctcacagaagccgtgctctgggctgcagcctgctcgacacaccgctgtggggggaaggagaggcagaggggaagaggaatattgaagggcagagtcaggaggataggaaatcagagacgattctgagcactttccctgcatccctcctctatctttgtactacaacccactgggctaccggtattagacccccagttacagacagggaaa

SEQ ID NO: 59176 - DNA, 858 bp, Bovine  19866880752972
ttagccccaaaggagaagtgaaaaggccccagcagggatgaatcatcagtcctggggaagaccccaggcaccttggcctcagctccgggaagcagaccttgaggaggaggcttcaggaagagtgtaccccactgggctccccacttccctgagaggcagcttcagggagctcagccatggccgtcaggcctgggcaagtgtagggcggagctaccagctcaggcccagctggtggggtgtgaaaggtccaagtgactcagcctggttgggggacggatggccccacccagaaccttctgtaccctggttcccatggcaccgcctagaggtctgctgtcctggaccccactcagtgcagaacacccaggaccacggagccttgcaaatcacccagagcccaagtccccacgctggagttctgggaaatggccagctcttgtgtgtgtgtgtacatcccagcagttccttccctttctccctgaccttcctagaagtgccaggcacagagggcaagctccaggcagggcagcagacctctcgggcacaagctgaagctgctgtccacagggagaatttcttctgagaggaagccacagctctgcccatttatctgactagatcagtcccccacccatgtgactccccacatcttctaggataatctgcttaaagtcaactgattatagacttgaatcacatccacaaaattccttcacagcctcatctagattaaataactgggagctgtagcctggccaagttgacaaataaaactgaccatcataaccttgtcagtttggcacccctacacatctccttaaccacacttaatctccaaatcaacacaaaaacaaagtc

SEQ ID NO: 59177 - DNA, 1132 bp, Bovine  19866880798835
ccttggcctgaaggaaggggaactggacctcagcgctgcccacctgattccaaagcttgtaacagcggtcactgcacgtgctattatacacgtaaaagcatctggtttaatcgtcaccaaatccaacagaggggatactgtgagcggagttattttttttctggtgaaggaaattgaggccggggggatgtccagttgccaagaccacaaagagggtgaataccacacaagaaggttcaggtcacaaaccttgggggctggggtctttattgcaacccctccccagaagatggcagtacagagtcttgtcccagcagaagaggttgttggagccagcatggaagccaacagtgttgggagaggggcgcccaggacccctatgggttaagggtccactgggctgggctttgaacccagaccagctacttctagagctggacttgcttcctcagggcactgcaggtgcaccaagggaaagaaagttctgcgtgatgatccacccaccgggtccccacagtcacttcttcttctgcacgtggccacagtcgtacttgccgcgcacgaccttgagcttgacacccggcaggtcctgcgtgcggccgccctgtacgaggaccacgtggtgctcctgcaggttgtggccctctccagggatgaagcagacggcctcccggccagtgctgagcctcacgcggcaacacttgcggttggctgagttgggcttcttgggcttgcggataaaggtgcgcaggaccacacccttcagctgtggccggccctccgtcgggcctggtttcgaaggcggaaacttcggggggccccgacggtgtagctggttcagggtggccatgggacgcgtgccccaaggccggggggccagggctaggcctggagagacaccaggagggcggaagagagattattatcccagcgaacagataacagcatcagccactcgctcttttgtttgaggcaccgttccaagtacttcccagggctatatttgtttatggctggaggtactcatggctgagagtaatattaataacatttatggagcaatcaccatgtgtcgggttcttttttaagcatttcgtaagaattaacttacaggtttccactgtgtcctgta

SEQ ID NO: 59178 - DNA, 1698 bp, Bovine  19866880803483
tgaaaagtgcaagaagcaggacagaatacaaacgtgaagagtcagctccatgtgagcaaaacaaaagtgggagaaaagatgcgcaggaacaaatgtccaggaaagaagagaaaccggaacgaggctgtctctgggaaggggccaaccactggggtgggaaagagacctacagctgcacactctctgtgctttgcgtggcttctcaactgtgaacagatcatacgtgccgctggggcaaaaatgggccttcttaaaattaaaatgcaggaaaagagaaatgaggttaataacaccccttcctcaaggctccgggccgagctgctgagagatgcttataaagcacacatctagctcttagcacttgggagctgggggctggcacagtgtcctgaggggctgggagcaggtgaagaggaggctgcagcccagagcggggcacatccgatgagtttactgtgtgcctggcaacatgcaaacatgtcgacatcagtctcctccaaccctcccaatagctcatttaacagctgaggagggcatccccagtggcttagctgtaaagaacctgcttgagatgcaggcgatgcaagagatgtgggttccatccctgggtcgggaagattctcctggagaaggaaatggcatcccactccagtattcttgcctggagaatctcatggacagaagagcctggcgggctacagtccatgtgacctcaaagagttggacacaaccgaagcaacagcaggagcaccatgtgagggaggagaggcccgcggcggcccggcctccccccagccccggggtcctcactaggggtcgggctgtggggtgtggggaacgcgtggccctggcaaggaagctgccactgctccgaggacggcagcagagcacgtggcaccctggggaaggtcagggtgggaccagagggccctgtgacaccagcagcggtgagtggtggcttctgctacatctgccgtagctggctcccctgggacctggaaaagctccccttctgaccctccttgcctccccctcaaccttcctgtgggccagggcagctgtgagacaataagccccagccccggatgggtggctgggccgggaagggtcccatttccctggtcgtgactgggaaggagaccgcttcctgctggcagcatctgtggccgcctggctggggtgatgggagaaacagctgctggggacaccccgagcggcgtctggccaggaagtctggctcactaggagccagcaggacaaggaggggtgacgcagtggaccagaaggggaaggagctgtgggaggtcctgagggaggcgcgggcccagggctcagaaactacccaggctgccccctaaagagtttctgtccaaacaggaatctgggttaagaacaggaagtagcctgcttccaaatcactggagggccactgtgaaaacaagcagtgactctggagcccggaggcctgaagttcaagccctgcctctgccacctgcctgctgtgtgtcccaggcaggtcacacgcctctctgggtctcattctctcatccctaaatggggttaataaccatacctatgggcttcccaggtggccagtggtaaagaacccgcctgccaatgcagggatgaagagacatgggtttgatccctgggttgggaagatcccctggaggaggaaaggcaacccgctccagcatt

SEQ ID NO: 59179 - DNA, 1220 bp, Bovine  19866880856885
acctaaatgtaaagtgcagaactataaaactcctataatgtagtataggagaaaatctagggaactgtggtgatgattttttgtatacgctgaaagcacaaaacatggaagaaaaaaaaattgatgaattagaaaaatttaaaatttcagatgacagacaccattaaaagaatgaaaaagttactccctttctctcccctagtcttaaaaagcatgattttaacaaaagactggaaagaatatcaatgcctaccaataggagtttgggattggttattcaataatcccattagattggaagccttactagtggtacatgcaaattgtcttccatctgcccctccaagttcattcttcccacttctctagcctcctctgggccccagaagctggcctttggcttctgttgagtgcagccaatggggagcctagtaataggccccgagagagggaaagtagaatacaggcagtgtatttacttctctttccctccacctgtgtgtatgaccctctttgtcccaggtcagggaacccctccctcccctatccgctttcttcaggtttagggatgacagatatacaccggctgggcccaagaccttgaactactcctcctctgctccctttaccatccaatcccttggtaaacactcctggtattaaaccacttcaaattatcctaaattgattagggcatctttcctgcaggggacctcactgatacagtatgattaaagatgtgggggaatgcaaaggagagataatggtaagacacaaaaatcaggctaccaaactgtatacagacaagctccaacttggcagaaattgttcatagagggaaaaagaaaaaaggaggattagcaactaactgctaaaaagattacctccaggaagtgggattaaagacttgtttaactctccaagttgtatgtttttttaattggctgaatctttataacgaatgtgttacttcaataatcagaaaacatacacacaaatcagtctatgtacgtttctacacattggaaaaactgttccagagctggggtgaggcgagacagggtgaggtgggtggtgaattgacagattttctttttctcccttacgcatgtctctatttttcaggcgttatccaatggccttgcattactaattttatcgggaaaagtagtaggttttattatttatttatttaatatttttatttatttatttggctg

SEQ ID NO: 59180 - DNA, 1104 bp, Bovine  19866880872490
ccccacccttggggctccctgcaagggtacaggatgggggcagagtgtctcccggtactgaccctcttctcccaggtgtgggctgtcacctgggggacctcgggcaccccaccccccggaactcctctaggtctgtctcctgattagctgcacagagaacatcccctctttccatcagaaatgtgtgagacagagccctatggctgtcggtccactgaagataatggcctactgcttggggattttaaaaagccagaggctgggaagatgaggtctagtcaggaggtgagggacgaggaagaggaggaggaggcagcagaaaggacccacaagtctgaggtgcgggaacaggctgtccgtgagcagctccacagccggctccaccaggaccacgaaagaggagaaagaggaagaaaagaagagggggcccgtggagaccttggagggcctgtggaagaagcgtctggagggcggcaggggcccccaagaagcaggtggcagagcaggccagcgatgaggagacggcccagttcgaggcagaggagaagggagtgcaggtgctgggcgagggccgcagcctgtggcagggggtcgaggcgggcggagagagacgtgagggaccgccaccactcccgccaaccagaagccgagccccagcaggaggagaaggaagaggcttcagacaggcaggtgagtggaggcgacaatgggggagcagggtagaccagatgtcagtggacatccttccaagtagtcaccaacagcaacatccaccatgaataggctgacacaaggagtaggtagcaacacctaagcggggccttcacctgaccaggagggcttccatgcctactccccatacagcaaccaagaagccacccttattgcccagaagcgccagagttagctaccattgctggtctgtgaccagtgtgttggccccatgaaaagtagcagctgtgcccagttcactgggccataggcggacaccactggtgggtcgtggagagtagagctgtcaccacgatcaacagcagtgacagaaatggccctcacctcacagatgggtcatggcatccaaggtgagcgcctgtgctagccctc

SEQ ID NO: 59181 - DNA, 1134 bp, Bovine  19866881009004
atttacatgtggaagataatctggctcccgtagcctctaattcacggatttcctctcaataccctgagcccgcagcggttcgtttggctgagcctccatgaaactggctgactttccagacccggttaaagaaactcacgcaagaaagggctgggagaaggggagggaaggcggatgagggctctcggccgctcgtgaggaaggtgtgtgaagctggcttttagtttttaggacaaacccagcagcaattggttcccttccttgtggcctccgcttgacctgggagagtgggtgtcccgccccgtcctgtggcgtgggcgttcctgagcaggacgcggcggcgggagactcccagccctagctggagcgcccgcggcagtgcacccgcggccctttgtctctctcgggctcccgtccacccgccccgcccctgcattaccattggccgcggccccggcccggggcgggggggagagagtgaggaggcggggccgcgtggcgtcagcgcaagatggcggcctcggcagcggtgttcctgcgattgcggagcgggctccggcaaggcgcgcgggggctgtgtgcgaggctcgcgacgccgccccctcgggccccggaccaggtgagccggatggggttggccccggggtgctggggctccttcctgtggttccaggcggaccggggccgcccggggcttctggaacgcagcacctcagggtgctgaatggaacgccacccgcgttttgagtctctcccccgtttcccggggttagcagcgcttgcttccccgggatagatgcttggggactcaagtgtgttctctgaaccttccttacctcctctggatcccacctcttctggaccccaccttctcgaccccacgtgggcgcgggggaaggaggggtcacctgctctcctgtctctgtgactgttcaggtaatacttgagggggaggggcccgggacactggagtcccagcctggcctcccgggtattttccccgccatggtggtggtggtgttgctcgggcttctgattcgacctgcctccatcttgacaagagaccctgtccttctgacctccgggtgcattacttctgtgccctgctccccaagtctcagcaagcgattgccc

SEQ ID NO: 59182 - DNA, 1021 bp, Bovine  19866881311245
gggccggtggaccgagcacattaggtagtggtgggctccctcctgggcaagctggagcgcgaatctcccgtgtttaaccctattatatcccacagagggcttcagaggctgggaggtggagcacggcgggaatggctgggccgtggaaaagaatctcataatgatgccgggcgctccttcccagacctgcttcgtgacttcgttcgagtgagtggcccttgatcactggggcgagggagggggaaccctaccctacggtcctcatcctcaccctcacccacgttcacactctccttcccacatgcatgtactcagtcattcgactaataattgtcagccttttgaattccctcttttgtcagttacctgttcctatttttaccacttactttatttatttggctgcatcaggtcttagttgcggcatacaaactctcagttgcagcatgtgggatctagttccctgaccagggatggaacccaggccccctgcactgggagcatggagtcttagccactggaccaccagggaagtccctgcctgttcatatttttattaaggttgatgtcttattctcgttgatacacaagaattcctatatattctagatgtcagttgtttgtccatcctggacattacagaaatctcccactctaccatatgaattaagtgtgtccatggtattctttgttattttcatatgatcaaattcatctttttgctttagaatttgtttttgaaattttgtttaaaaaatccttccctccccttagatcctaacagtgttcacttctactcttttctagtaacctcatagttttatcttttatatttagatctttaatccacctttgaatgtgatgttcggtaaggatccagttttttgtttttccctctatatactgagccagttttcccaacaccatgtactaaagaatccttccttttaccatggaatgtcagcgccacctccatcatttatgaagttcccatacatagctagatgtgtccttgagcact

SEQ ID NO: 59183 - DNA, 701 bp, Bovine  19866881417989
acgaggagagagaactccaacacacacacacacacacacacacgcgcgcgatagtaactatgaggtaattgatgttaaacattgtaattatttcacaatttacatgtatctaaaattattttgttcaccttgaactaacagcgattatatatatcgcaataaaactggaagaagaaaatccaagatagaaaaatatggacaaagagacagtgtcatttacatagtttgctgaggacctgacactgcctgacacatctacaaaattcttaaactgagatttagaccgactcaaatttccagacatctaagaggcaacaccaccccctggtgacgaagaggaaaactgtacctccccacaatagaaaacactccctaaccgatcgtagccagagtcccaggattctttccagcctaaaaattccgacgatcgaaatgtttattcttttaagtgacgtatatgtttcggttgattaataagaacaaatttataaaccggtaagagaaaaattaaaaactgctccaggtgaggatcgaactcacaacctcggcatcgctccgctcgcactgccctataagtaccgcgcgctaaccgattgcgccactggagcttcggccgcacccctgtgccgtgaagtccttcagtcattcatggccacgtgaccttggaggctagctccgcctctactttgcatatacaaata

SEQ ID NO: 59184 - DNA, 1240 bp, Bovine  19866881558797
gttgggggcggggcggggcgggggggctcggactcctgcgtttgagagacagggtggctgggaaccaggactcctgagtctggtgaagccacggcctgggaaccgggtctcctgggtctgagcgaggaggcggcttggaaacccgaaccccttgatctaagcaaggaggggcagaggtcggggctcttagtacccccgcccctgttagtgtttagacgggtgctcagtccttcggcgcgcaaagccccttccagtctctcttgagaatctcccaatccgaagcgccctggccctcgagccgatgactcagcatatggaagaggggagggggtcagcctgagtcagggatgggaactcctccccgtctccagggaatcgaaactggtattccctcctccaggacagcggccagagccgagccggcccctaggaaccccagaaagcctcccatctctcgttctcccgccccttagtccgactacgagcacagggatttggagcccaactgggcggcgggtgccgggcatctcccttttccctccttttcccgtagtcctcaagcctctgtttacaggagaccaaaaccctggttacagagaggaacccgggcgtccgggtcgagcctcctcgtcacggcttccaggaagccccccccttcccccgccccttgtgagtgagtcactggcgagagggaggctgcaaccgtgccagagccgcccgcagccgcccagctcacgggaccggccgggaaggcccctcagcccgagaaagcgccgcaccagggattcccccgtgctctgtcggacgggcagatcagcgagcctagcagaatctcctcacctcaataaaagcccgcagtccgcggtcacaacctgcaagaatgaactttccaccataataactgcactccgtggcaatgatttatttctaccaccgttttttcagtcagggcagccagctctggagaccccctttaaaaattagtgttttcaccgtatcttaagagagcatcactcagggcaactccttgacaataaaagacttgtcaatgaggggagtcatttctgcaaacgcagagttctttcaaggcacatccctttatgagagacccatccgaccatcagttggggatgatccgttccttccatttgagacagctttccagcaaagaaaccctccaccataataaaagatttccccttttccaatcttgagttttcgagtgcaaactttttaaaat

SEQ ID NO: 59185 - DNA, 744 bp, Bovine  19866881892185
gcagaaaaggctcaggaagagagatggctgactttcagaggggtgcaggggctggggaaccctgccagaaatgcagagagaatgaagacagtatctcgacaggcacaaaagaacccttcaacccagaaaggggtcattttctagctgaagcagctcacttaacagacagtgctgctcagctggggtacctggtacctctgaacttgttccgtgtctcactctgggctttacccgtctctcaccccgaggctgcctgcctatccaacttaccgtgtctgtgaactggtaggcaataaacttgcgcatcaaggaaatggctgtggcccgttcctccccaatctggaagaataaaggcaggcttatgagagatgacaagacggagaacaggccatagaaaagtgggcaggagagagcagcaaggaagacagagacggggagggcaggatagggtatgggattaagagctacaaactactatgtataaaataaagttataaggatacactgcacaggacaagggacatagccaatattttgtaataactacgaaagcagtatctttaaaaattgcaaatcactatgttgtacacctgaaatttacataatattgtaagtcaattacacctcaattaaaaaaataaagacagtgtcattgtgcaaaagataaagtaagacagcaggaattttcctggctgtccagtggttagaaaggactcagtgctctcactgccaggggcccaggtt

SEQ ID NO: 59186 - DNA, 2020 bp, Bovine  19866880791580
tattactattaaagacagtcatactttgctgtggccattgtgatctatttctcaaaagaagtttcattagcttggattagcattttctttaaaaaaaaaactgaatatgaaaaacatagttttctctttccagagtctcttccagagagacctatttacaaaaggtactattttttcatatatccctaagcaacacggaattacacataaggggccagactgcctcccagagagtaaagccatcagaggttggatgtctgaacagcatgctgagtctttgggaaaaaaaaaaaaattttttcaagtgtaataaaatcagctgggtcttaaaaacctctgggcctttcagcatccaagaaaactggttaagtgccctctgttaaggagttttgttgagcagttgacaggaacgagacccagctcctgtgtcggacagtgcagaaggtatatcagcctgagatgggagagctgggtgctcctgtgccaccagcacttccaaaatgccagtttggcacttcagttacagtgctgtcatcaagccagtgcttgtgcatcatcttagtctggtcacctgtaagatgaaaaggttggacttttcctgtgtttttgtccggttccagcagctcaatagtctgatgggtctgaatggagtctggtcccagccgatgccactgcagttaataggtgcagcatctccgtggaacacaatgaccacagcaaagaggagaaagtattaagtctccacatggccagattgaggcctgagtgcaaatcttttcatcaaagtcctgtatgctatttaattaaaagtcaccatttaattaaaagtcaccatttaacctggagttctattattcacacaaaaaagacttattagaccatgtaattttcgtggcagaactagattgcatatctctctgagattaacttcacattttcactcattgggtttctccaatcgtacagaagagactgagcattaaggctggatttgggcatgagagaaacaaaggagaatcttgacatgagcaacccctcatttagggtgagattttgtgttttttctttttctttgacggctatatagaaagctgcccgtctgatttcttctactggtatatgacatgggagagtgcaagctggcaagacttcagctggaaaaaaacgctttttggcaagtaaaggagacacattgtcagagctttaagaaatctaggagctactgctcagatgcagtagaaaagtaatttcattgtgaaatgataacatttcttttacctgctaaagtttggtcttcagttttactgtatatactatatatatatacacacacatacatacacatgtgtgtggtgtatatacatatatataaactgtaaataaaagcaactgaaaagtaatcacaaaaatagaaaaagaaatcaaagagcaattcaaaaagaaactggctctgaagggcatttagttgttcttctccagggacgcataataatctgtcaggactttccatgctttgggggccatgaagccatctggaggattttcgccttcccgggccagcttcctcatacgagttcctgagatgaagtcaaactcgtcgtgcctgtcatagggtagcaacaaagaactcagcgtaggtaaataacatctacttcaaagaccccaggaggatgttatgggttctgaaactacatttttttctttctgtaaaatgcatctaagttaagcagttcagtaaattttcagtaaaggaacttgcagaaggcccggacatcgtagcagctctgcagtcagcgctcactgcaccctcagttcatagggcatgtctcctatagctctgactacttggtgagctctgagcacgggttgagtgctctattaacacatgaaatctttttctgtatatacaaccctttcatgtaacgtgccaggcactcaaagcatgcccaaggaatgtgtgttggaaaaggaaatacttaaggaccatttaccacaagatgagctacatctttgggggaca

SEQ ID NO: 59187 - DNA, 1268 bp, Bovine  19866880858451
cttaaactggtaacaagttgaatgttttctttattcacctttctttcattcccttctgagtcttgaacttggcaacaccccccaaattgcccaaatattctttagtgttacacccttaattctgtgcccccattttctaactgtaagtacaacagaaagtctgacatacttgctggagtgttggggcaccattacaaaagcggggaaacagctgtgtaatctcttatgttctctggcttcattaaggaatcacagacctcccttcccatcttcagggggttggttccaggagccagtgcatatagcaaactttgtgcatgctccagccccatggtccagcctctgtatctgtggattcctcattaacgattcaaccaaaggtggatcctgtatgaggcttgctatctgcaaggtgatttaatatgcaggtgcaggatttgcagagatgccaggcagtgcctttatttggtctaattggatttttaaagactaagctccctagtgtgtggaagtcaggacggaattttccaaagggaactcagaagggagacaatccctcctgggcctcccagtcacttactgaagccatctccacaatttgaaacaccccacttttcacaaacgctccatctcttgctttgagaagcctcttcttaaaggattgatcacagattctagaaaaactagtgcagcagcacagctatgttagaggaaggtcttgatgccttttgcaggaaatggcacacatgggagtcccctttaaaggagcacatgcctcgtaccccacgttcacacaccacatggctctttccacagatggagtgatcaacatgagcatccctatagtactccccatctctgcggatgataagacacggctggaaggctgcagtaagtttgtcttgacacacggaggacggagggtggctatcttagaagatcctgaattctatgaacatagaaaagaggagcgttgttcccatgtgtggggcacaacgtgcgcaaagcacccctatatcaaagtaagtggcaaaaccttcagaaggctttctttcagcttggggtaaaaaaaaaaatcttttcaattccttcacgaaggacttagaaaaactgtggtgagatggaagaatgtgtttctaagggaggtattgcaagctttgcctggggagatccttttcattagggaaaagaaatgactttctgtttgagggttggtctgaatggtctcttgtgatggccagtcccctcagctaaatgggtaacaaatg

SEQ ID NO: 59188 - DNA, 1732 bp, Bovine  19866880891485
acaactaaccttttttttttttcttttctcaaacgttgggctaataatggatcaaccaaaccagtatttgtgtcaactgtttatggccagggatgacacacctcatgccatcctatctcagaaatgcatattgtgggagaggggcctagtgaaactccctcagccttgaggtgtctctcttatctgattagcagctcactaacagacataaaatgccttgctaaaaactagcaaaggggccttctttctgtccccttctgatgtctatgtcaaaagctttccctatctctattacactttaataaaaactctgctgcacaaaaagctccaagtagtcaagcctcgtctctgaccccagatggaaatcctctcctccggaggtcacgaatcccggagtaacacacggcttgcagaagcaactgagaccgtgtgccacaactactgagcccccacgccctagagcctgtgctccccaacaagggaagtcaccgcagtgagaagccctcaccctgcaatgaagagcagcccccgctcgctgcaaccagagaagcgtaaatgacacactttctggcaaccacagccattgttatgaacacgttgctcaaattttctagaactaaacagtcacttgtactctccttttattttttaaagttgaaacattcggtggtgcaggtaaattccatttaagtttataacctgtgccacagcaaggaatggtgatgttccttactcaactctaataactgaaagttgattaactgagaaaagaaaaaaaattttttaatttaaatattcaattttaataataataaaaatattaatactttaatcattatggacaaaagttgttcaagaggagctactgaggatgtgggatggtacagggcccaattgtaaattttcttaaaagtgcatcatcaggtgttcagcggcatccctggtttgtattcattggatgccaatgtgtagcccacccaactcccactccccctagttgtgaaaactgaacaacactgccaaattcaaaactggcactggtcaagaaccactctactaatgaattagtgactaattcctgtgtaacacaatatccctcccagtacatctaatgagaataacataaatcaaagaaataaagcttttcttgtttcaaggatcagtgaaaagccaagtcacagagatacatagggtcctggatccttttggtcaccccacaaattacttctcccagacaactgtctgttttcttcttgcattcacagccagcactagagttctggatcagaggtaaggtcaatcagattcataaacacacacgtacacacacttggttaaattgcaaactagttgaatttggcagatttcattctatagtggatgccaccagctactcacctgctggaaactaagacaatcaaccaagaattaaaataaaggcatggctttgctcttacatgggacattacatctatttttgaatgattaataattatcctctgtgtaaaatggttgattctgttatactgaaagaaaatacccagtgcattctaataggtaaagagtaagatttcctctttgttttatttccaatattttccctgattttcccgtgattggctcaaagcagcaaactaacataatcggaagacatgtattggggttgtaaacatgccagggagaccctttgtaaagaagccaataaggtctcagctctcatagctccctcagt

SEQ ID NO: 59189 - DNA, 1100 bp, Bovine  19866880956184
gtaaaagttttactgtagtatagtagtcatcagtgcagatttaacattgcttattatacactaaagaaatagtaaatataaaatatggtgagacataaccacgttaattttaaatatagttttagatagagaaagatgcatttgtatgtattaccttttagaattttaacaacattgaaggtaactggtgatattttaattcttgtgtggtacagtataatatctgctttattccataaaccacgaaaaaaaacaatacagacctcttaacatcacaaaatactttttggaagtctgattttcagaggtcctcattttgagatttgccccatttgctatttgttcatgtggtgatagcttaatactttgtaataatttttaagccacttaagtaatcacttcagtgacttttagtgtaagagtatttattatgggaaaatcagttcacaaaattttgacattaaatcactctcagacattctattttaaaatttttacctcaacctttctagtgagacagcagcgtaggaaatgtttttatattgtatgtgaaattggagtttgtaaaaagaaatttagaagtttgcacgtttatgacagtttttcacttaacttgaaatgttaggccttggctgtactataagaagttagctttcagaaaaatgttattaatgaaagaaatttatttggtatactttttttttctgtagacactctttgttccgaagttctatttgtatttcatagaactgtcactcttttttctgtttttctgttagataaacaagattttaagtaaagtcaagagtcttttgtggttcgatttctgttaggatttattctaaggatagtgacttaagatgtatcagactgtgagattcgggtcagaaattatttcagtaaatattcagttttacttaaaatactttcatttgtcaggaaaggtgaaattagtatattggatttgactattcacctactattccctactttttggaattttttcattggctacaaaaaagctatttgcagtttggtacttttaaaataatttgcattggaattaaaaagactgttggaaaaatactgatttaaaaaga

SEQ ID NO: 59190 - DNA, 1446 bp, Bovine  19866881166874
catggtcatttatatattgtctaggtctgctcttgactataatagcagaatggcatgattgcaacagagattgtatggtctgcaaatctaaaatatttatcctctggtactttattggaaaggttcctgacctcagctctggaataaagcaagccttgactatagcattcatgcatttttataatcaagtagacccaccctcttcagcagggattccagcccagatatgtgctccctcttcactcaatcaccatggtctgagtggcttgaaaataataacgtacttcagctctaacggctagcaatgcatcagatctctatctcagatctatgaaatttcaaaataacttattcctctttgcctgttgggcaaattgttaaccctacatctgcattccttgtaattttatttgcactgtcctttgagaaggacacccagttctttcaaaggtgggcattaggatactgaatttttttctttctggaagaaatatataattcttagatattctgagttctgaaccaaagatatttccatatttctaagaagttgaaaagaatggtggtgtttcagacttgcaacgtaaacattgactcagtccatcttcatagagaataaacaggtgaatgaaagcacccaaaggaattgtgagaccaataatatgcactccatcctgaaatgtgactgcattataaaatgcaaagtgggccataaacaaaatgagaatctggtcatcctaccccctttccacctggattcacaactcacttctctgatcacattggcatgcgaaatttttgtctccattaagatgagccagccatgttgggaatgttttttgagcagaagcaaaaataaaatgctaataagttgaacatagatgtacttgcaccataaaaaacatctgtgtctaataggagttgtgaaactatatttataaaaatctttaaaagctattctaataggaagcaattattttacctcatttgtcacatgacaagctcagagaagctgatttaggtagattcacactagatataaacatcccccaaagggtggagatatgaaggtctcaaacttattcgtaggacttttttccaagtaagtattgaaaaaaaaatcatctgtggaattctgtaaacttttccctgctcccacccacaaaatactctcaaacttagtcctccttatccattccattccttaacctatttggccatggacacccttcttcatattagaattctgatgagaaagcattagctaaacatatccatggtctaattactggcttcttttacaaatacaaattgccaaggagtgcaaaaaaaaaaaaaaagggaggttgagttgttaagattaatttgttgttttaggcccaacgcccagtggctaagtcatgagagaagctaatgcacgtagccctgacacgatcctaagcgctt

SEQ ID NO: 59191 - DNA, 1422 bp, Bovine  19866881306437
tgaactctgggggttggtgatggacagggtaggcctggcgtgctgcagttaatggggtcacaaagagttggacacaaccgagcgactgaactgaagttatcttaatctgcattttatctccatgagatgctatcatttaagatatgaagtaattgaggctcagagggatgaactggcataatgtagtccagctggtaaatcactgacctttaaccatgaggcaacactacctccctttcccgctcgttttcccatgctctctcttgctgtgcttgtctctccatggtccatcttggatacattactgttactgtttgtccccacccactaacagttaatatttgacattctgattcttctctgattccccattcctcttctcctcccattggttgtggttgtgttgtgttagtcgctcagtcacccctttgcaaccccatgggctgtagcccaccaggcttctctgtccatgggatttcctagccaagaatactggagcgggttgccattcccttctccacggggtcttactgacccaggaatcgaacccaggtttcttgtattgtagactgattctctaccatctgtcagggaagccccttctcctcttgtatttcatgcttttcccctcgccttggtctctctttcactcttgctacattgatttactggctttcctactttgggtatcagccatagattattattttaaaggactctttttttttttttccctcaatggtaaccaaatgcttaccagctgtatataaaaatgtagcccctgcagatctgatagctaacctactccctgtttaggaggggctggtggctggagggatacagcaggtttacatgttcaagtataaaaatacgaaatgttgttggagccatgtaaattccattaaggaggattatagtgatgctgaggataacaaactttgagaacagcaccgtattttgtgctggtagcataattttctggattactgttattctgacattatccacatctgactctaccagcacatattgttcagtagtgaagcttgagcatattttcctaaatttaccctttctgattctatcccaggaataactttagagagagcttgcagctgatcctccaacagtggctggctagaataaaggccgtgaactttgttctgaggcaagctttggaattttaggcaagtcagtcttgagaggagttctgagatgatggtgggcgggaggaggagtggacaatggggccattttcaacatcattacactggatgaagtaagacttttcctataaagcgtccttgaggtgccctagcactcttttctggtaactttcttggatagaaaataaacagaggacttctggctcctgaccgccacagcacctacagaaagcagctttttagaacttgcgagcta

SEQ ID NO: 59192 - DNA, 746 bp, Bovine  19866881560756
aaaaaaaaagtctctactcgcatgcttgcagcaagaggtgaaacaggtgtcgatcacacaactgcctgacaaccattcagtgctgatcaccgaacaagcatgtttatttaattatcccaacaaccataattgagccacatctaagtttctgatgtcactgacttcaactattcaactccagataaatactcaacttaaaaaaaaaaaacctgaaataagtgacaactagaaatggctgaatcattgtacgttttagacacaaccattaatcttagttttgctatatgctatttggtactttttgattcagtagttgggattacaaaaaaaagtttctgtattcaaacctatctacagaatgtcaatataaaatgtgtgactatatacatttaatacacacatacacacatacacatactctcacatatctagaaaccagcacttaagcacgtctccaattctcactaatgactcaataaatcatttgttaccttaagaccagcttagacactataaggctgcaacatatggctaaagaggtcaaacacaagcacccacagtcaggctgattaaattgttcctcctcatgatttttcacaagtagtaataccatttatataacaactatgtctcaataacttagaattcagagtataaaaccagtgtcatgaacataaaactctctcgctgttgaaagaacactcctccttcagctatttccactgatgataagagggcacaccaaa

SEQ ID NO: 59193 - DNA, 773 bp, Bovine  19866881695948
caagatagagatggagagttttttgaacacactagagctgatgggaagaactcttttgactctagagaaatggcctttgcaatacgctgtcccttcccactgatggaaacagtgacacacagcacttcctttcaagggccatggcaggaggcgtcctgcagctcctgggtcctcattagtgtgcccaacctgcttaaacacagggcttcctcccaaaccacagaaaagacaactagaagtggtggggccacttctcaaacctgaagccaccaagaagaagctgaggccataggaatgaggaaatggcaggatccctcctgcctcgttctggttttaagaaaatcaggagtttcacataggaactcgaagtgacatgctcagggtggtaggataagtagattgttctctgttccagtgtacctgagctagggagacaatggagacgaaaccctctgtttgtcaaggctcgttcccagggccagggaatggacagcaaccccaagaaggacattttttttccccctaatttacacagactccatatgagtaatagcatccctggaaaaattcaaaaagatacttctaatcaaagctctaccaatggctcagatgaggggttccttatctttaagatgtgtaattccacactctcatatatttggagtatacctagaaacatgattctgtttcctgagtccagtaagaactttctttagtgagtatttttttaaagcaatgtctctgataaccaagaaagaatccacatttgagtg

SEQ ID NO: 59194 - DNA, 2896 bp, Bovine  19866880195635
atgcattcagtttagttcagtcgctcagtcatgtccaactctttgtgaccccatgagttgcagcacaccaggcctccctgtccatcaccaactcctggagttcactcagactcacatccatcaagtcagtgatgccatccagccatctcatcctctgtcgtccccttctcctcctgcccccaatccctcccaccatcagagtcttttccaatgagtcaactcttcgcatgaggtggccaaagtactggagtttcagcctcagcatcattccttccaaagaaatcccagggctgatctccttcagaatggactggttggatctccttgcagtccaagggactctcaagagtcttctccaacaccacagttcaaaagcatcaattcttcggcactcagccttcttcacagtccaagtctcacatccatacatgaccataggaaaaaccatagccttgactagacagacctttgttggcatgcattagattagatctatttaataaacattgatttcagaatctgttatatgtcaaaaactacatctgaaacacagaaatataaccttaagttgcctgtggcctactgaggtcagataattaataagaagttgaaatgcagtgtggtaagttctctggtggaatagaagtagcctgtgatgggaccacaacaaggcccctccctcagcctggggtggttaaaagacacttccaagaaaggctcagcctagagacaaggaggtctgggcagagactgttcaaagagcccaggacaaatgggtatattcatcagacatgaaacaaccacccaatctggctaatgtgtacaggaataaaatatattttttcaattatacaagtaaccacatacacaagtttagtataaaaatccaaacaaaaactaggaaaatggaaagaaagattttaaatatatgtttccttcacctgaaaatcttacagacaataatttttaaccatatggttacatagactttcataattttttctaaatgtatatatacatgcctattttacataatataaataacctgatacatgttattctgcaacttctcttttcattgaaaatatcttggaatgcttatgttgtctatgaaagtgaaagtgaaagtcactcagtcttgtccaactctttgcaaccacatggactgtagcctgccaggctcctctgcccatggaattctccaggcaagaatactgcagtgggtagccattcccttctgcaaggtatcttcccaacccagggatcgaacccaggtctctcacattgcaggcggatttttcaccctctgagctactagggaagctatgttttctatacatatagatatcattctttttaatatctatatggtatctattttttcagaaatgatatgtagttacaggttcatattaagaaaaataatattaaacctaaaaagtgaaaatggaagtaccctaatcctcccagaacttaccattctcattctcatttcccagaattaattaaccttttttaatgtctccacatactgtcttgtaaatgctgtggagtgtgtgtatatgtgtgtgtatgtaaatattttctccattctcttaaagtcaagctgttctcaggaactcatcagtataaagacaccctacttttgctatgctaatccacccctcggaagagctgggagtgaggtatagagaggtgggttgtggcactgggcttcccagatggcattagtggtgaagaatctgcctgccaatgcaggagacccaagagacatgggttcggtccctggattgggaagatcccctggaggaaagcatggcagcccactccaatattctttcctggctggtaggctcagtccatggggttgcaaagaggtttgggccgactgaagcagcttagtacagcacatggctattcaccacaatcgagtagaaggttctagtcaacatgcggtacaacctcagtaaagaccagtcagaaaagaattgcattttctgacatgaaacattcttttactagggtaacaagctaaaggaaaacagaaaatgctcttattgctactgttggagagggaaggaaagttttctttgtaaattattcactctcttaagccaagttattcagaacatgcattttaaataaggcacaggaaaaccaacaggatccataggtagagaatctatttgaattgccacctgccacaaagaaacaaatactgtatcctctagataaggacattcaactttacatgctgcaaggttaccagtgatcctagctcctggctctgtgataatttatagcaaatgaggcatgtctttgtaggaattatttatttactttgaagtaaatctgtgatctgtgaatgaccctcttacttgttaatagaggaaagtacttgtgactggaatgaaagcaaaagcatgtaccatgttcaatgtgcagttttcacaatttctccccaaaaggttcatttcagtaacattcacaaggaggtaagcaaagcaaaactatcatccacacttgagaggtaaaaaaatggatcccctcacacttagatacctgacctgtccagttttacctagaaagttcatgagcaagccagaactggggggcttgtcaccccaggggctctcagggtcatattcaaatatttaatcattatgaagctaagattagcattgcagtttatatttgataaagcaagtttacaacaaacaatttcatacaataactcagtttaaaaagagtatttgaggtactatttacagcacttcttcagaacaagaaaatataatctcgggaaatttaaaaatttgattcagctcatgcccctaaaaagtgacagtattcaagtgacactgcttctgcggaaacgttcacttactcctatcca

SEQ ID NO: 59195 - DNA, 1625 bp, Bovine  19866880487214
tgggaggctgagggagacagaaacagctctcgaacggtatttattgagtgccaaatgtttcctcaacactgtacaatatacagggaaagacatggtccatgccccatggggttaccatctaaataggactgatgagatgaggcataattggctgaattcttactctgtgttgatgacttcactatgggaacccaaatcatcctctgtggagattggtgctattcaccaaaccttaacaagcgcgttatgtcctctgagagcctggcaccgtcagcccatcaggagggagagctctgtgtttgtcataactgcttctcgtattcagtatctcaccagacacagtcttcaatggcctcagcagcagtgggatgtcaatagaaggctttgtggatgatccaggagaatcaggaagacccttgtcctggagacaaagctcagcctaatacttctagaattgctctcctggctgccattttcaacatatcgtttcaatggttatagctccccagtggctcccctgtttcttcctacattcaatggggacctctgaacactgccgcagatttgatcctatcctcccgatcgtcagattataccctgtggccagccttgcagtctctccttctgcatatcccagccaaggggcctcacaagccaaggaaaaactatttcttcttctccctaagacaacactgatctctttctataaacctgtcctgagaaactaaaattaatccagtctgtgtaatctcatctgccatctcacaactgacttttaatagtgtgattcttcatttctaaatcttaatctatttttatctattttgagttttaattttatcttataaatattatatctagagctatggctgatgaaatgtgtaaatacaataaaacctatagaaagctcccatggtagaattcaggaattattttattttctgagcatttcatttctgagtggtttttttttttttttttactctctactactttaattctaaaatttatgcattatcctctggggtttttattaatctttaaatataactgagataggtgtaagaactgtgggttagtataagccagagaggggagaaagtccaagactattctaactctttaaatcctagagcctctgaagttgcctgaactcagatcactcaactgccagagctcccagaaatgtgaccagtgaagctgccctgtatctaacaataggctgtatctttgactaaccgatatgttaagcaattaactgggtaaagtcataagcaaagggcttacatcaatacaatcagaaaaaaaaaatcagaagaattcatctgatcactcaaaaaatacacagtgagactcaaacaggtgccttttacagtctttcagggtattgatttttttttccattaagagaattttgtaaagatcgaaataaatggacatctgaaggtgcaatgtctgataaatacagcagatgaatcagaacttcccagacaagctgtaacagtttttgcctggtcatcaaagaaacatgtggtcttcctgtatcccgatggaaggctgtgcattttctggtgactaattctgggagcttttcgttgagtgctgcttttcagttggtctaatag

SEQ ID NO: 59196 - DNA, 1487 bp, Bovine  19866880507764
ttgctttccctagcttacccaatttgcttttgatcatgctctgttacaaattccctcacctgcttttgcagtgagttcctttcaaagggaaccagtgggagtgaaagggggtgggctgggtagctggatgcacagtgagatggttttaagtggatttttgacctgtcatatttccaagtaagcctccctgcttattgtttcaagactacctgaggtcttcctcgcactcctcactgggtgatgaacaccaggttgtttccttttgttccttttactctctctttcaagagactgcctattttgaaaaaggactgaatccttaatctcaatttgaatgcctcctgcatgtccaaaaccaatggtaagactaatcagtctgatggttgattttcccagtgacagtgcaatctaggatgccaactcttataacttattcatctgttgtcacatcttagcgctctgcgtggcacatagtagacgttcaataaatatttataccatagttatacgaattaatatttaataatggaactagacttagtttaaggattttaaaagaagatgagagagatgaaaatgtggataaaaaaagaaatatgtacagaaagcaaatgggttagagacaacatcagaggccagaggttctggtttattaaggctggtatgggcacctgattctgcagtttacaagcatcctgctgacctggatgtggatggtagcagacagctccttaaactctttgagaacactggtctaaatgaaaaaggctggttacagagtcagaaaatcaggtctcaggactagaactcaagttcaattccaccatttgctggttgaaaatgaacttccttgagattcccacttctaaagtgcctgcctgagccaaaggagagtaacaacagtatctatctcccagcctaaaaatgagatgcaaaagagaaaaggcatgacaaaatgattcacaaactgcaaaattagctatagttgtctaataaaatagaatggattagcttattaagatgaaatggatgatttaaaagatatattcagatgatcaggaaatagaataaaagctgatgattcaaacagcttattttattttatatttgatgttttgagaaaatgtcacgagatggtcttaatggctataaaagacattagcattggaaaatacatgctatgtcacagtgttcttgagataatgtttattggagctcacctgccataatgtaagctgcattatacacgtggtgtcggctgatttgtagggcattcacctcaccaacaaacataatgaatcatgtgagtaagaacatatcattcaagtcacagtacaaaggggccttgtctcaagaaatgaagacattgacttcaatgtggtttttctttgcatgggagtgtgattatccctgagcaacggctctgtcctaaacactctactcaggaaatagaagcagataaagaaagtgtgccttcatttcctcat

SEQ ID NO: 59197 - DNA, 2586 bp, Bovine  19866880624670
tgtctgcctgtgttttgcctgacctacccaaatagaagccagacagcaagatgggaacacttggatgaagtccacagtgaccagtctcctgagtagataccaaaggcaagcagaacatatcaaatacctcctactccttcccttctgtaaattttagtacttaaaaccatatagccaacaagctaccactcagtccttctccaccacaaatcatgccttttctaattaattatgttttaactgaaagaagttagaatatttctaccaccaccatatatttataaagttagctttatatttttaaaggactccttcccaacatccaattccacaatggacacagtataagcaaagattaaggcttagattaatgtattctaaaatttagcttattagttaattttttttaatcgataacttactctggacaaagctaaaaagctcaaaaagaggttataataatagagcttcttttaacaatttcatcatttagcagagagcaaagatacattaccatccaagagaatgtatatgatattgacaaggatatgggttaatagaagacaggtaaattaattttcctagggaaatctgtaaattattcatctaaaatactggattagatttgtttattaaaaaaattaagcaagaaatacacctagtgcaatggtgaacatggtgtcaaatttcagtcacatgcaagtcaacttcatgggaaatgggaattcaaaaaggctacagtaaagcaaagcaggccttaataaccatatatcaaatgccccaataacatccccatatgtcaacctgaatctggcttttagcagattgtcctgcttacttggtagacttcctttcagcccttcactttcacactggcattgctccaggctgtattatttcctttctgtagttacttggtgagcttcctcatattggtcatcagaaagtcaatatccagagtaacaacttaaaacttagcttggtaaataccttggtaaaaaaaaaaaaaaaaaaaaaaaacggcttggtaaataactcttcctgcccaaccccttaaataaaaacttattttgatgaccagtaaaatgaaatgccccccccgccactttcttagtgtaataggatgctatttgtcaccctttccattcactttttgttgtatatgtacctatatctgtgctatgtgttagtccctcagtcatgcatgactctttgcatctccatgggctgtagcccaccagactactctgtccatgggattctccaggcaagaatactggcgtgggttgccatttcctactccagaggaccttcccaacacagggatcaaacctgggtctcctacattgcaggcagacacttcatcgtctgtgccaccagggaagcccgtatcttccttagggactcaaatatctttacgatctctagcaaatatgaccaattcaggtgagaataactacaaatcaatagcacctaaccaaaattttacctagaaaatatcctagtagaatagcactgccttgctgtctttgtcaaggctactttgaggagtcaataagctgaatgggaaaatttgggaactagatatatttgtacttaaactcatttcatcatcttactatctgtctaaatttggagctttctaaatattcaggatttgattttactgcttgtggtttttctgtaggataccacagtttctttgaaggaatagtacattcatatatacacacatgggagtaagtaacaaatttcccaaacctgtgttctcatctcaaaaaaagttataacacctatctcagatttaccgtgaagttgaataaacttgtggatatgggtaggagagggttgcaagtgttagaagtacagttcaaagtcccgtcttcattaataaggaggtgcaagtttatatagtttactctttggcaaaataggagaataacagtaaccatcacattaatttgttgtcgatttttaaccagttgatggagtttaaaagcttgctacagtatcagggtaataagcattcaatacaattgcttctttacatgaaagtctgataaacatctgtttcttgtgaaaatccttgcaatttccctttaacagtactgtaggagcagaataaatcaggtcactgtgggaaaagggaagttgttgctcattcttcctgttcctcccctctaattcctttgtggttccccacaccctgccccccttcactatctttttttttcttcttctctctctaggaattgttttgtctagcaagaagctaaaaagggtgtgtagcaaagaaagacttaaaagtgccttttggtgacagagcttacatgccagggggaggcaagctgccacagagatctcagccagctgccatgggaaactcatacctgcataatcagcctagataaaagtcaagagcttccttccatgatgcaatgggcgggggctggggcgggggctgaggggaagcccacattgaatcacagccggagaaggagaagaggaacacagggggagaccaaagacttattaaagctaattgtgattcaaagccatggaaggattcagtgtatctgaggagca

SEQ ID NO: 59198 - DNA, 816 bp, Bovine  19866880668066
cgctttctttgtgtagtaaagacatactctttctttatgcttcagtccatgtcaatttcttggcatcttcttccctggagtgtttagctcaaccaacttgcttccacagtatctttccaaccacaatgagttaaaccagcatttgtagggtcctaatcccttcccctacaccccaatatactaggaatttcttaaaggaatatttcttctcatttgttttggaaggcttagagcataacatagtctatagtaaagccagtgcccacaaagtttatgatgaactgaatgaatgaatgaaggtagaaataaataaatgtgtgtgtttcatctgaattgactcctaacatgggctaatccttccctctcagatttcttggttgaaaggaaataccttgagaccaagtcaaaaaagaatattaatatcaaatattttagaaacagtcaacggcctcgtgaacttgggggcattttctagccatatgcttttcatctcctggctcagctgatagagtatggaagtaattgaatggccactcttttctaggatgtcaacatacatttatcaaggtttccaggcagttagtttctcctttgaaatcctaaaagatgtgactcttggcagtactgcataaacattaggttattttcctgatttttgcttaagaactatcatttgattcatctgccaagataacttcattatgtccttgaggcaattcaatataccagctatttgtgtctccatttttcaaattcaccaagcaaaaactcctagtcttgaaagtagccagcacaaacctttaggaggcaggggtt

SEQ ID NO: 59199 - DNA, 2153 bp, Bovine  19866880718890
ctgtttctctaagatgcttttgccgctagtattatgaatcaactgagctgacttaagtaaaataaatgacatcctttactttgtttaatttgccagtcagaaagaccaaggtctttcttaatgttcctgccaaagtttcctttaagttcattgcaaatcctttctcttcttgaagggacatggtcgcctattgtagttgtctgtgctgttcccaagagcagctcaggaagcaagtgaggtggtcaactcaagagtatgcagttgcccgcaaatacacaaggacctcagttcatcagaatgccatcatttttacagcctccagttagatatattttctcatgaatgaaagattaatcccatatttcttttggttcagctcatgtttaaaatcatgaagcagagatgaatttatatgcacatctaagtgtcttgtcagaaacaacaccttaaagtttcacccagaatgagtacccaaaagaaaactcaactattgaattggacttttgtttttcatacattcaattgggtgaatgatatttaatctctttacaatggagagactagtctttctcctctctataactccatcagtatcttctgttaataaaatattgctatgattacagaaatttatatatatatatatctttctggaacatttagagaatatagaaagcaatattaagaaattaaaaatacccacattctaactagaaatacatatcttattaaaatttttaggtgtttagttctttaaagatatgcacttttttttttttgcatattattaggcctgtatgtgtgtgctcagttgcttcaattgtatctgactctttgcagccctctggactgtagaccaccaggctcctttgtccatgggattctctaggcataaatactggaatgggttgccacacactcctccaggagaatttgacccagggaccaaacttgtgtctcctgaattacaggtggattctttacctactgtgtcacctgggaagcccaagacctatatattcaagcagattacatataatcataaatatgtgtagaaacatgcacacatagatccgtgtatccatagttcatgatacaaagctgatgcctatatacagcttttgcctaatacaactagttttagccaaggggtttttatatagtattactgattagaaataagagtacatttccagatatatcaaattatatttcattaaagactatgtatccactaattcatttacttatttattcaacatttattcactcaggcactatctaaaatcctgcggtcagcattgttgtaaatacacatgtgcagactgcataccctcaagtcacaaagagcttataaagtagtttctcggcttatgaaaaagccagtgctgtctttcactggaagcatcccagtagtgcctctgcattctatatttgcttacaaggcttatgagcctccagaattgaataggctccttctgtatcaaggaaagaatccaaaaggtactcaacttttgccatgtggccctatgcttctttttgtgtcttttaagaatattttggaaccatgtaaataaggaacttctcaataacaagttccttctttaatgtgtattttatttgaggacgtgggtgacaaaatggctgtatacttaatggagcaatttaggagctatagaagttcttgggccattcaacagtaaatacacagaagagatgcatcttccttctctggttatttcttgctgggactatgaaatctggaattcagtaaaatagagtcattctatgttttttgctgagggagagtattaaacaaagctgtgacttttgtatctatcaaatagtagcatcatgatctatttaccaatgttgtgtccattagttgtgggttggactattaggctgatttgtataagttcagtaaagtcatttttgaacttaatgtatctgatttcattttgaacttttttttttaatctttattttattttggaagcttggttcaatttttgtaatttattattacgtggggatttaacaaaatattttgtttcaatgttattactgactcttgatttcataggtagctataagctgaaggtctctttactctgaatgcttttaggaataatgccaagttaaagtctaaa

SEQ ID NO: 59200 - DNA, 2749 bp, Bovine  19866880764602
actgtaataaaaaagaaaatccttgattttcagtaaataaatatggttaaaaataatttgtagctatgtcaaaagtacagctctcattgttctgagttggctggatatgcactaaggatagttcagtcactcagtcatgtctgactctttgcgaccccatggactgcaggatgccaggcttccctgtccatcaccaacttctggagcttgctcagacttatgtacattgagtcagtgatgccatggaacagtctcatcttctgtcatccctttctcctcttgccttcgatctttccagcatcagggtcttttccagtgagtcagttctttgcatcaggtggccaaagtattgaagcttcagtttcagtatcagtccttgcaatgaatattcagcttctctatataggttcatttatgacagaaagagcacttttataaaataatagaaatatattttattattaaatatattgaattatgaacacaaaatatgtccttctctcccactcaactttgacaacttctgttttttcacaagttttagaaatagcaaagtgaggaagccttctttccagtttcttgctttagcagtctgctgacaacagtggtcctactccctaatggtgcgttaagctctgtggtggtggtacttagttgctatgtcatgtgcaattctttgtgttcccatggactatagcccaccaggatcctctgtccttggaattctctgggcaagaatactggagtgtgtttccatttccttctccagggcatcttcctgacccagagatcaaacttgggtctcctgcattgtgggtgaattcttaacaactcagccactgtaactctgaggaaatcacttaaatcttctgaactttttttcttcttcatgggatgacagggtctgactgctgctgctgctgctgctaagtcacttcagtcgtgtccgactctgtgcgagcccatagacggcagcccaccaggctcccctgtccctgggattctccaggcaagaacactggagtgggttgccatttccttctccaatgcatgaaagtgaaaagtgaaagtgaagtcgctcagtcgtgtctgattcctagcgaccccatgaactgcagcccaccaggcccctccgtccatgggattttccaggtaagagtactggagtgggttgcaactagctggtctctaaagtccttgtcagagccattgttataagacaatatttgctagattgaagaaagatacaatcctgactcccccctagccgttacataaacttggaattaacccacacttccagcctgctgtctataatgtttcatacaccatattttagtgtattaattggataataacctttttaaaacaaggcattgaattggctgcttttttacatcacaagttgtttttgatgctttcagagctatgtattctctttagctaaagtataaacgtactatatctgagaaattctgacattaaagtaaagggttccagaataaaatcaataggcatcaacttttcttcaacatattgccttagattaaatgccaactggtaatttagtctcaaatctgtttatgactttaccataactgaaagtagcttcagaggatcttttttaccagctaggaaactgatctcatacactacgtctaaatagtttaaatctgtgcactattagtaaactggctaaggaagtcaccagtctgtacaatgttaattcagaaaagcttgaaatttgttagcacaataatgaggtaatagtttgtctaatctaatcttgacacagtgatatgtgacacttcaataatagctaacatgaccttaaaggttaatgatggcatagctcatctgaagtgacagactacttcaagtttttctacagtcgatctaattattattattattattaggtgtattacaagtataataatgaagcttcagtggactgttatctggaattgcaaacttggccaaattagttccaggggtcgtgtgatgagacattccactgtaaaagcaaatggcagcactattatgaaaatggacatgaggaactctaaatgtttctgtatagatcatataaggcaggaactcttcagatatgcttccatgtatggagctttctcatccatcaagatggagttttctcaggatattgtatcatttatccccctctctcacttgacacagcaccatatacgtggttgctgccctgtgtaaaacacagtgcttggctacatgcagaaaactgagatgaactagactatgatctaggctttgaggaatttaaaacctgcccaaggaaagacaacagacagaccaatccctgtaatcaaaggtaatgagaacaagtgcctgtctagattcatgggaggacaggtgaaatctctcctaactggacacctaagatcatttcctagattaccctcagaagcagggtagttaaaaaatgctctgattaaaatacatcttactcttttctgcagcttcccccaccttctgtatcttttgttactctactgtgattggtgagagagagagagaggcaatgaatatgatgacttgtatatatagatggatggaatggggttgaaaaggatggtttttggttatcaagatatagagggagtagcttcaaaactatgggtgaatgaagaatgaaaaatgaaatccaggtgaatgatattgaatgttgaagcaagtgtgtagttttctctgacacatacacaggagatacaat

SEQ ID NO: 59201 - DNA, 2207 bp, Bovine  19866880811351
tgtggggaggtccccaaggcagttagactggctgggaagccaggtcgtgggcgggccaggcaacaggtccagagacggtcttactccacaggaccctcactcagaggatgctgcttggatcttgattcataaataattttaattgaaataccactatttcaacatttcttgatgcttcgggaaggcacgtcttttacatcgggagcgatctgctcagaagcccgggagtacgggttccataccttgtgcctcttctgggccagggttgtcctcacacgcccgcaaccagagcagcggcagaaactctgcaggcgccccgcgcccgcacctggggtttaaggcatcttccgtctgctgccgctgctgccgctaagtcgcttcagctgtgtctgactctgtgcgaccccatagacggcagcccaccaggctcgcccgtcctggggattctccagacaagaacactggagtgggttgccatttccttttccaatgcatgaaagtgaaaaatgaaagggaagtcgctcagccgtgtccgattcttagcgaccccatggactgcagcctacccaggctcctccatccatgggattttccaggcaagagcactggaatggggtgccattgccttctccgggactctcgagcagttgtctttaaatctcttcagacccaatagcctaaagaataaaacatgctgctctccaaaactgctgctctacaactcacttgagaggagattttcaactggaaatggtagagctgagtatcagaatctctgagttatttagtccccttcccctcattctgatatatgaccatattgcttcctactacacacttaaaagcatttatccaaaaaaagcaccaagaattttttaaaatgatgctttatagggaaggttctgtttattttcctaagcaaccaacatattctaatcatcattattgccatcaaaataagtggaatgagaaaaaaattactaccaggtgcatatttaaaagagcatccctttttcttattgatattagcatgcaattaatgaacattagtttctcagatcatttaagaactcagtgcttatttcttcacttcagaaaggaagttatgattgtgatgatattttttgggagcacaacagtaattctccacttctcatgtttccaggtagagaaacttcagctaaataaagtcccttgcctctgtcctcactctgctttttcgtcccagagctggggagaagtcagccagctgattggtgtggttagaaacaggtgaccattgctttctcagttgcctcctctgttccctttggggtcttcctgatcacatacaactctgtcctgcttttccatggagcaaatactttagtgggtggactctaccatgtagggcaaagtcttcagtcatgtagtactgcctatggttgagtgggatttgtctgctcaatttgagagtaaagtgttagcaatctcacttgaggtgcatagccagggtctacatttaccctaatgtaagtgaagcagatactgtgcttactatctctctgtctcctggatttccttttattctgaactaagggcagggaaaaatttaagttttcctaaagtccaatatatgcatgtaccagttagaaacctgagaaaagtcaagaagtagctttgcagaacaaaatatcacacacagagagaaagagattggccgagagctttatccttaaggctttagtaagtgtggcctaagtagaattttgcccttggtggatcattatggtttatgacagctttgttcacagtcaagtggtttcactgatagaggtagggctatttttagcaggcatagctcatagaaaatatagatctttagcaaacaaggcttgcaaggaccttagcaaactgggacagctccactttatagagcagtccatgttggccttgactttatagagatacagcttgatcttgaactccaaaagcatgacttgacctctgcagaagccaatgaggcatagatttagacatgatttgtaagatgatgctaaggtaaaaaagtataaaactgaaaaggtctctggcaagtctgactttgtcatccacacagtagacaggaaagaaaagcagctttttggatggggcatgttatgccacaagatcctgtccgagggaaggcaaaaagacccagaagatgcctggtgggtgtcatcttggtt

SEQ ID NO: 59202 - DNA, 1173 bp, Bovine  19866880859743
gagtctgtacttagtaacaatgccacagcactcagagacacaagaccaatcgctctctccaccatgaatggattcagtaaattcacttaacatctgtgctcaactttcataaaaaaaagtaaaggaagtagttggaatagcaatattttctcataagaaaactatgaaaactgataggtttgcatgatttcgatatgcagggtactttcattagttagaaaaagacatttaatttaatgatagaaaggccaagtactttgtaacactgtgttatcaacaattctggataaaagaatatttgcaagctttggactacacactgtcattggtagattgaaatcaatagagcatttaagcattattgatttcatttcagatttaaaggtgacctatatataaaatatattgaagctgaatgaaaatatataatcttatattgtttaatgacattcagaatggggttggtttagagatttgttattagaggaacaaaaacataaatcttgtgttttatctcttttccatgtaagtacttatttattaaattatcaaaataacattaacaacagctaccacttggtaagtgactactttacagccaaagttatgtctggattttcttacttcttacaataatcttataataaaggtatggtattttttagctcccttttgtagataatatcaagtgcctgctagatgatgaatttgggctttgaaaccaagtgtagcagatctaaaagtttctgtagtgttcatgataacatacttcataatttatctgaggaggcagaaaaagatacgggagagtacagtggcttgccttgaaagatcttcatcctcccaactgatgaatcaagtcccttggaacaatgcacactcttgttagtcatctttctttgaatctgagaagacctctggtattagcctgtgattaagaaaacagagggcttcccaggtggtgcaagtggtaaagaatgcacctgccaatgtaggagaggtaagagatgcgggtttcatccctgggttggaaagttcctctggaggagaaaatggcgatccagtccagtattcttgcctggagaatcccatggacagaggagtcaggtgggctacagtccatggggatgcagagtcggatcgactaagtaacgagcacacacgcactgcaat

SEQ ID NO: 59203 - DNA, 1317 bp, Bovine  19866880955333
atactctcctatactcacctacaatgtggtttttatataagcatctcctagcctttcaaggtagagataattcaggctttcaaggtagagataattcaggcaaagaattgccttgaaagcataaatttgacataaattcaacctttatttctaatctccatttaattagtggaagaaggctggaaattagaagcgataagatatatatacaatttggagtttgtgagcctgagcacgtcaggctaaggtttaaatcctttggacatgtactcttaaagtgagtctgtttatcatagccgacttctgcagtccggcatattttcccccatctgccaagagtctgagcattttctaggtgtgtgccctttcgtcaactgattgcactgccccattactgctgactttaaaatattcaaaccactaatgtaatatgcagcacctgcaaatactgtgaaatattagcggagtggtaatgagaattgactgtacgtataatgacaacaggtgaaattattcatagcctgctcatgtggcaaacttaagatataaactcaatgaacataaatggaataagttcatgacaaatatgaaaatacctaaactgctaaagtaataaaagtaaatataataaatctttcctgcaaatataataaggtccctaactgcaaatgtaataaaacctatcaacagctgcaatatatttggaacatattatatagctttacaaagaaatataccccctgctggtatggcctcaacaatatcatgctttgtcttttgccagtgagtccagatctggcggaatacatgttgcccagtgtatattaaatatgacagagtgttaatacaaccaggtttggattgaaaatgaaatgctcaatccagatgtgctctttggccattctgcaagcagagccaaaggctgtggatctcccaccaggggttgaaatgcagccagaaaagccaagcatgggaggtgaggaattgatgaatcacaggataacctttttgttgcttggatatggtgtctgaatcaggaaactgagcagtatgtagaccaaggaaatgcagggcacaggaatcaaaagtgagaaagaaatatggagctgatgacattcgctaaagatcattcatgtgccaggcaatttgcaagatattttgtctctttcctctcttcctccttttagttcatttttctttccacaattcagcctacatctgatgaatgccccctagtttatattcagggagaaaaaagtaacttaactcattgtccttagctgcttaagtcccttacatcctatgggagaatcagga

SEQ ID NO: 59204 - DNA, 1073 bp, Bovine  19866881092631
tcacattgacttgacaatgacttgacaaatgagttaagtggagatgagtcaaaagctctcatgctaatgtactttcccagcacatacttttaggaaaaataaagaaaaggttactttatcatttcgtattattttatttggttttatttaggaataatataggacatagaagaatctaataaaataatggccatagcagaaagcatattcattgctaatccatcacatcttagctctgcactccttgttgacaagtacagagcgatggcttcaccagcagagtaatgataaatatcttcaaaagggtccatttcctttgtcttttcagtgcctaaatggaaaaactgttttatgtcaactcagtggagttagttccatttctaccatggaacttttgtgttttttcttgttctttttgcttctttaaagctttattccttgaatgtttcataatacatacataaatgtatatatgaatatattggtatatatgcatgcatatgtatatacatacatgaaatatatatgtatatgtacacacatatatgtatatgcacgtatatacacacatgaataggtgtatctgtatgtacctatatatcctaagaataagtgttcattataattcactttttagtataatttaaggcccctacacaaaactagaattttaaaattggcagagacttttggtagctggcattattttctttcataaatatctttttcaggatttcctctaaaataacccactggtaggtgtgaaccctgctttattcctagccattatggcaaatggctttattaatgatgtgccatggaatttcattctttaatttctccttgattggagaagtataatattttggatccaaattatccatagaaggatgcaagatagacctagatattccttgaagtggaaagccacttagagactctctgtttaacttcacttcagagtccagaggggaaatagaggcattggagactctcagcagtgtagccaaggcataatgtgctgaatctgagttcaatccagtattgacagcaacacttttttctttttaaag

SEQ ID NO: 59205 - DNA, 1780 bp, Bovine  19866881136534
cctagaaatggataccggtctgtacctaatattgagtgaccgaataacctgatgggctatttcaccttacagtgtctgctgcttaaagaatcttggcaagcaacagagggctaacaccttcaggagagctattccctattgacagaggggatttctgctttgccaaactcagtaccaaatgtccaggcctccctaattgcaatcttggctctctggaagtcaaagtcgatgactcccatgacagtcttcaagaacttgactcccttcttcaaaacccaaaggtcaaagtgaggcccattggcagctctatttgcatgcaggtaccaagaacagcagggttcttctgattagaaacgtagcacagcctgacttacatgctcagagatgtaaccaaatgttctgggaagagaagaggtacagcaaccaaggccccctgctaattttcgcagcctgatctctcatcacttcatgtgtctctgtctatgctccagcaagatggaatttcagccaggtcaccaaagatgtgttcactcattctgtttcttatttgcattgcttctcaactctgggttccgtgcatccactctctggtactcctaatgcttttatgaatcttactgtatttagaaaatactgcatcgatctgtctttcacaacttgtgtaactgtagtttccctgaaaagcggtcacagcttcccaaatctgtgccaggtgttgcttttccgtgctcccggttgcttcctgtaagtgggtctctcagagcactcaccacactgtatgctataactgcttgtgtatattacttgctggagttaagaccctcaaagacagagaccaggtcgtatttaaattttaggctcaagatactcaaaatagtgattcgtgctcagttgcttcagtcatatatgaatctttgcaaccctatggactctttgtgaccctatggactatagccctccaggctcctctgtccatgggattttcctggcaagaatactggagtgggttgccacaccctcctccaggggatcttcccaacccagggattgaaccctttagttcagtcactcagtcgtgtccaactctttgtgaccccatgaattgcagcatgccaggcctccctgtccatcaccaactcccgaagttcacccaaactcctgtccatcgagtcgatgatgccatccagccatctcatcctctgtcatccccttctcctcctgcccccaatccctcccagcatcagagtcttttccaatgagtcaactctttgcatgaggtagccaaagtattgggagtttcattccttcagcatcattccttccaaagaacacccaggactgatctccttatagaatggactggttggatctcctttcagtccaagggactctcaagggtcttctccacaccctggaagatggaaaaagccacacaatgcaatgtaaaaatcctggcactaagattcagatgagcagggtcctaatcctgactttcaagtaatggctcatgtatcagacattggatgtaaatcagggtcaaaactgagaagccttttgggcatgctggtacaatggcagtctaatgcttggactactcaattttttgagatggaatgtaaaattagctaaatttggctgaaatttgagtagtttgtttagtcctgttgtcttatgccaggatcctagcctgtatcatgtaaatatttgaatttgtgactcctgatttgaattatctgagtctaaatttcttcactgtaaaatgctgtgggtggaggcttag

SEQ ID NO: 59206 - DNA, 1242 bp, Bovine  19866881251828
tgtgttttggtttgttgcagctaattcattttagtcatgggaaatggtctctctgatatttgctgtactctaatttcctgaacaatatgtcctttctttccatgtgtcttctttggaaggccttcctgaagtttcctgtggtattgtaattcctgtggattttgcaaagtggttttgtgatgttcaggacttcaggcaaagtaagaaaatgttaaccacttacttgcctcaaaggagcaaggaatgacttggatgatgataacaataatgagaatgataaacagtggaaggattttttttttttaatctatatacaattcagagtggaaagtttattctatcagctatataatgaattgtaggggaagaacagttgaattagaaaggccaagtagacaaatacagcagaatccagataataaataatagtgaactgaatggatgtgatagctataggaatggggggaaaaagctgagtaaatctgagaaatgttaaagagatgacgtgctagaactttgcaattgataatgtttatagggatagggaaaataagttctcaaagtaatacctacattttaaaaataagaactagaagaatggtgggcaaattactctacctctctgatctgcattcctacatgtgaagtagagatgcatacctggtgagcatattagagtgaaaggatgcaaaagcacaagaaagaggcagaagtaacacttactgaggagaaagttttcttattaaatacatataatttattgaaaaataaatgatcattttagcacataagaagtatgagaaggcttcttaaaataggtaaaaaatatgaacaaaatgctaaagggcatgaatgtgtatgaccaacccctattcttttttggaatcttagtggccagaacatgaatagtcagaagcaattttaatttatgcctcattcttgagaaaaataggcaaatgataagcaaatatacttctcataaaatacaagaatttgaggaacttcattgtcttaccccacagaagatcatgcttatattatcagagtaggcaagggggtctcaaactacgtatgctcctagaagaaccttaaatactgacaatttaaccaccattttctgtgtggagatcatagagactaatgtcgttattccttctgtgtctgcaggctggaatgcaaaaaaaaaaaaaaaaaaagatgacagtagaaggcattttctggctatggcacaaccatctctaa

SEQ ID NO: 59207 - DNA, 779 bp, Bovine  19866881277800
tgtcttgtgcttacttattaatggaaagaataaaatataatgaacctgatatggacaaagaatgcaaagaataaaatatttctttctgactgtcagcgagcaatgggacaaatgagatttatggcagaatcagatatgtgatttatagtttcgcttgttcttcatttaagagaggaaattaaaaccacacttgcatatgattcaatctttgatcactagagaatagctgctatgaattaattattataaactctattatcctcgttcaccccaggtgctgcatccacagtactttccaacaagtgtctcaggggaaaacatttttgttttttggttgaaattctgcaggaatattatctggtgtttgcccgagtagtctttcattacttaagggactaattgaataatctcatggaaaaaacatagttcaaagaaagagccagattaaattcttagcagcttcttactcatgtggagactgtaagattttactctcttttcatcatctacaagtctaaaatcatgtgcttaaatttatgcataagtattctcagatcttcagctctgatagttcacatttaattctggtagtaaatgtggaaaatttaattcgtaaagaagatattttgttcacttagtttctatttaaggtaagaaaataaattttggatgtaaacatttcaagacaacaaaatataacaacaaatcatgggggagaagggcactaagacatggtaaataagaatctgtttaaagatgataaaacagatattcagtaa

SEQ ID NO: 59208 - DNA, 2263 bp, Bovine  19866881380313
tgtacagcacaccctgagtggtttgcatcaaaaaacacaaaaattcagctgagtaaattttaacaatctaattggctttattgaatgagtcttgagttgggcggcatcccatctggtgagtgtgaaaaggaaagatttttaaaggcaagacaaggaggtcataaacagaaaagattatttcaggctaaagtaatgcccctgtgggggatgggatggggctgtgtggcagtgacctcatcttcctctgggggctggaggacgccccggagacagatgagctcattggtgcaggccgggaaattcctgacccaccacaggacactgcagtcagggaacgtgggcgctgcactctggtggtggggcgtagtgtaagtgcctgtgttttgggcctgtgggttttttttttaacatctgtattctgtgtctcagtctcttcaccttgtaatcactccttggccctctagtctcgtggtcccgtcatgtcactgaggcagccgccggcactgtcaccaggtggcctctgtgctgctcgccccgctgacgtttcccagtctgcacccaaccgagtcactcaccttgcctcctcatccttcctccttggctcctctggcctcacctcattctaatttgttactgttgttgggctgttctttctagatgtccttcctttgtttaatgttgccacttaaattctgaaagcttagtcctaggcctgtttctttctcaggcagtgctctcctttgggtggtaattatgtatgactagaacttcattgcattggagaaggaaatggcaacccactccagtgttcttgcctggagaatcccagggacgggggagcctggtgggctgttgtctatggggtcacacagagtcagacacgactgaagcgacttagcagcagcagcagcaacttctatattgggtgtttatatacacatttttaactcttgtagtcttcccatcacttttagggatattagtctaatctgtggaaagagaaactgtcttagagacagggagaccacatgacctggtttgtcaggacagtcctgacttatctgttgtctccgcagacaacactggttctttcaccatcaaaacttctgcctttggataacaagttatactgttgtcctacttgcaagttatacaaattgcctgatctttttttgttttatttatttttttgttctaaattgcctgatcttgaataatttcataagtggcatacatacatgatgtttgaatctgcaatattattattttattaaaaagacaaaatcaatgtttggagcatataggtagattaaatatttgcttagtattttttgtttttataagcatttggagatgaaaacttttatctttatggagtgcatctctggtatgatagtttgagttggagaaaacttgcttcaatatatagaaaatcaaatagttgtaagaatgtatctcttatacattcacctatactgacaaaaaagaaacttttaaaaatggcagcatatggaacatgaaaaatgtacacaggtatgtttgtggtgtgggtaaaggggcaaaaagttcaaccatttcactcatccttcagtcatgtttgaagactaatgttaatcagtagatttgtcactggctttgtcttgaacggtgatcacattggcctttttttgccagccaccataattaaccagtgtatacactttaaaccaatgaaagtataaccctgactcaaaaatttgttaagtgtcatggtacctgatttaagtcttgataatagactgtatccctttttcttttcctctcttggaccccacgagtgcctctcaggaaacttgatgttaattgctttgttatagattaggtcaagtgtgctgtcacttatttctgattatatttttcctagagctttttagtatccagacttgtcttgctctatcacacacaattgatgttatacatgatcagcaaattaacacattgcccaaacaatttcctgtgtttattaggcagtctgatcagaagctgcactaagcttcagcacaaatgagtaagtccaatttgaaaaacattttaaaaaatagatgaagcaaagcttgcagctctacagtgtagaatataatgttccttttatatagaggacatgttagatgtggcattaggtgtttctatacaaacaattatagttctgggagacttgactcttaaccacatgggctttaagggaatctgttcacagaagggcttctgcattgtgctcaacgat

SEQ ID NO: 59209 - DNA, 646 bp, Bovine  19866881416353
aatttggtcaatgaaaacacacacacagacacatgcacaatctgttcagttaaattttttttagggcaaaactttttgatcagttgattgactgagttctttgttgggggactagtgtgttgacacaaagagttggttagtttctttcctgctggggaacactaaattacatcccaccaacttaagcttccctggagtgactcacacagtggttgacttttaaagttcactgaaggtgagggttcaggctatacaaggtcagagtttctccacgaagcaggacaaacaaaaatttataatgccaggctgtttgatatactttctaaaaggagaaggccactggtttttcccttccctaactctttcctggaaagaaagtattggaattatccccagtagtgttgaaagacagaatttctgggtaagtagactttttttttttaatccccagggggattcatggctgactgagtagtaaattcagtctcagtgttttagctcacaaataaagaagtaataagagaagctctgcatgtgtattggctgaaatagaaaatggacgataagtaacaggagtttgtaaggaaacacatcttgctggaaaaaaatgtgattgctattttggaacaaactgcaaaattggaaa

SEQ ID NO: 59210 - DNA, 1916 bp, Bovine  19866881561129
taggaaccagaggatcagagaggttcggtaccttacttaaagcccaaagctagtaagtcatgggggagaatttaagtcaggttccatggcttcaaagcctgtgctcttagtttatcaaaccaaaagtgtcctagtatgaagtgagaggaagagagtgatcatttggtcaaggggaaggaaagtatcactaagtgtgtttagtgaactaagccttctcagtctccccaggatctcggttcagcatccctgctgggtacagatgcctttctgaattctggaatgccagagctaagtttttcctccaccttcatttctgaggcccatctctttgactcccctggctaggttctgcctgggttctgagtaaacagccacagccataaacctttcaagtaggtgcagagaagagctgtttttcatcaggtcattgtaggcagcctgggctgccaacttcccatcaaagcctcataaactcttttacgaggctcataaaacgctgcctactcctgttaggggagaggaggacggccatcagacccaaatcatgctggtttcaattgcttcatttccatacatcagactccttggaaaaccaaaggcaggccacagccagataataaagtggtccttgtgttcctgtggtgctcttttaccaggcctcccaagccctgtgatgcatagtagtgtttgattacccagcagagcaattctgggtggtgaagtcggcagcaaggatttcagggaaccacagctctcgttcagagctgaagtgttggctgccaactgggttctgctttctctctcgggatgtttagagagaatcttcctgacaatctctcatggcttttccactgcagttgggcatagaatctgccccattcttatctttgtcccttgcaaggattgtgggtgtcaaaagaaaagataaccaccaccttgttaattaggttcatagatccgccaagcctccaagtttatcttatctacctgctcacataatgcttcatcttctctgctttgtcacagaagtagtgaattttggattcaggaataggaatagaaagcaatttacaagtaatctaattctctagttaataggtattttcatcccactctactgtaagctccctcagagacaggtgttgcttctatttttttttcaaaatttacaaatgtctactcttgtacctggaatatatacagagaggatgcagaaagtattaaataaatggatcaccattattacatgtatcagtcagcatatgctaagttatgctgtggtaacaaacacagcactgaagatttatgtattattcttgatgtaaacccacctcaagtcagttgttccatgctgtctttactccgaagtaaaccagtaaaccagtaactggtttactccgaaacccagaccaatggagcagtttttaatgtttctagtctcttggaagaggaaaagaagacagtgatgtgaaccacatgctggtttgaaagtttctgtttgagagtgagacgtgttacttccactcacagttcattagttaactcaaatgaagaccaggtctgacttcaagggactggaaaattaaaattctcccaaacacaatccctttcttaatctcctttatgttttgtcagagtttaatatttacttgagtgatgcccctaagatataatttagggaacgcaatatctcattgtaattttaaacaggcatagctaatctgaaccttgaacagcagatatatgttctgtgctcagcatcccagtcttacacatctaggaggaatcaatgctcagaacagtggtgccacaagaaccagtcaatcattaaagatagtatctgttactgacatcagtttgtagttactaaagcaaagcaaacatttaatgtaccttaggaagattttcaacaaaaa

SEQ ID NO: 59211 - DNA, 2306 bp, Bovine  19866881655908
tgaaattcttaggccaaagtgaacagcattttttactgaatgacacttgaagagttttatttctgacaatttctgtccagaaaggctgcttcctaaagtgagggccacctgacacaattctttctaaactttgacaagaaatacaacccctccctcagtgttggaaggtttatgctggtttcgagtcaaatttcctttcaaccagctcagtgaaagccttaagcaagaacctttatttaaaacaattaatgcaaaattcagtttaacataatctgaagaagactgacatctcataattctgaaatggggaatacaaattaaaagtaaaatgataccttcctaatgtcctgctgtggcaggcctcgatttgaagggggaaaaaaatccatctggccttaataaagatgcgtgctttccaggttgtgggggtatattgtttcctttacatttttacagtgagggctagtttttagtgctacggaactaaacaatttattttatttttaaagagatcactcttattgattccataagtcttcattaaagaatgaatgaataactgttgagcatctcctcagagacagtgggataagtcctatgccagagtgaagtgagatgtgcgcgcaggagagcactttcatccgacccacaagttaggcaaaactcccctgagaataaggacggaggtcgaattttgaaaacaggcagcaatgaccaggatgaagaatgggaggaaggacttctcaggcaggatgagaggtggacgcaaatcacattagtgaagcctgattatgatgcatctccatctaaatcctgtgctttctcagatgtcttgtgaccatctctcatctgcagcccagcacatgtgcacttccatctggattccccatctcaggcgaaaatatcatgagcacctattcctaccttcccggaagcatgagttaaactccactcttccctctcctttaacgatagtcttaaattagaagactatattatacgttccctattatatatgtgtcttcatctccagcaatatttacttatttaaatgtctttctctttaatctgcagaaatgctataaccagtttttattcaatgattgtctatcttgtaaattcagcaattgttggcagttataataaaatatgtacaaagtgttggggctataatgatgaatatgacactgtcacaggctccagtgggatcataccaaatggaagagatacaaatatatagagagaattttaatgcaaggtatcttaaagatgggcttctcaggtgattcagtggtaaagaatctgcctgccaatgcaggagacacaggagacgtgggttccaaccctgggtggggaagatcccctggaggagaaaatgacaacccactccagtgttcttgcctggaaaagtccatggacagaggagcctggcaggctacagtccatggggtcacaaagagtcagacataactaagtgtctgaacacatctcagagatacacacagaagacacctgaggatcagaggggaagactggaaagctttctagatagattaaaatcctgtggtgagactttaggataaggaggaaagaccacagagaaactattccagagaaaacagaattagcaaaggcatggatatacaatgagctataataaatgttgctgaaaaaacattttcagaggaggaaatgatgagaggtcaaggaacagaggaaagcagaggctaagtcatgcagaatcttgcgtgccatgttagaaagacaacaaaaacagtaataatacattaccaaatgcctattgtactcctgtaatatgattatgcactttatttcatcacaataactgtattttgaaagatatcattttcattttacagactcaaaaaaactaagacttgtgtaagttcaggtagaatcttaactttgagtgcatgggttctaatgcactcaaattcaaatttgatctacaactgaattctctgtcttatttctgcctttcccgaaagcctctttattttattaacaaatacttttgtttgtaatttcaattataccaactcaccaaggaagtgtattattctggcttttgatggttcaccttttccttttgcagaaggttcagatttcttaatgtggctttcactgtcgtttatgttttctccttccttcatctcactctctttatattcacctaatttctagatataattaatttcttaacttttctgaagttgtctctataccattgtacgtgctatttcaccttgttcaaatgcctacttctactttatttcttccttcat

SEQ ID NO: 59212 - DNA, 1074 bp, Bovine  19866880234592
tccatggggtcacaaagagttgttcacgactgagcgacttcactttcacaataaaaactaagaacaaaaaggcaaaggaattttgaagaaaaaaacttcagggaggtagggacaacacaagcttcctctgaattcacttctcataaataactcctattttcattgctatccaatcctgactttcctatcacacttcagtcctttgcagactgtcattggcaatggagggcaaccaatcacagatcacagaattcatcctggtggggttccagctcagtaaaaacatggaattgctcctttttggtatcttctccctgttatatgtctgcaacctgctggcaaatggcatgatcttgggactcatttgctttgaccccagactgcactcccccatgtatttcttcctttcccacctggccatcattgacatatcctttccttccagcaatttgcccacctttctggaaaacctagtaaaacacacaaaaagcatctcctttgacccttgcactgtgcagatgcttttcaatttgacttttggatctatagagtgcctcattttgttggcgatgtcctacgacaggtatgtggcgatctgccatcccctccagtacacggtcatcatgaactggagagtgtgctccatcctggccattgcttgctgggcgtgtggatttgccctggccctggtccaagtaattctcttgttaagattacccttttgtggcccccagaaggtgaaccacttcttctgtgacattcgctctgtcctcaaattggcctgtggtgacatctggatgaatgaaatgttcctctttgctgatggcgttcttatcttagtcgggcctcttgccctggtgttggtctcctatatgcgtattctctgggccatactgaagatccagtcaaaggagggctgcaagaaagccttctccacctgctcctcccacctctgtgtggttgggttctactttggcttagccatgattgtttacatggttcccgacaacagtcaacaagaagaacacctgaagatccttttctgtttaactcttttcaacccatgctaaccct

SEQ ID NO: 59213 - DNA, 1637 bp, Bovine  19866880403500
tcctcattctatctgccaattctcactactataatccaactggaaaccatctattaggtttttctgatggtgctcatatgaaaatataagcaaatatgaatctatatgcattcctattccttcctaacacaaaaggatgagtaataaattcaatgtactttacttttctcactttacaatatagaccaaagattgtttctaatcatttaagaaagagcttctttaatctttatagatagatattttattatacagacaaaacataatttatttaaccagtcactattgatattagttatcaatattttgttattacaaagatgctgtaaaaaagatgctgataaaattgtgctaatgacataagaaacaggggatcagctaggaaccaacatgctgattagaggaatgatgagaatggcaatgctggagagaaggaagaaagacaaatttgtgggaagctggaaaatagtgtggtaaacttggggtgtgtgaggggaaaaggaaaagaagaacccagaaatgaatcaaagacctggaaccacagaaagagagctacagaggggaaggaggaaagaaagtgccaggagaggatgaacacaattgctggtcgagataatctacaggaagtcactgtcactgttgaaccttggagcagaagcctcaataacgttgatccctgaagttggacttggtaccactcacggaagtaatacagggaacttccagcagtgagaaaaccagaaaatcacagaacaatgtaggggaggatgacccagcacccagaatcaaacacttaggtcagctgtaagacaatgaacaacattttgaatgcttttccctttcaaacatctcagtgttgttaataacttgtatatttacagttcttaaatttattttgtgagaagcattttcatatgtattaatgaatataagcacttaaaaaataacaatctaccatatacgaatgactcacttatcaattgaagcaatgtcagtatttaaaagttaaattgtagatcacaaacagtttgcagatgaaaatgattatttcagattttaatcagtgctttcagcttactcaggcccaaggtaatgagtccatcctcgggacacagctaatccttcaggagttgatagcagcgtttcatgacatttcgaaaggcctctatgaatttgtcattccggagagtgaagataaaagggttcagaaaagggttcaccactaaaaccatcagtgacgctaccctgttgtactcagcggcctgcgtttgcttgggtttcacaaagaggaacaagcagctgccatagccgatgacaacaaaggtgaagtgggaggcacacgtagagaaggctttcctgcggccggaagcagtggggatcttgaggatggtggatacgatgtaggtgtaggagacaattgtagggatcatcgaaccaacaataatgaaaacagccattaaaaacagaataaactctgtgaaaagactgttgtcacaggatagtttgagcagttgccctcggtcacagtaaaaatggtctagcacatttgatttgcagaaagtaagatgaaacgtggcataggcggccagatttgaaacaggaagccaaacacccaggacacaattaccacccagaga

SEQ ID NO: 59214 - DNA, 1774 bp, Bovine  19866880472380
tgtaggttcaatcccttgttggggaactaagattccacatgccacagggcaactaaagaagcctacatacctcatgaacccagcagagcaaaacagaaaaaaaagaagttgttcccctcatcctcatgcctgggttcctccccttccctccttttccctgggaatcctcccttcctttcttataacctttccatctcccaccttccctgcttatttccaagctgcctcactcctttaattctcccctgcttcctttctagaaaccccaggttcctggcgcctggcccctggggaggagaaagcctttgaattctacaactcctgcatgaacatgagtgccattgaggcagcaggggccagtcccttcagacaggttattgaggaggtgagactggcacatctacttttctggattcggaaagcacacaagaccagtgtgtgctcagggctgccatattttcttccccatagaggatggatctctttcctaggagtttgggagggaggtggacatggcaatgatctgtggacatatcaagaccttggctgagggtaggaaaagggggacagagctggagccctagtaagcggcaggggactcagggtagaagtcaggatgtagcaatggtggtgagggatgtgctctgagagactatatccctgtgttgagtgctgtttcttttcttcccagcttggcggctggtcgatcttcggtaactggactccgttagattttaaccaaactctgagccttctgatgagtcaatatggtcacttcccattcttcagagcctatttgaaacctcttcccacccctccatacttgccagtcatccaggtgagggatgtgctggcaaaaatgcaggcctgtctcaaatttgttcttagaccaaaaaaatgtgcgattcaggaaagcaacctaactttgttgttgttatggttcagtcactatgtcctgtctgactcttagagaccccatggactgcagcacgccaagcttccctgtccttcactatctcctggagtttactcaaactcatgtccattgagtcagtgatgccatccaaccatctcatcctctgtcatctacttctgctgccttcaatctttcccagcatcagggtcttttccagtgagtcagctcttcccatcaggtggtcaaaatatcagagcttcagtttcaacaccatccttccaatgaatattcagggttgatttcctttaggattgacaggtttgatctccttggtgtccaagggactctcaagaatcgtcagcactgcaattcaaaagcgtcaattcttcggcattcggccttctttatggtccaactctcacatccatacgtgactactggaaaaaccatagctttgactatatggacctttgttggcaaagtgatgtctctcctttttaatacactatctaggtttggcagagcttttcttccaaggagcaagtgtcttttaattttgtggctgtagtcactgtccacagtgatttcagagcccaagaaaataaaactggtcactatttccacttttcccctttctatatccaatgaagtgatgaggccagatgccatgatcttagtttcttgaatattgatttttaagccagcttttttactctcctcctttaccctcaccaagatgctttttagtccctcttcactttctgctattagagtggtatcatctgcatatctgaggttattgatatttctcctggcaatcttgatttcagcctgtgattcatccagtccagcatttcg

SEQ ID NO: 59215 - DNA, 2226 bp, Bovine  19866880512661
ataggaggaggccgcgatgaggacctggcccatgtcattcaccatcaccgggaaggaggcttctccgataagaagcagttcacacgggacggcgtcttcggggacgtcccagcttgtcactccattcataagggcctcgaaggcagcagatggagtcgccatggctggaccggcttctgcagagaggaaagcaaagactcagcctggtgaagaatcggtaaacaaacaaacgagccaagcagttcactcttccctagctggggcagctcttcccactgagcagatgagaccgatgctgtgaacagactcaagcactcaagcactcaaggctgtcggtgtctccaacccaggagaccctgttgtgccctgtccattaacactcttactgtcaaactaagtgagctccacgcatttccgtcacagaaggaaacaaacaggagttaagaacaaaggcagaactgtgtctccaaagacatacgttcaagtactaactcccagtacctgtatgaccttatttggaaatagagtctttgcagattcttgcctgaaaaatcccatggaccgagaagcctggtgggctacagtccaaagggtcgcaaagtgtcagacatgcctgagtggctaagcacacaatttaatgactggagcctttaaaagaagaggaaattgggacacaggtacccagggagagatacacaggctatgagaacatgtaggcaggtatcagggtctctgtgatgtctcaatgagccaaggaatgccaaagactgccggtgaacaccagaggtaggcgagacacatgaaacagactctccttcagaacttccagaaagaaccaaacctgtcaacacttggatttcaaacatctaagcctctagaactgctacagaatacatttctgttgttttaagctactcagtttgtggcactttactgcagcaaccacaggaaagcaacacagaggtgcagcgcgctgtctccccacccccgctccatcccactcggcgctcacactgatcatattaatctcagcgtaggcccagaaaaccaaaagcagaaagtaatacattatgaattgatagcagattattacttgcacccagacatagcagcaaaaggtgtatatgtcgatggatgtgcagtcacaaaaaccctctgcttcttcaccttgagctccctgcttaaggtcactctgcactctgacctcctctatgtgccctttactgaagcacttccctcatggacagactgtttaacagtcaggacaaccagtcctcaccatcctccctgacaactcagtggctctggacaatgctgctccctggtccccgaggctcttaccacctctaaacttatggccaggctcatggtctgcaacctcttgaaccgcttccttcctggcctctccttccctcttctgaaaatgcagagattccttaggtgtttatctttggcccttacctctttttccttgtctcactcaaggtatgatggcaaagcaattattaatacacgcttaggctctggagttaggctgtctgggtttgaatctcagctctgctgtttattaactgagatcaggcaacacttctcagacttggtttcctcattcattaagtaggaaaaatggcatctaccacacaggattgttttgaagatgaaaggaatagcattggttaagtgcccttccattatttattttattgcctaaaattacttgatctaaagtatattttatatatatatatatatacacacacacacacagatatatgtgtatatatatctttgcttaaaattactagattaagagtaattttatacacacacacacacacacacacacacacacacactgtgtgggctatagtccatggggttgcaaaacagtcagatgtaacttagcgactaaacaacaaactactatatatataaaatgcatataaatgcatgcgtgtgtgcttagtcacccagactctttgcgaccccatggactgtagctcccttggcttctctgtccatgagattctccaggcaaaaatactggaatgggttgccattcccttctccaggggatcttcccggcccagggatagaaccctcttctcgtgcattgcaggtggattctttacagtctgagccaccagggaagcccatatatatataaatatatatatatttatatgtatatgagtatcaattacttattatacatatatatatatg

SEQ ID NO: 59216 - DNA, 2227 bp, Bovine  19866880573831
tgggaaaggaaactctgcaatgacttccgtatcacaggaaacaataaaaaagaactgttttcagtcagggcttgcagactttttaaaaaaataagggtacagatagtaaatgttttgggatttaggggacatgtaagttctgtcacaattatttgcctttgctggaaaagagctcagtcatagacaatgtgtaaatgaatgggtttggctgtgttccaataaaactttatttacaaaaacagataggggaccatatttggccctggggcataatttatctacccattttagatgatgaacagtctgcttacacaaactgtttacattaatgtccttggataataaaaaagaaatttaaattgtgttaagtgttttccagtgaatgaaagtcatgaatattcgaaatactttgagagaatctagagaaaattactgaaggcaattttgatgcttaaaggcttccttgggcttccttgatagtgcaattggtaaagagtccacctgcaatgcaggagaccccggttggattcctgggtggggaagacctgctggagaagggataggctacccactccagtattcttgggtttctttcctgacttagctggtaaagaatccacctgtaatgtgggagacccaagctcaatccctgagttgggaagatcccctggagaaaggaaaggctacccactccagtattctggcctggagaattccatggactgtatagtacaaagagtcggacatgactgagcgactttcactttcacttttcatcaggtgcatagggccatcagtcaaccctcattcacagagcatttaccatgtgtcagggaatttgcaaaatgttttgcatttactactttaatcaccatagccaccatgatccttggatagacaaaatgaagctaagaagtaaatgttcagtaaattgtccaagaaaacacaaccagtttgggatagaggaggaattaaaatccaagtctaactctgcgaagatctttcaattcttcacttcaaagaattcacatgggacaaatatccataatttaaaatagcatcatcactaaccaaccatataccttcacaagcacttcaagactgaaaaacccagcttacgatatcatgcaggcaaaaacagcagatctgctggttacgatgttaaagaaaacaaagcccctttccttccatgttaccatgtcattttcaccttgaccctgagatcaggagagcatatatggcatgataggctcagattttaacatgaagacactgcgataaatgcagaatcacttttaaaattgtaaagtatcagacatgtgacatcgtcgccagggaaatgtacatctgattatctcatcacactgctttttacatcttcaagtgattctgcaccactgacagctaaatagtccagtctctgcagaattgctccaaagcgtcctaacggttcccactcttccctacaaatcccaggcttcagctgcacagatgacttgcagtttccacctgaacccacctccctgctgtgtgtctgcagctccatcccgcggacatgacctccagtttgcaccagtccatcaggctagtgaaatcgcccctcccgcagcaagccccccagcagcccttcgggaagctgccggcctgctctcggtccggggtaatcagactctccctctgggttctcctcatccaggccctcagagccgtcacagctggcctctcaccctgctgtgactctctcactcgcgcgtgtgaggttagaactgctttcaaggcagaaccaagtatgcaccttcatgttgtcccagaagcgtaataaacatgtattgaacgagagtgactaacgggatcccccaaaccatatggtcttctccactcgagacatttcctcattccattctatttttacaaccttaaacacaaataaccgtgtccaactttcaattcctttattactaaataataaacacagtggacatccccacaccctttctgacccttgccctgactcttattagggatgaacttcacagacagattaggtttcaggccaagtgtgaaaatgcctaataaaatgagaagctgaaacctgaatgatatgttttccagctctccactgtaccacatcccctcagatgacctgtccccttacctggatgctgtgtggcaagtttaacacataatatatctgaacttcatagtttagccatatgatgatgaaaca

SEQ ID NO: 59217 - DNA, 1164 bp, Bovine  19866880702892
taagaatattactggcatactctttgacctaactatccatttctaggaattgctcttttagatatacttaaacaagggtgcagacatatggtcacaaggatacgtatgcccttgttggaaacatacatatcctttgctttggaataatgaatctaggataactaggctactaactgaaaaggggctttaaacaagttatgctttacaataactttcaatatggaatacaataaaattgtattgcaatatacaatacaatatatacaataaaataaaattatacaataaaattccatgtagtcattaaacagggaatactgtatttacactcatgtataaaactaagcactttaaaatcaaaagataagttgcagaatattatgtaaaacagtagtatgttaaaaaggtacatctctgtgtgtgtattgtgtgtgtgtgtgtgtattaggatatgaatgggaaaaaacttagatacatatcacactgttacatcagttgattggagatttgggagtatgggcaacataccagaaactgttttttattttacccgtagcaatactatttgatttttaaaaattatttttaagtgtttagaaagaaggatgttgttgttaactcttaaaagttcaattgaaggaatagattaggaaattaaacccaaactataattgtagtaagatgaagtaataaaagcaactgagcttgagaatggtgtataataatatgtcttggctttaaaaagaattcctgaataggtggttttaaatcagttatagttgttcagtcacccagtcatatctgactctttgcgaccccatggactgcagcacaccaggcttccctgtccttcactatctcccagagtttgctcaaactcatgtccactgagtcaatgatgccatccaaccatctcatcctctgtcatccccttctcctccttccctcaatctttcccagcattagggtcttttccaatgaatcgactcttcacattaggtggccaaagtgttggagcttcagcttcaacatcaatccttccaaagaatattcagggttgatttcctttagaactgactggtttgatctccttgtagtccaaaggactctcaagagtcttctccaggataataacttctcctttaaatcagtagaagttattat

SEQ ID NO: 59218 - DNA, 1912 bp, Bovine  19866880961090
tcacattagtcctgtccttcccaacactctcctaaagcacctttgacctctttgttcctcaggctgtagatcatcgggttcatcatggggttgaaaagactgtaaaacagggaaaggatcttctgctgctcctcatggtggcgagacttgggggccatgtacatgacgatggcactgccaaagaatatcccgaccacgcataggtgggaggagcaggtggagaatgccttcctgcggccctcatcggactggatcctcatgatggcggccaggatgcgtgcataggatcccatcaccaggcagatgggcccgactaagataaacacagaagcagcaaaaatgacaacttggttgagcttagtgtcagcacaggccagcttgaggacagacaggatttcacagaagaagtggttgatttcatgaggcccacagaagggcagccttaggatgagacccacatggaccagggccaggagggagccacatgtccaggaagcaacagcttgaacagtgcacactctccagctcatgatgacagagtaacgaagagggtggcagatggccacgtaccgatcatgggacatcaccaccaagatgagacactcagtgtgtgcaaaagccatgtacaaaaaggtctgcattatgcatgggacaaaggagatagtatttttcttgttcagaaggttcaccagcatcttcgggacattgtttgatgcatatgaaatatcgacgatggccaggtgtgagaggaagaagtacatgggggtgtgcagtctggggtccagtgagataagccccaggatgaccccattccccatcagggtgaggacatagaacagagagaagagcccaaagaggagcatctgcatgcttgggctgagcggaaatcccaggagaatgaattctgtgacccatgtctgattttctgtcatgccctggtgacagtgcctgtgctgatcacagctgctgcagtgcctgtgggctgagaaacaaaggcgggtctggattagccattaacagaaagagggaagttgtggtgtgcgctgtgttctgagtcagctaacaatcattttcagattcatcatgtcaagtcttttaatccacaataaagcagaaaggctcccataaataggatcagtgaacacagggtgtcatgcattatttccatttctacagaattttatgtaactctgattgcaaagtttatactcatacagtcaagatggcagccacagaataaattgttctccataatgactaatcgttttactttttaagaaaggcgcatagttacactctcattttgctttcttatttcttcagttctcaaattttgctcatactttatcatttgatttgctcttattttaaagcttgtgcagagtacattgcacacagcagttgctcaataaatgatcatgaagtaaatacaccaataaaacaggggatgagatgtacaaatgcaacttcaagaaggtatatttccttctgtgtccactaggtttaaagctttagcaaatgaaattgacaccaagttttttcttcctgatactatgcaggaaaatctagctttttccatgctgggcacgagcagagtgccatcactgatctggtcagcattcacagaagttgtttgtgatctctgatcagggcaaggatctctactatattcctactcctgtcctataccgccttcttacagggctgcttccctggttctagagagatgttatttctgggccctttgcagttgtacagtgcatttgttgaatggatgaatgaatggatggtaaaggatggataaaaggcattactttaggaataacatccagagcatattctggaatttaatcaagtctttcgactctcctttaatttttggctaccactccaccaaccttatggccaccca

SEQ ID NO: 59219 - DNA, 1497 bp, Bovine  19866881046777
actccaggtctttctctccagtgaaagtgtacgttgctcagcaccagtgccaggccgcggggccgagactgcaaccggtaggcctggggaggggcacccgatgagaccgtcagcctcgtgaggacagaaactatgcctccccttccaaaatgagacatttcaagaaaattaagacgtcacattcttcttcatagtcccaccaggtcaaaatatagaaatgcccacaaaagacagtcaacaggcaatgcttttaggactaacaaggcaagaaggaaatgatgtacacacaagctagctacgttcagatgaggaaggggatctcatttcccagtgcctttcctcttgccatttccaagactcaccaggtggtggtgtgtttgataaaactcaggcgtgcagggcttcacctgaaggcagggaggaccatctccgtggtctagggagtgctccactgcatctgtggcacacaaaccagaaaaactagcttatagtctacttggcaatcttagtatcttcatataacttcaggtaccctttggtctcgctcactcccctggttcgtaagcactacagagacagagatcctgtttgcttttgctcattacaggatcctctgcacttgacctgcctatagtagtaggtgctcaacccaaagaatgactgaatggggtatggggtatctgataaaagtcttattctaatcagtacgctatcactgtgaagtaactcagctgtatacaaacacacaccaatcacgtgaaggaatctttggcccttgttgctccaagggccaatcaccattaaaaaaatcatctgtgatggaaggaaaacaggtccaacctacaccccacctaaactgtcctgctggttcctaacaaatgcactgaggaaagtgtgccagttataaacaaaaataggtatcacactgggcaaagtcagataccagtcaaggaaacagaagtcaatctgcaacaggggactggttggggcggagatggggttgtgctattttacatcatcagttcttacctggagacaggtggagccgcttgtggcgggtacaggactcacacaccgggaaagggagactcaggtcatagtcacagctcaactgtaagaaagcaggacccaccaagccaggctcaggggagctggttcagatcaagtaacacagaacccctagtcccccaaccccaacccatccccactgtctgaaagatgcccttcccaccaaactagcctttctcaacacacacagcctagggctccataccggcgggactacaggctgaagaccagacagggttctgagcagcagctcctccaggtgactctgcttggtctccctcagggccacacagaaggcatcaaaggcctgggggcctctcttgggcagcaagttgaggagttccacgttctggccgaaactgccagtcttggcctacaaggataaaacatgacgtcaccttactcacccaactgtatcctatttctcca

SEQ ID NO: 59220 - DNA, 1139 bp, Bovine  19866881082830
aacggaaagtaggatcctctctcttcccaccctccagttcctgagcccagagttacccgccatccattgtttcttgtttgcctaagatgttttctctatggttttgttgttgtccttcagtccctaagttgaatctgtatcctactctttgcgactgtggcgtgccaggctcctctgtcctccattgtctcctggagtttgctcaaattcatgtctttcccctgtggacacaccatcatatacctctctctagtctccttctgtccccacggccaccctatccctcaacccagcacatacacatgcttttagaataaatatacagagggagccataggatacataggctctgcaccaggggcctctttctaaagtaaaggactttgggaaggagggggaggctcctgcaggctccaaaagctcagagctttgtgatttcagcagggaggaatgggcgaagggtgcacagccaacagaggggggaaatggagcaaactttggacaatcgtgctaggaaataagccagactgcggtgaggtcatgcatgtgctccgtggtgtggttcattaaagttacaagacccttgggattcaaggggggtggggtgggggctgcccatgcagggagaggtggagtccagaggaacctggcttttgtggttgggctgtctctctgtcctgagtctcgaagtattgaagagggggaaggaaagcccacgtccagctgcattcgggatgaaccccaacttcacagttcctcattccctttgttgtgggaggaggcacgccttcggttttggcctctgtccttaactaacagtgcagctttttggagttatttccactctctggaccttagttttcttagacccagatgatctctgagaccatttccaggaaagacgatgggatatagagtcagaagatgaaggccagctcattcagtcttgtgtgtctctgtttccttagctacaaaatgcgattaaccatgcccacctcctagagtgggtgtgatgatcccaaggggagaaagtactttgctaactggagggtactgagcaaacagtactgggctcggagaatgacggaggccaggactttcctgaccttactcttacctgcctcccaggttactcccag

SEQ ID NO: 59221 - DNA, 1093 bp, Bovine  19866881150632
aacttgatacactatttacagaatagtgttcattctctgtttttctcaagatgattttttttatgagaaaatactcctgtgtaatcagattattctatcacatcagaactaaagtgcaataaattttgaaagcaacatggaaactctgccttcggggagaactatagttttcataagataagggactaggactacttttttgaggttggcagcttcctaccctgctgacaaactcattgggagcagtgagatttgggtcaacacaaaaagtaggatctattcaatcctgtagggatcagattcaagaagactgttgatcttattgctggacagtttcaaatggagaaggaaaatttagactttgagatttagattctatattcaaagatttagaactggaaagcatttgcattctgactgctttatactgtaacagagaaatccactgggaagctggggcgaaagctgctttctcaagttaaagccaatgactgtatttatgtgagtgaataacagtatactttccttcatctgtgtttgcaattttttttgttacatgtattactgtagttgagttttactaacctgttattttgagggaaaatcatcaccaacctttagtagcaagaccagactctcatggctctaacaagtaaggctgaaaacatttttgtttgtacaacgtatgtgttcgttctcagcctttctaagttagatataagcattactacttcttttatcatggcacttatataaagtcttgccaactcagtctcctcaaagaaccaaatattaaagcacataacaaaatatgccagtaatgcagtttgtacaagggtgactcaaagattattttaaaaagaaaaagcaatcaagcttattcaacaaatatttatttcccgagtgcccactgtgtgggagatgtgggggttggagatgaccagctttgttctttagaagaacaacataccttgctattagcccaaaagcaatgtctaacattcaagcatgtatttaaaagattaagacctttgctgtgtccagaaaatattctttgtgaaaatacttttttactgcggtaagaacacacata

SEQ ID NO: 59222 - DNA, 1034 bp, Bovine  19866881161109
ttgagaacagcagagttgatgtacaatgaagagggttgcagattgcaaattccttgcgtgtgtaacaagagttcgcctgtctctgccttctctcagtcccagcacagtgctcagtacatgcaggtaggatgtaggtaggtgggtaggtaggtaggaggtagaaaggtaagttaagtagacaggaaggaaggaaagaaagaagagttaggtcaaacagtattcatacaaagcagaaaagcttctcagagctaatatttgcttaaaacacccaacagtaatgcttgcaggggaacttgtttgaaccgtgatgagcagacatcaccgaagactaccccactggactgtctggagacggagttctagctgccgatagtttaagcttcttaagggatcctgactcataacatttggagacctcttgaactattctgtactatctctttggaataagtacatgaaagccataagggattttgcaggctcaggttaatctgaaagctccagtaatacagataataggcggccaatgggtctgatttcagaggatgaactttagattatcctccaagatacgcgtaagaagaggctcagcatcacaggacgctgaaagttatcaactcctgcagcacagaggtggacgcttgagactagcaaactttttgagttgttagcacacaaaagggaaaatccaaaagcagggcaaatgatctggaacacaaattactcccaagattttaagcccccagttctagagaagtgggaaactagagaccccttctcacagattctgttttctttagatgcttcacaaggaggaagcacaggaagattaggcaagaattctccagagcctcgggctgtactgagaactcaatgatactagctaataacgttagactcattaaaaaggaaatggagatgttgtaatcatattcatgctcattagagacacaccagactcacaacaagacgataactttccatgtcttaaaattgggaagatggaagttcccttcatcagtgttacgaaagag

SEQ ID NO: 59223 - DNA, 1784 bp, Bovine  19866881205079
ttgtccttgagctgtgccagtccgcagtgtcaggcagagacccaggaacagggcagcagcactggtcttgaagagaagctgaagagcatgcatgctggaggaatttggtgcccaagaagcctgtgttcccaaggagcaggatggttctttataactctagcacaatgaccctggagctatgaggacaggttcacttggccaaaatcatcacacctgagggatttccctcattgctaacttttccctatcgtgtgtgagaaaggtcaatgtttggctggaacttaattaaggaaagagaggaaggaatgaattggaccatttccatttgtttttcaacgttgaagtgttcctggctcattaagatagatcctgccttaactgttttaaacaggattctttccttttctaagtcctacttcttaatccttgttctacgtgtaaagatccatgagatgtcctttccctttgtcctgtatgtgacacatgtcttgtcttcctctcaatgcctcaaccctaaaatttgctatagattttagatgtagaatagatgccatgaaactaatgtccctactcctaccttctctgatttgcatttttggttcaatgaatcatctctgggtagaaagtgtgtttaaagagaatttaatccatgggaatggaaaaactcagatgagatgaggggagaccagatatatatggtgtgcatttctttttaaaaaaatttatttatttattttatttatttattttaattaatttattttaattggaggctaattactttacaatattatagtggtttttgccatgcattgacatgaatcagccatgggtgtacatgtgtatttctaatgatactgccaacaagcaggaagctggataaaatgcctttctgtgattgaattggtttgttaggagccttgaattcacattacctttgtggatgctgctttcctgaagtgtctcagaaaaggtcctgtcatctcagttctatgcttctctagcttcagttactgctctgtctgcttctaattgcaggaaattacgttgcaaggatagatttttaaaaagcccatttggaaggacttttatgatcatctctaattatctataagagaaaatggtatctgaggaaacagagaattagggtgactagggaactcatggaatttcccacctgctatccaaatgtgagaaccgtggaagagctgagggtccttgcgtcagatggggaggtaaagtccaagagtgaattagttggggcagctgagagtgcttcactcttactcctaaagggtatctcagagaactagagtgctgaagctaagcctgaccttgagatgccttaaggctagagcaagaccaggaaaggttgctttcattcctcatttgtattttatgcagtattgtctatgaatcaggaggggcctctctctaactccaggtgctttacagcaggtcttctgctgcctgggtcactatgcctttcatctctgttttctctcttgtggttcagtctctgatgtgtctgactctttgaccctatggactgtagcattccaggcttccctgtccttcactatttcccagagtttgtccatcctcatgaccattgagtcagtgatgccatccaaccatctcatccatttccttctccagaggatcttcccaacccagggattgaacctgcatcttctgtgtctcctgcattgcatgccggggtccagccccagtggatccagggaattcgaagtggggacggagtcggcgaggatcaggaaaca

SEQ ID NO: 59224 - DNA, 2238 bp, Bovine  19866881255688
ttataacattggactttacttccatcaccagtcacatccatcatctgggtgctgtttttgctttggctttgtctcttcattcttcttcgagttacttctcccactcttctgcagtagcacagtggcctgtcgcaggggcagggctctgggtggagcagacctgagacacatagcctgtggcataagcctcttggaggaggtcaccattaacctcaccatagagccaccgagcagatgactcacaaactgcagaacaattacaccaaatagtgactgtgacaagactcaaaacttggtcttctgactttatctggggaggaagaagataggagtacaagatgtcctgctaactatgcaaggatttctggtcatggaatcagcttgggtcttggtctttcctccatttaactgtgactttaggagagagttttaatctgtaacttgaggcttcatttatttcatcagtaaattatttaagtcttcttttactctgaaaactgagattctagtcttagaatctagtcttatcctgtgcattacaaaagatgatacttttcacatcttacagatgaagaaactgaggcacagagcaacctactgacatagccagtaactcacagtgatggatgtctctatgactaacacctgccttgatcctagcccagggttcttcttaccatagcactttggtgttatagctgtcatagagggtttcctacatgaaatgccctttgaaaatgaaagtcaagtctctcagtcatgtctgattctttgcgaccttattgactgtagcccgccaggctcctccattcatgggattttccaggcaagaataatggagtggactgccatttccttctccaggggatcttcccaactcagggattgaactcgggtctcccactttgcagtcagactctaccgtctgagccaccaggaaatccctaaagtgaaagttgttcagtcatgtccaactcttttcgactccatggactatacagtccatggaattctccaggccagaatgctgaagtgggttacctttcccttctccaggggatcttcccaacccagggattgaacccaggtctccagcattgcaagagaattctttaccagctgagccacagggaagcccagaaatgccctttgaaggtcactaataaaatatggttaaaaaattcacttgcatgtgccttgtgtgctcagtcatgtccgactctttgtgaccccatggactgtaacccgcaggtctcctctgtccatgaaatttttcaagcaagaacactggaatgggttgccattttctaccccaggggatattcctgacccagggattgaacatgcatctcttgcatctcctgcattggcaggcagattcttcaccactagcagcacctaggaaatcctttattatgtataatttgtctcctgtgttctatttgataataatgatccccacaagtaataggatttgagttagcctaagtagaagtgttgctcagttttatgcctgtcaaaggagttttctaaagtcacctgcttcatagggtcattgtgagactaagcacaacaaagatcacttagaacagtgcccagaacacaccaaccaaccacagatgtgagctccgactgtcaggtgggggggtgtgctcaccagatttcctcatggagcgcccagcaggtgtgtggtcatgtcttaggtgtcggcttagagaggtgtaagtttccacttgagggatgctaaatgcaaggacctgatatagtatccatgcccagtgtttacacgggcggaaagcaggcagaggaaggacaggcaaattcatggacaggcagggagacttctgaaactgagccttaatgatatttgcatctattctgagaagaaaatacctcttcaccctcctcagatagcccacatcctcgactttatcctctgtactggggcagctggaagggccaatattatccaggaccttccagaaccgccctacaggaagagaccttgaagtctgcaggagagatgagcggaggggacatggttcctggacctcagttggttgataagacagcccttgtctgcattattattttattccttttgttcctggtggcattggtaggtaatggcttaatcatcatggcactgggcagcgagtggctgctgcagagaacgttgtcgccttgcgataagttattggtcagcctgggggcctctcgcttctgtctgcaatgggt

SEQ ID NO: 59225 - DNA, 872 bp, Bovine  19866881328182
gggactcctctgtcactgcccccaaagggtcctagcccactgtatcctcttaaccccaaaaggtcacctcagcagagcagcctgaagctcttgaacctgcaggatatcttttcctggccagactatgtttccgaaaaagagcctcatttccaagcgacagacaccttcaagtcacagtgatttactgtgtgactgacttagcttcaggagggtcatttacaaagccatctacattgtaaacctcacaagggagcctggagtgaagatggccctgcctgagccatttgctttaacattttcctttaacatcaaatcaccttcaacaaagatgagaaaatcagatctgtccggaccaacctgcaagagtacattgcgagagccagctaagccagccagtgtcatagaaaagaactccaaggccaaggtattattccaaaaggaattgggatgattttagcggaagtaatatgtataattgctttacgacgttgtgttggtttctgccgtacatttgttattgtcttttgaggtcagccctggctcaagggaatctctctaaggttcagaaaatgagacactttatttctcattagtttacaataaagttggtgcagttttcagttgtacatatttttatcctggtaatttgttttgacccttagctgctgtcatcttttaccaaattcatttcagacctttttctaagattggtttacttattttggaagtcatatgtaaacctgttgcttaatttttatattatgtcacatatttttgtttcttttacagatatttcaaaagttcaatcactggtcttttccccattctatttctcagttcttttgcctattctgccgcgaatatgggcttcc

SEQ ID NO: 59226 - DNA, 753 bp, Bovine  19866881345590
cctggaaatctgaagtttcctggcgttcccccgtggtctcaggccattagacggagcactctctccaccaataagcaatctttaaaggggaaaccacactgctcgtccctagtagggtatccgggcttctatattttatcacaagccactgaaaggcatttaacgccttcggccaagattaaaagggaggaactcttggagaaaccagagagtaaacaggtagggcggtgactcactgcttagccagaaactggctgaggaccttgtgctttcggacaccgagcatgacttggcgatgcagatacacaaacacagctcccaggaacccacagcaaatcctgagggtgtaagccatacagaaatgaaaccctcatccctcggccctggccactgcagggaagcaaataccaggcctccacctgccctttctacccacctcccccgcaacagtttccaccttacccatgcccacgccaccttcccagcttgggtcctttccaatccaaagctttgccccagccctgccccgccccccccaaccccactcccagagcagccactgacccgataatcgcaaaggctgggagttcctgcaggtcaaagggggaagtccattcggaagttggttctgaagagggctgtgatggtgactacaggatggaaaggccaaggtcatggtgggagtgtcacagaagccatcgaggaggacccaaggtcatcagccttaaggtattaaagtttcctccaaaccta

SEQ ID NO: 59227 - DNA, 2525 bp, Bovine  19866881423808
cgatctttccagcgtgagtatactctgctcctattcagctttaagcctttcacttgcttctcatggtatttagaccactattcagatcccctgttatgagctgtggggtcttacacgtgctggccctgcttgcttttcccccctagtcctcatttcttctccctccatcacagcaggcatggcctcatctcagtgcagctctctcccacctcactcttcagaaggctgggcctccggcatcctcctctgtgcaaatatcacctcctcagaggtcagagaggcattccccaatcacacgtgtatcatttctgttttttaaccttcatagaaaaggtctcaaattttattatgtgtttcttattatttgctgattaaagaaaatctcctccaagagacttttacctccaccccaaggacttcagtgtccacaagaagaagctcatgtccacttcctactctgcctggtccacagcagtcactctcctcgctcctgtgagcccattcttatcttttaaggccctgagatgggagaggagccctttcacatttactgtcatttatatgtttataaattttactttatatacaattttacttacattatttcatttgggttttgatccacattgacataagctaaatgaatattaatatttgcacttgcagaagaggaaattgggttttggagatgataagattttaaggttcatatagcaatttacgactgaggtccaggtttttaatactggaaagcctaactctccccacttcaccgtctcatgtaccttgcagacaatgacaggtttcactctgtctccatggatagtacagggggaaaagcattgtaaaggcagaacttccagcgctctgggtgggtggtaggccaggaaggccaggtgtatccttcacagttggcaatggtaatgtggaacatggttgtttgatactgtttaatttggatgtggttgtgaaaggcagtgtagggtaatagatacagcatggtgtttagacttagacttgaatgtgattcctgccctgctaccagtgggaatgtggtaggttactaatacttctctaaaactcaatttcttcattactaagatgtataaaaggactatgtgagaatcaaattacattgtgtacataatgtacccagtgtatgatctaacctataatgcactattaaaaatgatgttactgttgttactagtcaaagaaggcaaaagatggaaggttccaaatggaccatggaatctgaccagtaattttttctcccaggagagttaagccctgtgtttccaatatggaagtggaaaaccagacacgggtcaccaggttcatcctggtggggttccctgggagctggggcatgcgtgcagcagtgttcctcatattcctcatggcctatattctgacagtggctgaaaatgtgaccatcatcctgttggtgcagcagaaccgggccactgcacaagcccatgtacttcttcctggccaacttgtccttcttggagacctggtacatctctgtgactgtgcccaagttgctgtttagtttttggtctgtgagcaaaagcatctccttcgctcactgcatgatacaactttacttcttcattgcactcatgtgcacggaatgcgtgctcctggccaccatggcctacgaccgttacgtggccatctgccgcccactacactaccccaccattatgagccacgggctctgcttccgcctggctctcggttcctggaccattggctttggcatctccttggataagacatacttcatctctcgcctcagcttctgcggccctaatgtcatcaaccatttcttctgcgacatctctccagtacttaacctctcctgcacagacatgtccacagctgaagctggtggactttgtcctggcactggtcatcttcctcctcccgtctcactgtcactattctgtcttacggatgcatcctggccaccgttctacgcatgcccacgggcaagcagaaggcgttttctacttgtgcctcccacctcgtggtggtcaccatcttctactcagctacaattttcatgtatgcccggccccgagccattcacgccttcaacatgaacaaagttatttccatcttctatgccattgtcacccctgccctcaaccctttcatttattgtctaaggaaccgagaaggtcaaagaggcagtgaagaagctggcttattgccaggccagatctgactagtctgttacaagtgattagatgaagtaatttgatttggagcctgctcttcaacccccatcctttctcctttaatgctgcagctggatattaacatattactcatgttaatgtgacctcaccagatccacattaaccaccggctcttggttgtgtcctgagatctacatctgcgcctgtgggctgtgttttaagggcatgccctttgaccagtgtgttctctttgactgtgatccaaaatggggtttctaagattgtgagtaaattcctgagttgaggggagagaga

SEQ ID NO: 59228 - DNA, 1169 bp, Bovine  19866881561530
ttttgtgtcctcctatacagggttcttggtggctcattggtaaagaatccacctgccaatgcaggagatacaggtttgatccctgggttgggaagatcctctggttcagaaatggcaacccactctagtattcttgcctaggaaactccatgggtagagaagcctggcgggctacagtccatggggtcgcaaaagagtcggacatgacttagtgactaaaacaacaacaaaaaatacagggttatttgcaagacagacttgggagaatcaaaggataagtctgctggaagatggaagagtctgagtagtgtcaattcctggattaataaggatggttggctgaagttcagatctcaagaaaaggcaagagaagaataaagacctgggagaaattgctcttgagccctttagactgtgaggtgctatgggaataaataccactctaacagtttcaggctatgtcgcaattctccctgcgcttagggaaaaaaaaaaatcctatctctctttgcaatgttaacaaacttcaaagcattctgtttgttttggaggaaagaaggtggtggagaagctgtgagcctccatcgcattgcagcaagggccacagaggagcgcaaacttgaagaacggatagtagcagccaccaagaaggaagtcggattgtttctggtgctgatgggagagacaaagagggtgaaatgggaattctcatggggttatacattccatccaagtgcatacttaggtacaagcttgaccacgccttcctcattcccatgcttagctgatctcactccaaagtaaaaataaaagcaattcgcaatcatcctattatttcctttggcttctggagcactgacaggaacttgtggaggggtcagtcatacaaaggggccctgactcagaatttcttgtatactcataagtacgtgtgtctcatgagaaatggcgctgtttctaccttaccttgttggcttggctgcctgagaaactggtgttgctgacctcagaagttaatactctgcgtgaatgcttgggcaggtaggagggagggagcgaaggaagagaacaaatgagtctcagtgaactggggcatgtcagaaatttagtaagaacaagtcgagacaagtgttaaaccagaatccccgagagaagagagatagggtggt

SEQ ID NO: 59229 - DNA, 900 bp, Bovine  19866881625753
gtcctggctatttgcacctgatatgggcatctcatacatttatcctagacctggctctggcataggcaacagttccctacaggacaagggtcattatgcttctctcttgctgagcacccacaaactagttgaaatgccttctttgcacatttgcatgttggtacttttccccttgtcccttagccccagtctctctcttttttgcctttcccgctcctcctcttggccccccacatccatttcctgagtctcccttcctggtccatcccatagccccacacctggcctctccttcctgcacatttcccacttctctcagcctctcttttgtccagatagaccagccagagcttgacgttctcctcaagcaaaaacaggaaccgaactatgcccaggtaagatggtgccgcagaccaaggtcctgacctctgactctggagaaaggcaggggtcgatggtggctgtgactgaggttgcctttcccccagatcctgcgggaatacctgagttacctgaatcgcctggtaaccttgctgggaggagacccaaccgaagtgggaaacgatgcctcctattccctcttcattaactcacagctgaaccagttcctgaggcctggggagcagcagcaggcccagggcaaggtcttcgagatggtcacaattgaccagttgcaggtgcctcgagccaagggctgggggaagatgggcataaaggtcttgctcccaaacttttttgatcttcatgtcttctttctcctcacttccttaattcttagtccaccccctaacttttctgactccatcctttccccaaccaccccctttccaatccctctctatcccaagggaggggaacccccatctcttttctggtcccccctcaacctctgtctctctc

SEQ ID NO: 59230 - DNA, 3517 bp, Bovine  19866880958117
acttctctgctgtggattattctgaccctttgccggttcccagacctccgctcaccattcaacttctaaatgagtagctccacaacccagcttggctgcacaacactttgatcaatcggcggcactgtaacaattgttcaatctttgaccagggccagcttcacaagtgtgtaacctgggcagtcgaaaaggccctgcatttagaagggccctgtatttagtttaatgcttggctgtcactatgttgacattcttaattaattttgaacatgggccttgcattttcattttgcactgagtctaaaaaattacacagcctgttctgatcttgcctttcatcactagagcagaggttttgtgattacatggtagcagtcaggggaaagctacaaaagaagaaaaataaatgctggctatgcaagtattatgtgtcactgaacatgtacacttgcaatctgaaggacggcatgaagtccttaggacagttcaggaggaaaggctcttagaggtaataagacctaatacaaggctcttttttaaaattatttttgtttgtttattttattggagtttaattgccttacaatgtcatgttagtttctaccatacagcaaagtgaatcagtcatatggatacatatatcccttattccttggatttccttcccatttaggtcaagtatgtaagtgtgcttagtcatgtctgactctttgcgaccccatggactatagcccaccaggctcctttgtccatggatttctccaggcaagcatactggagtgggttgccgtttcctcctccaagggatcttccccacccaggaatcgaacctatatctactgcagctcctgcattagcaggcagtctttaccactggggaagccctcatttaggctaaagccctaattcagaaattagaagagaggttgcctctggagggtggctgggggttggaactaaatgagaagagtcacatgggcactgtgattacaatactgctgtatatcttgatgggactttgtatgcactgttcaaacctctggcaaatgtacatttaagatttgtgcatgtcactgtaaatgttgtatcaaaagaaaacctataggaacttccctggttttccagtggttaaaactcctggctagaactacactcatgtctgtaattttgatgctggaaatgcatcaaaaattagatggattacagtatatataaggggatggatgaatgtacaggtggatagacatacagacagacagacaggtatgtactaggccagtaaagttaaatggtaatggaggactctgggtgatgagtatacaggtgttcactgtaaaattctttcaaattctgatgatctgaactttttcataatgaaagttgggcggggggggaaactcttaaaaggaaaaagcagcttccgttcgtttttaagatttactagtgacaaacactttagtgggcttggcagttatcatgagtcagaacacctaagctaatagctgaactgtattttgcttaaattaaaaactcgaagatgctcttttcagatctctaagtccttaaaaagtttatgaagaatgtttgtaaaatgagagattgcttgtgctcatctcaaagccatttagtgcctgcaagggcctgaggcctcaggatgatctataatgcatggagtgtatgctctcagcggtgtttttcctcttctcttgacgtcagttgccatttgtaagggttgccaaggtaatgaccagatacatctaaagacagggccacgagaaaggacagcatatttattttttctcttttagcatccaatatatttaaaattcataacacattcagtttgatgaaattcgacttcacagagaaccaaacttcactgtatagaaaaggactcccctaatccctcccacccctgcccagtcctgtgtttgcagctctgcttttaatgactggagttatttgaaaactgcatacaggcttttacatatgccgtatattttttcctggggaaaaaagtcattttttataaaatcatttttggtaaagtcaacagaaagacttagtttacctcaaaggcaggcatgggaaaaattgagatctgtttcaaaaaggaagatttcaggttccttggaaagtatgtgatttttaaaacttaagaaacaatacttgggtttatcaatcagtatgattaattgacatgtttctaatgggacagatttgtcatgtcacactaattctaagttttccatcaataaaaagcatataaatgttacaactttccacgttgacaagtatatttttattttgtggcagcaataaataaaccactgtgggttgagaaggaactcatttcagctcagttgaacttcattatgttttgaaatgaagtcaccctaatattagaaaattacatgctggcatgaacttcaatattctatttctgttaatggctcatttatttcaaaataagttcttactattgtatacttttaagtctgtatattttggcattattgaaattcatttatttacctttaaaatgaagtccaaacatgaaacaaaagtcattttctaaggagatctttgcaagatgcagaaatctttttatgtgtgaacaaacatttttcaatgttttatatgagatacaggattttttgtttatgagcatgcttgtcctcttggatgccaattatagagggtgcgaaacaaatctgtcctcaaacacctcttgaggtttttacctttttttgagacaatttctattttcagcctgaaccacttgttgggcaaaagattccataaacttagcaccaagtttgtaagactgtagtatatctcttttttgtacatcttagaattataagagtcaagcctcaaatcatgtgcccttttgctatggagtttgatggaaaattctgcgtacacgcctctcctcatttcatgggatgggatcataccactttcctgagtcgccactagaggcccaggactcaaagtccaaacccctggaggtcattctgtctccttgggttattttggaactttgccaagtccacaataccttccttgagagtgatcagcatttcgggagagtgtgcaaatgggtccttaaaacaaatgtatgggttaatagatgctgaatgctaacatcttcatggggttgagaaattgctggtgtgggaattgggcggggaggagaaagttacaatttgaaataccaatgggttgtgttggctttctcaaattttctgaacctctgctttgcttgaattttaaaggtaagaaacatccattagtgcatcccttacaagcaaacttatgacagttaatcaattgttgagcatgattgagcccctattttagggtctggcactgctctggaatattacagagtttgtgccttcctgtgactttcccaaatatcaaacttcagagaccatgtaaagaaaacctaacggactctttgctgccgatacaatatgtgcttccctaagctcctattattcacagattt

SEQ ID NO: 59231 - DNA, 953 bp, Bovine  19866881821455
aatagcttgacaatgatgccaaatgacagattttatttattagtatttaattgaaagaaaaatgagatctctattaagaaggctttgtaatttgtcagatgctttcaagagccttttaaaacatacttgtgaaaatgaaagtctgtgaaaaagtaaatactataaaaatacgtagattcatataatatacgtttcttcttttaggtagcttctgctgctttttgatatgccctgattaagtttttttccttatataaactattaggaaagtttcattaattaaaattgctcatttttattaaggatattttatgtgctatttaaataaaaaattggctttctttaaatagttaaaattataaatattttactatttgatcatctattagctttttatttgtttttttttaactaaggttggatggtgtgtctattttttttacttattagtctatagaagatgttcttattggaaggtgtgcaaataaatcctactttttcttgagcatcataggaattatttatattaaaataccttcagtaactgtccatttactttatgtctgctttagtgccaattaattgtttctgctttattttttgagctgtgtctaagctaaagaataacattctcatcacttcctaaagatcacgtcaaatatggattccgtgggtcgcatacagatgcgaacgagacgcacgctgaggggccacctagctaaaatctatgctatgcactggggctatgattcaaggtttgtacctcccattttcaaactgcctgcagaattattttgttgactcatcacttgcattttccattagaaacaacctatatctatgaagtgtttgaaaaaaaatgcatctaatatgactgctttgctcttaataaaaatattcattgacactttaaaagtttagaaacctttaatatggaaaagaaatttacctct

SEQ ID NO: 59232 - DNA, 863 bp, Bovine  19866880734030
ttttccaagattctaataattgctggaaaccttgattttcatccttgtcaacaaacgctgccagtagttttccatgaagtgtgaggctcatttaattaatttttgataaaatgtctaccaagacacaagtttgcataatagcagcttgtctgtcagttgttctttcaagtaaaaatggtactgaaaaaaagcagccagttcagctgcaactcaagttgcttttctagaaagaaccatcatacatccatatgcaaagtgccttatgcatacctcccgatccatcattcagcatattaaaaaagtatactcaagggaggagactttcaataagtaataagtttcactgcttcatcaaggacattcttaattgaatttttaaaattctgaatgcactgtgggaaagaatacaaagattattagtacagtttggtgccactgctttgatttgtcctaatacaccagcaatttatccatcacaacttttgcatcattggtgtaaatgtcaacatggtgaaaaggacaaaaaaatcatcctagtcattattatgaaattagttttgttctcacagacttgcttaaaagggccttgagatcaaagcttcatagaccacagtttgaaaatcactgccctatatcaagacttttacaaactgtaaataacataataacttgataattattccattaaacaatgtaaacttgagccacagagaaaaaccttacttttgtgggatcttgtcatcctatcagatttagcagatgcatccttaactcggttatgatattctaaaaggaatgttcgttcatgctcaaagaaatcatctacatcctatgggatcaaaagaaaatatgagcttttttca

SEQ ID NO: 59233 - DNA, 1756 bp, Bovine  19866880971816
tgcttggggctggtgcagtgggatgacccagagggatggtacagggagggaggtgggaggggggttccagatggggaacacatgtacagccgtggcggattcatgttgatgtatggcaaaaccaatacaatattgtaaagtaattagcctccaattaaaataaataaatttataaaagaaagaatttgaacttttataccgtaacaaaaagtgaatttcctgaaaaactcattattttcaaatctaaatctgcctcttcatgattctaaagtataactcatctttttcataaagttaaacacagcccaacaagttaaacattgtttgcagagacttatactcccaaaggttaattattagtacttactctcgtcttatcgaacagttctgaaactttaagaaaaaacctggaagggaaaaatatttcatcataagctatctttgaaataattttctattgcaaatgttcagagaacacaccgcaaaccatattaataataaacattcttatctcattataataataatgatttttttcactgcagatttcatctagttcgacaaaaatctttctttgtataagcacccatataacagattccccgtgatgtactgttatagaaaatcctcccatttcaaggtaacagtctaagccatacattaaaaactttgtcttgggaattccctggtggtccagtggttaagacttcatgctcccaatgcaaggggcccgggtttgatccctggtcagggaactagatcctgcatgcctcaactaaagatcccacatgatgcaagaaagaccccatgtagtgcaactaggatctggtgcagcaaaataaaaagtggggaggggaaacatagaggtagaagcagggttgggaatattctcttgcttctgctaaagtttgaagtgtttcccagctctggtggtctccacatggcatttctccctatgtaggtgcagaccacccagcttacacactgaaatattaccgtgtcatttgcactgagaattgagttcttgatctacctgtactggagtttcagacactggtcaagatgtcccacagacatagccatatttcagtccacatcggcatcagctttgcctcttgcctccgcctagacactagtcaatacccatggtgagttcacatcgtctctgatatctacgggtgccatgtgccccatcccaccccctttccaaacttataacccaaacagtttccatgctggacttcagatttagacatctccttcccataacctctactacgcagacattccacttgatagtatacctttaataggatcttttaggaattctgctaatgagaaaacatgacatgactttaacgtatctgttataatgttttagctttattcagttttgtaacatctgtctttgttattgctataatttaaaatacatataaatattactataattactaaatatattcagttcagttcactcactcagttgtgtccgactctttgtgaccccatgggactgcagcatgccaggcctccctgtctatcgccaactcccggagttttctcaaactcatgtccattgagttggtgatgccatccaaccatacaaaactaattattccttagtattactttgccaacaaaggtccatctagtcaaggctatggttttcccagtggtcatgtatggatgtgacagttggactgtgaagaaagctgagtgctgaagaattgatgcttttgaactgtggttttgg

SEQ ID NO: 59234 - DNA, 1629 bp, Bovine  19866880571279
cttattgttaattcttttctgttttgtgaagtgtttcaatattatctagacctctgtagaatttttaaattatctattgaattatatagttcaaaattaacttaaaatgggaaagcaatgtattgcatgtaagcaaacacttaatctgtatgacatgatttcactgacttctgggaagatgctctaattccaaactaacttttctccaaccagtatgtgaaatccctttaacaagagatcaatcttttatatacctcaaaaagaaatacaacttcaaatgtctctttggagaagtaatatcttgaattcaattcttcttgggtaaaattaaataacaagtcctttgaaggtactaagagcttgaaaaggaaaagtaatggatcagataagctgaagaaaatgaacaaaaatataaacctggtgtgaagaaactctcaatgtgtcccagctctaatttaaaacaaaatctatagctgtatgaaagaaaatgtcttagagttgaagaacagaaagccaggtagaattcacccatagaatgattgtcaatcattgcctgctggaaaatcaccagcagcactgaatagaaattcaatgactatttcatcctcataagaagaaacaaacccagagggtataaggaaaccacccaaatcacagagataattagtagcaaatatggaactaaaaatattctatcatttgccaccattttgttttgcaatatacagtaaaaagttattcatttgctgtttttttaatcaaatcacagcaataaatcataataaaatcacaaaagcaaaatgttataaaatatacttgtcattttaatttcttggacttcaaaatcttaaaatgccacatttgaattctggcctgaaattgcttatcttgcataaaaacctattttgagatgatgggctgaatgcatagcttccccctgtctatttaaatgtgtagtattgattttaaaaatatatagttttgaatctctaaggcttttctggaaatctagaaataaaatagtcagtgacaaagaaattttgagaaataaaggaaataaattgcatgtactaaataatgataaagctttgaatgaaaattgtgtatgtatgatcaatataaagtatcagagacaaaacttatcttctcacctgaaacaacaacaacaaaaaaaatagacatattcaagataacaggcattggaaaataaagggtattattcactgagagaaaaaaaacagaagataagctatagagtatcctaaggagcaggaaggagagatctaggctcttgcagctgctctgaatttaatattgaagctgaaagaccaaacagactgcaggaactgaagttcacagtgtaggtatatatgggagattcttctcaaatggatttctagattcgggcaatcccagtaaaaaatcttagcagaagaatatgatagaacagagagtacggaaatagattcacacagctatagtcaacagatttttgagaatggaccaagaaaattctatggaaactttatcttataagtaaatagtccaggaagagtttgattttgatatactgatgaatggacttcgatctgacctttatactcaataaaatttaaacaaaaaggatcc

SEQ ID NO: 59235 - DNA, 1141 bp, Bovine  19866880693391
tttggtacagtcatttctgattacacagtcaaatagttcacttagcttgtcctaattaaactgttttccttcctacttccatgctttggagacatgctaagttatttctaatgcattcaagtgtttcataaattgtgctgtcattctattacagagataccaatgctacttatcaaaagcacacacagtatattttatattcacttcatactccctaccttgcataagaagtgttacatgttgatagctataatttcatttctgtattcatttttaatattcaggatccactttgttttcagcttttacaacagttttaattaataccaatatggttcattcacagagaatacacgtgaaaatacatgtcataaaggaattaagtgagctacatcatataagtataatgccattccattgagcaagcatattattgtgtctgcattatacattaggaatcattaagtatggaggacagaaagaaaatatacgcaattcctttgcaagattctcagttgttttcaagaaaaatatacctaatctaagcaatattatcatatggaattgatatcatcattgtcaaccaaagggttaagggattgattaacccaacttttaaatcttggtaaaagaatatttgaagctaatctctgaataataaattgcattcctcaaagtgtaaacaagggtataattacccacttactatacattggcagaccatgaagtacttttacacatgcgtgcatgctcagttgctcaatcttgtccaactctttgcaaccccatggactgcagcatgcaggctcttctgtccatgggattttccaggcaagaatactggagtggatttccatttcctcctgtatggcatctacccagggattggaccctcatctcctgtgttggaaggtggattctttaccactgagccatctgggaagcttttacatacattatcccttcatagttccggataataactaattatcagatgaggaatcttaagctcctagaatgatcttacgcaatttacttccctcaatataagggctggatttctattatggcttaagttttaatgttttactcatttgtttaggtttgcatattttcttttactttctttttttctgtgtgt

SEQ ID NO: 59236 - DNA, 1840 bp, Bovine  19866880700042
atctttcccagcatcagggtcttttcaaatgagtcaggtggctcttcacatcaggtggccaaaggattggagtttcagcttcaacatcagtccttccagtggacacccaggactgatctcctttaggatggattggttggatctccttgcagtccaagggactctcaagagtcttctccaacaccacagttcaaaagcatcaattcttcagcactcagctttctttatagtccaactctcacatccatacatgactactggaaaaaccgagggaaatgattttatcttagactaactaatttgggttttatcagtgcctaacccaccctggaacgtcttcactgatggctgagtcagtaaagcgtctgcctgcgatgccagagacgtgggtttgatccttgggtcaggaagatcccctggagaaggaaatggcaatcaactccagtattctttcctggagaattccatggacagaggagcctggtgggctacagtggaatggaaccaccctggaagaaagaatatatgcccaactccactagctttcctgtctcacctacactggtaggcaggagcaaagttaattagtgcttttgaaggtcacaactcagggatatgggtcactaaaaactgagagctaattatatgattatagaacatttctccttcccctacaatttgctacgcatcaattgggatcctgtataataacaggagattgaaagacctgcaagccttagacactgtttaagaagaagaatctagggaaacccgataacaatggagaggatagacaaagacactaggcacattttagcctctgaccccatggctacaaaaaacagtaaaactagcctaactcctagagagcttaacataagacctcacactaatgctccgtttacctcagttacttttactcagtacatcatgtctgagtttcaacaaaaaagtactgggcattctaaaaggcagaaaaaaaaaaatcaatctgaagagacaaatcatgcatcagaaccaggctcaggtatggcagatattttgaaattatcagacttggaacttaaaataaataagattaatgtgttgagaactctaatgaaaaaaggaggcaaaatgtaagcatatatgggcaatgtaaagagagatgtaaaataagaatcaaaaggaaatgtgagaaatcaaaaacactgtaacaaaaatgaagaatgcttttgatgaactcatcagcacactggacatgattgaagaaagagtaagtcatctaaagatatggcaagtggcttccctcgtggctcagtagcaaagaatctgcctgccaatccaggagacacaggtttaatccctgatatgggaaaatcccacagattttttttccagcatctgggaaaacactgcagagcaagcaactaagccaatgtgtcacaactattgagtctctgttctagagcctggaaactgcagctactgagcccatatgccacagctactgaagcccatatgccctagggcccatgctttacagcgatagaagccacagcaatgagaagcccgcgtactgcaacaaagaatagctccctgcttgtcacaactagaaaaaactgcatgcagcaacaaagacctagcacggccatagataaataaataaataaataaagtatgccaagagaaatgtcccaaactgaaaatgtgatcaaattcaatagaatattcaagaactgtgggaaaattacaaaaaatgtaacacgtatgtaataggaatgacggaaggagatgaaagaaaggaaaaaattaatgagtgaagtgataaggctagaattttccaaaagcaatacaaaca

SEQ ID NO: 59237 - DNA, 920 bp, Bovine  19866880853150
agctaataattattggaagattatgcaaataagcttagcacgtgtaaagcagaagtttttggttatttctatattttataagacacactgaaaagtattgcttgaggatatttctaagttcctttatttcttttatacatatatagtcaaatacatagatgttttgccaatacttgtaagaattctaaattaaattatagcaattctaccagcatatgcatgcatacttagtcgttcagttgtgtccgactctttgtgacctcatggatggtagcccaccaggatcctctgtccatgggattctccaggcaagaatatcagagtgggtagctatccccttcttcaggggatcttcatgacacagagatcaaacccaggtctcctgcattgcacgagccaccagctcctgagtcaccaggaagctccaccagtatatagggttccattttaaggaataggaatgatcatcataattcctgttacattttacagtaattatcactattactaaagtgaagagaaagagtaaaaattagcatgtatttccaaaaataaactgttgaatatgtaaagaatttttaacataatgaggatttattccatatgaggagaacctgagggataaagtcttttctcctagcaattcatgaaacattttatcctatgcaaatgtggcttgtgttatgagattcctcttttatgaattgtatttttcagaatttgagactattttgtgactattgtatttggtgtaaattctaggccagatagaaggtctgacacataatatgtatttagttaatattagttttcttcctctgacccttcattgttaccaaacccaggtctggttgctcactactcaaaatccattaaagaagccagattggtggaaaggaaagtttgctttattttggatg

SEQ ID NO: 59238 - DNA, 944 bp, Bovine  19866880874787
tagttaattttagataaatatttcctgcaacttctagtaaaaatatgtctttaaggattttactgttacatataaagatgtcattataacatcatttaaacagactttcttatgaatttagatgtttcacgaccttttcaatgaaatgtttcatattaataccccttcactatcaatgtctcattaaagggaaaatactcccaggagtgtatagaaatcttgaatttatagggtcagaactacaaatgataaatggtagtaataggatagatactataaaatacatcttcaggaaccttgtaattagtggcacagttttcaaaatcaaataatatatttgccaacacaaataattacagacctgggaataattgtgaaattacagaactgttatatatgaatgatgcccaagaatgctatgtatttatcattactttccttttattttctaaagcatttaagcttatctgccaatgggatactacctaagagcccattaccagttcaaaaaattgaatttcaattaatctgcatctctacttttcaccttagccaatacgcctccaggaaacacttctcactgaaaacattaattcatgaaatttggttagatgacacttgatgggctcaaactgacacttcacctccttgagacatgttaattacacatttggtttctataaataaagatagctaaatacaactcttgggactttctcacacatcactggaaaccagggcaagactattgatgaagagaaatgaaatacttaactgtattataggctagggacatgatcagaataatattagttatttctttctcccagctagggatttttgaaaatgattttagtggtacatttttgaatataaattttgtaacctataaactggacatggaacagtagacttgttccaaatcaggaaaggagtacatcaag

SEQ ID NO: 59239 - DNA, 740 bp, Bovine  19866880882332
gtttctgatccagggtttgtgggatccatgcccctacccagagattgaacctacaacccctgcattggaaggttaattcttaactactagactgtcaaggaagttgcaataacctgttttcttcatttattatattccattcataaggtaatagttttctaattttttcttttctaatctaaatcagggcttaatatataaattatgtttaaccaagtttgctttcatttatttgactaattttaattctatactcttaaaaagcatttccatacattgtaacataacctcctgattatatatcaataataaatcaagctgatgaggatctataaatattttaaatggtagccatttagagaataatactggtttacactcaaataaaattttaatgaaaatagaaatgaataaggcaattattagaactgatagtaaaaaatatatcaagtaagcaaaataatcacaataatataaaaaataatggaacttagtaccttcttctctccataatatgttagctactgcagcatgtttgaaagaaaaaggagaaaaagaaaagtgagtaaagtgagaatcaattacatagtaataaaaataactatcaaagaggtcacaatctctaagatagaacatgcatttaagaatagtgaaggtgaattcaacaatctactctaacaaaacattaaaatgctgggagtatgaataatgtttggctcatgtcgtgatagccaattctt

SEQ ID NO: 59240 - DNA, 944 bp, Bovine  19866880890884
gccacctcatgcgaagagttgactcattggaaaagactctgatgctggcagggattggcagcaggaggagaaggggacgacagaggatgagatggctggatggcatcaccgactagatggacgtgagtctgggtgaactctgggagttggtaatggacagggaggcctggcgtgctgcgattcatggggtcgcaaagagtcggacatgactgagcttctgaactgaactgaactgatgctcaaaaccatgaagtatttagtgataataataacaggcttaaaactgggtaataaaggcctatgaatatatttctcaaaaaccatagtaactttattggatgagaataaatcagcattttactcaatatttggaaatatctaatagaatccttttaattaacaatctttctaacctaataatgaatgtgtgctcagtcgcttagtcatgccaaatttttgcaacaccatggacttgaggcctgccaggctcctctgtccatggaattctccaggcaagaatactggtgtggattgccatttcctgctccagggattctttcccacccaggggtcaaacacggatcttttgcattggcaggtggattctttaccactgagccaccaaggaagccgtaatctaataatagaaatgacctaatggaaaatttatataccttggtaacactgagctctacctttatgtcatccttaacttttcattctgtgatcttcctttagcagctgctgcactattgtcaaaaattatggcacattgtaggtattttggaagtcagattttatagttaggggacagaaatcactgacccaataccctgactgcattctaactgaaaacaaaagtgaatttaaggtgaattgtcaggtcacagggatgtaaacaaataatcgcggatatcttttttccttttctgatgccatatcct

SEQ ID NO: 59241 - DNA, 2789 bp, Bovine  19866880903986
acttattgtttgtagattctttgataatggccattctgacagtgtgagttgatcccttattgtagttatgatttccatttctctaattataagcaatattgagcatcttttcatgtgtttgttgcgcatctgtatgttttctttggagaaatatctatttagatctgcctactttttgattggtttgtttgtttgttttggtattgaggtacatgaactacttgtatattttaaagattaatcctttgtcatttgtttcattcacttttattttctcccattccgagagttgtcttttaaacctgtttatagttttctttgctgtgcaaggcttttaactttaattaggtcccatttatttactttggttatatttctattattctaggaggtgaatcataaaggatcttcccagtggtttatgtcaaagagagttcagcctatgttttcctctaagagttttatagcttctggtcttacatttaggtcttcattctgagttaatctttgtgtatggtgttagaaagtattctattttcattttttgcatgtattaataactgtctagttttcccagtaccacttactgaggaggctgtcttttctccattgtatattgcctcctttgtcaaatataaagttctcataggtgcttgggtttatctctgggctttctatcttgttccattgatctgtatttcagtttttgtgccagtaccatactgtcttgatgactataactttgtagtatagtctgaagtcaggaagcttatttcctccagccccactcttctttctcaagatttttttgccatttggagtcttatgtaccgtaagtggaattgttattgtaatttttttaaatgctatagcaaggaaaagcttttccttttctcccatttaagtatttattcatttatttatataactgaattcttaaagtcttatttttatactccttcataactggtaattatcttaatgctcaaattattttgtatttggtaaatgaaagcccctttaaactggttttgtattttttgatatgtttttctcattccttaagggcctctttagttattgaaacaagatatcctgggcttaccttgtatttcacctggtacagtctcagaatagcttttgtccagggaccactggcatatgttagtggatactaaattacttagatttgcaaactgagaccttgtagaaatgcataacatcattaacatatacaattgctatttttctttgtttcagaaaatcaagtggcatatatggatactaatcattttcttttctgtttctaattttagttcctccagtaatccgggtgtatccagagagtcaagcccgagaacctggagttactgcaagtctcaggtgccatgcagaaggcataccaaatcctcagcttagctggctgaagaatggaattgatattacaccaaaactgtccaagcaactcacacttcaaggtgctttttacttgcattttttctcttaaataacaatgcagaaatttcatactaaaatttataacacattttacattctttgaaaaaaagagaaagtgatacttggtgacaatgtatgcaatgaatatgaaaaaaagttatgttagtacctaagacattatatttgaaacaatactttaatacttttaatgttttaaataatagtcttgtcataatgattagttatgtcattatttttataagtaaaatattgtttttcttctaaaacttatcctctgaattatagcagatatgctgaacagaataattgaattccttcattaaatacatttctgaagagacaatttatatgtttaaatcatacattaaaatatgttttacagaatatgtcaataatatagaaattctttaggaaatattttacagcacactttccaaatgaacaaaggaaaaaaaaataaaaatattgctaaatatgtttcacatttgtgttgttttaaagtgatgaagttcttgcattctaatatataaatattctacatgttctaacaatctaatatgcagttgtgattagtcattatacagattatactaaccacacatgtatggtattaaaaaacagataatctttatcatatcaaataatcaaaataatgcaaaattaattgcatatagtttgattatcatagtaagtaataaaatatacagatcttatttccattgtcaagagtagtccagggacagtcattttactggaatatctgttacgtggcattacatcccttattccatgcctttaaattccttctattcatactgttagaaatgaatatattttccttatttctatatgagtatactgctgctgctgctgctgctaagtcgcttcagtcacgtccgactccacgcgaccccatagacagcagcccaccaggctccccgtccctgggattctccaggcaagaacactggacggggactaccattcaacttattagcatacattttaaaataaatcttttaaaaacatttacttatctatttctgaaaatccagaatgacatataagagtatttttgatctttcaaagctgaatcctaacaatgttatgttaatataattaggcaaaataaatttacatgtttccttctctgattgtgtcttagtgtctattatctgagaagaagattgatctgattaacagaaatcaaattgagtaaaagtctaattagcttctgattttgcaatctcttgcccacttgatagcagcaaaccgtattctataaacataatatagcccttgttttagaa

SEQ ID NO: 59242 - DNA, 732 bp, Bovine  19866881200533
aaaaaaaggatataagtctcctgggattgttgcaacaaaattgatctctcactactttgagaaatgaacaacatagaagactatctctgtggctgaataaacattcttttaattactcatttggtatacacacacaaagatgtatgaattaattgaatggttcaagcatcaactatttcttttgcatgaatacaaacacttggtttaagcttattttctacctttaactgatcagaggatggtcacacttaaactaaaaggactcttctcccagcagtggtcatcgagagaaccctacaaaagcctctgagggtcaagaaagcatcattatacaacagtgatagaaatgactattttactatcataaataacatcaaatattgcccaatgttttaaattaaacctccttatattcaatacttcatatattaataaacaaaaataaaacagaaaatgaaggtgaatgagagggacttaaaatttattcacagataaatgtgtttttatttctttaatatatttctggaagttgaataattttccacaatctttactaacacacggcatcttttggggtaatatagtgtaactaacttagttttatatatttagtggcacataaccaaatgcagcaaaagaacagacggtattgaaaaacaggcaattaggaaatatttgactccagtccttcatttagattttatagctgctctgtgtttgaccagagaaagt

SEQ ID NO: 59243 - DNA, 959 bp, Bovine  19866881320730
aattgatataatgaagctaagttgtctttccttgattggtctcactttacctgccttctaccccatcccatcactttcaaaacaatggggacataaaccagtctgtgtttgaagcactgggaggaaaaacaaaacaaacacgggtattcacattaaaacactgactgaactctcaagggttaaaatgtaagaggtttattctcttttatcaagcagtgtctacagacaaagcagccacatggtgtaagctaccaaagaagggtgtatgagacagacttaggttaaatcattaggtcacagccactttatgtggttcatgttcacaaagaagaaaattgctaaaaaggaaagcaggtaagtagaaacataagctaacttctgttgtccattaaatctgcctcccataatgtttccttaagctaagaataaatctactgttatcacatagttcaggatgctatatatacataagatagtacacactataaaatttcaggtttctaagcagttttacacaattaagcttgagtaaaatttgtatttaaaaaagacattattggattaccttcaggaaatggaggtcatttcaacagtacattagcatttttagcaacaataaaacaaaaatataataagtaaaaagattctccaaacaacgtaagcttttactttaagcctggataataatctgcttatttcaataaaccaagttactagttttaatgcacttctactggccttttatttgccctggaaaatgaaagcaatgatttttacttctatgcagtgtctcaaataagaggattagttaggttttgaactttgacacacagtgagagagttgtttaaggattacagtaggagttaagcagaagtcatttgggaaaggttattaaggaacgagtcctttgagggattagtatttaaatagcaaaggcgatagagaagtacatcttttc

SEQ ID NO: 59244 - DNA, 1327 bp, Bovine  19866881493439
ttctttctcaagtacataaaatgtgcttgggtgtatacagtgaatccttatccctcatataaaaaatgtgatagcaatacattgagacacgtacataattctgatcacatccaaataacttggctggttcaaatctctcgaagatttagtatgttattttagataaaattacttgacccaattaatatgctatagaactctattgaaatactgttgaacaatttacatgcttcgcacgactatcccctaatgttaggcttgcatacttcaagtgcattagaggcacaatgtgagaatttcgtgagtgtgatttttaatgaaagattagaaggcctctttaaatccaaggcttcaaagaccaatttcataaatttatttattttaaaatctacagcgttatcttctaagaaatagttagaggtagtttacattactctatttaggtagcctttgcaggatactattgtaatcgcaaagggatgaaagcttaaatttttatcattttataactctttgtaaattaagccatgtttgaatagaaacccactgagaccagaataagtggggaaacatttcgattacctttctgaaatatacaagtggtattgaattcaaaagtttgctcaatggcttcatggggaaatgaattgtgttcgtggtataaaggggctgatgttttaacaattatttttgtggatagaatttgaagaggtaataattggattagaaactgaaggagatgctgggaagggaattgagaaaagccctgaagtctgagctgatcttagaaaggggaacaccagcagagagagaaatatggacatagcaaagagaggtttgttttcccatttctaatctcagtttcaatttcttgattcctgagtattctgcacactatggacaaactgtccctatgtacaagctccattctaatagagtgctaatcatattatttataaagacaaggcaattttcttacatgggaattctaaccctagataatagacattttacatcaaactttctgtagaaaatatgttcccctagacttaaagttgcatcaaaacgagggctagaatcttcacattccaaaacataagacccgtgcatgatgagggcctgagccaccacaggcttccctcgaggctcagatggtaaagaatttgcctgtaatgcagaagacccaggttccaaccctgggttgggaagatcccctggagaagggaatggctacccactccagtcttcttgcctgggaaatcagaaaagcctggcaggctgatgttcatggggctgcaaaaagttcaacatgactaaacaactaaca

SEQ ID NO: 59245 - DNA, 1457 bp, Bovine  19866881564373
gtgactgacccccgactctgctccctgggtctttcacttccggagtctagcctggtcttacacaatgctattgttaaagagaaaaccacaagctttaagatgtcacttgtgctaaagcccaggataataaatctcaatttagtacctgacttattggcagttttaacctacccagaaatgtcaaccagttgtgagttttttggtcaacatcaatgaagtcatctgtcacatggatcctctccatccccctcaacaccctacctacagaagaagatgacttttgcatgataagacctttttattcccttacctgataaaagaagctgtcctggtctaaaaataattctttcttttcttctgctaataactcccttgctccaaacttctccctataaacaccttccactctgtaccgtgccttgtagcacccttctgttttctaggtgggatattgcctaattcatgaattcctgaataaagataattagatcttcaaatttatttggttgaattttgttttttaaacaagtggagacttcaggtgtccaagaaagcacaaagagacatacaagacccactgagtctgaaagtagaaagtaatatcatattatttacctccctttcaaacaaaaccagtcactataccagctcaaatgcaagcaataaagaaaatgtatctatctctttctgagacctgcaaagacactctgcaaagagcatggacataagaaaacatgaataattgtggctacttttccagtcttccacaagtggccttacatatttgtagagaaactattagctaaaatccccttagtaacctgttgctctggggtcttatttaaggaaccaagaagtttttatttacctcatcataatattataaataatttttatataaaatttccagttgcttgcatataatttcactcgtctgctatccctgtgacatattttaacaatttgtaccattaggttttgtttcctctgaagttagtaaactgcaataaactgcattcagtgctaccctaatgcagcagttcattgaatttcagtactagttaacttcgaccaaggtcatcttaaatcagcttctgctttgacaggaatctattagcatcaagaaacatcaagcaattaattactacattttaagtttggttcttttcatttttatctgcttacatgttaaaaaatggaaacacatatcaaactgtacagttatgaattagaatggctttcctagtagatgacttattaatgctgcagtgattaacctttcattaaaacttgatataaaattcttcccccatatatctgtgttttttactcaagtcccaaaggaaaatgaatcaaacaagacagcttggttttgtaaaacacttttgcaacttggagactcagaaaatcttggattttctaaagtctccactatgccatatacattatgatagaag

SEQ ID NO: 59246 - DNA, 1266 bp, Bovine  19866880596968
attccggttattgaggacggcagcatgcacatgcgctctacacgggcaggtgatgtatgaatacggaccctgggctggagaggttggggcggctctgagacaggcaaggcaggggagggctgcaaccctagaagaaaacgcctgccaatctagtaactagagtgggatgagagcaataaagagcatccccagagggccaagtatagctatggagaacctgctggattggaaacaccaacctttcatattgagagtattaaaaaaaatgagcttgtcctaagaggacgtttttcttttcaaaaggggtgtgtgtatgtgggggtgggggcagggtttgtgcagagaggggttaaatatgaaaaaaagaaaaaacaaaaacaaaaaacccccaaagaatcccactagggcaggacctgtatgcaaagtatgcttcaacattatgtttagtattttgttatcagtttcagagaaacgtagaaattcttttctgatatccatacatcacctgctttttaccctgcacattagacatgcgataagatttggctgatcacacaagcatgcaaagtattattattcagcattttaagaaccaatgcaacacctcagaaaaacaagtcaatcaattctgaccaaagtaaacagagaaatgtaattaaaaaaaaaacacaaccaaaaatacccacaatgcattgctttcacaagcagagataatgagctaaaggttaaggtgattggtccaaggtccaagaattgaaaggtgcagtggggatcccagatagtaacaatataatccagagtgggaggagtaactggaagactttaagggttcttttttgaccataagaatattcatggaattctgaaaaatacagttgatacctgaggttctgggcatgacctgttttatttaaatgaataaaatcgagaaggtagcttgattaggaataaaaagatctattttcctgtttagaaaataaatttgtattgaacaacaaaaaaaatacaccattctgtttttaatcctaagtgacactaaactattataatcaagatatagacttcaagccttttgagctattttgtgcgtataatttccccaaaactttattttgggaccaaaagacagaatagcagtagagaaaaaaagataagagtcttttcactaaatcaagatttgggtatttaaaattaaaagatctgtttatcatttattcaactaaacaagctgggaaattttcactactaccttctctgctataataa

SEQ ID NO: 59247 - DNA, 1376 bp, Bovine  19866880648079
ggtgtacaaaaaagccaagaaattgaggaggatgaacgatatggggtctgagtcatctttacttggaggtgtgcacaaagacccaccaatgaggagggctgtaaaacctacagtgcactatgacacagtaaggcaggccactcacctagccctcacatctctgcttctaaagccaccagcaacttatttggaatgttgttactgactggtgtgtactctgctttagaagcttcttttttccaccccccattcagaaatcatttactaaatgtctgttatatgccactgggagtaataagaagagggactaatagttcctgccctcaacaggttgcaacaggttggttgcaataagttgcaacaggttggaagaatgtgtacccaaatataaatctcgtatctgaagatcactcaccaaagttcatctacttcaaatactttggttatttattcctgctggcatttggaaaaatatctaaacatacaggaactgagaacctttcttctctgcaggcaggctcagtgataatcaaggctctgtagacccaggtgggaaacccctaactgctctctctcttgctcatgcacagtatggtaccaaatgactgtcaaaacaagctctcacataaagagcatgagacacttctagctcaatgttaataccatctgaaacattctggaaacaaaaattccagatttcattgcttatttctcatttttatgtcagaaatcctttctttttgttttctccatcaacaagatggaactatccaatgtaaacaagatctatattaaaatacagcaattcagttcagttcagtctctcagtcatgtccgactctttgtgaccccatggactgcagcacgccaggcttccctgtccatcaccaactcctggagcttactcaaactcaagtccattgagtcggtgatgccatccaaccatctcatcctctggcgcccccttctcttccctccttcaatctcttcccagcatcagggtcttttcaaatgagtcagttcttcgcatcaggtggctaaagtattggagtttcagcttccgcatcagtccttccaatgaatattcaggactgatttccttcaggatggactggttggatctccttgcagtccaagggactctcaagagtcttctctaacaccagagttcaaaagcatcaattctgcggcgctcagctttctttatagtccaactctcacatccatacatgaccactgggaaaaaccatagctttgactagacggacttttgttgccaaagtaatgtctttactttttaatatgcagcagcagctcacaataatgaaaagcacaaataaatgacattaaccacgacaaatgatttttaaaaagat

SEQ ID NO: 59248 - DNA, 1317 bp, Bovine  19866880860841
aatgtaacagaatatcaatgcattatataaatcttcatcttggccaccttaagccctcacagtagtggcttaagacagtagccagaactgtcttgtgttcactagcagtgtgttggcatggagttcactcagcatcgcacgaatttggattaacactcctgcagaaaaccaaactaggagctcaagattgtagcgcaagactgcgtctgctgggctcacccctccccaccacccttgctgggctgaggctctcacatgtgccctcccttgtggtttcactgcctggtggtgagcagcagagctagttacccacaatggatttgctttctttgtaggagacggattaaaagaggttaattcaaagatgaaccaagtccaattgaatcaagggagaaagggagaagtaggaagaattaaaccacagttggcttctgaatgatggtaaacaactaacggagctgagcatccttcaccctttgatttttgtacggagggtgtctcatgcagtggaatgattccatagcaacaaataaatcctttgttactgaatatgggggagaaggagtgaagatggcaggttttgatttctgttgtttctcaaggccagcctacaatgtatatttttatataaaaagtggacttttataagttagttgtatcaggactttcttcaaagttgtgacgtttgtgttcctcttcttttttctgcctgtgacaggtttttttcgcatatacttactgaagaataaacagtggcagagcagcctgttcattgctacttagtaaaaatgtaaagggaaagagcctcctttgtaggtccttttctgacagcaaaattgactgtgaggtgtactaatttagtagttagtcatagaccaaagggacatgccattcagggtcctcaattacacagaattaaaacatttttatcagacaagacaaatatgggtgttgaaattggcaggctccagaagccactagaaggggaactactttagaaataaacctttgtttgcagtctatagatgtttaaatcccatgcattccatcatctccatcttctgccattacttacttttaattttatccttttttccctctcaacttgacctttgaccttcaacctcgtgacatctccttttaaagaagtgactaaagatacaatattgtttcatcaagaaatatttaagtaaaacgtaaaactgagccttggatgttctacacactaggaaaattgtttacaaagcgtcttccatttcagtccaaaagatcgtactgtcctgtttgcaaagagatactgcttaccagaaacatggg

SEQ ID NO: 59249 - DNA, 1589 bp, Bovine  19866881144164
aactgtaagagctgagataaaattttaggaaatgaaagttatgtatagaatagttaaattgatcaattctgtacttagcccagaggaacctaaggctctaagaaaattagcagacatttctcaaggttctggctataggtaaattacagagatttttcttatgttaaataaaaagttaaataaatattaagacctgtatccttcatatgatacttaaggtaatggctatcattaaaaaaaaaaaaaaaggatagaaatagcataaacactggaataagctaaatgtggattcaaacccaggctttgccatgtacggctgtgtgactggggacaagtctcttaacttctcaattcctcaatacttttatttgtaaaatgaagatagctacccagtggggtatctacaagaattaactgagagcatgtatacaaaattctttgcttttggctaaaaaaaaagtagtagaaataataaataccttttgtgaaggaagaagaaaaaagggggaaagaatatacagtccacgatataaacctaagagttgagttataactttaaagttcttcaagttctttttcacacaatagcaatatcactaccaatgttggggggtggtggtgtttggttcatattctttttactaaaagctttatataaaatataggctaagtgaaatgaacccaaacagaacacatatattcccagtttttccaaaatgtctcttggttcctcaagagagaaaatgataaaagcatatatttggctgaacttctgttcacagttactgcacaagtaagcgacaggcaaccattccaactcaagaaagctccacccagagtcacaccactcaccttctctagcaggtacatgtttagttcaacagcacccccgccccacttcaatgtctagataacctgaaaaccatttaaatagcaatggctgaaagcctaaaggctgcctactacaggatttctaaagattcatagatctcagaccagcgctcatcattttcactgaccacagtgcccagttttctccactgctgaagtaagcagatggtatgctgacttttctcccttcctcttctgctaggactgcaatgacagggaatccataggacaaaggcatctctctccttttccacaacagaccacaaatcatgctcaactacaaaaacacagaaacccgattcttcctgtgatcttgtccatgtattcttaaaaaactatcttcaacggtgattagatcagtcctagactctctctgaaattattccaccactgagtctcacttaatactcaaaaatttgcttctagatctacttaatatcttacctaacacacacacacaatatgccatagcttttctccttccctttctgccaaactcctcaaactaattcttttctcatctgaacttctaaaggtactttatggacatcatatccacataatttaccatattctatcttggtattttaattattcttttgcatcatatgcattctcctccaacactgcttgaaattactggtcagctgatttttcattcataaattaggaatacattaaatgaaatatcatgtaat

SEQ ID NO: 59250 - DNA, 854 bp, Bovine  19866881261843
aaaactagagtcctatgtccccaagtcttagctaacacctattagtaaaaccctgctcaggcatgcatctaacatctgaggcaacataaaacagcagtctcgtttctgctgtctttacccaggcagggagctcacatgagcacacaaaggagccacgtgaaatttacaggtagtcctactggatttaatactttggcaatggaaacagggctgaatttattacctccctagatcttctataatctgtaggtaaaagtcagaagtaaaatgtttaaagaataaaaaatggcacatctacttaccacagcgccaactccgtaactagcggcaggggcaagggcatggtaggggtcggcggtgtacaccctgccataactgcaaaaagaaatccaatcagggataaagaaaagacagtaatcaaacaaaaaacacaaaaacttaaaagtgtgtttgactgtctaaggatctgtgaggaacctggtcttggaatgctattaggaaactagcagaatggaaaaaaaatctctgtctgctcctaaaggcaggaactgaaaatctctgaagtaggtctataaaacggaaaagaagggcgttggtgatgagggagcgggaaaccggggtcagagccagaagggcctaagaacaagagggagggaagggtctgagctggtgggtttctggtggggcagggtctggggagaaggcctgcagaaaactcagctcagcagcagccctgtggcccaagtgcccttctggaaagggtgcgggcagggaagggggtggcgcaaggcatcggggctcgccctccctcagcacctacccgtcgctgtaagcggctgcagcggcggcagcgg

SEQ ID NO: 59251 - DNA, 1447 bp, Bovine  19866880673720
atatgcccctgctaactggattatggagatagattcagaggtgctgtgcttagtcactcagtcgtgtcagactctttgtgatcccagggactgtagcctgctaggctcctctgtccatggaggttcttcaggtaagaatactggagagggttgcccatgacctcctccagggagattcagagataggaaagggaaacaaagaaaggatgggttatggtgtagacagagtcggacttaattaaagaaaataaaatagacccacagaatttagctttggggggcttcacccttggctttcttgagctcagaataaacacaagtttctatttcttcctcaaagttcaatgttcattaatttgatgtatagaagtgtcaaagaatatttccactggaaaacttctcttggttaccattttgtataacacagcatactgtatattttgattgttttatttgtatgaaaaaactggtcaaaatttgtcttctctcttaaaaagaaatcatgggaaacaccagatcgcgtattgatttttttttttaagatctctttgattttatcatcttaagagaataagtcagaactttttatagatttgaatgtgtgggaatatttgctgctaaataaattctaagttagtagaagagtgatcttcctaaaacaatagctatcatttgttgagcagtttactctgtgcctggcagtgtgataagtacatgtgtatttccatttagtctgtagaataacgctatgcgaagatacatgctccattttacagatgagcaaatggagttttagagaggctaaatgactgatttatccacgttgagaaaaaccagtaagtggttgagcccattttctgctgctctcaacccaaacaggctttctttccattggaggtatttctatggctaaatccaattcagatcagtcccctcatggtagcagcaagtcattatgcttcatcttatccttgtatttacctttattgtacatcaacacttaatccaagaaactggaaaataccaagatcaaaagaaaaaaaaaaaagataacttttctcttcggtattaaataagagaagtgggacttccctggtatccagtggttaagaatctgtgcttccactatcagggaccccagttcaatccctgactggggaactaagatcccacatgctgcatggtgtagcatgcataataaataaataaatcaagaaaagtacttgaatttagactcattatactgttacgacccctaacagggtcttggtctttgcatgctcttggcaaactaattgcaccctcaaattcatctgagaagggtaggtcaaacttttactgtaggtttgaacatgatggattttcttattgttgtaactgaatgaatcttggaggcagaggaaaaattctgcagaaccggctagggaaaaacaagcgattcaacata

SEQ ID NO: 59252 - DNA, 1361 bp, Bovine  19866880695679
gaatctagaaaaatacatgtgtgaggaaggtatttttaatattttccctggacttccctggtagtacattgaataacaatccacctgtcaatgcaagggacatgggtttgaccctggtctgggaaggttcctcatgccacagagcaatgaagcccctttgcgacaactactgaagcccatgcctcctccagtccacacgcctggagccttgccccgcagcaagagaagccaccatggtgagaagcctgcgcaccgcgacgaagagcagcccccacttactacaaccagagaggaagcccgcacacaacagcaaagacccaatgcagccaaaattttaaacaaaaatcaaagcattttgactgttccaactaagagacaggtgccgatagcataaggaagatttgaacgttttggtcattagaaaggtagataagggatattttcttgggttctacaatgtttcataaaacatgtctcataaaaataagattctccttactctctcctccccagatgttaaattattttgagttgttccttgatggcagagttgcaaaagggctgaatgggggcaggtagcagagtgtgggggcagaagggaagaggtggaggcaaaagagaggaaacctgaatagaggcttcagtacaaatatgtttatcaaaactcatcagacagatcactgaagatctgtgtatttcactcaaaaatttttaccttaataataggaaaaaacacctcttgtctttaaaagcaagagccctaattatgaatgaatgaattcagatgtagatttttgtactccaaggcttatgaaattggaccagtccttcagaacttactacacctagagagattaacaaaattcacctttctgagcatgcacagttggagatctgaccaaagtccagcctaactccatctactccattagcctaaaccctacatagctccagtttcctaaatgataaacctgtatagtgctcagagggctgacatatttttaaccccagatttactccacgcttatcagctgcataaaaatgagggcatcacagatgaatcaaatactagttggtagccttgtgctctccattctgctttcaaattttataaactacttcatgctcgcccatagcttgatttcctttacagtgggtcactgacttcaaagactcctgggtaatttgcatgcgcttcagatttatcatgtaatcatgtaaaccactttggagctaatttactgatctcatatgccttccaagaggaataaagcaaaatcacctccacagggtgccttcaaaagcaggatgttttcaaaagaatatctgaaatgaataggaatagagctataccctatgca

SEQ ID NO: 59253 - DNA, 1453 bp, Bovine  19866880732904
gagacatgcccagtctaaatctccaaggtgtgaatgtgaccttattggaaaccgggcctttgcagatacagttaaggatcctgaggtggagatgatgggtttagagtggacccagtgaccagtgcccttctaagaggaaagggaggcgtgaagacgcagggcacacagagaaggcaatgtaagacagaggcgctaaccgaagctctgaacagtgtcagaccaatgagacccaactaactgagccatactcttagagcagcacacaaaactaagccacgtaccttgggacaatttgatcaacctgttattcaatcctccatctccatccacaatgtaaatatctcctgtgtcgtctacatgtaattccgcagggttatcaaactgcagggggttcaaaccagtgccttttttgcctggggttcccaaaacttgaacaagatcaccaaaggaattgtattttttaatagtatgaccatagaatcctataaagacaaatatgcatatttcacaaatataaccactgcacaaacatttacatttttcaagtaagctgagggcaaaaaaattgacaaaattaaacagcaataaaaagtttaaatgctaataattaaatatattatatttgacaagcaacaaagcttcattggttctattcacagattagaatctcatgtactccaaaattaagtagattctaaataaaataaatacaacgaaagtgaactgactcctaaaacagaaggctcatgatgtaaaagtactggtacatgacttttttaatcttatgactttcaataaacatgatttggacaacacaatcaagctacatctatacatataactgaatcactttgctgcacacctgaaacgaacagaacattgttcatcaactatactcaggtgtaaaatttaaaaagaaaaaggaatcataagaaaagaaaatcaagaagaacttgaacaacttatatctgaaaactgttatttcagttactcatgggcacatctccagtttcagtagctcaatgaaaaagttctttataatacagacacatatatctattttcatgctaatttttaaagcttctttttaaattgaagtaacattggcttataacaatactgactttttttaagccacattttctccaagtggaaacaaatacaacatttaatccattagcttttctttcctaaataaggaataaatctttccatagagttaaaattatcttacaagcaaagcataagctggaatattaataaacaagaaaaaaccataaagcggttaacagaaaccaacttgaaggcatatcaagaccaactaaattggtacgcattcaaatgataaactggaaacaatgtgaatcagcttgcattacatcctatcttgacttattattatacttcttttggagactgagctaaactttgtagcagaatgagagcaaaacag

SEQ ID NO: 59254 - DNA, 1549 bp, Bovine  19866880873206
tgcaaagtacatctggaaggagttttccccatcacttttccttagggtcaaaggtagggtgcaaaaggccttaaagtaagagtcagaggaagtttctcagagagctagtttggaaactgtgctgtgaattaactccatatggagacattctaccaagttcaaaatgcactggtctgctctgctcaagtaaacacagattagaaatctatttgtttatattgcaaggattggctttcttttatggcattctgtggtgtcttggaggcaatgcaagaagataattttggcattaaaagattgccaataaactccaaggcattaaaatgatcactcaacttttcccctattgtagttcttactaagagtacagatgctgggatttctctggtggtccagtggttaagaatccgcctgctaatgcaggggacacaggttcaatccctggtccaggaagattccacacgctgaggagcagctattgttcatgaatagcacccatctcgatgagaagcccttgcactgcagcgaagcatagtcccgctcactgcaactagagaaggcccacagcaacaaacactcagagccatcaaaaataaatacaaaaaaaaaaaaaaaaaaaaactattgaaaagaatacagatgcttgagcctactgtcagagtttattgttcaagagatgtggtctaggggccataatttgcattcaaaaaataagttaaaacacaaaaagatacagaaagctgtaaggaagagcaagcatccatattaaccctatttgtacacatagatctggttcactactttcagctgttgtgaagagttccatcctggtacgatcctcatcactgtcaaggggatcaggtatgtcctactggggaaataaagcaccttgagtttgaaactcaagcgaatattattacaaatgagggactaaaaacaggtattttctttttcttcttcaaggagtagtctgtattgtcttctcagcaatatttactaatgcaggtgtggcttcctcatgtctttttatcagaaagcaatctagggtctttcctggtggtccagtggttaagacttcacctttcaatgcaaggggtgcaagttcgatccctggtctgggagctaagatcccacacgtgtcatgaccccccaccccctcaaaaaacactataaaacaggagcaatattgtagcaaatccaataaagacattaatgatggtccacattaaaaagaaaaacttttaaaaaagaagtatttgagaataaaattcggatttcattaggatagttttggtcacaaggtaaaaatgacggtatagaattctgcatgtctgctacagggttattgatcttcttttctgagcatatgccagctgttgtcagttctgtcttttcctccgtggatctgaatggaccccaggccagaacaggctggtttgttttcttcagaccattcatctttggtttggctcgatctcaggattctggggaaaaaaaggctctgatctttcctgttttgtggttttgcttctttggttctttttggata

SEQ ID NO: 59255 - DNA, 1474 bp, Bovine  19866880960575
tccacaggcagagttatttttagtgcatgcaatgactcataaatatgtgattttgaagaaattaatcaatgaatataaactcagcagagcatggaccatttcttttctttctttttttttttcatttcttttctttgtatctacaggtcttcacatagtgcagaccttcccatagtacattataagtaacgtgttagtcgctcagtcatgtctaactctttgcaatcccatggactgtagcctgccaggctcctctgtccatggaattctccaggcaagaatactggagtgggttgccattcccttcttcaagggggtctttccgacccagggatcaaacctgggtctcctgcattgcagccagattctttaccatctaagccaccagggaagcccatatgataaatagctcttcactaaacaactggaggaatgaatatatgtgtattgcgttatacacatgtttgctggctccaatcctgggatgtgtttttctttcccgtcctttttccaccttttgtttctgtggaagatcagagacgttctcttctaaaggagtattactcatgaagagaacttacccagatcgaattggccagaaatgtagccacaagtctgccggacttcctcactgtcccagcccagagggtagagggcgcagccagcaccgatcaacaagcctgcaaagacaaaagacaagaaggctttagcaatgcccttctggagcccaagataaaggtaccagggacaaaagatcaatatcagcaatatgacaaaggaacatagggtctgcttttgggaaagcaccaaccaagctccctttagcgatctaaggtcaatttaaccccaagaacaacttcaactctgcttaaaaggagagagaagaaaaagaacaaccccttgatagacatctcagtctggttccaactttgccttttaaaacattaaaagccttgcaaatcctgtttaggaactacaatccagaagccctttttaaccactcttgtaaaaagccagcccaattccaccatcaatccatgtaaacaagtaattcgagcgccagcaaaagacctcatcggttatgcttcatcattcatcagattttttttccaatttaagtatcaaaacagaatatttcagcatcatcaaattttacccagggcagagacagtacaaagattttcatgcaccacttaggcacattgattgaactagtgaactgggctacggctctcgtgttctcttgagacggtgagaatcatcaagtgttcatgtgtactggaaatactcaagaagacggccgctggttgggatctcagtgcttattgcagcaggtttgctaattaaactgaagccagtgatggatttattttcatgtaagtcaggttatcatggcagcttactctgagccagtctttagtgactcattcagagccactgattagtgagtctttggtgttgcatcaaagcctaa

SEQ ID NO: 59256 - DNA, 1485 bp, Bovine  19866881002467
tgaatcagttatgaaaagtgaaagtgttagttgctcagtcatgtccatgtctgcgattcccatggactgtagcccgtcaggctcctctgtccatagaattctccaggcaagaatactggagtgggtagccattcccttctccaggggatcttcctgacccaggatcgaacctgaatctcccacattgcaggcaggttctttactgtctgagccaccagggaaaccccgaatcagctatatgtgtacttatttccctcccttttgaacctcttctcccctaacaacaacaacaacaaaaaataggatttttgtgagggttttttttttggccatactgcatggcatacaggatcttagtttcctgaccaggcattgaacccttgccctctgcaatggaagctccaagtcttaactactggaccaccactgaagtccctgatattagctcctttgaatatatcattttttaatatacaaaacactctggtacagattttctcgtttaatcttaaaatcttgctgcagccttatgctgtgggtgccgtgggaaacaaaagaagtaaatataatatagggttgtgacctcagggagtttataaattcagggctttggtcactggactctccctcagaaagatgtcattgatattccaacaacagccagcttcagtattgtgttctacagctagatcattttttttttttatcttcacaaaatgaaccttgccagtgatatttgcggttgtatgttgcagtgatgttctctaagattaaagctcaattcagggcttgtagggcttttgtttcggatcctggggggggattgagcaaaataaaaagaaaatatctttgatgcttgtatataattctttaaaaactgtaccaagtgcattcttagagaaagataaaatgtgttttgaaattgaggctagagatggggcagaagaacatgctgtaaaacagtcatctgttttgtcatcagaggctgaatcctgtagaaggctgagacatcttactgccttgaatgttctatgagcaagtttatataatatgtaactgtactgagacatgttattgagacatgttactgcgatagtcatgatctctgagtgaccatttaaaaagccattaattgtgaaaaagccattaattaaaaaggcattaaattacatttcattgcagtgtcatggtgccctgtcacattgatttcaaatggctcagaggacccgtactgagtggccaatgtctgtcttttgcccgggctacgttcctgctcacctgcctccctcttgtccatccttgtggtgaccaagagtcatcttcttggctgggatcatggcccctcatgcttcccgtggataaaggctgtttacaaggtgcctcacgtgcccccagagaaggcaatggcacccccactccagtactcttgcctgggaaatgccatggatggaggagccggtaggctgcagtccatcggtcgcagag

SEQ ID NO: 59257 - DNA, 1936 bp, Bovine  19866881012453
tctgggcccattctactagaccttattacaggacatgattgagtcagaacatgaagtgaagtcgctcattcgtgtccaactctttgtgacccatgaactgtagcccctcaggttcctccatccgtgggattttccaggcaagaatactggagtggattgccatttccttccccaggggatctcccagacccaaaatcacttaaaaaagtaacgagagtcaaggttgagttaccatgctgggcagcagcctagaacagtacagaaaggaggaaatcaatgtgggttccatttctaactctttatttcttgaactgtgattttacttcttggatgccatgccattttcccaatttttagaataatttgtagactaagctgatggtcaatgttagtgtccccagtggtggcaccattcttcagatttgatgcagatttgagggtcacttctcatgattctggactaccatgtttaacctggattcagtggagacatagctttgggtaaactcaggatagacaggaacatacaagttgacacctgtcgaaagcagtcagaaacatggcagaaggtgggccgttctacgggacaagtgatatatagcctttccaggaagccagtgtcatgagaaaaggggcataccttgagtaaggagaccttagagacatcagatgtaagacacagtcctgactggctcttggcgaggacaaatcagttgtaaatcatactttggaaacaattctgaagtttgtatatgagctggtatcgaattacattaaggaattactatccattttgttatacataataattttaatctggctacataaaaaatattattctttgagctatccactgaagaaattagatgtagaaagtaaggatatttgtaatttacattaaaatctctctacataaaatgtgatttattcatctaccatagggtgatacatccacccctgggagaggcaaacattttctgtgaaaagcaagacagtaaatatttcaggcttcatggactattgtgactctgttgcatttactcaattttactgtcctagcacaaaaacagccacatgtgtgctaagtcagttcagtcgcgtctgactttttgcgacccagtggactatatagcctgccaggctcctctgtccaatgcataaatgattgtgcatggctatgtttcagtaaacctttatttacaaaaacaaggggtctatgggtcatcgtttgctgacctctgatctactccatttaaaaatggatgctgggctcattgcaaacagatggttggctatagtataaaacacagcccaacatacggttcctgttcattttgagatccatgataaccggcaagttgttttcccactcagctagtcttttccccagcatatgactcagaaacttcatttgaaaacaaaacaaaagcaattagccaataaagtgaaataacaatgtcagaagaaaatttaactctcagaagactcttacgtcccaaatgaaccaggaacctctggctttggaactgattagcgtgggaccagcttttaaaaataagtgggaaagtctttgggcctttcaccactgggacccagtttactcttttaggtcttcaggacactggtacaactcagcaaatcaatgttttcatacacaaaggctacacgtgcccagtggtctgaaagagtaaacacaggttcccaacgggtctgggacaactactgtcggtggataaaccactgggaaaactggactcgattatcctgaacactgcataggtgaggtcagcacctcttacaaagcgggtacagcttccactggaatagaggtgtctgtctgtctggatgctcataaatgaacgatacttccagaatgatccccacaaactcagattgccatcaagatgactctagacatacagaagtcaagatcaaa

SEQ ID NO: 59258 - DNA, 1277 bp, Bovine  19866881031398
ttcatggttattagtgactattgaaataatttaaaaattatatttcattaattgtattcatttgcttcccagtgaaggattgttgttgttccagttgctaagtcgtgtctgactctttacgaccccatggactgtagcctgccagactcctctgtccatgggattttccaggcaagaatgctggagtgtgttgccatttccttctcccagggaatcttgcgtctcatacaagtctcctgtgttgcaggtgtattctttaccgctgagccatcggggaagccccaatgaagattaaaatgaatgattttctaatgtgagcataagagtgctggtgtctatttaaatttctcactttgttggagtcacaggaatgattctggtttccctttatttggttgttgctgctttacatttctgcctttaactccattcaacagcgttaattttttttcctcttttgtttaaaattacccataggaaaataaaataaaattacccataggaaaataatagttatacatacagccaagctggcaagtgtcaaacccattctcagtcaccacctccccaaagagcccccataaatagtaagacttgagtaaacaagcaattgtatcctcattgtctcagggaatccttcatttcacaggcctcacaaactgcatgggttgccctgtaagatgtcaccagttgacgaggtgtgctttgtctcataattcttctgtatccttcttactaatgatgttttgctagcccccatgcagagcctttgaataactttcccagaaaggaccacccacagggaaaatattaagcctatctggtggacttgaatgcatcccttatgaagtggaatctttatgtaaaatagacactcggggagcaattattattaattgcaggccctttcaacacagcttttgatccttccatgcaccagtgcgcaccactgttgttcaagttggtgacggtggaatagcccaaggatggtttcaaagccattaagaacaaagggactttttgcagaatattcagtttaccaattactgtcacaatcatagcctttgaatgtggctgtgtgtgttcctctcagttaatggattctacttatagtaatgctggcccctgcctctggacagtcttcaagggtacatgttttagctggcctggtgacacgggttagattcccatgtgtacaacttattttgatcaaaaaaccttgtgaatgagagaatcacattactgtttcagattcataagggaatgctacgtggtgc

SEQ ID NO: 59259 - DNA, 731 bp, Bovine  19866881064594
aaaagaccctgatgctgggaaagattgagggcaggaggagaagggggcgacagaggatgaattggttggatggcatcaccgactcaatgaacatgagttcgagcaaactttaggaggtagtgaaggacagggaagcctagtgtgctgcagtccacgaagaagtcgcaaagagtcagacacaacttagtgactgaacaacagcagcaacaaaaggtgaaagaactcaggctgagtcagttgcttgccggtggccatgaagctgttgaggggcagaattcatccctgtctgcccagatcctgctttacaagacaacgcacaaccacagaatcatgtaaacacaagaacagaaggcagcacttgaagctttgttaatagaagggggaaaaaggcattaacattttattttacttacagtcttacagaaacagtttcttctgagatccgaccacatgcaaaatcctgaagcatcccacgtggggaaaactgttgttattctaatcccaggctgcaagtaatgctacaaaaacaatctgccacaacttacaagcttaacaagctaaacagggaaagtatagagaaatgaaaacatgtccctcctccaatattttccaccatcttaaaaactcatcagagtcagatttccagatctgctctaagtagactgcaagaagattatggtaaaaaccacaccacacaaagcatgattgtctgaaattactctgaagtcaat

SEQ ID NO: 59260 - DNA, 807 bp, Bovine  19866881090553
attggatgatgggtattcttctattaggcaacgctgagtaagcatgaaatccttaaaactcctggttcaattggtttccaaattatatattgttcatatttggaaactgaacattctgtttacacatataagtatatttttattctttcaacgcatattgagcaatttaacttgaatatccaaatatcacccttgcttctggcacttctaatcatccacggtgaggactgatgccacccgggaagagcaatacaagattctggccagtaacattctggactttctgaggctttgttgctatggaaaaagtcactctgctctcagatgcttatttcatcctgtgctgaatgccgtttgattgtgtctcattgtccactgaacaggggcttctccactctgtggcttcctgctgggaggagacaattgcactttgcttcctcaattagcccatcattttcacgtattgctagtgtctttcaaatttctttaactgcaccttcttgtcagaatagtattatgacttcctaagctcacatcatcaaattgggagttctcaatggaattcattaaggtctaatttcttgggcagatttaatgataacattgtcatttttatgtaatctgcagggttttagacattagcgagcctcactggaataaaaagctgatcactctgacatgatgaagtcaattggcacacgcttatacctccagttctgactagttgtaatttttttgttattgttgttcaagatgtcccagggcttggtgagcagcatctgatgtattaggaattgtataaaaaat

SEQ ID NO: 59261 - DNA, 1469 bp, Bovine  19866881124404
taggtgattcgtttagttgaacagcagaaactaatgcaacattttaaagcaattatactctaattttaaaaaattaaaaataaaaacttcctttctctgactgcacagtctgatattttccctcctcatggttgcctaaaacaaaagtaacaatccatttctgcaagagaaaaagaattatttttttcagaataagaaatgaatgcagcaggaatgaaggaacatgaacttcgccttccagcaggcctgctggtgcttgccccactaatgataagattctagatctgtcttttggaacactgttctgctcactagaggcacttaatatgtgttagctcacagcacttcacttggattaccaccctccttgtacagttaaggacatgagaacatcggttaatgaatttttatctcacttaaacttttccttaactttcttaaacttgcattgagtcaaaagtggatcagcaaggtataaaactagggatgaaagtaaaaacactaacacgtcaacttcgaataacttcctaataaagaataatgaaaaggctccccagtgtaaatatagaatttgactgtgagtgttggaatggggaatctataaatattttttgcaagcatccaaagaatgacaaacatttgagaattgaattgtattgaattgtctttttgtttaaccttagtcttaaatatgttttcttttgagaagccttgttgtattatgacattagccccagattcttttccatcatttttcaaataaagaaaaattgcttttatgataaaccaactgaatttctccggaactttccagtgcaaagatgttgttactgctacaagaagcacaatctaattggtaagggcacagactttgaaaactaggcaacctggctgtgaatcatagctctgctgcttgttttgtgacttcgggtaagttactttggacaaaatgtctttctgatcctctttcctcatgtgtaaagtggtgttaatactcttatagatttattgtgaagataaaatggcatgtgcggagctgagaaccatgcctgggacatagcaaacaataagcacgagcaatattagagacaaagaaagcttgcaactggagagggccatctcggggtttcactcttcatgcagatgcaggtacaaacgatagtaatctcaaactcagagaaacagtccgataagagattggcagagcttttatcaaacagagctctgaatactgcataggataaacagtgtaccaggaggaagggcaatgactaattcatgtgctgctggcatagacttcacaactggctgaggatgtaagttgcataatagagaatttgattggtctatgtgccaggttcctgggctggagcttctgaacccttgaaatttcctcagtgataagagtgtttttgtttttcatgatggatcccatgatgggtccctagatagtgtcaggatggagagcg

SEQ ID NO: 59262 - DNA, 1085 bp, Bovine  19866881126902
aaaagaccgtgtagggactgagacacagcaaggacttaatctcaataggccatctcagagcttcaaactccaaatcgagaagagcatcctggaccaatatccacagcgggaatgtggagagtgagtccaaatgtcattcttattattttgtctttatggagtcataccttttacctgcacattatacagatctaaaggctctgtgttaaaaactaggttaggatacagaactgaaagtcagagcaatcattatcacacagtcactgagctcattaatcagcaatttgtacaaaacaaacaaaaataacttaaatcaaggcatttcatcagggacttcaatcatgaatgggctgagggggggaacagggagcagtctgacattttattgaaaccggtattctcaacctcagaatgtcgatattttgggatggataattctgggaggctgtcctgtacctggtagggtatttagctgcatccctggcctttccgcccaccagatattagctgtatcgccctggtcatgatgatcaaaaatatctccacatcttgcagactattccctgggagggattacaaactgccttcttctcttgcttgagaaccactgtggtgaagcttgatatggaagtgcatttttgtcttttttttggcaggggggtgagaaggttctcatcagtttcatcatattcttaaaaaggtctatgacctcataaagagtgggaactaattacacaaagcctctcaaattaatagtgtaagcatgcacatctccatctgtagtagtaaaacaaaaacgtgcaccaccatggctaattaaaatggtgtaatttgaaaatttactatgaaatctatatctatccagcgattactttcaacttttgaaaaagcacaaaaactgtatgtggggaagtagctacttcacaaactgctattcccagatggcagggttcttaaaataccgccttcagcaaggactcccacagtctgctgaatgtggctttcaacttccaaaggggttagcgctaaggacaagcaaaaaagaactgacgtccagagagggaattaaaaccagtgttttctag

SEQ ID NO: 59263 - DNA, 2407 bp, Bovine  19866881203669
gaaaccccttttagacagtattcctatgtagaaaagcatcacctttgcacctcatatttatttgtatttgcagctcaactcttttttttttttttttcctccagggacaagctgatatttgctaaagcttttctgggtcgttttccttagcagacactacgttttggtgacaggcttaattcttccagcttcagtttctgagttgtttcacctatgccccacttggcacttccctgagaaggatcaaaatttagtgaacatgttttgtaggtgaagatctggaaaacggaaagtttgcatgctgtgtagaaatgccttagcctgattcaaggtaaacttcgtgatgaactccagaatatggagtactcaggggcttggtctggaagaagtagattctatcccaaaaattgtaggcagaagatctacaaccggattggagagactaggaaagtcattaattccttgattggctgttggtgttcagtcgataagccgtgtctgcctctttgtgaccccgtggatggcagcacgcctggcctccctgtccctcagcatttcccaaagtttccccaagttcatgtccattgaatataaacaggcaaaaagatatgacactgaaagatgagtcggaaggtgtcctctatccatacaggatttttaaaggaaagggatatgtggaatccaattaaagaaacacaatgtctgtggaacccaaataaatacatttgaaacactgaaggatataaactctaagcttaatgtagacagcagaattctgttatgagaagaaaagtaaataaatagatgattttagtctagagatctgggctataagactgtctatttggagagcatggttttgagatccatgttgcctattgactgtcaaaacagaatttcctccacatgttgatgatgataatgagaaaaactaccctgatctgctgcagtcctggagtttatgtctaggctaaaatctgaggttgatattcagtcactcccagtggagaaatataatctcaaccatcacatgtcagcatgaccacaaaattgtttgaggtgatttggttgttttcattagaagacttaaaattacatgtgcgatgttttttaaaatgttatgttttactccagaacagtaaatgtttttgtattaagaaatctgaatgtatatggcatcgtaagtgtttatcatcactgagccctgtgattaaattaaaatgggcaattgactattcagactggtggttttaagttgaaatattaataagttcataaataatattgaaccacttgagataacttaagatccaccatatttaaggtttaatttgttatgtttgtaagaactgctgatgtgtatcgtagaatttgaattctaataattgaggcaatgaaggaaatcaaaggtagtaagtttgtaaatgtagtttaaaatgtttacagagtttaagttaatcaacagatcatagatcacttaaaagacattatcatttgctaaatttcaagagaataaagatattttacaaagtgaatttggaaatttcaggaatatttatttttaagaaaataacttctagggactgttaagacttcaccttccaatgcaggtgtgcagctttgttctctgatcggggaggcaagatcacacatactgcatagccaaaaaaccaaagcataaaacagaaacaacattttaaccaatgcaataaagactttaaaaatggtccacaccaaaaaaaattttttttaaaaagaaagaaaagaatttctaaataatcttaactgagcaaaaactaaccttggagatattaaaagtcacaccctgataatatactgataggattcttcctcaaatggtatattgtttactgaaaagaaaaggcactgaactggataatattttacaccatctcaagcccccgattgaaaaaaagtatatgttgccttttcagacacaagaccaaactggaccacaaagggaaattgagctgaacgctctatcgtcatttcccattcatcctgaactctggggagctcacttacaatacagaataataaattaacgtcagtcacacccatgaggcctctttaatgttacccattgcaaaaatagtttggacagattccatcctttgctttaataggatgagtcttgccattaactcagatttagattagggaaaaaagggctggagctgcccccaagcagcttggactaatcttgcatatcctttaacactttaccacatgccttccttcaccctggagctccctaaaatgtattcatcctcactctccactgtggcctatgaacattaccttaatctgtggcacctgtttaggttatgaggcagaagggcccacaagcttcttttggtgtgtgggttttttaatttttatttaa

SEQ ID NO: 59264 - DNA, 799 bp, Bovine  19866881205459
ggtcttttgaactgactgtgggaaagcggctctcgcagtctgagaggctggggctgtgactcctgagcaactcaaatcttcactttgattttctcttgatcaaagatggcacctcattatcgaaacagagtcaaaggctcctgggaagaattcccccaggagggtacacaatgacccagggagacagcaagataatttgataattacatcccagagtttccttaataatctctaaatccctagatactgagaaacaagccaaaatagggatcactagggtaggagacctgggagaagccacgctttgatcaaggggcaattcaagtcattcacagaattggacaatgaaagctttgccagtctagacaagggaacatccaagcagctctcctttatttccaagtttacgcctctgcactctctaaactcttgtgttctataaatagtcaggaaaggaagttcatccgtgttagagttctcatttaaaaagaattttttcctagcctcctctcaaatctttccaggcttagaggtgaccattatttccctgtcacaagtgtataattttctttgttgtttcattaacaaatatgtaataagtgtgatattgtgcatatacctgttggtttaaacttttgtgtccaggagtcatcagctaacatgttatgaagaaatgcccaagccacggtggcaagtgacattggatgagaaagcttccacagtctagaggcagctaagacaagccttgctattatctgcaaatcaatcaagagcagaaaccaaccatgccaactgcaag

SEQ ID NO: 59265 - DNA, 960 bp, Bovine  19866881231836
tacattgaaggagtggggactcagggctggaagagtgaaacattttctgatgtgaaaacctggaagaatctggtctacaaagggaaggttagggctgggactcagtggagaacttggggggtcatgggccaaagagaggggactctcttgagtgaaagcaaccagaagcaagggctggcagttggaatcactgtttacctccagtttgtgctctagactcaatctctctctgcttccaggctccccatctgtgaaatgaaggaaatagaaactaatttacctcctagggtgtctacacagtgtaatgcattttaaaaaaaatggtttgcatggaataaatggaacaatctgaggatattctgggccagggttaacatcagttaggttgagaattaaagtacatgaggcttgaaatgaaagaatgcaaaacctaaacctccaatgtcccaccccaaaagaaaggatgaaaaggatatctataagaaagaaaactgaaaaccgaaagaagagcccaaggggcatgctaagcctcagaggtgtgatacgtctctataggtcaatgtccggtgtgcactgagaatcttcgggaatgtcggtatttgcaagatcaggaaacgtctataatcgtgggtggtggtggaagaaacacaacagagaaatttatgttagttcgtaaacagaaggagcgagacaggatcagaaagaaagaagagaagcaaaaagggtaaaggaagtggaatatatggaattcagttaaaaaataacccacatcctcccccctgctaccccctccaaaacaaaccctagagtgaaaaaagaaaaaaagaaaactaaactaaaacaaaaaagcctcccctctttcctccccgaccaaatagattgttggaattacacagacagttaagccaaaatggttatctggtggcttcttgcacacacagtcctaagagcagttttaaa

SEQ ID NO: 59266 - DNA, 1193 bp, Bovine  19866881250007
aaatatgattaaaataataaaaatgcaagtgacttcctggccttcggatattactctcagaaaagaaatagcttttataacaatttaaagccacaaaaagggactaaataggcagtttaaaatatactgcatttaccaatgtactatatttcatttaagtctattaaatacaacaatgaactaaatctctgaaatattacagaatcaaacttggttaaaacgagtgtggtgattctcttccatgagttggctgaagagggcgccagagagaaggggagcatcagttgggaaggagacatggcaagcaaccccatttcaagaaaggaggaggaaaagggcgggtccccgattccccagtgctatccgtgcccagtatcttcagcgccaatgaaatgagtgccaactaatggacaattacgaaaattgtggctgctctcctggaatccccagccactgaaggacctagaaagtcctagtctgtattgaagcctgagtgaaaaaccaccgcctggagccccagctacagccagtctgatgtggaatctgcatctggactcctgagaattctgcactgaggtggtcattgccctagcctcttaaaagacacatctcggtgtttttcataattgagtttctagagcccacctatgtggttccagtggcggggtttacagagttccatagtaagaacccattaaatagtacatctaaggtttgaattgatttcacaagtcacacccttctcccacatactgatacatccctaaatttatcttagcatccctacgcagttatctttaataggaaatgccaaacgcctttccagtcattgtgccaacttacattcccaccacttgcaccagcgtgtatgagaattccaattcctacacatacatttatgacatcttccatctttttcttaaaaaaagttttttttttagtgtgtatgtaccttttctaaaatctttattgatttctttacaatattgcttctgttttatgttttggtttttgggacagaaagcagggatcttagctccctggccagggatcaaacccgtaccctctgcattgaaaggtgatgtcctaaccctggatccccaggaaagtcaccattttttcttttatactgttccagtaggtttattttggcatcctccggtgttgatttatgtatgtcgaagccaaagatt

SEQ ID NO: 59267 - DNA, 987 bp, Bovine  19866881399815
ttatgaaaaggaactaacatgggttttaagcaaggaagattcctgatctccccattaaatacatactgcaagtctgtgaaatatgaatcacatctttggtctcctttttaagacttggcttctacggcaaatgcgcttttctacctcagtttcatctccattaccattttacattgcatctgaggcccggctagcaacagtggccagttcttgtctgaatcctgcaaactaggctcataacagacgacacccctagaaaggctgggctcaacccaggagacccaacttctgatgatggctttgcatgagaaaaatcactcttgtctcttgtcattttgtggttagtgggcaaaaaattaatgcttcctccaagggaaattcagatcttgacattagtggaaatgaagagcatactcaagtaaattaatttcatggtggcaaagtaataaacctcgaaaaccccagattggcttggaccttccctgtttaaaatacacagtgacagaatactttgtcaaaaaatgatatatcccctcagagcaagcaaatatttcatatggatatttctggctccatcaaaaattttccccaattcaactctttcataaacttagaccattcatttttacttattaaattatcagtgctaggaaagtttttaacattcactggcattaatgtgagttgaatttgatagactagcatgctattattagtatgattactatattcatttcatagccaacttatgattgttttacgtcatctgtctccaaaagcatattaaagaggaataaatatgtattttcaagacagttgtgcttaaacacaactatagtccaaaagtaatcatatgtaaggcctatctatttacaattgttaacagcatattattaactattaataattaggaaaaataaattgacctcctgcaagtattcaacagtattatgtgactgcacttttacttatactgaaaaatccatt

SEQ ID NO: 59268 - DNA, 1099 bp, Bovine  19866881406792
ccgggtcagggagctaagatcccatgtgccttgtggcaaaaaagaccaaaacgttaaaacagaaggaatattgtaacaaattcaataaagactttaaaaatggtccattaaaaaaaaaaaagctagtcccataaaacccaagacaatttgtattctcctatgtatacggacttcaatcttgcttacaaaagagaacaaacatttttaaatgtggaataaattatacagaataagggcttgtttctctactctgggacatcttgcttcttgcaaagcacaagcataatttcactgcctctcttcagtgagttgagactgatgtcattggttgggaccacagtgatctgaggtcaaagtcttttatatcactgaacaaagaaagagaggagcattttcaggcagctttggatgaaatggtttcaaaaccaatttggtattcccaccctcttctctaaaaacagaagtgaagaaaagtattataattcttatttaacgaaatgcactaaaaaattctcagtaaaaaactttatagccaataaattctgcattcactgtgtgtgaagtaagagttgagtttgtattctcaaattaattaaaaccttttaacttccactaaagctactgtattcttaatcccttgggcaaactggtttaagttgataattcctcctaaatcctaatttttattgaaatttttaatcattatgagttctgcacatagcagcctcaaattaaaaaaaaaaaaatacattcccctgccaacaaggaatttagaaatgatttttctttgtttcttggggatcttttcccaatttgaggcttgccaagacagattaggattaactaaaaggttttctaaagatatatttaatgtccctgacctgggtagagtggcacctggttggtggcacctgtctcataacagtaagggacaaaacaaccccttgtttatcccagtttggcttttgctctgtgcccatgcctggttcattccctggacacatggaaagaaaaaaaaggaaaaggaaaaaaaagatatatttaaaacccaagtacattttctaactggtaatagctggtaatatttctttcacagaag

SEQ ID NO: 59269 - DNA, 1158 bp, Bovine  19866881434683
agaggatttttctttgtaaatattattatctgatatgatttttggtctgaggtccaaagagagattgggtctggtttctgctatttaggctttgtaatcacatcttgattaaagagactccccttaagaaaaatctggaaaagaaaaaaaaaaattgctttctttcctctgggaccacactgtttttgctccttcagatgtaaagagcagggctggctcaataacacatagtccatattccatcaggcctctcacaccaagacgctggatctcacaaacgttgctaccgacctattgtcgcgcctccccaggctcttctctgggctcttccttcctctgctgcaaagtgccagttggctttggtgttccatggccttgctgaatttcttttattcagtttattctgaactgaatttcttgttcggaataaaccactctgtctctgacactaggcagctcttgaaaaggattggccccaaactgcaaaccaagtaacccaggggtcagctattcatcaggatggatggactcattcataattctatgccagtggagagcaattccaattttactgcacagtcactgttgacagctctgcttttgcacctcctatgataaaatgtcacctgacttgggcctcactgtttccgtgtgattattgctttaatctgatgaaaattgcactgcattaatatttaaaatgaaaatcagtgatgactctgtagcagagtgacagaatgctgctgctgaatgctgttgagtttctcattaatattaatttgtagtttgtagagaaatggtttaacaatcattgagctacacacatgtaattcaaatattgatgaactgaaccataagtctataaccatgaaagaaattgctcatgacccgtctgtgtttgattttatggtctttcttaacacttttaaaatttatcatatttcagtaataacatgtactttctctagtaggttggttattaacaaatattttccaatttctgactggcatcaatttgtttggttgccaggaatgatataaagtttcccaatgagatctgtatctgaaggcacaataaccctgatatttatatttaatattatctacattaatcatgatttactgagtatattttaagaaccagggactgaactaaga

SEQ ID NO: 59270 - DNA, 841 bp, Bovine  19866881450490
atgtctgatttcctacttgtacaaaattttgtcaatatttttgctaaaatcaagaaaagtcacccagtattatttctctttcttctaattgtaatatccttatattttaatgtatagtccttcatcttgaacacatttctaatacatgatatcgaacaattttataatatatttatagaaacttccagagtccaaaatgatctaaacagcaggacatctatgttgcacaatgaacatactactaatttttcatcacatattcagtgcaattttgacattatattaatacaatggaacttcatattatcacattgtagcttcaattatataagtcccattatttttaaaaaaagcattcactaaaccgacactttcaaactacaaacatgtaaggaacaagtatgaacagggtacggtcagatctcttaggggtgctgagaggttgagaactataaatcctcaatgattaaatctccttttttaaaaaacaatttttttctaagaaatgtatgtgaatctttaccaactattaataattgggaccaataaatacttacttcactgtggcacttagaagaaagttcagctgtggcattaacaggttgtcaggagctgacagatagcgatcaaactgaacctaaatgaaacagagaaattcaaaacacaaagtgcacatatctgctaacagacctccctagtaatcattcctttttaaggattaaatccttggaaaaaccccatattccaaataacgaggtctttgtgatcaaaatgagttatttcttatatattccaactaaattgactgcaagtgtcaactctttaaggtactcagtatcag

SEQ ID NO: 59271 - DNA, 1253 bp, Bovine  19866881564761
ccaatgaaaacactctctcagagcaaacatatagggaaaatgagattaattgatttaaagtgtctggcacaagataggtattcaagcagattcattttgatatttggcaaaactaatacaattatgtaaagtttaaaaataaaataaaattaaccctatggaaaggggagatgagaggaagaggaagaaaaacatgcagagctcagccaactccatctcttgataccttgatgagtccagtgttacgaaatggggcacaacagatcctaaagaagacttgctcaaagcccagcacttcaaaactgcacacatgcagtcgcgtttatacctcccaaatgcagagaaggaccaaatgtttgagtgccaaagaaagatacccctcctccacacaagactagtaattcagcagtctgcgtgctaagtagcttcagtcgtgtctgactctttccagccccatgggactgtagcctgacaggctcctctgtccatgggattctccaggcaagtcctggagtgggttgccatgaacagcacagagctacagagaagtgtacagcagactggatacagtcaccgcaggaaggcaagcaatctgtcatcagtgaaaagcctaatgacatcccattttagaaaacatttgcccagctggccacttcggagatccagaggtcactcctgccctcagtgtttccagtgtctggctgggcatgagacactagtcattactttccaggaaaccccacgtacagcgtgatgcccagaggccaggaccacagaactggcagcatcaccgcagcgcaggttgcaggtggctgcctgacacctctgtactacccgaaatcctaacctacctgaatccaaaatgcagaagcccatctcaaatctaattcctggctaaaaaaactgtggagccagaaaaagaaaattgagcaattagacttcagtagggaatctggacttagtgatagatcatttcattcatcatcctgggcaagtaaactgctttccgaagctaccaacgggctttcggccaaacccccacttattgcagtctccgcaagaggcagaccggggcatgatgtcaggttttatggtaatgctaagcaaaagtaagataggaaattgggtgatcactaaaccatggggtctagttactggcactgactgcgaacactgtagggggaggtcaaaatgaaagaggtctcaaggagctgattttcttcttattcatgggctctatgtcattaacgtca

SEQ ID NO: 59272 - DNA, 1564 bp, Bovine  19866881877071
tgggttctttaccactagcaccgcctgcacactctactaaaattatttaatggaaaggtttcagacatgctgaagtcagcaggacttcagaagcattcacaccaccagcagtttctgcaaatcttgcactctgggcaagaaagcagttctggtttctcagcagaatctctcagacaagtggtaaaggaaaaaaacaggcaaagaccccatttattagcttttagagactaccattttatttggcttcacagaagtagtctaagaagagcaactgatattttaacatgcaaaagtcccatgacaaattaaaggaaagatcacaataatgatagcctccttgttaaatgtctcaattatacataacaacgatataaaaatttcaaaaggcgatttcacaaatcactgaataaattacaaatagattcggccactctgattttaaaatggacaagtaagaagatgggcaaagaggaggtttctagcaagataatttaagagatattactacacataccacttcctacatccgtgatccagacggatttttcctgtggtgtactggccgcaaatataccatgaggtgtgtcaactgtataattccaggatcgtaggaaatatccatcctctgtgaacactaatacctttgggatgttatcccctctctgaaggtatacaaaaataactgcttagataggatcagttttaaggaagcaatcattattttcacaacgagaaacagaagtcaaagattaaccaagaaatgacgtaatgtttacaaaaccaaacaatattaacctctatcaagctcaaaaccaaaacactaactttaacttaaaaaaacaaactccacaattggagtaacataaacgtacatagatacttagtacagtaacataggaaagctgttttctttgcgttcataacttcaaaaacaaaaatcccagttttacttacctggcctacataaaccaatccgttgagggagtcaactgcaacacaaaatgttgctccagtgaagtattctgaatacttcggccaatccacatccagccggtaaagaatctcctcagctctccaggaaattttaaaagccaagtgcagatgtggtgggagctggggaggaaaagaaaataaggaaactgagagtgtacttacctggtggctcagacggtaaagaatctgtctgcaatgcaggagaccaaggttctctccctggatggggcctggagaatcccatggacggaggagcccagctggctacagtccacgaggtcgcaaagagtcagacacgaccgaacacacacaccacattacaaactttttaacgctaaggggcaacacgtcggcggttcggccgcagatgcagttttgagacgagccagtgagagaaccagctccatctccatcccaagaccacctcccaagaatgctgctacccgagaagccattccctaaccatccagctcacccgagaggcacagaaccgcgaatgcaaaaccagaagcgctaggaagaagccagcgccggctatgcagacccagaatctcgtcatgaccggacggga

SEQ ID NO: 59273 - DNA, 1756 bp, Bovine  19866880550554
catcccttgggtgggtcccacctcaaggcattctgggacttcagtatcccaggccagaagaaaagcggaggaagcgagggccggagaaaatcttgcctcctctatagcacatatgagcgcggggcttgctgtgaggtgaggagctcatgaaaacagtccagactgctgagacgagtgcttgggtgctcagagtttatggagaagttaacacggagcttggtttctattacaaagagcaatcctgcaagggtttgtcagacctgtcagtcagttccaaagactgttccagtcggataacatatgagaggctggagagttgagggcaagagaaaccggtcaaacccactgtctttccatggctgagcgctctcatttcaaggaatccattttgtgcatcttaatggattcccacatggatgccagcattcacttttctacttccaaaatatattagagctctcctataaactcagcctagaaatcaaaatagtctgcaaaattatttttactaagaaaatagactattcataattttgctagcctcaagtgagtaaaaattaattaagaaatgtgtttgagaagtagtgaatctcttctgtgtctgaatataacatactgccagggtaaaagacaaaacctacagctgcaactgtaatacatcaggttgaattgggagcctgaggagctcccatgaatgatgaagtatggaaatttttttttaatgccaggaagactgttattccccaacatcagacaaatcgtattctacctgttttcagaagatatcaagtctcagactccctggcagtcttatttgtttgtttgcttatttgtttaacttttagagctcttcttcgttttttaagcatatatggtagtcccatctcaatgcagttgtttctggttatttgtagaggccgactggacacacacagctcacaaacaaagggaagaaagaatacagccaggtaatgccttccctcagaggcattagaatgccaaggctcagacttgacttgcagttttccaaacttgtctgtttccaatggcaactgtgaaatacacccagcagagtgtttcacatttagattgcttttgtcagtgagttgcataattagattgaatgtgcttaatctctctgagagtttaaaaaaaaacatggaaagatttcatttgatgaaaaggggaaaaaaacagtggaaagtatttgaaactgaagcatttgtggatttctaacatcaatacataatgtcctttcctgctttggtttcagaacttgcagactggaactgctgcctctaaatgaggaggtttatagaaaaatttgttgtggttgcttcttacaacaagagccagaaagagcagaattgcatcatagtgtctttcattatagggttagggaaagaaaacaaagctttctcattcaacagacctttctgaggcatcatgtttggcctgttgggggagatatgcaccagacaaatcccgcctctctgagtttgcaaccaagtaaggagaatttggctcttaaaaataataaataacataacagtgactattgtgtgcatcttaagattgtcagattcctctgtgctgacaggattagagaggacttctgggaagaaaatgtcagttgaacagagcctgaaaagaaaggagcaaatacatgggagcaagaagtacaaaatgccatactgtatctgcccttgtctaaaaagttcactgaaacagtgattaaaatattccgttttgaaaa

SEQ ID NO: 59274 - DNA, 1467 bp, Bovine  19866880647026
ttttgtttaattttctaaaagcttttgtgcctttgtgcattgactatccccataatttttaatgggatatcagaagggaataaacgttagagcacatggctactcagtcatctgccttccattaacttttacagagactttagatatcctccctgcttttcttcagtcttaactaaaaggactggatctactaataaaatatttgggggctccctgccagtcaagtggttaaaactccatgcgtccactgcacgggggctcaattcctatttgaagaactaagatcttacatgccgttcaacatgcaaaaaacaattaaattttaaaaataaatatttgttgtctttatgcctctacttgaaatgatagttaaataatgactatttattacttcagacactggttattggtaaaagctgaataatggggactaaaatacccacattattgtagagttcttgaggtgaatttcaaattaatttctttgttgattcatctcagaatagagaaaaagtcatcataaaagtaacttctgaatgtcactgtctcaaatgtcagctaaagatgtttggttttagaaagaacagtttttctgttacatctgtgaaatcaggcaattgctttagttaccaaaaagctttgtaaagttggtaccaaataaagttggtaaacttatactggatattgtggaagcaaagaacatttgctaatgaaaaacaatggcaatagccattacttcagggcaaaacttaaacaggttctacaacgtaaggaattccatactctctggccaagttaaatttaatatatttttcttttaaaatttagctttatgaactagtcaggaaagacgaaatgctagtattaatactacaaaacttttgatagtttactatcgatgtcttcaagctgacaattctaattaccaaatacagaaaacactgcacaatatagatacattgtgctgttactcgagtaaaatgtcattttctgtgtaatatagtcattttataaaataatattgaaacgtgcatttaacagtatccagggttccatgatattttaattttaatataatctgattaaaattagataaaagaatcttctggagaagcaagttctgggcgagtcccattttgtctgtttactattaccgtaatttacttctccacacaaagcagaaactggagaatctggcattagctgctcattatatgttgggaacaaattcagttcctcaggacacaaaagcacattgatggatatttttattctactcagcagaaattgaagacagcatagttttagctttcaattacttcccaaagaaataccaatgttttaactttgtaatgagaacaagaaaaacagcatgtcccaaagttctttagcagcataattttataggttacaaataatagtatatactattatgaaaaatgtaaaagaaatagcatatctagacat

SEQ ID NO: 59275 - DNA, 3373 bp, Bovine  19866880690434
agacgttttaaagtgattaaaggttagagctcttattcttaacgctttgatcctccacacattgtttggccttggcaacccctgcactcatatactctgatgtacttcagaatttatttcaacacagtctgcccacttctcttcctagatggttattcacattctttcacattatgtttattccatcagcacttattgaatacctcctggggtaatactgaatatgtagagattaataaggcacagactttattctagcatgtagtccattagaggagatggacacagtcaaatattcataaaatacttgtacttttgtctgcatggtaagtgtgcctctaagaaacaactccatcactccatgtttacttcatgaagtgaagactggttcaaggtcaagaaaacgcacatgtgtcaaacaattccagtcagggccctttcatgaacttgatgtgtgaataccaagagagacaagatgtcttctctttttggatttcaaactggggacaactagtagcctctcgtgtagaaagggcaagcttaagaatgagaacaacagaggcagagggaactgttagtaacagataaaaagagaccaagtcactgtgacatcttttgatcactgatattcagccattcctattctagtgttacttccttgaacttctgaaagttcagatgaacacaattatataagaaatactctgagagaccatatataggcattatgtaatcacaggtgtagagtccaacctagaaggataaggctaggctagatggagtcaacagtttcctgaaaggtgtaaatagcatgctttggaaagagtctcagactctcagaatgcaatatccagaaacaccaaccttctacaatatcagttcttgctgctacatactcaaaaactgcattatgttttaatcaccaaatgaaattaaaaacttgatcaccgagtactttgaaaagttttctttatcagaaatagtgcaactttaagtttgatatgtcacaactagaactgtttactaagtgtacaaaatcaggaggtttgtcctgggataatttgggcccaactgaatcctggtagtccaacacaggccagggcttcgattttgccatagctccctgtatgtcaccttcttcagtacttttaaactgacatttcctgagggaatgcactctttgagggtagggatagcgtctgtccatcttgtgtttcattgttacctctgcatttggctcagtgcctgaactgccctgggtgttccacacatttgctgtatgaaattgtctcaaaagtaggaacatcacacatgacagagctgcagtccagaatctttttgtatgttgaagtggattgtaggagaggagaaaatatggaaagtaagaagaaatgtgtctgcaggctcccagtgcagggggcctgggttcaatccctgatctgggaactagatcccacacgctacaactaagagttctcttgctgcaactaaagatcccgcatgtcacaacaaagattgaagatcctgtgtgctgcaactaagatccagcacagacaaataaacattaaaagaagaagaaacgtcccaggtggcagagaggctgggtggcgggtctactggactggtatggatacacctttctactcatcctcttacatacagcgtgtggtgtttggaaagccagcttagagaaaggcgttagctaccccagcagaagtctttcttgaggccaaagtaaatgtgttccattgaattacaaaatgctgggggagctaaggcccggaatgtcataaaggcttcttgtttaatgatttctattctctctctcctttctttaagaaaatacatacgtgtttgtgagtgtgtgtgtatttataattcacagtaagattattggcaggtatttcagcttatctatgatgtcaatttcctgagagagtggtacctataaaaatttgctaaaatcattcatataacacaaaataatacatacacatatatacttagccatttcaaatttgaggaaatgtgatccttgaatgttaattacattttttaaatgtatagacattttaaaacatctaaatgtgcagagaatgaatccctatacatcaatgattatcaactcatggtcaagcttctttcattcgtactcttcctcattcataccctcctcatatttctatggaaaacctagactgtatattgtttattataaatatttccttatagctttcctggtggctcagacagaaagaatatgcctgcaatacaggagagctgggtttgatcctttgcttgggaagatcctcaggagaaggaaatggcaacccactctagtattcttacctggagaattacatggaagaggagcttggtgggtaacaatccatgggatcatgaagaatcagacatgactgagcaactaacactttatgtataagatacagacttttaaaaaacatgaccacaataattatgtcactatatatatgtttgaaatttacttttagtacttgcagttatattcaggaactagaatttgctaacacagttaacttttcacttaggatgctagagcctgatttgaccagttatcataaaggaatgagtcatttgaaattgttaatttatcattccaaaaaatgataaatttatttctttaaatagatgataaacaagtctcctagggtctcattaacagtattaatttgttcagaatacccttaccacttattaatgggaaaaaatggcaccctatatttctgaagtctgatggggagaagatttatctatcaatatgcattcaatgcattactcttggagaattttgcactttgcaacttaaaaagcttttaaaatattttataataatcctgtaagttggttattattagtctcatccttatttcacatgaaaggaacaacagctctccaggtgaagtaccagagggtctgagtcaatctctcaaaaccttgggctcatttcacctaattacactgtttttctatgaatccttccattattgctctcctgcaaagatacccatattttacaagctcaaactttcaggtccttaggtaaagaggaaaggtaaaaatgagaatgtgtctcacatttctaatctgactaggctgctatgttcaacatttgttttttttccttcagcctcatgtgcacacatgcctgatggcacacgcttgtggtgcttgtggtgctggctagtaatattacctgcaatcaaatgaacaccttttcctctctgcagaaaaagtacatctttgagagaaggtttcttgtccaaagttctctaccttcaagctttgacgaaagtcatgttaagtacctgtgggatatatgactttataaagc

SEQ ID NO: 59276 - DNA, 1009 bp, Bovine  19866880730148
acatgctcaaatataactattgagagtgttgcagtaagcacagaaaactattttctaaatcctttcaaaatgccaacactttctgataaatgaaaggtcatgttaattcttttggcatttaaatcagcacctttaacatgattaattgatgtggcatttaatacatgattgtacttgtattctactgttattatatggaaatactgatttgaatccagaagaatattaaacaatcattagttgattcttattgtgctaattcctgcaattaattctgtcctgttattttaatgaaatgaaaaaaaaatttgctcttataaaatgaacctggtttggattttagtttatgcttatgaaaattaaatgtatagaaagtctcataataaagacatgaccatgatactgactatttccaatgtgaaagttatatgaccatttgtgttcaaaggacaaaggctttaaaaaacagtattttattttcaaggaaaaacaactgcagaaagaactttgagtttttttgccatctagagatgattcatgctaatttagaaagtggaaattctcttataatctattttagttcctatcctttacattaggaagaataatgtagatgagtctattgaatagaatgcaagctctgttttgacccagaatctctttgcaaaacttaactcccaataagattggtacgttgtcctccccagggaaattgagttcaattcagttcagtcactcagtcgtgtccatctctttgtccgactccatgaaccacagaatgccaggcctccctgtccatcaccaactcctggagtacacccaaacccctgtccattgagtcagtgataccatccaaatatctcttcctctgtcgtccccttctcctcctgccctcagtctttcccagcatcagagtcttttcaaatgagtcagctctttgcatcaggtggtcaaagtatctggagtttcagcttcaacatcagtccttccaatgaacatccagaactga

SEQ ID NO: 59277 - DNA, 1544 bp, Bovine  19866880737062
cctaccaggctcctccgtccatgggattttctaggcaaaagtactggagtggggtgccattgccttctccgaggctttctccagggggttctaatttctaagcgggcacagagttattaataaagtcccgatcatctggggccaactgctacagaaaatgtggtttagcttcctggactagttggggcaggttgtgggtcagagttctgtttttacatatcttctggctattgtctgtttgtatatttagcctattgaaaccaaaggctggtcagtgatttcactaactagctaaaaaaaccatagtcccaaggcagccatataaagagtagtgagctgaggataggaaaatgagtaaaaataagaagagaaaggccacagaaagaagagaaaattaaaaaaaatggaaagaagggtaaattgcagtttgggaataggtagagataggaaaaagaaaaaaataaaagcaaacaggttaagtcttttttgtgcctctcttctgaaaggaggcacttattgtgtaatgatggatttagtaggtccatgcattttaaatgaatcaagattggggatatcagatacataggataggcaatggaatgaaatatgaaaaccttttgatattttagtaaacacgttttaacagtgaaccagtgtttgtgtaccagggctatttttcaaaactagattaagttatatgtttttcaagtcagccttagagatcaaaatgtctttttatcaagggcatatgggcaagggaacaggcacatctaccatggagcattcaggagtcctttactgttttatgcctcagaccttctgcccaaacttcccacagctcgctctggtcctgccgatctacatcattctctgttcctgagcccatctgtgctatgttggcagctgaaagttcacctactctctctctgtctaatgtaggtttttttttaaaaccccccaaccaaagaatacgtttattaatttcacttttgcacatgaaaagttaccacattacaggtgattctggagtgggggaaactgaacataccctgtgaggggcctcaggtctagggccagagtctggaatgaatgccagggtggctccaacagctactagcagagagaaaggcgatagcacattacacctactcagttctattctctacacagagaagtagaaaacaattattttcattatctacatatttttcattttgaaagcattctttaatttttcaggatatttttttagggaaatctggttctgctttataaatgtcacatgagtcatatggacagtagaacaatggaggaaattagcaataagatatgctatttggttaatcattcacaattgattttttcccccttaatttaccgcatactggtaattagtaatgttgcctttacatacctcataaaatctgggccctaaatttcagggtagttcatggctcaaggggcatttcatttgtgtcctttctatttatgtgtatcagactttgaacacacaggctcagccttgtcatacattttatacaaat

SEQ ID NO: 59278 - DNA, 1559 bp, Bovine  19866880754200
atgtgcctactatttgcaactgctaggctcacgtcagtgcaaaatgatgctatattaaaaacatgttgtttaaaatgatttaacttgctaacatgtcatagaacctcatcaagctcataagaattatatagctcaaaatttaacctagtaattttctgatctgaaatcttccatcttttttaatgtttctcaaaaagatagaaaagctggaaaaaatttcatttgggtgggatgtcaggaagtaagattcaatcaaagactcgagaatgttcaagataaaactgaagattaaactgttccaaaagctattttgagtaaaagataaacctttattttaacattggtaatgggtagtttaaactgccttaaatgataacaaaacaagaggaaaacactttatacaagtctagaaggccatacttaaaactcattaaaatttgcttacagaatcttcatagatttttcaagctttaacaaaatgacaaggcacttctcgaataggccagatgactgaaaatgttattgagatagacctatctcataccttacaacataacactcatgatatatattattttattcttttagaaagtcaagacatacaaaatgattggcaggagttttttatcagaagaaaatctcttagaatgagaaatgaatgcttctttctacactcaggctctctggctacataaaagtatccatggaaacccttacctgttgaaattctaatatgcatacacaaggttattttcttttacattttactgcaacaaaaatgtgaatagaatggaaagcatcaaactattagaaaactctgaagcgttatataatagttctagacaaaaaagcccattatattttaatagtttctacttggcacaagaccaaatgacttttcagaatatgttcatcgatagataaaataaggataattagatgtcccatcatacttatggaaacaaattcacaattttatttttgtttcagaaccagaattgatgcacattcaatttaaataaaatttcaccatttgccagtcaaataaaaagtgtgtttaaaataaggagatccttcctaaagcctcataaagggtagattgcacttgggtaaagtagggaaattgaagaaaaggagctagagagaactgatgcctccagtggagcgatggctatggtatttaggcaaagaacttctgtaattggcaatttcatacaatgaagaaattgtgggaataagtgaaattcacccaaatgagaacaagcaaagactaaatattcaggacttgctctagcaaaggagttcattacagtcacttgtgtcttagtagagactcaaagacaggcacaatgggaaaggtttagagtgaagaaaatggaaggtttttttcggatgctgatggtgggggaaagctggaggtgggctaacaagaagtaggacatcctacacaatgggttaggggtacatattaggctttctcccactgctgctgctgctgctaagttgcttcagtcgtgtccgactctgtgcgaccaatagacggcagcccaccaggcttc

SEQ ID NO: 59279 - DNA, 731 bp, Bovine  19866880802599
acttactgactacttcttgccataagagaaacaacagtttctagtattttggaaagggagacagtggaaaaagaaattacagagagagcatattcatgaattttgtctggttacttcaattttatcatttttttaaacaaaataggcgctttgacagtcacataaccagggaattttattttttcagttgtatgttccaagtatttattcaatcaccctccaaatctcaaaacatctcatccatttcattacaacctattgactgtaattttctattttatgaccacatatatttgtatcctaatggatagaaatccactccaaatcttagtaattttaaagatcacatcaaacttaaagagagaaaagacttacattaaggtagagaggacatggaagacatggacaatgaatcttaaatacatattgggctggccaaatgttcatttggatttctctgtaagatgttatggaaaaacctaaatgaaccttttgcccaacccaataaaatttaaatgttgagcctggtaaaactgatgtatacataagcatttgaaactcatataatgaagcacaatgcaaatataaatcaatattgattgttttgcatataaggcccaagaatccagactgatgttatgcccaaggctaaagacaatgatcactggattctgcaagagcaaattgcttggtagagtgtacaattctgactacagttacaagggtaatag

SEQ ID NO: 59280 - DNA, 1400 bp, Bovine  19866880847798
atggatttgtactatgaatggatataggaagatttgattcacattacaaatccagcactgattgttggaacactgagaaacaatgcaaattgagattataatggttctcaaaggcagaattgctcttaatcaaataaacacttggattgtggttgcttaatggagaagaaaaaaataatttttgaatgttggtgaaggaacaagtaaattgaccacttgagaacattttgaaattaatacactaaataattattgcaatttagtgatcattgtctttaattatttgtctcttcttttgggaatagcattactccctcccctctccctacttcctaccccatataattgtaatgagagcctcttcctaatgaaatccttggctacagggattctgggggcaggtctctgagcccaaacacagtgctaggtcgagagtaagacctgtgactcagccaggaaaaatccttctatgaagtgtcaatagctggggttgtgagagtttgtttcctctttggacacaagtgagtagtggaagcttttggaagcttcaggagcttttagaagccagatctccttctcagaaaagcctgtctgagggaacgtaacctacttgcagagagaggtgaagaagaaacctgaacagtgtgagtcctgacagtgtgagagcccctggaactgctgatcagtcctcaggattgttcagtatgaagaatatgcacttagtaattatttaagctaatatgcatactcagggtttagcatacatcctcttgtatggtagttttttccttttttacatgtgttttctatatgtctacacatcaatgctacaagagttcaacagaaaaaacaatgatcggggttgaatgtggttgagaaaactttcataaactctgaagtcataggtttcaccttgaaggaagtatgatcctgaaataagtagaaaaaataaggaacaccatttcatgtggatgtgaatttgagcagatgtacagagatgaaaacacgtgtcatgtgttctgatggctaattttgtgtatcaagttgactgggtcacagggtgtagagatatctggttagacgtttttctaggcctgtctgtgagagtgcttctggatgctattaacatatgaaatggcctactaagtaaagcaaactgccctccccattgtgggtgggcttcattcaattcactgaaaacctgaatggaacaaagaggctgatgaggggagaaattgctttctctgcccatctttgatctgagatgtctatcttctggaaattataccactgcctctcctggtcctcatcctttggtcttgcaccataactatgtcatcaactctcctgggtctccatcttgccaactgcagatgttgagactttccagcatccataat

SEQ ID NO: 59281 - DNA, 743 bp, Bovine  19866880957945
tgataatttgtcacaactctttatgatagtaatgcagaaaaatatataaaagttggagaactgtttatatcccttgaccccagtcatcttaacatataggaactcttcttagggaaataatgctaaagaggaaaaaaaagctatctgcataaagaagactgcagttttatatataacagtgaacagtggaaacagcctaagaaataaataatacagaaatggtttaggaacctagtcaaatgagtattatgcatccactaaaatcataattgtggtgataatttaaaggatattccttataatcaagctttgttcctacaaattttaggtaaatataggcacctataattttaggtacacagaaagatacatatattactataaaaataagattctgtttaaaatgtatgtgagtgtcaggtgaaatgaaaattaaggtaggaaaaaatagatcctgggccatggttagtatccaacatacctacccattgtcttgtttgatttattgggggtgggtcattgatttggcacaagaaaagatgctcaaaagccctgatttctgacagttaatctgaaataaaatccacattgtctaaaaaactttaagagcacactagctattaaacagctattttcagcatgaaatctaagagatatttttgcttttgagtctctgcaaagaagactctgtgtgaacctagtgaacaggatcctacactttaggggaggggattctccctccc

SEQ ID NO: 59282 - DNA, 1352 bp, Bovine  19866881106438
catgggattttccaggctagagtactggagtgggttgctgttgccttctccataaaagatttatactaaatattaacagtgcgtatctttaaatctcatattatggttatcttttaccttctttaagttaatatttttgggtactataatttttaacaacaagcatgttgtcaaatttatcttcagaaagtaaacattcatttaaaactggaatgtttcttgggtatatgttaagctgtaattttctaattgatttgttttagtattaattatgtacttgaagattatctttagcaaacatgtgatattttaacccttaggtcattttactttgggggtacaaccatatgcttaatatcttgtaacttatgtattaaaaagcaaccaaattctcgtcctctatgtccaataaattataattcaattcagccaattccatctgtaccccacgcccagacgtatcgtgggcccagatttactccaccactggattcttcatcttttttatacttgattttacttatccttttcgatttattctaacatacttcacattatttggggaagtggaaatgtatgggaaacagcaagattttgcctcaatataccagttcttgcaagaaaaaggccactgttgttccgaatgctttatggcgaattaggagccagtagctgctgctcttcattttttccacatggtgtcctgttcatactctgcagcgctgtggaaacaactgtcaaaggcagggcaccccagctgccagggggcagttcatctgccataagaagaatgacaagattctgacttacagttcagttccagatttttcttaaaggcaggagaggggagaatggggggaaacaaagaagagtgaagctaaaaacaggctacggtgtatacttctgttttgaacaaagttatctaccaaacacagtttcacaaataaaaatcctttctttttaagctaaattactgagctgggttttgcacctgtctctcttaattgctgaaaaagacacaaatggagatgacatgactgatggcttttatccattgcatctcctgagttgggacaaaagagccacctcctgtcaaagtcctttgccaagttttagacagattatttaaaaaggtctgacttgaatactgttttgactttgactgcaatgatcacattggccactagacaggagctgtttgtcttaattttgaacactacagagtagcattttcaagagaagtagaagcaatgaaaagagaaaactataaataataattaatatgttttatgaggcaggtactcaagcacacacttagtgcccttttctctgctggtagtacataatttcca

SEQ ID NO: 59283 - DNA, 1253 bp, Bovine  19866881209740
aaaaaaattggaatctgactttagatctaaatttaagtctacagaatatgacaaagaagttaaactgcaccacaaagaagcaatagtcaaatccaggaagtgggtcatactttcttcagtatgccgatggcctgaaaaaaataagatgaatgcgagggagatggggggaaggaggcttaagataaataatagccataaacaacaaatgaactgtcttgtttagatcctaatttaaacaaactataaaaagacattttgaagaaaatcagtgaaagttgaatatggggtgggtattaaataatattagggaattacttattaattttaagcataaaattgccattgtggcaatattagaaaatatccaaaatttttgcaaattaatattaaaatattgagaaataaaatgacatcatatttcatatttattataaactactccagccaaaaagaagaaaaggcagggtaaggtggccaggatgggaaaaagagatgaaacaaataccactgactattggcaatcacaaaagctgtgtaatcaatacaagggcacacaggaccgttgactctacttatttgtacattttgaaattttcacaacaaatttttaaagacagaaaaatcattttccaagtttcatgaggttcttctttactattctgggagataatgagaatattaagagactttagtttataatatgtgtgagaacatgaatgcagaatggatttaattataaatatagcacacatctctgaatttattcataattaaacaagaagtatgtggcaactgagaactttcattatgtgaaaagaaaggaatgctcattattcctttcctgatttatatgttgactacttcagtgacattctataaacatagagcaagtgatggaagaatatatttgctttaataaaaccccattattctgttcgtaaagaagggattgtatattggacttttagccccaagataaaactatccagcatcattaaaattctagcacaatcttcgtttcactgaactcccattaaaatatgcagaggaaaattgtactttcataatccacttatttcatatcaatttccaagagttaatctatatatttgtttgatttctacaagtctgtaggctgagattaatatatgaatctttgattttgatctttgaattcaaagtatatttgaatactttgaatttttagataggatgtcatagtattgactggaaacattgctgatcaactctgg

SEQ ID NO: 59284 - DNA, 1840 bp, Bovine  19866881247806
tagaagataaaagagagtagtaaacaggagttcaagcttttacacgcatcagcacaccaagggttttccgcaccacttttcatgtttctcttatatagacctcagctacttacagataccagccatatggtccatatctctccacatgcttaattttttgatctctttgactttattgtaatataagatgatattggcctttaaatggtttatactacatataagcccaaggttatacacatacactcactggtcatgatcttgattagaagggacaaaccaggagaactgttccatagactatgatgactaagagaccagagagtcaagatctgtgttaaagtaaataagaaaccagaaagccatttaaaaaagatagaaagagttcaggggggattcctttgtaggaaagtagatgggaggagccagaggttaagagagatgttcccccagaagatgaagagcaataagagggtgctgatgatgctgacatatgaccagggaaggattgattgtttccactataagaataactaacatagccacattaactgcattaaattagagacctcaaccaaagaaacagtgatattacaattaaaagccagttattttcctctatgttggcttcattcacattcaatattgctaattatcttgcattccaagtctaagtaaaatcaggcaataagcctaaaagaactcaatgcagtgtttctattttggtaaaattgccttaatagtaaacagaaatgaagttttaaagattagaagtatagttgaaaagaatccatgattccccttccttatgtaattttcagaattatctgtagaattttgtttctagggaattctatactttaaaactgcaggtcagtttgagataaatgatggtgttattcaacatttttcagttaatcatcaacaattcattaaaatctcacaagttcatatctagtaataagaaatcattatgtgggcttgtttctaggcagatactggaactattaggaagtgtttgggaccagtatgctgacttggggtctatagaataaggagatccatggataagcttcagcagctccacagtctccctggaataacatgaaaacttgtgtacttgtgtcccaatgagtttttcctggggattgaatccagaaacactagaggattcccaaactgattcttattttctcagaagtttttgatccactttacagaaaacaacttaccagctctttaaaataaaatgtagatctcaaaaaaatagattatacattggaatatctgaaaatctatcagcaatatattacctccatgcagacatgtttggatcatctgtagtcattttttctaaaaaattatttctctttgatagtcaataaagttttttagcttctacagtcagaaaatgagagatgctgaatttagagcgtttttttttttttttttttataaccactgtttccctttggcaaagacatccgatctgggatctgacatgcctctggatcaaaaccaacatttatgagtttcctttatcctcatcccaagagcattgacccatttagctggaggatggaacatagaggtttggggtggctgtaaataacatctgtatttgtaatgaaaccttgctttgcttgattttggtggttttagaagaattttgtggggaacaggaggagaaatggttgagggaaggggagaaagaaacaaggacaggataaaaggggaaagttaaaatgaatctttattcaatacagaaacatatttgtttctttggtatggggaaagtttgcaaatgctgccttactaatttaccatgggaggatttcca

SEQ ID NO: 59285 - DNA, 3585 bp, Bovine  19866881318475
tctttgtgaccgatagactatagcctgccaggatcctctatccatggaattttccagaaaagaataccaaagcaggtttccattttcttctccagggaaacccagactcttgaatctcctgcattgtcagccagttcttttaccactagggccaccaaattttatgtgtgtgaaagggttggcagatatatgtatgtaaaatattagaataatctacataaaactatagaaattagccaaaatcaaaaattatatatgctagggtgtcagtattttctaagatatactaataatttacacaaatttagcagtagctggattcttttctcattgacatgtgtgtttttacttgaaaattgtgcacctgtcagagttgttaaactctgatgaatctctgtatatgctttccttctgttctattttgactgacttggtacccgtaagaacatgtaggaatgatagatgtggactttgaattgatgaactctgattgctgtgtcagtgaactactttctaattggcctcattctttcaaatcatttactatacacttgtccttggaggttatgtatcttttgggtgtttgtggaagtaatctgattatggtcttttttccatcctattcttttcaggggaaagtatgacagattaagtacactggtgagtttttaaaatatttactaagacacttttaaaattatatcagtatcaactgtcatttttaaaattagctttataaaagcatactatcctttgcttgttactgatcaagtacaacatggtagaaagaggtgaatagaacagtaataagtaaagattgcaaaacaatgaattagaaaataattattgcattctgaaggagatcagccctgggatttctttggaaggaattatgctaaagctgaagctccagtactttggccacctcacgcgaagagttgactcattggaaaagactctgatgctgggagggattgggggcaggaggagaaggggatgacagaggatgagatggctggatggcatcactgactcgatggacatgagtctgagtgaactccgggagttggtgatggacagggaggcctggtgtgctacgattcatggggttgcaaagagtgggacacgactgagcgactgaactgaacttaactgattgcattggtatgtacatttaagctgcttttttcctcctccagcttaaagttactctagtaacttgattagaaatatttctggaagaagcaattgagaaagcctgttgactagctggaactttgacctaagagcaatgattcaggagaaaaaaaaaaaaaaacatgcctgccattccttcagataaatgatagtcttggaaataggatggacataaggtatagggaattgggatagatagaacgaaaccatttcttggagacaggtttgtcagactttgcagtgctgaggctgtgaaaattatacctctgagattatctaaattcagcaaaggtctgccaaagataatttagtgttcattcctctggtgacaaaatgtcagagcttccctgcacactgtggggcttcaaatggttacagatgtgccaacacagcaatcctttcagccttcagtgcttgcataagcctgggacaatggaacttataagtcatatccttcattcttgagctggccctgccactttacttcaggttgcctgaatgatcttttaagtcttatatatgtttttgtaaaaggtggacaagatgacttcttgaggttctttctcttaaaatcaagcctgtctacttgctctcctccactgtgctaattaattcctagtcttaagggctccttggtggctcagacagtaaagaatctgccaggcattcaggagacccggcttcaatccctgggttgggaaaatcctctggagaagggaatggctatttactccagtactcttgcctggagaatttcatggacagaggagcctggtgggctacagcccttggggtcacaaagtgtcagacacaagtgggtgactaacactttcactttatggcttttatgtataggatgttctcctccttccaaactattaggtgcaaatatttcttaaaacacaagaagtatgaaccataatgaaaagactgctaaatgaatgatattaaaacttacaacttctgttcaaagagaaacactaaaaacaaagtgaaaagattcatcttaggctggggaagatccatgagaattaaagacaaactaattttaaaaaaggacaaataaacagtttctggagaaggcaatggcagcccactccagtactcttgcctggagaatcctggagatggagaggcctggtgagctgccgtctatggggtcacacagagtcggacatgactgaagcaacttagaagcagcagcagcagcaaagaaacagtttaccaaatgggaaaccaaacaggaaaccaagaaggtcaacaagcatctgtaaggtgcttaacattgctaatcaaattaaaaacaacagtgagattccaattcatgttataatattgtaaaattgatcaccctaaaagtagatgaggatgtggagaaagttctgtattgatgagaacagattagaggacaatttgatagtagctggtaagtttgaagatgtaggcacagaaatttcacttctaggtctctattttagagaacattttacacctatgcaaaaggatgtttatttagcaaagttataaagactggtataacttttctttaaacatacatgctcagttacttcagtcatgtccaactctttgcaagcctatggactgtagcctgtcaggctcctctgtccatgggattttccaggcaagaatactgtagtgggttgccattcagactaacagaataacccttaaaatgaatgaactagatccaagtgtatcaacatatataattataaaaacaatgaaaaatgaaaaaaggcaatcagaaaattatatatactacatgatcctatttattcaaaatttaaaggctcacaaaatgaattttttaaaaatgtttaacacatgctgttaaactgcatagccatgcatgggaatgatacacagaaactttttagcagtgtttacctttggggagggagaggacaggaggatgggtattagctggaattagagaatctcattaaaaaattaaatgtaaagaaaatgtcaaagttaatatcaaattaattagttgagtatcttactaatatcttgtacaactttctgtacatttaaaagtttcaaatatcttttagatgaatgagagaaatccaagctcagtcttaataaatttcattgattatatatccacagatatctatctagatatatattcatgtcagtatatatctttgtattgtatctgtgacactctatttgataatgtttccttttcccatcaaattaggggaaatttgatcttttaagggatgacattgatttctgtttcttttctgccttttgcagtgactagaactgcactaggcttcttgtatgtatgtaacaaatagctgtcaactgattgcaaaattgcattcactgaactggaaatcctcccatggtaaa

SEQ ID NO: 59286 - DNA, 1543 bp, Bovine  19866881361116
ctccatgtgctgtgtgctatgactgtgttaattatacttaataaacatggaaccagcttctcttttgaataaagaagaataaaatatccactatagaattttttaaaggaataaatgtttaaaatgcatatgaaaacacttgtaaatttgaaaacataaaaccacaaaaccagttagtcattattagatcatctatctggatacatcttacttggacatcctacatttccaggcatacagagacaacagtgaaatatgttttgctgaagaaagaaagattataactagagacaacagtgtagagaaaacagatgcttagtgggataaaaatgcaaatacaatggtgataaatttattttgttatgatcaaatgaatgtatttattcactaagtaaatctgtgtaaaagtcttcagcttcaacattgaaatgtatataccacaaccaaatgtttggctgacatcagaatatatatataaatactatgacaagtttcagtgacaatcgtactactaattttcctaacaagaatccatcactaataaaaaccaagaaacaaaaaagctaaattccttaatggcatatatagcaggtcttcttgaagttaaatccctggcttgtaaagctatcacattctgttccagtgcagatcctatatacatgtatctcacacttgaacttcacctcctcagggaggtctttcctcagcctctcttgttagagggtattttcattccaacaatttctccagcacttggtaatacacactcatgtttttttttgataggaaacagcttttttgagtgtggttaaataatgttttccccatcataagaacaactagcctcttcatcatcttcagagtttcatttctttaaattatatgcttcaaaggtagatggcattactcatagctttatgttgcccctctcaagtcatgacaaggtttttacactttatatgcctaataaacacatgttgattttatttgcaaatccagttcaaaagcacagagtattagagttaaaaaggattcaacagttatcaccaagtttcaaaattttgaaattaatgtctttaggaaggccatgtgtctccagtttaccagcgtccctaccacttttatctaacccaagccatttccacacttggtctctgaggcattcacagctgtcactgtggattgacacctgtgagggactatactccaaaggcctttgctgagttgcctgaaatgacaatggatcaccttagtgacattgccaggttgaatctgaaggtcttatttttttattttattttatctttttgttttccagagctctttcatctcaatatgttacctcctcaagtggcttttaacctaataattcttattcaacctgctttctacctccacactcagttgtaataaaggtcaaggtcaactgattcaaaattaaggatattacagggctatttatgagtgcatagtatacatgataaatcataacataattatttactatatatatatatatagtttaaggtaataacctttcaaa

SEQ ID NO: 59287 - DNA, 2639 bp, Bovine  19866881491166
cagaaagctttgatacaactatgccatgattgccacctggctgacaacaactgcaagatgttatcaattatatgacaactcctcatttcagaaatgtaaaaatatgaattccatcttgaaattcattgggaaagacacagaaatggtcaggaaggtggacatccacagtggaagaggtcttttctgaaggaagtaaggtctagtctgagatgtgaaggatgagcgggaagttgtgaagaaagtgggaaagagggtgccaggcagaaatcactttccatgacattttcctcgtctttgaatttgggagtttagggggattaggatatatgtattattttagttctttattttgtgttggcagcaaatttttgaaaggaaattctatctgtaatcctaatacataacacatataaatgggtagttgcttttatcaagaaggtgggggtggggttgagctctattcatttccctccacttctcccccttgagggggctcccaggaatgtagtttgaaagccactggactagatgataccaagatccctcctacttgtaatactctataatgcagtgtgacaagttcatctggacactatccaaagctcaactcagcttcagaaatttatataactggtaagtgacaaaggctagcagataccctgattccaacatttgcacttttaacctgatattatactgactccaatagtattactggtatttctttgatatgtaaaatggggataacactatattctaaggccattgaacacatgagtttcatctgtgcattagtggtgtttgggtatgcccataaagacattgtgcatcactgcataacaaatagcccctgaattctgtggctttggacaatactaattttatttcttacatgagtttgggaatttaggcaagttttgactccacacgatgcagactgcacttaggctcttccttgatggtctctcctcttttgtctaacggctgagggtgccaagagtgaataattctaagagagagaaagtggaagctttcagtctcttaagggctgggcccagagactaacacagcatcactctcgccatatgctacttgtgtgcacattcacagaagcagccatattcaaggcatgggaacacagatataatcttttgatgagcagagtaccagagagttgaagccatctttaatctgccagagactcagctgaggaagaagtccatcagtgcacaggcagcaaagcacagatggaccgcagtctggatttatattttccccctttgctttcaggggtgtggaaattacagtatgctagaggatttatgaagcaattcacttagtcaaccaagtgtgaagttagttctttatcttggggaaggaaaggctcaatataggactgccacggcctgtttgaggaagtcagtggtctcaggaaaagtggggggccactgtgaataaggtaactatggcaaaggcagaagaagatattgctcagatggaaaaggtttaaggttaaatgttcttttactgcggctcaagaaatgacttcattgtcaaatatggagctcttgggatagaggaaagggatactatctttaagtgtcttctttaagagatggggctgtggtaacctatgagaaaagatgactggttatgtaaatactcatgattggcacgggaagaaaggagagggtagaaagaatgtaaagtggaagaaggtcaaatagaacaaatgagatggtaacagctattaaacgaatggagagaaactacctgaagcttgaaaggaagaggaaaaatagtggatttcatttcaggaattaatacaaacaagttgtggattttggaaagcatatggggaaacgtgaaggtagaattgagtgtaatgtagcaagaaactcagaagggagctcttgcagtcaaagggaaacagtggaacgtggctttgtgaatagaagagaacaggaagatgggaaaaaagtgtagaagagctcacagatgaaaagaccagaacaaatgacaccaagagacccaaggctgacagagcaaagccctagaagtaggaacacgaagtaggaacagttggaggaggtggaagaatctgacagctgaggtgaacgagagggttaaagagaagactgcaattattgtcaatgccactatggttgtctttatcaatgtggttactggtattgttgttatttcttcgtaatttcctagaggagttaggaaaccatttcaggaaaccatttcaaacctagaggagtttgaaaccatttcaaatggtttccgctctttaaactataatcttttttttttaactctaattttattctcagccagtaacagtaatgcctattctattgagaagggtgaggcaatgatatgaactccaccaacttctgtcaagtttacatcaaattgtcaatgtatctagtaatcatcttttctttttttaataatttttaaatgtcccttctttttcaaggtacccttggtgccactccctccaatctgttgtaggagctctttaattatccatttttttccccacgtatacaacaccttccttctttctggggagaagcattttcctgtctctcctgggcgaaaatatcttgttccttattttctataac

SEQ ID NO: 59288 - DNA, 1527 bp, Bovine  19866881564992
aaaacaacatttattctttagagtcactactggcagcacaggtcattctgaaacatgtttactaaacttacctgtgaatggcatatccttgcttattcttcatttaattcagtttacagtgccataacctgcacaggttttctatgacacaggttggaagaacccacaaaacagtgtagaaaactggaacttttagaaatcagataaacctcctaaagcaataaagctagttagtggtaaaactatgaattcaaaatgggcctgtctgaatatgagacactttctgtcaactagaatgggcttcttttatgttacagacttagatttatgcagctttgaagaggattagcacagatattttctttcccaagcaccaggtccttcccaaattaaaacaactaccagatctcagctatagcagcattctaataactgatttcttttcacaccctgaaaggagaatgccaacctatcatgattctagaaacaaataatatctcatatatgaaattgagctgtaatagtcaaaagatggtgtgaagtgttggatagtccttacaccacggtagatcaatagtagaaaataacagagactttccaatattagccaatacttattttggtatatgatgttcttgttgactcaagacctacatttgaaaattctgagtcttctcattttcaactttcttcatggagaaatatcaaggaaatattatttccctttaaatttatcctttggaatctacaggataatctagctaaaatgtgagaaataaaaattcagtgacatgttaaatatgaccattgtttgagatgtgttacattcagataaacttaaaacttttcctctaataaaagaaaatatttgtcattttaattttgacaagtttatgcctgaactattatactctacttgcttcaagtaattctttaaacattatgttgtgtttttaaatgattgttaaaagcaggctttataatagtatgtaaatcacttcaaaacactgatacaaagaattgtcaagaaatttgttttttgaaacatttttgtgtctaaattatttttccttgaaacaagttcaaaactaggaatgtttattcatctgtcttgtgtacactgggcttagaaatcatattgtttcagggtttaacatgttaatattccatatatccagagaccaattacttagtaacatcaatcatccagggtcccccaaaacagaaagatcccagaccagctaaactatataataccaaatatgttcatttattttaggaggagggtctaatctgagacatactcagagcctatttgtattttagatagaattttattgtactccatagtgtcatttactaactgagttagatggagataggaaatttttaaagagaggagagttatagaggcagggtaggttcaacatctttggtatattcttttagttgctacacatataattgtagccagagtaagagtcaaggccaaaggttgacacttgtatttggtataaaggtgcaagt

SEQ ID NO: 59289 - DNA, 3418 bp, Bovine  19866881378891
gtaatggcaatccactccagtactcttgcctggaaaatcccatggactgaggagaatggtacacaacagtccatggggtcgcaaagagtcggatacgactgagcgacttcactctctcactctctgccataatcaaatgagatttttagggtcttgaaataaaggtgaatatattttgcttgtgcagcaggttaagtagttgtggtcaaaggacagaaggctaggttacaactgttgtcacaacattttgtaccccacctcaacaagaggtagagtcaccccttggattggagttggctatgtactatcaaaaatatgatttgacccatagtgtagtagaaatgaagttatgtgagttctgaacctggcctgaagagcccttgggacttccttttgtttcttgggaccatagaatgacatgtgaacaaacacgagagcctcctctaggattagataccatgaggaatacagatattcatttatgctgagtaatgtcaccacctcgatcatcttagctgcagactgatgaatagaattacctagtttagtctggccatgttcaaaggatgagatcaaatcactcttcagtttcaatttttgacaaagctctccatcttactcagaataggatagaagactgacatgatctggtcccctgctatactgccaacttatgtttttctactgattattcttgtccctttactgttctctttggcttcattgattactcctcaaacaggccagacaaccaagcctatactatagctatacctccacccacttctccccagtaggccattcagcaccctcatctgataaaggcttttgctttaatatcaccttcttattgtggacaacagtgataaattttacttaaaactgcaccccttttcagtgtccctttctactccacttttttttttttcctttttccctcactgcacttgtgactttctaagacaatatgaaatttatatattgttttagatttatgttttatatattgtttatgatttatgttttcaccagggcagagatttttgtttgtttcttgaaagcatttcatacagccaggacaatataaagtgctcagtatatgtttgtgatgaaaacttatataaaagtgtaccgttatctatatctatatttttatatatatttgtattattttttatttagtattctattctaggggcttccctggtggctcaggcagtaaagaatctgcctgcaatgcgggatacctggatttgagcccttggttagaaagataccctggagaagggcatggcaacctgctccagtattcttgcctggaaaatccccatggacagaggaacctggagggctacagtctctggggttgcaaagagtcagacatgactgagtgactaaacacacattatatactagaaattttgctttaaaatattctttcagtattttaatgggcataacactaagcattcagtggttattggagttaatctttgtactattagatataatgtgtaaatgataatcttttcaatgagtttgtgttttagaataaatccagtaaggaaatatgatggttcagagaatatgaacattttaaagtcacatttttttctaaatgcacatatgattaatgatcaatactaatctctttgtaaaaagtgagataggaaatatgtgaccaaatgacaagtgactctgtgcctgttttataatttctctataaaatgataaaacagtacaatcttgtatatatatttatgatgtaatatatacacatatttgacattaaagtgtaggcatacatttttccctgaacttgtatatattatagggcagaattgtgattaaattctgaaatctccactacattgtagcagttatatctatatgtaattcaatgttccataaaataaggagctaggatacagttgagattctgcatttcagtaatattttatatgaatgtatggataaggcaatggcaacccactccagtattttagcctggaaaatcccaaggatggaggagcctggtaggctgcagtccatggagtcgttgagagtcagacaagactgagcgacttcactttcacttttcaatttcatgcattggagaaggaaatggcaacccactccagtgttcttgcctgaagaatcccagggactggggggacctggtgggctgccgtctatggggtcacacagagtcagacatgactgaagcgacttagcagcagcagcatacatatgtaaggtaaaaatttgcccagagtttaaagttaatagcagtattagtaaatttttaaaatattaaatgattgtatagtgactatgtctttctctacaaattgcattgattatattttgtctagggacaaatgatgaattgaatcatgaactttttctttagtttattaatcaaaatattaaaatatttcctgggagatctgacaatatagaaaatgtagatttttcttaactgcaagactattaaaagataaagatgaaaaaaaattcatgtgtatcctacaataggctaaacatgaaaaaaattttgttgttctaattcacagtttttgatgatgtacattttctagacatcttcctttttacacaaatcaaacaattttgttcatcttgacctgtctcgtaatttttgaggcaatgctggaaggtgtttatgtgatagagctaattttccctgatgatttgatttcacattgatttcctccttcaaaagctccttttgtaacttttgcctgaaacatcaaattagcaactcattacttgttttcttgttcagtgctggctctgggcaaaattgttagttctcaaagaggtgtctgagagcctcctcacctctcttttctatacacatttcctccttgtaagaaatctcttcctcagattctctgaaaatgttttcaaaaaaattatttagcttgagtgtaaattattataattattttcctcctttaatataaactattttacattctgttctaatttgtttttggaaggttctattgcctcaaacaaacaaaagcccacatttttaagtaggaagaattcagtgatcctaatataagatagagcttacatattattccttctccataaacctagatttacagatcagtgttttttagataggagtttaaatgtagcttgcataagtcatctataaataagttcataaagggaaaaaaaaaatctttctgccttggtatgccctgtagcacctaacacaatgtaggtatatatcatgatcccaatagacacatcagttcagttcagttactcagttgtgtacaactctttgcgactccatgaatcacagcacgccaggcctccctgtccatcaccaactcttgggagttcgctcaaactaagtccattgagtcgggggatgcca

SEQ ID NO: 59290 - DNA, 1168 bp, Bovine  19866881720766
aatttttgttggaggaatataaattgtgagttctaaaaagttaaaaccatattactttgatccaggaagctaaatatatccaatggcatattgaccaggctaaagttaaagaatttgcatcaatatcaaagtctaagaacatttaaaaagagcaataatatcataatcttaataataatcataaaataaacctagtaaacacaatagctatggtatttcatctttaaaagttggtactttttccccaaatttattgttttagtgatcctgatcaaaattatgcagatttttctgtttaagcattcctttagtatgttatgttttattttatgatatctttcagtgtttttttgctattactttttatacatatatataattttggcactaaagggatccatgttgacttggaaaactatcaccaaaattttttgcaatgtagtatatattacaaactgtttgtcttattgacgttttagctttcattctattctattattactgtcatttgaattctatctttgtcaagtgacagtatcatttataaattctactcatcctttcaagaaccagtttcttcagtattgcttaatatcaccatatgcatatttttctctcagatttttaaattatttcacttggaattctttgtatatagctttgcattttgaataactctattacaactgaacaactgaatgacatttatgagcttatgacaatttttacaacctaccttattagaataatcactgggaaaccttttcattggccaataacaaatttatttcattacaattataatacagctaacctatatttaatgcacttgaaaagcccattccctgtttatttgatatgtctgctataattaattctaacaagtaattatcagggtaaacatgccgatttctatctaacagtaaacaaatttgttgttgtccctgtagctcttcttagtgcagcatcttgaaagctactccatcttctttgacatgggttgatccagactgactttctaataatgatctaataatttatgactagctgtctccaagttagaggactataattctattccacaagcatttctatatagttcaaggagatggcagtgccaagaaaaaaaagcaccttctcgatcctacaatcataaaagcaatcaatt

SEQ ID NO: 59291 - DNA, 1345 bp, Bovine  19866880628510
tggtaggtccataccatttctgtcctttattgtgtccatctctgcataaaatgttcccttggtatctctaattttcttgaagtgatttctcgtctttcccattctattgttttcctctatttctttgcaatgatcactgaaggaggctttcttatctctccttgctattctttggaactctgcattcaaataagtatatctttccttttctcctttgcctttcacttctcttcttttctcagctatttgtaaggcctcctcagacagccattttgcctttttgcatttctttttcttgggcatggtcttgatcactgcttcctgtacaatgtcacaaatctccatccatagttctttaggcactctgtctatcagatctaatcccttgaatctatttgtcactttcactgtataatcataatggatttgatttaggtcatgcctgaatggtgtagtggttttccctgctttcttcaatttaagtctgaatttggcaataaggagttcacagtcagctcctggtcttattgtccctttattctatattttgctgattttcagccaaaaatgtctatcaaatttgaacttttctatttacatggtgtgtctttttctacccttttactttataacattttatatctttatacatgaggtggatatcttataagctaaataacaatctctgccttttaatttttatgattagaccatctacatgtgatataattacttatattgttggattatgatctactatctcttccttcagttctttgtttgccgttttctatttatctctcctttggatttatcgagtattttctataaatccttatttttttcccccaataccactgacagaggctttttcatattaccaactctagttcacagtgagcactcatggaataaaggttacaggtgtatgcaaactgtatttttgtccaggatccccggggttccatattttcaccttgtcatccatatcagtccttagaattctctttaacatattacctggttttaaaatttatatatatggggagggaggagggaggagggttcaggaaagggagcacatgtatacctgtgatggattcattttgatatttggcaaaactaatacaattatgtaaagtttaaaaataaaataaaaataaataaaataaaataaaatgtatttatatggcgcctagcctctctttaatccagtgctcttccagatgtgatccagtatttgcatcttatctccccttggaagatcctttatttccttagatttcaggctgtttggttgttcttcaacctctattctctaataaattcaagaaaatttatgatt

SEQ ID NO: 59292 - DNA, 1018 bp, Bovine  19866880932819
tgctaattttggaagaaaattgaaactgcttgctcaaatatgtatttatgggaaaatagttcatgttaactaccaaagacactgaattgcagataacttgataagaagccattattagggagtaaataatgattctattaaaaattgatgaatatagggtaatctaaatatatttacagtgttaacaatctgaaatgcaggactttcagaaacacttacttgaataagacttcccaagtaaagagacattcaaaaaatcatagatgtttcattattaatgtggacacctccccactcgtatgggatgtgaagtgcagagaagtttaaggaaagccttcactggcaaaggaaagaagaatgaggcagcctagcagcataaagggcaccccaactttatgctgacatgctggggaaaaaattcctacccacaaagggaaaacaaagccccaaagggagatgaagttggaagaaggggccaaagtaagaggatgccagtgctcagttctgggccttttgcacctgcacgtgtgctgtgaggcccctttacttctgccatctctccctgcccacctgctcaggcccgccccctacagacaccctgctcttgagagaaaaccctagctcacgctcgctacagtggaaagactaatcccagctccctgagcctcctgggaatggctggcagtgagggggagtggtggggagacagataaaagaggaaagtggacagtgcgactgttaatagaggtgacaccagtgcattcaggtaaaggcgtctggtgcaactgggagaagttggggcaagaagttttccctctcttgctgcatcttgctggggctgtgcctggtaaccaccactctttcaagaatgtcacattgcaaacaggtgccaatgttcttgctacactaacgagctaagtgacgcagtggacaaagcaaggatgctgttcctggctcaatcgctctttcaggacgatgatttgccgcatcaacttaccttgccaggcacgaagcatca

SEQ ID NO: 59293 - DNA, 1276 bp, Bovine  19866881070663
tgtggaggtctttggcataagacaagctggtatgaacactttaaatgtttaagtgtcatgcaagacaatgagaaattgaagaactattccagtttaaagcagaccaaagagacatgacaactaaacctaatccatgattttagtttggatacttgatttaaaaaaattgaaatgaaggaaaatattggcaacatttgagtatagggcttatattaaaatgacagtgaaattacagaaattaaaatattaagtgaaattttctaagtttgataatttttacttttttgtataaaagaatatcctttttcttgggggatatatgctgtagtggaagagtaaatacatgtgtgtgcatgtgcagaccaatgagataaaatgttaatatttggtgaatctaggaaaacattggtagaaataaatttatcattaaaatttttatatcttagaacttgttttaaatataaaaatgctaaaagcaaaccaaataaaaccaaaacatagtactcttcttgcaaaagaaaatagatctatatgtcagatttgttctagtatctgatcagtccatagaacattttttatatttttggatcctcatagtatctactatctttataacacaagcttgattagagtatgttttgtcttgttttccaatgtgtgcatcttatttttcacaatcggataggctactataggatatgttctagtctctgtctgatttatatattccctttgcagtaaggaaggttttgagcacaaagaatttagtgaataattcttgaatttggtaagtttgcatgaattttatagcttggccaaatgataactttgtctgttgcagtctgggagtatctgttatcatttgtactaaagttttacttcctaagtaattaagacagtcatttattccttctcctttttaaatgcttctaagatttggagaaactcaaagggagttttgccaggatgaagaagtattctagagcacatgaagaggtcactattttttttttttttatataaagtaggtcattctctctgtactttcatccctaggcccagttagagattcaaaagtggaaccttactgagttgttctaactgaaagagcatgaacaaagcactaaatattagtgaagctcaaaaaatttcaatagaggaacctcttttatttttaactgtcaaaggacctagtaacatttaactaatgttttatttttatggaatgtctaccaagaatattggaggggcattcagaagggtttcttgtattggg

SEQ ID NO: 59294 - DNA, 1245 bp, Bovine  19866881168243
aaaaatttatgaggagcttgttttatccttctcattattaaaataatctgagtactcacatggtcatttaaacaattctgtgcctgtataaaacctagcacaaaagtattgtctttattcttagataatttaaccaatttgagggtctcacacactgaacagagctgaaaactgtagtgttaatggttactgaagtctacaataaatcactgataaagctggaatttgagctgttggcttccagacattgggtcctctgggaatcatggtatggaataccatcgctaccttgcctcccacactttaaaggctagttactgacttggaaaaaaatgagccagaaagtaaagattacatatgagacacatctctgtaagattgtaatatgaactgtttggtaattgtgcatatatagagagatcaatcagttgcacagtggttcagaaattttaagaaatcatgtctcaaagaataggaaagtcctattttaagattttcaaattcttttaagtttaaaatgttggttttttccaaattctttgaatgtagggaaattactacacagatattggatagttgtgtgatctgtgcatgatggaaaaacaatttggttttatagccaaagaatatagtttaggttacaaattaatccaagctgtagtgaaagaaccttatacttaagaatcaggggacttgacttcaagtttgagctttgccactagttaattgccttatgtcattgaacaatatataacctctctagactacagtttttctccctgtaaaaatacattttggatcactctaaattccttttatcttgctaaattctttccttgccaaattcctgttcatcccagagactctataattcttttaattccaggatttgcttccttttttaacctctccctaggtctaccatcgtgagttcccaggtgctgctagtggtaaggaacccgtctgccagtgcaggagacgtaagagacgcgggttcaatccctgtgtcgggaagatcccctggagaaggaatggcaacccactccagtattcttgcctggaatcctatggacagacagagcctggtgggctacagtccgtggggttacaaagagtcagacagaccgaaagcgacttaacacagcacgtgtctaccatcattttgacataaatggccttaaatttcacatcttgtgtttggtggtattaacctaggacacagaaggcatacaataaatgcttgtt

SEQ ID NO: 59295 - DNA, 1026 bp, Bovine  19866881568995
ctggagagtcccaccagaatgaattccatcacatttgcattattttcttcagttgaagaaatcaccatcctttctatgaagagaaaaaggaggaaagtatgacaaatgtgacagagtcctaagaaggcactgggaaaagtgcaaggctgatggtgaggaagaacttcacttcaccagagagaggaaaaatatagtttatgccactctaactgtaatcctttgcatcttctcatagctgtggttaggtcaacgaggccttgtttttagctcttcatcctctcactcaacagtcaaacctgaagaggcagaaccacaccctccttacagactatttgttttaaaatggagtcttttgtatagaaatttgttttgagtggctacacttgattttatgtctgtaatgagtgttctcatggtgaagtgcagcctttcaaaggaaggctttgaaaggccttcctatacttactaacacatttacttggcccagaataataagagaagccatccaatacaagggcaagcatctcaaacctaaacagaatatttcccttgtctttgtctaagtaacaaaataaaaattattttgcttccagtcagacttcaagtcttgaacatctattgtgtttagagaacaatttcttaggtacaagaggctaaaagatacagttgaaattaaagatctgatcatagaattcaaggaacttgaaaagggacttgatcatcaagagaagtcaagaatgtgttgagggtagctctgtgccaattttgagctttgctttttgtgaaattgcatgcaactctcacccaggataattgtagttgagttgaattataacaaagaaccagtgaaatttataggaaagagtacctaagtaagggcattttagctttggatggactctttacttgctatgtgactcaagtgagtggcagtttcattacctatagaatgaggggaaatatatgcctttcctacgtcacagaaatagatagatagaaatagacaaaaagattcaagggattaga

SEQ ID NO: 59296 - DNA, 1827 bp, Bovine  19866880397768
taattaatgaagtaagggtagtgacggtttaaaatatgatttgtagatatatccagggcagtggaattctcaagaaataaccaaaaaaacttgcttaaggacaaagaatgcaaaacaacatgatatcttgttttttttgttttagaaagggtaaccatatgataggagaaaagaaacacagcagatgctgcatttttggacccaagttgcagtatttcatatagcaactcatgaaattttaattgctaacatggttcagttggcagggaaagcaagttacatggcttgaatatgaacaaaagattatgaaggaaaggtgaatttgtcagacaagtcttcagtaagaggtgctcagcagggtgtcccaaggtcagtgcttgctcactttagatttccttgtgcattttaattagcaatgtgggagagacaacaagagacccctgaaagtgatctgaagaagacttgcaaagggggatgttgccaaaccccaggaagaagtccaaattgagatagataagcccacaaggtttaacctatggacgaaataactgagggctgagattatttataaagaggcaaacaagctcattggagggacattaatcagagctccttatactacagaagcaaaaggactcatatcccaaaaaggtttcaactaatagagtaagagcagacaccaccatgaggaggtcaggctgtactggatccagtaagcctgccccacccacctcatcctactctgcctacctatcaatatcagccagaacatgggcagaggcaaagcctgtcagtatattgatgaccagcatattgatggtttctgtctagaaaaataaaatgtttaaagaaatgtctgttagccattattaggcactagcacacagaccctttcactgtggcccagccaacaagcaagactctccataacatagatatttatgatttccactaatccccatgcccctttctcactactcagccagggaaggcaaagatcgccttctcctgggagtcccgctgctccttgggaatgtttcctgcagaattctgtggttctgacttttagaagatgtagaggtttttatggctcagttttattaagaggacagagtcaatctcctcaatataaagtataggtaaattgagagctgagtatccctcaaaacatcataaaaattaaattttatgttattgctagctaaattctaattgttaagttttaggaagaacaatttgacagagaaagagaaggggctttgaaattgagggatgttccatcgaaaagccaactaattttgggagggatgtgtccttgaaggatcaaatctgagacacatacccagagttcaggcagcagcccatccctggatcaggagttcaatgtctcaatgtgcgcttgtgagagaaaccaaacaggactaaggggaaactggagagttgagctccccgcctttctccatggaagcgaaatgcaatctgcttgttggatccaggtgaagggaccagaaagacaatgcccggccctcacctggaaactgctggaatgtaacctgtcagcatgggctctcctctctgcagctacctgatgctctacctgcctccaaaccaagagtcttttccagtttgttctactggcatttgttgactgcctagtgcatactctaggaagggcaggaaatgatccatttgtctagcatgtgtacacttgtccctccagggcagtgtccagtctcatactgaagacaagaagacaccttcaaagtcacctgtagaattttaaagaacaataaaggaacagaaattcaaagtacaggaacggaagca

SEQ ID NO: 59297 - DNA, 1291 bp, Bovine  19866880402705
tgaactttgcccccaggacccctttcttaccttccggccaaggcaaccaacgatggcaaactgcaggcaaaggtccctgtgcagcacagggtctcagccactgcctagtttatttttgttgagtttataggttccctttataagatgaggaaggacaggataagaaatgaggagctcatttgtattttaatctttccccaaatgtacttggacagacattactatctacattttatggccaagaacactgaaacttgaaagaggttaagttacttgcctgcagtcacaaaatagtaagtggtggaacgagggtggagaaaccaagtctctctggccccagacccatgcttttcccattacaccacttcagccggtcttggtcttggtcggagtcttggccaggggctgtggaggcacgcctggtgaggttaaactttatttgcatttttaatcagacaggagtctaatggcatgtctaggcttattggaggattgggggcagatttcaagcagcgtaagggcaagtagtgtctgggaggttgataatgaggcaagaagaattggggcggttgtaagaccaacttcgcctgctttgcatttttgcccagagctgcggtagcacctggggctgttgttcaagctgaaatagcagcacttccttggagttcctagcatctgctctctccaaattcatcttcctgcttggcagaggaggagagggaggcagttgcagctctggagatgtttttgagttgtcccaggtaatccttctctcgggatatttctggctagtacttccctttctcagcacttctgagaacaacaaagggatggatgagctcagagcagtgttgtgtctgacagtgttgtctggcctaccaggtgttgtgaaacagtcttctaataaatctccgagctgctggaataggatctccatgcaggtggggtggacctaacatagtgcctgacacagagagaatgcttttgaaatatttgttgaataaacacaagtgttctagttccacatgggcttttcttcaatggttctacatctgagagctatctctagttctacaggcagaatagagaggatctagatccattatgggcttccctcgtggctcagacagtagggaatccacctgcaattcaggggacctgggttcgatccctgggtcaggaagatcccctggagaagggaatggtaacccactccagtattcttgcttggagagtcccatgaacagaggagactgacgggttagacacaactgagagactaacactttca

SEQ ID NO: 59298 - DNA, 934 bp, Bovine  19866880487620
acagcgaccccatgtaccgctgcgagtgcaagcctggctacgccggcaacggcatcatctgcggggaggacacagacctggacggctggcccaatgaggacctgctgtgcgtggccaacgcaacttaccactgcagaaaggtagcccgccctcacccgcctccagaaaccacatcaaggggatgagctgaggaattgcttaaacttggggaatggaactgaaagatcaaatcatccaaaggcagaggaacactaattcttattaagtcacttcatgccaagaacatgaatgggacaggccctttgggcaattgtgttccacagtcgattatgttgtccaaaaaaagttcatttctctaccaaatgccagcagagcatgacccatgttcccagcatatataaagtttagaacatttatacaaagtatttgtgtgtgtgtgtgtgcgtgtgtgcgtgtgtgtgtgtgtgtgtgtgtgtgtgtgtgtgtgtgtgtagctcctccaagcaaacttttttgtcttcccattgaaaatacttgctgtcacaaagtagtattcagttctgtctgcagtgtttcggtgcacgctttagtgcatgagctgagcaaaaggcttgcaaactgcagctgcaatgtgtcttctctttccaggataattgccccaaccttcccaactcagggcaggaagactatgacaaggatggaatcggcgatgcctgcgatgatgacgatgacaatgataagattccagatgacagggtaaaattgttttccattcctctttcagcttttgtgttcagcaacagcctgtaacccttaagattcaacaaaattactgatatctagtcatcagaaattattcattgtgattctgtagttttaagatataaatgttgccaagagaatttttaaatgagggttttatttttcatcatag

SEQ ID NO: 59299 - DNA, 891 bp, Bovine  19866880672268
ccaagggcatcaataaatcatttttttacccttcctcccttcttactccattcttggtacctccctcccttagggtatgcacagctatttggaaattcttggaaaatcgctgccagcaggctggctgctccaaacagttattggtttgttgtctatccagtaaatagaaaacttggaaacattttagagaatttctcaccttttctaccttccagtgtctgtagcaaggccagcctgggactctatgccagaatctgaacacaggaaataagcttaggaaccacctaactctgttggttcttgggcattcttgggaccggagaatgtttctgtctggccaaaaatactgaactggctgcaggccgtggagggcaaggcgaggacagctctcaagacagaagcaaaactgtaccctgtgttccgggtctgccgttaaaacaaaacaggaaaagacacacatctttcagccctgtgttaattctatgtgaagattaaatgctgtaaaggtcacacattaatgaaggaactttctccatgagctgccaagatgcggttgcctttctgttgagaaagttaaagttcattctctgggatatttgggtggctactcagttcaacaatgcagtatctttctttcttttcctttatatttgaccctgttgcccttaaccccagacaaggcaaatttctcctatttctgagattgtatcacacctggtttaccagaatggcagactctattctctttgggaagaggtggtatttggttccctcaaattgttgacgggacaaaaaaattaggaaatctgaaggccagctttactctacaattctttttatccgagcaacactttgaatcaatattttctgggagaagtaacatgtcctgtt

SEQ ID NO: 59300 - DNA, 1286 bp, Bovine  19866880779254
gttattagcatcgagcctcactttcagtccctcagcatcatcagggatacacatgcaggggctcctgctaacagggggcgggtggaggccactgaccactttgcggatactgtcctgcagcgtggtcacgatggtgcgtagacccctgagctccaggaccatgctggacagctcgtcacatgagatgccacagatggcttgcaggtcctttgtcttgtggccaatgtagtcggtgcggatggcagggctggacccattcaccacgttgttgtcaagggtgacaaagacactggtagctgccaaggaacaaaggaagacagtgaggaaagtaggagagtatcttcaagtagatgctcccaccagccatcccctgggcatcctaagtgtaaaagacatttcattttgggtgagggaggcaaaaggaggggaccgttgagtgtggaaaactgtttgaggtcacctttatataaaggtaactatgttacctggggtaatttttgcacaatcaccattgcttaagtttctcagcttgttttgggtggaatgccctcagttccccatatgccctaaaaacagagggatacttacagctggagcagcctttgttcctgaggatgtcttctggtgtggttccaaagacaaaccttacattctgcagcaccccctgtgagcagaggatatacagtgtttgtagagtgttggtgggggccggggggtcggtgggaggggggactgtttacgctagaaggagcacacaacagatgttctaacatttgaaaagaactccctttcaagatcaccgtgtcaaaataacacaccaagtaactgttggtgaattgccaaattcacgggaattgcaaaataacttcaaaaatcttaattgtctcttctgccaagtctgcagtcttttacaaagaattcagttatcggcctacttggggatacaggaaatggaatctgatattgagaccagaggatacaatgacactctccagtgtcaaacagttaaatgtgggagtttcaaagccacagacggaaagatctagaggtttaagcaaggaagacactgcagcagcaaatagccactattttaatcttttctttgggattggttacatccccatgaggaagcaaatagccaagtggtatttatcctgctcataaaaagtatccacttcaagcaatattataattggtgcaatgcatttgaaattattttcttgagaagagcataaagagtatttaaggtttgaataggcagttacaggaaaaccatttcttgtttc

SEQ ID NO: 59301 - DNA, 2135 bp, Bovine  19866880792714
caccacatcttataagtgatagtccttcctctggagtgctctccttctcacccagtaagtgaccactcatcctcagaagctcaattcaaatgccacctccccatctctccaattgttcgtcattccctctagtgttgccaaatactttgtccagaagctcttatacttagccccatatgctgagattgtctactttaagtgcctgccttcatcaatatcctatgaaataattcagagcagtgatcatgtcctactcacctgataacctaggagcagcatccttaatgaatgaatacgatggaaccctggagcaggttttagtcataactaaacaacagaatcacccagaccccatcctcagaaactggctttaaaaatcacagatgcccagagccaacccctagaaatttatttaattctggaatggaaacaaggtattaacctgttgttaaatattacctgatgattctaatgtgcagagataagaagcactgtctaagggatagactcagtatagctttacatgccaggcagacctgaggcagatgccaaagagagaggtctgaaaatcaaaagtacacaaagtacagatgatcccataccagctaggtatgtctccaaataaaatactagccatgaaaaagtagtagagagctaaagagtaggactagcttgctctcaaggagaagacaatggcagcccactccagtcctcttgcctggaaaatcccatggatggaggagtctggaaggctgcagtccatggggtcgctaagagttggacacgactgagcatcttcactttcacttttcactttcatgcattggagaaggaaatggcaacccactccagtgttcttgcctggagaatcccagggacgggggagcttggtgggctgccgactatggggtcgcacagagtcagacacgactgaagcaacttagcagcagcagcagcagcagcaacagcttgctctcagtggtgaagaagaaggttatacacaagaaggaaaagtgggatgggtagggaggtaaaaggacagtctggagaaggcagtgtcttcattaaaatgaaattcaagaggataaagcagggctagagcaggcaggaaaagaagatactttctgatattattttcaccatcaccacataggctatttttttttataatcctaaaatagagagactagtaaaccatctaattcagatctcaaacttcagtaatggagaaggcaatggcaacccactccagtgttcttgcctagaaaatcccagggatgggggagcctggtgggctgccacccatggggttgcacagagtcagacacgactgaagtgacttagcagcagcagcagcacacttcagagtgcatacacctactgcagggcatcttgttaaaatgcagaacctgatatagtaggtctgggactctgcagctctaacaagctcctgagggatgccaatactgctggttcataaatctagtctacagtcatgatcttcagtaactcatgttttcattttattcaatttgaatgatgcagtggaatcagaagttcccaatacttgacaaagtgataagttcattacaattaaatatcaaaactctccaacataccattgttcactttatactactaaataaaacagtagagaaagtgttattttatgatagagaaaataaccagggggaaaatatttctatgaagtctaccccaagaagaactgaattagggagctacagtcaataattttttaataaactataatgaaaaataatttcaaaaataatatatgtgtatatgtataaatgaatcattttgctatttatttattaccttgctaacctgaaacactgtaaatcaactatacttcaacaaaatatatattaagaaaaaaaagaaaattagttgagagtaacttgaaaaaataaattcatcagatacgaatttactatatactaaggtcttacataaaacgggaattaacactgagaattcctaatatgccaactgtgatattttgattaaagaaactttggagggttggcttactaagagcatctgagaagcaattagtagacttggaaaagtattttacatgataactaggaggcctgaaggcacacactatt

SEQ ID NO: 59302 - DNA, 1773 bp, Bovine  19866881143341
attatttttcctttgacttaattttctgtgtatctagctaaataaatctttggaacttctaagcatttatcctatcaatattattttgggacgtggtcaaacatatcagataatctacgaattttccaccgcccccttttttatttcctcccagagacctccttccatattccttcaccctcttgctccaggatggactgattttattctaaggtctggaaatttcatatgttaagcctttggtttgatgtttgctgaggataacaatcagtggaccatttctaaatcctagcgaattgtttatgcattgcaaggaattttatataagcagtttttgaaggtgtattttagttatctggtatcatataaggactgctttcattttctagctgtctagcttcacatagttgggtgaaggaaatgctgctagtaatggataaagtactacatctggatacctgaaatgtctagtgattaaaagtaggatttgctaatatatgatacaactcttttttttctttagaaaagctacaactcctatttttttttgtcatgcacattagccttaaggtgaaatacctgaattttgaatcccagatgattattaagaatatattcccagataatttcttgttacttttaaactcttaatggtacttgccagtatgaaacttggtttttaatatatggaagttaaatataattttaaaacatgatatattttaaaagcacgatatgaagttctttttacatgctactttttgttagctacattagaggcattacacagttatggggaattaactatactagttccatgatagctccccaccaatactttgtaaatgcagaatattcggttaattcttactgtgtactacagattagaccaataacattgttttactttattgaagtaaaagttaaagtcgttacaagtcatgattaggttttcttatggggacttcttgttgtcagataattcactcccctgtaaaggaggattaatgttatcatagataatgtactatgtaaatcaggtacagtgctaattctttaaagaaggagaatttttttcagtgtctttcaatatatttcaatcatgttcctttccaatcattgttgcaattcaggtggcatgctgttcagttgaattcttgtagaacacatagctctataattttgtttgattaattttgtttcctgagaacattactggaagagaaaaaaaatgtttttaaatctttactatcttgtttgaaacaatcaatcctgataatgtttacaaacagagattaaatgatcaaatcctcctcccagagtgcactgctgttgggatgcccctggcctctgtctagacctgtagcactgaagccactgcacatctcaggatgcatcaccccctctcccttccttctctgtcttccgtagtattgtccactgaaagctgtagacagacataggagtggtgaatccccaggggcaggttaatccaccctgtttgcctgagttaaggaattgggtggtgatagggttcatacccagaaatggaggaaacagagaaacaccaactagatattgtggcagaatttcttgctttctatcaaagaagtggttacttactaaccctgcttgatgccccaagacttaaaaaattgaagggtttttctaatatcttcatttcagcccaaggttattactatatgtgaagtgttagtggttagtttggtgcagtaatttgtttccatcagtgtcatgggacttttcctggat

SEQ ID NO: 59303 - DNA, 2620 bp, Bovine  19866881367372
tgtgtgtgtgtacatatatgtgtgtgtgtgtgtatgtgtatatatatattaggatttattcccaattctccctctcttaagtcgtctttctgaccaaaggcatagtcactctccaaaatgtggtatctatagaatttgacccagcttttcaaggacactttgtctttcactaacatttctaaagcttcttcacagcctggtgtcctcattcatgggtcggaagatgtagctgtgagtatgtgcttcactcctgttttcctttttattttcaggaacagaactgggctttgaaaaggattcgataaatgacatttagtgacattagtaaaatataaacttatatccttttgagtctcacatcttgtgggggtggtcatttctcattgcttgtttttagtatgataggctaatttattttgttcttttattccacaaatccagcaaatacgtcatctaagcaactgcgtcttaaattgtaaaggaactgtgaacgttactgttaactgtgatttctttttgtgtatgctctattggcttaaggatacagtttacccatacctcataacataaggccagaaatcaaataaacacggatacagtaagtataaatataaatttccatatgatttattgttgttccttgtacataagaaacagtaatatacaacttacactgctttagaatgtaaaatggataaaaatgtgtacaaaaaagcacattcctagaaaagtattggcaaatagtaaaaacagggaggagggtaacaagcaaaaaacaaatcaacaaaacaaaaaacgaacaattcttcaattcagtgtgcaaacattttataaaaatagaaatactaactctacaggcagtatttcctgataaattatttaaatagcatatctacacaatctgagatatctattccaaaggcattgagaaaataatttataaaaataaagcaacggtatacaagatgatagaaaaaaaacaactttcagaaaacgtatataacatttcaatgctatttccttactgggaatacttttctgcaaagaatttttatactatgtacaacattgatttttttttttttttttttaggtactacagtagctttaagtttgttagacacttaaactctttctgtttgatcccaaaattctttactcagtcacacaacaaatgaggtaatatttgtatacaagtttcacctttgtcatttttttcttttggaaaaaggcaaaaataataaatgtagatgcttttcatctccctggaaataggcacaagggatgggataagacagtattaatggcctcttggctttctttgcaaactaaaaacacttgcaaatggacaaccaagtaattccacttggggaaaaaaaaggaaaaaagaattccaaatcatccagtctaagcacaaggtgaagagcagcttgctatgctggtttccttgtgccattcctgtgaaagatttgctgatcgatctcaactacctgctctcaaacactttccatatgaaactagattccaggtagaacagagttaataaataatctgtatttacaatcttacagtcataatgacttgtagcaaagatgatatggatagtccttacgcttcttcctgttccatgaatagtctttcagacagatcccccagaataagtaaaaaataaatagtttacattgtaaagtgtttgtttaaaacactaaaaactacagtccaaaagagacaactggaaaactccatgatgttcaggaaaaaaagagaaagaaggaatgtcttagttgataattttgtgcctttctaaccataaaaatacaagcatggcttgccgtcccttgggagacagcctggtgctcgctgagatggtggggtattcttattttgctgctacatctgcagaagctacatctggaatacaactgacaatttcaatagaaccaagctgcagcagctggccctgccttgtgtcggtttaactccgactccctgttctggtcactacaggtgatgtgttaaggggtggaaatctgggaggaagtccagaagccagtcttttccttccttccctgctcctatttaagtgcctatttatgtgggttaatcagctaacaccggtcagcatcatgaaatccagcaatagtctttcaatcccctgaaaatgatttagtaccaaaaatgtaacagttcctccatattttcttcatacaatcatctcttgggtatgcatcctcccctttgggctttggccccccccacccgcccccattccagagggagtaggtcagggctggttttgtttgtcaattctagtgagtcctcccttctctcacatgcctgaaaacattttggagtccactgctcagagctggcctcacagtcgcattctgctctgacaaaagcagagtgggacaggcaccttccaaccaaagcatgtggatgcttttgcttttgcaaaagccaaccaaagtcattgtttgtctccttggaagattcttctcagtcagaggctgaatgcagggtctgatttggaaaattgcattttcttgaggcaagtcacatgttctaggagtccacactcatgcaagcagagagcaaaggcaggcagcgaggcgcgatc

SEQ ID NO: 59304 - DNA, 1576 bp, Bovine  19866880490897
atcctccaggcaagaccactggagtgggttgccatttccttctccaatgcgtgaaagtgaagtcgctcagtcacgtctgactcctatcgaccccatggcctgcagcctaccaggttcctctgtccatgggatttgccaggcaagagtactggagtgggttgccattgccttctccgaagtcttactaaatagtatacaaaagcttgggggttccgcagtggctcagtggtaaagaatcggcctgccaatgcaggagatgcaggagacatgggttccatccctgagtctggaagatcccctggagtaggaaatggcaaaccactccagtattcttccctggaaaatcccatggacagaggagcataatgtgctacagtccctggggatcgaaaagagtcagacatgactgagcacacagcatgctagactcattacaaaggcaccagagaagccaactactggtcatcttttcctctctttaaatgcaattctttactcaaatcacaatagaaacaattttaatatatacaacataatacgtagctaacgatatatataaaaacaatattaaaaactagtagccatgagttttgtcccttactctattttcaatctctatttaaccaaatttttggctgcctttctactttcagggattgcttataattttctctcacctcctgtgctcttagattgaagagctccaggccccaagaccagagctgatagtggctgacagatgtgagcagcttgggcacaaaagtccttgtggacattcttcctgctgtcttgtcaattttcagcccggttgcttgaagctttgcctcgtgtagatgcctctggccaaaagagacgtatctaatgactggcatgctagccactcatgcccaatgaccccattgtctatgcaccttcactggtgtgtcagagaggagggaacttttctcttctgggtcagaatgcacatgactgaggcaagacaattttacaactgtcatctccctggtggctcagatggtaaagaatctgcctgaaatgcaggagacttaggtttgatccctgggtcaggaagatccccgggagaagggaatagctacccactgcagtattcttgactggagaatcccacggatagaggagcctggtgggctacagtccatggggtcgcaaagagtaggacatgacttggcaactaaataacaaacaacaaactctatccagctctactacaggctgaattcactctaaaacaggatcaagaagtgagtttgaagtgatcctttaagtgtcagcctcgcagggcacaaagaaggctagtgaaactggaaggaaccaaaggaaaaagttcagctcagggctccttacagtgacattcaaaccagcttttcctaatttccaataagtaaaggattatctttgcaacaatgttactaacccagttaattaagccctccaaatccttcattgtccaattaacatggtcacaactttgcaaagccctctaactccaagatgcattcagatcaatatgcccttaaagaattcatggatttattttctctagatttttttctca

SEQ ID NO: 59305 - DNA, 1308 bp, Bovine  19866880641925
tgggttgccatcttctcctccaggggatcttccttgacccaggggtcaaacctgtgtttcttatgactcctgcactcgcaggcgggttcttcacccactagcaccgcctgggaagcccaagaattgtcttacacaccagtaagtactttatatgtcacccttgcagacactaagagagagacattatttctcccacgtatgagagaggaagctaaaaattaggaaggttaaatgattgacccactcttagacagttattaagggacatattttagatgtacagtaatatctttcaggaccataggaaatgaacactgagccatatgatttctaccttcttcacttgatttctaccttccactttcctaggtggtacatatagctgtcatatcaccttcagagtgctccctgaaggacaaacacacaatgtctccgtttcagacgatcaagcagagagaaagccagtgctgtagaagagcatctgtcctccacttcactggtctgtgcagtctcatcagaggaagcttgacctgcatggggagggacggctgtgttccttgaagtctccagaaaagtattcctttctgcttatgtcactgtcacattcagggtcactgactcaggcacatgatttgtgtgtttcaagtcagagaagccaatagaaacacaagtaggaaaaatcacagatcatttgtacacatgtatatttttaaagtcctaagagttgttcactgattatgtgcaaactaccattcttcagaccttcagagttcatctgctcgatacatcggcgatctcagccaaagtctatttttagaaatgcattgtcattctcctcccgttgtgactttgtgtttgccacgggcaattagacacaacctaaacttattgcaagcataaattaaaagcaggattacataagtttgttgttttctcatactgtgcagttgcttctatacccaataattaggaggggaaatgggccactggagattggttttgcaaaggcccgcctgttctggccaatcttacctggggcaagacgctcttctggggacaaaggaagcaaattcaagaataacagttggtatttaaattcatggggcttccctggtggctcagctggtaaagaatctgcctgcaatgtgggagacctgggtttgatacctggattggaaagatcccttggagaagggaacagctacccattgcagtattctgacatggagaagcgaagaagaactaaagagccttttgaggaaaatgaaaaagagtgaaaaatctggcttaaaactcaacattcagaaa

SEQ ID NO: 59306 - DNA, 1616 bp, Bovine  19866880808651
ttgctatgccaacctggccggtgcagggcagaggtcaacagacactggtaggtcggtcctgacatttgcatgcaacttgctttgttaccagagaaatgagtgctgggctgagaagcagtatgttacggttcgacacgtggcacaaaccatgaactacgttgccctggatgctctctcaacactcttcaacccaatattatctttaattaacaagatcaacctcttagaatgttcaaatttctttcccaagtctccactgtctctgtcttggccagacctgccctcctggattgctgcaaaagtccgttaatttctttctcctattaagcctcctccaacagtcttaaagttttcagagagatagtctctaaaaactttgaccttattcctctgtaaccctgcaaaaatgccttcagcagcttaccactgcccacggaatgaaaactaagcctcttactttggcataaaagatcctttatgaccctttatggtcaggattctcccacttgtgccatgcacttctccccactgagtagtaaattgctcgcggttctgtgagcacattgtagtttgcccttgagatttttctactcactgtttcttctgtgagatacgcacttccctccgccttgtaaatttccagcactcatctggcttggtacagtcatcacttcctcttgggtgtcttattgaagatcttccctcacctcccagtttatcggttcctgcctggtctttccagagccatctatgcatttctccattctcagccctcctcactttctggcattaatgttcttttccatgttagtggacctcatcagcttgtttgtagtccacagctgccaagaagcagaggctcaaaagggtgtggttgaataaatgggtacttattccagttgagagagtggggaagacacggaagttatgaggaagatctcaactggaggctccccgagttccaggttctccacagggactcaaactgttagcaggagaaagggcacttggaaatcccacatgagggaatctcattagtttcattaattcagtgtcatcagtttcattagtcaatagccatactgtttaaaaggctgctggttccaggaccatgatgggagcctgagtctatgccaacatccatgccatgcacagcctccttgatcgaccaagccttgccatgaaaaaatatgccaccccaatgtgacgaatgcattcaagcacaaacccctttcctcactgcagaatgaaaacacactttttgtggctggcagaggtccttgggccatgcttctggagtctcttctgactgagtttaggagaacaggcaggatcttagaaggagtcaattttcacctggtatgactgcttggcataaaactatcatttgtttactttatttctccccatggcccaaattaatatctacctccaggctttaaaaaaggaaaaggagagaccatgcctagaaataaaactaaatagcacagagtttcagccagctctgtccctccttgtcttcgtgaccttggccaaatcacatcctttccttttgcattagaaggactgattaatccctgtcccgtgttctttcgtggcatttgtgaagattaaat

SEQ ID NO: 59307 - DNA, 1839 bp, Bovine  19866881041017
ggtgcagtagtaaatctgttcaaaaagtctgtcagaagctaccagtccctggctttttttttttttttttttgctttatctggatttcaagcagttacattttgctttgtggctatccttgcctgctacataagtttccctatttcttgctcaatgtcttgaaagcattttccaactataaaatgtgatttttctcatggggacagcttgtatattctgagaccatgtttatatgcataaattgaagtagaaaatagagaattttaagtcaaatacttttgacctttgcttgcagcaaatcagtctttggatttgaatgatcatggttccaattatgggtcttccttgtagctcagctggtaaagaatttgcctgcaaagcaggagacgctggttcgattcccgcattgggaagatccgctggagaagggataggctacccactccagtattctcgggcttccctggtggctcagatggtaaataatctgcctgcaatgtgggaaacctgggttcagtccatgggttgagaagatcccctggaggagggcacggcaacccactccagtattcttgcctggagaatccccatggagagaggagcctgggaaatagtttcccttggaataagctttaaaaatactcctcagtaacaatgagctttgaaggacatgtaacattttttaaaccagtcttttcactttttttttttttttggttgttaatatctgtgttaacatctactcatctgatagatggagcacagctgtaggtattagctcaggaaagaagttgtggatctagactagaatatatgtttccttgtacaaagaaagtgaaatgctaagtgagcatgagtccattactcatgtctaattcaagccaccaagagatctcagatgcagggcttaagacaaaagcaggaacaaaaaataaatgcaggaatgtgtgtgtgtgtgtgtgtgtgtgtacgtgtgtgtgtgtgtgtaaattgttaggttttacattgataaaagtcaggtgtaattcttaacataaaaactactttgatgttactttgaaaaacatattaattctctttcatttagcaagcaaatatttttttctgggtaatctctccttttctttttttcactatacatttttctaagccagtaccactccaaactcgtattgtccatttatttaacagttcaatcaatgaaggtatttatactgatttatattgatgggcttcagtggttaaaaatctgcctgcaatgcaggagaagtggattcgatccctgagtcaggaaaatcccctggagaaggagctggcaacccactcgagtattcttgcctgggaaatcccatggacagaggagcctggcgggctacggtctatggggtcacagatgagtcggacagggcttagcgactaaaacaacaacgacacatttcttgtagggaaaagagaaagcaagcaaccacaaaatttatattgatactgatttataatgcagatcactgtttccctggtgatctcctgagctgtgttcaatgttttatatagcctttctaaggatcacaaaattatttgagaaatttggtaatggtaagagatgtgcattatcaaagtgaagaactgagcaaatggtaaaaataactgacaattacagatagaaaaagaaagggaggagtatatttccacgtaattcagattccaggcaagaagaatggtcatttatagaactctctggaaaattactgttgtactttaattcattcatatagtataagctttgacctcattgatagttcatactacatacctatcaattatgatcaaattcagtaagta

SEQ ID NO: 59308 - DNA, 681 bp, Bovine  19866881507384
cctgtctctttcctgcaacaatctgttgcactatcttggataattttagcaacagaattaactttcaatttgttgacactttacccaggagaaaaagtagagaaaaatgagacatcaaaattaaattagttccaacactgatattctaaccttaatatcaggtacacagtgtcctcacacccacggagccaagagttaatcaaattcctaataataaaatctttttcttcaggtcacatggattactcatcagcagatgaaaccgggtgggagaaaaacccacccagtgtcttctgatgcagacatgaaaatagacatatgccagctgttactctccatcggctttaggagaggctccattgagggggagcatgttctctgcaggcaaagtccttggacctctgaagatgtaacctggtgcctgccctcagggtctacacagtatgttccagaaacggataaaagaaaaattccatcactgaataggcaagctgggactggaggtcaagggaatggggacacgtgtatgtcctgggcaggcaggaagtcttcttagtggaggggacgatgctgtgagcaagagaccagttcaggcagtgagcagtgttagctagctcactttcctaaaatctaagagggtggaacgcaaagggtttcccctgagcatgacaagtctccaag

SEQ ID NO: 59309 - DNA, 717 bp, Bovine  19866881861621
tttagatacacttagaagtgacagcacctgtgtgtccagctgtctctgaaaaggaggcttcatttatcagaatggcttccaaattgctctgttttgtgcaaccgtgacccacaggttcccatcagtgtggaagctgagtggtgtggggaatgcttcctggagtggcttggtttccactggaaactccagaataattttctggtggtgagcggaggcccttatatgctatgatcctttgaggggggcagtggttgctgatgttttttaatctcagcctcaagcatgttttggaaaccagcatacgattaatttcccgattgctgcagggttgttttaggacttttttttttttttttctattttaattttattttaaagctgggacactgcaaagctctgtaaacaaagtaatcgatcagttgctatcagcagttcttgtgagagggcagaataatttgatggattccggacaataggaaaagaatagtgcaagcagcttgaataaattaatggacatgattataagtggagactggggtccccacaggtgttcttaaaggagaacattcattctggctccgaggtgcctgcatccctcaggccacatggagtcaattgtgggtggatgcttctcatttatagcctccagtccatttttgaatcttcttgcttttgcaatctgatgctttacctggactgcaggtagcagagatttaa

SEQ ID NO: 59310 - DNA, 3049 bp, Bovine  19866880647669
tttagggtttctgtgaaaaacttttaacattttaatatattaataatttactaaaaacatctttgaaaacaaccaaaatagaaataagtacatttttctattggtttatagaaattaagaatctcttaaatttgcacaaatcttcttagcaaacataacaatttcatatatatctcatttgagattaagactataatcacagttaactgttcttaacaactaagtaaatgtgcccctattaataatcctattttaataaatttgtgtattaagaaaaatatttctatttaaatattatttctaatgaacataaattgggaagtagaatattaatgaaataagtcctcttcacatatattatgattatacactaagttatcacatcctaattcaactcctagatcataattaataatatttaatagttggctatctgatgacattaaaagaaaagcaatttctcacaagactggagtctgaaatttcagacttaataatgagattggtcatgatatagtgtctctaagataaacagatgttaaggtacctggtatttatgtctcaaatattcaataatgactgtgattatctacaaaaattccatttaattacacagaactctgtttgtttgtttgtttgttgaggtaggagaatttcaagtaatcacaggtcaataaataagtgatgaacaagaaggtaagtaaaactgaatactgatttaaagaacaaggacccgtgaagcatttcactgaagccacaaatgacacagcagacagatttaaaatggaaaaacatagataaaagacacagaaattaacaagattctctaattagtcctatcaataaaaatactcaccacataatacaaagttcagtgaataagatcatgagaaatgcttattgctttcttaaagtcactctcatttatcttagaaagaagtggctactagaagggcaaatcatccgtagggtttttcaaatcctcccagtaccaacaataaagaaggcctcttatatttcttggataatttccctctgcagatcacctccccattcccactcatcctgggttctccaagcctaaccctgatacactgcttgacgtctcacttctccagcattactatcagggcatggaggggctggctacaagaacgaacagacatagatagaaaggagagggctttgctaagtgtctttagaaggcaataggggacacagaggtgtgggatgggtgggagatgggaagttcaagggggagaggacatctctggctgattcatgttgacgtacgacagaaacctgcacagtgttgtaaagcaaatatcttgcaattaaaaaagaaaagatacggcaagaaaacgagatctgttttcaaatttctgtacctaaatgtaataaaatagtactcttgcaaggaaaaaaaaaaggcaatggggggaatacataaatctatatgactcacttgagtacactataaaaagtgcctttgtctgatggtgatgagtattgtgctcacaatgctattttaatgaatatattacacttttaagagagaaggttccaatttcttggatagcatcctcccttatcatcatgagtggtgcctcagtgcagtctctgaggaaacatgagttttcccccagacagaaatgactcattttactggtgcctacaagtttatggacctatttctccctagacaagaggtcagtgaagtttctctgtaaggggccacacagtaaatactttaggctctgtgggccaaatggtcactggtgccacagttccagtctgccaccatagtgtgagagcagccacagaaaacatgtcacatgttcatttacttcatttacagaaacaagcatcaagctggattttagcctctgggccatagtttgctaatctctgtcctggaccaaaagccttagtcttataaaacctctttaactcttgttctaaatggaaatcaagtcactatgctactcataatttaaagtttcaatactgagaaccagtccttcttcgtagaatgtacaacaccgtgctaagtttttaaagcaggagaataagaaaaagggaaggaaaaagaagttattttagaggaaaatgaagtttagaagactgcttttgagtgactgaacacacatgcgtgcgcgcgcgcacacacacacacacacacacacacacaaagggaaaacagataactgttgcttggtaacagtgaaagagatttatataccgttgtattttactgccatggtcactgttctctagctctgatttaacaaaacactgtgttaagtagtgttgtgattcattaagtggaatccccagatcaggtgaactgtccagaagtgaaatatacaagttcatattctgatataatttcatcatctcacatttctttcgaaaggacaagtcctccttagtttgaaaaaatactctataacaatgacactgatgacattacaagtgattcagataaacaaaaaaaagtcacagactggggagaagatatttgtaacttgcatctgatgacttagtggtatctaaaatatcacaagaactgttacatgtcaataataagacaaacagctcaattttgaaagtgaggaaaagatttggacacacttcacagaagaagatatatgcataactaataaacccatcaaaggatcctcatcacccttagtcataagagacatgtagatttaaaccacagtaagataccgttacacacccattaggtctaacacttaaaaagccaacagtaacaaatgtcagcaagaatgggaacaactggaactctcatacatgccggtgggaaatatacaactacttttgaaaacattttagacattttagccacaacagccaatacctggatacaacataaacttgtccattgacagatgaatgaatacacaatacagaggaagctcacagcaggaatattcatcagcaagcaacaaactgctaacacatgcaacaacacgatgaatactctaagcatcacgctaagtgcaaaactaaacacaaaaggcca

SEQ ID NO: 59311 - DNA, 1839 bp, Bovine  19866880670173
attaaaatactattatgaaatttggatgataaaaaaagtgaaagtcactcagtcatgttgaaaagggaccacaatttaaaactagcaatctttaatacaagatacataattttatccacagaataatttcaagaatgatttttcattacatgtaaatacacgatacaattaattatctttactacgaccgaaaaagaatgggaagtcagaagtaacattcaggggagaccacacccacctttaatagtcgctgctgttccaagacgagaggagccagatccaatctgaaaacatgacatgaagtaaacacaatgctagccacgccatcagcacagactagcaagaccatcagatgaaattatactgtcagaacaagtcatcagtcaccttcaccagaaggccatgacacatcagcgccacactcggctgcagcgtgtgcggcgcacccagtgcacacaagccggacacaagcccgcgcctgctcagggctgctgagcccccagggggagagcctccaatcgcagacaatctgggtcaacaattgttatcagtttcctattgcatcatacacgttccagtgataaacaaagcaaaactaggtgtcaagtttacctgaaataaatgtagacttatcagggattataaagggaaagtttggaggataaaacatagtaacaaagagcaacctaaatcttcctgtcaaattcttagtgcatcaatatgtactttcctgagtttcaggcagaaagttctttgtaggctgtgataatgcattttttaaaaatagtaataattttacaaaaaactaaggcatttaagaaaaaggaatttttagcacaaactctataaacagaacactattataaatctgtggggtttttagggcttatactcaagatggtatacaatttccctaaaattttataaccatcatatattatactattataacaatcatataaacaaatactacaaattccatgaacacattaaggaatccaaatataacaacatgacagttactaaatcaacaagtctgagtagttcttgttataacctgttttcaagggattcaagaagagaacagtcaagtaaatttaatatctttatactaaaaccaagaacattcacagaatacttgcattttgccaaatctttcccttcaactgattcaactgaacagaagtatacaatgagaaatttggtaaaagtatagctaataatgactttaaaggggcatgagggactttcttggtctggatggcaattaaatgggtgtacattttatgtaaaaacatactgagcctatacacttaatatgcatacactatacatatgaaagctatatgtcagtgaaaaacagcaaaaataagcatatgcatataggttaaaaccactaataagcagtatagacaaaaaaatgagctttgcaatatttttgaacaattaagtttgattctcctgctttttcctgatatgttttcaagtagccacaaaaagcactgcaatagacagggagaagaagggcccaaaggcattttactgcaaaaagagtttcattctaaacacacctgctaaataaataagttaaaaaaccaacaagttatttttctactagaataataaacacataactttctacacagaagcttacaaacaagcaagcacaccagaaagcaccatttcgtggcatccttctaggaatttaaactttaaaaaaagttttttgaatatgcatacagtagtcatttgctcacaacctccaagtgtttcctttttctctccttaacaagcctctcattttgttcaaatgttggacatatatcttctgatttatga

SEQ ID NO: 59312 - DNA, 1435 bp, Bovine  19866880698381
aaaaagcttaataataatattaagagttgttgaggatttggaaaatcaggcatattgctgacatctgtgtgccctgatgaaggcatttttcaaggtaaattggcagtatctttcagaaattgtaaagtacacgtgctccgctttaacagttaatttctagaaacctattattcagaaatatacatgtgcgcaaagacatgtgcataaggataaatattacaacattaactgtaatagaaaaacatgttgaagacattcaaaaatacaccaagaatttaattatggcatgaaatgccatatagttgttagaaggagtgggataggcttatatatactgcatgtgaaggtttctgaggcagattaagagagcagagcaagttgcagaacaacatgtgaacattctacacttatgtgcaaatatattttcatacacacacacacgcaggcaaatatataagaaagggaactgaagtgttgagagcagttacctctgggtgggaagtcatcctaggaggaggtaggagatgtcatctcatttaccagactttccactttctttcccaactgtgctcctctctgcaggaggatatattcccacactgtcgacctcaggaatgccatgtgacttgctttggccaaagaagtgatgttggtcacttttgtgcaaagttttagaagtcagggcctcatttgtcttgtcatcttctgccaccagattgacagtgttccagatagaggctaggcttttccatcagctttggttctggagtgaaaaaagcaagaagcagagcttgtagccaacttgtcaaaaacatgtgctgtgaataagaaataaacatttgttgcaataagccactgagagtatgggtggcggtgtgtgtgtgtgtgtgtgttactgcagtgtaacatgtcctactttgactgatacaagtaaagactacctctacaggtttccattgtgtatttctctactgtataagcagtttgcaatatatatactcatatattacttgtgtaatagctaatttttgaaagctgacttcttagtaaaattacaaatgactacatgtcaaggaccttcaggattgttgattattgatgaatagagactgcaaagctaaatcttggaattccaagggcaatgttccatgcttgcctgagatctgcagaccaacacaccacggctacagcctgtgtaagcacactcagtcacccaatcgtgtccgactcttcgtgaccccacggactatagcccgccaggctcctgtgtccttactaaaggtgggttgccatttcctactccaggggatcttcccaatccagggatcaaactggcatcccctgcattgcgggtggattctttaccgctgagccactgggggaagccctggcaatagcctgtagtgctgggaaaaggtacaaagtatgttatcag

SEQ ID NO: 59313 - DNA, 1904 bp, Bovine  19866880729098
ttctaggtgttaagttcttccttcatttctaagtcttcctctgcctgtcagatcttgcctttggatacctgtcttgttgccccaagtccttgtcttctaaacttgccctgtacctcctctcaagaatctcaattctgtttcatcagttccccaaaggcagaggaatccagacctgggagacagcactgagcttgaggtcttactataaataatacattttcttttaaaaattttatttatttatggctgtgctgggtcttcattgctgtgcaggcttttctctagttccagggagaggagctactctctagttgcggtgtccaggcttctcattacaggggcttctctggttgaggaacacgggctttaaggcgagtgggcttcagtagttgtggcttctgggctctagagcatgggctcaataattgtggcacgatgagcttagttgctccgcagtcacgtgggatcttcccggatcagggatcaaacccatgtgtcctgcatcggcaggaggagtctgtaccactgagccatcagggaagcccaacacattttcttaatgcttgctaatttcccaatttttgtctgttcctgggtttccaaggctgcacagcagctgcccattggcttacattttctgtgttgaaccatcctgatcctggctgccttcctggctgctgctggtaatgtagcctccaaatattgtcttctggatgcacattcatcacaacaactgagtctgccttcagttccatggttgtatctcgttctggtctccattcttccagtccacctcaccccattacagctaattcttttacattaaactacagcagatatttgttgatgtggaaactgatttggtattggaattttatccttgtttacatttttctttgtgttggaaaagcttgggatcacttccaaaacctgctcagagagctttcctcttttaggagaaacaaatgaacacttgacaaagccgtgtgtctgtgacaaaaactctaggccactcttttaattgtaagattgcatattttaccttaattttgttttattatattaatatattttaattaaaaattaaaaaaaatttgggccacaccacacagcatgtgggatcttagttccctgaacagggattgaactcatgccccctgcattggaagcaaagagtcctaaccactggaccaccagggaagtcccattaatacatttaaaagtatattttggccagtgttcattcaggtctcttaatttcaagatatgttattggactttcaattctttttgcttataaggaaatgaaatcaaggctggggatggtgttctacaatgtagtctcaacttttaaggtatgttagaatcttctggaaaagtgttagttgctcagttgtctccaactctttgcaacctcatcgactacagcccaccaggctcctttgtccaagggattttccaggcaagaatactggagtgggttgccatttccttctccaggggatctgcccaaccgagggatccctacctaagtctcctgaattgcaggcagattctttcccatctgagccaccagggaagcattttctggagggtttgttagaacagaaatctaggtctcacacccagactttctctggagtgatgcctgagaatctgcatttccaacacgttctcaggcaatgttgacacacctggtcctgggatgacactttgaaaacaactggttatatgtttaaatgggccccaggtgacctgaagcggagcagttattgatcagttcaaattcttatctgaatgtgtaaggtggagagtactgaaaaataaacttccaaagttcagtccatgcagttaggatgactgctggtgccagaggtcttttcaactccatactagaactcaga

SEQ ID NO: 59314 - DNA, 1445 bp, Bovine  19866880753305
atggttggtgtcatctgcatatctgaggttattatctgcatatctgaggttattgatatttctcccagcaattcttgatttcagcttgtgcttcatccagcccggcattttgaatgatgtactctgcatataagttaaataagcagggtgaccaatatacagccttgatgtactcctttgccaacttggaaccagtccgttgttccatgtccggttcttcctcagtattacaatgggggaaataatagtaccacccctcatagagcagttgtgagtattaaaaatgtgatgcatgagaagtgctttaattcagtggcagacatgcagaaactgctcaacaaatggtgtgtattgaagagtggcatatataagcagactgtccgagaaagagagacagtatgcaataaacacattcctctagagagggatgagtgtactaagctataggagttcgaagaaaacaaaggcttctttctgcccttagaaaacaccccagtctcctggaagagacaaagcagtaaacaaacaactctaatgtgatgtgacagagcttgagcagatgtctgcttatacttgtcaaaggatttttactcagcactgcccctgacactgttgctgttggatgaatattagtttctatcccactagagaatcacaatgcctagtacattctccttgcagtgagtggaagattagtagagtgtccctgagtatctggatttggttggtcccgttgccaaaaactaccacttaaggatccaagatgtgtcttccctctctatgcgtagactcagaggggcttcagatcctcagatgcttcaccttggaagacccggggctcagcagcatcttagaaagcacacaggagccagctacctgccccaagcctataggagattaatgacgccatgtctaaaaagagtgtaaattattaagtagaacattaaatatgccagttttaagtgactgaattcactgaagtcagactttaccattttaaattgttattattgggaatacatatctttagtaagcacatttccaaatagcagtgatgatagaaatgcaacaagcattattcttcgtatgatttcaagacatttccatcccatcatctccctaacctccaaaatatactacggtctacgatgagttacagaagctctctgagctattgttttgctaactaaagtcaagaaaacttagatttttagaaaacatttatagagtaatggcagtaccttgagtgtcacaaaacaagagagggtatcattattaaatagcataaaattaaagttaatcaaatagggaaaaaatcaaagttggactgattcctcacagctaaccaggataaattctaagtagatataatatctaaatgtttaaaatgaaaccatcttgtccttttagaagaagctaaaagcgagttattcatcatcaagtag

SEQ ID NO: 59315 - DNA, 2085 bp, Bovine  19866880761178
tggaagatgtgctctgttctgagtcctcggatccaggacctcactcaggagggagacatctgagtcacggatgtgcgagttgcagaatccagcctctgtctgtgaggacgaagatgtgctaggtgctcactgttcctccagcgttctctttctcttttccttctctcctcctttttccccatccttcctcgggtgcgaccatgattctgtgccctggcggaggaggctgacgggaaggaagctattgcacagtggcttccagcacaaaggcctttctgttcttcccactctccccctcaggctgcttggtggcgtctatgaccctgctcacctgtgaccgtgctgctcacgaggcagtttctcatgcctccccccaggtttctgagcttgggacctgggtgagacccaggtcatctcttcctccccctgggagtaccatgcccctgcaaggaggccacgtgccccagatctcaccgtgggagccaggctgacccactgatcgagtttagaaccatcccagaggctcgccacctaaacagagggagtttcactctctccagtgttctttctgttgcactaattttctttcctcactcctcatggtaaaatatacattggactgacgttgaagctaaaactccaatactttggccaccagatgcgaagaactgactcatttgaaaagaccctgatgttgggaaagattgaaggcaggagaagggacgacagaagatgagatggttggatggcatcactgactcaatgaacatgagtttgagtaaactccaggagttggtgatggacaggaggccttggcgtgctgcagtccatagggctgcaaagagtcggacacgactgagcgactgaactgaacagtagaaaagaatctgcctgtcaatgcaggagatacaggttcaattcttgagttgggacgatcccctggagaaggaaatggtaaccctactccactattcttgcctgggaaatcccatggacaggggagcctggcaggctaccgtccatagggtcacaaaagaatcgaacacgacttagtgactaaacaataacaactatccaatataatattgaattgatcaaaaatttcattccataacatcttacggaaaatcccgaatgaaaacttaagccaatctagtactttctagggcggcaactaactacagagtagtcaacagctgaaactctagagtcagacagactcagttcaaatcctagctatgccacttaaggccatgcaaccttggacaagttttctgtttttcagtttccttatccatcaaatgggaatagtaggtaattacatgaaagaaatgagattatacatgtaaagatctgaggagaatgcatttaataaatgctcactattaacattattgcatctgtatatattttaatttgtacaatattgtctcactgatcacacaaaaaatacatgaaagtgctttgaaaatcttaaagcatcatataaattaaaggtgtcattggtaataatctcctatgactatttctcaactcttccatctccttgaagaccgggactacatccttcgtccaagggcatattgcacaatgacaggcaaatgacaagccctcagtaaatgtttcttatttgactgaagctacatggcatcgcaaaaagagcataggtatctggagactaggctgggataaaatgagtttaaggcaggagaaccagtctgcagtcatcattcactcagtcaacaaatacttgttgaacacattctacgtgctagatattgagtccagataatttcatcaaaaagggttttacaggttcccaccagccaagtccctgggcggtctccacagtcccagcctactctaaaagcacaaaggcgcagccagctttgtacaccactggacaagtggcccattgctctgggggaagccccatcctgcctggctgtaagcaactcggactgagggttgggggagggagtaaaagtgagggattgggctgcttccaacagaagtgacagggactgctgcctgttcatttatttttattcacacttaacttcgtccacagttcagtctcccagt

SEQ ID NO: 59316 - DNA, 1769 bp, Bovine  19866880766137
aaatagcgttggttttgttggcatgggaccaaggcctgaacagcttagattagtataaagaagattcaaatatatgtctttcacatatgcttaagaaactgagctgaaggaagagaaaaaagcagcacatgccatctgtttaggaggtatgaaagctccagagagagtttgaaaagaaagggaagcttcagtcttctaagaccaagaggcagtgagaaaggcagaaacacaaagaaagagaaacaaggtcaggtccaagggcagatacagagcctgaggcccataacgtcagcaggagcactgtgccttctgctgtgcatcacaccaaattcttcccagcaaaataatccatgaacatctctaagaaatcttgcaatgcatctcatctcagtaacagctcagtaatgagctattacattagtgataagatcacccataggattcactgtcctatgtccagtgctggccaaaggaccagtgaagccaactgtgtagcagaaacaccgtggctcagtcttcattctcccctgtgaaatccatgagcaagcaatacattcaaggaccacctacaggtgagcagtccaaatactatttttacctgaataggtgctcaatttcttagtgcagagttctcttgcaaaaacaagtggagcaaagtaaaagccaatagtaaaggctagatgagccttaccctctccaacacatacccaaatctcgctctctgtcctgccatcagttcagttcagtcactcagtcgtgtccgactctgtgtgactccatggactgcagcacgccaggccttcttgtccatcaccaactcccagagtttactcagacttacatccattgtgtcggtgatgccatccaaccatctcatcctctgtcgtccccttctcctcccaccttcaatctttcccagcatcagggtctttttcaatgagtcagttctacacatcaggtagccaaagtattggagtttcagcttcagcatcagtccttccaatgcatattcaggactgatttcctttaggatagactggttagatctcctttcagtccaagggactctcaagagtcttctccaagaccacaattcaaaagcatcaattcttcggcacttagctttctttatagtccagctctcacatacatacatacatcacagctggaaataccatagctttgactagatgaacctttgttggcaaagtaatgtctctgccttttaatatggtatctaggttgttcatagctttgcttccaaggagcaaacatcctttaatttcatggctgcacctatcatctgcagtgatttgggagcccagaaaaatagtctgtcactgtttccattgtttctccatgtatttgccatgaagtgatgagactggataccatgatcttaaaagttttctgaatgctgagttgtaagccaactttttcactctccactttcactttcatcaagagactctttagttctttgctttctgccataaaggtgatgtcatctgcatatctgaggttattgacacttctcccagcaatcttgattccagcatgttcttcatccactccagcatttctcattatgtactcagcatataagttaaataagcagggtgacaatatacagccgtgacatactcctttcccaatttggaaccagtctgttgttccatatccagttctaattttgcttcttgacctgcatacagatttctcaggagtcaggtcaagtggtgtggtattcccccctctttaagattttt

SEQ ID NO: 59317 - DNA, 1445 bp, Bovine  19866881021867
tgatacaaatgtaaatgaattagtaattgagcaaatatgatactgcaatattttagaagctatttagcatgatctatagtacagtatctagaaactgactactactgaaaccttgctcaattaatggttttcatttgcactgtccccatgctaggccagatctctatcaaatctaaattactgtcacaatctcttaagctgttctccatacctttaggttctctcttccccaattcatcccaaatgtggctgaccaggctaacttttctaaaactgggctttcattgtgttttgtagctgctcatacgcttcagctctctgttacctatcaaatgggataatatatgtcaaagtcctttgtatgtggtcagtgttaaaacaaaatctaaactctatttaatttcaaataatctgcacaactgaagtcattcagaaaggcagtacggtttagcaaaaagattcttggaggcagaagatgcaggttttaccatctcatctgtaggactaaaagcacctatctgatgggtggaaaacaaatcttagaagcattctgtaaacttcagagtattctgcaaataaactagtgtctgatcgttcccacatgggttcgttgctctcagtctctaccattttcactcagcatcaggttatttcctctgcccacagctcagttcaattgttaccacgtctatttctaaactccaaaatcacacccccttttggaagatcccatgtattcaaaaatatatacttattagagttcctttaattttcccatatatttaatttcaccttcctacctatagcaagaaatgtatcttctatgggtcacagttgactggtattgtttagggattctaattctaaataactggttgaccaaagaaagatattacttaaaagataatgaaacaaatgaaatgcaagcataatcctcactaaatggcataccacttagggagacactttttacagacaagaatgttttcttcagatattaccttgttgaagagtatagacatgaagaagagatccaagagcatggtctctgaaaaagcttcatagtcgattttgaaaaagagcacagtaaagatgactgtgacatactgataggtaggactgctaaaagaggaccgcagcaacttcagaccagcaatggtgatcattaaagcacctaatctacagtacagagaaagaacgttaatcaactaataactgaaaactctagataattatgaacttcagaaaaattaccatttcatttactaagctcagaatattatatcaaatttaaacttcaaacattcctttttaataatgtgtcatgattctgatcctttatataaataagcatgcttaaaaaataagtaacaaaaaacccccacacacacacaaataagtgacaatattgcaattttgacattggttctccaggttctcagtat

SEQ ID NO: 59318 - DNA, 1003 bp, Bovine  19866881117115
cagaaccccaagtaatctgcctggggcaatataagtatacacaaactgcaacttataaaggagttcccaaagctgtaggaggaaaaaaaaacagcaaaaagctttttatcagacttttaaaatagaaaatgaaaaacttctaaaatgattttgaaatgaaatgaccctgccaaaacaccacacatgtttttaagtaaagatggttaactgacttatggattattattattttttattctatgctctctactggttatattacaactacaaacaaaaaaaaaaaggtaggaaatatagatgtctgtaaaacttacgcaataaatacgtatttttattctaatacatttccctcaaattttggtgctttgggaactgagcatgttttaaaggcaatgtcaaaaggaatttgaaagcagccaggaaggggataagatgtaatacagttgtcactgcctatttgcctaagaattttattagtgtgtatcaggcatctgttcataatcagaactattactgccaatggaaacataatgtacatttccatcttatttaaattaggatctgttttgctgttgaatatgtcttcaacactgaaacataattattgcctttgcctaaggttgcctctgcatgctaggcaacacaagagcccattcttagaacagattacagaatctcaaaagcaagaggttctgacttactcaatgccatgattcaggcaccaaacacctcaaatttaaattatttagctgatttacaaatgaacttgtttaatttctaagttaaaaaagaaatcacaacctcaaccaatcagaaaatgcagatgaacccctgcattctctgccatgactcaaaattgtgctgacaatcctctgcactaatgcgatcaggatgacgggaagacttatcagaaaccattacaactgcttaaaaacagtgactcagaacactcctccatctctaaatacagactgtactcaaatctgactgtaatattaaagaa

SEQ ID NO: 59319 - DNA, 1362 bp, Bovine  19866881166038
aagacttgtatgcacacactgtgataataaagctgaacctgaagatcaggcatttgagatataaacatttatgggaatatttttaagtccctgcttttaaaaaaaactgtaaaactcattttgaccttgggggcctagagtgttggacctgggatgatccctaagagatcatgatcatcggttcatcttcctttttttttttagatgcctggagtggggaagagatacactcaagggcattcaaagtacaaagcctatgtttttggttcaacacacctgtaggaagctgctatctggtgtctatggctgctctaggctttgggatgtagaggttaaaaaaaaaaaaaaaaaaggaaccactgctcttaacatagtcgcacatgttcagatgtccagatcagtccttgttccattttttccctcattctgaatagactccttgagaaataggaaactatatgtagcagcacatacctaagagattaggaaaaaataaaggaatatttccctatgtccctagtcatgagccctactcccaagcagagtcctatactgagtctcgcagagtcctacactgagtctcacagagtcaattagttctgcctctttcagcttcatcttcttgcctctcattccatcacagaagctcatctcttactattcatgtataacatctgtgtggacagccccagctgggtgacatttcaatttatcacagtcttcccgtttggtggcagattagggaatatcttttggagaatgtgttctccaaaatacctactttctttctttcctttttttttttttaaataagagaattgtcagcccactaaggaggaaaatcgtgctgtgtgatgttgctccgccaatgtggaaatgctaactctggtcctgggatctctcctggtgctgttgccaggcagacttgttactgacacacatttcctccccgataagttgagttcttccccctccccaccaacttcattatgcctgcagccggagctcggctgcagagggaaccctgccagacactctgattcacactcctaaaatatcagcctgcctgggtatgcgagtgatgtgataaatctggaaaacataaatcagattgttggatgctatatctgttcgtgcacacaggctgctgcagcaggcacgatgacatgcccgcaaactctctgggggacagaggggacagagcctccagacctgggaaaggtgagcaaggagggcaggatctgacaagcagaagaggccttaaaactgttgacttatatcccagacaccagacgtggagttcaggctcaaagattgctgggagtggctggaaaatgacgcctaaggaatggccctgatgtt

SEQ ID NO: 59320 - DNA, 852 bp, Bovine  19866881170657
tcgggaagagcagtactctatccagctgaggtaaatcacccacctttgctcttcgggaagagcagtactctatccaggtgaggtaaatcacacagaaactctccctggatatgcctgccagtcgatggtcatagtcttcatcaatgtttggattaaatgttggatccacatcaacataatttcgatctgcacacagacgcagtccttcctgcatcgtctcattagctagccattcctctagtttagaagaggttgtaacataataaatgataccctaatgagaaaaaagatttaaaaaaaaacacctcaggctaaatcacaatctgaattaacaccaatatctcattaaattgtttatactgataatatgaatcaaagtaacattagtttactaactttaaaatagtctaaaaacaattccaatctactgaatttatgatctcttaagaggtgaaaaacctttactgtggtgcatttattttgagaaatttctcacagaactattaagctatcttgtgatcctacgtcaacttataaaaatataactaataaagcaatagaaacacatatttagagataggaaaggccacacacacatacgttattaataaaaatgttgtaaattcaatctcttttagcttcctgaggttgggtttaaccaaatattaattaaacagaagattcagacttcaatccaaccaatcaatgcaaataagttggtacacataagtagtaacacatgaatcatgaagatttagcatatgttttcctcttgaaaatgctggctttgcctataaacctctagcgataaccatgttgtatattctggaaatttttagcaaaaaacaggat

SEQ ID NO: 59321 - DNA, 2098 bp, Bovine  19866881236725
cccactcctccctccacgacgtcacagggggtgggtgggtttccatgtgtgcccttcacctgcagagccatttttagaccttgttttctatcgaccagaaaactgctgaaattagaagacatttgaagtggctcttcatcaagcccgaggagatttctgcggttgctatatttgaaagcccggcagcaggttgtttgggcttacgtcctgctgttatgtaataaacataatgttaagctttggaagcctggaacacgggttgggagggaggagaccagtagcctcacaatgctgtgtgccctgcagatgctttgtagaggttggggagaagataatacagtttctgcgttaaatggtgttaaaataacaatgtgtgcacagcagacttgaattactatgtaaattcccagaggaaacagtagggggggaaagacagaagcaagaaaagaggttgtgtattaatatatgggaaaatgtaatcaacagccaaatagaagctgtttttagtaagataaagagactcagagatgtgggctgatccgcagagaggagattgtattggttttccaggacttgtcactgattaccatatatgtagtggctgaaaacactatgaatttataatcacagcattctaaatcagaaatctgatcatggtatggctgggttctctgattaggacctcatgaggtgaaatcaaagtgtcctccaggctgggacctcacttgaagtgtgaggtcctcttccaagctcacatagctttaggcagaacttagttacttttcggtgtagggttaagggtccccttttcttttcagctgttgctgggagctgttcttagctcttagaagcctcctacatttcctcaccatgtgatcccttccatgaaagttgctcagtcatgtctgactctttgcgaccccatggactgtacaatccatggaattctccaggccagaataatggattgggttgccatgccctcctgcaggggatcttcccaacccaggaatcgaacccaggtctcctgcaatgcaggcagattttttaccagctgagccaccagggaagccctacaggaagctggtcctgctgaaaagtgatgttcttcctgaccaaaaaccgggacagacatatagatagatccaaggttgcatcaacctaggaggtttgcctccctgtaaatcctccaccttcctcagctgaactgtctgctctgactggttcatattttggggggctcacttcacttttcaagtccttgaaaactcacaggaatgagctacactgggtaagagagccccaaaatctgagtggcaagaggtttccagactcttgaggtgaacactcttgcgcacatcctcaggtcacagagctgggccctctacctcctcctaccagcaaggtgaggagcagaggacacaatcattccctcctttcatttcatactaatgagacaggagggaagggggtggggcataaccattaaaaaacatgatatacccattgaggacatgacaaaaactggtgggaacctcctaggtccaagatggcggaagattcaacttcctgtagaccttgagcctcactgtacactcattataatatattcagatcagatcagatcagatcagtagctcagtcgtgtctgactctttgccaccccatgaatcacagcacaccaggcctccctgtccatcatcagctcccggagttcactgagactcacgtccatagagtcagtgatgccatccagccatctcatcctctgtcatctccttctcctcctgcccccaatccctcccagcatcagagtcttctccagtgagtcaactctttgcacgaagtggccaaagtactggagtttcagctttagcatcattccttccaaagaaatcccagggctgatctccttcacaatggactggttggatctccttgcagtccaacggactctcaagagtcttctccaacaccacagttcaaaaccatcaattcttcggcactcagccttcttcatagtccaactctcacatccatacatgaccacaggaaaaaccatagcctgactagacggacctttgtggcaaagtaatgt

SEQ ID NO: 59322 - DNA, 1503 bp, Bovine  19866881245501
tagcaatacgtaaagttgaatattttaccatcttatttggaagcatggaatttaagagctggaatgaatctttgaggtaggcaggcatcacctactaaaataagggaagagaactttgggttcatttttgcatacctctcacctcctaatgtagctttcatattgttggcctgaaaaacaacagaaaaagccctggttgctaaacctgggaatgaggcgagggtcaggagcatcagcgagaattccatccagtctgagcgtgtttccctttcatagcaagattgcaattcctgtctgtcagagaaggggcagaggtaaccgtgcagatctgcacagagggagaattcttcccagggagcagctgcagccgcctggttccacaaagcacacgctgaagagaagcaaccttccaaggaaatagagttgaagtcaatccagacttaatggcgggggaacattgagtcagttcagacagactgaggagttatagcagtcagctaaaacatctggtctgagtaagcagatgtggtagcagtagaacccagaagggaaactcaaaccaaaaaggatgagaaaccaaagtcctgagatcacccaagtgaggtatgagatgagaggagaaatcacaaggacattttcctaagtcctgccaaggttgtgtagttgcagggagacccctagtcttaaccactcagaagtgtgagctgtaatggagaaggcaggactcaccatcaaacctgaggacaaggggaagttgaattctggagactgagaagagaagctagaggcaacctgggagaatggaggaaagggaagggtcaaggcagcagattcagaacaaagacagcgacccttaaatttctggagttcttttatgtgatgcttgatccatggctagggtgaccatttaaaggaactacatcaaagtttggacaaataaaaggactcacacaggattatgacagaattatttcctttagacaatgtccttaaatattagaagttaataccagaaccacaactgtatgtatctatcttcattttattttggctacagcaatgttaccccaaaactgggtccatctcttggtgggtgtcatgccaagagacaaaacagagccaagatttggagaaggaagaaatttattattcacagcaagtaagaagaacaccagggaagttttaagctaagggtacatgcatgtttggggcttcctgggcactcagtggtaaagaatctgcctgcaatgcaggaaccgcaggacatgtgggttcaattcctggatcagggagatcccctggaagagggcatggaaacccactcttgtattcttgcctggagagtcccatggacagaggagcctgataggctatagtccatagggtcacaaagagtcagacacaactgaagcaactgagcatacacgctcacacccttgcatattgatcaaggggcttgagcagagaattcaacattaactcggacaaaggtgacagagtcca

SEQ ID NO: 59323 - DNA, 747 bp, Bovine  19866881584569
ataacagcctttagtttctaagttaagctctacggtcactagatggacagaagggacgggggtgactccagtgcagcagggtgctgatatcatcttgagctaactcttgtaaccatctttaggattcctcctggagtgactcctacttcacctcctcttccagttactggtcatgcagaactggccacagtctacccagtgctgacagaaaggtcaaacagtctccagttttgttccagccaggggtcactcaccttccatgagtttggcaaaaggttccgggcatgtagaaggaatgggaagggcaagcttgttcatggccactccataagcaactgctaagccatcgattccccggaagggcacctcaccagtcaggagctcccaaagcagcaccccatagctagggagaggaagaagacagaagtcacacaatgaaccacagctgtaacttcactgaaatagctaatgaggctttgacgagcatcccacatcttctctaacatgtagggagactaacagaacagacatactgccgtaatataaaagggaggccaagccctactggctataagcaaaaagccctactggctataagcaaaaactctggagtcaatcatactcggtttcaaagtcttattcttcaaattcctcatctgtgaagtgcgaaggacatgagcagttggacaaggctatcatgaaatgaatgctctattgtttaaatcatgctcaagggccacagctatt

SEQ ID NO: 59324 - DNA, 1246 bp, Bovine  19866880508944
actttttgaaactatgaaatgacatgaaaacattcttacaaacatttaagaatttgaatttgaacaatattttcctcagcaaataccctttttataactacatcatttttgcttttataaatgagtagtttacagtgatactgctctatattttatgcacactaaaattttatggattaaaatgtgaaattgcttttaatatttgtgtttacaagtcgttttgtgtcttttgtcaacaagggttgcctgtttagttggaaagtgccattgccctagagtgctgtattttgaagtcatctgtcacaaatacaatgtagagagagaagactatttatgtttatggcattttaagtaactgagttaaaccctttggaatatagagaaatggcttatttactgtcatcactgttcacttaatcttgtgaccctgacatgatagcattcccataaatctcccatgtggtagttcaataaaacagatgaacatcaaaatgtaatgattgtttcagctttaggaattaactctgtgatggaataaatgtggcccagatagtgatactacagatgcattttaccattccctttttctaataagtaatgctagaaaataattatttattgtaatttgtactctattttcagatagtattttcagtatctaatactcattaagaaaaaaagaaaataaatgcaaataatatacatattgtgactattttttaaagtttcattttttggcattttaagattattaatgttaatataataaggttggtttttacaaggatgttttaatatagctttgtcctatactgtgttttcattgtatcacatccttgtgttagtttttttctgtatgcactttttttaatatttgagattatatggtttctcaaacataaagtcttaatgtctgtttatctgtttgttttatcccacttttttgtaaacaactagtgaggcattctgaaaaacaacaaaaacaaaaattgagggtattgagtcattcaagaaggaaaaaaaaagtgtggccctaggataattagtggaagaaactaaaagtctatacctgagaccatctccacaaccagaagaaaacccagcgtttgttcaacattttgtgaaagtaaatgttattaatactcttattgcaatgatcttagtttacatttgtctcctaccaacttcatatgtaaaaaactttttgtcagttttgtttggcatggtaaaacctttaatcctctgt

SEQ ID NO: 59325 - DNA, 2530 bp, Bovine  19866880520141
tatgagtcatataattataaaaaagttttatacatctaaaatacacatataatgagttcacattcattattacaaagtaaaaatccttcatggaaggtatatgagcataatcctttcaactatctctcgatttagactaccaaagtcatgtcttccagagaaataatccttcagtaacctaagaaggattaattcattttccaatttatctttttgtacagggactcaccaattagtacaatgatctgtctccataatgaggttaatatttcattagctcattggagagtaaaattaaattttcatttttcttccttaacaattacaatggttagccaaaaaacttaactgttaagtacccatctcaaattaaatatactttttttcctaattacaggcttatatgggagatatagaatttcctcaagaagtcctagtataacatgttatggctttacaaaatctattacaatttaaaagtggaatatgtttggtaaactacacatgcacacagatacacacacatcaatgcactttattaatatagctttaacctaaaaggaacaaatagaaaatttgggttaaaaaaaacaatgcacgttcattaagtaacaatgataatactctcaaaatttggtttacatcagtattttatgtgtacacaatctaaaaacactgagttgttcacattccattcacagcatctatacctcctttagctgtgtgtccttaatcagagagatctcattttcaccaagatggtgaaaatggtattaagggtgtgtgaaaacaatcttactctttaaatgtataaagcacgcatacacagtacacaaacaaataaacagcatattggctataattataataaatcatggtaggggctgattagggtgacaactatttaaaaattttccttagggggacaataatgtacaaaggttgtaaaacatcactcttagcttagtatcatcttggttaaatatatgttagagcttgtaattaaaatctgatggcttgaaaatgtatcttaaatgctttcacatgtcaaatattgatctgcttatatccccacaaaataacttgcttttcttagtagaaatatgatcaactcaaaactgattctgcagggaattcagttaatattctaaaccttattactaaaagaggtcaaaagtcaactgaacattgctattttgtctagagttctgacatatcttatacctaaacatgttattcaaagcagataacttaatcttttctcatcatccagattagagtatgatacctgatttgtaaagattcgatgttatttatggttggaaagatacaaaacttcattctgacaaacacttaactgttgatgtatttttattagaatttatatttttttcagataagactgctacaatcccatatgacaggtgtgtggtgtgtcatttgacaaatgaagtggatattatggttattataacaaaacagttatttctgccttattttcagcgaggtagatcagagatctctagacctatatcaacctgcatgactaagagagctgctttattgagataaaaacctcaaaactggaaatatgggttctagcttccagttgcacgacacttgttcatatgctgtatcaggagcataaattggtggacttaggtattattttcaaggccaacctaagtctaacaccaggtcacctaaatatttctgaaaataagtttattgaatcagggtaatatgtcaaataattattgacatgctagaaatataagaataatatttatttaaaaaactattagtatgtactatgtactacttggaataccttaaatttttgaatataaaatagaaatgatagtttgttctttatgcaaattataatttgtgcttatgaagattttaaactattatgtttccatatatacatacagatctacatatacatcatatataataggattgcttcatttgttaataaagtataaattataaaaataaaatatgaactaaaatgatctttggccactctaaatagagatgaatacattattaaataataaattagagaagagtaaaactgtttcttcacataaccactattacacccatatctaatggtgtgtaaactatgcttaaaaattactaaaggaattgcactgtaaaactgtatgtgcctttaagaataagttagaacaacctcagtctatcaagtggttaagcataatgctagagtagtcttttcatattgcaaatgaggtaataagaaataagtgtcctgtctgacatttactaaagcttttaaaaacaactgaaatgccttcagtgaaactttcgtctcgaaaaaaaaaaacttatgtaaggttaccattggtgacaactgacttgtaagagaaaagcagaatttaattcactcccaaaaccttacctcaaactctgcatgtttatgtacatcctcagctctctgtctgttcaaaataaactcagcttcatttgcaacacgaactatatggtccttcatagcagg

SEQ ID NO: 59326 - DNA, 1259 bp, Bovine  19866880721103
ttttaaatggttgaaacacagaaactggagtgtaggataacatttaacttgtcaagtaagaagttaaaagtaagattatactacaaagaaataccacgtttatatactcaaaataaatacagcatgcaacaataaggaattaaacacaatctgtatttccacacagaaacaaaaagtaaatgagatatgatatgagtatggaaaacaaaatgcagagatttgaccactaatttctactcgttttttaaaatattcaataaatgtatatatcatatgcatttatttaggaaggataatttccattacaaactaatctagtggtacatgaaataatcactgggctgctaaggcaacactgcaaacaatagagaaacaaccttgaggtaaacactggcaggaaatgcaatagacaaaaggcgtcctgtgatattaaaatattagttgccaaaaatgtatctatcatttccaagcagcgtaaacaaagctaataatacatgaactcctacaacataagcatcttctatagatgagaaagataacatgacccaaaacggttcactgctgtctagaaatttctgactttagtcgatgcaactttggtataaaattcagaatgtatgtttgtttatgatacatctcctggctgaatatttagctactgaattaactacacatattgaaagaaagaaaggcagatggaaagaaagaaagatgctactgagcttggctacaaagatttctagtttggcttactgttggttttgaactactctataaggacctcctactttcatatgtttataaaggttaaaaataatacatttaaaatatatgagttatttgtatattaagtagtagcataaatgttttatgctaataaacagaaaaactaaacccaaaaccttgataaaatgagaatatagccaatatcattctacatttttgtgtaattaaacaagattaaattggcatttatatactgcctacttataaatacttgagatgattatgaatagaaccagtttaaatctagatgtaaaaattaaataaaaaggagataaatgatgatgaaaattcaaataattagacaaatattaagtacctgtacttgttggtgaatttatttcttgtctgatgtttctacctggttggcttccagttcttgcagtctctcgctggggttctaaaatgtcacgatacttggaaaccatcagaaccgaaagaagtaaacaacagctagagctaagaactgtgcctgc

SEQ ID NO: 59327 - DNA, 725 bp, Bovine  19866880877938
aatttgaactgggagttccaaatcaaaaaaatatcatatttaaatggttgggatgtagttatagtaaagacatattgctttgtttatctggcctatatttgttgatgcccactatatccaggcacatgttagattctttgcatacacttttagcacatttgcatggaaatgcaacatttttcttaacatttgctaatactgtaaaatgaaacatgcataaaatgttttctcttggttgttaaatatcagttttaatttgtccttgtgggaatgaagataaaaatctttacgtggaaattgttataaatgtttatgctacttaacatctacactcgtgaataaaattcatcaatcataggtggagaaagcaattgtgcagttgtctacaattaacaggacaaaaacagttgatgaatgtgcagctgaattaaaatactccctaggacaggctgaaattataaactggatcatttaaaggaatctaacaaaggatctttataattaaaacaaagcaaggttaatgggatgtaaaattgcctataatatcttggcaataataattggattttaaattattaaaatatgaattgaactataaagcaaataagaaagacttttaaattatagaacttgagtaatcttttgaaataaattaatcatttgcctaaaataaacctttatcactcttttgggaaatgtataggatacaattaatgaatattcat

SEQ ID NO: 59328 - DNA, 1086 bp, Bovine  19866880915023
actttcatccctgctgagaatcactacactaaactaagtgctgtgaggaggtagaaactgtgtctcagcctctgaaccttgtacgtcgtgcatgcatggcacgtggaagatacctgataaatgctttcaaatgaatgaagctaccatcttgagtcagtttaaagccttccatctaaagcttcaacataaaaacaggggagttgttaaaaccttggttgtcatgaaaatgttcttatatgaaaactttaaaacgcattttataaacatattttataagacagcatttaaataatccattttagttcttttaagagactataaaaccatgaggtaaagatgagattatattaaaatgtgcactgacatcaaaaagagctgaaagatgattccatgtatgtctttctttcactcatacaaaagttacatcattaatttttcaataaattattttaataataatcagatcatctatttcattcaggtatgaagatttaattaataatataccaactaaaatgaacttatcaatgaacaattataagatgtctgctagagacaatatggtacaaacaatcgagaccactaggttaaaaactcaaataatcttttccgactaagtgtaaagtcttcaaaaaattgaagtaaaaaaaaatgaagtcagataatttgaagttcctgtctcaacaaccgtatatagctgcattagtattctttaaattctcagtgcttttcttgtttcttgaatattgcaagtagcactttacagtagtcatgcatataccatcaaaactaatttaattccagatttattacagagctgctttttcttcatcaaggtcatatcatgatggcttcacaagcttggataaaccaggtgctaagtggacacatctctgaggaacctaaggatgttctcatttgcagttctcagcatatcttattatttattgccaaagaaatgactgattaactttgtcatctttgctccaagtttttttttttcctctggctaaagcagcctgccgtcctctgcgatgacagataagacctatttaggatgatgtctttgatcacagacttggggga

SEQ ID NO: 59329 - DNA, 1443 bp, Bovine  19866881071161
tgcctaggaaatccagtacgtgttgaatgaattgaagtgtgatagtggacatacttgtctttgttcttaatggcaagggaaaggctttaaatattttgccataatcataatatttgccatagggtgcattgtttgctttttgtagatattctttatcaagtaaaaggaacttcttttcccttcccttccctttccatactggtttgttaaaaactttttatcctaataggtaaataattttgtcagtgttttttcctgatttattatagtgcccatatgatttttcttctttttcttctattaatgcagtgattcagttgattggtgttataatgttaagcttatataccaaaggttgattgttaagctggttaatggctttttcagactagcaacttctcaagagtttaagtgcctggcagtgtgctaggacatggattggtgttttgttagctaactggtagttaaattaatatgtcatttgggagaatatatacattcttccatccaaattaataaatgttaaacaactatgcagtgatatgacacacagcaggccactgtgctatgtactgtgtggaatacaaagatatgtaagtctcagtctcagctccaaggagctgtaatctagtttgtgagatcataccgattcttaggtaattgtaatgttaacataaagcaatatttaataacagttaagtgaagcatcgattagattgtatattttataaagaaatggatgaatgttcatctttgcagtcccaagaaatagcacagaattgaaaaagccaggcttgtttcattacagtaaatgatccagaataaagtacaaaactgttagtagttaaagataagactccaagagagttcagattcaatcaaggaagatctttaatgcccagtgaaagattagacctggatgtgaaggcaactcaattttaccagataagaaaataagtcttgagaggtcatgacctgcctgtggtgatacaacatcagaactcgagttcatgagaagaaaaaatgtaatcgtcttgatccttaatgaaattttccaccccttccaaactagtttatttgactaattattacagtggtgtgactttatattcataagaatagtttgtttcttgtcttttttaattgtattcttctatgtctaattatatataatgccatatataatgctcagttgtaaaatcaaattgatgagaagtgggagggggaaagcaattattctttagccatgacagatataataggcattcatgtcatatgatactgaatgttaaaacgaggtcacagggcactagagaaaaggaaacaggcaatatagtacctctgggtgatgaatgtgacgggaaacatcttatgggtgtactggccaggatatttatcatttagtactaaaactcctggtgacatgataacagggtttttcta

SEQ ID NO: 59330 - DNA, 912 bp, Bovine  19866881261170
cccctctcccaaatgaaaattgctaaacattttaaactttgttcctttaaggtataagtacctgtgtgataaatcatttaactaaaatatattttgttacatatttttggaacagatggcaggaaagagcagtcacccagtggaataaaatgtacactgactagttgtctaaatactgtacaattaattaccttccttcattgatgagctcaataaatgcaagtcctgcattcttctgaatagaattttgccattcctaaaaggagagagcagaccacgtgtaagaaaaatgagcacgtaaatgaaagttaacatctggtttaaggatcatgttgatgctaataacttccatgtgatatttctaaatctttctaaaagattgttaacaaatgctattttctgagaaatgagaattttaaaagcaatcctttactgtttagttaaaaggcgcttttgaattcccagtgatgcagactgagatagaaagtgaggtcacaagaacagatcctcactgtgacagtaaaatgttgcttattttacactctttttatggcatatttagaatatgttttaaagagctttttgcttattaatttattccaaggactttaattttcttggtctttctaatatagctggcaaatttagttttttagattaaagattatacccctttcaatgatactacaaataaatatttgcctaataaagttttattaaaaatccttattgatcagtcatgccacccatctataggagttttcctccatgattttctactaattaagtgttggccatgactatggctttcggaaacacagtctccatgtcactccttcactctgtttctgatcttgtttccttttaaagctttgaacacatgctgggaataagtgtggtcccccaaagtag

SEQ ID NO: 59331 - DNA, 720 bp, Bovine  19866881409082
gcaatggaaactgtgcactgaattgatacagaggagaaaacactggtgggggaaaaattatgtgcagggtccagtatttctactgtgttatctaactgccataaagtgattgtgaagagaacatggggatttcattgtcatccttctggaacctatttgtcttcaaagtgtttagtttcaaaggatccttaacttgatatccaaatctctgaaaaagtccttcatcttgaggaaatgttatgcatccatgtagaagagttaaaaaattgtgacaaacctgtctatacttgacagctctcaacacgcgttcaaacccagtttagtatgtttccccacgaggataaaaatttgatgcctacgtttaatttacaccttttcttatggctgctcattttcttcagtagtggagcaagtgagtgagtgtatgttttctcaaatggcagaaaactttggaatgattttgtagctaagatttttgagtatacttttttcctgtcattgccaagaaattgactttgttgagatgacaatgaattattattattatccttttgtatacattttcatgtattcatttactttgttttgggacagtgattaaagtgtcctttccttgcccagctacctcctattttcttaactctcagtgtactttatagtgttgtgtacttttcttgtcacaaagcttttaatatctccccttcagtattttacttaatt

SEQ ID NO: 59332 - DNA, 825 bp, Bovine  19866881547858
attctgtttgacatcaccataggggctttaggcaaagcacctagtaaggtgccagatgtactcccggagcctaaatctccaggagccatggctgcatgagaagatgaggaggaataagaggccctggaagccattcagtattgtagggcccccaggctctcctcacagccccattattgggcatacactccttgaagccatttctgtgtctcttgcactacccatctgggtgtggcactgtgttgtggagaaggttctctactaatctctctttaccctctgaagaggctttgggattcagtgggattgttcttgaaaggcggtgtagtaaattcatcatttttaggagtataaacagaagtgtcattttaggagatgagggcaaagaagtctgtcttcttacaatgcacttctgagaatagtgttgattgcctgaatgttgaggattgtgtgtgtgtgtgtgtgtgtgtatacttggtctgtaaaacactatataaatggatcttaataaatttctgctttaaaaaaaacacacatacaaacatatcatgcattagttgatgtataactcctcagtgaaaaactgggaggacagactttcagacaaccaatacagttttctctggtgtatctgaggcatgaatctctcctaccccatcccctgctctgccgccatgcctcttggctttggtcatccactgttttgttgctaagaatggtataatacctattaaccagccagaccctgagtctctcccttcctgctgtcttctgttaatctatttaaatataatctgcactaattcgcacatattagatttcttc

SEQ ID NO: 59333 - DNA, 1365 bp, Bovine  19866880567063
actaacttaaataaattacagtattaactaaagcttaacacagaacatcaatgtatagtaacaacagagatattttacaccccaagtctatacatattttcatagtaaatggtgacagtcttaaaaatatatttaaaacaaaatacatattttaaactaggaaattaggaaaatcttaaaagtgtattttgatcattggaggtattcatataataaagattttaattatgcccaagctattaaacctaagaaaaaatttactacaattaaaaaattatacaaggctttcatggaaagagtaatttttcattgaaaataggtgatacactttcctgttgcctcattttcttttattagtccagagctttttcatggcatttttcatctcagcatttctcagagtatagattagagggttcagcataggagtgataattgtgtaaaacacagtcaaggatttatcagttggtaaggtggaaggaggtctcacatacataaaaatacagggcacaaaaaagaggatcaccacggtaatgtgggaaccacaggtggacaagcctttgcgcctcccttcctgactaagattcttcagggagtgcaggatgatcccataggagatgagtaagagcatgaagatgatcacacagatcgccccatcattggcaaccactgtgaggccaataatgtaggtgtcagtgcaagcaagtttcaacaagggatacatatcacagatgaagtggtcaatgacattagggccacagaaaggaaggttgtaaacaaagagaagttgaactacagcatgtaaaaacccaccaacccaggccaggagaagaagcataacacatactcgctgattcatgatggtcaaataatgcaagggtttgcagatggccacatagcggtcataggccatgaccaccaggagcaaaatctcagcaccaccaaataagtgtcctataaaaagctgggtcatgcaagcttggaaggaaatggttttctttacataaagtaaatctatgatcatatttggcgtgactgtagtagaatacacagcatccataaatgataagtagccaagaaagaagtacatagggacatccaggcttggactgaacaccacagtcaggacaatgagtaggttgcccaccatcgtcacaatgtagatgagcaagaacaccacaaacaatattttctgaccctggacactctgagtgagtcccaagaggacaaactcagttacatttctcctttgttccatagatttttctatatgtcatatttcagaaatatttcaggacgaattagctgtaaatataattcttacacatggctgcctggaaaattaagataatgcatttacttatt

SEQ ID NO: 59334 - DNA, 1066 bp, Bovine  19866881585262
ggctgactttcttctctagagtaaatctataatgagtttaggggtattgacacaggaatagcaggcatcaataaaagagagattagccaggaaaaagtacatgggggaccccaataatgagctggtggcgatggtgaccaaggtgagcacattccctaccatagagacaatgtagacaatgagaaacaaagcaaatatgattttctgcaccttcagattctgtgtgagtcccagtagaataaattatgtcacattattccttttctccatatatctcatattatggttaattacattacatgaaaaaatgtcattttttcataatgtaaccttgaatcattgtctctgataataaatacctaagttctattgagttctgtatccttgtgagtttatttgagattaaaaaaaaaaaaaagcttctgatatcctgaaaaattactcaaattctttcctggcagaagaaaatgcttagaatcaggaggaatttagagaacacagaggcaagagggtatctctgtacactgaatcatgtgagatgacttagggccttagtagaagcagtaggtctcatgtgtagtggcgactaagcctgaaaaaagaaatagaaaatggatgcaaagactataaattcaaagttaaagagttttccttttaatcttagaaaatgagaaaccagggaaagtaattggaatactagtggaaagatgaagaagcatttgagaaagaaggaatgctggatataactcaaatagaggtctttgtgtgacttttatgaagtaggtggaggttcaggaaagtgaaggaggatagataagggaacctcacctatcagactaattgtaatagttggcataaattttaacagagcattgctgatgagaaggaaatgaaatgacacagttactataattgaatgatcaatgtgttgcctaattccagtaaatttataatgctaacaaacatacttccaatgactgacatcatcatggcagtgagtggcaacctaggtggagtagtagttatttcattattttgcacaggagttaaaaagttgtaaagacta

SEQ ID NO: 59335 - DNA, 2081 bp, Bovine  19866880236989
tgtcagactttttgggggggctcccaaatcactgcagatggtgactgcagccatgaaattaaaagacgcttactcctgggaaagaaagttatgaccaacctagatagcgtattcaaaagcaaaagtaatattactttgccaaaaaggtctgtctagtcaaggctatggttttcctgtggtcaggtatggatgtgagagttggactgtgaagaaggctgagtgccaaagaattgatgcttttgaactgtggtgttggagaagactcttgggagtcccttggactgcaaagagatccaaccagtccattctgaaggagatcagccctgggatttctttggaaggaatgatgctaaagctgaaactccagtactttggccacctcatgtgaagagttgactcattggaaaagaccctgatgatgggagagattgggggcaggaggagaaagggatgacagaggatgagatggctggatggcatcactgactcgatggacgtgagtctgagtgaactccgggagttggtgatggacagggaggcctggcgtgctgcgattcatgggattgcaaagatttggacatgactgagcgactgaactactcaactgatgtattatttttcttttgaatggtagaaagtagtttgttggataaaagttaatatggaaaacaattttaattctgataagagatatcagccaaatttaggaatatgctctgagaaaagcatgtgaagatttttcttctcatctagaagatgcttctggcctctatttcattagacagttctgaagatcccgttcccattgtcttctttgtcccatagcttctctgtcacttttcttctggtaatggagaaaaagaaatcctttattttggttgttttgctgaagagggccaggtgtctccctgtaacttcagaaaataatatttccaaagggaaaagtccttaagtactgtttatttgagacaaaatcattctctcaccttataatccatatacctaagtacttacttaagagcatgctccagtgttctaaacccatgcagatacatgatttcgtaattctataagtatatagtgtttaccagggttatggaagcaagttgcatgctatgaccattatacactaaagcttttttcttaccagtttttttcttttgagatgactagtttgtaaaatgatctcaatctgtgtttctatatattgatatatggcaatcaaataggtaaaatctaataggcttttatattgttgaggacatgaaaaatcaactacaatctatgtagtaaaatctagactgtaaaccttaggctattaatattttagcatatcaacacactaaaattatctttgatatgtatatttcttatgtatcagcataggtataccccacaaataacttagattactatttttatgttagtcattatattttttctctttttcaggtaatgcttcaaggactctacagcaatttctggtattggacatattcaaaatctcttcaactttttctatcctggtgcactgttctgctgctttaacttgcttgagatcccatcacgcattttacatggtttgcaatggttacatgaacgtttgggaagtggcatttgtaccatctcatactttattcatgatggcactttaggaaagtaatttggaaaaagcttccaaagcctcatttttaaaaaaaaatgaatcttattgtgaagcttcggagaagttttcgaacattgattgttctcttagccaccttttgcttggtgagcattgtcatctctgcctatttcctctactctggctataaacaggaaatgacacttattgagactactgcagaagcaggatgtactgatgttaaaatcctaccttaccggtcaatggagctgaagacagttaaacctattgatacatccaaaactgaccctattgtcctcctgtttgtggagagccaatactctcaacttgggcaagatattattgctatcttggagtccagccgatttcagcaccacatggtcattgccccggcaagggagatatacctcctctaacagacaaggcaaagggaaat

SEQ ID NO: 59336 - DNA, 795 bp, Bovine  19866880842512
atgttgacccagactgagaataaaaagatatccattatattttaacttttaccacaagtgttttagtatcttaaattgtcctacggtttttcgaacaaggcccactttactcctcctattcttttctcccaagatgttttgaagatcagcaaaatatttgacattttataatctaccagtatttttttttaaccaaggaggtttcctaagtgaattattttggaacagtgtctatcatccttttaaagcattcgtaagtatcatttgttataattctagattctactcatcaagtattaaaataggagcatctcaaaaaaaactgcctctcacaagtagcaaaatgcttgacgtcattgcaaagctgttctcatgagtttttctcatgcttttttctaaactttgagaattgtgtatcctggatcagtttagggtgggagtatgaaattttatatggggtatatgtatatgcgaccagtcacgttgtttctactgatggccacgctggtgttttattctgcagtatctaaaagttaaaattgcataagctataaagcaactaaataaaaaataggcacaaatcactagtgaaactgaatgaagcaaggagtattcagttgtttcattttgtgtaagattaagaatgctctgaagtaagagatctaagtaaaaggtagatatagtaaccataaaatacatgaaatctacatttaggaaataatttatcaaaaaaaaaaaactcattttcatttccataaagtgctttgtaagtcctgttcgtggcacggaattctg

SEQ ID NO: 59337 - DNA, 838 bp, Bovine  19866881319677
tcgctatgaacatcactgaataaaaaatgatatgctacttttttctgtttaaagtgaaaaatatgtctagatggagaaacagaataatctaagtactaaattgagttcaacttggtttgactgatttgaagatcttttttgtgtttattcaaaaagtgccttattccaaggaaagtggcttcacaaacagatatcaggagccatcatacttgaaatggattaataagtgtaatttttaaatgatttcctgtgtttgattttacatattacagtatgtgaaatctcaagtgcattgacataactattagtgaaagattggttgtgaaacagatgaaatttaattctggttctaattatccatttgcactttagagtaatgaatagaattgggacttttatatgcattcacaggagcatatgcatctctgcatctgtttcctttcttgtattaatctttagtgttgctatatttatatctgaggtttaaattatttttgtgtaggcgtgaaagactattcagtacatcaagaagaactcttttgagatgtctgatgaaatatgacaaattctgtggaacagcagtctacaattgaatttttgcttcaggaatggagtcaagccaaagcatcttaatgtgcaaaatagctttcccttctctctttttcttccattagtatggcagtgggcctttaggctgaatatgaatgttactatgcttaaactattaaatataaaaatgatttatgggagtttaaaataccagtataaggattatttacatttattattattttatttttgccactaagctgcatttgctgcataaaaaaaaattcca

SEQ ID NO: 59338 - DNA, 1089 bp, Bovine  19866881331640
atgggataggatagtgaaaagcattatattggcaggctacattttacccttggctgttagtaaccatgttctaatacagctggcacctcatttaatgtcttcatgcctctgtttcctcccctgaaatggtaatgattccctttttcactctctaaactatagagcttttagataattaatttatatcaactcatctgccaacctaaagcacaggaccagataatccactgatcaatttcagttctaaaattctgtgatcgttgatattggtccacaaatttgaaatgaacatcttgaaatactcatctagctacaatcgaagcaattatggaaagggattttcaaactaaaaggccaatttatattgaaaaacatccaaagtgtttaaatctcttttttattccatcctgacattactccctattccttggtttgaccttggctggcagaggtgtgctgtgcttttatcagtgaaaagcacaactgttctcacaacatttacaaaaatgattcacctaacatattaatagcttcatattgatattttaaaaattgttaaacaatcaaacaaaatggttcatttgtagattttctctgaattgtttctggatagagtttattttgtgttgcaatatgtctaaaaatcatgagaaaaacatattgcaagactgtttctttactatttcattgtgtaagaagaattattattactgtaaagcaccatcattccttaattcacacacacttaagtctgcagtgtgaatgtttgtgtgtgggggcaatgacgtatgtctatgttgaatccatgaccacatgtgtacatagtgtgtgtttgtgtgtgcatttatatatatatgcatgtttaatccatgaacatatatgccatgaggatgtgttatagaagatgttagtctattgattagcacaggcaacccaaatatggtcattgtaacgagtaaggcagtagggtgggagaaataattttgactcttcttttttttttctttttactaaatcatacattttgctgtcaacagacagaaatgcagatagaaataacacttcgaagatgacagcaaaaaattaagg

SEQ ID NO: 59339 - DNA, 1908 bp, Bovine  19866880404878
aaataaaataaagcacagcggaagattcactttttcagtcacacaagccatccttcccagtctcagtaggcgcacgtgggggtggctgctcctgcggtcggcactcctaggttaaggctgcgcgtgccctgaacacccagtgctttcagatggtctgtgctccctcctttccttcagcagccagtcaggtcactgtgtcttggctaaagtgcttgtttggattataagaaaagtgttctggggcagttctcagtggttaggacctcacgctttcactcccgagggcataattccattcctggttggggaactaagatcctgcaagccagtagtgtggccaaataaataaataaatatatagatatattctgattaaatttatataaaaatttttgaatggacctagatattattatactaagtagtaataagtcagacaaagaaaaataccatatgatatcacttatatgtggaatctaaaatatgatacaaatgaacttatttacaaaacagaaatagactcccagacttagaaaacaaacttatggttaccagtggggagaaggagttggggagagataaattaggagtgtgggattaacagatacaaactactgtatataaaatagatgaacaacaaagtcctactgtgtagcacagggaacttttattcagtatcccctagtaaaccataaaggagaaggatatgagaaaaatgcgcatatgtataactgaatcattttactgcccaccagaaacttaacacaacattgtaaatcaactgtatttcaatttaaaaaataaaaaatgttaacttccacttcactactctgaggcacatgcattttggaagagggtacctgaaaaaatcacgcatctccagttggcagaattccacacaataaatggtggtggttaatctgaaaggctgtgcagaagggcttatccttaaattatggagtgcacacacacacacacacacacacacacacacacacacacacacacacgctggtgggcgtctgaacgaacaaactgacgtgtgaggcctttgtgttctcctgctccttccctcctctaagagaggattaactactcttctttttctcttctcactaattgatagataatcaataaatacattcataaatttcttgcaaccactgtggtggcagaaacgtatttctgtatgaagcttaggaagcgtggaaatgggtgagctggcctctctgcagaagactgtagcccagttggtgatgggtgaacccgctcagctttggccctgaggtctgggcagcctgcacgcggccactgcccctcactgaaggacggctctatgccttcgttccatgatcgtggactctcagagacgatcccaaaatagttagggcttgagtcatggatgagagtctccacagagacctcagaacagcctctcttgtgccttcagatggtcttcagaaattctatctatctctaccttcagctccctctgagagctgacggtatctgctgaccctctcccacctcattctcccttctcctgaagtcatggcagcagcttgcaaggtgaacttgccctgagcctctgcctccgttaggtcctgggcaggagtaggctgtggtgtgccgaagagtgtggcttgggtgtccaagctctggctccactgctcttttgatctgtgatccgtggctttccctcagcctctctaagcttttttttttttttttttttgtatgtaaagtataatcataattatccataaggtaatctgagatcgtgggaggcatggaagcatggactgagggatttgggagctggactgagttaagggaactagggtgtaaagataactgattccttcccaagccgctaactaaattctgtttatgtatgctcgttcgtca

SEQ ID NO: 59340 - DNA, 1723 bp, Bovine  19866880571524
aacaaaacacataaaagtataaccagaatcaagtgggaagtgattactctcaaaaaggagaagaggatatagaaaccagaacgtgctgggaaatcccagtgaacgccccacgaagacctgctgcccggtcacccccacccccgcacccggcccctggaccgcagaggcctgcggcagcctgggcatcccaatctgcccctgctggaatccaccagccctttgaaggcgtctgcctcttcagccctggctgcctccttcccctcagggacaaacacagcagacctgttttgtgaagaactttttagtagctaaatatggcaccatgtgtcccgagggcaatataaattacagtatgcaaaagataccaccggctgaggtaaaacacactgtttctgcctcacgtcaccatgaggggaaacacacagatacttttaaaaacttcttgcttataaaaaaaaaaaacgtcccctagaaaggcctcctaacaggggctaagaggctcaccctccgccgcggggcgtgtcggtcgggggggcagggggacccctggctgcccgctcgcctccggcccggccagctcggcagctggcagcaaccctggcccactactgctggcccagagctctgtccaggttgctcttgatggtgtccaggaagtccgaggtgttcaggaagtgttcgttcagcttcacactgtcgagagagcacgtgcatgtgagagtggttctggcagacgccgccccgccgctgccgccgcatccagggcagcgtccagacagtaggcttctcgtgccgttgtgcggagggctacaggccagaggctacctggagcgcactgtcaagaggccacagcgggacttccctggtggtgcagtggttaagaatctgcacttccactgcagggggtgcaggttcaatccctggtcggggagctaagatcctacatacagcatggagtgggcaaaaaaaagcgggggagggggccacagcaaactcaacaggaacccagcgaggcttggctttgcttttccagattacaacaggcagctcagtaaagctcttctgagagaagccaggaggtggttgtggcaggggatggaaggctctgagcagccggcctagggacagggacccattcactgagcctggtgtggggaggctagccccagccaccatcactcagggccatggacctgtcctgtcccctggcagccaagctgacttaggaagaagcctctacaagggaccctgggctacgatccacctgaccctgagcccccggaagcccagccctgccttgaccccagaccactcacttgctgaggccgtggatgcagcccgccaggtccttggtcatggctccgctctccaccgtctcgacgcacaccttctccagggtctgggcgaacctgcagggcacggggcagagtgagaccccagctgtatggagctggagcccagaacctgcccagaaccaactcacctgatgaggtcctggttcccatccaacttgcccccggtgttctaggccacgcgtccaggcaaagatgctggcgatggggttggtgctggtcggccggccctggaggaagaggtcgcagggggatgaagagccaagcagccaatgaaaaggccccttggacacagatgccccctctagactgacaggaccaggcccatgcacccagccctcagggccagtgggcttgggctccagggatag

SEQ ID NO: 59341 - DNA, 1203 bp, Bovine  19866880592931
cagtgccccagaactaccgagccctggctccagagcctgtgctctgcagtgaggagcccctgtaatgaggaaactgtgcactgaactagaggagcctgtgtgcagcaacagagacccagtgcagccaaaaataaataaataaaaatgaaaagggcagccatgatgtcgtgataaaacagggtgatctccctaagaggctgagaaaaagctctttgcttcccattaaaaaaaaatcagacttgggtgatagaaactctagaataagcacaataactcatccctcaaggcacaaggctaaactcatgtggagagataactttatcaaaacaaagctgccatgacctcacccttagaaagaatcaaggaagttaactataatgtttggtttttaaattttcccagaagagcagcagtcaatataaccatgagaaaaagacaaacacttgtagagaaaaaaaaaaaagggacaaaggacatgaatgggcaattcacaaaagaaaataaagcagcctataaatatgtgaaaaacttttaactcatcattagccaaagaaattcaaattaaaacaatgacacacagggaatacagtataaaggtaaagaggtgtaaactcaagagtcttattgtctgaatttgaatcctaactatgtctctgactagatgtgtgacctcaggaaagttacttaagctccttgtgtctctgtgtcttcatctataaattagggaaaatgacaaaacccaccttagggcttccctggtgcctcagtagtaaaggatccgatgccaatgcaggaggcatgggtttgaacccctggtctgggaggatcccacatgccatggaactactatgtcccaaaagtcactaatacagggaacacaggttcaattcctggtttgggtgttaggtctcacatgctgaggggcaactaagcccacaactactgagcctgtactctagggcccgggagtactctagggtccacgtgccatgattactgaagcccgagcgcccaagagctcaagctctgtaacaagagaagccactgcaatgagaagcccttgcactgcaactagaaaatagtctgtgcagcaacaaagacccagcacagccaaaaataaataaatttaattaaaaagacctaccttacagagttgtcatgaggattaaagattaagtcctcaataaatgttagctatcacta

SEQ ID NO: 59342 - DNA, 5168 bp, Bovine  19866880624052
gtggcagggtatgagagagggtgagagagaagaggtgtgagtgacagcgagcgttagggaagtggagtggtggttccaggcgcttcctgggagccccatggtttcagaagcatttcacaggcatgaaatgtgccaacagcgaagccctggcactcctaacaaggagccatgggacttgcctggtggcccagtggtcaagaatccacactttcactgtgggtggcacaggttcaatccctagctcaggaactaagatcccacacgctactcaatgcggccaaaatatgcccccctcaaaaaaaccccaataaaacccaaaacgaagagtcattttacaccagggtcttttctgctgtttctctgtcctccatccttgctcagccctgtcctctgctagaagacaagatgtctcagctggcttccactgagcacccccacggagtctggggacactcctagaaagtcagggaagagaatcctgacccacagagaacgtagtaagacagctaagcaaagagggcaagggccagaggaagtgcagcaacacacaaggagatgctgcgtgtgccgagcaccccagaggagtggcttgtctcctgggaatgtctcttgtctctttctccataaaccttcgcccccaccccacagtggcttcctatatccaggcaggtctgcccaccaccctgaccgttctgggcagagtgaccttcaagtatgtctctgtttcaaactgatgtcacttacgggtaacagctgcgtgccctctgctctgtgcagtatctccacagtggactgagtcacccaaaccagaatgcagccactaccctttggaagaatggtcctcagggaagtgtttcagctctaacttttatctagaaatcaagaggctctccatcggctcatctgacccatctctgcatctcctgtttttcttttcctttggctgcactgggtcctcactgcggcacatcggtgttctcctgttgcagagaacgggctctagagcacgcaggcttagtagtcccacagcatgtgggatctcagcgccctgaccagggactgaacccctgtcctttgcattgcaaggcagattctcaaccactggaccaccagggaagtcccccactttacttttctactgtcttggaaattaggtggcagagtggttcaacgaatgggagtgtgaattcgggattcactcatacctggttcaaatcccactactatcccttacaggtgcaaggcctgggaaagtggctgcctttatgaacctcagtttttctgcctctaaaatgggtcaagaatgctgtttcttacagagtcactgaattagaagtgcctggcccagagcaggtactcaacaaacattggtcctccttatccttcccttgctggaattggggaaaagtgttagtcacttagtcaactgtgtccaactctgtgcgaccccatggaccccagaggcccactaggcttctctgtccatggtattatccaggtaatactggagtgggttgccgtgccctactccaggggttctttctgacccagggatcaaacctgctcctgtaatgcaggcggattctttaccactgagccacagggtatctcattcagtaactatgaaagtcgctcagtcgtgtctgactctttgcgacctcgtggactatacagtccattggaagtctccaggccagaatactggagcgggtagcctgtcccttctccaggagtccttcccaacccagggcttgaatccaggtctcccatgttgcgggcggattctttaccagctgagccacaaggtaagtccaaaaatacagatcttcccaacccaggaatcgaactggggtctcctgcattgcaggcagattctttaccaactgagctatcagggaagcccctcagtaactataaacatgaattaataatacatctcagtggggacttccctggtggtccagtggttaagattctgtgcttccaatgcaaggagtgcaggttctatccctggtcggggaactaagattccacatgctgtgcagcatggccaagaaaaaaaaaagcaactatactccagtaaaaaatgttaaaaatatatatatatatataactcaagggaaaaattttacttgggattatttcctggtcagttttaagaaacacagtcaagcacagaaaacataattttataaatgatctgtaaacggctcatacagagcagatatttcaggtgaaatgaaaaggaattcaagcaaaaatactgtatttattcctcttaagggtttttcaaccctcaaatcaacctttccaaaggggatttccccacatggaataacaatgtaaaccccaagtcccctggcttataccagagtgatctgtcaatggcttctctgctcagaacccactggtggctctcccaggtctctgaatgaagttcaagtctttggacacattcccaatcggcctctccagctccatcttctgccatcccacctcgacaccctatctcccatccgcaacaaaccaccactgactctttgaatgcccctgttctttctgacttggtatattctagtcccccagtggaatgcctcggcttcccttgcctgctaagactcagctaaacaccacctccaccagtaagtcttccctgaactgctccccagcttcactatgtctgcagagcaaacttctcatgcttttgtctgcatatcccatatcccttcagtttgagggcctgctggggacaaagaccacgttgtttcccctttatatcagagtttactaggtgtttggtatttactgactgaacaaaggaataaagaaaatgatggaggtttttaagagaaaagaggactcacggtggagcagggctctccctgacttcacatgcctgcagtccacaggtaacaatgatcaccacgtatcacacagcacagacaaggtctgtatagtcaaagctatggtttttccagtagtcatgtacagatgtgagaccataaagaaggctgagcaccgaaaagaatcgatgctttcaaactgtggtgctggagaatactcttgagaatcccttggactacaagatcaaaccagtcaatcctaaaggaaaccaaccctgaatattcattggaaggactgatgttcaagtgccaatactttggccacatgatgcaaagatctgactcattggaaaagacattgatgccaggaaatattgaagttaggaggaggaggcagcagcagaggatgagatggttggatagcatcaccgactctacagacatgagtgagcaaactctgggagacagtgcaggacaggggagcctggcatgcagtagtccatggggtcgaatgggacacaacttagtgactgaacaacaacaatacagcataaagcacacctattaaaaagtaggtacatgaacccacttcacaggccatgaaatcaaggcttgctgggggaggctgtggctcgtcagggctgggagatggcaagccaggacaaaggccgtggctccttggatcctgagtcccatggcttgaagtaggtcctccacttgcctgtgattctacttctgtggcagacaaccctttagattcatccctgcttgtggggagaagaacaattctgtgtttcagtgattaagcccctccagggcttcccaaggccaagaaggtgccaggttagaagttataactcagggacttccctggtggcccagtggttaagaatctgccttccagtgcaagggacacgggttcaattcctggttggggactggtcaggaaactaagatctcacatgcccggggtgaccaagctcatgtgccacaactactgagcccaaaccctgtggagcccatgaggtgcaatgaaagatcccacatgctgcaactaagacctgatccagccaaataaatatttttaaattaaattaataattttttataaaaaagaagtagcagcacacatgggagcaaaccatcaactgtgtcttgggcgacccagagccaagaccctcacccttggacccaactcttccatcctgctaagggtgggtgccacacaccatctctcactggacaccaaagctgcccacttctcatgcctttggtgggtccatcatcaccaaaagtggaccctggttttctccaaatcaatgagctaagaagcaaggtgaggagtttcactggaatctaaggttgcagaatgaggcctgcaacactgtgtctcaaatgggggaggcgggtagagactgtgggaaggaggggccattgagggatgagaggcagggctgggcagataagagatcgcatccaccagacagataacgggaccacaaatgacaaaggagctggaggccgtgctggagtgtggagagaaagaaagagcatattaaattttaaacaaagcccaccccgggggaacctccagccttgtctcccaacctgtgcctcccatctccagctcacaagtcgccaagttcacagaaatcgaaacatccctcatctctagggggttgggttttgttttgtcgctgtgtctctggggggtgggggaacttgggcctcccagaggcccaggggtcttcccaccaggcctgagaaaggagggcaggctagaagcagcttcagctgggacagccctgcttggaagggggagcaatggcagggctgggaaccagagcagagcgggtacaagaaaagagctggcagtgccaggtccagatggtgggcagcagcagagatgtcaccaggagccaagaggagggaagaaactaagaagtagggaaggtcctgagaggccttgccaactgccataaagactgtgctggcgtggaggaggaagagaacagaaaaggaggaagagcgagcccagagctggagcaggaaggcccaatttagcccaagcacgtgttacttcctctgtaattccatcaaacctcccccaccccaccccaaggtgatgactggggaatggggctgcaagggctgaaggtctggagagaggcactcccctggggcaggacccatggggcagggcctgaagcttgcacacagcatcctccatgccagccccacaaacaccaacccagccaggcaggaccggcttcgggtctccggagtcaggacaggatgtttgtttcacaagcaccttctccgaag

SEQ ID NO: 59343 - DNA, 1457 bp, Bovine  19866880825862
ctgtgctccctggcattttccacgtgccccttctctcagcttccttcctcaggttcggaggcccttctgggcctgttcagactgagcaacagtctttcccaggtgaagctagcaaaggcagggttttcattcctgggtctgtgctgcatcccagcccctcccccgcccctccccccgagatgggcctcaagcatctcggggccttgtattggtcctcgtcactttgtgatcccagcccctgccacccagctctgcacagactgatggctccatagatgagtgaggttgaggctcgctcaatcaatcaataaaccaatcagtcttcctccactcagcctctctgctcccaggcatttctcattatccagcgtctggatgatcagaaggaaaaagaagcctctgcataaaggtgaccccatttcaggtttcaccgtgactcactgagtattgagaaacaggaagagccagagaagggaagacgaagaggggggccagggatactcacctgccccaccctctcagggggaccttcagggagatgtttggtcactagactgagggccgagtgcgggcagggactgtcccgtgcaccgcattctccccagagctcagcatgagtcccacacacagtagacaccccgtcatagctgctgtctgtctgcagaaaggaagcaaggacagagcccacctccaggcctgtttcgaaagggggacttgggattgtccggggcgcctacttggctcttagtcctgggtctcggccagcccaaggaagttgctgatctgtgatgtccacagggccccacccttggaaggacactgatccaacagctggcagccagtgaaaagggagaagccgccaccctttcaccctcctgagcaggcagccacttccttgaggcagccccaggagaggataccccatcccagggccctttcaaagtgtcccccctcactggtacccagcccctcctgagcagactcgggccccaggctggcctccagccagaacagccgccttgctcagaccctcctccttggtcctcctacctgggctctcaactctcagacccaaacaggagaacccagagggccaagaaccgcagaggccaggccttactcacagcgtcctggcccagggctctcccggcctgggctcacccggggctggggcagaggaagctgaccctgaaataaagctgatggctgttggcctgtgcctcctgcttccctgagaagaagcacttctcttgtgggtgtagtgagttttggggggaagcatttaaagcaaccctttgatgcttctccaggaaaactgcatttatttttttgttacttttaggaattaacttgcggttcccagcccctccctctctcccggaaaggagagaaagagaaagaagaaagggtctgcattgtcccggtgattggcaccttctgtgaatgaggggtcaccg

SEQ ID NO: 59344 - DNA, 781 bp, Bovine  19866880836425
tacctatatagtatttttaaaaatttatttatttttagttggatgatgattgatttacaatattgtgttggtttctgccatatatcaacacacacatagttttattgggatgtctttcctaatctctttatgtggtacatacaaactaattacagagacttaatatgataatttttcagtttttatccacttgactctttattataattggtgctgtttgccagctcctccatgaaacatgttattgtttttgctttttaaaattgtttttaatctgcctgatagtcctctgttttctgcagcgtttctaccttctgtgtcctagtgggcattccttaagatgcagttctgtttttagctacattctcttattctcatggtttcagttgttttgaagactctttgctttacgataaacacagcgtcttcaattggctactcgacatttctctgtggatagctttctgtctcttggactttctcgtatctaaaactaaacctaccttttctcccaagtgaacttctcctctgtgtaagtggtaccatgccatcattttcccagccatccgggctcaaagccttggttcccttggactcctaagcggtctttccccaagccttcctcggttgcttgcagtgtctgttttatctgttgaaacagcctcccagcctggtttctccagcttcagtctcttcactattcactgtattctgtgtcttgtcgacagtcagatcttcctgaggctccatttttagctttggcttcaaagctaggacttct

SEQ ID NO: 59345 - DNA, 651 bp, Bovine  19866880886410
atagggtctgtctcccaagtggatccgctggtgggtgatgaagtgggagctctggttgaagctcttgccgcactcaccacatttatagggtctttctccggtgtggatccgctggtgcttgaccaaggcagagctgtcggcaaagcccttcccacagccgttgcacttaaaaggcctctcgcccgtgtgtgtcctctggtgcgtgaccaggtgcgagctctgactgaaactcttgtggcagtaaggacagctgaagggcctttctcccgagtgagtgctcatgtgggccacaaaatgagagctatctcggaagcccttcccacactcggggcacttgaagggccgctctcccgtgtgggttcgctggtgcttaatcagatctgagctctggctgaaactctccccgcaatcgagacacccatagggcttcactcccgtgtgggtcctctggtgggtgatgaaattggagctgcgactgaagctcttgtgacactggaggcacatgtagggcttctcccccgtgtgggttctttggtgcactgtgaggtgcggtttccgtgcaaaagtcttcccacactcggggcactggtggggtctctcacccgtgtgggttctctggtgtttgatgagggtcgagctgtcgctgaattt

SEQ ID NO: 59346 - DNA, 1006 bp, Bovine  19866880887112
tgtttgaagcctttcccgcactcccatgcacttatagggcctctcaccagtatgggttcttcggtgccttatgagataggagctctggttaaagcttttcccacattccacacacaccagcttcttttctatatatccttccaggagcttgtttaattccttctcctgtgaaaagggcccctgctgaccctctcccaggagggttccatgctgcccttctaattcaagacccctctcccagtttcctccccaactaggaggaggagaaatatctttattggccccttctaaggatgttccacatggttctgccgtttcagaaatgtcctgatcgagttgtaccacctgattcttaaattctgaaaagttaacagagtaacacaggatgaagttattacttatcaggaaaggtcatcagaaagcagcaagaaagagtaaaattagtatttttgctacagaccacatttaatctgactactctcattctgattcctgaagagtatatccctggcggcttagtggtaaagaatccacctgtcaattcaggagattcgggatcaatccctgggtcgggaagatcccctagaggaggatatggcaacccactccagttttcttgcctagagaatcccatgtacagaggagcctggcaggctacagactatggggtcgcaaaagagtcagacatgacttagcaactaaacatcaatcaggaaagatcagcagaaagcagcaaaaagattaaaattagtgtttttgcaacagacgacatttagtctgactactctcattttgattcctgaagagttcactgaagatcactgagcttcccattcatgacataagcaattcccaagccctttttattttaagatggtccaatgaaccttgaggtgaccttgatatcaagagtaaaacacgtattgtcagaactgggcaacttttttcaatgatgttagaatctagacaaaagtgaaatgtttaatttaaatgaagaccttatttg

SEQ ID NO: 59347 - DNA, 822 bp, Bovine  19866881068442
atgatgggctcccggaagaccgttcccccgaggatgttccggatggttccattggggctcttccacatcttcttcagcttgaactctatgaggacaaagaggaagtggccccactgcagcccaaaccttccgaccaggatttgaaccctaagcgggaatgtagctagaagggggctcctaaaaaccaccctggggaagcagcagagtcgagagtggccatgggcgctcctgaatcagatttcttagcttcaagatccagctgtgtcacctcaggcaagagcccataaaacgaaaccgttgataaaacccctggccttttggcttgttgtgagacttaaatgcatgttgtgtgtaaagtgcccagaacagtagctggcacacggtgagcgctctgtcagccgtatcattgccgcttcacgctgggcggagcccagcctgacgaacctggcaacacacagcctcagtccagacgctgtgcttccagccccacccgccaggctcagcctaagacagcgaccctccaactccttgtccccacccccaccgtcccagctgccccacccccaccccctcgcaccttccacacgggcctcgtcgggggtgatggtggcacacttcacagccacactgtacttctgggtggccaacgcggagtcgatggtgacctgatcattggtctggtcacggttcgggagccccaggtcgaaatacttgagctggacgtccacgtggggcaggatgagctagaaacagacagccagggccaggcatcagcccagattgactggattcaggggcacctggttcaccccgtgggaaggg

SEQ ID NO: 59348 - DNA, 762 bp, Bovine  19866881116090
taaatgacccctttacaaggttctttaatttctagggctgagaaaatactttggagcacaggatgtttagaaagaagcatccttgaaaccctccacacattatttatttacaccataccataacaaatggagggcttcctgggtggctcagtggtaaagaacctgcctgccaatgcaggagatgtaagagacttgggttcgatccttgggtcgggaaaatcccctggtgaaggaaatggcaacccattacggtatctttgcctgggaaatcccatggaaagaggaacctggcaggctacagtccatggggtcacaaaaattggacacgactgaagtgacttagcacgcacgcacacataataaatggaactaggaaattacaaacggttagaagccaaacaaaggactaatgcaataaacagatccagtgtgttgtcagtaaaaagcgccaatgtcactcactttagttgcctctgcatcttcccctgacattgattcattataaaaatactcacttgcccttgctggctaagttatccaggcaggtcttgatatagcttttatagtagtccacctgctctccataaaaggtggccttagagttcagggcagcgtatgtctgctgcagtttcaccagctcagccttcctcctctgtcggtatctccgctgattccgaatatcctgagacataattattaaaatcacaaaaataatgatgtcatgtgcttctcgaaccattaacactagaatctggcagtgtt

SEQ ID NO: 59349 - DNA, 1175 bp, Bovine  19866881117837
ctttgtacctgtgtgtgatttatttaggcatgatccgggagaagaatggggatggaaaggaaaggccagagacccaaaacttggtatctcttcctgggctacatctcttactaccttcagctcatgaggtctttcgttgttcattgctaatgatcacctgtgcctagaacagggcccggcacatagtgggccctccataaattcttgttgagtaaatgtactgggtgttaggaaagagttccctcccagaagggaccgacaaatgacagacgggaggcagaggcagggaggtaattgatgggagctgcagagttttgctgtgagtcagggctttgaacaagctccagacaggtaaaggcaggaggggctgggaagagcaaatctcatggggtggagccactgggtggagacttgtgaaacaatagatcttgaattggacaggttgtggggaggataataataaccataggtcttgggccaggcttgtgtaagtgctctatgtgtattgtctccctaagagtcctcacaggtgctagttgttgcttgcaggctgagttgctcagtcgtgtctgactcttggccaccccatggaccgtagcccaccaggcccctctgtccatgggattctccaggcaagaatactggagtggattaccatttcctcctccaggggatcttcctgacccgggaattgaactgctgaattggcaggcaggttctttcccatttagcagattggagaactgaagcacagaggagtcagtaactcattcaagagcacaaagctggtggtgtctgaactcaagcagactgacttcagacttggctgccctagaatgatgatgagttcaggtatttctgcccatgtcaaggagctgggcattcagagctttggggttgctagaaaggatagcaacggaaaaattgaaaaagaaattgttggtctgcagtgcagtgaagctggtcagggaaatggccctctgcttcctttgccaaggccctcaaggtgtctgaagactgtaaaagtttttttttttttttttgaaagtatttatttatttggctgctttgggtcttagtttggcatgtgaacgctttcttgctgcttgtgggatctagttcccgaccagggatcgaaccctggccctctgcattcggggtgcagagtctagcca

SEQ ID NO: 59350 - DNA, 1020 bp, Bovine  19866881145501
tagtgtccgacactttgcgaccccacactttgcgaccccgtgcactgcaggacccgctaggctcctcagtccaaggaattctccaggccagaatactgaagtgtgttgccatttccttctccaggggaacttcccaacccagggatcgaatctgcgtgtcccgggttctttaccggcagggttctttaccactgagcctccagggaagccattaaacccgtacaacctctctgattcggaccccgttttacagagtaagaagctcagagaggttgaggcacttgcccaagctcacacagcgcggattccagccttggtaggtcagttgatccgacacccaagcccaggctccttcgtgacagatcccaagaacccctccctcggccactgtgaggcctcacccgggcaaaatgggcagctcggcacttacaccacccagccgcctctggggccgtttcctttttcctattcttgctctctggaaacgcatcctatcggagctgatcctatgggttctctgagcctcgatttcccctttgtgggtgtagggagtaggggtctcccactagtaacaaggacgagggagagaaaagagaagagagtggctctctccctcatcccacccccacctccgggctaagaccccagcccggtcctcccggaagcgcacttcccaccaagcaaggtcctgcggcaggaatggggctcggcccctttaaatcccgcgcgggaacgcccggggccgggccgcgcagcccgtgatcggccgtcgggaattgccggcctccgcgcgtcctccggaagcttcccctcgcgctgtccccagccccgcgtgcccactcggttcgccatccctcgagggcgccgcggccgtggggaggatgagccgcatctatcaggacagcgccctccgcaacaaggcggtgcggagcgcgcggctgccgggggcctgggaccctgccgctcaccagcggtaggctccgcccgcgtctctccaccgcctcccggcccggcctctgt

SEQ ID NO: 59351 - DNA, 960 bp, Bovine  19866881159378
cctacctgtgcctgtgcaaggcatttaaaattttccaagcttgtcatcttgttctggtctcagaggactgcggtgtagattaaatgatatgagatatacaaggcctctggcacatggctccccatccagacaggttttgctccccacctcctagagctctgtgatcatgttaccatcactgggcctcagtttcctcatcaaaaaaaataggtacaataacattacccaatagggctattgaaagcctcatgctcttctgataggagtgcctcatgttttgaaaggatgcaacagaggatgagatggctggatggcatcaccaactcaaaggacatgagtttgggagatggtgaagggcaggaaagcctggcatgctgcagttcgtgggggtggcaaagagtcgcgcactaagcaactgaacaatatgttttcaaaaggccccattcctgggaccatcctagcaagactccattttacaaaattgccatctctgctttctaccaaaacaaagaaacacaaatagaaaaaccaatcttagagccattatcctttttgagacaaaaagccaatattattcacactgctcggcttggaagattttctcagaaggaaaaccagaagtgacagctcaaggcataacacgggttccaggattctctccagcttcacactccgagaccgacgacccacccacagcagccgtgacaggacagacagctagtgcaaagcgcaggggggatccaccggggatttcagcccaaagcaaaacaagacactaaactcctttacctgtaaatgagccaatactgatcaagcttttgttatcagcaaaggcactatgtggacatatgtttccccagtatcaaggaatatactgatacatgagaacacagtaccaccgctgttgtggatactcatcagggcggtggcctcagctcttcccaaaggccacgtctgttt

SEQ ID NO: 59352 - DNA, 881 bp, Bovine  19866881170612
tttgtgaggatgctgtttctatatgctggctctccacttgactgactggagccccaggatacctgcaatgacagtttttaaaatcttgaatctggctttacagtgagtaagcccggcttcctatgtctctccccagatccagtccctgtctgggcgccctcggtcctgtgatgtgggaggtggcaggtaagagaggttctttcagttcttgtttcagggccgtcctgagggttttaccaaaaggaatgtctcgctgcttcatcagagaacactgagaaatttcactcattacatgagttgaaagtcaactgaattttcacaaaaacaacagctcttttttggtatgctcatatttcatttgttcaaagtaattatatgacataactgcaaaagtaaaactgccataaatatgtttgagaatgacatcaccgactctgggtaaacaaacagccccactggaggaagccagggcctgcaggcgttgagggagcccgccagcctcacgcctttggaatccgcgggccgctggcagcttggtgagccagaagttgcctaagagagtttgcacaaatatactgaatgccacaaaaccatgaacctcaaagggatagattttgtgttatgtacattttatttttaccacatttttttaaactaatggaagatgattaaataggaaaacttgtgatattaaaaggagtttctatggaacagctaattaatgtattcagaagtatacaacttcactccctgaaaaatgtgagagacagctttcaaaaaaaaaatatgtgtagtactaaaagattaaaacgttcctgaggagatgggaccaaggaagaacgggagacaacagaggtgatgaggcccacacacgacagacc

SEQ ID NO: 59353 - DNA, 793 bp, Bovine  19866881256066
ggttcgatccctggtctgggacgatcccacgtgccagggaggaactcagctcggctgtcacaactactggttctgtactctagagcccaggaaccacggacaagagaagtcaccacaaggagaagcccgtgtactgcaactagagagcagcccccatgcatcataaccagagaaaaacccacacagcaatgaagagccagcactgccaaaaaaaaattttttttaataaaaaataccaatttgctcatatttacaagattcattgttcactcaacgaatattcattgagcaaatatcacgtgctagaaactgtgcaaaggtgctgaacaattcattacctggtgttgctaaaagatgctctattattattttgcaagtgggaaaaccactgaccctctcattttctcatctctacaatgaaagagttgtaagagatgtttcttttcacttgagtgctggtgcctgtatgaaagcaaactaaagtacttacgaagatttcggttttgaaagactcaatttattgttaagctttcttgccgaatgacgttccagttgttcctgtagattattttgaggaacagcagccatgatcctgaaaaatgagggagaaaaatatcagtggaattacacgctttgcattaatcacaatatttactgttccaactgtgcccagagtaatgagacttttttttggacaaaaaactgttttgacatttaaaacaggtgacatttgaaatacataatctttaactaactgaaagctcacttatagcaaaatgacctggttttcccc

SEQ ID NO: 59354 - DNA, 872 bp, Bovine  19866881259360
cccggggggcgcaccactgggatgtgaagaccccgtagaagagggtgtcgggccagtcctcggggcggggcgtcagcgtgaacatgtcctgtagcacgttgaacgggaagccgtcgtcgggccgcaggcacagcagctgtgccttcaggaaggacgtccagcgctgctgcaggacgcgcccgcccccttcgtcgccctgcaccagggagaggggctgggctcaggggacagcgcctcgcttcccctccccagacaccaggaagggcccgacggacacaacaccaggcctgagctcatctcaaatcaagaagacagggcttcgtcgccctgcaccagggggagaggggctgggctcagggacggctcctcgcttcccctcccgggacaccaggaagggcccgacggacacaacaccaggcctgagctcatctcaaatcaagaagacaggggacttccctggtggtccagtggttaagaccctatgcttccagtgcaggggacgctggttcaatccctgatgagggaactaagatcccacatgttgcatcccatggccaatatatgtgtgtgtttatgtgtatatatacatagagagagagagagagagagcacgcctccggctagatctaaatttcacataaacaataaattaaaaaaaaaagacttgaagtggcagccttcagtcccccccttgccagaaggctggctaggtaaatgacagtgcttccctaactgcaaggagccagaaaaaggacgaagggaatctgtctacaaacatgaaaagacgtcacgatttactgctgagcagaaagggaggctaaagagttgcattacagtgtctctttgtttgcacaggttttacacaagacaaa

SEQ ID NO: 59355 - DNA, 1655 bp, Bovine  19866881283582
cttagcactctgcaggtgaggttttctaaagcaggggtcttcaccctgcaggatctaatgcctgatggtctgaggttttctaaagcaggggtcctcaccctgcaggatctaatgcctgatggtctgaggtggagctgatgtgatgataataaagtacacagtaaatgtgatgcacttgaattgtccagaaacctaaccacggccccctccctaccccaccctgctcctgtccgtggaaaaactgtcttccacgaaaccagttcctggtgccaaagagcctgggaactgttgctctgaagggcctcagtgtcatcctttatgatccagatcagaggaaactggtttgcactctgggctgagccggccaccctggccaccttctcctctgatgtctgtggacccgcctgccctcaaggccctcccgccccactgccctccgtccaggccaccccagaggtttctggcctctgccctctggtcctcctcctacctctcctctagcctgcaggtgagaggttccccagcccccatgagtcctgggagagtacagacccctcaggggccggctgcgtcacccccgtcctggggctccagcctctttccctgctttctgtgtgcagtctgccctgaacctctcatctcacgtctgcatgtctcaggggctgcccccggccccaccttcatcctcctggctggactgcaggtgtccacccctcacgtgggttctgacccacgactcaccatgtgacagtgcgggtggttaggtgactaaggagcgagctggcacagtactgctgctgacgatggcttgcgtggatggccatgtgcgtctcatgtatgcatgtgtacactctcgggctgaatgtttccccagctgtccctcccctccggagatacatgaaggcattacgtgaatgagagaggcattctttactcctctcctggcataaatccggactcgacttgggtgtgtgggtgactgcaaaataaatgttgattacagcatcggcagacgctgccagggacgctgctgggctggaggctcaggatgagtcacgccggctgccgtgagtgaggagagggctccgcggccaggccaccctcctcggccgtcctcagccctcggcacgttctctgcctgctgctcttctgccattttcccttcccttcatctctcgctgcagcagatggggaggtgggtgggggcttctgagcaaggttctcttcttcctagactgtctcagcccctctcttgtgtactgcatcccatagatcatgctcactggactgaagggctcagctctgggaagtggaaactgggatcctgtgtcacagatgaggggcctgaggctcccccaaaccaatatataacggggtgaagccggaccccacagccagtggagtctccgttgactcccaaagtgcccgttgacttgcaagaatctttctgacaccctttaaaaaaaaaaaagcaaagttactctgtctttttgtggcaccccatgctttttgtgcttttttcctctcctgttccatgattctttgtcttgtctctgaaaccaaaatgtgaggtccccgagagtggggtctgtgtttcccaccagccaccatcaccagccggcccagggcgggatagaaggaagataacagcagca

SEQ ID NO: 59356 - DNA, 697 bp, Bovine  19866881614088
ctatgaaaagatgacctagtccttgggaggttgagctggctccagttttatagaccgctgccctggggctgaccacctaggtcactccccaaccctaccctctaatgaaaccctgctcctagctggtggcaatccctgaaaactcaaggaacctaggcatggaattagggtcagggtcaatgttagggagcctcctggtggtggcctgcccccttcccatcttcctctgaatgctggacctcacaggaggctgtccacactcaacgcctggctgggagagcacagctaaaattgcagtgagcggtagggaggcactgaggacgtagtcacccaaaccatcattttggcacattctgttctttgccacaactaccgaacctgtttcccccagtatctgagtggagctacatgtgtgcctgtttttgaccaggaccaaacttggttttgacatcttgctggatgacaagctaatggttgagggtggtcgaggacggtctcttgagttttgcaaaaccaaggtctgccctgaacaggatcccgggatagaggtggtagaacatacagtggcggacgcagaggcattcgttcggggggtggtggtggtggtttccccgcttggtggtgtccaactcttttgcgattccatggactgtattctgtcaggttcctctgtccatggatttctcaggcaagaata

SEQ ID NO: 59357 - DNA, 1751 bp, Bovine  19866880777104
tctcccagaagtcactttctcccctgcctgaggataagaatccttggcacaaacatcaggaagcagccttcaaggttcccgagaagggaaagctcgtcttgtgtagacagctattcctgcctttgaaccacaaaaatcccccactgaaaactactaaatggctttcagtacattgggagatcaatgtgacagattcctcagactctgagcaaccctggggaaatgacaagtacagcagtctgtttagcagaaggggagacagagctgccccccgccagcctgccacaaagctaaacctgccgcccacccaactcttaagggtgctgtgaggaatattgggagaatggatctgaaggatgtggtagtggtgttgagttctggcaaagagccatgcatttgtaagcaaaacattaatgactatttattgcaaacattgtaggaaaattgtttatattgcaaaattattaaattctgactgattagagactgagcagaatatgtggctgagttatactgcaccaagagttctcaaatctgagcatgatcaaacctgtaggatgcaggttctaccctcagattttgattcagtagatctgtgagagcgttttgtttgtctgtctttgttgttgtttttggctgcgctgggtcttcattgaggtgagggggctctttgttacaattcgtgggcttagttgctctgcagcatgtgggcttttagttccctgaccagggactgaacccgtgtaccctggcattagaagatgaagtcttattcagtggaccaccaagtaagtctctgtgagggtttttttttttttttaaacaagcattatagttggttctgatttgggttatctgtggctcacattttggaaacctttttctagaaagataagaggcttcttgtacacttcaaattaggagattgtaaaacaagagcacaaatgtagtcagtttttcaaagcataccaggaatatggactacgcagatgaggcttctcaggtgcaagggagttttcaaatgtctgttttgcagttgagctgcccccatactggagtgatatgaagcagcagaaagtctgtgtggttgagctacagcctgatcatccagaatacagaactgtggcgagcaagtttcaagagacctgtgcacacttcaaaatagagagggtaagccttctgcggacatggggattctccatggtagaaaaagggctgtcatggtcctggataaatacattttcattctcatttgttttatcccaaattagaatattttatggtaattaggttttaaattctagatcctactcctgtcactatgattactgagtcattgagcttcttgtgttattacagtatcatattagattataatacaatattataacactatatatttactttgtgaagcaaggtaacaaaaatgcctaaatatggctcctgaattggagtggataactagcaagcacgacagagagacacagggaggctcctcagatcagggttgtatgcttctgcaccaccactcacaggtcagcagtgccctcttccttgataatccagtggtgccttccttgttcatttcctttattttggatcttctgcttttaatagtttaaaaagtttgctttttgaaattattttctccttggatttgtacgacaatatttagatgctttcctctccttcttttaactaattttccttttattatctctggtatgtatttctcctctaaacccctaatc

SEQ ID NO: 59358 - DNA, 1782 bp, Bovine  19866881066085
cccaagttcatttgaattaagattctgttttgctagctgcctcctggattgtaattctgatccccatgtaaggccaggatcaccatacacatggaaaataatcaggttcacctagagagcaaagaaagaggacttttctcaggaaaaaaaaggaaatccagacaaccaacactgcagagatcagagcctgagcccctaagcaacctgtcaagagaaccacagggaccaaatgaagagccttactgcagtttatcatttgaaaagctttataggaagagggaggtagggaaaattaccattttgtttatgtgaaaatatgtttctttcctgtccctgacagcaagagtaattttgagatcctaaatttactcttggacttggtttttagtagatggttgaagaggtccagttccttaatggattcattaaaggaaggtggtacatctagtcctaagatgaaaaatgtcagagaattggatctttccccattcctaccctctccagtcctctctaaagagcgcagtatattctctcagacaattccatctcctagctaacacttgtaaattctacatcattttgattttgtaatcctggagtttgtatcttaacatatctgaagataaaagccttcagaaatctttaatttgcttgtatcaaaattctcagattcctcccttgtacagactatttattaagctgaaagatgaagaaatgattcctctggaagtgaccacctcatgattttcaccttagcagtccaaagactgagagagaaaacaaacctgtcatcatcctcagattttcttctgtgtacatttaacatagtattctttctccagtgtgactaatgggtaatcttgactaccccaaaagcaggaggaataaatatattccaagaggcttcatggtcaaataattaggcatactctgggaaacttggagagtactccttcctctgtctccttggagagcactaggatgtgagttgtcactgatactcctactgcatattggaaatttgaatagtgtgtcttttggaatgagatgtttgccatttctcttccagaaagagagtaataatacatagtcatgatagcttaactcactaataaatccttggacaaatgtaatcccttcattccatatacaaagaattgtgaatcttagtgaagggtctctttactgtctttctggctttcctcatccccaaaccaatggggtgttgcaaaccaaggtgataaaaatgcctgcttttggcagtgctacctaaatactcacttgccctcaaatgagatgatcatggatggaatctaggactttggaagcagactatgccatttaactaacagcgttctcaagcttggtaacatgtgggtctcagaatacttgagcccttgacatgagattggtctgcctcatggtgtattccctggacccactttgtttgcatttttgagtccaggtccaacatttttgtactatcctttgcagtgctgagatgtattcccaaaccttcttatagaaacttacaaaaatagctagaatataagtaaattgcctcttagttccagtcattaaacagatattcctcttaaagttgtaaatttgagttaaattagttttcccatttctacctttcttgttaacactacaagcttaatgtgataaactgcagtaagccttcatcctcctatgtttttcccatcttcattgagccctctacctatcttgaaaggttgctcagatgactcaggcactgttctctccagagtttgatat

SEQ ID NO: 59359 - DNA, 1665 bp, Bovine  19866881402729
tgaaaagtgaaagtgaagttgctcagtcgtgtccgaccctcagcgaccccatggactacagccttccaggctcctccgtccatgggattttccaggcaagagtactggagtggggtgccattgccttctcccgaaaactctacataattgaccttaaaatattttcggaataataatattgaggatacattttcttcctttcatgttgccctttttttctcataaggcaagttcagttcagttcattcgctctgtcgtgtctgactctttgcgaccccatgaatcatagcacaccaggcctccctgttcatcaccaacttccggagtttacccagactcatgtccatcgagtcagtgatgccatccagccatctcatcctctgttgtccccttctcctcctgcccccaatccctcccagcatcagggtcttttccaatgagtcagctctttgcatgaggtggccaaaatattggagtttcagctttagcatcagtctttcaaatgaacaccctgggactgatctcctttaggatggactggttggatctttttgcagtccaaggggctctcaagagtcttctccaacaccacagttcaaaagcatcaattcttcggcgctcagctttcttcacagtccaactctcagatccatacatgagcacaggttcttagacattgaaattatgcagtgacaaagtgttaagattaatttgagagctgtgtgaaggatgaattaaaaagcaaacagtctaaggttaaggaagggtggttgagagctgttgcagttatgcagctgtacaaaattggacatgacttagcaactgaacaactacaagttatctatctgtatgataggcacctaaatcagactggtggcagtgagaatagataggaatagataaacactttggatggaataataggcaaattttgattattttaactaaatagacatgaaggggaaattggtagatttcattttgaaagagtacatttctgttttaccaccagttttgcatcttgcttttaactttattgcttttggggctttattttcctagaaaacaaggaaaattgggcataatgtctttaaaggcttctggttcctgagagagtgcaaagttactgacaataacttaagtttttaaattagtcacttaggtgataatatcctaaagatgtttgcttagtataaagataattttctcattctattacatgttcatttgattataaatctctatagaaatgatttcacttctttgttacctgagctttcttcaatccaactgcagcttacatttcagttgtgttttgcattgaaacgaaaagagtgttagtcgctaagttgtgtctgactctttgagaccctatggactgtagcccaccaggttcctctgtccatgggattttccaggcaggaatactggagtgggttgcccttcccttctccaggggatcttcctgacccagggattgaaccctgatctcctacattgcaggcaaattctttatcccctgagccataagggagacaaaattattttgcatctgtttccagtaaaacttttgctcccactatggagattttcagttgcatgcagatgccgtatcagaatacacttggtaatttttgaaagaaagaacagcaatagagacctggt

SEQ ID NO: 59360 - DNA, 836 bp, Bovine  19866881703805
tgggtaacacatgtttcttgcaatttccttctgctactggttccagagtggttctggttctggatgtggggcctccaggaacaattttcgtgcccactttcttgtccataatttccatttcttattttcaaagtttcacttttattccttctattgacaaaatcaagaaatgaaaatctctgacctgctgagaccaaaaaatcccccattccaccaggttactttcttcaattagacagcagtaactttccactgattcataggatgacatcagattttttcccatcagctttctaactggaaactcatttaaactattttacatatgatgatacttatcttgccacattctaaccacaaatctgaattgctacaattaatttttgaaagaaagttctatgcatagagagcattttcagctaaaatgtaaagtttctgtgcaatagcttaacaaacatttataaagtttaaaaaaataaattattgggctttcctggtggtccagtgataaagaatccacctgccaatgcaggggacatgggtttgacccctggtctaggaagaggccacatactgaggtgcaactaagcctgtggattgcaattactaagctcacatgcccagagcctctgctctgcaacaagagaagccaccacaatgagaaacccgtgcactgaaacaaagagagtgtagccccctctccctgcagctagagaaagcctgcgtgcagcaatgaaaacccagtccagccaaaaataaataagttcatcaaaaaaatttcttacatttatggaaaatttctacacactcagaaaaataggcaataacaccccaca

SEQ ID NO: 59361 - DNA, 1473 bp, Bovine  19866880567407
actgccaagcaacgaaatgggcaggacacagctaagaagctatcagcaggcagagacctgtctactgtagctcagtgacacacaggtgtgtgtttgtgtgtgtgtgtgtgtgtgtgtgtgtgtgtgtgtgtacctcgagcgggagctgggtgggccaccaacagcctctaccccagctcactggcatcagttcacataagcgccttggttagagtgtttatacagaacttgtaggtcaatcatattcagagtgatagagaaaatatctcttgggtgggtcaggaaaataggattttctaatttaaaaacgaaggaaaacagggctgcttttatgtaccacctctcttctaacttgaacttaatgactagctgcctttcaggatgctgtgggtgtggactttcaccccttctctggtcccctggcccagcaaaccagggatcagaaagatgagcgtgccctggaatgttctgaaagcatctttttcttttgtcttttttctgagcacgatatccttctgtctggctcccagagagaggggcacaagtagggttggaattaacatgaaaacagcagaaatccaaagagaaaaaggtaatttcatcttatgaaattcaaaataggctttcatgggactagagcactccacagccctgagtgattgcgagaaaagatcagcctccctttctgcagcctggctgggcgctctgggcacgggctggcttgggaggggagcccgccccttgctgcctatgatgcggcctgggagggccaatttccccttcccagacctgcctgctaggggagggcttgtctactgaagttagacagtcttaagagaagcttcccgggcagaggcatcctggctctaatcgcttctggggactcggggccccagacgtggctcaacacacgtcagaagcctgggaccgtggtcagagggagtatgctaggtttggactgtgctgggtttgaacgtttgagcctctctgttaccgaggccagcaggtctgctgcaggccccaccaacgtggcctgaacaagactcctccacatcacggaggacaaggcagagactcagggaggaaaacagctctttaagagccaaggggattccatgtgggaaaatacagagccctgaccagccggcagaaggcctttagctccagacatcagcagagcatgcagggaggggacaaagatatccttatcctaggggacaagacctcaggtgggagcggagaacctgccctccaccaccagggggcgccggcggccttagagaggagccagtgggggcagggctacagaaaaaggactttcggtttagttttcagttcactcagtcgtgtccgactctgcgaccccatcgactgcagcacgccaggccttcctgtccaccaccaactcccggagtttattcaaactcatgcccactgaagtcggtgatgccatccagccatctcatcctctgt

SEQ ID NO: 59362 - DNA, 3342 bp, Bovine  19866880635842
ccctgtgctctctctttctctgtaaatgaccctcttaccaacctggcatttttatactatcgacaacagttatgattcagaataggtaaaaatgtattaagttgatttcttatcttgggagaatttacaacaatgttcaacagcacactttcttggattatctaagaccttatgcagcagtcaggggacagagcttcagggagaacagaagtctactggaatacttagacaaatgagaaaagctctctattaactagatactgcaaatctgaattgcaacaatgaaaatgtcatccagactggctgatgcaccacttgtttttgtcaatgtctctgaaattggtttgtatttttgagaggaaagtgggcaggactctcaggtctaggctcacctgtaggagacaggtaacctcatgggcattgcttttcccatcgagaggcagccacgatagaagaaagaggaaaagacatccctcctcccttcatggaagaaggcttgtgagtcaccagcagtggcctcctgggtaaatatttatacagagatggtattaacgatgagagaggtaaagagccccaagtgtttaagacaaggcagacaggttttcctcgttttgcctcaccttgcttgtgtgttcctatcctaaggggtaaaatgtttttttgtcgttcagtttttgtttaaactggaattggatgtgtttgtctgtgaaaggagctcggggtgtaggattcaatttctaacacttctccatctacctggaagcccatctcaggagcggccttagccgactggatatcaaagtccatcctgttagggaccaggtcagtacctgaatcagtggctcaattcaggcttctttgcttggactggagtggaatccagtctgggactctaggcataagcggagttttccacactgctgagagtctaaatttgggacaagaatgctgtgcctagtaaagacagaatgaaataaatgcagagtttagctttacaaggaaacttctaattcagttaccctaaaaggaatgaactttacctgaagtaagcaagcaggatgaagggacacatattatcccaactcacaagagactgatgcacaaaacctgagtgtgtctatgtgaatttatgttaaggaactttgatggaacacgactgagtcttcacaacctccccatcctttctcaccctcgctgattcctgtctctgtcccattagactcggcaccagcagcagtggcagtggccgggagcccgggggttgggggtaagccgctttttggtaggaaaaggtgtgaaacccctatgaatggtgacttgttgataaagaggcttcatgagagtttcaaggagcagcagtgtatgaactgtgtattgagaaacacatgcagacttgacgcaagaaggctaaggaggttctaagaaaagaaacgtatctgcaaatttggcaagcacggtcaattctagatgctaccacgtgctttagaactgagggggaaagacacaagacttgaattatgtacatgtgggtaatatgagggcttctctggtagctcagctggtaaagagtgcgcctgtaacacaggaaaccctggtaagatgaagacagcatagactgtggctcttactccttagagggtcagaattagagactctaacagcattgaaaggaagcaatgaaggccacaaattaaccaagtgtgtgacttttatgatggctgttgagagtaaggacatgggcagtgttgggaagtattcagcacatgtatgtggttctttctcctctgggcactggtctgtgggtaacctcacttcgttcacagacaccacctccctggctcatctgacagtcctggatcttttctgaggctcatctctgatcttactcatctccctgagatggtcagctaagctggggtttttcttacaaggcactgcgtgcacatttgaacaagacatttccgagacttctagccatccccacgctctcctggcttcctacacacgttcacccacttgccctggaggatgctacgcctggggccagagtggacctcagtaagcatcttccccgctgccagtgcgggaaccagacttctcacttgggcctagaagtcattaagcaaaagccttctttccatctgaaacagatcctcttggtagaggatcttgggttatcaggtgaaaccagccgcctctgtaaacgacttctggggaaagcaaagtgcctttgtgggtggaaacaaggctgctctgtgctgttcaacatcagcaatcaactgttctcagctttcattctttctggccaaggtttcgaagctgtgtaccccaatgatgaggagcccccctttcggcccctctgggagctagaaggaaaatgcaaagccagtgagcttggccccctcccactttgtcactgggtggctttacttgcatctgtttcaagtattgtatggctgcaaaaacctttgttgaaagaaagtttcaaaaactaacgaaaatcggccaacttgggcttcgagtatggtgtaaaaacagactgctccatctctcaggcattgatttcctgctgatttagctcctggccattctgctttcttctgaccatcagtctggggcattcagtcatgatgaggtggggctcaaagctctcagcttgcacactcatccatcaactgctaggaacaaagagccctgcactggacctattgtgccagtaggaagttctacctgagaatctggtctcagaacatgtacttcttcctaaaattatcactctatgctctggttggagatcagtggtgtgctagtaaatgtctaacaactggatctctagtgagggaaaagtgccctgatttgtagcatttactgattgtgtgtgtgcccagttgttcagttgctgagttatgtctgactctttttggctgcatagactgtagcctgccaggttcctctgtccatgggatgtcccaggcaagtatactggagtgggttgccatttccttctccaagggatcttccttaccagggactgaacccatgtttcttgagtttcctgagttgacaggtggattctttactactgagccacatgggaagcccgtttgctgattactctggtgtaaatactcccaataatatcaatttcaatcaatcaacttgatatcactggatgcagagctgagaagagaggcacagtagtatactgttgtatagtatatttccatcttaaagatacaaaagacataaataacatcaaagtagagataatcaacctatagtaaaatatttagggagggatacattttgaaactttcctaccctttctcttaaaataattta

SEQ ID NO: 59363 - DNA, 1215 bp, Bovine  19866880659334
caccaatggaggacacggctggagcctttcttgttcagccctgctttcaaaattccctttactcatagcattctttttatttacacatggcttcttctcaactgccatcctgtgctgacatttttctaatttgaaatgtttaacttcaaaggttattgtgccaatagaaaaagcaattcagcatttgaaacattgaataattaagcaatggcccattgacttacccattgccatacattaggcatcctcttctcatttaccatcttagttcctaatgagtttattctcacactggtatttattgacagctagagaacaacaattcaaaagcatccagaggcccatcccaatatgagccaatccgagctgagttattcataatttagataccgcttgggtgttgtgtttcctgccatctttactaaatgaatacgaaaagaattggaattggagaaaagaaccaggttctggcttctgataactgggagtggaacagtacttctaacaaaatcagttctattctgacagttaacattcaattcctgcacaccatgtgccatttaataagtaaaccgctgctctttttaatgaagccaaaaagatgatgtatgccatctgaagcacaattatacccccagaaacaaggaaagaaatgctaattacaaaactgttcacatggcaactgcttgataaattaaactgaggaaaacagccctatgtctcttacccattcttctttgtgtctggcaaaggcaagggatatgaaaagacaaatcgacatctcattttgggtgcaaggtggccctttttataagatgggtctcttgaaagccctaactatgctgatggctgagaccaacacagtggacacgggcaatgagaggggacccctcatggaaaatatcctgaatctctcctggttagcttcttccctagctgccaactaccaccgcctccagtttgtccctagggattgcaaagtcgggagctccccatttctgggggaaatttgacagggagccacaggaatgaacccgtcagtcaactctgggatcgggatgtgggtgttggagtgcagcaaggttgtcacttctggtcctgacactgctctgacagatatggaagagccagtcttccctggaaccaagagccctcccaagaacgctccactctccttaccgtaaactactgagagggtactctgcccaccatctg

SEQ ID NO: 59364 - DNA, 1226 bp, Bovine  19866880686026
ctgaacccccgaagtaagtcgttaaagtctgtggtgggctctagaaaactgctcatgctcctctacacttgccaggaacactgcttattctgtgatcactcagtgagtgtttatcacattctcgtcaaacccaactgtattttcacaaaatatttttaaattagtcataattcactgggtagtctttgtaattgacccctggtcacgggatcagtgtctccagctaggaaaataaacattccagctgccatcagcagggggcagaaaaccattagcctgtcacagtgtcctatttcattggcattagcttgaaattaatggtaaattacaatgaaataccaacaggactacttatgtcacgttcaatagctacccggctaccccagagcctgtacagctgtgtcctgctgacatgactttgaatttgactccctggcatgatgcattttgaaaggcaagttccggcaccctcaattaacagcatcagaggaaagtccagtggcactgtgctgtgacctcttgaacacttgaccagttcagttcggtgtccgcctctttgccaccccatggaccacagcacaccaggcctccctgtccatcaccagctcccggagtttgctcagactcatgtccattgagtcggtgatgccatccaaccacctcatcctctgtcctccccttctcctgccttcaatctttccaggcatcagggtcttttccagtgagtcaattcttcacatcagatggccaaagtattggagtttcagcttcaacatcagtcctaccaatgaatattcaggactgatctcctttaggatggactggttggattttcttgctgtccaagggactttcaagagtcttttccaacaccacagttcaaaagcatcaattctttggcactcagctttctttatagtccaactctcacatccatacatgactactagaaaaaccatagctttgactagacggacctttgttggctaagtagtgtctctgacttttaatatgctgtctaggttggtcatagcttttcttttaaggagcaagcatctttaaacttcatggatgcagtcaccatctgcagtgattttggagccccaaaagataaagtctgtcactatttccactgtttccccatctatttgccatgaagtgatggaaccggatgccatgatcttcgttttctgaatgttgagctttaagccaactttttcactctc

SEQ ID NO: 59365 - DNA, 779 bp, Bovine  19866881587112
ctttcgcttgtcctcttagctagccaacactaggaaccttaaatttcaggtgaaagtggtacagggtattcagctaaaatccccactgtcaaggaatggatagtctatataaattttcctaaacaagtttttgttggcttttttttttcttctagatttgctaatgcaggatttccagatccttgttaaatggtctaatattcaaattttgtaaaagttcccaggagtattttttatatgctcatgaataaaccttgtcaacaattaatagcatttttcatgttctctctgttcagccttctctacctcccagtgatatacactaatgcttttccacgtgtccagagaagagtcacctctactcaacactaccatctccctgtgggtactgctctctttcaggattctttgtcacatcttttcagtaccactatttcataccataatgctgcatgttcttcggatttctcagtattcttcaatcaccctatgttcattagaactagaatcaatgcttccctcccatgtaaacattacacttttttctgcatatgaatcctccaccatttttcaaatcgttgaattcttttatgctttttttcttacttacaatgaatcaccaccatcaccaccaccccacccccaacatgacagataagactcagtttgtgacttgaagcatctacagaaaaattcaagtgataaacataacattttacaggacttcacatgctcccaaatctttattcttataaaacacgtttattagtaagatttat

SEQ ID NO: 59366 - DNA, 2417 bp, Bovine  19866880436402
agttggactgtgaagaaggctgagcgccgaaaattgatgcttttgaactgtggtgttggaaaagactcttgagagtcccttggactgcaaggagattcaaccagtccattctgaaggagatcagccttgggatttctttggaaggaatgatgctaaagctgaaactccagtactttggccacctcacgtgaagagttgactcattggaaaagtctctgatgcctgggagggattgggggcaggaggagaaggggatgacagacgatgagatggctggatggcatcactgactcgatggacgtgagtctgagtgaactccgggagttggtgatggacagtgaggcctggcatgctgcgattcatggggtttcaaagagtcggacacgagtgagcgactgatctgatctgatctgattaatatgcacctttacatatttaagaaagtaaataaaatgtaagttaaaggaaaatatgagaataagagtgaaaataaatttaatttactttctttttatcttctgttttccttcttcatttattttctacaacaaattcattcctcaaaaattgataatgacacttgaaataacagtctataaacaggctgagaaaataaagaatgttcagttttctttttttttttttttaatttcctattcctagacacatcagcagtctcttcctgaataaagcaagcaagtgattaattagtataaacagtggttaccctgaaaatcaacaagcttccaacacacaatcaaagccagccgtctacttagaaggcaccctataatcagatcagaatcattgtgcatagaaagtaagagataagtacagcagacatttagctacaataatccaagagtttaggccataaactatttttttaaaatcaaaccaatcccgttagagcaacaaaattaaagctaccctattatttaagtaataaaccatctgtagagtagtgtaggtaaagcacactcagccattccccatgatatccatatgtcctgtggatccacccccgggtgtttctaaacagcaggaagcatatttgagaaatggttcatcccttttcattgcagcactaaccaatataaagcagtacttaaaaactatgtgtttcagtcctgaagcttattgtctcctatattttccttcttcaacctgattttacctgcatggtagatttgttttatattgaaacagatctgaaagattatagagggctaaaagcatccagtttatgaactgtcttaggtgaattcacccttgcttcttttgaataataataagagaaccgaagattcagctcaatacaataaaacctgctaagttatattaactctctcatcatttatatctctcatctattttataaacacagtataacatctgatttccttaaataacaatcttttaaaataatttaaaagattaaattgtgtagttatctatgataagtgacataatggtccattctaattaggttgggaaaaagctatatgacctttatatagttaaaactataatactaagacttgtatggaatatgggaaaaaatgatttaaaaaaaaaaaaggggctgtttatctataggccgaagaatgcagttaaaatacaaacttggcactaaatattttagtgtttcttgaacaaattacaagcagagaaaaggcaaaatgtttttttcttctacctcatgctaagtgtccattacattatcctattttaatttcattgtcatgaccattggtacccgatgttacagctggtgctcaccattatgttccttattcttgagaaacccaattgcttccaactgttatattttcagggggatgttcccaggaatgtggaataaaagttacaatgactgattcctccagcattttactccataatcagtcttcagcaaaatgttgtatatcttcaaacttttctaacttttaatttttttcatctgattgaaatttgacttttgcctgaagatgttaacttcgctgcatctctaaacagatggctactttatgccaccatggttcaattcccctaggacttgagctagaagcatcattgttccttactacccgattctaataactccttcctggctccgtacaatctcagctttaaatcacactttatcagaccatgccaccaagaatacttcattattgctgtcattggctgacattcaattcaggtcatttcagttgctcagttgtgtccaaatatttgagaccccatggaatgaagcatgccaggcttccttgttcatcaccagctcctggagcttactcaaactcatgtgcatcaagtcagttatgccatccagccatctcatcctctattgtccccttttcttcccgcccccaatccctcccaacattataagcagggagaaaatacacagc

SEQ ID NO: 59367 - DNA, 4617 bp, Bovine  19866880495986
ttgtacttttataataacaatttaattaaaacaaaaactcagaatgacaatatttgggggagtttctgggttggtgaatgtagtgtgggacagcctgacgtctctgggacagaggctcctgtgctcaagacacttgcagagctttctctgtgtacctcttcactagattgttcatttgtatcctttatcataaaacaacagtcataaatatagtgcttttctaagttctgtgattcagtctagcaaataattgaacatgggttctgtgtgtgtcacctgtcatctgcagatgaaaccacccttatggcagaaagcgaagaactaaagagcctcttgatgaaagagaaagaggagaatgaaaaagttggcttaaagctcaacattcagaaaatgaagatcatggcatcaggcatcaacacttcatggaaaataaatggggaaacagtggaaacagtgactgatttattttgggtggctccaaaatcactgtagatggtgactgcagccatgaaattaaaagacgcttattccttggaagaaaaggtatgaccaaactagacagaatatcaaaaagcagagacattactttgccaacagtggtccatctagtcaaagctatggttgttccaatagtcatatatggttgtgagagttggactataatgaaagctgagcactgaagaatcgatgcttttgaactgtggtattggagaagactcttgagagtcccttggactgcaaggagatccaaccagtccatcctaaaggaaatcagtcctgaatattcattggaaggactggtgctgaagctaaaactccaatgctttggccacctgatgaaaagaactgactcattggaagagaccctgatgctgggaaaaattgaaaggcaggaggagaaggggacaacataggatgagatggttggatggcatctctgcccccatggacatgagtttgagtaaactctgggagttggtgatggacagggaggtctggcgtgctgcaatccatggggttgtgaagaatcagacacaataaagactgaactgactgactaactgggcagaagtgtgggaaccccacttggagttggcatctgagatggggcagccttgtggaactgacctcttaacttgtggggtcagcactcgattgcaagtagttactctcagaattgaattgaatttttatacttccagttgatgtcagagaattggaacatcggttgttgtaaggaaaaaataagtaccacttcatcacctttgccatataatatagcctaattaagggagcaaatagtctttcagagtgacctgtcccacttgtgactcaaggaaagtcagggtcagaggacctatacagcagggttagggatcagagacagtcttagaattctttcaaccacagctgagattctgtatgcctagggccaacaatcacccaagtaaataatccagtataaagttgctttctgaaaatgaactttctacatttggcctattgcttatataaagaaaacaatttcatttaaaaatagttaaaatgatgaagtcatttcattgatacataacatagggtagccattatccacattcaggtcagtgttacccttgctttatgttaagttttagatgctgatactccaaaagtgaccaaagaatcacatggttatttttataaccattatgaaattgtatggttggtgacttgaaacatactttgtttctatgagctgtcaccttgtaaccatggggaactggagacaccatgtacagattctatactgtaacacattctccttttctagtggttgttgcacttcaaagacctcagataatctgtggttgaggtgagtcatttttttttttcctttttaaggaaaataactcttgagacaccaatttatctcaaagtggaacaactttttcatacagtagagtcttaatcatgtttgagattaacatataagtatacaaaaaaggaaacaccctcagagatagatattgtttaaccattcactaaaaatatttaatagctatcacagggaaaaaatgatatatatatattatatataaatatacacagatatatattcaattcatctggtcaaagtaatctcttatattcctttacaaaggcactacaagttcagatgatagtttggggttgatgatgctgatgactgtttctgagaacatgaatcacctttaaacctaaggtagtgctctgaatatgttgacactgaccctggggctgaaccattactcaaattttccatgcctcagccactacttccagtgacaaatgaaacagattctgccaactgcctcacacaaataatgcttttggattgcttgttgtgcttccttgcaagagctgagagaaccatttttcttctaatccttaaggacaaaaatgcattagtctttccacttctaatccaatcagtgctatttttcctcttgtgagtaaaaggttttgtgaagtctgttggtcattataaacactggcttatgaaagcttcaaagtgattcagaacttctgtattctgctgtaaccttcaacatcatgctttggccatccatacataagaagttagatatttcagaataaacgccgtcttaatcttgttattacttaactttattattgctaattaaaaaaatgtgcaatatatgaatagctctatagagaaaaacaaaaatgtcaaagacatatatacacatatttacatatgtctttgacatttatatcagcttccctgatatctcagttggggaagaatctgcctgcaatgcaggagaccccgatgattcaattcctgggttgggaatatcccctggagaaaggataggctacccactccggtagccttgggcttcccttgtaactcagctggtaaagaatccgcttgcaatgcgggagacctgagttcgatccctgggatgggaagatcccctggagaagggaaaggctacccactccagtatcctggcctggaaaattccatgcactgtacagtccatgggtttgccaagagtaggacatgactgagtgactttcacttttgcaagatattgaatatagttccctgtgttatccaagtaggacttttttgtttatctattatatatagtggtttgtatcttctgggcttcccaagtggtgctagtggtaaagaaccctcctgccagcaggagatataagagacatgggtttaatccctgggtcagaaagcttccctggaggaagttatggcaacctactccagtattcttgcctggagaatcccatggacagatgaacctggcaggctatggtccataatgtcggaaagagtcagacactgataaagcaacttaacacacacacacacatacacatctattcaaccctagtgtattttttccatgtataaactattgatacccaaatatgtaaatatacatgtttgattaattttaatgtgatttcatgattgattttaatttgcagaggcacttaaaagtattagatcatttaaccatttagcaagagtagtttatacatatgtatttagcaacatcaacctatctcttacaaacaaccttaattttaaaatagtcaaaaataacactgtgtgtatgtgtgtgtgtaacagttgatttaggcacatgtacaactaagtaaggtatgctgctgctgctaagtcattgcagtcgtgtccggctctgtgccaccaaatagatggcagcccacatgctcctctgtccctgggattctccaggcaagaatactggagtgggttgccatttccttctccaatgcacacgtgcacactaagttgcttacatagtgtctgactctatgtgaccctatggacagcagcccaccaggctcctctgcctatggaattctccaggcaagaatacttggagtgggttgccatttccttctcccaagtaaggtataggattgttaattctcaatctctcagtattaatatgcaactcaacccttgttaatcctgttggttatgtacttggttacatgttcctttgttttggcttattgttccttccttatcttgcagtggctcttttgaggaccttaactgattccatccctgatggcagaacatgagctttcaaactaactctgaattttcctagtgtcccataatttagtatacatttctttactcattcccaaaagtagttttgtttcatatctattgctccatactctggcttctggattcgaggagttaaattacctgcatttgtgctctgtgtgtgttctcaatggagagttttccttttgatcaggttcctgttagataaatttcatatttccagatcctattttgaagcctgtctttggatcagtgattgtgctgaaagatcagattttgctgctgaattagttagaccaactaaagttcttaatggtaaaaagttggttactctagccttatacttaataatatggtaattctgattatgatgactatatctttctagttgggtctcaagttctatttgatctgacagtttattccaaaacattgtggaaggattataatttacctttcttgtatttatcatgcagctgtgtgtgtatgcttgtatcaca

SEQ ID NO: 59368 - DNA, 1370 bp, Bovine  19866880754187
ttattgtgatccacacagtcaaaagctttggcatagtcaataaagcagaaatagatgttcttctggaactctcttgctttttccatgatccagcagatgttgtcaatttgatctctcgttcctctgcctttcctaaaaccagcttgaatatcaggaagttcatggttcacatattgctgaagccttatgtatatatataaagatatttggaagtctatatcaatttctggagggcagagtgagactattacttaaatgatatttttgtccacttatattttattctctttatttttgttaaaatacaaaataacatatgtaactatgtgaaataatacttgacctagtctattcaccattgttgtataatcatattatggaagctaattatgcataaagtatataatctgaaaaactaattaatatcagacattctttgtttgttcaccctggatatctacatatgatttgaaatacatacattttacttggttctctgtcttgaaccaatccaaaaaggcagaaataacatgtaaaaccatggatttttaaatgggtaagtgattaattacattaaaagatatgttaataacaaacaaatgaggtcaatttagttgaaggacattgtagtggaaaaataggaacaagaagtaaacacatttttatctatgcaatcaggaattctagatgaccataagctgttaactggacacaggtggctgttttctcaggagatcccttcctaataggttttaaatgagaaaatgggaatcatcatttttatatacttttgaaatatcacacgtgtgaaagccttcatacatcataactgaaataatgggaagtgattaataaatgtcattgacataaatgagttgccagatgcatctaatcctcaagtgagcaggaaaaacaaatgcacaaaaacctcttaaaatatatcatacctgattgtgacaatttatgcttaaccacagaaatgatttcaatttccaaaataaagtaattttataaagctaaattatttattttgagaatataaccaatttctttattttagcatttgaaaaattatattttgtcttctgtctcataccataattataaatgaatcaaagcaaaaaatggatacaatgtaataaatatctaaggaaatgaagactgtaatgaaatatataaatatttccagttaaaatgtgagaattaaaagtatctcttaataggtatttgtttactgaaacattttaaaaataatttgattttaatttgaaagctaactactagtttagttaacttatgccatgatgtttgtcattgggtgataatcattacatttaaattttagaaaatattataataccaagtatttt

SEQ ID NO: 59369 - DNA, 1358 bp, Bovine  19866880772425
gctcctcctcttataaggacaccagacatatagtattagggcccactctaattacttcatcttcaactgatagcattttcaaaggttctgtttccagatgaggatacattcacaggtactcaaagttataacatcaacaggtctttatggagggcataatataacactttatgatgtagatattggttttactttaaatctacctaccaacagataaaaaaatgtgagtatactcagtatactagagtatactagacttcaatgtgctctgtgactcttcccaacttcgattggtagagaaactcttgaacttgccattagtgtcaaaactcttgggaacaccttagcagtctggaggatgatgccaattgccctgtagtttggtgaattccagataacagctcacataacaaactcaatttgctgaactaaattatttatagaaactgtacactaaagtagcaattcctaaggtgtcaatggaagtcaatgtcagtatgcaaatttcctttttagctgcttcatgagtaccaaataaaatgttttttataaggttgtagggtcctcttaaataaatagatctgttaagctaataaaacattggcataataagcctatttaaaatagatttctgctgtattttgccaaatttacagtcacagtgttagaagaattctaaaatgcaatgatttgaatagtcatcaaggataattaaattttactttttattaaatacaacactccaaaagtgactctgtgagaattttttttttttctgagataaaatttggagcacagatcttaattattcagatctcaacacttaagtcctgataattggtcatttctataccatgcttctaaacttgctggtttggatatttaagtaagaaatttattttttactaaacagaagattttgttctcacagacttcaatcagtttcatttgttacaatctagctataaaattacagttaatttcctacagtgatattaattcttttcaaatttgtaattggcaattaatggcttttgtgcagcttctgtcaagagtttcaaatggaagaaagagcaattttttttacattctgtttcagttttctttttccagaataactgtttgctgaaagacagtactttcagtaaagggtaactttagggtttctttaaaaatgcaacgtgcaaattagcatccacatgctattataggaaatatttaaggacagacttagttggtaacaatgtcctgaattaatttataatcaattacttttaatgtgattactattaatccatgaaaatgaactttaaaggaaaacatttcatcttccaaatatatgcagaaaaatattcata

SEQ ID NO: 59370 - DNA, 1522 bp, Bovine  19866880817575
ttgctgaactgcacaaaaaatattgattatttcattttaaaaagttattctgtgaattttttagcacaactttaaagcaatagacagaagttatattcagcagtgacttgaaaggctgaataatccagttgatttttagttttcctgtaaagcttgaattgttattaaggttatataataataaactaatttttctcttatgcatcatgccagtatttgattttatttttagttaattggattgctattgtacattataatagcatttgccaatttgatatcccctttactcaaaggaagatcaaaggactttttgctctctgatctccagttcttcaaacatccttgaatgacatttcttattactttctgaaaatacccaaggtaaggcagaatgtctgcaatataatacaaaatctcttcatgccaaaaagacagagtagctaaaattattaattttatgttagccagaactgttgtcagtacttctgttactactgtaacagtttgccctggcaaactaatacaaaagccacacaagaaaattatcaactggtctcagaaattcatgaggcagttatgcaatgtgttgactctaaaaacttaaatggatgcttttattttctatagaggttgttctccatcattttgtaaaataaaacaagagtaatgaattactctcatagagaaagtctttcatacagtcagaatgtggtaatgttagcagaaactctactgatctactgaaacatgtgtttaaatatagcataggcataaggtcttataccggagaaggcaatgggcaccccactccagtcctcttgcctggaaaaccgtatggatggaggagcctggtgggcagcagtccatggggtcgcgaagagttggacacgaccaagcgacttccctttcacttttcactttcatgaattggagaagaaaatggcaatccactccagtgttcttgcctggagaatcccagggatgggggagcctggtgcgctgccctcttatggggtcgcacagagttggacacgactgaagcgacttagctgcagcagcagcagcagcagcaaagtcttatacaaagtggtatcgtgtgccatctatgtctcattattcagagagaagacagagaaacttacatgttctactggtaataaatgaattaaaaaacatttgctgtgagtcaagctaacagtatgtatcaaagaattaaaatgatcatatatcttgacccaatataccatttgaattatttatttttttgaaaaataagaaatatatacaaacatatttctaaaaaaattcttaactataaaattgctggttatagaatattatgaattatattatatattaatattatagagtatattagatataatataattacttagaacttgaaaattttgcaatttttaagttaatttatattatttaacaaaatctttaaatatgagttaaaaatcaaatgcaatgttagaaaaaggttgttttcaatgaaatacttcaaaaaacg

SEQ ID NO: 59371 - DNA, 1663 bp, Bovine  19866880954175
ttgttctagatatatttatttttatgacttttaatttaattttatatgattttcatttaactacagatatatgcctttattatgtttttattataaattccatctaaaatttattttacaggataacagattgattatccaaatactatttattaaatgttttaaatatcatcaccaattttaataccttccttttaaaaataggaaaatactgccagtatgttattaaaaaatttcttctacataatcctctttgaactatatataaataatgcatttccattcaatttggggagaagtacaggatttgtattggtgggatttcatgaataatagatatcctaagtataacataatgaattagaaatgaatatctattctagattttttgtttgtattttcatttttctctcatggcactagtacatgtattttaaaattattttagtgttataaagattttcagtgtctgggaatgtaaaactctaccctctccctgtccccctaaaaaaaaaccaacctggccaatttcttattactgtgtgccatccactaacttttaaaataatattcataatagcattttcaattaaaaaaaatgttgtggtttttgattatgctatattacatattaatttgcagagaaccaacatattgtatacatttactgcttccttcaaggggcattctatatcttccatttacttagaatttatctgttacatataattaaatttattatttttttaaagctcttaagtttatggaatatttatatatagctattttaactttagtaaagttgacccactatattttctaccatttatttatttgaaatgatatttattagcacctgtaaagctttatttattcctataatctacataaagtaatatataacaaaagccacatttgaatgaagtgattttttaaaatatatttttattttactcctttcacaccaatactgaaaaacacacactgtattctattatatgcaacttgcatatgtattaaaagcaaagtggttcacttggaaatcatatttacctgttgacaacaagtaacaatgaaaacaatacagattcaaaactcttttcctctattaaaataggaccaactcactatgttataaatattttcaatagtgttatttttttacataaacataaatatttaattcaacatggaaaaaaggatggaagtgattattcataagaattcataagtaaaataattttcaactataagagcttatcaaaaattaaaatcaatctgtcttcattaagataatatacttattttcctcgcacaatattatgagatcaaaagagtactggcttcattcaaggatataggctacacttttgaattttctctcagcaactatatgaatagattaaggaaaaatatcacactccacctagctttatattcacaaagtaaagcaatactagcttctcaataatggttaagacaaatctgctcaataatagctgacagaattgataatgtgtttctcgtgtttttcttctcctctattataaagtatttgaataaggtaattcatctttaagatccctttgggttataggactatatttctattttgcaaaattaatgcacattatggtgatattaattttgggatttgtgagat

SEQ ID NO: 59372 - DNA, 2814 bp, Bovine  19866880968492
tttttcttggaaatgaacagagatcttctgtcgtttttaagattgcttaaagtccaagtactgcattttggactcttttgttgactatgatggctactccatttcttctaagggattcctgcccacagtaacagatataatggtaatctgagttaaattcacccattccagtccatttttgttcactgattcctcgaatgtccacgttcactcttgccatctcttgtttgaccactttcaatttgctatgattcatggaactaacattcccggttcctatgcaatattgctctttatagcatcagaacttgcttctatcaccagtcagatccacaactgggtgttgttttttctttggctccttcccttcattcttcctggagttatttctccactgatctccagtagcatattgggcacctaccagcctggggagttcccctttcagtatcctttcattttgccttttcatactgttcatggggttctcaaggcaagaatactgaagtggtttgccattccctactccagtggaccacattctgtcagacctctccaccatgacccatccatcttgggtggccccacatggcatggcttagtttcattgagttagacaaggctgtgttccatgtgaccagattggctagttttctgtgattatggtttcagtgtgtctgccctctgatgccgtctcggagcacctaccatcttacttgggtttctcttaacttggacgtggagtatctcttcactgctgctccagcaaagtgcagccgctgctccttaccttggacgagggttgtctcctcacagccacccctcctgaccttggacatggggtaactcctctcagccctcttgcacccgcatagccgctgctccttggacctggggtagctcctcttggctgtcaccccaacacaggcctaagaaggccaggcaacatcaaaaaatggtatcttttgagattttatgtgctttattgggaagaacttttgctcctagtatttctattgctagtttattggatcatttaccttttcctaatagactgacacaatgacagtggtatatgaacttagtgtttttgtttccgatgtcaaaggaaaatttaattggcttgttgtttaattgtgaagttatgtccaactcttttgtgaccccatggagtataatccatcaggcttccctgtccatgggatttcccagtcaaggatacaggaatgggttgtcatttccttttccagggactattccacacccaagtatcaaacccatgtctcccgccttggcaggttgattctttaccactgagtaactagggaagccccaattggcttataaagaaagaaaaaaaaaagtttcctcccctcacttaacaataatagagataggaagaaagaattatgtcttgtttatgacatttgaaagaaagaatcattgagcagtaagagctaccaggtagaaataaacctccattccaggagaccagagcagacagattgtaatttgcagaatgattctgtattctcaaaaatcataagcagagatggcaaagatgcttatcattacaaaatctcagttgtcagatctcctcacagattaaagataaactactgcattaacatttattataaatctagaagtattgacaggacagaaagatctagcaaatcaaagacagaaataataagtattatccctctcagggctttatgtaattcaatgatagagaaattgattttcagttaaagcaataacaatgcagtctgtgctctaattagacagcaataatcttagagaagataacagaggtgttttgagattaactctcattatacaactgtaaattgtacactatatgtactactaaaaagattattgtgttagaagaataggtctctaaattttgagttaatctgaccaatacatatcattataggtattaaaacctttgcaaaaggagttagtgatatacatcggcttttttactaataaaaatatgccaaggataattggaaagttttatgatagatagatagatattcatttttgccaattttattttgtctctatttgccagatttaaaagaataaaaaccaatgctatgcttgaaaacatgaggctcaaaaccatctatatcttgctctagagagaatattcttaggaggcatagagacatttaatcttgatctaacctgggactgaggtaataaatggcttgaatttaaaaccttttgtcagattatttatttccattgcaccttctcttctaaggagtaaccagccctgcatatttcccaacagaaaagcacatgctcaccaaggctcatcttcctcagtggactctgaactccaactgtggtctctcaacttagtgaaactgcttaaagctccctcatcttttcaacatctagtctgccacttaataaatggaaaatgtctcagggggagaatagagttaattttaagagtttctttcttagcatttttctccagtctaaaatcttatgttctccagttttcattgttttatcagtactcaagtgctttcaaactggtgtacactatatttcctgttgtttttcatgggagatttgccctcaaataatcctttctgtcatagctagaaacagaagtcaagtgttcagtatttaatttgcaaattactgtctgtaattgataaaacactttccaggttttgttagctgtgagttatatgagaggccagattccagaaacaacaggtcagcagtttttccatctttaattctaactaatgatggcttatagataaaggttagaggttt

SEQ ID NO: 59373 - DNA, 2867 bp, Bovine  19866881266083
gatgtgcagagtcgcacagtgttttggatggatgaccagttaagtgagtctgatatcaccaaccagccagcatgacagaaacagatcgttaagcctttaattttcacaggtgataaagatctgaagataatcactgaatgctttggcccatactatgattatatatttaagtcccaaagaggcaaactaaagctataaagctatcaaatattttcagagatgagtatatagtatgcttcaaatatgcaatcaacttccatttgtcaagtgattacattaatgaaatagccagttttaatttaatagttataatgctggccttttttggtgtgatttcatcatgaacaccatatgtgtggttaaatgataaggcaaatttggcaatatatgttaaaatggagccagtctgctaatattaaataccactagctaatgcataattgataatggtacagaaagcaggttaagaaagtcaagtggaaagcttgatgatagatatctgatgtacagacatgttttaatcatgtccttaaaatacaaggtaaaaaaaaaaaacaaacacaatcaacaaaggaacaggtacaggcctgcttggaaatagaggtagatagaatgcctctgtttggttttcagacttatcaaactgactctttgaataaaggcagtaatacttggccttgtgaataccagccacagacttaactaagaaaccgagaacattagagaagtatcagctcttgtggctacatacacagcacaagatcactggcaatagaaggtggctacatcattctcaccagaggcattggagaaaagaaagaatcaacaggggaaatttagaagtatgaaatatttaaggaaaaaaatgtgaagagcattgatctgagtacttgatgggttctgtatattcatcataatcacctgatggatctttgatatattttaattcatgccactctgtgtccctaattctgatttgataagtctagattgaggcccagggatgttgagctttttaaatcctctaaggtgatcagtcttttcttctttcagcttgcccccttgttgttcagtccctcagtccgactctttgcgatcccttggactgcaggcacaccaagcttcgctgtccttcaccatctcctggatcctgctcaaactcatgtccattaagtcagtgatgccatccaacctctcatcctctgtcacacccttctcctcctgccttcaatctttcccagcatcagggtcttttccaatgagtcagttctttgcatcaggtggtcaaagtattagagcttcagcttcagcatcagtcttttcaatgaatattcaggattgatttcctttaggattgactagtttgatctcctccaacaccgcagttcaaaagcatcaatcctttggtgttcaaccttctttatgttccagtctgacatccatacatgactactcaaaaaaccatagctttgactatatggtcctttgttggcaaaataatgtctctgctttttaatatgccatggtttatcatagcttttgttctagggagcaagtatcttttaatttcatggctgcagtcaccatctgcagtgattttggagcccaagaaaataaagtctgtcactgtttccaacttgcccccttacctatgtagtatttgcatatcccggatgactgatggccagtttctgctctcagatgtctttgaatagggaaaattagttgggagtatcattatatatactctaacaaagctctgataatccccatcacatatttttttaattcacatataaaaaagtcactgataatttgaggtaattcttcaccatcatttcatataaagtgcttatattaagatcaatactctttatggtaaattgtatatggttaaccagttatcatagaatatttgatttttgctatagctgacctatgcttgcaattctgctatgaattaacaaatgcatcctaatctagctttatccctataaataaatcaccattgaatcttacctatgatgtattggttaactattctaacactcatgcaagtggtattcactaggctaaaacttctttaagcatcagcattaaataaatatcttatttgtaatactgctggattccctgttgtcaatattcccaccatggccaatttcaggctacaaatgggatcctggtgaatgaggaattggaaagtgtattaatttcctaggcctgctataacaaagtatcccaggacaaatgacatttattcactcatggttctagaagatagaaatttaaaatcgaggtgttggcagggccatgctctctctgatatctataggggaggaccctttctttctctatctagcttctggtacttgatagtaatccttagccgtctctggcttgtagatgtaccactccaatctctaccacctttttcacacggcatttctcccttctgtgttgctgtgtccatatttttttctacaaataagaacaccaggcattaggttagagcttattgtaaccaactatgacctcatcttcagcatcagtccttccaatgaatagtcagggttgattttcttgaggattgactggcttgatctccttgaaaatctccttggccacttgattggaagagtctgctcactggaaaagaccctgatgttaggaaagattgagggcaggaggagaaggggaccacagaggatgagactcaatggacatgagtttgagcaaactcagggagatgttgaactccatggggtcgcaaacagtcagacatgagttagcaattgagcaacaacaaataacaacaatgacttcatcttaactttattatactcaaaaaacatttatttcaaaat

SEQ ID NO: 59374 - DNA, 1236 bp, Bovine  19866881591292
ttctctttgatgaaagtgtgtatttattaagtagttctgtaattaaaattttgaaagagtgacttatacagtgctctggaataatactatatggagagttatagatttttaaatatatcattgtgtcaaagtattcctgtgcaggttagcttgctgttaaaactattgcaatcttatatgattaacatagcaaattaaaggaaaaatagtgtgggataaggataattgaccaacaattaaggagaaaagtagcacagcattacagggtatacaaatataatactgtttttaaaatttctaatttatttgttttaaatagggcatgtggtaaaattatactagaccaatgaaattcttctaggaaactaggaaaaataactctctgaatatctcctagaagggataaaatatttgttacgaaatattttagctttgtatactaatatttatctttttagaaataagaacagagttataacaatggcataaactaaaataaaacaatgaaaatacatattacttttataaaataattagcaatgattaaataaatcaaaattgagattattacttagtcttctgaggaaactactggaataaacaaatctgtgtttagagagaaatctatgatttcattaaaaaaacaaaagggaatagactttggtatctggcctgttagttaccccaaccagcagtaaaatgaaaacacacttggaattccaaataaaacaacacacatataatttagaatgtatagctgactttgtaacacagtaagggtaatcctagatatgtaccttgaaaagcatttgcatgtatatccaaagtaatgccactaataataatttaagagttttgcatactattgaaagtacaaaacaatataaatacatgttaacttagaagaacagattaggactggagtactataaaacaagataaatgagaaagtcagttgcagaatgatattatcatatgaatttatagtttaaaatgtataaaataaaattatatagtatttgacaataatatatatgtaggaaacaacaaagatatgcattggaatgatataaactctctttcagagtaatgagagaaagagaatataattgaataagggtggacataaccctcaatgtcacacaaaattcttttttctccttcattttgatcttaaatatgtatagataataaaaataataaagggaataaatatactcaccttccaaatcaaat

SEQ ID NO: 59375 - DNA, 2468 bp, Bovine  19866881564294
cagagttggagacgactgaagcgacttggcagcagcagcatctttttatgctcaagcctgtgttaatttgaacacttttttctttatggtctgttgaaaggagggggtatagaacttcatccagatagaagattcattttcattatgttgaagggttttctatgttgcttaaccttagaaaagttatgtttgtctgctgtggaatacctcagcacatctgtaaggaactttggcaagcacacttgtcttcatcaacagagacagcaacagtctagtgctttgtctccaagttctatcatctctctttctgctttttctgcaccatattacacagagctgttgttcaagaactttcagatatgcccagtgatttgggctgactcaagccaatttaattttgacgacccttacttaataatggtggtagccaaagtgaaagctgagtaagagtcaattgctttcctaaaatctcacaaaataaattctgctttgtataaaacattaattaaacaaatatttactatgaaaaatatcattatagcttgttcaataaagatgatgaaattctatctttttgtttttcaagttctcccactacacttttaatgaaaaagtttgtgtcagatactataatattttggaagcaggatttagttaacagaatgaggaaactagaatcctatgaatcaatagctagatcgagactcatgtttggataaaccctttgcattatctctaggcattgcacctttaggcttgctgtaaatgcaagactaaagggtgtctctaaaataaataaatgtgtctctataaatataaataaataaataaatggctaatccacatggtactgtgctgtgctgttctcagtcccatctgtctctttgcaaccccatgtagtctagcccaccaggctcctctgtccatggaattatccagacaggaatactggagtgggttgccttttcccatgcgggaggatcttcctaacccagaaatcgaacctgtgtctctcatgcctcctgcactgtaagcagattctttaccacggcatcaccagggaagccctaattcacatgtcttgaacaccatgaacacctgttcctaaaatctgttacaataatttataagcttcaggtaacacaaataaaaaccaatttctaaactgtactataaaaattaacaaagctttggtgctaaaaatagttgaaacatgtataatactacctttggaagtgtgacctgtcttactgaggactagctgacttcccagaaagtgtataaatttctgattagagcaaatgatagttgtggcagtatatatacacacataaccacagatacacacacacacccacaaatatactgatgtattttaaaataaattacaagcagcttagcatcccttagcattcaatatctagtcataaaagaatcatggtgtataacaatcttcactgcagatggaagtctaataaacattatgagatcacaaattcattttaaattttgatttagttcagatgaattagaagcattcaaagagagatactttcttttcctgcacaactcccccttctcttatttccttccttccttaagatttatgcaatgcttactctatacctgattccatgtttggggaatctgagggtaaaataggattattatttccctggaggactttgagtcaaggaaattgatacaaacaaaatattttataagcattcaaaacttatcattagcaatataaagtattttgagagaatctaactttgcttataaattccaagtaactcttcattatgtagttgacattggaaaaaatcttgaaaaatgggtaggcagtgaaataattctatataacagggattatatatgcaaaagcacaaaaattcgagtctggtacatttaggaaagcacaaaatagttcaagatgtttgttgtaaaatgtaagaaaatgtcaaggagcaaactagaaaggtaaaccacaggcactatttctgtgtttaaggttcatatcctactgtctcattgatatttcatttggatatatagtcatgtcctcaaacttagcatgtgtagaattgagtgcttcctgtgatactttccctctcataaaatacctttagtcttgttggtggctcagactcacagttagagtcctcctcttgacttctctgtctcttaaaagcatatatgttacatctgtcaggcatcaaatttgccaacttttctttgactaatttcccgctttcatatttgtcccaacttctttcagttgttgacacaggggtcaaaaacaattcagttcatattacttctatgtttgaaatttgataatgctttcttttattactcaggaaaaaggtcaagctcttgcactaacttgtgaggtactcctcagtgtattaagctttatctttgatcagtgatatgaaaattcttcctattcagacatcccctca

SEQ ID NO: 59376 - DNA, 1871 bp, Bovine  19866880552062
gtggtgattacgggaaatttatgagtaggtttttgttatgcataacttatggaaaacaatagaatatgccttttttttttcagggtgtgtgtctgactgccaccaaacatagctgatctaatgagactccctgaggttaacacccttgttttcctcaagtgtacacatctcttgggtttccaagtgaagaattttcacaaggacacccatagaaacacagagccctttgtcccaagctccttcctcttgaatatttgacttttagcactttattgtcaactaccacacatgtcacatggctaagtcatgaaatgacacaaagctaacagtccaccttgggaattaaattgcttacctttgagcaattccaacaatccacatcctaatttacatgtagaatcatttactcaattctttccaggaattaaaatataagaaacatggtattagagactctcccttcctcacacccatattccttctgtgggctactgtgtacagatctctctcatcattctatacaaagagagagactactgttcagaattaacaattaagatataaaacagttgttttatttatttatttattttaaattttattttatttttaaactttacaaattgtattagttttgccaaatatcaaaatgaatccaccacaggtatacatgtgttccaataatatatttggctgacaaaactcaggcttttcttgcttctaattcagtttgactaagcttagaacaattactgatctccattttttttaatatacaagtacagggaggaagaggaagatgggtagaggatttaaaacaagccttagattatctgtattctgataatcaatggtgcactattcctagtatctatgaaaactggaggaaaaactccaacaacttagttttcagttgaacttctgagaagcatacctgaaggctaacttcccctgtatgtcctgaaagaaagtagatgtattttgacatttcagttccaaataccctaaatagtctacctatgaaatacttaactgctttttcttcaaattgagcttctttctgatttttcattgcagtctgactagcatcttccgaaggtggcattttaaatagtagctttggctgtttaagagagaatgtaagtaaagaaaaagtgttggcaagctctattatcttaaaataacttaaagcactataaatagtaatagctatagaaataacactaagaggatcataataatttctaatgatttttaaaatttctgcatttagagaaaatgacatcacataggattttaaaatgttctctgaaataactaactacccaaatgaaagtcacaaattttagggagaacattatttgaattttaaaatattttactctccaggattataaataaaagagtagtgattcatttcaaaatatccccagttgttttgctttcaaaatcatccctggaagtaactgatcccagatcccaaagtctacggaatgaaagagcaaataagatgtgagttgttagcagatgtacgtgggcagttttagctggtaatgaaagctattcaacgctaataaccttacctgtggataatgggccactaatgcagtgtgactctgcagttcaggaaggtctgactacaccccaaattatcctttccttcaatttgcaaaattatttaaaattctaccaacagaaatttattctttgaggaagaattcaaacattaattccccctcgccagttcatctttcaaaagacaggcaattttgagactgaaaactattaaagtttagtttactccaaggcagaggtcagcaaggtaggaagtaggtcactccaacccgctgcctgtctttataggtcctcca

SEQ ID NO: 59377 - DNA, 1772 bp, Bovine  19866880749917
tattctgccctagagaattcccatggacttatagtccatggggtcacaaagagtaggacacgactgagggactttcactttctttcactttcattgttgtttaatatcttgtttgtctatgggaattgatgctgcttaagaaatcctggtgggcttcccagatggctcagtggaagagaatctacctgctaatgcaggaaatgtgggttcaatccctgggttgggaagatccccctggagaaggaaatgacagcctactccaatattcttgcctgggaaatcccacgggtagaggagcctggttggctacaatccatggtgtcgcaaagagttggacatggtttagtgactaaacaacagtaagaaatcctgagccaggaaacccttggcctcttgattggtcagtggcttagtgtggatggccaccctcctcattgtgtaagtctgactattcctctctctgcactaaaatcctcagtacgtgaaatagcctatagtatttcctaggatcagcatttatagtcgttcatttcatgaggataagagctccatattactacttctgtctgtgattcactagtgggggaccatataagagactgggaagatttgacctaaattacaaaccattccctaggagctgtccaagacccatgtgggttatgggtgacttgacactcatttgacctttaacagttgtcggcctcgagctgaacttctcaacccagcattagtgacatgtgtgccaggtaattctttgttgcagaggctgtcctaggcattgtaggatgttaagcagcgtccctaagaatgtactcactggataccagtcacattccccgtcccaagttgtggcatccgaaagtgtctctggatgttgctaggcatcccctggagggcaaagctgctctctccctctcactgagaacaccgagctagagaggatccatctataggacactccaagtcaatttagaaaataaagctaaagtttcagctcttttatattcttacaaagttcaatatgtatgcatattcattacactgtatatattcacttatttcagccaagtgtaattatttttaaggtgcatcttccctcctctgaatgtaattggacagaatgctcagtggatgtaaagacagtattcatttacataagccctccctggcatgcttaaagtgagctctttacttcccccatcccaaacagaaacttcacacaatatgccgtgttattgatgcccttactgcaaagagggcggcctgtgactttgtgcttttttatacctttgctctttatattggtattattgactatagcagcgatcatgttatcatatatggcaaattttaagttcactaaattgtcttccaacattctcatcaggtctcatatactcaagcatttctcctccacttagagtgccactgacttaagcagaagaacaaggcttagacaacaatagctaataataataactactcgttactgagcacatattagagcaaactacatgaaattgctctttttgtatgtgtcttatgctttatgtgcctgatttcatttaatcctcacaggaaccctcttttttttttttaaccactgaagaaaaccaggttatagagcgattatgtgattgaatcatggttaaaacctacatctgcctggttacaagaatctatatccttgaccaccaggctattatagtgtaaatttggatcctgctgtcccttaattttttttagaagtcaccaaatgtaggacaata

SEQ ID NO: 59378 - DNA, 1526 bp, Bovine  19866880752522
ataattctttgatagagactgagatttagactgcaaatataaaatcaaatcatgagaaagaattgaaactttaataaagtatactagaaatgcttggttttattctacatgtgatattccaaatttccacatgtgtcagctccttagatcccactgaaaaatgttcagttactgaactagcaaaatacacagtgaaattttaaaatagtgtagaccttgaaagctgaatctcattaatacctccaagaaatcaatatggcatgatctgccttatattttttacttactatattctcaaatatgttagagttaagcagaacctaaatataagttacattttaaaggcaatgtgaaatgaatggttaatgtttttcaaaaagagactctcacctctgtttgtacatacagagccaaaaaattacagatcatgaaaactgtccactccatatgcatccccaaggggccatgtgaagatgctatctgggctggaccttgtttggcatgactgggcagcagggttatttgctttgcctctctcctctacgagcaacttaaaaaaaaattatagtaggtaaacccacatatgtaattaactgacttcataaggaaatcctttgtggttagagttctatcaataaatagcattagatgcaaaatctaaaactctatgtggatttgaatcattatattgtcatatagggataacctgtgtactactgtatctctacgacaaacagtactctggaaatttaatgatttaataaaagaagataattcacaaatgaaaactgctcatcaaaaagttatatattaccaatgtaatgtattttaattcttcgatttttctaaattgtaattaaagctttagggagccaaatgagctcctggtaatagggtaaaagtctctcttttcctttattgtgctaacatataaattccattattttcaatcctggcttcacaaatgtcaataaactcagataagattgagagctaagagtctccaagctctttggttttccctccctccctacaattttctttgcacatcaggaagatgtcacttgttctcactcagataaaaatactgaaagagacaagccaactctttctcactcggaagcctttgaaatcttctagtaggctcagtttctcaggcacagactccagatggtccaaagccactcgggtactctagaaaagaaaacaaggcaagcaaacattataaaaaattgatcaatactctcagaatccaactactaaaaattggctgtaccactggtataagcagttcaagctgtagattgagagtcaactaagaagaaatagtatttctaatataaatgtatgttttcaaatcagaaaataaaagttttaaagaagtatatgagatgcatttgcaaactgcctccaatacaaagctcttcctagataactgctttcaactgatacgctatgaaactttctatagagaatttcatattaatttacaaaccgcttcagtgcacatcagaaataatcacaag

SEQ ID NO: 59379 - DNA, 3333 bp, Bovine  19866880780482
attcctggggatagtccgttgataccagtactcccccacatgtgcctgagaaaggtgtattacctctgagattgtctcccacacacacaataccaatcataagagaaataccagacaaacctaacctgaagaacattttataaaatacctggaccattctctctaaaactgccaaggtcttggaaaacaagaatgagacagttacagagcagagaagactaaaaagatgtgacagctaaatgcagagtggtgtcctggattggacactggcacagagaaaggacctcagtagacaaaatctgaataaagtctgaagtttatttaagagtaaaattagtgttagtttcttagttttggttctcggtccaatggctgtgtgaaatgctgattttaggggaaactgagtaaaagacatttccctgtataatctctgcaacttttctataaatctaaaatcactttaaactaaaaaaaaacatctttataagttaaaacacaaaaataatttctgtgtttcaacattttgctcatctgtgactttagtttatcactacagaaacttcctttaggaaaatgtagttaaagggagacaaatgaaaaaaataactaaaatgaagatagcaataatttttggagatagaagcatgctcatctctgtataaatgttgcatgcacacgtgcgaagtagcttcagttgtgttcgacttcaccaccctatggaatctagaccaccagattcctctgcccgtggggttctccaggtccgaatactgaagcgggttgccatgccctcctccagggaatcttcccaatgcaggtattgaacccacatctcttacatctcctacattggcaggagggtgctttaacactagcgctacccaggaaggcctcacctctatatattgagacatagttcacaagctataaaacaatagttttaaagttggtttttagcatacttacaaagttgtgcaactaccatccaattccagaaaatccctttaaggtcacaaaaatttacacctgcttttttttcccatgacttttataatttaggctcttatatttaggtctttgatccatttctagtgcatttttgtatacggcatgaggcaagcgtcctctaaaatatggttttttacttgtttatgttgactaaaaataaatttttaaaaataaataaataaaatagaaaaacatatatacttacaacctgaaagtagggagtaattttatttggtgggaatgtttaggactccaagctcaggagacagcatctcaggagctctgagaaaactgctccaagaaggcaggaaggggagtcaggctgtgtgtaagctggcaacaaagagagccagcagtctgaacatcgcagatcagataccaagtttaggaagtcagcattctctgtatgggaagatgcaagcctccgggctcactgacttcattcttttcacactcaccaagctatctggagccaaatcctgtttccttctttgctttaaggagtggcaaatggctgcttcttgcattgccccagctccctggcaatcactgtccaggagtgacagcctctgttggcccatagttttgggagctctcattctcatttggaggccagaaattgatggtggttgtgacatttctcacttattgatatggtaggagatatttcacatttcacacttacgtagcatcaaaaacattcttcttagaaactgaaatgccaaggttgaaatgtcaggccccagcagtcacctagtgttaaggtatttttcctttcctaggtgtccatcttctcaccagcattgtgagggaactgatcatcctctggggaacttatttcaattttaattgggattttataaccaccaaaattgttgttacttacagagtacatgtgggttcactatgctactctctgaatttaatatattgaaaaaaatttaaggaagaaaactgatactcagaattgccaatattttaggctgtcaagtaaaaacatattttaaaaagactaccatctcttatggacttccctggtggctaagagctaaggaatccacctgcaatgtgggagacacaggagatgtgagttcgatccttggttcaggaagatcccagggaggagggcatggcaacccactcccatattcttgcctggagaatcccatggacaaaagagcctggcagacagcagtccagggggtcgcaaaaagtcagacacaactgaagcaactgagcacgcgtgcatgcaacatctaattacaacttcataaaacaatgattaataccatatagtaaagaaaataccatctttacatagagtaagttctttttaattgaggaaaaaataccttcataaaaactcactgccctgtccttatatttttgacttggccatggaccagtactgattcctaccctagtgtttgggaagcactgaatcagattataattctgtggaattagaaccacgtaggctcaggcgtatgattcactgttgataaacacagagaacaataataagtgggaggaaccagatgttctcaggtagaatcctattgatatcaaactctcaataaacctgaagagcactaagcttcagctttattcacaatacagtaaaattttcatgaagcactcatgactacagattaaatgaaaataactgtgaggtaggagagagtgaaaaggtaactgtcatatcctttgagtttttattagttttattgtggaaattatggatagactcagatgcactactagtaagttttaattccatattgttaattgaacatcagtaagaattctagcaatatacaaaagtaaaatccagaagtagagatcattcatttgtaagagtcaatatgccagaactcctcatgttatagaaactgccgtaatgtaataatactgatttatgactgttttgaggaaacagaattataatttccaaaacaaaaaatttaaaaagaacctggatttttctcttcttgtctgtggcctcctaatgatctcaggatcaataataagttagagttaccactggctcaataaagtgtagactttttccaaacaagatgatggtaagtttcacaaattctgcaaaagtaaagttgaacatcatagacagatcacttgaactcaagaatgaaatggaccttaaatcagtacaactttgaacttgttgtacctttctttatatcaatagcatttagcatcagttatatatttctttccctatataatatatatatggggtatgtatacacacacacacacatatataggcctatatttatatttatatatatatatagacctccc

SEQ ID NO: 59380 - DNA, 671 bp, Bovine  19866881356781
aaataaaagtggatgagaataaatccatttctagggacagctgaaggaataagccacagagaaggcccgagggaatggtaggtcaagagttgcagcctggtacacaaagaacttgaagtactttgagacgcagaggcgcaggaatgaggatgagacaatgtggtttgtttgggagcctggcaacatggcaggtactcgaatggctctgaacgcggagagctggctttgccaagtgctgtgtgcctttcataagcatgaaatacacttaggtaacccttggtacatacccttctgaagccacagcttgttctttacaagtttttggcaaaacacggttttcactggtcacgcccaacctattctgtatttactctgagtgcataggactaatgagataatcataccctgcagcttaactggttgaaatctgtaaatctcctaaaagtgtaattacctagtcataatttttttttccaatattgcatccatctcattagtacatatgtttttactattcatgtatggaagaaattgtctttttgccattgaaggaagagttggcagggggagacaagggtgttgtgtttgagctacttgcttttatctccttgatgaaattttaaaaaaaatgcattcccaagtgtaagaattctcttagcagttagttcgtt

SEQ ID NO: 59381 - DNA, 2009 bp, Bovine  19866881374552
aggcattttattgtggactgtcgttaactgtaggtattctcataggtgcctgatgttactcaaggtgctttagcaaagtttccttttagtttgggaagacattggaaaatgtataggcatttatggcagagcttgaaatactatgtcatgtcagtagaagtctcgaaaggcaaaggaagatagtcactgttttgagaaatgaagtattgtaccctggtccagttcagaaaccccgggctcaagttcacacacttctcttcactagttatgtgatgttgacagggacttttaatctctcggaactcagtcctcatctctaagatgtggaaagtgggttagagcagtgagcagtggtcctcagcacagtgtggagctttagagccatatcacagccccacagaggttgatgccaggatgagaaggaagtccagtggccgggcctccaggcccttcacttctgcttccaccaaagctgctttcttttagctttttaaattgtttgtttatgctatgtttatatgttttaatatgtttgtttatgcacacacacttgaaagtgtgtgtgacttcattcataagaattctacttcttttttaaaaaaatcaaaaaccttggcattaggttagttcagtggtccctaaagtgtcagcaatcctgaataacttgggagccaggaaaagaaaagagaaactgaccgtgttttcagcatgtagatagtacctggagcacctagtatataacagcggaaggctaagcccaccgtttgcgatgtcttaagggttgtggtgtgttctttaatttgattagttccattgtaccacacctaccacccacaaagaaaaatggcacaggtttacttgttacaaattattcttttgagaatttacattatctattgtttcccatgggttttccacagaaatttcatgggaattacattatctattattttacattatctgttgttttccacaggcttccctgtagctcagatagtaaagactctgcctgcaatgcaggagaccccggttcaattcctgggttgggaagattcgctggagaagggataggctacccactccagtattcttgggcttccctggtggctcagctggtaaagaatccgcctgcaatgcgagagacgtgggttcgatccctgggttgggaagatccctttgataaggggacagctacccactccagtattgtggcctggagaattccgtggactgtacagtcccctgggtctcaagagctggacacgtccgagctactttcacatcacgttgtttttcacagatgttagggtacgtagagcagcattgaaaaggagcactaaattactaaatggggtgcaggagccagaaactaaatgcttttccctaaactgcagtcactgtttcaccatattcttctgccactgctaccgtgtccagtgctgttgttataaatgctgctgagtctgaaacccttgtttccagaactttctctccattaacaactaggctgagttataatatggatgagatattttatagtaaaatttaggggaaaaaaaacaaaaacctacttctgtctaagcttgatctccaacctttctgtgaagggtcaagctgctaaatgacttatgcacacctaaacaggattctccttttaaaagcaattaaacaaacaacctatctgtttccttggctactaggaaccagaatcaacatttaaaaagtgtcaaacctccttaaatagccagaccactagttgcaaaggaagtggtggaagacagtcttagccagaaacatgatcatgatatattaccctgtgtgtgccagagaaatgcaacatggaggaaaacaaaacagaacaacaggactctccgctactcatccataatgtcctgcttttgtaagtgggactttttccctcctctaataaccatatgtcataatgagttagtatcagctcatttaaactggctcaagccagtccaaaaaaaatacacaggatggctgcc

SEQ ID NO: 59382 - DNA, 3772 bp, Bovine  19866880186938
catgactctggaaaaaccatagccttgactagacagacctttgttggcaaagtaatgtctctgcttttcaatatgctgtctaggttggtcataattttccttccaaggagtaagcgtcttttaatttcatggctgcagtcaccttctgcagtgattttggagccccaaaaaataaagtctgacactgtttccactgtttccccatctatttcccatgaagtgatgggaccagatgccatgatcttagttttctgaatgttgagctttaggaacagataatagaagatactgaattcaagaccttggagtttatgtttaagcatccattgatgattctaaatagcagagtgccagaatcagagtttttgggttttttatggccgtgcttttcaacaagacagaggtgaaagatatcatttggacctagtggtaactaggatttccaggactttcctgtaactccccttccactcttctactcaagaaaatattgaaatacaatgaagacaagtaatactattatacaaacatataactcaactttcatttattaaaaatacatttacttgatagtagttataaattacttgcaatacactttataattgatcatgacaggaagctgtgtattatgacagcacttaagagccaaggttgagggacttctctggtggtccagtggttgagaatctgcctttcaaatgcaggggaagcgagtttgatccctggttggggaaccaagagcccatgtgatttggggcaactaagccagtgtgccacaattgctaagctcgtgcgccacaactggagaagctcacacgccacaactgaggaccccatgcagccaaataaataaattaaatatttttaagaaaaaaaaaaatgaaaagaaccaaggctgaaaataatatggcaacactgtgtagaatggattgaagtgaggaggtgctggctgtcgtgagagagaacaataaactattgcatttgtcttagaaaatttatacagatcagaacaaaggtttaccatgtaagtgaaagaggaaataaagtctatagcacagggcaatttacttgatactggtgatgaggaaatgaaagaaacctaggatgaatctgaaatttcaaactggattatctcctttgcaatagaaataagagttgcttcaaattgggaaaggaagaaaattgaattcagttttggccactaattggggttcggagcttatcttacagaatgcttctgcatagctggaagtttaaggttccttctcaggagcgtgatgtcgatttttaagtcatctgtaaatggaatgttctttccaagatacttcaaatgggaggaggcactcctcattctgtttgtgaacctcatttaattcttaactgttcaagtacattatttaatccttatattattaatgatggaatttttatttgcatggcacctgaaatttctctgcccccttaatggtggtaaagtgattgtaaggagctgatgcacattccaggagtaagtactcattgagaggaagtgaaggcccagagcttctctagctcagtgtagaggagattgtttccagtgctttgcatatctcctgtttattgattacatgtttagttaaatggcagagtgtattttcttacacatggcctgtgggtggctttcattcttttatataattttaaaacattttttaaaagccttaattaaaagacttgcaaagtttctacaccatatgatgttttccatgtcttcaaaactctggtaccctgtactgtcttgtgaagcttgctagtctaaattcaattcaggtgcaattccaggagtagtccttttagcttattttggacccttagcttttgtgtataaaaatcatatctatgggtaggcatgttcttatatctacttatagacttgctttttacaactggtagaatgagaaaatgacttattttcattagtttgaaaaagaaatatagaagcacattcattgcatgataaatattaatgataatgactatactgaaagcttttgtcattcaagaagctcagaattggaaattagatttcagctatgctttatatacagtatagtcagcagcatttaatgaactctcttcattaaatccatgatcgtgggtataagcagtggatggttacttgaaattaagaaacgatctaccttagctattaatgttgataccttactgaacttcttataaatcgttctggctatagaaaactttgagtggtgtccctgctcttttatttttctcagcagcttgtgagaagagttttaagatggaaaaagcaaactgatcaatgaacaggttgttggggatggagggttacttttgtgagtgggtcgcagggaaagggccagcaataggattgcaagattgagtcacagcctaagagataagagtaatcaaggattgatgacaagttgttgcttgactttcatagaaataatccccacccacccccactggaacttttgtctcaaaaaaaaaactggtttatgtatgtatggatacttctatatactatattttctgctatagtcctgatttcctgtattttttgtttaaggaaaatcattttaaaattttacaataaagcagagttgtcttagaatttgaaaaaaacttttatttgcatagattaatatgtaagataactctttgttcatcaatatttcttattttttagcttgatatgagatattgattattgacatttttggtcattctagaatatttattgcagagctatgttgatttatttttctcctttagaaacacagcaatttactagaaacactttttgtttatcttaagagcagtggttaatttggaagtgaaagtatactgtacagttttccttttttaataaagagctatttcttcatttatatttctttcagctaggtaaattgactcgggggaagcatgggggagaacaacagaatttttgcctgagcctgtcaagacaccatgccattttctgatagttttgtaattatgaagtggaatgtgaaaattatggagtggagaatcgtgatttttttccattccctcccaaatgatgaaatacattatattgagagatatcatggcttaaatttttgggagggttaacagctcaattgagctgccacgaagccaagcctctttgcagttgctcccttctgccgtctactggtcattatctgaccttatccctgctaacacttgctcttgagccccacataggtacacatctgtggaagactgcaagtttatcaagatggtgttcttagttattctgcttttttgtgtagatttgtgttgatttctgtgttgttttctcatttaggtttaagccttggataccaatttttgcctcaatatttagaattcctttgagcctaattcactctttctacaaagaactcctttttttaaactttttattttgtattggggcatagctcattaacaatgttgtgatagctccaggtgaacaacaaagagactcagccatacctgtacatgtatccatgatggctcagtgggtaaagaatccaccagcaatgcaggagacaaaggaaacacaggttttatccctgggtcgagtatatcccctggaggaggaaatggcaacccactccagtattcttgcctgaaaaaccctatggacagaggagcctggcaggctatagtccaaagggtcacaaacagtcagacagactaacaactaaacacatatacattctctcccaaactcccc

SEQ ID NO: 59383 - DNA, 875 bp, Bovine  19866880380558
actgagacccttaagacaaaaaattacagtatatttttgcagaggaactacgtgcttgcattttactcttcgtttgaaacttctgggaaaatagtaaagatgtcagaggctgtttcttgctataagattgttttcaggccattctgtttaggctgcagcttaaaaatagaggagcacattgaaagctgaaggtctttgattatccaacttgtgggttgccatgctgaatgacattagttacagtgtcatgagtccaggacaaggttccacgtttatttatggcggtggctgctgagcgactcttccagcagggctccaaagggcgaggggtggggcacagcggggaaggcaacacgatagattcacattcctaaatcggccattttgatgtaaggacattagtagcaaactaaggtgtatcgatctggccggtggtgtcaggattagctgggagtaccaacgaggctgccgtggcagtggttattcttgcctcgcagctatggccatttcaaaggtcaggcccctgcactggctgggctcagaggaattagaccgaacatgccgtctctgggctgattacttaaccaaagacaaaataatgagtcctaagcaaatactgactaattgaaagggctgtaaatccattacatattggtcagggataatcaggagtatttaatcacttttatctattcaagagcactgaagctgcaacagcaaagccctgaaccttgccatgtggttattattctcatcattatcaaaattacttcacagctgttctttgctacatcacctcagctggagatttactaacctgtaaaatgtttttaatttggaagtcgaatgagtgcgagaggaggggtttctcattt

SEQ ID NO: 59384 - DNA, 2777 bp, Bovine  19866880468317
tgattttggagcccaaaaaaataaagtctgacactgtttccccatctatttcccatgaagtgatgggaccagatgccatgatcttcgttttctgaatgttaagctttaagccaactttttcactctgcacttgcactttcatcagtgtccattatttgctttcataccttattcaagactccacattgtatttaattgcactgaggcacttcggttgcatgcaacaaattctgttaaattctctttacacttttattctattgcaaatatgttctaatttccttgttatgtcttcttatatacacccatcacttaaaagtggatgtttaatttccaaatacatgggattttaaaaaatatctttgatattaatttcccatttaaatgctttcttctctgtaatcaccctctgtgttttttcagtattctaactttactgaagctttcaacggctaaatcaaagatctctcttggtaaatgtcacgttacacttgaaaatatgtaggttattttcaaatatcttttgatattgatttctaacataatttccacagtgataagagaatagactctgtacaatttcaagacctttagaccatgaactttttgcaccttgttttatgttcttggatatattttagtgtctcttggtttatagcctatggaaacttgaatagaatttgtatcctgctattgtgtgacaattgtataaatcttaattatcttgaattggttcatagtgcttttcaggcctactatattcttctacttttctgtctattcattctattaattttttagagtttgatattgaaactctaactaaaaagtttgtctacttaaaaaataattgtaatatatagtggaactatatgtaactttgttctatattttccatgtgtcctgaaaatgtgctatcatactttataattttaaaaaataaaaaagaaagattccacctaaaaacaatcagagttatattccatgagattggcatcctgttctgtctactctcctgaagtctcctctagcccaattcagattcggcccttacatggtacaaatgtgtctaacactacattcttctgacctttaattatttccatggtgattggcccccaaagaaatatcctcaaataagatcttatatcattgtcatcagagtaacctggcaatggctgatggagtaacatcagaactccatatacaaatcttttctttgtgggcagtttttctcctaatgagtacctactcagtacaattagtcatttcataccctatattttagaactattcatatgtggcttataaatagctggcacagaaaagtggtttaggtttaatcatgccctctattttagatgacactaagtactctgctattgctaggaaaataaataataatatacttcttataaaatgctaatcccagtccattattattagttcatcctatgggataggatagagacaatgtgacatgtaagtaaaagcatgagtggtaattatacttgaagatgtcccataattaaagtaaaacctttataaaagagaacattttctatagttaatttatcacatctcttgcacgtttttgctatgtccatttttacatttcaagtagtaaaagttacagggaaataccgcgagccatgaatgtctaagcacgaatgcaactgctgtggtgctttcagttttcttcttttctaaacaaagtcggtgcacaggagaacagcactttgagctacttacttgttctgaccggcaggctgcggaacatagatatagcaatctgcctggctgactcctgccacacatcgggagtcacggaataggtctcagcaggttaacagccgtgtacctacgcacagcagaatgctgtgattacagcaggtaggtggctcgcgtagcagagaacttcagaaagtggggagtccgacataatgtgatgtgtgatttattggagttggtggagacacacactgtaattgtatgcttggtctaatgtctgattgttgtgtctttcaaaccctctggaggccagccccccatgtaagtgataacccactggcgcttttgttgggagtgcaattgaaatatacgaaatgaatagcaactgattaattgaagccggctacatttttggaaaacaaatcaaagtgatttgcatgaatcacaatttgttatataatacgtttggagggcacaaattacctttttaagcctaagacacatatatacacagtggaacaaacgaaactacaataaactgggctataactacataattcatattgaatactggataccaaaactgatatgaaacaaatgattttccaataaactactcaggcagagccatatctgttctaaactttcaatagaatattatttataataccaataattcttcccaattgttagccatggaatgaaggaacaatctattttacatattagtttgcgggggggcgtgtatttacaagttggaaactgatttatagttatgtcccagaagatgtgataaataatagtaaacttgagagaagtacttggaggaaaactttcatggcaaaatcattattaccttgttctagttttgaataaaaaccaaagtagtaagaacagtgtcagcattaaaagtaaatataatcgtcatcattacatatttctctgagtttaatatctataatggatttttttaactttcacttattgtttttctcaaatttattgtctgtatcatttttattgttaaaaactacagtatacacata

SEQ ID NO: 59385 - DNA, 770 bp, Bovine  19866880468780
taaatagaagggaatgtagtcacccgtagttccacagcttagttaacatcttgctctgtatttttccaatctctttcctatgcatgttttatttgctatttgacatagttgttaatgtccatattaatttgaatcctgcttttgaaagctaacgttatatcaattcttaatataacagatgaagccttctgggggcattttttaaaaatgttgaagttatcaagtctttcacccttgaaaggttaagaggattaaaataaatagatacttctattaagtagaatgctcatcccaggaaacagcttttgcttttagtggtaagtcttggtaaaagcagtttagaacctttatagcatgcatctctatttctatcagaccttgaaaaggagactgcactgtgaggacgtaagatttctttttttcttgctgaatatttgaatttgtgtaagaatccatttccaaaattttagttaatggggtaaattcagtttgtgtgtttgtgtatgtagaaaatagacactgagatgatttttttccccttactgacctcctctatggccttaaattttctttttaatttgaaatacaaactatcaaggtatatttacataaaataaaatgcacctactatacaggttggtgaattttggcttatttctacactcatgtcatcacaaccaccatcaagacacagaacaactccatcattccaaaaaaagactcttgtgcagcgtcccaggtactctcttaccggatcagacaaccatcag

SEQ ID NO: 59386 - DNA, 2189 bp, Bovine  19866880480480
cagcctggcgggctataatctgtggggttgcaaagagtcagattcaactgagtgactaagcacatacatacagtaaaacagacaagtgattgattctgtatcttaaatacaaagcgtagtatttttaaataaccataaagctgagatatgatgtactcagcgtttcatggagataaattaggcagcaaaaatctaccccacaaattaaaatgagtagtatattcattgatacatcttttaagggccattttagacaaaagacatagcggtatatggtgaaactgaagctggcctgagagttaaagaatttgcttccagcactgtgaccctcagcacgtctctggcatggtctgtggctagccctttagatcatatctaaagatgtctccaaatcagtggttctatataatctagggcaatagagaattacctggtttctcatctcactgcctattcaaaggggtactggaagtataatcctgagagatcctgataagattaaatcattgatagcttaggggcagatggggtgggaaggaacatagagaaaaactgaattgatttgataccataaaagtttattgtttattttttaacttgggaatcacccattttgatcatataactcactatcttggccccttggagcaagcaaactaaatttatcctgatattagatgtcaaataagggttaaaggtatcttgtttttaggttgtatataccaggttaaattggtcagctagaattaggaatataaaaccatgtaacaaatcataaaatagttttcacttaggtttcatgccactttgatgcatgtggtgccattctaccttgggttgtggtttcctagaaggcgaagaatgtaagattgagtatatttttaagtgctaaaattctgcaagctgtggctctgagatgaggttacagcagcaagccagcggtggcattcttgctttgaattctattcctacaaaagcaaaaagaacgctttgtgggttctgctggttattaaggagactggagaaatcttggaggattcactcaatcttttttctgttttcagaaaacaaaaaaactgaacaaacacagaggtgtggctggtacattgacttagaaaagccaggcgggatgtaaacttgggcgggcactggacagctctgctctgtgaatgagtgttgtgctatgagctaatgtgtaaaatacattgtttttggctgcctctctgaatcagttagaacgttttggctgcaagtaacagaaaatccaattcagtctggcttgaacaataaaaaaataaagctatgccattggcaagaggtgaggtaggctccatctctcttttccttcaattctcttggctttgccctcttatgggcatcaaatttattcgcaggctggtggccagatgacctgagcagttctgagcctctgatcttcccaaaacaacccagaggaaggacacctgtttctctttctttggatactctcaagggaatacaggtgcaaacaatttgagaagtcactaacaaacttaccctcacatctcatctgtacatatttgcagaatgcttgaataggcttaaccaggtatcttgaaacaactactggttagaggaggacccagtcctaaaggtaggagcagacactttcctgtgttatggtgcaaaatgggctgagagaagggttagattccgagaagacaattttttctcagtttaaaacacagtggactagggacttccctgatggtccagtggttgagacccatgcttccactgcaggtggcatgggttcacttcctgtttggggaactaagctccccacatgctgcctggtatggccaaaaaaatagaaaaaaaatacaatggactaaaaactagtacaacttctggcaaatactggacttttggaatagttgttccatatttagcactgaccagctgctagccagtgtatctaacataatcttagaacccttgctcctaatagttttctatcttccagagcagagttcactgatcatgggcagagatcaggatgtaatagatcttttacttatatgaacaataatagcatactgttgagaagtcccttgggtagcatattgggggttccaatgaatctgtgatgtttggttttcaaaaagaaggaaacaatgacatcactatcataaagaaaatgataaagt

SEQ ID NO: 59387 - DNA, 1013 bp, Bovine  19866880530083
cattcaaatctctgtctcaggtctacttctggggtatgtgacctccaaaaatatgggattcctagagtgaaaaattttgatagaatgaactcaattgtttgctaaaacgaattgcccaaccattggcctctgtttatggatttgactggctactgatctggcaggacacactgggcctaatttcctttatgggaatattatcataagttactgaagatattttaagaaccattttaaaactcagaatgttattaaatgtttttctttcattttgagtgagacaacatatgttaatgctaagaaatgttgcattctctctgcatactaagtgtaagtaaaggaagctggtttgatcaatatgttttctacaaacatgcatattatgtatatgctgtaaattaaatttaccaccttcataaaaggcaattgcaccacatcttgtatatatctagctgttctcaaagataaaaatatattgaactgcaagcggttaaacgcaaggcaagagtgccatcctgtgtaacactcaactaggcaaaggcagagagaactaatctgacttgacatcactggccctgcttcaccatcttgctcttggcagaattcccactgaagttcatatatgctttgctataggaccataggacggagttcatggattttctccagtgcaaatatgtcagactttattctttgggcttcacatttgggtatattttcacatgaaaatctagatgtaggcagagcctgaaagaaaccaagtggatgaaaagcatcataaggacatcactttctgccaggaaccaactgggttgtatctgcatgttttttacataggtcttaaatgtcctacagaggatatcaaattctttatgtatacagaaaattatcactcagattcagttaacctagaaatgacttaagtcagagaattggctctgtaacattctaatttctttagtgaagaacaacatgaagtgatttactcctaacattttctaaaaatattttaa

SEQ ID NO: 59388 - DNA, 1636 bp, Bovine  19866880603302
gacagaattgtctagtgagcccatgacttccatttgtgttcttgtctcattggtcctctgttgcttgatgaaaaatgacaaaaagtaaaaaataatcacagctgtctggaatttcatattgagtgtcaacatctggtcaaagttcagaaagtcttaaaatagtttttgcgtgtgtttccttttcccttgagttcccttatactactgggcatgaatgtccataacctgtccaccaacattaggatctacagaatttaacattgtgggactctgtgctgacatagtcattccaggggtgggtagggggtcctccgtgcatcatcatggctgggtggtggggatggcttggcaaatatgaatgcattgggggtccatgtcttaattgagtagggtgtggggtcatctggggaggagtgtaacttggctgtgccatactcattcccataggaccaccctgagaaatgtactcccctggcatgctctgcaaacctgaaaagagagaggcaaaaagaaagcaggtcaaattcctaaacatttttatactttactcatcaaagatgaaaaaaaaaaaaaaaaaacaacagacactgcaaatcttatatctaaatttagctgcagattcttgccaatgttttgcagacattcaaattgtagtttgcatttaatttcatcgcacagcagtataatgcaacacaacagaactaaatatttaatgcaactaaatgtcataaagtggaactgtttttcaaaatggtattcagtacatttctttgataattgcaataagaatataaattctaagtcgagttttatcagttaactgttgatatatcatttcttttcctttgttgcatttctaaaatggaaaaaaatgataaatattaaaataaagttgacatcttatcatatctatatttcttcatgaaaaatttatcatacaaaacattatggcatattcatttcaaagggatgggcttttatgtatatttaaaatgaagcccccttttgaattagaggcattcttagagcagtacacccaagagattgtaaaggtcagaggtaagaagtcaatgtaaggtcatatgacatgcccagtagtttatgtctgaaaattaaaaaaaaaaaaaaaaaaaaagaatgccttgagattaggcataaaatataacacatctagaaattcttaatcaagatacacaagatttgaagttgtgaattaaaatgttgggaagtcagcagttgaagattctgacttgtcttgcaagttacctgttcattgaattaaggttatattatatttattgttgcccatccccagagctaaaaggacagctttattcacctctatttaacctccagtacatacagttgaaaagctgaacagatgtttttgacactgtaagctggtaatctaaaggcttatacgctgcagtcattttgttaagtagatccgcagtccattattaacagaagtggcaaaaccatctaaagacaataacacagcctgcatagtcccagctctctgtttattctaccacagcagcctgctcaatggatgatgataatttaagtaccaaatataccatattgtgtggctgcataatcaaatcaagagaggataatattcttctgtattaag

SEQ ID NO: 59389 - DNA, 1705 bp, Bovine  19866880616010
aatttacttgtttgtgtgtgtccatgtacacaccatgtctgtgcacctatatgctgtctgttccacatgtatttgtatgtcaatatgctgcacaagttattatcatgtggctatttctatcagtacgctaactaaaaattgcccttatgtacacaaattcaattacacttaactctttgttaagttacattcaactttgttaaattgcattaaactacctgttaaggctattttaaagtaatttatttacaaaccttatttggacttgcagactagtgatgacatttttcagacagacatatgaaagtttagaatgatctttcttcagcttaactttctgaacatttctgtggtacattacagtgtataaatctttttcttctgtaaatgggtatttcaatctcaatgaccctaaaaacctggcagtattcacattttaaaaggcatgaaatcacataaacagaaaaaagaaggcagattctttctggaggaggaggaggacagacaagacataggccaaaatgttcatgatgcttcactagggcactagagctgtggatgggagaatgaaaactgggctggaagattttatggagtccagaagaattcttccactcccaaaaccagatggcatcttacagcaaacctcagccagaatgtgaggataaggcttgaagaaatgagggtgaaagaatctagcttctgaggaagaaagattagcaggagagaggagagtaataaagataactttaggaggaactcaaatagcttgatgagttcagaactttggccaccaaacagaaataacaagaacgaccattccttaccacaatttatgtgttaggagagaaacaagtatctccttttcatagatgagttcagagaagtgaactcattagcctatttaacctggctaatacaggggtggtttaactagattcttaatttacccttcttccccagtataaacacattgccttacagtatatccattaacttcacttagtgaagatttttagggaggagaatatagaaatgaacccagggaaaacaaattttccagaggttggggtgtaaggtgaaactccttatgtctttgtgtggtagaggtggagaggcccctccagcagggcaccaagaagcccgtttgaggatgatgtggatccattttgtcacatcgcttcaaaaaccactgtgatctgcttcaaagaactttttaaaccatactgctttgatataagtgtagtgtagacccaactacaagagacaaaaccacaagaccattatctgcacttcaaagccagcagaaaaatacaagtgcaggtaatctctaaaattgccagcctaattctcaaatcccaaacacttcaaatcctaagtgtggatgcagctcaatatctgagaaaagaggaagagataatgtgtgtatgtgtatgtgtgtgacataataccacgatgattcagccacaagtggaaagataagttctctccaaaacagggaaaacaagtgacaactgagtatgagactttgcccaaagaacaagagagaacatccaagtaagcggaaacagaaagctacaaatatcattgtgtcgtctttcatcattatcctgaaactaatgcattttcacttgaactcaattctggaatttttagatttagacccaagagatttcaaaggctgagacagctctcaagcaggttt

SEQ ID NO: 59390 - DNA, 1207 bp, Bovine  19866880621287
cttaggtttgtggccttgactaacaagggttaacgtagctaaatcaagaatcagatggacagtagggccctgaaaaactatgtcctctggttaaatctctaagccatgccccgttgagaacagaaccagtcttttccctgtctctggcttttctgttgtttggtttttattttttttctggtgagaaagtgagcgagtgtaagaccgacacacccatcagaactgttcttggcacttttgtgtgccaatcagggcaaaatacttaaaaaaaatagtcttggtaacacacgctcgtaagtgcagatcagtctcctattttcccaacgatcaaaatatcaagagatgggagatctctcccagaacagccttattatcgagactcaggcaagcacctggggaattaatagctgacatacctcattttaaacatctaccatatgttcatggagaatacagccacgttacttatcactttctgtttttctttcattggtttatgttttgccttgaataaaaaccgcatgaaaacacagtcttacggtaccaggtatgcagctcctccatggaatagctcaataacatttttagtgttttatttatgcaaacaaaagtgctcctcaaatcagtgcaggctgaactgcttgaagagtgctgttagaatttcagtaaactgaagctttttcctaacatcgctcaggtacagatactctccaaaaggcctgtgattgctttttttttcctttcttgttttttaaaatcatatatctgtgtttcagtgttcctcaaatttatccaaagcagaatcatgaaatttcttaaggcaaggcagtgggttcacaaaaaatgaggtgttttttttttcttcccagtggtctgtgaatctactgaacacctactacgtgctataggctttggacactcacatgttcattctcctcttccggacaatgctgtgagatgaaaattaccagctccatctaagagaaactgagcttctgagagagtaagttctgtgtttaaggttgcatagctagtgagtggcggagctgggaatccaactgtttcttcatttctttcttacacttccaactgcttgtttattgttttgactggcacacaattgagacgatattcacatgcacagcctctccagtgtgagaccaagcacattataacacattaggaaagaacgtgaatgaaggtagat

SEQ ID NO: 59391 - DNA, 2827 bp, Bovine  19866880650684
tgataagaggacatctacagaaaaggtacagctcacatcatacataaaggtgaatgactgaaagcttctcgaacctgtagaccgctttgggaagcatatggtcattttcacaatattggttcttccagtccaggaacgtgctgtatctctctgcctctttacgtcgttttttctttctttcatcagtgccgtatagttttctgctacaggtcttttgtctctttaggtaggtttattcctaggtattttgttgttgttgttgctgtggtgaatgggattggtcccttaatttctctttcagattttttgttgtgtatagtgtataggaatgtatccttatcaaattgctgatggcattttccacagaactagaacaaaaattttacaatttgtttagtaacacaaaagaccccaaacagccaaagcaatcttgagaaacaaaacagaactagaggaatcaggcttcctccaggtgattccttcctgtaggaattccttcctggaggaatctgacttcagactatactgcaaagttactgtaatcaagacagtatggtaccagcacaaaaacagaagcatagaccaatgaagcagggtagaaagctcagagataaacccacacaccagtgggcaccttatccttgacaaaggggcaaaaatatacaatggagaaaagacagcctcttcgataaatggtgctgagaaacctggacagctacatgtgaaaaatgagatgagaacgcctcctggcctccctactggccccagagggaagtctctgcgtgcgtggggctgcagtgacctgtcgctgattggtggcccctccccaggcccagcatgtgcctgtcatggcagagggcactcctggcagctggctcgaggtggtcctggtggtggcagtccagctggggcagcaggtgctggagtgccggtggtgctggggtccgtggggcctctggcgggccgtgcagttggagcaggaggacttggggatggtgggcatgaactgcatggaattctgctggggcaaggccatggccctcatctttgtgggcggcgtgccccagggtggcaccatgctggacgcccgtgccaatgcactggggagaggagaccacattcatccccccacgtgctggctgtgcaccaggcctggtccaagtgaggctgagagaagctacagccgggatgaggcaggcatgacaggcaaggtgctggacaccgcccatgcaggccttcatcctggaggtgatcacctagcaccaggagccagcctgcatcctctgcgacaaagactcctttcccctcaagtcctacatcagcctgttggcctcttccccaactccaagttcctgctggtggtgcaggacagcctctgtgttctccctggtcacccacaaggtcaccatcgctggcttcaagcctagcagctaccacgactgcctcaccaagtggagcaggccatcgaggcgatgtatgccccaagcatggaggaggcaaggacaagtgcctgccatgtcctatgagcaactggttctgtacccttcgcgctccctcaagctcatcctctgcagcaacagcatcctatatcaggaccacctcatctgcaagccctgcagcccaagtccaagattgagctccatataccaggtcctcaagcctgtgaacctggaagctctctccaagtggactggccacattcctggggatgtgttgagggacatgggctagatggcccccatgctggcccagctcatctatgacccctatgcaaacccacccaattactacgaccccagccccaccccacagtcatcaaccacacacaccaggtcctgaaacagggactacaaaacaccggtcagtctgaaaggctactttcaggtagacaagaacagcacctcttcccacctaagaagctcgtgatttccagatctctgcaaatggctttgttgccaggagaaactgcattagagtggaaactggacctttaatccaagcatattatttgctgttatattaatcaccaaaacaggactcctcatgaggaaggtatatgcatatgtttgcaaaagctgaattattgaaaacttacctcttcacactctatcttaggaccgtctggggtacagaaccaagagtgtggaagtagtctggtttttgaaactttggtattttgcatttttccccttgaaaacttgttttaagaagtggatttgcaggactgccttggtggctttgcctgcagggacaaggcccaccacctgtgcctctcctgtagactcttattttttaattcaaagaatccaattaagaatttaacatatgaggtcttctttgattctccttttctctttggttgactcagtttcacagaagaactatatatatataatttgaataaactgaatggggggaaaaaaacagttcccagcaccatacacaaaaataaactcaaaatggattaaagacctaaatgtaaggccagaaactataaaaactcttagaagaaaacatagacagaacactctgatataaatcgcagcaagattttccttgagccacctcctagagtaatggaagtaaaagcaaaaccaacaaacaaatgggaccaacagttagaactggacatgaaacaacagactggctcaaaattgggaaaggagtacaacaaggctgcatattgtcaccctgcttattaaatcatatccagagtacatcatgcaaaatgccagactgcattaatcacaagctggaatcaagattgccaggagaaatatcaacagcctcagatatgcaggtgatacaactctaaaggcagaaagtg

SEQ ID NO: 59392 - DNA, 588 bp, Bovine  19866880716843
tgcatgtgtaagtcccattaaggctaataggaatttggtgcctgaacccaaagaaaaatctgcctctgagatggcaatatgcatatgtaacacacaaagaaaaataaccccccaaatccatttctttttatccaaagcacataaaacaattatattaattataagtacaagatagagtagtctctgtggaattttaaatcaatttaataaattcgcgattttaggcattccccttgctcaaaattgctttcctcagatatgctttaggttgtctcaggctttgaagaacctagtgacggatggaaactaagagaaataggagtggtgggagtacatttctcaacatggtcttcatttatttatattctgcagcacacgcagtcatgatgtttcaaacttatttccatgagattcaaaataaaacctggaacacaaaacagcttgcccatattttcttgtttaaggctctatctcctgagctttcctttgtatctcagtttttctaaccacataagaaattttcaggcaagagtcggtattcaaatgagatgttaattttaaaaaattgctccatccttctgtttattt

SEQ ID NO: 59393 - DNA, 2480 bp, Bovine  19866880752949
tcccccatggactgtagccccgcctgtccattggtcgcaaagagtcggacacgactgagtgaaaagcccagcccagcacacatttccacaaagtacatagttggttagttcttgtaccctactcttcaatttgcctttggaaaatccgatgcccatatttccaagcaagtattatttactttttgatagaaaacataaaggcatttcattttatgaacactttattgtaataaaacctggcatttctcatcactaccatttgcagtctactcttgtaaaatgtaatgcatgttaacacgtgcatgatccggaaaataaggagacaaagaagaaaccttctgtttatccgtaaatgtcctgaagtgagcttatcaaggcaagaattctcatgatctagaccagctctgtagaatttcgtaaccgttagccatatgtgaccaccaaattcttgaaatgtccaaattccaatgtgctgttagtataaaatacacattgaattttgatattgtgcacagaactgtaaaataacacgcaatgttatactggttacatatttaaatgataatatcttagatattgtgggttaaataaagtatattaaagttgatttcacttcagtgtttttttttttttacttttttatgatgtggctattagaaaaattttaattatatatgtgactcacaatacatttctactggaaagcagtgatctagattaagaaatgcacagctattattccatatggcaattagatctggcaatataagcataatttcataatgttacaagtagtaggagggttttgatagaaacttctatccatttgttttgggtggattaactggcctaatcagatgtaagctgttaaaagggcccccagaggaggcaggggaaagaaatgtggactcggacaagctttccaagtcctcaagtcacacactcctggttgactggtttgcttagccaagctgaaaccggtcttattgtcatgttgggcacattaattggagagtagactaatttgcaagaatgcgttagtgccctttaaaaggtgatttaaaattcaaaatgatggaaatggcataaaagcatgcttgtctgatcactcctcggaatccatcttgaaatcccattcttctgtctccattgttagaattcaagcacacagtaaaacacttaacgattcgcaaacatcacactctacatcttagcacaaataattatcctgttaaagacaaacagggatttcctatcatcagacacatggggattataagtgaaaatacaatctgtggatttagttagggttccacatacaggaatgaaacataaaaatcacagtagtatcaccaaacatttttgtaactgaatggaagaagttctgcctctaatccattagaagtttccaaagaatttgaggaagcaccttcacctctaatttagctgcaataagactgataacttatatttataaccactttatagctacatataattttacatccattagcacatttaatcctcatgaacaagaatgacactatcatatccattttgaagacaaggaaacaatccagactcctgaaatcaaacctttggactgtgctttttcactacattgcaggtaggaactaaactctgtattgccaggtcaaagaccaaacctgggcttttaggcaagcaaagtagagaagaataatatgaaggaaaaaagtaagcataacagcgcttttagagacagtgaattcaaagaacatgaatttacttttggaatttacagaatgtaaaactaaaaagtcttccattttgttacacatgcatgtatttctgattatacagtgtaacaaaaaaccttttactatcatttgatcaagggatctgtgttcattttaattcgataaccttagatctttggcccaaaccagtaataatgaaagcaagagctttacgtgtcactttctaaaatagtgattgatccagggttctcacacaaaatatattcaacaacacactcttagaaagggctcagaaatactgaataaagaggaattgttagagctaaagcaaagcattatttatggagtttgttttgtgaagagatttaggtttctcacagtgatattgagttccatgaagatgcagaaatgaaaacttgcctttagcaataactaggaattttttaaaaagtggaagtcacccataagaattaatgaatgctaactgatacttctctggaaatctattcttaccatagctctaagaaataaaattataatctagatccaatctacacactcaaaatatatatcagccttaacatattggattcaaatccaacacaaatggctgtgtctttgtcactcgtgtgttaatgtattttgtaaaatgtgaattttcaataagttaaaccttattgaatgaatggctgaaaggaagaatgaatggctgaactgtccactggcaaacacaggtacttg

SEQ ID NO: 59394 - DNA, 1087 bp, Bovine  19866880802106
tgcatgctttttattcactataaaagcaagctattaaaaagtgaaatgctcttctcacaaatattgcattgccttttatggtgcaccctgacctcagtgatagtttatgatgacagtaattaaatgaggtttaaaatcctttactctgctaggcagataacagcattgccactgaaaatagacagctgtgattaatacctgatagacctgatttgctagaactccatctggaatctgagaagggtcccgcagcatactatttataacagacttggaggctgcagaagaaaagagatgaactgttagcagacagtcaacatacttttaatacaacatgaaaagtgacatatacctataaatacaccaaccatgaaaatgaaaacactactgatactaatcattttttcccttttttttttcaaatctcagagaagcttttaattaaaacattttgccaagtttataagccacattgacagatttgaagatgacctaatgtttccaaggtaaattcacaagtacagacctaaagcatatgtctcttcgcagataaattagctttggaaaagcccacttgggggggaaaaaaacaatcagaaaagaaaatattttccttctgcaggtaagtatgttataaccaagcatatgtagctggagagtttagtgaaggcaggtcagatgcaaagacttcagtgacgtcaataaaaactaccttcagccaagaaagcatctctgaatctaaatctttctaaaataattctcaactgccatgaaatgttatgtccatttcacaggtaaggaaagtaggtaaaactgacacaattgaacaaatcttaaataagagaaaaaatacatatatacacacacaattgtacaattatatacaaattttgtcccaaagtatgtctcatcatacccaattgcaaattaagctgaccttatcccgggggaatgcagtggaaggggctataggaggcatcttacgaagtgtggtatatcagatcacaccttttgaaaagcgaggcagaagattctgacttcactgcttagtggaggcatgcagaacccagtggccagaactcctctt

SEQ ID NO: 59395 - DNA, 1749 bp, Bovine  19866880869882
ctgaaaactaggtgtatttattggaatcgagaaacacatcatatattttgacgttaattaattactttggtgagaattaattacttcagaaaccctcaaaatctgaaatatggcagtttcatccaccagagtatttgaggatgcatacttagttgtaaaggcttccctggtggcgcagagggtaaagaatcctctgccaatgcaggagacgcagtttgatccctgagttgggaagatcccctcgagaaggaatggctacccactccagtatccttgcctggagaatccatggacagaggagcctggtgggctaccatccatagggtcgcaaagaactggacatgactaaagcaacttagcagccacgtatacacttagttgtaagaggaattcctgtgctttcattgtgtttgccttaaaattagcctttgtacattattgtttatccaatatattgataaattaactcaaacatttaaattttttgttgttttttttttaagggcttattaaggcttagctttatctttacatttctatttaaggaagtttcccctaaaatcaagtcaaggcaactatgttttgtacacagatttggggatatttggtgaaattattagattaactgcaaaaaatggtgctttccattgcttgcttttatactgctgagccggtgacaaagtgcttcctggccatagaagtgtctgctggcttaggagagacgggttctctggtcattggccaacaggatctgacttgggagagacactgtccatgaactgctcagtgggtgtttccctgttagtcattaattcagagtatgttatcatctgaaagccagagacatttggcatatgtcctcatattttgaagacttatgacacaaaaggagctggaactctcacattacttctgtgctctgctggtttcccaggacttaattcactggggccattttgggacgtgattccttccatgagtgtctccggagagaactgacactcaggacagatatcactgagactgaatcctctttggctctgtgggatgtttccatcttatatttttagcatttagggtcttgaagacatgaatatttatcgagtctctgatgtatgtttggcaggcaatagtccatggggtctcaagagtcagacccgacttagtgactaaacagcaacagcgacgtgtgtgtttgaaactatctcaggtgttgtggggaattcagaaacgtgcagtaaatgctcatctgggggaaataaatcattacttgggcttcccgggtggctcagccacggtgcacaaatcattacttggcaaaatgaaagcaaaagatttgaaaatttcagaaaagacaattacagtataaaaaggaaagaggcaaacctgtggggcttttagtaagatattttacttctagaccttgggcagcaaataattttctatatgctgtggtagctgcattcactactgttgagaagggttccgaggctgagtccagctcaatgggaaataaggctgtgatcaattctgggcacaagtctttggagtgggtagtaatcacatagatgccacatattttctattcctgccctaggccattcatgtttagtgcaaatataaataaattctaagcatttggaacagaactcataatcttgttcatgggcctgaataataaacagtaacattttcattggttctgtaacatcaagtgaagtattagtaacatctgtccatggctgagat

SEQ ID NO: 59396 - DNA, 874 bp, Bovine  19866880921611
aaatggggccccattttttttcccactgaccttttttacattcttgaaatgattttcccttgttttactctaatgtcttccacaaagaaagcttaggattatccacaaatacataatttattattatattatggaaaataatgaattaaccttcttcaaatgcctcagaagttcttgcatgaatacaaaattgtcattttgggaacctgccaaatcttgaacatctcattgaagagatagaaaagagttgtcttcattagggtaaatggttggtggttgcttattgtttaagatatttccataatgaatggttatttattgtaaatttctactttaataaatcttttctgtctctctgcaaatctattatgtaatgacttatgcggcatgccttggggtgctcggtcctgggccaagaccagctattttattccaactgttatctattataacaagtaaagttatagcagttatctagaaaagacacttgttaaaaatggcaatgtttttttgctgtttctgagaggtttcccaaaccaaatgacagaaatatcagctaacaattgttgtcactgaactcatatttgcaatacaattggggaattgataaacaaaaaaacttacattgctttgaggttccccaaaagatagttctctagaccctccaaaaaaagaatctaatgtgactcatttggatgatcatcagtatttgacatctttaagaatctaaaatggtgttccagtgagagaaatgcccattcctaaagcacagaatcaatcaaaaaatgattaaatagctgagccaaatttttgcatagatcctggtggtcagcacaaaaagtattctcaatggaaaaactgagtgttatatctt

SEQ ID NO: 59397 - DNA, 2597 bp, Bovine  19866880924115
gtttcctgcagaggtcactgggattatataaattttgatttttccctataaaagaaatttcagttaaaattaaaaaagtccactttacatacactcaattgtaatttctgactgtatctgtgttgaatataaaaaggacacttttttttttttaaagaaaaaagtgctagcttttcgagaaatacctttaactgaggctgttttcaggggaattcatgactgctttaggttaatggtcggtggcttcatgttcaggcctcaattaaactctgaacttccattgttattacttaattgacttggttatatttcatgtcagcatttcaaaatgaccttccttttaaaaaataaaaattacctgacagggaagcattgtggcagccatcccacactgtctttatgtatggttgggcctagaatttactcaatttatctaccactagggtacttctcatcatccttgcttatgacatgagacagctccaagtaaatgcaagtggtgagggaaaagagatgaaacacgaaatctatctgctaccatgactattattaagatgccaactaaatccactgatatccactttaattctaatcaggggagttagtcttaaacaccttgcatatcatgattaagtgctgtcaagttatgcttctttgaaagcaggattatgtgcaccttttccttccattacaagtgcctccaaaggtttagttgtgccagttaactagatggaaacgtaaatcccctttacttgtacacgagacaacaataagaacaagttggattgctctaactaatgagtgggattttatataaagtaggtatgacgccaagatggaacgctgctagactgactgaagcaaattaaagcatcaaatgagtctgtcccctccccctgcatcgtggaaaagttttaaaagtctttttgaagtactttgatcaagctttgaaatcattttagtgggtgactattgtatgaaaaccgtaatttatagttcttgacctaagcagctctttgtctcacagccatgttcaaaacaatggcaggaaagtgaaaaacacaaggggaacgcaagctgttctggttattatttaattcataattccatcttccttaatctttgcaatccaggcatgttcttaataaaacatcttcagaccatttttactatatataggaaggttagtttggcataatacaattagagggtctgaactgtgtcactgggacctttccttaacctgagggtgacctaccaggcaggtccagagaggatctcgctataaatggtgacagtgcaggcaaactcctattgtttgccttttaatttcctctctagttaagccggctttgttccttgaccttaactgagaaggtgccaactgggagattttcacctcccatcctattcacaaaatagttatagttaggaggcaatttgctcccagcagatcacacagaaaatggcaagcttcctctaagatgaactagctaggccgtgattctctaattgaatcacagagacattttactattttaattagtaattttaatcagctaaaacatcaccattcagcctggaaatatcagtaaacctcacatgttctttggactctttttgccaaaatagttacggatagcctaaacctcaggctctctttgaccctgtaaatatcttagttacaggttttacgatcttcaagtgccacagatgcctgtgaacactggatacacggaggagccttacgtgtgcttttccccagagggtttaggccaattgttcttccccaacctggactctgaaaatacatggatcaggattcagacgggctgcatttcagtcctgggatcatttcccagagagaaaaagaaccaagggatagtgctgttgtttgatgttcagtcactcagtcatgtctgacttttgtgaccccatgaatcgcagcacgccaggcttccctgtccttcattatctccctgagtttgctcaaactaatgcccattgagtcagtgatgccatccaacctctcatcctgtcgtccccttctctcctgccctcaatctttacagcatcagagtctttttcaatgagttgtagtaagtgccgaatgtgtgtccacgtgggaagaaactgcaaaggctggagaaggggagatgacagggaagaggaagggcatggaggccagcacggatttaattcaactgaaactgcaggtctgtaaagggtgtgtgtgtgtgggggggggggggtccgctggtgagaaagagcagacatctcaggtatcttggttccagagaggaaaggaaacactgggtgtagctcctcagggaggggcgagtgacttaactgttcacttgggcgctgtgcgttaattagtgaggcccaccggggcccatttagtggatgacctcatccagggcgctaagcaatcccctggtggctttaatgagtgagtgcacccctcaaagacttgacaacttatctttttccagagtggaattaagccttgccaataatgagcacctacacacctatgcttaaaggaaaatgatgtcccctggagagccagttttctactctgcacccgagcctcc

SEQ ID NO: 59398 - DNA, 995 bp, Bovine  19866880945074
ttattaactcttaaatatgttatcaagatgcctcctgaaaggtagggatggagaaaaagagaaaagtagaggcaagaataagttccccagagtggccagaaaagggctggattcatgaccatccatgtgccatattaatccgtcatgcacaggtagctccatgctggttccaaacccatggaccaaaccatcctggatgcagctgtctgtctgctcccctaagacaccgagacttgtcattcagtgagaaactgtggccaaccccctttcctgtgttcatcacagtataccagctctccaaagcagcaatttgaaaccagaatgtccaaaacaatcactcgaagacatttcccttcaagaaaaagacaaccaaaaataaaagaaaggaaaatttattctttacctgtctcccacatgattttcataccagtacctgactttaatatgttaaggtcacttttcatgcttactctgaagaaggggttttatatcggttgtttgcttttttaaggaaaactcaaccaatatggcaaaattgcacaaaatgtgtaataaaaacataatgggaaattcagtcaacatttgttgaaagtcaaataataaaacattattaccctatacatctattgaacatttttctcctagggaaatatataattcctttttattgtaccagcaaacattccaggatcagttattacttagtagactgaagtcggatgcctgaatatagacttaaaaatgaagtcaataatctaataacataaaagtctccccctcaaactaataagaaatattgtcagcatgtaggttcttctctggataacactatatgaggttttcttcaaatactcctttgcaggaattcaagttcatatcacttttataactatgcacatgtaaagtggcacaaatacctgataaaagttaagcacttcttcagaaactgatgatgccatatacttaacaaaataggcttccagaagagtcttttt

SEQ ID NO: 59399 - DNA, 1036 bp, Bovine  19866880951939
atctatactctggaataagaactacatacttatttctagacaattaacttaggcacagttatgtataacaaattacaaatggcataaaatagagttctcttaggaatttctacttcttctttatcaaggacctagaaaaccattttgccaaaggaattgtctctgtactggctcagtgcgggattcttttccaaaattcagctgacattcttttggtcaactacagtgagctagggtattagtgtattttgtctgtgtgatacaatgaatgaaatctaaattcttaaaataggaaggagataaactggaaaaaaaaaaggagaaggtattctgagcaacatgagtaacttaaattcacacagttgaaaatgaaagtggcgttattattacacagagtaataatgggctggactggccagtccagaatacatgctaatattttgtgattgtgacagccaagtttggacagatagggcaagaatcttgggaaatagatgttgtaggtaagttggttattctgagtaccagaagcctttgtgggtgttacagaaaaggtctcatgacaaaaaatagtatttttcaaatgctgtcttacttgtgcagcagttgaagtaaaatgcaagaagacaattttaaggcaagtttcagccaagaggatttagttataattcaagtgtaattaagaactcaaactatgtaagaaaatgcaaaagcacaaatgtacaaaggaaggatcaattccacttattacattagatgagaaaagggtataaagtgacagactcatagaaactaaaagtggccatttaatgaggttatttgatttgcttattatttttaatttagggataataaaactaatttaaaaggggggataaattatagtgtaccttagaattttcatgtatttcaaactcatagcatatataaatcctataggtttggtttgtcgtaaaagctagaattaaaaacatctattcaaatagactcaaatttttctaagtgttggtttatatatatattgggggacaataag

SEQ ID NO: 59400 - DNA, 1731 bp, Bovine  19866880953240
atgaaggaaactggcatgagcctgcaggagtctccccagtcacaaaagagaaagactatgaggaagtgtaaccagaaatctgcggctatttagtaatctgctgtctggtattatttctctgcttatttataagtgttatattaaagtttctcattcttcagttgttttaaattggacatcatggttaaaatattagtaagagattacattctcttgcttttgtctatgggttggaagtaacatgaaatttatttggatttatatagtttacattgaaatgggtgctttagtcaatgaaccacagaaattctaagattgtaccattatgtaaacttactgaattcatagagaagataacataacatgaaggactggatatccaaacctcaaatttggtgttaattatagtttttgttttaatatttgtcatttatctgcttttaattcagtagtgaattttacaattgatggcatctttgattcaaaaaattattatagagtcagaagtcttctgagagcaggttctttttgcccaaaatgaatcctcaacaacagtagtggttttacatgtagcatataccatcctgggctaggctattcatgtcatgtgtgctgaagccatggccttcttttctagatttacatctctgagaaggacattgtctcttcatctccacctgaaggaacaataaataaggccccttccccaggcaatcagaatttgctgttcatattatggagtttatggtatagacattcacattgtgatggatggaaagaaataaagattcctagggggtgtctatgactgatttgtttttgtattgacttctgaagttaaaactataatagcagagtttgtctttctttctaagatatgtgttaatgtgcccaaaggctagtaagcaaattgagtgcacttaatatgcctgataaatacaggcatgaaaccaccaattttgtttaaaaaagatgagtttacttatttttctaaaaatgaaaacttttccataaatgaagactgaagaaacacagtgttagtctgacatacaccaaagtaggaaataataggagaacaattctgattatgcagaaaagaatcaaatacatttcaaatttcaaaagaaaaaaatcaaagtaaatgcaagtcatttactgggtggttttgttaaggggcaaaggattgggaagagacatacttctgggcaacaagtgcagtacagagccccctgaagctactgagcctaaaatccatgtgttcaatggaacaagtaaggaaagatgatggcatcctgagtgccctgctgattactctgtgaaattagagcccacttgctgtatcaactcattctttttcagttttgagtggaactgagtcaggaattgacccagaattccccaagcatgttggtcaactagggcttcaacagatgtatcttttcattctggttcaatccctataccttatagatcggaagagggagaatatttttactttgtcttcatcagcaagcatgtccaagtatgaaattttagaaataattttataaattattttagtatgtattccatatttaatactaatatcaaacatatatataaacaaagcaggtgtatcactcagccttctgagttatattaccatgtattcacaagtccaaggtcatagcattatggtattatgtcccactggtggcaagaaagcatgctagtgaaacatagaactggggg

SEQ ID NO: 59401 - DNA, 1285 bp, Bovine  19866880970540
tctactgaaactgataatgatttcctcaaatatttacaccctgagtcttacttcatgttaacattcaaagatttaaagcaaattagaaattctcaatggccttaaacatgacaggaattatgtaacttagaggattattccattttgaaattacattttttgaatctatagaattctcactaaaatccctaattttctacagttgatgtatcatactggtggaaaacagagttgacattctctgctttcaactgcaaaatattaggaaaaccattacctgactaattgttgtgagatttgtgtcccagttttagaaatgtgtgttcttgggaaaaaataccttagatttacatagtgatttttcagctttcatatgatttttccaactcttgatcactacaaccatgtgtaaatggcatatcctatttattcccatttaacaggtaaaccaagcatggttaacatttttggtaactccatgcctttgctcggagcactttccattatgaacagtttgtaactattgttaggttgaaccatttgaaattgctagtatttgaccagtattctaacctaccaaaatggcaatttcataaaagcaatattttcagttttactatcaaccatactcttggttgttcttttgcttattctacttttcgatatgcttgtttttaccaagatgtcgtgcctcactcttaccaatcccttcattttctcttttcatagtgagtagataaaaaggcaaaatgaaaataaacactaataaaggaaaccctagcctatgagaagccaatgaagttacacacaaaaaacttaccaatgaacaattaggtgatgggagacattgatgtgtttttaactagggttgaagagagaagctgcttcatagtattcagtaaaaggaactatttttgtcaattctaatttcaaacttcaacaacagtaattagcattgagaaatgaggaattttcactctaaatatttcctataagaacaacagcaacattaattaaaaaaaaatacttattgagtatttactctctttcagacacgctgttaaacacttgacacgaattacttcatgtaattctcaccatcctatcaagactgattttccttttgcacatgaagaagctgaggcttggagaggttaagcaattagctcatatgaataataagggacagagactgggttcacacctgtgcccttaagagactgttgcctatgatgactgatccctgtgactcctgagcccatcgagccagaattttccagcctcg

SEQ ID NO: 59402 - DNA, 1793 bp, Bovine  19866881002619
ggcacagtcttggtcatgtgtaatatgaactttgttctgaaatcctcaggtatagtgttataaatcacagattcaaagggcaaggggggacaggaaagaaaacaaaccttaaggtcctaatttcccaaataaaatacacaaaaggttattttcatgcatggttttgtgatttccaacatcttccttttgtgataagtgctatttctagaacttgggcctaaatttagaaaaagaaaaaaaacccattaatcagatgctaattagcatgtatcattaaatgttatagactgagacaggaagcccacctccttataagtggctgattccatttctcctgtactgtcagatatttggccacttctctctctctgattcagttctttgctgtgcagactgcaaaatataataacttctaagcagtgtgtaaaacaaagtgctcaattcactttattaaaatatccaataataattgatttaaaggcaataaaatgtgttcattagagggtttatattcaagaaatattgaaagtatacctaaaactgtcacttttattgtgaatgaacaggataatataatttgaaaagagtgtgatcatactaaagatttgtcctgcagcattatctgatagctcgtaaagtgctgaaatttaatatgatgctttcagtcagtttaattgaaatttaattgccactttgggcagaaggtttagatctgatcaataaaatattaaagattttgtgctttcgcttggaacagctcctttagcgatgcatcaagaggactctatattttcggaaatatttgtttgttatagttcacacactgctcaatatcactttctaatctgaaagttttaatgtgctgtgcagacaaatagtggaaataataaagcaatagttgatccatttaattacaacacgatgaaagaaataacggtcaccttcagattcatgagaaaggcattaacgtaaaagagcaataaatattttgaaatgtcaaacctcagaaagacagagtccaacttgagctgggttgtaaatcagactgagggaaggaccttgaaaaaaagatggttctttggtattttagaaataattactaatacaaaaagggtaatgatgaaactataaattacattaaaaagggccattagaggaggattagtttataaagctgagagatggttcttaaaattgtcctgctggttatttctacttttcattttattcaggaaccccctgctcaattatctgattattaataagctaattgatcatgctttgcagttcaaatattaaagtcaactttttccttttcagggactcccataggacttccacattgcttatattttaggaagggagagagttggagacttaagacatatgaacagtaaactggagaatgacttccagctaagtaacatttctattaatgtctcaaaattataatttctttcatatgactgtattcaaaaaatgactgatacttgtgtgttataattttttctaattatcactggaataagttctttactaatgatcttttttaacctatagaatttctcaaatgctccatgttccagcctccatgtttctttagtcaccagttttctgtaagatgttaagttcaatagcaaggcatgttgttttatttggtttgttgtatctctaatgtatatttcctctttacaaccacattcaaacaagactaattatctacaatgatcataatcagtcatcttttttctttaaccacctctgtttcagatttcttttggttaaccatccgc

SEQ ID NO: 59403 - DNA, 1901 bp, Bovine  19866881022584
agaatgatttaatcaaggtacgtgttgttatattcagcctcattaaacaaggaagtttcgatgttatatgaatttttttatgctctggtgtcttcagcaaaggatatatcttgttggcagactctgaatttttttcagatgtcaaaaacacttgaagctttaaagtctaatgggtttcttaatccaactgcagccattcagcctcagtgaaaaatccattccttcatattcagttgctcctaaatgtctttccctttaaatttattgactgactttcctgtctttctgtctcatgtcgaaagtcagtaggcacatgtaaaaaataatcaaaacacaccgactccctagtgaagaatcaatggtgtcactgctgtcatatatctagactaggcataatgaactgcagcatttcatctttgcatataagataatttgggcatcaatcgtattctgacagatttatgtcactcaaaggacagttctacttttcctttttttttatcgcttcattgaagcctgcttaatttctctcagtcaactggtgcccccaagacgttatttttattcttaaatgtccaatatccacctgatgtctgtgtttgtgctcattggggcctcagtaaatagactaagagcaagtcccccctgcttaagacacacacaggcttgtcagttggccttttcaaaagtgtgtatttgtgtcatcttcgcctttagagatggtgatatatatttaaaaacaggtccttagtttggaaaggcatgcagttatgggcaaggaaaaataaaacgggggccaaattataaaaaataaaataaagtctctgcagtgacagtgaagacaggtcgcacccaactgtacttacttcccccggctttgcgattgctttacatggtgaaggttacatgtagtgccattgcccatccatgcccatattcatgcccattccactcataggtcctagaaaggagataaaatccaagaagaggccggaaaatcagcaataattgatggtgaaaaaataggaggaaactcaagattccttctcacttactgccttggttcaaaaagaaaaaaaaaagaaaaaggatgtgtatggggcagagtaaaatggtattgttgtcaactctttactttttaaaagaagattttttttcccccacccaagggaaagaaagcaggcagagcaggcagcaggcaatattaaacccaccatgagagtgggagagtagagtggatgaagaaggctggtggagaaggtgacacttgccagggaagcccagaggagagatgagcaaacctacctgcaggccggattcccatgtgttgctgaccatccaacacaaagctccccatgggctgaccctctggactatacgctgctccttggctcactgaaggatcaagaagaaaacctgattgtagtcattcgaggacacagaggagaaagaagaaaagatataccaaacaatcagcaattgttcctgctgcagcactgaaacgttacagcaacaacgtggttggcacttgcaaagggggggtgtggtctgtatgtgcggttctagggttgaggtgagatgtgtgagtagctttaccaaacattctagaggaaagacttccccagcctgtctaacaggtgggtcatcctcagcagcctttacttctggacttttctctctcaattagggggaagagggacaaggaagagcggctacctgatgtataaagatcgccacatgctattaagattttgtgatcctgccatctctggtggcttaataaaatttcacatcagacataaacacttgaaaatttgagcacagttttacaagattaaacagactcaatggaacatttgctttttcactcataccaaagaaaatgtaaacacgataaattt

SEQ ID NO: 59404 - DNA, 1018 bp, Bovine  19866881061310
aactcggcctgaaaagacttttagggggagcctggtgaattttttgtccttaaaataaagctgtttttgaggtaggagagaagcttagtttttgaaatggcacaatgaataacaaaggccccttttcaccccccaaaaaaggactaaaaaggacatttgttcaactcttgaggaagaattgcgccgttaacataaaagtctagatacaagaggagggaaaattggaggaagaggaggagcaggtagaattaggaaatgcaggacccgggaagcaacttgttttacaaagatgattatgctcaagctcagactgagaactcgagaaagagcacttttagtgaatgaaacagctggaagattaaaagtagaacatcccttctccgagcacgtggatatgcgtgtgtttctctccccactcccctctcctgtcccccagtggccttataagtatagtctggcagacaagtggccagtaaccagtcttcataatggaggtcaggtgatttgtatttctggatttttagaagagacagggtttaccattgatttaaagatgcaaagtacactatttcacctccccctgtcatttagtggatgtggttcttgagtgtgttaatgcgtctcgagccctgacctaaactgtagatgaaaagactctttaaatattaaaatgcagaacaaacagaattgcttatgcagtaagaaagtgcacagtattctaaaatgaggcctaatcttttttattggggcagcaaataactacgtttctggccaaatataactgttttgaaaactccctctttaacaaaattagtaagttgctggcctttcttttaaaaaaaagaattcaagttacagagtatgtaactctggacttatcaaatctttttatgcctcttacatgtcaaagtttaagtgccgtgttttgtgtatacagtcatcatgatatttgaaaaggccataaagaaaagcaattatataatgttttcaagaaccaagaagcaaggataaaggtttt

SEQ ID NO: 59405 - DNA, 948 bp, Bovine  19866881075461
ttggagagagaacaaaatctcataggtctttcttagctctttaatcccaatatgtaaaaacaaaattacaggaagtagtttataatataaagatttcccagcaggtaagagtgtataggaaataagctggattgtagttgccgtaggggctttatgtgatattagagtaaagcattttcttgaattttctaagatgcttttactttctaaagtcttcctgctgtaattgctgaaaattgaatggctttaataaagaacaagattcttatttcacaattaacatgaaatcaaagagatacaataatgtttttaggtcgtatcaataaataaatgactaataataaagtctatttccaaagatgaccattataggaatgagaaccttaacagagaagtacattatcttttaactaaagtattcattatttttctctgaaactttgtctgtttaggtgagagaaaaactatgaaaaactaacaatactgagtcagtctctacagagttttcgctcaataataggcattattctaacccctattagtcatttgtacatttaatctccaaataactcaaaacatagaatgtttaattatccccaatttgtagatgaataagttgaggaaagaagagttaaccagtctagagcattaaggtacttgctgccttgaagaaagtaaaaataatgcctttgcttctgagagtaacactgttgtgtgcagagtagatgtagcttttagtattttgaaataatgtatttccaagtgcacatgttgttgtagaactaggttaaattctccaggattcacaggtaaatcaatgattattgaggaactcatgtcactggtactaatcccaatgtaatcctttcaatcatgggccttactttcaaaatagcataacaaataaggtatgggaggaaagattacggagaaaatacaaaaagggca

SEQ ID NO: 59406 - DNA, 2704 bp, Bovine  19866881102382
ttctttcctgagttaatttaatattccaatagtacctaaactggcattgttgatcgccaattctataaacagcctagtctatcctatctcttctatataaacatcagcatgctctagttccatatatccacttgaaaaaacaattccaagaaactattctagaaaaccaaatagtcaagacccctagaaatgacacgagaaaagcttttgctgcagaaaactgtgaacttttcatcctacaaaccatgtaactagacgccttcccagttcccccagtagtgcaaaatgtacatgaatttagaaacaggaagcaatgaaaataaacaagtaaatgacaacaacaaatactttgaaggcagtgtcatgccctgccgaccacaaccacacagcatatagctacctatcagcaaatgaacttgccatagctgcttgttgcacccacctgacttcagtgaatacacttaatatacaaaagagctccccaacatttccctcccagtgatggagaaagccaagagtaaagacaggcatgggagccttcaacaccacagtatttattctgtctcagaactggacatcggtactgatgttttcttttttttttaattgaaactttcgtccttaggctatatggctttccatagagcacaaaagctactcattaaaatctgtgactgtatattttcaaaacttttggagaaggagggggagaaacttattctccaggtatctcaactcattcctcttaccacctaggagtggggggtgatggtggtgatacaaactaccttcaagcctcgacgcccatttaactccacagagtgctaaattaatatttcagccatcaagttagtagactatagcctatatcattcaggttgtgagttcaattgactgtaatctatgggcaccctgtcccccacccccaggcttgagttcctataaataaactgctgttcacacccactctttaacctctccactcttgcctttcctaccagctgcaatctttcttctctttgcttctttttcaaattttcagtctcactacatatgcttttttttttaagcatcagactcactagatcagttccaaaataggattaaaaacagagagaatagaaagaaatctccgttcctggcctgacacacatgggtccctcctgactatactctccgttctcatccaccaactcttttaagtgttaaaattcaaccactaacctatgtttactcaatcacaattcccttcagctttctgtaatacattgttaatatttgtttcatcaaggttactgtcttttattaccaagatgcttcaggcacttggcattaagttcatacactgacaataagtttctatacagcataagctcagaaaactagaatgggttcactccttttatttcaaatgcgatgcaagattggcaataattctcagaattgccatctctgcgagaaactgagaaatcagtccttgctccccaattttctcccatcctgtccagttaactttcctgcctccttctctccctgctgcactgattacagagttgagaaagcagaaaaggcagcggtcaccgtatcaagcagacaatttgctaacactcaagttaccaaatccaggaaactttacacattagaagcacaaatcactctatcaatttgctgtttttttttttttttttaattctcaacataaataaggaaggggtccaagaaaagggaaatacagatgaaaggtgtggaagaagtagtgagaaagggagggaaagactcccagagagaccagattttttattttaaaaaataaaactcaagtcagtggagctagaggttacaacaaaattttcaaaactgctgtgcccagtagtcttaaaagaatgccaaaagctcacagacttacatggtcagcgagatttgtggaggagcccgaaagttcttcgtgatccgacttggagctgccgtctctttcatcaatgacgaggtctataggcattttccccttcaaacagctaatgtaccggtggcagaagttatcacacagttcatggacctagaaggagggtcatggtggagggttcagcttgtattgttgttgttgttgtcatggttttgtttcatttttttaaggggaaaaaataccaggttgcaaggtttcatttggaaagagtaacagtgccatgtcttccaaactaactctaattaatgggtgtaatagttgaaggcaaggaaacaatagagcaattgttgtagcagatattattctccagagacttccctgagcaacaagttacaataaagggaacagaaacaggactggaaataactgggttcaggctgggactccttggggggaaaatccgatttgatgataacatcaaaatgtaaggacgaaggaactgggaacagcattagcatttgcgattcaataagctaggaattttgtatgtttccaggagaaaatgattgagctgcagagcaatgtaaagacaccctagccagaatgattccctctgctagcacctaatgcatgccctgggcctaatagagacgcaagcaagctgaatgtccagtaacacaaatggtttgctgcatttcaaaataatcctgaatgcctggggaaaaaagggggggtggggggaggcggctactttaaaaggcggggctgccttaattcacccatcctccgagcccctgggtt

SEQ ID NO: 59407 - DNA, 2305 bp, Bovine  19866881115602
ggatcccaggctagtgctgtcttgatgctttgatatagctaatcacttatgaagtgaattattgagaatacctgatatattaatgcttgaaaatgatacagctgctggagcgagagttgttactttaaaaatataactttcatgcagatacactttcttgaaaatgagaaaagaaggattgggtttcagctaacctttagggaatttgcttattgggagtgcatcactgatattaatgtcatcttatgtgtatttttctgtaacagggagaatgtttacagctgctcaaggaagatggaaccagaataagaaattttccacttagactcaggaaccagcaacctcattcagaacaaaccaatcaaaataagggaggaaggtaggacatattatatctatacctacgcattatattatattgtctagagatgtcatgatttagatttcaaattactctttcattgacttcaacctgcaaagactaagaaaagttttgttttttggcatagttagaaaattttccatctgaacttacatgcttataagtaatataatttataaatacatagtaattgatatgaatacatttatattgatgggaataaatctagataacctcaaagagaatcatatatataatataggattaaattaatctttttctctgattttgctaggaggtagatgattgcactttcactaacaaaattctacagagatgcacttaaatatagaagtacttaataactattttctagatgtatcacacttcattcatctgtcaataggtcatatgaatgaaaacctatttttaaaagaagctaagaggacacaaaactacccatgtaaacatttgagtccatactcatttttccacttagaatctggcaaaacaagccaatcccagtactctaagacaggaaactagacatatgaatactggggcaggggtcagaatccaagcaagcctagtttggacaggtgttagctgaatgacctctattaagtcttttgacttctctggttctatgcaaagaaagtgttgatgaaaatacttacacttctaaaataattgataagaactttgaattagataatacaaaattattcaagaaacttgaatggttatttataaaactttacttaataggtttcttactctttcatttttcacccaagactaaattttttcctcttaataaagacaacagaaaatgagctttttattgaataagttgaaagtatttatacaacacaataattctgcaaaggaagtcatcatcaccatgcccattttacagagaaaagaactgaggcctaacattactgaccctcctagagtttgggagctttatagagatagtatgagaattaatttttagtaccttcccacttttccattggttatttatgtctgtctgactcatcaaattatgctgattgtttttaacaacatcactcagaatttatctcaatgcctgaagcatcataattgctgtgactaaagtttgttgacctcggatttcgtttgtgatacaaggaagggtcagaagtgacctgcggtgtgcagaactctctagttttaagtgtgatgctttggctaagcaagaggatgactggtgaagacaatggtgggtgaggaagctcaagactggaaagtgttgtccgtttattatccctctcagtgcttagtctctttccctgattcaggcagttagcaaaagtcttagatgcccttaaaccagtcttctaccaacaaaggaatcccatctatggttttcataacagctgatcactcagctgctttttctgcagggagattgtaatatctcaagtagctaaacactgttgaagatttggggcctttttttttttttttttttttagaaattccctttatactgagcttattcactgtccttgttctgcagtttatgcttcaatttgtccgcatgaaatggataatgagcatagatttagatcctgtcccaggctttgagaaccctggagtaataggcaaatttggccttggagtacagaatgaagcagggcaaaggctaatagagttttgccaagagaactcactggtcatagcaaacaccctcttccgacaacataagagaagactctacacatggatatcaccagatggtcaacaccgaaatcagattgattatagtctttacagccaaagatgggagaagctctatacagtcagcaaaaacaagactgggaactgactttggctcagatcatgaattccttattgccaaattcagacttaaattgaagaaagtagggaaaa

SEQ ID NO: 59408 - DNA, 1088 bp, Bovine  19866881131864
taaaaggtgacttcagagatggagtggaattgccatgagtgtttcaattcacatgttgataaaacatgtaaataacatttctcccaaatccttactttcattgaacagtaagacagcagtattcaagtagggttgtttgttttaaaaacaataatctggagtaatttctgtttatcaccaatatgaaaagaagtggaaaaacataagcaatggtctaaacactggccttacaaggccatatggcacttcctactctccacatagcctccccacccactgaataaaataaccatcatggaatggcacttttttcctgcttaaatttggctataaagtgaagcgtaactttctgaataattattttgagcctgtaaatggtgtctctctataaccaaccaagcatataacaagaagatgaagattagacttattttcacttcatttcacttctttgtaattgacaagctctcactgggtgtcaactttaaaagatgacaaatcctaaatcttagaggacccaattcaatagtccaactttctaaattgtttgcaaattaatctacattttcaaatgagtcaggcatgaaatataagatgacatctatattacaaaaatattaatttccttgtctttctctttttccctgtcaaagacaaaaggtacatttaaaatgttcattttgttaagagatagtaaaaatgaatatatagtgtgcattttagcaacttggctttttctctttttttaacactaatttatttctctctatttaaacatgcaggttattcagttcacaaatgttctatgtattgatgagagaaaaattaaatttgtgaagcattttcagtgcattacattttttaataaagattcaacaaatgaaatagtaatctgagccccattgatttaaattctagccttagcccccttctcaattagcccttgactcagtttatccacatgtgagtaaacaggtgctgtttttttcatgcaaacaacttgatggtcataaaagctctgcacatttttaattcctaactaaaatagttataacatcaatgtcagtgatctgatttactgaagggta

SEQ ID NO: 59409 - DNA, 1176 bp, Bovine  19866881178895
attttaaatatgttatcttaaatgatccagaaaaaaattaaatcaagaaaaatgagagagtaaattataaatcaaatagagtaaaatgtcaacagtaggtgaatatagaaaaaagatatgtggtcagtttttgtcctctttttattttgtattatttttattttgtaatgttttggtaaatttgagattattttcaaataaaaaaatttattttttctcctatttcacagtgtaaaatgaatgaaaacacagtgtccttcaatcatgtagcaagctcctgtcaatcatatatgatttgtagacatttgattgacatgctgattttcttgggacttcaaagatgggattgtattccccaatcagacccacaggataacctgaggtataactttcaaaatgtctccatatgccagctcacaacatgaaccatagatgctttctatctcattcaagaacctaatgatttacttttatatccataagaaatatatcattaatatataattaccccactcactgtgtacttgtaatccacactctctgggttcataaacactctaaagaacacaactatataatagaaacaggaaattccaccagacaatccctgaaaacatacaccaatctttccttcttccttccctttctccttctcaggggtcagatagctctcccagcctcctctctctctctttctactatttccttcacagatgattaccccagtaaatctcttcatgtaaaatcctatcttggcatctgcttctcagagaacatagcctaacatggccctctatcttcagaagcatccacacagaactagaggttatacctagtcaccctattgcattggagtgcttcccaagcctccatcagcaatacgttaaaaatgatctcccaagaagtcagtctaatctagtattatagactagaccttgaagtcaaaaggactcaggtggaagaattagctggatgatcttaatatttaatgggatcagatatctatttcagtgacatccataataataatagacaggattctactttttatggactccccttttacagggaccatgcagattttcttcttttctaaagacagaaggcaaagtacccagatgtgaactttctcaggagcaatcaaaattcatatttgtttcccccaaagaaagttaa

SEQ ID NO: 59410 - DNA, 766 bp, Bovine  19866881215827
cttttctcttccctaacaaaaacaaaagcaaaaacaacaagccagcaaaattaaccaaaatgataaaactcaatgccttggccgtggccgcaactgttcagcgttccaaaccccaagggtcatccttccctgcctccccttctccctggccctctcctgccatctcgctggccataactcaaccaacccaactgaaccagtcagttttaaatttcagttgggaccttggtgacctgttaatgaatctacagagaggagaaaaactcacagtgttgagttatgcctggtgttgctagctgacttggagtcagaaatgcttgaagcgttaacgtaattgcaagaatgtgaaaaatgaagcgctgggctcctgagcaaagtgaaaggtcaaagcgagcctcacacacaacaagtctttggaagatagcctcattagaccattaagtctgcttctcctttccccttctcttgtaccatgtttaaggtgttttgtttttattaatagatacatttccccctttgtggcaccatgatttggggtggtgggaggagaggagtcttagaaagcttttcagatttaaacacactgagaagtatttctccaagacatagaaacacaatgaaagccactgcattacagattcactgaatttatatacatttcatcttcaaaattctttatagtttcgttttcttacatataaccaaaggatctaataaaaaacagtacagaaagcctaaatagatacagttcaccggttcttccaca

SEQ ID NO: 59411 - DNA, 874 bp, Bovine  19866881221808
cctggtaaattcctggcatggaaaggaccccagggaggtgtcacagttgccctgccctgcccacctccacactgtcatctcaagggcaaccctccagaagtgagaagaaccatcagctgttccctgcccatcccactcctcctccctcggataattacaccagcaggggttggcctgttcccatttatgaacggtggtatttgtaggttgatcagtaagtgtgaatcaccgattcgtttatgtgaagcaaacagtccatgaatctctggactggatctaatctcttgattaaatggagctcactgaattaagtggtagactgtgctgtacttcttatgaagaccatgactgaagccaaagtcaggataaattttaaatatgagaatatatatttattaactatgaaaacatatttgaagttagtgctatagaaaatctggcagggagagtcatcatgatcctactgggttgttgctctcctaaactacacagttcactgaattttgacttaagagaaaaagtcaaacatttagtgaaaactctggaaaactcatagcaaatttatattttgggtgaaaaatgtcaagtatcagttaatgcccataatttgagcataatcaaagtctcctttcctaagagggcttcataattcaccttcactcctatgattataattaatatttattgagctaggcactatactgagcgcatacaggtatcctcttatttaattctcacaaaaacctattgaagcaggtacccttatcagcattcccattttatggtcaggaaattgagatttggcaaaatctaatgatatgcctaaatgtcctccagatggcttgatgataaagaatctgcctaccaagcagga

SEQ ID NO: 59412 - DNA, 904 bp, Bovine  19866881230580
gatttatctgttgatatttaccaaaaaagtaaattaaacctgagaaattttaaaaattgcttatttatgttaaagattaatacccataatttaaaaaagctagtgagaaaaaatggcctcattttacacttttggcaaatctctttaatacctgtcttaatagaaacaagatctgtctgcttcggcattcaacttgtgatatgctatcttgattaaagaatatgaagacattctggccttagacaaaaatgtaattggaaaactatttttgttactacataatacccaacaagtggtgtttttcttagaagttaattgcaatgtggaaagtgaaaccatattatagaactttttggccagtcttgaacttagagtggatctttcacccatgcatagttcttatcatcatgcactgttcatttgcaaaatattggttgtgagttatgcaaatcttctaaatgttgtcatcattacacagcatctaaaacaatcacatttgttaatatccctactgatttcatcagaaaagtctgtaggatttgaagctgtaacacttatggtgatggatgcacagttttccaatatttgagtttccccttgaaagctcagttttttcattggcaacaaacactattggttgtttctcttgaagtgacaggctcatgtttatttttgagaaaatgcctgccagatacccaaatgtgaataatggtagtttgttcatcattcatccaagaataaatggtgttccatggaaagggcacctagttcagctctgaaacagtcatacagatgcttccccttcagatagtcatcatgcttcgatatgcagtagacgtgcttcggtttacctcttattttgttatacagaatgttaagaggatgtgtatctagagtgagatct

SEQ ID NO: 59413 - DNA, 1064 bp, Bovine  19866881258867
cctggattggcacacagatacttttagcaccacctgggaataaaggtgggaaaatggggttgtagatgtttgcaaaatagctgacctgaatatttgtaggtgaaaatccattttgggggccacttgtctagggtctctgtcttccaaagttcttctgctcagcagggatgactaaaaaggacaggatgctgcaccaagggtgagtgagcatgagtttggatgagtgttctctgtcttctctgagcttacgtcctccaacactggaacagttaatcgagagttgattccctaaaattcctttgtctactttaccttatgttgatgtatatagtggatacggtggtgcacaaccaagattcccattggtgtgaatgtactccttccccaggggccatggtgttccttgccatcatcttactgttgagtgctcctctaagaactgccctggccaaagggaactattttccccaaagttgcatctcttcccaaggtctagcctgaatcccatgactaaaccatggttccgttggagatatttctgatggatcatcccaagctcagaactcctcacgggattggctgaggtctcagttgtgactgcactgtaattcaacattgctctctgacaaatccttcctcacacatatcatatccaagagcagtctccaatgaaccatttgtatccaaatctcaagctcagagtctgttttataggaaactcaacctatgacagttatagtggggatggttctagggggtaggctccaaaatgaaactgtggagttgaattatttccttgctggctggctggtgactaaagacactattgccccttctctcagaatctacccccaacacccctcctggttaccaaaacagtatcaaggattaaaataaagcagggatgcaattgttaacattttctctgatctttaactgtgatgggatatcagcagaagagaatgtactgcaaagtataatactgcagacgtttcagagtttaggggtaaatagtaattaaaagactatagaattacagagctgttgctgcagctatccatgca

SEQ ID NO: 59414 - DNA, 1419 bp, Bovine  19866881286952
tgcctgaaaagacttggagatttatagttagaacacaggtctgctttgtggttcaggagctgactgcctctctatgtagctccatgcgtagttcctctgatgtccctccagccccagtgcagctggcttagaaaaaattctaggaatttggtaataaagcaataagaagttggagaatttattatgatttatttcattgggaggatgttaattaattttaaattattaagtgactgaaataacacacagtgatactcataggttattaaagaggcatgaattacttagctgaaaaataataatacaaccttgattttacatagttcctattttaagtctgactgcccatgctttttactctcaagggtattactccatgaattctcagcaaaattgggctggtggttccctttacccatttcctcaagttggggctatcctgagctcaggaggctggcaggatctgacgctgtagactgcactaaacatttaattaccagatcagcctggtttgtagacatcactttatttatcctccaattcatcctaactcttctgctacatttgatctatctggttacaaaatatggctatctgtttgctagtgataagaagtatactttcaatgttgatgcctgagtgggatcacagtttggaactcatcatatataactgactaaagaagtctcagtattttgttttgaggattttctttaaacttggtattatgctgtttgctattccacttactacatctgtaagtttagaaatgggtttaaggatcaaaataagaatggaaaataagagacagtgtttttcatcctatctgaatgcatatttaggttggcttgtgttaacaatagatcatttatctgttggaaattctaaaaagaatgacaaaaatgttgttaggaaacattttgcaaattgacagaacatattctatcttttctaaattaaaaaatatcttttggtacccgggaaggcaatacttttgacccaactacggtaacttattgggaaaagccttttcttataaaattcaaactgccatttatgacagaatcaatacttatgatctggttacctttctggaactctgtgctgtacttcatgaagtggagaaatatttattatcctagataaaaatctcaacagataaataatataaatgtgtgcctctactaaacagttttaattcaatcaatgaatactatgaacttgccaagtaattagaaaaccccttgattttctttatatgcttcggaaagtatttcaatagatgataaatttactcttctaacttcaacttctcttaggtatttctaattataagtattttattcaattgatatcccagatttcatatgggtcattctgagatagagattgtttagttgaaaaaggatacaggagtat

SEQ ID NO: 59415 - DNA, 1642 bp, Bovine  19866881294906
tgtaaaagtttttttttttctttctggtatgctttttttagggcttcccaggtggcgctagtggtaaagaacccacctgccaaagcaggagacataagagatgcatgttcaattcctgggtcgggaagatcctctggaggagggcatggtaacccaccccagtattcttgcctagagaatccccatggacagaggagtctgtgggctatggaaaggtaagattcaaccaataattcataggaatttccaggtgggttcaggtaaaatatctggtgccttgcaaagtcataggctaccagttctctcctttgggaatgtaatcagaaataatcactttactgaaaaatagacgaatgcttacttttctggtgtattttttttacttctaagacattcaactattctccttaaagtacgtggaaagcctgaataagtggtgatagaaaattttgaggagcatcctgggagaatgagaggagttggtcttgggattcaatctaacagtgtgatttgggcaaatcacttgcctctgggagcctcaggattttttgagctataacatgcaggtaataatatctgttctacctgctgcacaaggtattgtaaagactaaattaaactatacaggtgaaaaaacttttaaaaagtgatgtacatgtataaatatttttaaatatttgtcaataagaagaaaacagttcacaaccaaaggatatacttaaaccttgtactgtaattattacaactgcatattccaaaccatttgaatactgagatatattaactttttataaaagtgaattaaaaaccaaagggatattaggtattttttaaagaggaattttccctgataaaccgcgaggcctttgtgtttgttattattcatttctgtttcatcagtgcctagcgtatcatggctggcagatagtatctgacatattacgactactcagtaaatctttaatgaaggaatgccaggagtttgagcatcactgagaaacagtttatagagttaaaactaaagccccaatagaattttaacctgaaattatctctacatattgaaatattgataccagtaagtagagtgaccttcttaaagaacaaggcagttttttgttgttgttgtttttttagacagaagttcccctataagaagttttatttatcatagatgttcaaggaaactttattcatccatctggaaacttacatttgtcagcaaaaaggcattgttctgtggatatctactagagtgcattcaacacagtaagagttttttgcctattttgtcagaggcagttggacttggagaaaaatacattatcctatatctaaaaagtaaatgcacattccgagtgtgttggggcaagccactaactacccatttaaaacaaatcttcccatttgattttcagagcaaaaatggaaactgtctgttttgatttaaatctgtcccagagcagtttccatgagttaacccagctgaattgtaaacctaggaccaaataaacaaacgaatacccaagtggctttgaacaacagaaccgttgcatggtttccagtgggtgcatctttctccccaagcctgcattataattaagaggttaccatggaaagaaacctgggacaatggcatggg

SEQ ID NO: 59416 - DNA, 860 bp, Bovine  19866881324350
acagaaatggaatcctgaggcattttgttaatttgggccacccatgtgaataaggcagactccagaccctagcatgcagttgaaatggtcaatactgattgtcaagagggccaaaatgactgttttgactgtgctgtccagatcagttatcacatacttgagatatcacgccgtattcacttcataccaagttcaatgtattgatcccatttatgcacatatgtacatcattaacacgctaaccagacacatagcatggaattacatttggaaagacaataggcaagaaaattccatctactttgaaaaaaacagccacatataaggattttgttctgctttgtgaatagggagatgcctttgttgctgaagttgaaaggatgctataaaaacctcagtataattcattggagtagactaaattaaaaattagatgaaaatcctgattttttattgaaatgattcaattagattatggcccctgaatttgagtctcaaggcaacaggggaattttaacaagtcattaaaactatccttctgtacagagctggataaaggaccaacagtaagcctgttcatggacctgagatcaaatctataagggatgcaagaacatcatttcaatcaatggggcaggaaattcagacttccatatgcagcccatataggatgtaaactacaaattggccaactcccgctgaagtagagaacctccaggttacagttgtgagactgttccttaccagcactgttctttctgcagagcatgggtcccatcagcagcagtgaggcagacatagtcaactgtttgctgtttactcggaatcagtgaaataggatctgcttcccaacaacaaca

SEQ ID NO: 59417 - DNA, 761 bp, Bovine  19866881390031
agttttgaaactggggcattgttttcgttagtgggttatggccccatttccagaaaaatctatctgagtctaatgtaacctagcaaatctttcaaatgaaagagtcttgtgggaggcaagttgtcattttctgacatattatttagggctcagctcaggtttccttctttcttctttccccacttaaacccctgctcactctccacgagtgccattttctaattaaggcaaatgaaatttgtaatttgtagaagcgagacgtgaccttccttgtgagccagcctcgctcctccccacacaccattagaaaataggatccaggggtggttgtttttttaattggtatcgctttgtctttagtgcaaaacacacggcaataatttagtgaacttcagtgtttctcttgtggcaaattgatagcataattttattatgagtggaacaatgacttctgggagcaggagagattctcccagaactacacataactcggctgactaaatgtaatacttgaagaaggtaatgaaaacagagctgaggttcagagagaactaggagatttcagtctcttgctcccatcaaaaggctactcaataaatcatacctgaagcttatttaatgtcagaagccagtaaactgacaaagtacactggggtgcttaccttagaaaaggcacactgagtcatgtgatctctggtccctggacctgatggggtcatataatccatctatggattttaatatgtaacctattatgttcc

SEQ ID NO: 59418 - DNA, 1156 bp, Bovine  19866881398745
agaaggggaaatagaaaaaaaggattttccactgtttgccttaagtttctagtacatattgtccctttctgatatttggaattgagttatttaagcttttcagagtcccaggaagatgctggagctttctttcttatcaaatctgtataaaagaagagctgctttttgggctccagaaagagtgctggtcggtggcactctgagaaatagaacatgggtagagatgggtaagaaatggactaattcagtcattaaagggacaaacaaaaaatagtatgttattaagtctcacgaggcaaggtgaagttgaaaagatttaaagatactttaaagattctttgccagcagttatcaaaagtaaatatttgaactgagatcttgctgacactaaaaccaatccattcttagagtttatccatctctcctgttgttcacattaggagtgattcccaccccacaccacacaccccttttctggtcagactgaggtcatgtggcctcataaagtaggacaccactcactgtcaatttgaagaagtagctggcatcctcagaactgtgtcagtaacaagctcttggacttttaccattctgtcaaggtctcccagctgctctcctgcttcaggaaaacaccattggcaacaataaacaacaataaacgggcaagcttcgtaacatacatatctcattaattaccatgaaaaatccgacaaagattttgtaggatttctcctacaaaagcaggcattctatcactacaatgtacatgaataagacacaagaattaaataatgtgcccaaatccacacagtgaggaaatgatggaatctggttttaaacctggtctgtaaaaattccaaaacacatcttcttctccatgggatggggcctcttaattttgctacactgtgtggattcttctagcgaaaagttgaactaatgccccaggacttaaagtccatttcactatactcttcagaaaagtaggaatacatagtttagcaatttcatggactattgtttcccagtcataggccagaatcctccaaaactaaataaatctatatattcattatggtatttccaaatactgacttaggctcacagcacaggcagcaaactgatatttgcgaagacaatattagaaaatacatta

SEQ ID NO: 59419 - DNA, 1208 bp, Bovine  19866881401247
aaaagagaaaagaaatttagtgactcttggaaggagattctgttgcctgagggaatatgtacaattgagggacaatgaataatttgtataaagaaaaattgttttatccccagaaaagctagaccaagacctgtagccatactttatacagcatcatttagggaatgtgggggcatcattattatgtgatggatgacaacaggtgatcaatgatttctttatagctttataggtagtttagacattgaacatgatgcaaattaaggaaacaccagctactgcactgtcaatgttattaactatctttccattttagctactgatgtgaaaacatatttaaaaatatttttctttttttggcaaagtagagcaattagttgtttggatattcttagaaatcacaattgagaaatccattacaaagaaatgttctttactccactttttttggatatgacactttctatttgtccctgaacaggtttttcaagaagaaactctgcccattctgtaggcagctggctccctgctctgctgtttcagaccttcaatcactagtgacatgcctgcaatccacaaagtcctgggtgtctcttttagctatcatcatctaaaagacatctaaaagggttttttagtgcttgaaagcattaggtttcattttttgcattccacaaggtaagtggaaaagttgatccacaatgacatgaagggctcaattctgcatgaactttttgtttttctaccagaaataatcctttctttctttctttgtaaggctcaagttcatctaaaaactgttgactctttcctagagacacacagcccagcaaaactaagcccaactcactgaaattgacatctaccagcaaaagtatggctattttaatactagagacacattcacagaatgactcaacttgctaagtagcaaaatatagagatagtatactgagattaagaagagtcaatcatcaaccactccgactatttttaaatagacttactatacttttaaaggagtattattttaataaaacaatccacaaataaatacaaaacaaaagggcaaatgtagagacatattgcaagtaagcatgcataccaaaaaggtaagtgcaaattagatttgaatattcatgagtcacaaatcattgacagtttgaaataatgcaaaacagctttataaatgaggttaaggcaaggga

SEQ ID NO: 59420 - DNA, 734 bp, Bovine  19866881414192
cagcagagtgattttaggtaactggtaactgtaaaatactaaagggtctagcatactgcacccttagaaaggaaagataaaggctatgaagtcaaatagagttcaatataaaaacagtcaagttccaatctccccaaagaaaagaactaaaaataggaaaataatcttgcttggtttaatgcatgatgataatggcacctgaaaaatccttgtaaggaatttaacccttgcagctttatgtcagaacaaaatcactttatctatattgaggagatcatacgaagatgagcaccaggactaataggcagcattaaactctggggttggtggggggctatgcctcaaaaaattcaacaagagttaattgagagcactgaagaatgagtttgagtgttgcaaattcttgctgggaccctatcatcaccataagtctggcattttacttctaaacaagaaatacattttacctttctgagattattttctggttacaagccaaccattatgaacctttcagtgaatcactgaatagggcacttaaagggataaacaattataaaaataactctgtcacaagtgcatacattttattttatttagtgatgtaataagcttaggggcatatatcaggtccaaaatggtcttggtcattaatttaagcaataaatcataggtcttgccaacaatgacggcaaacagatgctaacaaggaaatgtattatttaatattgcca

SEQ ID NO: 59421 - DNA, 866 bp, Bovine  19866881414909
ttaaagctgtttcaacagaatattactacaagtttctgtagcagacaagttattaaaatcttgagaatactgtggattcaaacaactggttaggatgcaatctgaaacttgggcagtaggcagctttccttgtacatcagtgattggttccaccctgaagagggtagttacacaccgctctgcacttgacacatgcaaatgctaaatacagtagcagcgtgaggtctctgtcattaagagtaatttatgtaatgaaagccacctggctgttttttataattaattgcttgtaaataataaatttaaatataatttatagttttctaaatttgattactatatagacccaacagcaaacctaaaagaattggcaatttcatcatttagttcaatgacttttaaaagatatattaaaagtgatacacaccacacacacacacatatgtctcctttcaggaaatatttttactcggaaatgtatgtatttgttgtaaagtaaatatcaggtgaaaatatttttggaggtgaatagtaaaaatgtaatctagccctgctagctttatttgagttggaatgctaatttggaaatagcctgatttaacttttacattatttcagtcagcattttaaaattatttgtgcacagaatttaatacacatagaagaaagtgtaccttcttaacaagaatgaagtacaatgaaattctttggagaaatgcttaccccttattttgtaaaattccaattatgttttgaaaagcatttctatatgagggaaaagacaagtatatgtatatatgttatatacccatggtgataataagagactgcctaaatgatttactaagcacactatcattcattta

SEQ ID NO: 59422 - DNA, 1794 bp, Bovine  19866881595840
cccggtctcctgcctgcggtgattctagtaacaaaaacttctacaagaaacacagctcaactggttaactcttctgtttacggacacaggagcacttcttcccctagcaggggtgttgtgaagcacagttaattatttgcaaaatgatcccaagctcccagataaaagaaaacacacttcccatgcccagtgttactgttagtgtcctctgccgccaaggagaatctgatgcagaacttgcctcaagcatctaagaagactggcatgtgaccacagagggaagcctccgtgcttgttcatttgttggaaaactgttcagcttgcctgtgacataatgaagtcaaagtttaggggtgggtgcactggccaaagtcaggtcttttacaaaactgcgcccaatagtgtcaggagcatcaatcagagaaagaacccaggaacaaactagtattcatttccccaaattccttttgctttgctgttttcagtttttcaaagatcacattcaaaaagcattttatgctttcactgaattaacaatagcccggagaaggtatttcaatcccaaaagaaaccttttctattatgacaaaccttcgggggctcatctggagcactgctgataggggccttcaatcagacctggaagcctgagctagttcctgtgctgtgttgtctccaaagttgtatttatggccaaggctatggtcactatcaaaagaaacatgggctcagagttcctctagagaagaggaatgttaagtgagacatgtgtctgcgaaaacaatcaactaaacatatccccactgcctctcctttaactttaggaaaaatggcttttttaaaatgagttttagaaaagcaataataaaccaagctatttaccttatactgatgttgatgttaacagaaaatgcacagttttttaatggtgcatttcgtttattagatggatccttctatggtagtgatattattaataactatataatgtacaataaaactatgagatatgatactagttttgttagagcactgatgtatgatgtattacataataatcttatttaatccttacaatagtcttatgtgataggtattatgtcaattttacaacagaagaaattgaagcctttaggctcattatttaagtgggggagcagggattccagcctgtcaccaaattgagtgtgagccaccaggttctactgggtacagttatagaatatgatatactaatcattactggtgaggatcagaaaaattcatgaattactattggtttaaacattatccttacagaaacagaagataataaacataacatctgtggatttttttaatggaaggagaaatcaaatgaatatgtaaatcagccaggggggaaaataacctacaactgtttccaaaatcatttttagtagcaaatccttaagctacatggcaatgtatagaaactgaatgctgcgctttcactgccgggaccagcatctcaccactggttggggaactaagatcccccaggctacacagccaaaaaaaaaaccaagaaactgccaccgaatgataaggattttaggttacttaagtgcaaataaaatgagaggtatttctgtcaaagcaacagctgattcctactatagagatcaaacaatcagtaacagagcaaaaacagtaaggttcagaatgttcattcaaaaatatacaatgatcttgtactttgtaaacagtaaatgtaacttaggtattggaagctctttctggaataaatgattaacatcatggggacaatgatgg

SEQ ID NO: 59423 - DNA, 882 bp, Bovine  19866881599084
ggtgacggtgcaaggggggagcacacagagagtaagtgcattgctctaaaagcattcccagtagccatgatctttgtaggaacaaaaatccattgtgcaggactgtaatctgagaaactttctgttaccgtgcttgttcgactcaccagcattgatccctggtacatgtgaccctttgaaaaggagcaccacgttggtgattcctcttattactaaataccattgtgttcataatggccatttatatatggttacactccacgcccgtttggttaatcagcgttcccaaactctctgatgccacctgaccagcataggatgcagacctcggcctcctgatcactctctttaccctgtcctctgttgttcctagatgtcctctatgagaatgaaatagggagcttagcatggctggaaatagggtagcacaaattctggggggagagggtggcgggtgtggtggagggtgtcaggacgaaaaagcctggcaaagtcttgaggaaaataggttatttaatttaatttaatttttttcagttccacaaaatgtctgcatgctttagcactgaattctcagctagttgggtcccaggaggccccgcagagccctgtactactcagggagttgcagctgtataacatggggggaaaaatgtagtttgcacgaattgttctttaccttggtctgggttcagaatggcagctgcactccgactttgtgtgtgacagcacaaaggccagcaaaactgaaaagcaagtcagcaagtagagagacaaaagcaacgatcagctaatacagctccacatggcctggactaatttatgagaaaaaaactgttctggttcattggatcagcactctgaggaggcaggtggaattgt

SEQ ID NO: 59424 - DNA, 748 bp, Bovine  19866881769378
atctgctttagtccttaaatattttagctttagagggttagttggtggatttctttccctcgaattgcagagaaataaagacatcaacctttgattcccgtattccacacacagctacagtcaccaatagacaaagaagcaaatactgtgtactgcaatttgaaaggaattttttgcatattcacatctcacattttcagaattccctaacgtggcttaactattagaaatagaaatgatagcatttgaattttctccattttcacagtaaagataaagtaacaaaaataatttaatttagaaattggtttaactgctatacagttatgtacatataaacaaaaagacaattaataagtataaagttaatatgccaactgcctaggaacacactatttcttctgcccttggggcctttctctcatggctgtctggtaaacacacccttcaaaattcttatcagagaatatctttttgaggtaacttcccagattccatggtttgagtaagaagcacttcttcagtcagtagtacctagttcacagatccatcacaacatctatccaatactataatcataatgtatatatctagcttctcaccaggtagtcccagaggccagggccacatcttaattgtacattattgaaagcatgtcaagcatacagtacatcttcagtaaaatgtatggggggaagtgctaaccaaatgacaaagaaaagttcctctgtcttggaaataatgtcaa

SEQ ID NO: 59425 - DNA, 736 bp, Bovine  19866881770520
aacttttcccttctctctctctctctttttgtctcaacatggaatgatattataggtaacattcaagctgttaaaggaataattgaattgctctaaagttacttaatttaaagggcattggctttatggagagtaatttgaaatgagcatctatgaacctagagtctgttttgggtgaatttgctcaccttcctgtaggaacttatgtgtcttttcctccttttttcacctaaaaagttatagatcctcagcacagaaaactccaaattcctcagaactgtaaagtctgaagtgttaatctgtgtattaaaatcactaggcttaaaacctttttgtcttcttacaacagttagaacaattggcaccttgctagagaaacaaatagatccacccttaatcttatttgtaactttaatgttttgaattggagtattttggattaagcagagtttgggtttgttttttttttttttttcttctttctttcttttttcctctttaaggttaatttttatttgtggaggctctcttgactggtttggaagaaagatactaattattactttaattcaaaaaattccttcaggtaaaaggaaagtgccgttttaaaatgagaaggtagatgtgagatgcttgggcttttagaataaaactaaatcaatattttagagtaaattatggttttaaagaagttttcttgcattactgacctgagcaagtaaataggatccaaata

SEQ ID NO: 59426 - DNA, 1233 bp, Bovine  19866881916382
ctttttatttttagtgggaagataaatttaagaggagtaaattggaaaatcaaatgagggctttagcagccggggagatttgcagagctgtctccgggtgtttgaaaggcccattcatcatgtcctacaagtagtcaattcctctagtatctgtaaatgttttcagatattagccaatttatatgctctgagattcatcatggaaaatcagctttaccatcgtgcattatctccatctgagatgaagtttgatatatgagcatctttgcagttcaatgagttgtgtgcaaaaaagtacgtttttaattaataaacaaatttgctcaggagctcatcagtgtcaagagtaataacgattgtcattcattattgtttattacattcctcccgcaacaaatgttgccttctaatgagatttctttcctattttttaatttagttaatggcattttcatcccagagaaaaatgcaaattccttgtacaaaatgtacgaaacccagtcagtgtgcttctctggagctgaattgtataaattctcaaaactacctttctttgaatggcccctctttgtgttgtcagtacatcccttttcagggagataaagatgagggaaaaaagcttggcagggtaggtgatgatgataactgtgctataccaaataaaaggcatccacatttaaacaaaattctggtgtgcactgagctggcaaggacgtttctcagtgtgatgctcttgccttttgtatatagcaaggaattcaaaaacatacatacccacgtcctgtaaaaagggaacagggggttaagaaattaaaagaagggagaatgagatttttttccctgaataaaatggaattttttctagtaaacacacacacacacacgatatggaggattggggtagggaggttaagaaattagaccatgagaatgagattttttttccttgaatataatggaatttttatttagtacacacacatgccccacataaaagaatacttaattataaaaatgctgccttcccctcaccaaaaaaagccatatatatttctcttaaccttaccatgatctggcctgttgggcgagaaggcaccatctaataaaggctccttaataaacgtatgcttgtggtgttggaacctgcaacgatgcagagatgttcaagtgttattatttactgcagtgtttgcgcaggacggcgaatcctctgctgcaaaggcattacagctg

SEQ ID NO: 59427 - DNA, 785 bp, Bovine  19866882021273
atgaaataaagacttgactttttagactgtagataaaaatgttaaaaattaaaatacttgttgtttttccaagttatatgataaaatttagtgtataaatcatacagacttttaagtaaaattttactttggcaagtaaagatcctaggcaaaatttactatatggtttaaccactatgttaaatatctcttgacttgtgttgtggaatagtatttttatctacatacaatatattttaagttgtcctagtactaaggcataaagatgtctcttcctaaaccaggagagacattcctaagtttccagatatttccctcccatcaaagaagttgcaccgaaaatgtaaaccatttcttttcaaattttgatgtagaaaaacgcaaaaacagtcctcatctgagacttgtctaaattcccataatgtactggggttcagattcttgctgctgaggtcgttgttgggcagtatgcccagtgaatctcagcctaggatttaagattcttgagctacgttaacatatttgaaaatattattccaatcagtagtctctaagtgccttcatttttttcaagtacagaatggacataattgaatatttactacatcttagagaaatgtgcagctttcagaacactgaaacatttaagaggctcagatgaaagattaaagaattaagtgtacaaaccatctttcttagttttaatccaaatgggtaatattcattatgatgtaaaacagcaggatacatagcataattggcatattaacaaagatctcaaaaag

SEQ ID NO: 59428 - DNA, 863 bp, Bovine  19866880458815
acgactgagggacttcacttaacaagtatggggcttctcgggtagcatagtgataaagaatctacctgccaatgcaggagacacaagtttgattcctgggtcaggaagatcccctggaggagggcatggcaacccactccagtattcttgcctggaaaattccatggacagaggatcctggcgggctatagtccatgggtttgcaaacagtcagacacgactgagcacacacacaacacacacacacaccaaatacattttcccttaaagtcattccacatctaccttttggcatgaagcatctaaaaccatccaaaaactgtaagtgcctgctttgccaataagctgttagcaagtcttaactcaggagatctgtctctcctggcattctgagaagcagaagtctcagattacttccagctgaagtggaaaataaaccaaacaaaatagaaactcataggccaaatgatgaccctaccacccccaaagttgtacacgtcttaatctccaggacctgggaatgtgttaccttatatggcagaagagactcttcagatgtgattaagggtactgattttgagatgaagggattaccctggattatctagatggatccattctaatcacatgaagaaaaggaaggcagaagagtgggtcagagagatgtgacatgaggatttggcccactttgaagatgaggggaaggggccatgagccaaagatttcaggatgtctttagaagctggagaaggcaaggaagcagaatccttcatagtgcttccaaaaaggaacacagccttgctgatgccttgattttagctgggtgagatccacatcagacttctgccctacatagctgtaag

SEQ ID NO: 59429 - DNA, 777 bp, Bovine  19866880533851
ctggaagattttgagtagatgcattaaagcatcaggtgatcacagaggtctttaacattgaaaaaaaaatatttgggactcttgagaacattgtgattgaattcctgtatactatggattctctgtatatacccatgtgttaaaaaccgatctttttctgaagcagaaccatgttaaatgggaaagataagtcttttgtcccctgctaacaggttcctgtttgcctgaacatgtcagacatactgccttaatcctttgaagtagtaaaattgaaatacattgacttcccccatcaactgagttttttgcgttagagaagaccattgagcaggttttcatacagaaggtgcaagaaacttagtatcatgtggtttgacatttaggcaaacttgctttcattatttagtttaggttgaacacatcccttttcttttgaatttaacatgtaagtaatgactccccacagagaaggcaacggcaccccactccagtactcttgcctgggaaatcccatggacagaggagcctggtaggcctgcagttcatgaggtcgctaggagttggacacgactgagcgacttcactttcacttttcactttcctgcattggagaaggaaatgggcaacccactccagtgttcttgcctggagaatcccagggacgggggagcctggtgggcttctgtttgtgaggttgcacagagtcaactgaagcgacttagcagcagcagcaacgactctccacactgggagacatgggagccactactgttctga

SEQ ID NO: 59430 - DNA, 1368 bp, Bovine  19866880543272
gaggcagagctttgcttttctgccatctttggagctttgtttcttcccaacattaaaggaaatactacccgatagcaatgaacacctaaaacgaagatccagctcagcagaaagtaaaagcccagtaagttgaaaataaatttgaaaaggttaatgacttgaaacccttttttaagctcaagaaaggactcattgtctttaaagtgatagtctacttcttctgggtttcatcatatgttctgaataaagaacatgtgatagagagtagcaatagctactcatgagttatgtcaggcagtggtgttaattgccaccattcctgggatgaggctgagagcagtaaggaatcacgaggcttgttccttccctttaaggatttgcagtgtattggagaaatacgcctggctttcttgaaccagctcataaatgcaaaggaagtgattgggagctaaattatggagaggacagcagtggacattcagagcaaggggaggtcagtcaggaagagccatgaggtcagtgaagtcctatgggccataggacttggctcttaagtgtttggttgagtcaaggtgaaagttgagctgaaccctaaatgatatacctttatttataatataaatgatatacctaaataatagacctttatttaatgctctgtcttaagatcaaacattttacttactttgaactgctgacttgcacaagttccaaatggtgaagatctcctttctactcctatccccagtccctcagtctccctaacccagagtgcctgccatgactcatttcttacagtcccttccggatggaatgtaatatttttgcacatatgtagcgtttcttatttgaattggtgaaatgttttcatttttaaaatgtatccctttgtaagtgctaaaatgtagaaaagaacatgaaaggtaaaacacacccaaaccaaacaaacagaaacccaacaaactgctctgctgttgggagaccacagctgtgctggtctcctttaatggtggtgggcaacacctgagtgagaagtgcttccctgggatgtttgcatccacgtcaatgggaatagccctggcgggaaggtagagcaaccacgagccctccatggcttggagaacaataatactgttgtcctgaatgtgatgctctgcgagaacctcacaactttttcgcttgatctccataacaactccacaaggtaggccttttccttccgttcagatgagaaagttcagactcgggccacagggcaaataggaggtgctgtcaagctgtggtgctgacttctaaacctggcctttctctgcatttatcaggctgcccttctagatgggagggtctgtatttcggaatcactgctgc

SEQ ID NO: 59431 - DNA, 773 bp, Bovine  19866880570130
tatgttttgagataaaatttcccatacaataaatgccaagttttacttaacaagccagccagtcagcatctggaagcaagtctgcaggcagatttttaacttccaggaattctgttgaggatttaatgtttctatagcaacattttgttgtggcataaaccaagtttgaagaatgctgcagggtttgcttgtaatgtgtttcttttatctctgtaccatctattagagtctcaagattttatatatgatatatatgcctgctttaatagtattttctaacattattcccacgtgaaaactcacataatagaaactcaaatctgtcaaaaggttttgcgagaaagaactgtgtgaagaaatgactattcctcattcaaagctttaaatttctctgcaaggtattttatttctccaatagtaatatgctttcattataggaaagtcgactgtctaaatgtgaaagaaaaaatgaagacattattaaaaccattaggctggcaacaatgcagtagtttttaacccagtggtgctcagagagtggcatgaaggttcttgattatccaggatttgatgatggatgcaggactctttagttcaatttaatggctgagattggtgtgcttcagaagaaaaagatttgagatattaaaaaaaaaataataattcccatctacatgttcctgagaactttttttgtaaccctaaaggttaaggttgtagtttcatttttatagaaaatcggttttcagcagatagaacgtgaaaattactgt

SEQ ID NO: 59432 - DNA, 1065 bp, Bovine  19866880615661
tgggatggagggctggggggaaaagtcatttgctgccacttgtaagttttttttttttccagaaacaatttaagatgactaccatagactcatgttgttcttgttcagtcgctcagtcgtatctgactgtgcagcctcaaggactgcagcacaccagggctcccccatccttcactatctcccagagtttgttcaaaatcatgtccatcgagttggtgatgctatctaaccacctcatcctctgcctcctccttctccttttgccttcaatctttcccagcatcagggtctttccccgcatcagggtcttttctaatgagtcggcccttcacatcaggtggccaaagtattggagcttcagcatctgtccttccaatatacctgtaagttaactaagggatttagtgactttaaaatgttttaacattttcagctcaagacaagggagttttgcattgcactcctgaggtattcctaatttttaagcagggaagaaatccagatacaccagcacctcaggtaactgatcatcacaacgtacagtgtaggtgttggggaggagtgataggcagggatggctggggaaagcagggaccatggtcagcctatcttcactattaggtttacttacatagcctgaccttgaagtatgatatggagaccattccaccatctagaaggtggaggataatattttttacacaataacacacgtatgaaccatactgacacgtgcaaagagcctagtgaaattccctaaagagtatcaattctttctcttcccctctcctcctttcagcaattccaactacatcagtcacaccagccttcaaacagggcacagaatgtcgtacttctagaggtagcacaatttggtacagtttggcgaaatagcttaagaagcagagtgatgcttgccctcatggataatattaatgcaatctggttaatttagggagtgtgctttacagagtaatttggatgagcctagaagcaccaccctctgctaatggtcatctctttaaaattgtattaaggaaatgccgcagacccgggacccagagc

SEQ ID NO: 59433 - DNA, 2876 bp, Bovine  19866880676876
atttctagacctgggaatgaacacttttagggctggcactgaggacgacaattattataacccaacaatagccagggctgtaaactcctgaggaagtaggctcattttcacatggacaaacagctccactaacagagaacacaggaagatagaaggctgtccgggaagctgacatttcctgagtgcccacttatggcctggagtcccacatgcttcacttcattcagggaacagcttacccaacaaacacagtgataaggatgtggagagaaagaaaggagtgttttcagtactggcctggttgttagtgggccacagatatatttgtagatatgcatgcatgtacttctaacttaaaaattaaatatttaccaagcccttttccaggtgcttggtgcctaaagaggtataagccatagtctgtgccctgcatgaggcaagtgttataaagaaacacaaagccaaatagccacatggaaattatatagcatttctcaagagggttttagactggatccacagtgaacatttaacctagagtttgctaaaatggagtatgcacctcattggtggcatgcatgaagatgttataaaaaatattttaaaatttcattaaaaatttattttaacgtgcattagaaaaacctataattatgatatccaacccttgagtatatggatattccctctgtcaggctacatatgaaagtgaattgatttgaagattatctgaaggaaaatatcaagtaaataaataaccaggatgggatttagtgcatgctgtgtgtgctaagttgcttcagtcgtgtctgactctgtgtgactctatggccggtagcctgcctggctcctgtgtccatgggattcttcagacaagaacactagagtgggttgccattcccttctccaggggatcttcctgagccagggatcaaacccgtgtctcttatgtctcctgcattggcaggcaggttctttactactagcgccacctgagaagctgtgattcagggatatggtaatgattctacaagtgttgcttgaataacctgagtttagaaaacgcagatcaagtccaatttctggactgcagggaggttacatgagttctccaggtcagaaagccagcgaagaacacagaccagaatctggtcacctgaccggtcctctcaccccacatcctcattcaatcactacttcctattttgcatatgaggaaactacaaccctgaatcacatatccactcttggtacaacttacttgagaatctgtaatgcagaaagaatagaactggcttcatgaagaatcagttaacataattatagtgtacttacctaagcatggcagtattataaaaatatcatacttattaatttttggtcatccccaaaccagcctgtgagatatccttagctatttctaccatccctcttttccataggaggaaattaaggagcaaagatccaagatcttccctaagattgtaagttaacaaagctgggatttgaacccagatggttcagctctggaatttattctcttaaccaccccacacagagttcactgtacacaggggaaggaagcaaactctccctgctgaaaccagacagagtctgctcagacaatatatggatattacgccctgtttcaaactcccattagacccgcgttcatctcataaaaggctttgtttcttcaaaccatcattttttcatatgtggaaactcctgggaggaaccagtgattaccaaaagcaacctttgtacaagaataatttgttagatcgctatgataagtactataaagaaatgaagggagagatggagagagtcgggaaggtgaatggagagagggacagtctggggacactgctggtggggctgagagtgacccgggaaatggggatcctgcagggctcctccctgcgccacagggggccaccaggtgctgtgaaagccctgcaccagccctgcctggtgcccagtgcttggcacagagcaaatgcccagaagctctgtggggtgagtggaagcctggatggaaatcaaaggcaaaccaggaggcaggcatgggaacggtgattggaggtgagagggcataaaacccacacttgacctactttatcactgctccaggtgggcccgaggacgagagcactgggtgaatctgagtcagataaagtgtgctaaccacttaacagtgtcccgatgcgtccaggacgctttgctttggggaaatccatttgtcagagcagccccagttcaaccttcaggcctaggcttcctaagatgaaaagtcctcattccccctcaggacagggtgcttcagggtgaggccaaggccacctggggaccagagccagcctgctctatgaggctgccagagagggatcagcctccagcagcctcctgcacaccagtaggtgccgacagctaagctatttgacgcacctttggggcacagaactgctgaaaccaaggccaacctcagagtctgaaaattcctcagcagtctgcaaggagaagcccaagggtgcgctcacacattacataagctgggggttcgcggcggcccgctggtgtgcggagccctgggcctctcagaattgcgcaactgttacgcaggagcacttgttaagtgttgcagcatgactccacatctttatcaaaaatgtgaaacatccacccggcacacacttggaaaacaccaaagcttttctccaccaggtggttgaggctcttgatccggctgacaggagaagcagcagtccaggggggacatgacttactgtagctctcggcccaggaagctgaacacgcagtaccttgtaccccgctagccttggacagcgcaggcttctgataaatgtactttt

SEQ ID NO: 59434 - DNA, 1471 bp, Bovine  19866880696116
ggttttaaaaggaaatatagtcgtatttggttttttttatccagtctcacttctgactttagtatcaagccatcttacgtgcttttgcttttgattttcagtacttgcactcttcttctgccatttgcccttagcctacttttttcatgaaatttgattatagtcactttgaatagctaccacctctaaattattttaactataacttattagatacccattaacgttatatttgtgggtaattttttggtttcatcttttgctgtcattctgtcttcatcaggaatgtaacttctgttttgtaatttcctggaagacctctaatacagtatctttactatgatgtctatgtattaagtcactgtctgatgggatattatcttacctaattatccttccagtttcttgaaggtgttgtttttctttgaagctgtactttatggtcgtctttgggttggtgcattggtaaatttccctgtgattcttggaagttttattttcagagttgagctgttaagtcatgaggatttgtttaatttccattttatctaggtaggtcacctgtgcattaagatgttctttattatcagattctgaataaaggtcagcaaaggctttatgatcccagggtgttggctccctcattcaatcctgaacctgctgctgctgctaagtcgcttcagtcgtgtccgactctgtgcgaccccatagacggcagcccaccaggctcccccgtccctgggattctccaggcaagaacactggagtgggttaccatttccttctccaatgcatgaaagtgaaaagtgaaagtgaagtcgctcagtcgtgtccgactctttgcgaccccatggactgtagcccaccaggctcctccatccatggaattttccaggcaagagtactggagtggggtgccattgccttctccgaatcctgaacctacctgcatttaattattgacctcacccacagtggggtggactggaagcataggtagtatgactgtacagaattgatgctgaaatagtccagtagattataaacactgggcgttaggttatctcatatatggagatccactgttagaattgttaccactaaatttatgaactggatattactgtttcctaatcccaatgatcttatttactttaggatggcaattcaaagagtcctcttagatttgggctttatactgagactgggtatagagctgtttgaattttcagggtgagaatgagcaatgaggaaattcgggctgagggtttgggattaaattgaagttttggttccctcccctctgccttttgcctatttttatatgcagttgtgcaaagattgatttttaaaaaatatagcgtatgtaaccatgaggctcccgctacttcctattttatgatattataggtgatgaaaacaaattaattaccctagctaaatcactacattataatttacctgatgtaat

SEQ ID NO: 59435 - DNA, 1795 bp, Bovine  19866880749874
ccagacttttatcagaaggttgtgttaacacacctggaatcagaactaggagagctatgaggttattattggaaaagtaagtatttgtagctgaagagaacatggtacaaaaggatgcttagtgataaagctcacctaggcctcccctgacccttgctgcttagccccttccccagaggcaacccttattaataatgaacttcttccacatgttggattgtctgaggcctccatttcctgagcagggaagttcctgctgtaccggccaggtgccttatatcttctagttaggctaccttcctggatcagcttttacttagtagtggatggcagacgggaggtacatgagcagtgggagtgacagaggcagttgggaggagaggtgcgcaggaagctgctgagttaaaaggatctgcattctctagaggggaggatccggaggaggggtgtggagtgacccaggagcttcccagtgacactagaaaggagtgctcccaggcccctggcagggagcagatgccaggtccctggtagagtattccctgacccttcctgggccctggggaacagaatggggggaactctgccccaactgtcttgaaggcacagcacccgccccagaacaatagccccaaagagacagagcaagatgaaaagcactgtgagaggtgccccatccccactgccccctcccagccccagagcagccacgccattcaaggtcagtcatatcttatggtgcaaaaaggcgccttccagcttccacactgtgacctggagacaatgcgggagaacgtctgtagcaagaaggcacaattagccgattcattacgctgacatttctagccacaaaataaggcctttccccttaattagggttgtgacagataaaagcgtattcccagccgacttctgttattcacgcgggcaggcctattatccctgcttggtctggccttgtctgtatatgagggcttgctctgtgtgtgcgctcttggcagctttgtaaaggattcagagggaataaacacagggcctgcttcctgccctgcatccagaagagaagacacattcatacatatggtctgagccagcaaaccgtggtgcttcaaaagcaggaaaagagctaatcagggggtggggagtgtctaacaccagttcatgtgaggaaaataaagctaatgggggatctagaagccagttcaagtgaggaaccaagggtggttagagtggaagaggggaactaaaaggtgccatgaacatcatctccgatcttcgaaaaggtggtggaatatagtgatggtgactaaaagccagattattgttgttgtttagttggtaagtcatgtccgactcttttgcgaccctgtggactgtagccccccaggctcctctgtccattgggatttcccagacaagaatactgaggtgggttgccattcccttctccaggggatcttccccaccaaggaatcaaaccagtatctcctgcttggcaggtggagtctttaccgctgagccaccagggaagccaaaacccagattgcccaagtttaaattctggttaaggcactttaagacctgtgtaaccatgggcaagtgacttcacctctctgtgcctcagtctcctcatttaagaaagtgaagatgatgtgatgcctatcacgtagggctcttgtgcggcctgagcaggtcacagcatggtgagctcttgtaacagtgcctgacaaggtaagcactgcaagtatttgctactatacataagacagggagcagaaagttatgcaccagaaaa

SEQ ID NO: 59436 - DNA, 1221 bp, Bovine  19866880786393
cgagtggacagcataagtattcagggttgggttttcatttttttggcttttttatttttggcatattatattgcattataagttgttacaagatattgactgtaattccctattctattcagtaaatccttgttgtctgtttattgtatgtatagtagtttgtacctagctttaatatgcataatttcacttcagttatatggatttaagacctgtccttttggtccaccaatggctcacacaagggaaagagaaaacttatttttgcagcacttgtttggaagacaaagaggaaggaggactggagttaaggaggttctgtgtgtcctataaagtttaccggaggtcaaattagtcaagccagggagaagaaaaaagaagcaaggtatacacagcatgaaacaggtggtggttattactgctgctcaccaaattggtctgttttcctccttgtaccacagaggaggactggatcgcctggcccccttgtggctgggtagctccattctgcagagttctggccaatgatctgagagtagaagtggcagcatttaaatgcaaacaagccattctcagatttctcctttcccactggcctccgccacgtttgaggaggtggcagctttgccagccttggttccagaatgactaggagaaaagttgctctggtgacacatgtatgagcagagaaatctgtgttaaaaagcaaatctttgttgttttaagcctaggaaaatttggggttgtttgttttgcagcataacctagtttattacgactgacacattatttctataatctacctctagagaaaggaaaagggtaatagggaagagatggtgtgttatggttgccctggaaagagccctaaaggagattagaggaagagagcaaaggtataaattcagatgtaaaagatccttctaatatggatgcccagggcctggaagatcttgtgttacttctaaaatcaaagtcctgaaagtgaaagtgaaagttgatcagtcctgtccaactctttgcaaccccatggactatacagtctatggaattctccaggccagaatactggagtgggtagcctttcccttctccagaggatcttcccaacccaggtctcccacattgcgggcagattctttaccagctgagccaccaggaaagcccaaggatactggagtgggtagcctatcccttgtgccaggggatcttcccaaccca

SEQ ID NO: 59437 - DNA, 1076 bp, Bovine  19866880883110
tgtgaattcatttgagtggcagctgacggctctaatttctcagaactggaccccaaagctatctttctgcataggcagacttgggcagttttcctccttttccttgtatttagctgttccatgaaatatccttaaaagggctcagaggtagccattccacaattagagctatgcctttaaatcctcattcctgtgagagttgactcactgactttaattcacactaaagtgtgaatgactaatgtaagtttctttcctttcttggaaacaagtgtattaaataagaaatatgagagagtatgggagagaaagaggaggaggagggaaagagagagactgaagtctgagagggaactgagtggaaggacgaaggaatggaattctagagactttatagctttataacaatggtcagctgtgctgtgctgcgctgtgctaagttggtcccagttaattttctggaggcaattccttagtttaattctagatttctccccataagtttctagcactcagtttcaactagactttctattggttggtttccttagcctctcatatgagaagctcttctgtgggtaagatgggaaagtggcaagagagagggggaagtgctaaaatggatcaaacattgttcagaggatgatgttttgtcaccttccatgtaatttcatcagatggcatctcaaaccagagctaacatgctcttttctacctcgcagcaaacaaatcttgggagaaattcttctggctaagcgcttctccaaggcatccttctttaaggggagaatgtgtaaacaatttgatgttgattttcagtctggctgccatttggtaactgcctgggtcaccaagcgaagaaacataatgtgtcacctgttccgaatataaatatcacctgattgtaactgctcagtgagctccgaggtcaaaggagaggttagcaccagtggaaaagtatcactttcaacacaggatgtgctgtgcatattagcaacatgtaccgcattaagcaatttgtgcaggtttccatgaacttgccagcctggtctatgtaaacttcacaatgatatcca

SEQ ID NO: 59438 - DNA, 930 bp, Bovine  19866880957605
aaaaatgacagaccctaagtaagtaaaagtccctttaattttcacaaagcatttgacccctttaagcatgtgtataaacttggtaggactcacgtcttcctaagtaatgaagaatcagaattccaaggtgaaaagaatcctgaaatctctgaggaaaaatgaatataatcatgtaatattaattatatatttcaggggaaaggaatttcttttcaagaatggctatattaaggacagatgggtcctgggtcattctccttgaagcctaattacctttctctgaagtagtttgagatcttaatgacttgactccttcatatccactggtgtcaaatttaaaaccgaccacacaaaatgttgggggcaaaaagtagttcagtaaacaaacttattaatagaaatgaaatcccacagggaacacagacacactcaagtcggtgagatattaaattcctgtgataagttaacatggattaagcaaaactttttatagtgcaagttcttagtatcaaattttgaagcacagcaacatctaataatataattatttatattaaccatttcttagtagtttgcaaataatgataaaggaatatgttgaaggaaaatattgatttattcaataaatagttattggacacccattctgttcctaatttgggaataaaaccagggacatctcttcctggaattcactctgtatggatgaggtagacttaaattattacaagctgaattacaataggaggaaacactatttaagagtagtttgtaggtgtgacaactgtagtagcttagatcttgtgatcattaaattaactggaagctcagctaggtgtcctgtgatgaccttgatgggtgagatgtgggtggagtggaagggaaggtccaaaagggaggaatatatgtgcacatatagctgattcgctt

SEQ ID NO: 59439 - DNA, 1166 bp, Bovine  19866880972937
ccctgtaaactctagtaggaaggactaataaaggtattggaataaagttgaagccatttatctaaaccctaatcttcatacagctgaccacagatctgcccaatgggagggcaggctggtggacctcttgtatccttaccttggaaaggtaagagcatgcagacatgaaaggtatgactgtctctagtttctaggagcatcctgccaccatctcatttctttagaaccagggatcctagacagggaaagactgagaattttgtgcccagcagagaggagatagttaatttcaggaagaaattacatagagccacatctacgttatatactaggaaattatttccaacagtatctttttgtccagccatctgcttgaaacaagtttctgtcagcctctggaagtagtaattattccctcctctgaaactgagccccatgctggctttctgctaagggagtagaccatttggtcgtctgtggtctattgtcaagaattattttgacacttattattgttagctgctgattttccaacagataccatctttgaggctaaaaataaatcctcccaccccaagccccctctttatgaagtgtgaaagacaatatgcaccaatcaatcatggatataattttgcaatagggagaacacttattaatgaggaatgtctcagagaaaaggggcatgagtttttatagaggccaagaggccttgccttggacttgtgggactcctgagaaagggtggaggtgggtcttgtatcagaatatgggaaggctgggttgtcctttgtggtggttgactgtttcttggaacacaaagaggggtatttcttaaccatccctactttcagagagcacaggggataaactccatcattgtcaaaagtcatatcttcttcgacttttaggaaccgaaagcaaatttgaaagaaacaaaaatgtctttgtaaggtttaggtaggagataaaatcagaattctggcatctcaattgcctgttctagaaaagacacttaagctactcctcctttaactggagtaaagaataccaaataccaacctacatgaccaaagcttaacataagaaaaggaattgaagctaccatggctttcttagggaccttgaagaacccatggaataattttcaacttgggccaatgatg

SEQ ID NO: 59440 - DNA, 903 bp, Bovine  19866881047898
tggctgaacctgtgtttattcatgctcagtggcctaatgagaggggatgggacaagaagcagctccgctaataactgtcataaaaataataatatcacttggctccatatggcatctttcattggaaaatcttgaatcatttttttttttttctcttaggtaacaattatttccattctacttccactaaaggaaaaaccaaagcatagagagaggttgtgacttgcccaaggtcactgagctaagcagaaaggcagtttttaaaggctgagaaggatttggggatatatgaaatccaatttcctttccagcccagaatggttctggttcatgactcaggaaggaaaacagcatgatccatgctcagcatctctttaaaaaagtcatgttacagggactcaggcataaggatctatgtcaagtgaatgttttaaggttacatattgtccctgcccatcacatttcaacaccaaccactgaactgtgtcacagacaaagaaggttggaaggtccagcctacagaagtgggatatggcttgggggtgtctatcctttctgacaattcccctagctgtttccccctctcaagtccaggcctctccattactttattcatcagaagtctattcttagggtacccacaagtctgtgatgatccttgtatatgccttttgtcccagggtagtagtagcaggagtgttggtggctcagtcctgtctgactctttgcaaccctatgcactgtagccctccaggctcctcggtccatggaattctccaggcaagaatactggagtgggtagcgattcccttctccaggggatcgtcccgatccagggatcaaacccaggtctccttcattgtagacagattctttaccatctagccacaagagaagtcccag

SEQ ID NO: 59441 - DNA, 1861 bp, Bovine  19866881072942
agttctgctatctaagcctcccagtctgtgatcctttttttttaccgtagccaatagcagactaatccaatgggaaggagctctaagatgggaaagaagggagtgagtcacggaacagaaaagtgtcagttcaggggtgtccaccgagtgagcgagagagacaagccctggctgaaggtgatgtgtgtacactattaactccttatgaacttgaggctttgctttcttcctcgagttcagaaccaagcctgggaatgttgtatgggataagctactataagaaagagaccgaaacatacggtggcttaagcagggcagaagcttgcttttctcccatctaggggagcggaggagggtgagaggtctggagctgggaaggtcggatgatggtaagacagagcagccatttttgacggcgacctcctctggacccgcagccgtagctcaggtgacagcaggtgaccttccccagcaggtgacaggagggggaagaaagagtggaggcctggagcttctgtattaaaacatcgcagtttgcaaggctcatgcatggcttctgtcctcaacccactggctggaagtcagtcaggtgaccacacctattgccatagcacctaggacaagctatcactcgaagaatccaacttccaaagagttccctgctaactaatgcagagagctgtgtttcttaaaggaagaaagagtctagactccgggagcagtttgtaggctctatcccagccgaacgtcagatagcaagagagctggactcatctcacgtgttttcctcaaggctccaagtcggtcgaggtgacatctgaagtggactgtcacttgtctgctatcatctctcccatgatttcccaaaagggctcttctgatccggtggctggccagcttgcgggtgccaagtcctgtctctctcattcccagctctgaaaaaaatctccacacctcatccgcaggaacccctgcccggtcattgtgttttctgccattagggcctcatcttgtatccttcatgcttacgagctgcctggggcaggcagtttatgtgtctggcacgctctgtgactctccagcggcctgaacctttactgcctgtcagaagcatttattaatattgctgctaataatagtaccgagcaggggcagactggcttcaacacgtcagaaggcagtgtttcccgttactgtgctttcattgttcactgggacatgaccggcagggtagattcagacttgccttttctcctactcaggttacggatcccattactagaagtcttgctctgctggcatccgtagaaaacacgtagcacatacaggccgtagggtattctcatgctccgtttatgcaggctgaaacggaaaatttggtgtctgtgaaagataaaagttccagctccgtagcctgaggttgtcttgaagtgaggtgggcatgaaagctgagtacgggctgaatcttgcctgtcttcttggttgcaaaatggaaaaggacaggcaaggaaagccaagttacctgactttagatctgcacgcctattgctcattctttaaaacgtttctctgtccaggactgtataaattgatataaattgataaactcattgaatccaggtttatgtcaaaaactatgcagggagctttctatgaatttccctttttgaatctcccagcagctcactgctgtagacactgtcagttgctagctcacccttcaggccaacagaatccattgcatatcacagaggtagaaaaggtgggttctcgggactttcttggcagtccagtggctacgtatctgctttgcaatgcaggggacgtgggttcgataccaggtcggggaactaagatccta

SEQ ID NO: 59442 - DNA, 1039 bp, Bovine  19866881097971
ccagtgtgaataagagaaatattagcctttaaagattttctttacagttcccttgaaagctggctggatgaagtcagccagagaattatataacagcaagcctcatttaaagcaacagtgcctttctataggactctggggtttcattgacgggtttttgctataaattataaagaaaaagatacaaattttatgaaaaacagatagagggaccctcccattcttactttctgttctttcaccgaagggataccatttctagggtgttcatttaaaaagaaagatacaaaacctctttcaaggaagataagaaaaaaatcacgttcattaacctcacgcagtcatagcatgcttaatcttgtttgaattaagaagaaaaaaaagaatgaagagaaaatcttcctaaagcattcgttttaatttaagagattttgtgaaattttacaaatatccagctatttttttcctctttcaaatggaaccagaccctttgaggtagggaaggatacaagcatcaaatagtctactgctgcagtgttttctgtggtgcttgaatacctctcaaagtacccaccatgcattaattcaactgttatttccacatacccttggtttgcccttctctatctttccattttagagataagaaaactgaggctcaagtttctgtgacatgcctggcagcacacagctcaagtggagaccacattccgcgagtctggcatcaccctcagaaggcccccatctcctttcctctgtaccagtagtactcaaccaagagcagctttgcctttcaggggacatgtgacaacttctggaggtatgttttgtcacaactggtggagggcgggcatggtgtaggtgctactggccctcagtggttgcaggttaaggatgctgctcaacctctggcggggcacaaacagcccccacaaagaagtacctggtgccaaatgcaatcatgcagagaagccatggtccgcatcagaaggaaactccaacttctgggatctgccagagctcctctgcccagcggcag

SEQ ID NO: 59443 - DNA, 1125 bp, Bovine  19866881160346
acacacccgttgctgccaacattgacatgcattctcttttaatcctttctcttttcctcccttggctttgcaattatggtagattttttttttttgtttgtgcatttcttccttgactgttgaggcattctctcctggctatactcatttcctttaaagaactctattcaatataacaaacctaacacagctccttgtacagagtagttactcggtgaagttttgttctgtgactgaataaacaccaagatctgcagggcttttgtgatgaacatgaagatgaagaggtcatttttatgcctgtaagcgggccacttcagaatctaaactcagtgtttgtcaggaaccctaataaaggggaggtaaggacggtgtggaaggaactttggagaatgaatttgacactgaacctcagattcagcctctgttctggtttttttatttaggcggatttttcagggagagaagtatagttgttattattgtgaacaactgaatcaggtggttaagaaaactgttctgaaacttggtgataagatgataagttagagatacagcttttcaaagtcaaagtagagcattgtctagtaagacctaagagtcatttgattctctggaaactggaactttgttttacttactatttgctgttaattagtactcagcctctgttaaagttagaacttaaaaaaaattgttattgatgcacataatttcttgcaagtagagaagataaccccaaaggttatattttattgccctatagagtattaactagttttgtatgtaatttagcagtcctattccagtattctttttaaaaaaatttttattatatcaatttctttgccaccttgctgttttcctcattatgagttacttaagtttttgacatgtgcctagtatatattggtatgtgagttatatttctaaccttttaaaacttatattttgactttcatattcagtaaagtccttagacatgcatgaatgtgcaagtcactatccaaattcccctcattttattctaccacatggggcttccgtggtggctcagtggtaaagaatctgcctgccgatgcaggggacgcgggttcaatccctggggtcaggaagattccctgg

SEQ ID NO: 59444 - DNA, 1546 bp, Bovine  19866881207455
cagagtgtcttggttcagagtgaggagctccgaccagtaatcctgggaagcatagttttagaatctttatcaaacatttcgaaagtgattgaaatggacatccttaaagatgtagtttgttgccatccgaggaacatttgcataggttttaaaattattcgtatttgaaaaactagcattatacaggcaaaatatttttgaaatagagatagcctatgaaaagtgaaagtgaaagtcgctcagtcttgtctgactctatggattgccgtgctgtcctccaggggatcttcctgacccagggattgaacccagatctcctgcattggtaggcgagttctttaccactagcgccatctgttttgtaagttcatttgtatcatagcttctcatgcttctttctagttcccattctgccttttggtcaaggttaaaacaaactccaaggtgcagcctggtcctgggaagagtggtgtgtcttgctctttctttgatattccccccttcacagaagatggctattttaggcataaatggtatcaactatcttttgccgggtgggagagtcaaaccttctaaaatgtaagctccgtgagagcagtgaacttactctgtccatccctctctttcccagtgcccagaacaggtcctggaacattgtagagaaagactggtggctaaaggaatgaaatgttcctgtcggggctccctggaggtagttggctcagcgtagaggtctgtgcatcaggactcatggttgcaagtgagagaatgggctcagtacatctctacgattctctccctctcacttgtacccacctagagactaagctcttgtcttttctgtctaggcccaggcagaaagcccattgcctgtgctctccaaaatattaaatctcacattcacaaagaatctggtttcttcaggttgatctgtatgttccaaggtccagtccatattcaaaaggtctcagcaagtatatttatgatttcttcatatcctttcccttccagagactgggtgaaatgttaagctgttgttttctatttttcacttcactcaagctataattgtagccccttcttatataagaagccttctctgatcaacttcatttcccttagatccctgtgtaccttactttgtgtttcctttccttattgctacttagacccctgtgtaccttactttgtgtttcctttccttattgctacttagacccctgtgtaccttactttgtgtttccttagcatattgctactaagttgtgttgttctgtctcgcatttgatatgctatgtatacatttgttctgtttgccctgttttcagcttttaaaactaattcatttactgtatttcacaatatacacacagtagtctcaatgtaacagtactaacactaccaccaacaaagtgattactgagaacaatttagtatttaaaaattttcaattctgtttccttcctctatccctcccctctttccttccttagaccactactctcttagcaagtcaaatttcagttatacaatacagtattataaa

SEQ ID NO: 59445 - DNA, 1645 bp, Bovine  19866881378738
taaaagatgcttgctccttggaaggaaagttatgaccaacctagatagcatattaaaaagcagagacattactttaccaacaaaggtccatctagtcaaggctatggtttttccagtcgtcatgtttggatgtgagagttggaccataaagaaagctgagtgccatagaattgatgcttttgaactatggtgttggagaagactgttgagagtcccttggaatacaaggagatccaagcagtccatcctaaaggaaatcagtcctgaatattcattggaaggactgatgctaaagctgaaactccaatactttggccagctggtgggaagaactgactcatttgaaaagaccatgaggctggcaaagattgagggcaggagaagaaagggatgacagaggatgagatggctggatggcatcaccgactcaatggacatgagtttgagtaaactccaggagttggcaatggacacagaggcctggcgtgctgcagtccatggggtcgcagagagtcagacacgaccgagcgactgaactggactgttgataccatcaccacaatcaaggtttttaataactccaaaagcttccttaggttcctttgcttttgttgtttttgttgtaagaacactttactagatcttcactctcagcaaatttttcagtgcacaattccatagtgttacctataggcagtgtgttgtacagccagatctctagaacttactcatttttataactgtaactttatatctgttgcacttctccccaattccccctgccctcttcccctggcaacttccacttttttttttctgcttatataagtttgacaatgtaagtagaatcatggaggtatttgtcctactatgattgacttattcacttggcataacgtcttctaggtctatccatgttgttgcaaataataagatttccttctttttttaaaactgaatagtattccatcatatgtatacatcacattttatttatccattcatctcaatagacggactattttctatgtcttttttttctcctctattcaagctctgagtgttttcagagttgtaacctcacctcatgttctaatttctacctgggcctggcaagttgaatatgggttcttgaatctgttgtgaatcataaccaggattaacccagctattcaactttgcaggaagggccgagccttcagttcctgccagggaactgggatttgattctgtttcatggtttatcaaatctagatttgtttgttatcatgaaatcactttaaagcctttagggtgatctattttaaatgctaatatatttttctccatctgcttttatatgcatagagagattgacagaggaagggcattcgttgggtcagtgacagggactaagggaggagagaaagaaaaagttgctcttcaattcccacctttcctttttgaatttttttagcgtaagcatgtatcatttttatgataaaaattaaaatatgcagtgaaacactgtgttctagctggtataataagcttagcatttgatcctgagattctctcttacagaggcagctgtaggacagatatgttactaaaggataacttcagtttctaggagaaatcattacacagaggtgcgacttcaagt

SEQ ID NO: 59446 - DNA, 717 bp, Bovine  19866881605361
tttgtgaggggaagggttgggaagatgagtataaaggatttccatcccacacatctctagacaaactaagcaaagactttgtctggtgtaaatgaagaaaaaacaacaaaggacatttgtggcatggtgactaaagggcaagcagtcacatgtttagttaaatgttctcagagatggagctaacactgttagaactcccgagagcttggcacttcttcagcaaactctcatttagaatgaagagcaggcttcctggagttccggagcaatgctctctggggccatacgggagcctgagacaatggagaaatacctgctcctatgtacattcatcaaaatatccttcaaaatattttgaaccaagtgagaaaaattaataaaagctctatgatcaaaagacgtgacaaccatgactcgttgatatatggcagaaaccaacacaatattgtaaagcaattatcctccaattcaacataaaattttttaaagacatgacaacacataaagccttgcactgcccaatcttttgcatacattgtcaagccttataatataaacctgcctagtgagcaatttgaggaccttggaaccaggaaactcagggctcactggacatggctattcccatcacacaacaatgcagagaagtaacacaatcaacaatagcctgtcttcacttaaaattttgttatttttttcactagaatttatttcata

SEQ ID NO: 59447 - DNA, 751 bp, Bovine  19866881708838
acggggaaggcctgcactacggtgtgtcttacccctcccaaatgacttatcatgtaggtggttatgtccctacggcttcccattttaatgggcttgagaaattattctttgggatgtacaaatactatgtagcatgcccatgagaaattaggtggagttatgaagtgtcaaagtagaagggatatgagaggttgtagggcccatctgtctctttttgcaggtgagaaaccaggcccagaggggtaaagatctgtcaagctcttatgattaattaataactgaagaggataccagtggctgttgccttcctcagtccttctggggaatcagcccctcccactctgtcctagcatcttgggtggtgctaactttactcccaaatccacagtgagcaaatgagccaagcctcactaaccagagcatcagaacatgtgttcccaggaggccaatcaaaactaaagagacttgatttcaggacattggaatagagaagttcatggtctccactggggttgctgggagggttggactgtagccagagagccaaagacagcagtgccaagatgtggagagagtgagtctgtctttaatgacatcttggagaccctgatatagctgtatctgatccctgaccctggtaggaactcattcatctctggattttttttgtttgtttggtttttgcttaagttgaatgctgtcactttcaactaataagttatcctaactgatgtcatgttagaactagaac

SEQ ID NO: 59448 - DNA, 801 bp, Bovine  19866881857078
cctttaaaacttgcaaggggttttcccacatcgagctggatggattctatttgttaagctctttcctctttgaatgaaaaggtgggctgattgatttatttttcaaccagtattttactgaatgccttctgtgctccaggtactggggcaaagaaggcaggcttggttcctgatttcagtggaaccatgctctaggtggggagacatactgaacaaataattgcaggagacattactttgctatagatgagatatatgctaccaaggagaagcagaggctgctgggaaagggtgccagctgaagtcttcacctgaatctgaggcatagatttcctctttattcaccctaatgctgtcttccctgctcatagtgctgccaaaggacagaaattctgtccccacccctcaaacagatgagtcagtgccttcaaggctgcacgtccccaggtgaagtaagagagtcattcttgctggactctcctctttactccttcacactcctgggctcggtgccatgaggcaaggcatcagatattttgcatgatgaaatttacattacagtttcctcctgaggcctgatgactaacaaggtctgaaaacaacaattctaggtactacctcctcctccttctcctcagtgtttattaagcacttactaggaatagggctggatgttcagccaaggatgcaaaaaagcactggagacaaaaggaatatgctaataaaacctgagtagtgatacaggctaatgactcccaggatttgggattttattaacagctaaaaatgagagctttatta

SEQ ID NO: 59449 - DNA, 2328 bp, Bovine  19866880667026
cttctgcaaagtaagcctgctgtttggaagtatctacatgtacaagcagggcggtgttacatattcgatttgcaagccgatctttagcttctcaggtatagagtgtccccagggatatttaggggacattgctgggaggaacattcgtactggcattgtttctttctggtgggcacaagcttggcacaattagccgtatccagagttggcactcatttgggagatgtttgctgattgcttaatcagatccagtaattctaagcttttgagcttcccaggtggctcagtggtaatgaatcctcctgcaaatgccaggagacgcaggggacacaggttcagtctctgggtcaggaagattccctggaggaggaaatggcaacccactccagtattcttgcctgggaaatcccacggacagaggagcctggcgggctacagtccgtggagtcacaaaggagtcagacatgactgagcacacgagagcatataattctgagctttagagaaaaccaagacttgggtggttgggaggtgatttgaacccatcagtatggtgtgaggatgtaacttctgacagagaggctccaaccacccctagaatacttccaaggcttttaaccatttctgtctagaaaaagaaaccattttcttcattaagaatgcattcccttaacagtgaggttttgtggggaaattactcaaatgacttaatgcaggaggcttgccctggggactcagctttggcatgacccagacactggagggtcatgttgctttctgaggatatagacagtgatttctttgtactgactgtggactcaagacactgtgtcactgtggatgacctataacagaccccacccctccccccaatatgcagcttcacatgcaagaaagaaatgagcagaaaccataagttttcctctccctacagtgcttttgaggaaaaagggtgcgattcagcattcccaaagcttgctttctgggcagatccacatgggcagacctccctgcaagacagactctgccctgcagtgagtgacgtgtcctcccccgccgtcgttgtgcctggtgtgtgggaggcactcagatacttcttgaatgaacagacctctttgaactgtgcccttgtcttcattttcagtttcttttgacaagaatgcgtttaccatgtaggcgtctccaggagtttcttctgagtcctgcatcaccttctgtgtgaactcactgcattatgttgtttctttaataaggggtggtgtttgagtattgattctaacacctgctttttaccattatactccagataacaccacctattcagagagtaaagggattaactagtaattctatagaaatgacccttggtttgccaaatgcttgtgggaatcatacaaagttcttagatttaatcccccttactttgttcttaggtccttgggagctttttgtcttgcttagtggcctgggattgaatactaatagattgttcattgtctttaaccggacccatttcatagctgaaaaatcaggggcaaccttgtttcctgtaagtcaacaacaaaagtaataccgttattgttcactgtgtgatgggtactgccctgagttcttttgctgattattctgtttaacagtctcaacaactccataactattattttatagatgatgaaatggaggcacagccaggatgtggctgagtagcccaggcctccttgcagggctcacatatgctacaccgcgtattggcatccaggcaggggctctcaaaatgcctgcatattggaatcgcccttaaggctgtcagaaccctccgtgtccaggtattctcccacttcctgccctcgtgtttttatttacttggtctggggtcttggtgaaagtgctgcgcactcaggactgagaacctttgaacctgagcagtggttcttaaaattttgtccccagagcagtaacatcagcatcatctggtcacttcttagtagaacttcttatgtcccacccacacctactgagttgaaattctaggggtaacgtctagccatcaatgttttgacgagctgtctgtatagttcttttccttaagttataaaaaccataaacttcaccagcgtaatctttgttgaatgtacagttcatttgttgttcagtcgctcctactgtgactctcaaatacaccctctgcatgccgccctctgcccagttctgcctctgcccctgttattctgagtcactgtcatcaagttgcttaacttccttgaggtgggttctgttctctccataaaggaggtaacctaacttgcagagtttgggaaaagttaaatg

SEQ ID NO: 59450 - DNA, 1081 bp, Bovine  19866881208547
gtctattaattcgaactttgtgaattgatactactaacatttaattagaatactaaattatctttaacataaaataaaagctggcttaagccaacaataaactgtacagtgtacagagtctgtcttttttctctcccgctcctctcccacatatatatacctgtggatactggaattcagtgtaagcctcaggaacctaagcagcataatcgaggtgactagaatgcagggtctggctgcacagtatttttaacaacacaaaagaagccagaaatggtgaaattttaccactgcaactgtttgtcattattcttattttggctcacatgtaaaaccaaagcactgtataggttaactaacagaattctagccactgaaaatgtatagtacttaccctatgtaggagctcatttaatgatccatttggcatgtattcggtaactattcctaaaaattcaggctcattgcaaattcccaaaattggaagaatgtaactaaatcgagctttgtgtaaaatttcagcttctcttaagacatcactttctttcactaaagaaaaaaaaaagcataattactttcaaaataatgaaaaatacacaattatcatgcccataataaattaattctggatttttccattcattcattagcttttgatctcatgtaaattaggcaacttttcttagtttcttcatatttaaaggagggataatctctaccttacatattccataggtctgtttagagaccaaaataacatataaaccactgacagaaagaagtgctacacatagatcaaaactgtacttttcctaggaaaggcaaagaacacaatgtttgtttataaagtctatttgtattaaaacgataggtgcttgaaccaattacataagtttctgttgtattaaaatgataaaattttattagactgttacattaaattttacggttgcatatcatgtaaaaattttctaaatatcctgaatattaaaacacttaaatgttgtagattttaatgactagatgataatagtcgcataagggtcaataatactcagaaattataggctggaactcagga

SEQ ID NO: 59451 - DNA, 1209 bp, Bovine  19866881261132
ctagaatgagaagatatgtcgagtataaatgtatgtgtctgggtattatatagataaaaataaactactcaactgaagagagaccccataccatgtagtgcattgccagtaaatactaaaaggaaatattagtactgtaaagtcattattttctctataaggaaaataagatccaaggatgttaaagaatgtcagatagatactatgtaataaaataagtatattttgccctatacttagttatactagatatttagtttatactattctcatggaatatttcattttcaaagtggaaataaatttggccactaattttggttttatttattttcatataaagaaaatcgaatatcctgatgttccttggccattgagatttcgtattctgcatgaaattgctctaggtgtaaattacctgcacaatatgaatcctcctctacttcatcatgacctgaagactcaaaacatcttattggataatgaatttcatgttaaggtaattactgtttttcaaaaaagcttatctgcatccttgtgtttaatagttttaaagacttcttagttaatttttctaccttgccaatttaatgtctctgccttttccatggcccctaattcagtgccacttcttcctgctgcagtgggttagttattcctagactacagatattcataaaagtatggttcagatacaaagtcattatattcttaatttaaattgttaagtatacctttatttactttttattttgaaattattagagattcttaggtggttgcagagtaaagaagtctcatgtacccttcacccagtttctaccagtggttacgtcacatataactatagtaccatttcaaggccaggaatttgacattggtacagtacacatatgtagtttgtagttctgtttcactttatcttgtgtaaatttctgtggctatgatagcagtcaagatacagcactattctatcacaacaaagataccacttatactatccctgcatagtcatgttcaccttccctccatcgtccctaaccgctgtcaaccagtaatctgtttttcttttctataattttgttgttttgacaatggactcatacaatgtatgatattttgagattggctttgttcatttagcataaggcctttgagatccatttgagtctttgcttgtgtcaagaattgttttctttttcgttggtg

SEQ ID NO: 59452 - DNA, 943 bp, Bovine  19866881607620
tatatgtgtctcttgtgtttgttatataaatattaaaccgtgcccagttgtttcaggacctcgtaacatttttcattctcagaatatcaactctctcaatatttgaagtcagtgagaactctagttaatggggcaaatccattccctggaggttgcatacagtcttgtcctaaaactaaatttaaatactctgttatgttcccaagtattaagcaagtttttattaaaacaaatattcttatccactgaagcagacaaaaatattgagtctgagtgagaaaaaaagccctaatcaatcaaaacaggaaaacttttctgacaaaaatgatactttaagtctcttttttaaaagcatattttgatgtaaaaagatacaaatataaatgtaagtatagtatttacttgcaaaaatcacagtgagattctgtggtatttaagtgtattgctgttaagttgttagactaggaaacaagagtccagaatggcgggggctaaaagacaaggaatggaaaagcccgcaaaaatagaacaagggaagctccaaggaccggagtgaggaccttaggtagagcaaacaacactcctggctagcccaatttacatagggcaggcccagggggagaaagaacatataaaaagaggtgccaaagggctgggggtctctctccctccacccccactccccgtgtgctggtgtgctcttctctttgcatctttgggtcgacatgccctcacgcctcgaggatggattttcctgctattatctaaataaaatagagctgttacacggagctgtaacactgatttgtctaagagctataacatggtccgtttgagacctgagagctataacacggtctgtccaagacacaagagctgtgacacgcttaggattttaatgtccgtcactccaaatctttgttggacgagacacaaccgagcg

SEQ ID NO: 59453 - DNA, 561 bp, Bovine  19866880604728
ctaatggtaggcatagcagagagcaccataaatgattaaaggatttggaaagctcaggttctagaattattttggcatattaaagagaaaactgaaggggaaattcagtcactgtttatgaagtttgtgctataatgtggctttaattttctgaagattctaagttaattaaggtgtattgtacctagagaaaactgctttgaaccagagttaatttaaggatttttcttgagctctgagttcaaagaataactgagtaaggtacaaaatctaaggtccacttcccttctgtaaaataggtgtgctaataatagtacagttggttctttgtatttgaggatgccggttctgcatatgagtattcaaccaaccacagacctaaagtagtaggaaaaaaatccagaaagtcccaagaagcaaaacttgaatttgctgcatacccgcagctatatatatataacatatgcattgtgtgttaggtattataagtaacctagagatagtttaaagtgaaagagaggatgtgcgtaggttgtatgcaaatactaaaccattttatat

SEQ ID NO: 59454 - DNA, 1742 bp, Bovine  19866880768409
gtaagcccaatgtattagttagggtacaatttaggcctctgtaacaaagagaccccaaaatacactgcttgaaaagcaagatagacgtttattttacataaaaatccaggcaggtggtccagagctggtttggcagctcagcattgttggggaactttgctctgctttgctcagcattctgtgtgcctctccttgccaggttggctcttccagctgcagccatggcactttctttccagacagagggaggggagggaaagagaggaggggaatttgccctttccctttaagtgctccggagcagagcacacaaatttcagcttacatcccactggtcacgtggccatcctagctgccagagaccaggatatggaatattttaccgggctgacttgtacccagctaaaacccctatttagaaagggagaacagttattaggggatagccctgccctatcctcaatagtcacagtatatttaaggatttttttttcctttcttagaaaaagatgaaaataatgttgtgacttaatttttttcctaaattaagtaattttcatattattgaaacaaaggaaacatggtattcaatgaaacaagagaaactctggcaaaatacccttgcaaaatctttgcctaaaaatgtaccagcttgaacctgccccaaataaggaatggagttataaccggaccttaccacagataatcagttttcttccttgagaagctaaaaaaaggatgaacacaccctgctttgaaacactcttcttgtctctcagctcttggtgttcaacctaaaggtaatggaaaaagtgaaggaatcttgtaagcagagaactgaattcagcatggtaatgtctgaatgctgtgttgttttggatagggaataaagaggcaatagacaaccctttgtgactagtctctaagtctctgccttggtgttaaagaaccagatttaggcctaatgcaatgaaaggtaccacctctgctgtggggaaggatgctatgaaccttggtagcattcaatggagtggaggtaaagctgtcactgtagagggggttaggcttcttagagggcttccctggtgatttagacagtaaagaatccacctgcaatgcgggagacttgggttcgatccctgggttgggacgatctcctgaaggagggcatggcaacccactccagtattcttgcctggaaaatcccatggacagaggagcctacagcccatggggtctcagagagtccagcacgactgagcgacttccctaaggaatgttgtggctgatttcatcttctatacagatcactaaaactttctccatagtagcaagcctgctggctttcttattattcttatcttatcatagatattttatgatggggattttactttaaaaaaaaaaatttcctggactattacattatctactagattaaaaaatcatgtcatagttgagtccaattactgatgaaaacaattgagtttttacaagggatttatacttaagggaactggttggaactcagaggtaaatgtacaacaatccaacagtcagtttaattgtacaatcatgaaaagattacaaccagggattggactcacaccaaggagtatatgaggattctaaaagaaatttaaagtgtagaatctataaatattatgcttaaggaaaaagaaaatatatttttgtaaaaatccaaagccttatttcagcagaggatgaaatcattcaggaag

SEQ ID NO: 59455 - DNA, 828 bp, Bovine  19866880864458
attgtatttgctaactttttgtccttactgttcattggcacttttatttgaagatgaaaagaggaagggaaagaagacaaatgcaatctttcagcttattcttatcactgataaaagatctgaagagtaaagtttaagctattagctaaaacaatattgagatatcactatatttatcattgcatataaccaaaggtaaaggataaaaagtaccttattgataaaagcaactgaaaatataattaattctacccaatgacagtaagattataatatataaatataatgaatatataatgttaatacacacacacacacaccgtgcaacatggtttggaagaaagaactctcaataaaaagcaggaaacctagagtcggctctgccagtagctgggtgaccttacgcatgagtcagttacctccactgcaccacaaggcggtaagataaacgtttctccttcaaactgacaccctgtacgtacacgcatatatacatgcttttatttacaggcaaggcgggcactcactagctcataccagtatggcatgacgggctgttcataggccagcacctgttccgattggtctgtcaatgctgtaccagttgttaaacagtgtgaattatcatcctatttacaaccacccccaaattacaaaatgtctaacatgtatatccctgtgtttgcagtctgccttccacacatagtgaggatattccaaagttaaataggccctccttaatctccagttaaaatttaagagcacaattcctttccaactccctttctcctctttcaaaaagagtttctgtacattttctgttctgta

SEQ ID NO: 59456 - DNA, 1585 bp, Bovine  19866881073902
aaataaactttcttttaaactttgaaatctcagtcatcagcaaacaaaggaaaaaaaagacaagaggagaatgttgccagtgccacagccttagaagacagaccccgattacttctttaccactgtgtggaagcagagaacagtgtctgttcctcctttcttcacatggctgcccagctagattaaattccgcagcttcctttatagccaaatgtggcaatgggccagaaatgtgccttcaccttgcctagaatgtggatgtgataccaggaagctcacagtcaggtcacaatgccagccctggactgctcaagacttcttcacatgaaaaaataaactcagtttttgaggtctctgtgagaacagcccaaactataccttaactgaccatatgtcatattttactatgctgtcctaataggttctaagttaaatatttctttaaaagaacaccttatttggctgaaagctttaaatcatttaactaagcaatccataaacagcagtaccaggattacagtattgattttctcagataccatctttcttatatgatagtcaaaaaactgctcgctctgcttacatggaagcagcatcagatcagatcagatcagatcagtcgctcagtcgtgtccgactctttgcgacctcatgaatcgcagcacgccaggcctcccggagttcacagagactcacgtccatagagttagtgatgccatccagccatctcatcctgttgtccccttctcctcctgcccccaatccctcccagcatcagagtcttttccaatgaggcaactcttcacatgaggtggccaaagtactggagtttcagctttagcatcattccttccaaagaaatcccagggctgatctcctgaagaatggactggttggatctccttgcagtccaagggactctgaagagtcttctccgacaccacagttcaaaagcattaattcttcggtgctcagccttcttcacagtccaactctcacatccatacatgaccacgggaaaaaccatagccttcactagacgaacctttgttggcaaagtagcagcatattataatacaaacataaaagtatctaaaaataacatttcactccttttttttgttaagtatgattgtgaaagtgagatgaaaaatctcatggaatcaccaaaatacctgaaaattaggcactagtagattttacactttaaaggtatagggtggcaatactactaaaatacaaagatttcttaaatgtatataaatttgtctcttcctgatttctggcttactttcatgattattacacagggatacagacatggatggcataagacaggggtgaaaagatcaggcttggctgaatgtagtaaatgcttctccttcccccaaagctaagttgttggcatgctttgatagtatctaaattgtctcccctttaaaaatagttttcatctttggccaatatcactggttttcctctctgctacatgtaaggatctgcttctttttctcccttccctccccctaccaccctagaatttgcctttttaaaaatcccattgaggctactaaccactgcagct

SEQ ID NO: 59457 - DNA, 1972 bp, Bovine  19866880351887
ccacagagcatggagctgaacttcctgcaccatatacagcaggttcccactagcgatctccttctgttttacacctggtggtatatatatgtcagtcccaatctcccaattcatcccaacctctccctcccctgtgtggccacacgtcaagaagtctacttcatacacaatcaacttaagatttgtataccttggtacatttttcccaagctctggaactccaggttttctgaataaccatacaaaaacctcttaccagtattctgagccacattgaatcctctgttttgaaacaagaatatgaattttactgaaatgattatttatagcaacatcaatattattcaacacttaaaatcattaccttgttattttctgattgggaggttaatgcccgacttcttttaaatggtggtgtactccagtactcttgcctggaaaatcccatgggtggaggagcctggtgggctgcagtccatggggtcgcgaagagtcagacatgactgagcgacttcactttcacttttcactttcatgcattggagagggaaatggcaacccactccagtgttcttgcctggagaatcccggggacgggggagcctggtgggctgccgtctatgggttcacacagagtcggacacgactgaagtgacttagtgttagcagtagcaggactaacgtatgaacgaaatgtgtcctacaaataacacatgaaaacaaagttagaaatgagtataatcctctgagtgtgttgtatgcaacagtttataccttcagttctgatcacagacatgcgcttccagctaagggccattaatccatttactgctacttgttggagtgaagagaaattatcaaagacttttccatatgtttcagtgaatacctctttaattgtggattgttcagcttccttatttttctatgtatatggcctctttgaagattcctaaagccaattctctttttactcaaattaaaaaacagcaacaacaacaagcaagctactgtggccacagttctgattcctttggtcgtgacaacgcctgcctcgttcttaatatttcatcctaacctacttccacactgagtgtacttctgcagcagtaaaataagatgtaaaaacttagaatcagttaagcaatgcagtagcttaagacccacaggactctttgtccttagtgttataatttaaagctttgccaaatagatagcctatccattctatatttcacgtaagaaaagagaccatccaaaaagaagtttccagggacttccctggtggtccactggttacgagtttgccctggaatgcaggggacgcaagtttgatccctgtttgaggaactaagatcccacttgtcgccacggagcaactaaggctgcaccccgcaacgactgagcctgagatgtaatagccaacctgacccagccaaataaataaataaatattttctttaacaatgtctccaaaacctaaattaaacatgtatgtcaaagtattaccatacgtaaacagcatgtatttattttagccttcatcaagaaaaataaaatatgccttgtgattatactatgcacattgaatcaaaatgtcagaatcttctaaataaattgttattatggaataaggcagaacttcagccctgaatttatataattcactccgttgtagattttttttcattgaagaatacatttcactgccataaattgcactgagtatgaacagcagagtcatttgaggttcattgaaaatataggagaacatcatgtttcctgtccttttgttaaacttggcatattgatttttttgcacagcttgcagcacagaaatgtgatatacagctacagcaagacaagctaaccacatgtgaatttgttaagtactgctggattagcagaaattgtctgactgtgcaaatagcaagatttgacttcgccaggaactctttatgacttaatcaat

SEQ ID NO: 59458 - DNA, 1383 bp, Bovine  19866880571464
ttacggcatacagcttctggaggatcacctgtgctcctgacactgggatgtcttttcaatttaagtctagaatttgccctcacctgtctgatactactttaattttattctcagttctgtcccccaaggcatttcctctctgaatgtccttttcttaaacaaaaaaaaaatcacataatccaactgccttctacatgagaagaatccttacaggatcctgaacttatttacacaacaccgacaatacatatagaataatatctcccattaagataaaaaatgcattgattttaaatgaaatatatattcttaaatatgtcatgtaaacacagtaaattcctattattcctagtttagaaaatgatgtgggcatatattagataggactggttacttcaatgccagataatattttagagtatcagtccttaagttccactaaggactgagttatgattaaaaactgaatagaaatagaaacggctaagtaattattaggaagggttatgaaaattatttataattataatccttactgcatctgtactaaattttatcctaaaaagacatttcaaaattctaattggactgtccatataggcttttctgcaactgtccagaagacttacagggggaaatctttcattattgctcaagaaattaaattttcctctcaggaattaaatttacttttgggtttgtaaacagttgcaatactggggtgtgagatattgcaatggatgtaaagtagattttacatgtggtacaaaatttgccaagtacatattgttcctacttgtttgctttgtaccctggttccaagcagcattttaaagttaattatagggtcataaaggtctcttccccgcgccccccccccaatattttaaaatcattgttacaattattacttggatcttgttaaagtggcaatggatgggaattaccacccaaagaatctcaactgtatcctttgggcatcactgaatgtgaatggcatctattattttatttctcttccacagagaaaatttaaaaagtcacactgatgggtgggaaagcttgtgaatccactgagaaggttaactacggtggaggcttaatctgtacagtgagacatgaagaagttggttactgacagtaagatgtcttcagttagtcagactgcagtgtttgggggcacgacaatgtctatggactggtaggatcatgagttgttaaaactttcctacaaaaaataaaggaagacctgtatcatcaagacaaaagtacttcaggaatctctaataaagaatgctataacccactgactagaaaaaaatatatttacaaaatataaaaaatggggctaaaattgtatctctacagtattaatccctacag

SEQ ID NO: 59459 - DNA, 1374 bp, Bovine  19866880769105
catggataaactaaaaaggagatgctgtattgagttcagctaccagggtaaataaattagtatacagaaaaacaaatctgttcactacctttaaatgtctttaattgtcataattatagcatgcctttctcaacacagatgcatatgatatattcttaggaaaattgccacaactgttgatacttatactcaagtgttatatttatatgctggataccatatacatgaaatatatttatacacacctaactaatgtccttgaatgcatgagtgctcgactgctcagtcatctgcaactgtttgcgaccctacacactgtagcccaccaggctcctctgaccatgggatttttccaggcaagaatactggagggggttgtcatttcctcctccagcgcatcttccccacccagggattgaacccacgcctcccacgtctcctgcattggcaagcagatgcttcttactgcggcaccgtctgggaatcccaactaatgtccttagtagacatcaattatacaactgtgcaaacaaaagcatatgacttcctcgtaattctgcatgcgttacaggaacactgagagtgcatcactgggtagaaagacgggattaagcaagactgctctcgacaacttcaccttcgagtctcacccacggctgtcttcttactgtgtcagccaacctctgtattcctcagctgagctttccctagtccctctcctggttggaaccatactatggacaaccgtagtcaatcaagtgatagaatggttagattatctggaccagtttacgcaggctcaaaatatgaactttttgatacagttattatttagggctgaggaaggcacctgagggcttccctggtaaagaatctgccagcaatggcagaagacctgggttccatccctgggttgggaagatgccctggaagagggcatggcaacccactccagtgttcttgcctggagaatcccatggacagaggagtctggtgagctacatccatggggtcacaaagagttggacatgactgccgctacttagcacgcaggcatgcaaggtagctgagctagtggtgcctgtccctgaaaagaaatttagaagtttcctcttgttttacattttccagttaggctaaactcagtgaattacttcagccaaggaggagataagaaaaaaaaaaaaataggagaaaatgagtaaagtgattttaataggtcaggggaagaaagaagtaggttgaatatatacacacccgtccccctcctgctccatgccaaggaggccgtgggaagggctggtcagggaaacactggtctaagggcatttgcgatgacagagcagggctgcctcctgccagaccacagcagag

SEQ ID NO: 59460 - DNA, 1197 bp, Bovine  19866880926990
cacgtttttactcaaagcctgtgcaaagaaatttccctacattgtcccacagatcattttttcctttcccccagttgtcctcttcactccattcttcctattctatgtcatctttccccctcctctccacctcctccctcttgtgcacacacctccagagttcaagtgtggataaacccgctggtcatgacaacacaagttcaatcagcaaataaataaaactcttacttttttttttggctgccggctgcattccccctctggccgttgcctcctttaattataggagctatatttcttccctgggagatattcgaggggattttttagcaggaaactcgcttctgctgagttactttagagccaggaccagtgagtgagtggccggtactcagaggctttgagtgaagtgcagattgagacatatcgagttccctctaaaaggatcatttcatgtgggaggttggacacaaagtttgcactcgtgactggcattccagtgagagacatgcatattttaaaacaacaaagcaagctggaaagaaggcttaggggaggagaaaaaaacttggaaagaagttactaagtgacaaacatctgtcaacatgggataatttgtacactatctgcctcctttgatggtggttcaaggcagaggatctaggaaagcaaagtggatacactactttatccctgtgaaatactggtgaaaacacacttttctccccaagtaggtgtaaggtgattaaagttgcttgaatgaatattatttttaaatgtttcttaaaatagtagagacctctaaaattgcttatttctgatagtacaaaaactagatcttatttaatcttgaaagaagttcatttaaacaacgaagagtgataaagtaatagcaggatatttattatagaaaataaaatgaatctcatcataacaacaacaaaaaaaaaaccccacaaaagcaagctgaagaaagaagagaaacaaaaagctcaaacaacccctggttgctatagtctagaaatcttttaactacaagtaccagatttacatgtgtctgtgagccaaacatataaacatccacctctctgcatgtcaacaaggagaaaaggcaaaatatttttcagaggattttctgtctcatttaagcttggagtttcaacaagcctattatagcaaaaaaagtttccttcttgg

SEQ ID NO: 59461 - DNA, 965 bp, Bovine  19866881034902
aacctgcatttggaactaagatctagtactgaagtctatccttgagaaatatcccccaacactgctgtgttcagactgaaaaatgaggtcatctttccatttgcttactcattttgggcaaaattcaatgttagtcagggggagaaagaagatgagtgtaggtttatcctggcaaatcctaacgtgcctgactggattttgatgtcttagtagaattcttggggaaaaaaattatatatatgtgtgcctgcatcaataagtgtaaaatttcaagttctttagaatatatttaacttcctgatatttattgtcagtatataactttcactgatttattcagctaacagtcttaaagacttcctttgaatttggagtcatctatattctccaaatacaaaagaagtttgtgagcagttctagataagctcagacatacctactttaaataatatttcatgggtatgtttagaagggggcccagtttctggaccggtttatgaaatgaccaaccctgtttctagagtcttgtaagtccagtttcatttcaataataattattagtagcaccttataatgaaaaaacattttttaagtcaattgtattgactattctccgatgcatactacatggaaacacccatccccaaacacaatagggaaaaaaaaaaaggtgttaattgtctcttttccttctcatttcccatgcttccaggctcatttggcatttcctccgtagtgatcacacttagacttactaatgttatcaaggctatgatgaatttgtaagctttcttagggagctcctctcataattcctcccaccccttgaaaaccaattcaatgtatgaatctagagggacctaaggagtcaaatggtctgaagcaattttaactcctttatttttttttctttcctggtgacagtctttatgaaggatgaacaaatttccctggtgataaagtca

SEQ ID NO: 59462 - DNA, 786 bp, Bovine  19866881147123
aagtcttgaaaaagtgctttacagaggaaagaagttttctttttgctcctcacaggagcgtccagaacgccactgttccaggacttccactgtgatgtacaaacaccggcactgactacacgcttggaaatgacgacctgcttttctcattagtatgggaagcattacaaacccttaaaataagacattttgcatagactttatctgacaggacactagtaatttcaaatcctccagaatcttgaagaagccaaattagtctaacaacatgaattcatactgtcattattactgttatatcaattgttaccgggaaataatgctcaataacaattttactattagcttttaaacaactaaaaagtttggaatataagaattataatagagagacaaaagcccaacattcagttttcgctatgtgaagtaagaataaagacaaaaatccaagtgtaaaaaaggaattttggctgataaagtaagctaaagtagaattacagtgttacttgagagtttcttctaaatggcaaataataaaagctgaagactgaacttcttaaagacctttatgtataattaaaaccatcccccaaatctgattagtaaaaagtgggaattacagctataactagaaattgaaaacatcgtcagtctttagacgttattaaaaaataaagcaaaatttggtttatagaaaaaaaattggatttgtaactgattctttccagaattttccagtaatttttcaaataagctcttaagctgagtaagaaactcaaagctcag

SEQ ID NO: 59463 - DNA, 1587 bp, Bovine  19866881245531
gcctgaggaaagccatcttaacaggtggagagcggcccacacaaggtgacttccttctggaaattacctgtgacatctaaaagccaagcgttcccttttctaacccaaacacttgctgggtgactgagaatctgaggggcctttgaagtcgatttaaactactttagccacccagctttgctgaaaacatcaaaaaaagactgtcttggggctggctctcctccaggaatctctagggccccggggctgcggccctcagccgccgtggaaggacaaggacgggcccaagggagttaaaatctgacctttgcccccgacacgcacaactcaacctgcgaccaggcctggccgaaagccctggggtgggggatgggccccctcaggaccacctagggcttctggaactctcccctcggggggttcaggctcacgggtctctggctgctgcaaagggggtcggtcagctcctggaagccccgcgggccaactctgcgccaggagcgccggggatctgcagtccccctgcacccaaggctacctgagctagtctgcttgaaacaggcaaaagttggtttttatttatttattttttgaatcctccttctccacctccgctggtaggcagtccttctacctcctacagtggcagcatcacctcgtaagctcctcgatgtctcagaacacatcacctgaacgtctccgcagtgggaaaccacgaaggagcgttgggaggggattgcggggaaacccaagtggggaactaataaaactcttgttagagggcctgctcgggatccgtggcgtcactgggccttttgctcggaaagccaaagagttgtattcctaaatgagttaaagacccatttacctctgtcgtgttctattcatcaagccccaagttgagagttcctaacatgaaactatttgtttgcttacacaaccagctgggcgcaatttcacgtctgagatatctatctgaaagcgcccctcatttattatctctccttgtcagcgaatccattttccagctccccctccccccttggactttatttatttatttagggggtggtggtgggggggcactcctctgcctggaggacctgggtctggaaggctcccaggggactgcccgctcctacccggtgtctgcgtggagcaggggcgcggaaggctcgtccgccgccaccgctgaccccggcggccggcgggtgggcccgcctggagacgacagagctgcctttctgcctggatgtcctccccgctagctcgtcccagagtcagccacaaccacctgtgcgaggcaggggtgggcggaggccggcccggggagttcacgagcctctctcccggagtggggggccccagatacgagatacgatccggatttgagagatgctttactcaaagcctcacctagtcccgtggggccaatttcttctccgggggcccggagcgcggagtgagtaaccaagatgtaaatagttgtgtgatgggctgggggaggaggtgcggggtggggtccgggtgggggacgcagcgcatttattgtgtgtgctgagggacgaaggctgcacgggtttcaat

SEQ ID NO: 59464 - DNA, 812 bp, Bovine  19866881536852
atgagaagtgagctcagatgtagtattttaagcaggtttctgcaatgactgtaacctatgctcactttttcccccttaagttgaacattgcagttaagtgatgcaaaagtgagcttaacgttttcctcaggaaatacaaacttccatattctacagaatgcttattaaataaaatttcaagaagtggttagagcttaagattttcagtccttcagggcatgcaaactttaaaatcctttccatattgtatcaagtccctaatgcacagagtataggttgacacataaatgatgctgttgactaaatgatcaacaacatttgatctctatgttgacacataggatcactgagtgtaaaaaatgaagccatatactcaggtaaaagcatctgatttattcccaaatatcaatgggcaagagtgtccttaatactctggaacaaaaagttcttgtctttattaaagcaaactgccccctctatgctttttgtgatccagagccttctcaaaagaagttatttctttcaaacataaaatgatttatctattaatgaaagttattttgtattaaaatgtgtttcctttaactatttgtagataagattctggtttttctaaagtgttagctcaacagtatataatttacacagtagagtttctatgaaagaaaaggaccaaaaaacagaaagaaagaaaatttacagaaagtctgtagaagaagatataattatacttttaattttcctactttcacccctctctctgtaaagaaaaagaaatgatgttcccaataactagcaaaatactagttcag

SEQ ID NO: 59465 - DNA, 990 bp, Bovine  19866881571610
acttaagacttagagctacgcaggctctatcattttcccatgtggtttgacaattccaaggattaaagggatcacaggggaaacgaggaggaatccctgagggcttctattacaagtttcttccaccatttcctatttcagtgcttcagggaagtcagtaccaggggttcactcttagcaactcaggactaacttctgctaattttcagtacatggtacattaggaaagaaagatatcttgctttgatttctccattttaactagccagctcttcaccatggcctcataattccttggtgttttaaatgcccacaaagatctttctcttcgtattatcaatgtcattttgtcttctaatgtgtttctttatgcagaaaaatgattatactttaaattctttttatagaatgttgtttgtataaaattaaatggttctaaagctttaaaaagagctacttggtttgaagaaatggaagaatttttcagaggtctgcaaaataaagaagcctgagaaatatttaataatagttctagattaaaagaatcaaaaacattctaactcagctaacactagtaactctaatttgacataacaaacataagaaagcttaataaaaaattagttaaaatacagtatctaatagcctcaaatttcatagccatgctctcactctttctttgcatcaaatgtcttttctccctctaaagagagcaatgtctctatcatgtgctattaatttattgtctaaaaaataaattactgcattaaaaaaggaagaattctgaacaatgatgaaagctcacacagaaaacagtgcaagccatgcttctaataccaaatgatgcctgttggcgttttgaattaaaaatctctctctctcttaagttcctttaaactctacatatgcagatcccctttcactgaacaggacctaatgggaatctaattcactgttaatgctgcctcagcagcacttctgcaccttaat

SEQ ID NO: 59466 - DNA, 895 bp, Bovine  19866880784691
acagctggatgtgcattcatctcattaaaatttttttcccagagtttgggctttaatgttgtgtgtcaccagtaatgtcatgagaaattcagagagaaaaatgtggtctatgcaattagtagccctcaggcagtaaagcttctgtttcagacagtgtcaaaacactgcaagatccagcaaggcagagccaactgccagagcagatgcctaaactcacagttcctggctacacaatgcatgcacattcctacacacatacacaagcatgcacacactgcatgcacacactgcaacagtgcacacatgcacacacatgcaaactgcaccacctcacatgtgttcgcacatgccatgcatgcatgcacacacatgggtgatcacatatatgcatgccaatcatatgccatacacatgcacaggtataatcatatgaatggtcacacacaatgcaaaaacaaatgccatatacaaatacacataatccccatatatacaaatatgcacacatgcatactgcatatccatacacacactgcacatgtacaaacacacctattagcaaaataattaactgaacatagcaattaacaacccaatgtccttatatgtagctttaactttatatttatattctttgcactcttcccaattttgaatcatgaaaactagcctgatggatgtgaaatttattttaggaataattaagtgtattcttaagggctcacattattcaaataggtttccacacttgaatttaatgaattcatctatgtaccttgagactacaatgattataattttataactataaaattctctctctccaaacagacagtgaaatgttttatttcattattatattctacttacagccaaattatagctatataataaa

SEQ ID NO: 59467 - DNA, 2777 bp, Bovine  19866880806766
gactgcagcctaccggctcctttgtctatgggattttccaggcaagagtgctggagtggggtgccattgccttctccaagtgacttcccacatatgcagaaactaaatatgaagaacattaaatctagagaaacaggaggatcctgagttagggttgttaaatctctaactgcaaagaaatattttgtctatagttggtactggagcatcctttaaggagcaatagaaggtctttaagggccaagtggattgctcattctgtatacaatttccgtatttgtgaagggagggaaggagttaagcgattggcgagagaagtcataattctaaacgttcatttgcttgattgctggccctcttaataatactctttttccatttaatgttgccaagtgaaactgagtattctttatagactcataatacctaagcttgggtcttttttcagttcaggtgctattaatatttctccagggcccatcaatatggtcagtcagatcagctattaatgtatgcatcaatcacaaaatggtcattttaggttgattgtgcaggattcgatggatcacttactatcataatagccgagcaaattaaatcaaggatcaaagtttcattatatggagtcatgaagattcgagtttctcccccttctggtttcctttcctaactctcttgttctcaacctccattcacttattttcctcttctttaaataataatattattattttatggattctaaggaaaaggcaaggagtagagtagttaacatagtgagagggtaacagttttgacagaaattaagatggatttgcaatattttaaacaaacaaagggcttcccaggtggcacagtggtaaaaattctgctgccagtgcaggagatacaagagatgagggttcaattcctgggtctggaagatcccttggaggaggaaatggcactcaactccagtattcttgcctgggaaattccctggacagaggagcctgacggtccatagtccatggggttgcaaggagtcggacacaactgggcaactgagcacacacacaatacaaacaaaaccctgctggaaatataatcattggtctcttatgaagggagttctttctgtattagaaggagatgacaaatttcttgctgctcttagtatttgtcttcccgtaaatcttatatttgtcagcctgtgctcttattacagacttttctcttcatgtgcttagactaactgctaaagcaatctgaataatcctgtgattattgctcagtttgttgctcaaaatcttgtgatttttctccgtttctgtgccttgttttacagtatttcctgtaattagaatccacaaagtgcctgctttttgcagttcctactgaacttttattcaaactcacaagtatcaaaattcaacagtatcaatctgattttgctctgtggccattcagatggttttaaaataaaaggcaaggtggaaaaatgaacgtaatgctacatttattatgacaacattgaaagggaatgttgaaaaggaagcaggaagtttgaaaaagtcttgattatgtttccataaatatttgctctgaagatgcagtgaattctaatatgcagaagctattaagataaaccttttttttttcttcctcaggagttttgcaaaaattctaactacatttttcttctctccattcagtattatacatctgcatgttttgaggctacatatttaataattgtgtagaagtagaaaactataggcacagttttatgccatgaaccacaggtcttgtacatataaagttgctgatggaattagaaacacaatggaatcagtgtattaaccccatttactgcacccggatgatttttgaaggaagtggtccagacttcacaaagtcttgtgaaaaacaagaatatatttcagtttgtaagataaaaatgaaccttcatgcatatttgcatttattttgcttaaggggatggaattgtgctttcaaagatacattgagaatcttttctaacaatcaaattcttaacatatagaccaagggcaagactttactcagaaaaaagtgtacattatacaaacaacttggtcaaattaagcaaggtcctataaccttgtttaattttttcccctcagttaaaatccagtagttaaaagtgttctggagatcacagctaggcattttctctgacagacgaacatctttccaagaatgaaaagttcattgtggagttgagtcgtgtccacctctttgcaaccccatggactgcagctaggctcccctgtccttcactgtcttcctgcagtttgctcaaattcatgtccattgaactggacatgaatcttgtcctctgtcattcccttttcctcctgccttcaatctttcccagcatcagtcttttccaacgagtcggctcttcgcatcaggtggtcaaagtattgtagaaggaagatcccaaatcacagatctgtcctggtgatacagaatccaagttcattcttaagaaagtgggtgaacttcctctgcctccatgggcatcgcatactgatctacttaaaaaaaaatgtatatatatttttaatgtggaccatttttaaagtctttattgaatttcttacagcactgtctctggttcatgttttgttttttttggctatgaggtatgtgggatcttaattcccggaccagggattgaacccaaactccctgcactggaagccaaagacttagcctttgctagacgaccagcaaagtcctcctgacctatt

SEQ ID NO: 59468 - DNA, 753 bp, Bovine  19866880941373
ctagacgaccagcaaagtcctcctgacctattctttaaaagtgggatgaagatggcaaattaggggaacttctaatgggtggtgaggtacttaagatcttttgccccaaatggtagaccaaaaagatacagatctttttgcttacaatctttgttctttccttgagcttgtattgttgctacaaattaatttctttccctgtcaggattccttttggaacctaagttccaaagcaaacataagttctctgctattttcccccctcaatcagtctcactcttgaatttttcagaaatggatatgactatcattttctttttcagccttaggaaagaggcataagctagttgaataatgacaggttagtagaaaatctatgtcttactgttgctaaagcgataaacagtttgtggcaaaatgtggttagaatcagcattgtggcataagatagattttgtagactcagaaaaaaagatccttgtgtctagctttgaatccaagcttctggttaaatgggtgagggaaaagaaaatggacttttctatttgttcactcagttgcatctctgagctttgcctggtccaggacatctccctctcagcccaccttcaaccttggtgtacttggttctttgtgtccttacctgtactcctaaagctctacctgtttcacataactttcatcaatcaactggataaaatttaatgcatttggataaccctctccccttcactcctcttcaactcttagttt

SEQ ID NO: 59469 - DNA, 1870 bp, Bovine  19866881285750
ttgtttaaggtcagtcatctgaatccatgtcttgggagagttcccatgaagttaccatagggatgaaaatctggggccagtattcacatgcctgattattgaagtcagaacagctggctttatttcaacattccccagcctcacacatacatacatgccagtgaagcttagaggttaaaatgtaagaggaaaatcacaagtgggataataagaaaatggaactgagaagctaccctggaaaaaccaaatacatgcctcagctaggctggaatataaaactgaaaaattactaagatatggtacagaggagaaaaagaaggagaaatgtaagaggttgtgaaatgtggagggaaaaaaatgagaaactctaaagtgcatttaattagagtcttagtaaaagagagtgagggtgtagagtataggaattacataggagataatatctcaaaatttccagaagcagttaaaatcattaaatgacacaaaatgtaaacacaagatatattaaacaagtcaacaaaacaaaaacaataattcttcacaacattgttaaattgaagaacaacattaagaaaaagagaaaagagaaaagatcttagcatcctaagagaaaatttgaatcacaaagaacagtgagacagacagcagacttcccagcagcaacagtgggagataaacaggagtggaatatcttcaaatggtgaaacattttctgtcagtagagaaccacaaaactctcctgcaagaataaagtaatcctcaaaacattttcagattttaaaagacctggaaaacctttaatggaagagctttagcaagaaaggaaatgattccagaagaaaaagatatggtatgaaaagaaatggatggcaaagaaattggtaaacatgtgtataaaactaaacatgagaaatataaatataaaaaataacattggtaacacctaacttgtgaggttgaaaaaatagatgaatctcaaagactgggcagtaatagcaaagggacatgtaagggattagaagaccttatattcttccaaagaatgaagaaagttaatgctacactttacactttacataacttcaaaggaatccaacaagtaataagaataaaatttaatttccacacagtgggagatgaaatgaaatggagtctggggcagagaatataaaagacagcaagaaggaagcaggtgaatgaagcataatgaaagcaagacaagcgagaaacaataaaatggtagtaaaaaatgcaaagctgaatagacacaaactcagcagttaagagacatgaggcaattacaatctctttggacaaatggaatctagtcacagttaataaacaaaaaatgaggtccagagagcagatggtctattactaaaaatgagtatatgcatcactaatattgatgctaaaagcagggagagaagaggcgggtgggagcaatgcaatggcaacatttgcattggcagtgatttgatgatttgacctcaaacttctgctcaatatctatgtgatcctgggcaaatagttagcctgcatttattttctaaagcaatagaattgagataggagtggtacctattcatagttattgtaggagcctatgaaataaaagatgtaaacttctcttgacagtgcctggcacagaggacagacacagagaaattattagtgtagactggaagggctacagagggttttatactatgaaaaacccttgaatttgaggaatgggtgagtggaattaaggatggttaacagtaagaaggacagaaaatagaaaaaccgagccaagacaaagagacaaaactaggaagatgagatgcaccgggcctgggtgggactcagacgaacggctggggaatct

SEQ ID NO: 59470 - DNA, 1347 bp, Bovine  19866880354417
aaataattgggtgaaacaaccctgggtgccgagcagctgccctggtgtcggagcccagaggagtcggcggcaataacagtcacagcgctgcctggttcgtgtcagagcaaatctttgaacagtgggctgtgctgacaccacatagtgacagctttggaaatggcgtgctagttaccgcggcgagagaggccgctcacggagacgtgacaagcagctgtcatttccacacaggtgaacagctgacatcccagcacggggagggcggcaggcaggtaaggcaggactgtgcagcgaggactcgcgagtgccagggacccttctcgtgggtggcagacaccgaccttggagtactcgcatgcacacacccatgcacccaggtcttctctgttgttcctgtagagctcatctgagaaagggctgtggaatacagcatcagcttaaaaaatttttttaatttccttttggctgtgctgggtctttgctgctgcacgcaggctttctctagctgcagcaggcgggagctgttccctagttgtacatggacttgccactgtggtggcttctcttgttgcggagcacaggcttcaggagttttgtctcatagacttagctgtcccaaagcatgtgaagtcttttcgtgaacagggatcgaacccgtgtctcttgtgttggcaggtggattcttaaccactggaccaccagggaagcccccagtgtcagcttttgaggatatgaccaaggccgtgctgccagcccagtgcccagcctggcatgcttaaagaacgtttgcagttcaaatctacgccctcctcacccgcttgacgtgtcatggttggttttccaaacccagtatttagtctcgtagactcctagtttcatggtgtctgccgataagacgctaactcaccattaaaaggaatggatcagatggaattcaggtgcaggatcaggtctgcatagtggttctcaaagtgtggtccccgaaccaacaatatcagcatcccccgatgccattagacgtgcaaactctcctgcagcaggggtccccaacctccgggccatggaccagtaccccccatcagatcagcggtggcattagattagaaataaagtacgaaattaatgtaatgcacttgattcatcctgaaaccacccctccctcccacgtgtgtgtgaaaaaaccgtcttccatgaaaccggccaaaaaaggctggggaccactgctctacaggatcagaagctcggactgtggcccagtaggctgtttagaccaagtcttccaggtgcttctgatgtgggtgagaaccactggactagatcaggaaagcacgtttgctggtaaggttt

SEQ ID NO: 59471 - DNA, 790 bp, Bovine  19866880360005
cggcccggcctcgggagcgccctccgcctcccacagccccaggggaggcccagcccctgcagggaccctcggatcagggcgctcggaggccgttggtcgggggggaccccgggagaggggatggcacaaacttgggatgtgggatgcacaacgccgtgccagccctgcccccggtgcctcgggttctgtccccgatgtccactggggaccgtctcggggaccacgagggcggctgtgaaaacgctccccataaagaagggctcatgcagaaagatctcacccctgcttcttcatccagtgtcctgagcctcggcctctgcacacagggcggggccgcagcgagggttcagcagcactgtgtcttttcatcagcctgacagccggctgcgtgacagcatctgctcaacccctggacccggggccgctaactcgcctgggggcggggcacgctcgtctccctggctcaggtcccccgcatcccctggttcgggggtgtccatgcgggtgagtgcctgggagtgaggcggtgatgaaaaggacaaggagatttgcatccctggcctcctgcggagacccgatctgccatcctagtgggcagcaggtgcgcgcgcctgccgttgtccctaatggttattaccagtgataagcaggacaaatgggaggtcatctctcctgccggcaggtcaggggggctggatttagagcccccaggagatgaggaaattagatggtcggtgtccgcaatgggggctgtcaccaactctgggctccagtgatactggaaagggag

SEQ ID NO: 59472 - DNA, 1108 bp, Bovine  19866880537298
atcctaagttgtttagatgctgctggtcaagcttcctattacttgcagctaaatgcacttctaagcaacacaaaggccaggactactgactggatccttctttctccttttcacctctggtctctaaggagcaagtgtcctccttctgctactaaaaattctcctctgttcttaattctgtcccttaagacctccttggggaccttgttccatcagtaatcccttattccttctccaataattccaactcaacctaaaaacacaatcatgtttctccaatctcaaaaaaaaaaaaatttcattttacccccttctgcgaggaaaatatctttgggttcagcgagcatatttacttaaagacttgtgactttaaccttgaccacttgcttgttcactttttcgcgtggtaacgatgtactgagcagaccaatgtgcaaggcgtcatgcaagacacagggggctccacgggatgcgggagcagacctgggcttgcctttggggagcctcgggtcgtcagctcatcacaccacaaatgcaagatgtgaagcaagaggagcttcacacctccactgagcccacatggtgcccctgggcagccacaaggccctgtcggattcttatcagagccaaacggtacctcacccgtcagtcatgggtaagagagtggccttcaggctggcacccgagttaggtcctggctcctctgtgaggtagttacgtgatgctgaggggacgctgagccaagtgtcctcacctgcctggggctgaggctgttccctccaaccccgccttcagatgacacgagacatggcgtcaagagttcggcacagcgtctggcacagagcacacctgctgaagggcagccatgagcactcttgctgtttgcacttctcagtggacacaggtgagcaaacagggaaaagcttgaagatggacagaagccatttcactcaggtcttttttctttttgagtttaatgatccctccatcgaataccttctggtaaaataaaacttgaaggacagaacacactgcctttaggccttgtccccagtcttatcaagacaggctgtataccggttaaaacagcctagctgacctctgccac

SEQ ID NO: 59473 - DNA, 2032 bp, Bovine  19866880594276
ctgggctggatttttgtatcattttattgccgagggaaactcatattctgcaaggatttctgcttgggaggtgtttgaagacgtgatactatgctgcacaagagcagaaacaatgacctaaacaaacaaaagcagaaaccaccgctgcctctcaaagagaacaacaggaatcttcccggtaacacacggttttatttcatgcataaaataccaacaaggaaaggcgctgtagaattcaatttactaaacattccttttggttcttactgcataattctgaaggtgaacagaatttggacttattcttcagtcaaatagtagtcagtactaacccactccagtattcttgcctagagaatcccagggacagaggagcctagtgggctgccgtctatggggtcgcacaaagttggacacgactgaagagatttagaagtagcagcagcagcagcaaccctatgtagaagggcttccctggtggctcagatgacaaagaatctgccagcaatgcaggagactcaggttcgatccctgggtcagaaagattccctggaataggaaatggcaacccactctagtattcttgcctggagaatttcatgggcaaaggagcgtggtaggctacagtcctgtccaggctgcagagagctggacacaactgagcaccatttattcttttattaaccctatgcatagggcctaagtaaaatgcatagatctaagatgtggaatctgtacctgtagattacgcactgtgcaaattatgacttatgctttgacatcattaagatgttcattcaaattcaaactggcaaaataaatatgtggacagatacacagaataaatatcaaaaactcaactgattatcagtgcaactaggaaagccagtcattttggaatttgtccagagaccttgaccaattagaattaggggctatttggatagccctttgcacagagtttatttatatgcaagatctatttaaggatggagctaaaaaaaaatcagccaacagagtaaccttgggaagagaccaaacttttgaaagcattaactttggtaacttcagaaacggtgaataactgagagactgtaactaaagtgctcgtcactcagtgcgcactcagcagtccagcagaggaggtctacccgccctggcacacaaagacgtgtgtgcccttttccacaggcatggacttctctccccaaacctacctcagagtttgcttgcatcttgctcttcctaaacctggcacccagtccatgctcaataaatatgtgtgaaagaatgaattcataaactacctgagtcaaacatctcagggaaagtgtcacagaaagtgtttaattaaggagaccaatgattgaacagcagttgatggaatggatgctaacgtgtttgaaggtggtggccatctgaatgcatctatcagaaagaacatcagtataattccgagataaaagtaaatcctaaaaaaaataacaccatacacttgtaagaatccaatgttaaggttattcttttaaggaaatgaggaaacttgaaatcctaaagtatttcttcttaatttggactcatgtcaagccaacggaaagcaactggacttgaacaggaaaagggagcagggtgctctcatattgctaaaacgtaacagccgcattatcaacttcccaccgatcagattttctgttttgtttttaaattgcaagatggtgaaaggaatagaaatatggcttgagggaaactgatttacaaatgtcaggaggtagttcaaggggatctgaagacatgttgaactgctgtatcacagaactaaaccctgattcctttccttctcttcatgaggtacttaatgtttgctcctcttagaattcatcgttttcataactaggattttaaattaaattatatgtaacaacagtctttattttaagatggcttgaaaactccgtcttctatatcataaacaaggaaggctaggattactataaattgtctgcaagaaaaatacaaattgccaagataaaaa

SEQ ID NO: 59474 - DNA, 1273 bp, Bovine  19866880595759
atggggcgagtgtggtgttcatcagagagggagctaggaaaatgattccagggtgggctcagtgagagactgaagacgaagagaagggtaaaaccattaggccagactgcagcgagggcattcaagatggggcgaggggggagagtgaatgccatgcctgtagactcttcccagtgagaggacaaagtgaggggaaagatcaaagtaaatacagagtggaggaagccgggaaggcacagccaacaggaaagggcccccttaaccccttgaaggcagtggctgttgtcatccgtctagtgctcagagcacctggtacattccaggctcagggtgcagtcgttgataatcatcacagttctgccgacagagtacagctggaaatgacttgtccctccctccccccagtctgcaggaagctgcttgtgtttggtaacgaatgggaagagtcaggaacccttacagccagggatcagcccggaggagctagttaggagccaatgccagttggggcaggcagctctcacacacacctcactgtgagcttcctttgcccactgtgctggtgatgcccggcacgcttggagctctgcagccttcctctttagacatgtgccctaaaaaatttcacagcacgcacaagaattaacaatccctgcaacctgaagagaattgactgctgtctcgagatgattctcaaaaatctgccgatagcaacacaaggcattataaatccttccaggttggttctgaccatgttgtagaagtaatttcagctggcatgtcacatgaaagaacagacttgaaaacagtggtgtgcgcagccctgaaggtttccacttggctaatgttctcagtaccttatggcactagtttggattgcagcaaaggcaccaaagaaaatgtctgaagtctggatttactctgtgtgtgtgtgtgtgtgtgtgtgtgtgtgtgtgtgtgtgcacgtgtgcatcttcatgtatattctcacctctgaaaaagagaagtatctaatcatatagcactctatttgtacacccttgttatgagtctagaggaagattgatcactcggtattaatgaggatgttggtacacacttgtctactctcacttggtgtacatgtatttatgtatgtacagtaactcattaagtatgaaaatgagttatacctggtcagtccaagcatggggctagacaggaatgtagattatcagtttggagaaggatttttcactttgtggacatttgtatatgcagaaattcctaagat

SEQ ID NO: 59475 - DNA, 1591 bp, Bovine  19866880617936
tacacttcaaaaacacattgccttctgtgcttacagtcatgtcttaaaaatcacagcactgaatgaattacattatattaataaaactgacagctgatgaaataatgcaagaaaaataatctactaggtgacctcaaatgaaaccacaaagacattaggctaatggaagtaaaatcgctcattgcacagtgattttacttttcaaattttatactcaagtaaaaaaagtcaacctaaaccttcctcaggatattacatattgaaactaaccacaaaatacctccagaaaggaggcttatttcagaaaatctatatgcattttgattttttcaagtgtgagcaagctttctatatcacagggtggttaaccgtggaagaaaataccacagtgatatgacataagtgaagatcattgatctgaaatagcctataattaccattttaagggtagaacacctgttttactgagggaacatacatatgcagtgcacttcctcactataacgacaagaagagtgaatgatggcccagagtttctcaatctccatctcttttctctgactttcacttctgtggttaggcggtgagacagcccatgtgagagagacatggggatgcagcctcacttcccctcccctcagaagctgagcacttctcttcactctctctgcgaagacaacaggagtacaaaggtgaactttcatgatccacgcagatcccattaagacagatgaacccaagtctggctgcaccacgtgaggcatgcgggatcctagttccctgactggggatcgaacctgcgcccctgcaatggaggcactggaagtgctgagtcttaaccactggaccacagaggaagtcctcaacaactttttattttcaaaaaatccttccatcacaaaatcgagctccagaggacagcacatataattgggaataataaacacaggtgggattacgcacaggtgtttcagagcagcataaaatctcttgtgactttagaaataactgcagtgcttccttcatttcagtctttagaggtaagagtttagttccttaaattttcttaaaatttcagaaagccgtatgactactgggttacatcagagaataaacatcctttggtccgatctccagtgataaatggaactttcctctcctttacaatatcctgccaagtggcgagtgcttggtgatggcaagagcactcattcctgaggtaggtagttccatgtttacaaagctccactgtgagattttagctcagagcaagaaagagctctctgtcttcctgtagtttccatacattcttcctagctctatccttagacatcccacaaggtgattctaatctctttttcacttgaaaggattttaggtacagcagtgcagaaagtctctatattcctcagaactttctctatattcctcagaacttgtcttctctgggcaaacatttatagtcattttaacagttcacagaactgagcttcaagaacacttcagccatcatttgcttgttcatttgtgtgttcattcattcaattattcaggtaaacatttgtaattatttcaagtattcttcataaga

SEQ ID NO: 59476 - DNA, 1803 bp, Bovine  19866880927038
ccccagttcttcgcactgaagtaatgccttgtagcataaatgcagacagccgctctgcatttaatatcagaaatgtaaatcaaaagcgtccagtctggttggaaatggcttcagtcttccccaggatgaaatctgtggaaaaaaaaaaattctctctgctgcttctgacaccactgctttggcagacaggccctgaaagaggctgataattattaaacaaagtatcttgtttccctactgaggtctctggatcgctctgtcattagattggatttatttctagggtttcattcatgctgtgacagcctgggattgataagttctgtgttttaatttcaggcagaaatgaaactggtcaaatgcaatttgggaggggaagagagcccttgataagatggctatgcctcttaatgccaagacacagagccagaataaggaggcatctgggtggggccggccagggggtgcaggctgagcctgcagccaaagctatctgcacacccagagtcggcctcggaggaaggacagaggcaggaaatctgcgttagtgcaggcccagagcacctctcaaacgccaggtcccacgtccaggttcgggagcaccatggccaggcgggtgtagtggtggtgactgtgggttttcctgtctcctgggctctgctgtcatttcacagggcagagggctggcccagcccaacccaagacgtgtgtagcttctcactgcaagtccacactgggcttctcagggcactggataagctcagggtccatgtttttcttcatagggaagccacaatcactgactcctctgatactctctttggctccaatttacttactgagcaaacgcccagttgagcactatttcacatcttagggctgcaccaatcaccagtggagagtagaaagaaaacctgattaccagtgagctcagggcagggtaattaagatgctgcatggaacagcagtggagagccctgacaggtcaactcttggcggtcctgatgctgctgtggaaacagctagactgactggaagttggaagggtgttgaggttgtcagtggggttctgtggatttctgtagtattttactgtgctcaaagcacttccctgaagaatttaagctttcaaactgtggtgctggacaagacttttgagagtcgcttggactgcaaggtcaaaccagtccatcctaaaggaaaccaaccttgaatattcattggaggggctgatgctgaagatgaagctccaatactttagccacctgatgtgaagaactgattcagtggaaaagaccctgatgctgggaaagattaaaggcaggaggagaaggggacaacagaggatgaggtggttggatggcatcaccgactcgatggacatgagcttgagcaaattcaaaaagatagtgatggacagagaaccttggcatgcctgcagttcacggagtcacaaagagtcggccccaacttagtgactgaacaacaacaaagcactctttcacgtgggcaaggtggtcctgggcacagatttgggtgttttacttctggatgcctggtacagcgcccccgcagttcagtgagagactgatctgagcctcttgaccggggcagcaggcgctaacctttatggaacactgcgtgccaggcatgtgggccaagcgcttcgtctggctgtttgctcttatttctccgaaggaggtgtttggatgagtcacatgaaattgccatttttttgttctgaaaagagaatggcaaattttcgtggcacatactttcagcagttttatgaggcacaatcta

SEQ ID NO: 59477 - DNA, 1699 bp, Bovine  19866880952280
atagtacagtagacaattaacattaactgttgctgacttatgtttcgtttgctccacccctcctcctgaagccctagaaacaccttcatctcaagtatccatcaaaatccagactcaccatcttctgctcagcccacacctggccccctcccaggctggtttcggtgatgacatcacccacgcaatcactcaactgccggagtgaagagtcttgtcatcatccttgactccaatcttgagcagatctatcttcctctctcaccccgcatcatcgattctgttttctaagtcctctccatcttcacggccatggccgccgctttccttcaggcttttattttatcattacaagaggctaatgacggctttccaaggcccaaggtctcttttgtttctgatccaagtctttactgaacagagtggatttcctaaattccaatttgctcatgacacttcccatggcctagagggcaatgaaaatgctacacggcttcccggctcttccactgccctctgctcctccaactcagtgcttctcgggctttctgtggaaaggaccatttgtttttgttttaattttcaatatattgtagaccaatactttgtaagatacaataaaaaataattgctagaaaaatggaaaaggaaagcaaagacatataaaaatatgttattagatttaagagatgtaaaattattctactgaattgctgtaaaagttcccaaatgcttactctcaaccgctatactaatctcacagtaggcagttacagagagctcacaggctggctttggtctgcatccacgcttggagtggtataatcctaacacatccagtcacaccccggtatactggatcacactctcaggtcctcccatcttcgcacttaacaatgtcctctacctggagttctgttcttccaagtttccccctaaaaacttataattcacctttaaaaatacaatttcctctgagtcctccaacactcttcttggaattgagaattctcagaattccagtactcttttcagaattaattgcttctgtctccatatcttacaaaactgtcttttcactgttggccacaacagtcttcccatcagagcacgggccctgtgaaggtaagggcctcgttcatcttcctccaggccttgagacacaagcagccgctcaatcatagtgataaatccatctcactcattttcagaattcctgatttcatgcagtataagcaaacgctgatttaaaagacaagtaattccaaagaaagaaaggcacagaaaacactgactaacttaactgcttaatacaaaggaacgtatgcttgaacacaccaggtagggtaaaaattattagcagaagcaagagaggtggccactggctcagcagtaaagaatccacctacaatgcaggagacacaggagaagcaggtttgatccctgggtcaggaaaatcccctgcagaaggaaatggcaacccactccagtattcttgcctggaaaatcctatagacagaggagcctggctggctacagtccatagggtcacaaagagtcagacacgactgagcatacacacatataagagagctggggcccagaagaaaagatgttattatttagtggctaagttgtgtcagactcttttgcgaccccacggactatagcctgccaggttcctctgttcacggatctccca

SEQ ID NO: 59478 - DNA, 1171 bp, Bovine  19866881018209
taatgatgctattttttagttagaggagaaaaagacacacacacaagagacatgcagaatgctgcccgtgtgatggtgtccctgagagcctgatggatgctggtccccagaggtccttcgagggcacagaataacctcactgtttttcagggcagagcatttctctgttttgatggttctcctgcatttttgcagtccagcatgtgtagctgaggacttctgtccagctcaccatgtgagtttggatttcgattctgacattagcggaagtgattgggtaaattattcaaccttgctgtggctttatcccctcatccataaaatggggaagataacctgtagctcttgcatttgtgtattaaaggagaaaatttaatgcatttcaggctgttcacagtgctgtgctcagtcatgtctgactctttgcaaccctttggactgcagaccgccaggctcttctgttcattggatttttcggggaagaatactagagaaggttgctatgtccttctccaggggatcttcctgatccaaggatagaatgcttatctcctgtggctcctgcattgcaggcagattcttaagccactgaaccactggggaaacccaatttaacatagcgctaggccacagtaaatgtccagtaaatggtggtcattggtgtcctcaccagatcatcctctctgtcccttaggttggtcccttgtgtccagcgtgggagatgactgcggtgctgggaaggtcagctacgacctttgggtgacagatccccatcaacacaagtaccccctgcacttgtacaatccacacccaggaagaccaaatggtcttcaggctccaaggagcccatttcctttacaggcggtgcctgggagggagaagaactggccaaacaatggtggccaaggtgtctgaaggtgagaggtgcaaagcacgggtacggggtcctccaggcgttacagcttgcctactgtgttcttcaagatgtgagaaaagcagatggctatgaggagaggccctgggctcaaaggtttccatggggtcaatggacgggaagagggaacctccaacctgcccacccaggcggcaacgctcatccttcccaggtcagagaaggcacacagaaggcagctcgtgcctggtctcccttctggagaagcagctatttcca

SEQ ID NO: 59479 - DNA, 1860 bp, Bovine  19866881198248
tttaatacgatttaggagcagaatgtgtaattgttgttcggtcgctcagtcgtgtccttctctttgtggatcccatggactgcgccatgccaggcttcaccgtccttcactatctcgtggagtttgctcaaactcacgttcattcagtcggtgatgccatccggtcatctcatcctctgtcgtccccttctcctcctgccctcaatctttcccagcatcagggtcttttccaatgagttggcgcttcacatcaggtggccaaaatattggagcttcagcatcaatccttccaatgaatattcagggttgatctcctttaggattggctgatttgatctcctttcaatccaagagactcccaagagtcttctccagcaccacagttcaaaagcatcaattcttcgacactcaatcttcttaaagaagtcacatccatatgtgactactggaaaaactacagctttgaccatacagacctttgtcggcaaagtgacgtcagccttcttatggtgcaactctcacataatagactgaattttaaatagtttcttggtgctaatgttaatatggttcttcctggctatcaatgtggaagctatcctgcagttcgggaacaccgtctacatacattgcctcttggggagtagggtacagcttgtctttcctcctgctcccccaaggcaaagttggaatcatctacttttctggaagaccttagtagaaataacagtagtatttctgtgtgtgtgtgcttagtcatgtcccactctttgcaaccccatggaccatagcccaccaggctcctctgtccatgggatttcccaggcaagaatactggagcaggttgccatttcctactccaggaaatcttcccaacccagggatggaacccatgtctcctgtgtcttcctgcattggcaggcgggttctttacccctgaaccacctgggaagcccagtatttctgtatactggaggcctgctgtattcctgcccatgaattagatgaaaatactcccatctttagagctaatagttgccaggagccgtatcctacagacaggctcctcaggtgccgagattaaagagcctgtgcgatcaacagcctgtatagagattgcagcccagtctgtctcatgcaggaacacacgctctttccgctagaccccatgacccaaagccctgactggggctcgaccagacctttggttgggcaggttccatctcccctctgtggatggtccgtgtgcttcaagggggagaggagcacctgagaaaggaatgttcatgcaccagttaaaatgagtgtcgcagcctcttatccccccttcatattcacaaatgttcacttctttctttctgtttttttttttttttttcattcttcctcgggatgatgactgacagattaatatatgtctaactacatgtctcagaaatcaaaaggaaggtgctgtcagaatcacttgtcagaaaatgagattaggcgcagttgtcatttgctgaggattgcagtctttcagagataaggtttcatttaatgaggctaaaaagcctcctttaaaaaaaaaggaagaagaagagggagttagggaggggtagaggagaaggagtgatgattcttttttctggtgtcagccgagagttttatcacctgacgcgatcccggggtacctggtagccactgataatggcagcctggccttccccacctgctctgcaagcagccttcagaagcggccgccgtgacctgcttttacctctcattggaagctgaagctccttctcctgtagaaaaggggagcaaagcatgcactctagatttaaaagcaggctcaagaaagcatgcggtataaaggaa

SEQ ID NO: 59480 - DNA, 1126 bp, Bovine  19866881210515
atcttgttacctgactaaggggagattaggggaaagtgcatgggattgagagtccgacacgactgagagactgagaaagcacaaaagcacatatcttataaagagagcaaggaaaaaaaaaaagcaccctcagtgcaggtgattcaagaaatctgattttctcaactcctacttctgatatgtgaccaagttactggctttaatgcacattcagaatctgcctgcagtatgggagacccagcttcaattcctgggtcaggaagatcccctggagaagggaatggctacccactccagtatgcttacctggaaaatcccatggacggaggagtctggcaggctacagtccgtggggtcgtaaagagtcggacacgacggagcaactaacatttccacttttcatacactttcaaatttattttagaacagattaaatttaaataataaattgaagtgaaaagttagtttatgaaagctaagttacatgataaaacatgtccacgctcactaaatcttcaaaaataaaaataagacagtaatcaaagaactgaccctttaagtctctctgaaatccacaagacttttggatctaaaatattaacgcatgaacatgttatagatcttttaagaatttgcaagagatattgattttctggtttgttaaggcgataggcacagaaaattgtttaaaattaatgtaaagaatgtttcagcagggatcataatgatttaaatttaatggacactcgctcctgccttctgggttcctgagccccacttcccttatcaattaacctgtcagcttgatagtcaagtctaattagttaaatccttttttaatgaaaagattatgccttaagcatcctgccagttccagggctgttggcaactacaaactaatctctgcaaatttagggggtgggggagggaatccttaaactccagtggaatctggagctccaaaagctcatctaagttgtaattatttatagcccataacgtacagcaaacctgcagcgcacagatgccaaggccctgatctcttcatgggcttccctggtgactcggacggtcaagaactcacctgcaatgcaggagacccaggttcgatccctgggttgagaag

SEQ ID NO: 59481 - DNA, 1956 bp, Bovine  19866881226484
ttcagttcagtagctcagtcatagtatgtacatattaagttatgaaccaaaattgagtgggaggagatgagtgaaatttaaaaattatgacaagtagatgagacggactgaagttaaggaggccagctgcagtattaacaatgcagtaatatagtgcaggacattcataagtggagtgagaaagttatgtggtgctgagcaggctcaacagatgagtaggggcatatgtaaatacagtagctagctcagttgtagattctagagcaggacttagagacctttttctgtaaagggccagatagtaaatgtttttaaggtttcaatcacaactgctcaactctgcagttgcagcagaaagctgtcatagcacataaatggatgaacataactgtgttccaataaaattttatttacaaaaataagctgcagaccagatttggcccatgagctgtagtttgccaatttctactctacagtacgtaatttatcttatttacttgtttgtagctcaaagcattgcataaggtttgaggccttgtaaaaatttatagggcttccctggtggctcagtggtaaagaatccaccggccaatgcaagagacaagggttcggatttcctgatctggaaagatcccacatgctgtagagcagctaatccagtgtgccataactgcggagcctgtgttctagagcctgggagctgcaactactgaaacccatgtgcctagggcttgtgctctgcaacatgagaagccacctcagtgcccacgtaccacagctagagggtagcccctgctggccacaactagagaaaagcccgtgcagcaagagagacccagcacagccaaaattgaataaataaatgctatttaaaaagaatttatacaacactagatgcatatagcaagttagagggtcactgggacctgctgaggttttgtgggtaggaatagagtccgctcctgtttaccctagattgaatgcatacactgctagcaccagggagtaacttgggagcaaaaccagtgtctgtggaccattttgtttccctgtcactgaatattacacacagcctgctttgaggacctatttagatgcccttcatatggacattggtggaagccttccagattcagtagctaattatctcccagtgatcattcagaaagattatgctcaattcctatttgactataggcaaagagacccctcttttcagtgacttggaatactcttagatgccctgagaaagaaggtgggccctcagcacctgaggggtgatggtgggacaaggggaatctgcatctatactggggtgtgactaaacaggactaactcaacccctccatcccctaccaaatgtaacagaaataaaacatcccctctatatatgtgtatgtcctttaataatgcctcttgcagtgatctaccctaagaaaaattctacagtagcttgtaaaaatttataaattatgtttgaatttcagtctaatttattaaacaggaaattggaaagaagttaaatatccaaagtaccgtagaattgatgcttttgaactgtggtgttggagaagactcttgagagtcccttggactgcaaggagatccaaccagtctatcctaaaggaaatcagtcctgaatattcattggaaggactgatgctaaagctgaggctccaatactttggctacctgctgcgaagaactgactcattggaaaccttgatgctgggaaagaattgaagggaggaggagaaggggacgacagagggtgaaatggttggatggcatcacccactccatggacatgagtttgagtaaaccccaggagtcggtgatggacagggaggcctggagtgctgcagtcatggggttgcaaagagtaggatgtgactgaactgaactgaactaaatatccaacaagagaataggtaaatacagtatgctatatatgag

SEQ ID NO: 59482 - DNA, 1045 bp, Bovine  19866881274606
ttgtgaaactccctgagtacttggagagcaattcagtataggtcacaggtgagcagaaagtttgcaggtgtccctaaatagcctctcattccccattagcagatcctgtggctcccaacctcccagggcagggacctctcttagggcacctgagacgacagggcgagtcctcggggtttccaggcagcttctctctgcctttgcaacgtagcttgaatatggcagcaagagaatttcagagcagaggtgtcgaaagcaaaaccctggtctggtcctgctctcaccctgcaagggcctctgcacctatggtgacaagcccagcaaccttacccttgtgccaggccatccaacttgccaggtgcccgctcaaacttgcagggcaggaaacccaagctccaagtcccgacttggttagcatcacagatcagatgatggcacaacagaatgtgagccctggtctgtcgacaccaggccccgtgttattatctgagagctctactttacaggttgctaaggatgaatgatgggatgttttggtttttgttctgtaagtagaccctctcccaggagggtcagggcctcacgacaccacgcattagtgtttggtgttggcaccgtgtatgtccctttgtagtaatatattccgaaagctctggggtcaccctcggtctcgtggaggaaagtttcagaagagagcagagaggttggagcgttagggtatatcctgagtgcacttcaattctcgctttctcccaggagcccttcaggtggccgggtggtgattagaggatgagagtcactgttgcttgaacacagtcagcaacagaaccctggcactgggagttgagtgggtcagaatgtttgtgttctgtggctagcccacacgcagcagcccaacttctgctgttgtccccagctgagcactctcagatgtgccttattttgtgtgggtatttttgttgttgttcagtcatttggtcgtgtctgactcttggtgaccttacgggctatagcctgcaaggctccttcctccgtccatgagatt

SEQ ID NO: 59483 - DNA, 1846 bp, Bovine  19866881744040
aaatgtggtatatccatacaatgcaaccctatttatctacttaaggagatgaagtcctgacacatgctacaacatgaatccatctcaaaaacattatgccaagtgaaataagacagacacaagaggtgacaccgtatggttccatttctatgaaatgtccataacaggcatctccatagagacagaatgcagacgaatggccatcagccctgggagaggggtgtggagagcgactgctaatgggtaagggggtttctttctggtgtgatgaaactggatgtgaaactggttctggaatttttactgacagttgcacaaaaccttgtgaatacacaagtcacaaatgactgacttgaacacttggaaattgagaagttttattacagagatagaatgtgaaccttctctccttagaattgttattaaaaaaaaaaaaaggctgccttggagggggtggttctcaaacttgagcatgcagctgtgtgtggagaactggtttaacacaggcaagctgggcgccacccctacagcgtctgcctccgcaggtctagggcgagcctcaggactctgcgtctctgaccagtccccgtgtggaaggtctcgctggtctggaggcacattccgagaaccccagcctagagcggtgcctctccccactcccgtgtgcctgctgggcaccatccagtgaaggaatggctagccagctgccaggagggctggcagtaggactgcccagcaaggggcagagaaggccgatgctgctctggagccacccacgtggtcagggaagcctgtctccaggcgcagaccccagcttgacctctccttccacctacctgcttccctcccacacatgctgatcctcccgcgaaaataacgagcttgctaaacgctatccgtctgcatcaagggaggtggcaatctgtcaaaacacataccatatcaccggggggctcttgttagaaaaggagattctgatttgaaaaatcagggcacaggtgtggggatcagcatttccgacaaacttccaagagaagcccaggccagggtccctgcgatctggagcagccttctgacgccacgatgggaagagtctacgagccagcagcttgggcactacatggaaaaggtcatctcactttagaggcaacaagaaggcgctgacattaccctgcccttgagatccaggccaaggaaccgggttatgggtgagtgtgtttcaacaacacctttcaggtactccagtagttcatccctttggactggggcccagaccaacataaggcataccttcttctatgctctattgttacagcatggctgcggggcatcacttgggcaaaagtcagtcatgtgtgttgtgcaaccagcagacaagtggtgacggaaacccacaacacagcctgtccagggagcctgagactgagtgggaaagaagacaaaaaaatacacaagcaggggttgtgaccaccaaatcttttccagtgtcttctgccctcagactaacagtgtgttccgagagccgagaggccactggtgtcttgtttctatgtcggagcctttcactaagggtttggaatctactctgaacttgctgggagccccataatctatttctcgatttttctactagttcaggctgattttagacgaatggaggggtggcagattataaaaagaagagaggtaagttgaaaccaaaccttcaagatgttatcatggagggaaacttccatgccatcacaccaaacacccactatccaggacaagaatcaggggactgggtaaaccaggggcagaagtttggaaagaaagaataaccatccttgactcttgtatcacagaa

SEQ ID NO: 59484 - DNA, 675 bp, Bovine  19866881833019
ccccttgccacatcagagaaggaaacaccccgaagaagaggtcgggctgcagggtgcatggctcagtgcaaaaaccacctctcttttaaaacacagctagaagcctgccctgccttcctcggagcagccaaagcgtccatgtggcctctcgccatcccctccatagtctgagcagaaatagcacctcctgcatcatggcggctggtggctgctggggctccctgggcccccccgagccctgacctaggaactgacccccgattcccttgaagctaattttcatcagcaccagcttctcggtctcatcagccccgtcaaactccacatgagctaagggttcttttgtttgtttgtttcttaagttctcagtctgtactttgggcaggaaatggtcctttagcccctgctcccatacttaaataaaaatgctctcctgttctccgtgatatatttgcttattggatttgtttaatgaaatatggatttatcccataaatattggagttggtgtagtccatatttcaattaatggatcatttatgtgtcatgctaactttgtaattactgaaatgtagaaatatacgtggattgaaatgagtttctggtcttcttggcattcctgccccccatccaaccatgtctgaagagcttggatccgtgaacaggaaggattga

SEQ ID NO: 59485 - DNA, 1059 bp, Bovine  19866880421406
attgggtggggtagggagagggtcacaaaactaggagttgctcttgtatttggtgctaagaaacacagggatgctgagggtcctgcaatgcctgggacagtctttcacaagagattattctttccaaaaatgctaatagcatccctgctcagaaacatagtcacagaggcctgagcagctggaagaacctgctggttcttatcttccagggagaaagctctattgccctaacagtggcttcagttggagttgctcctctaggttactccagggacactcagtcccattcaggtagctctgtgcttggtggcctaggatcttgctgctgttcactgctgccatctttccccaggttgttaatgatgagatgtgtgatgtctgtgaagtctggacggccgaaagtctcttcccgtgcagggtctgcaccagggttttccatgatggctgcctacgccgcatgggctacatccagggagacagtgccgcagaagtgaccgaaacggcccacacggaaacaggctggagctgccactactgtgtgagccttggctgcagggacggttagccttgcactgctaaggactgggccctttccctggaggcccagtcttacaacactggtttctgggcagtgacctgaagagtgttccaatagtacatacaagggctaggacaggctttccctagctcagtactgttgacacttggggcacagtaattctttgttgtgggggctgtttgcattgtaggatgtttaacagcatccctagcctctacccattagataccagtaacactcacccgcagtggcaacaaccaaaaatgtctccagatgttaccaaatgtgtcctgggggaacaggacattccagttgagaaccactgagctggagaacagaatgcataggatgagacctagttattcaaaattgattctgcttggagcagtggtggtttagttgctaagttgtgtccaacttttccagacacatggactgtagcctgctaggctcctttgtccatggaattctccaggcaagcatactggagtggattgcca

SEQ ID NO: 59486 - DNA, 1605 bp, Bovine  19866880509585
tactttgtaattttcctacattacaattaattatattcttcttatataattttttaaaatctcagggttggcaacatgatgacttcttttagttttacatataacattctgtgactcagaagacattgctttattgccctgggttcagtttccatgtctataaataaatattggaacagagagttaccaagttccctggctgtgataaacatctagaatgatcatgtttattttaaaattcatttaaaagtgtgtgtgtgtgtgtgtgtgtgtgtgttagttgcttagttgtgtccgactctttgcaaccccatagactgcagccccaccaggcccctctgtccatgggattctccaggcaagaacactggagtgggttgccatttccttctccaaaaagaactatagaaataaagaaagtgaagtcactcagtcatgtccgactctttgcgactccatggaccgtagcctaccaggctcccccatccatggaattttccaggcaagagtactggagtgggttgccattttcttctccaaaagtccatggacctaattgcagcatccattgatagggcattagccatgaggcagtggaggagtatgggtgtatgtataaatgctttatagacttcatgtaggaatttcttgaagtgaaaggctggacctgtagtccacagacactgcccacaggcttcatgcacacaggctgtgaaagcccccaacttacagcaaaaggaactggcactccacacgcaagaaagagagtgcaaaacccagcccttcactgtggacctttctcatgatcagttactatttccacggccaccgtgttttcctcagaaaccttctgtgaaatgtttttcacattttttttttattgtgacccatagtaagaaatgtagtttatgatgtggttctctatacacagttataaacatatgttcagagatctataactgaactcaattttttatggagcaatcctaattttactacatgtgatttcccctgatattttctaacctctctatcctagttcattaaaacaatcctgattgtgactctctaaaatgatttcatgacttcctaatgggtctggacatgtaattttaaaaacatagccttaggatcattatatatttttgattagtgaactatacttttgtcttttgatttaaatatagttacctctagaagacaagggcaacattgtgggctaaggtatgctttccctttgactggagtgatgtgagcacagcattctcaagcttgtttttagagtctgtgtggttggaagttctagcagatctgttctgatactgatatacctttggctgaagaaaaccctgctttgtataagagcctgatcctctaacttgtggacatatgtaaaagcatatttattggagcattgcttttagtgatttaaaggaagaaacaacctcaataggaataggaagtgtagagcaatgattattaaatggtgagctggctggatcctaggcagatgggaagtgtatgtaagaaacttcaggaagagagggagaaagaaggatgaaaaagcatatccattattttatgcatgtttatatttagaaaaca

SEQ ID NO: 59487 - DNA, 1430 bp, Bovine  19866880825809
ctttaccttcagtgtaccttagatatgggtcttcctttctgagctgaaagagtcaggcagaatgcttacctacctgtgaaatgggtttaagctccataccatatagggtgtacaatctaactcctctactctctccatcacataccacattgaaaacaaggaggcacaaacacatggttctttgcttaaaggtatagagtttattcagagagggaatgaacaccagaatattaatggaaatgagatgatgacagccttttcaggaggatgcagaagtctgggaacccctgagctccttcttcctggacggggtactctcctggggttgacaagtaccttctgctgaggtggaaactgagacatgggatggattttctggctgagtggcacaagtcagcagaggactgcgcttggagctgccactggagaggggcaggaaacaggactggctggacctcacggactccatggactgtcgctggaactcactgtccaggcactggagcgcgtcaaagaagccctcctccttctccaacttagctcccttcatggggcgtttggtggaaggtggactcttctcagccttttttgtcttggttttggccactttctcatccttacagcggagaatgcattccttatgcccttgacctttcatgtcagggttaatccactgtgtaaaatgcttcagcttatttcccaggtcggcttctacagcttctggaaggataggctcttgtaagtatgagctgtctttaccagacgctgcagctcttgcccctagaaagggtggccctataaattttggccctgcaaagtctggatctgaaaaatatgtggatccttttaaatgcaaactgtggaacaccaagttggtcctataaggtctggctctttaagccctgaacacttccagacacggcattcgcaggaatccttgtttgggtgaggtcattcaccttgttctaacagccttacagactattctcatctagtcctttggtcccagggaatcttggaggatgctctaggaactcaaggtaagggagatgctggtgaaggtacggacaggggacactaagctgagagtttggagatggtggctctacagatccagatagaaccttgctagtccctactcactcaaggcaaccatcctggccaaactaaaattttacctaagaaagatcctgaagatacatttgagaagtcaggggctcttggagtttcaacttaaaagtgtcctactagaaccctggcacagcaaatgctctctctggatggagagagatttggcactgcaccccttctctgtggttctctgaagctttgcgtttccctatgtccctattctccctgctactgcagggagttatctaaacaaggtgattggtaacagcatctggtgaggcttactgctgcgggttcag

SEQ ID NO: 59488 - DNA, 1681 bp, Bovine  19866880851438
gcttttagtattcctgtaggatgtccctgaatccccttctgttctgtgtaacactgtctcctggtttctcagctaggagacattcctggaaagaagctgacaagctgtgggagctgctctcagtcatgcgaaggtgatctcttgctctttgcagtctcccacctcctagtatggcctgtggtaatttctgtgtttggcctgcggcagggttgggcagaaggagaatggctgagagggagccagacacatggagcctggagccctgggtgagagttggtggaggagagggtggggtcagacgtctcagtggagaggggtcttccagctgtgctctgggctaggctcacaaaggtgctggaagtcaggatttgacagaatttaacgatgtgggttttctcccaaccatgagacaagttacccagtcaggagagtggatagttaagtgcataaacaagtcatagttttcacattctctttacagccgctccctttcaagggcagacccctggaccctgctgacattacctcctctggttctgtcttcaggaaggccagttcctgggacaaccctcaggcaggagcttgtcatattatccccttcttaagagctctgcagaatgaggaattggctcttaagagatgtgtacatctaatccccagaatgcagagctcccacaggacttccgtggccccaagcgaggctgactccaggttctacctggtgatatctctggtgctgccccatcagctaaccattggctcccccacctgcctggttcccttctcctaattcagcttctcagcacaggtcagcagagagctcacccgcctcccagtttctcaaggccctgtatttccatccgttgtctgagaccttgcccaacaagctccaggctctcagcccagcccactacagcttgccaaatggcatttccctaggaagaaaagtagacacttaaacacccagtggttgcaggccccagagtttactggactaggggagggcaggcccagggccacacactggccaagagtaacaaacagtaacaaactgtccatcagtaacatacatttgctatgtttcccttcccagccagggctggctacctcaggaggggaatgtgcggcagatcctgtgtgcagatccctgctgccaaacctgcaacaccatggctctggagattcagcagttgttgggtgagaacaccctgatctcccccacttcaggggatacctctcagggctcttcttgccaagaggttttgtccatgtctaatgtgacttttgagcagagtctggagcatcgttccccacactccaaagacctttcacttccatctgcaaccctcacagtgtcacagaaatccttagtccagtcagtggcccagtcacctggtgcagccggcatccatgattactgggctgaacatctcaagctaaggcagggattccaagtgctagagggtccctcagggactgaggagcctagaatttcagtgaatctgcaggagatgatgcagagcaacctcagcctcatctgtgggaaccaagtccagcagcccttaaatccccaggtctctctgctgaccctgaaacaagaaattactaccctgacacatccagtggccttgccgatggtcactgtcctccctgcccacctgccgttcctgagtcctgaagt

SEQ ID NO: 59489 - DNA, 618 bp, Bovine  19866881061128
aactgggatacttttaatatctgctaaagccctcttgttgttttcccttgtcctccaacttagaggggagtttaccttgttcctgcctagggaagtcctcagaacctccaaacaatcacttatagttacttttgagcctttttcaaatagctgccattcccatacaagaaccatatgaagacaagtaaatgtacttgacatttagcatgcctagtgaagagactcctgcctatggagagggctgcttcccaggctcctcagaactacaaatctttatagagaattttggaagaggttccctcaccgtcttcccttttcttatttcttcaccagctcctgctatggagcaacccctcctccacttactcccaccactttgcccttataaataatcccactttgttgtaagcatgtgctctgcagagaatgggtgtgccttgcacgcacacatttaaggctgcccacatatgtattactgcctgacaaatgcatgtaaagacttttcttccctgaagaaaggttctggttgtcatctgttttagttttctccagatcatagactcagacagccctgttctaccttcctctccctcttactcccaccacctgctcctgctc

SEQ ID NO: 59490 - DNA, 961 bp, Bovine  19866881774801
aactatataggctgaaattgtgatcttaaaaatcaatgggaaaaattacagttgtttagtgacttaaaaaattttttttgtcaaaacattaaagagtccattatggtcagtggtaatgaatagggaaatgaaaaaagcagtaaagctaatatttagtacactttaattagaaatattgagatgtaaagttttgtgttttttttgtaaagaaagcttaccaagatactaccgctaaggattttcccttcctctgtctctaaattcttaactaatgtcttaaggcatacagagtggtctttcctacttacgagatattttggagggtgcgttttatatctttttcaataagtctttcaacactgaagagttatgtaggtgtaagtacttcattgattttgttaaatgaaaaatcccccattatttttgttcactactattcaaaagcttctgagtattaaaatcaaactactcactgattctttcaagtttcaaaattatggagtaatttgtataagaaaaaaaggtttaattttgcaatattatagtccatatacatggaaagtttgtgttctttgaaacactttttttaagaaggttgcatattgtagcagtggaaataatgttctcacacaccatctgaattgttttgctaggattcattagaacagtttctaccaaaagaagaaaaaactcatcaagaattgtttgaatagtgcttgccttcttataatgtaacttagggtatggagtgagcatcttttctatgcctttccaaattctcatattcctttccaagtctagatcaggttccaacattttatcttttttttttcaatgttataaaatatctctgagggtcactttaatgtgaactatttttccagcatcacttgctctgggacatgatcatcctttcctcatttatgctttgctcattcctctcgctgcttttctagggtct

SEQ ID NO: 59491 - DNA, 933 bp, Bovine  19866881789870
aagggataaaaccttgtctgaggtgtaattggttcagtctggtcatagtgtttccctacccggcagcagttcctgttaggtcccaactttaaacctcggtggttctttttcacttgccaaataattaatgcaataataatgatggagccataagtgtaaaagggatatccaacatcccacaaaataaaagtagggctcaacataatctaaaccttactagccatccctcttcctaggcttcctaggctttaagggtcttagaacctaacacctccaaatcctagacctattgtctctgcctcacagagcatagaaccaaaccagcagactgcatcacaaagccctcctgtttcctaagtcatgcatggcatcacagacctttatttgtctaggagaagctcatgtgacacagtgttaaggtgagggtgtctggttgactacatgggttgcagagcctgagcctaaagattccaagtcacaggaagcaaatactccttcatgccctctctattctctctatcctgatggctcagccttcagctctcagataacagtctggcatctatccccagataactgagtctttatgtacactgtgtgccctaaaagagagatagtggattggtcagacaaactccatgaactatatatatcactgttctgagaagataactaggaaacacacaagaggacagtgtatacattatcctattaagtcttggacagtgaagtttgatgtcacaggcaataggtgggcagtcatgaaaaggactgtaattattgtggcaagaaaaggacatagcttctgttcttttaaacaactttctgagttaaaggagtgctcccagtctgtgtgatcaagcttttgatggacaagaagaaactgtaaacagtgcccttccaaggaggaacatgatttgaggctcacttctg

SEQ ID NO: 59492 - DNA, 953 bp, Bovine  19866881825107
cctgttggtaaccctggggtcctggggatgtctgaaagtacgacacctgacgctggacttataagcctgacagaagtttgttaattacttacattcatagcccggggttggggaggaccctgcgcaccacacagtgctacattgggtcaggttaacgggagactgagagcgcttgcagcagcacagagcaggaagcatgaacttggttggggaggaataatgacaactgtaaaaaattcaagtcactttttaggtatcttgacttgctgctaaaaagccgatgcaagctgctttttaactaattattaataacctgtcattcgggcttcctgggtggctcagatggtaaagaatccacctgcaatgcaggagacctgcatttgattcctggggggaagatcccctggaggagggaatggcaaccaattccagtattcttgcctggagaattccatggacagaggagcctggcaggctacagtccatggggctgcaaagaatcggacacgactgagcgactaacacatatacacaacctgtcattcagttctctttaattggaaatgtcttctcattcctatattacagaatttacaagtttaggaaaaatgttgaaatggttcaaattcatcccattttcaggatgagactcttcttaaattatcttaaatttaaggatctattttattttgattttcttctgtaaaaaaggacattgaagaaaaatattcagtaatctgtttctttgccaaattattttcagaatattcttccttatagatagcaaaaaaattcctcatgccaatgactggtttttttttaaaattgtggtaaaatatatacaacatgaactttattcttttaaccacttttaagtgtacatcagtgacattaagtacattcccagtgctgtgcagccatcaccactgtccattttcagaaccttttcatca

SEQ ID NO: 59493 - DNA, 2317 bp, Bovine  19866880953651
tgctcagtatgctttataatggtcccatctataacactactatgctgtctgcccacttctgccttgacttcaaataagtttcatctttgttccatgaccaagcacaatgcttaatattatatgcttaatacaaaggcattccttcattatggaaaaactagcaggtcctgctaaaggacaccaggtgagccttttctctgtttttaatggagatggtgggaaagaatcagtaaagaaaatgtgaggtaaaaattcaggaatgtaactaggttttctgataagaccctcatttggttatttcttctccatcttcattgaacatgatgaaatctagtttaatcggaatcactgagagaaagaggaagggcagggaggaagggttgttcacaaagtgtggttctttgaagaagaaggagggaaatgagctagaaactggaacaggattataatgttaattatatttcctaattgtaattctgccaagcaccttcttcgtcgttttcccttgctccccatagtcactagactgcttgccctggctgagtggaagagatggtcagatgtacaaaaaaagaagcaatttttccaccttagggatgtatttattttgaaattccagagtgctatagaattatagcaaacataatgccaaatcaccctagagtaaagggatctataaagaaataggttcaataaaactagcagatacgtatcatgcaacttcagctctccaaatcctgtgtacctttaaatgactcaaaagtgttttgagccatacatggatatgcccttgcacacttctagagggtttcctcataaagccctcaacagtcatgaacagtgtcttagctcagttgctctctggttaatgagcagtctttacatcttcaaacggaagtgaagtccctgctgccactgacctggcttgatgcttttatgattttttcattcagtatgctttttattgagaatcaacattatgatgctcatgaacaatagaaatattgttataaacaagaaaagaatagtatttcttgagcgtctgcaaattgaacatacattatctttgcatattatcccttttaagtctaaatgcaacctccccagaaaattattatcgatattagtcatgaaagtggatctcatcttgattacagagaaattctgggttgatctgagtaagtattattgagaaagggtcctaaagcagtgatcttgtttacattctggtcatagttagacacttaaaagccttacctcacaacatctttatatgatgcttcctctatttgtaatttcctttaccattagtcattcttcaagattcagtcacccacttctgaagttctcctagatcctcatgggaagaagcaagtatttttcatctctactctcacaattaaaacccaggaatccctctaaaagactgtacaacactggatttaaaaatgtactttaaaattatacagacgtaagtattttttattccattttgtctcttaattatgtgatgttctgagaggctatgtaacttacacaaaatcccatataagccctataaggagaaaaattttgtcctgatcatcagtgatcccctaatgacaagaacgaagaaggcaatggcaccccacttcagtactcttgcctggaaaatcccatggacggaggagcctggtaggctgcagtccatggagtcgctaagagtcagacctgactgagcaacttcactttcacatttcactttcatgcattggagaaggaaatggcaacccactccaatgttcttgcctggagaatcccagggatgggggagcctggtgtgctgctgttctatggggttgcacagagtcggacacgactgaggcgacttagcagtggcagcagcagcagcagctggatctcatcaatgtatcttctcgtgtctcatgattatataagctgatagtctaaccccagcacccttaattttcagaggggaggtttcttgaggcttcaatgaaatactgagttttggagatatattgaattttttcttaattttaagtgaaggaattgaggggttagttgtctagtcttgaggatgggatccagcaattggggtttggatggcttagtatttgttattaattggcaggtaaggaaaaaaaaaatataccagaaacttcttcctaatggcacatttctgagccctttcctataatcaccaaattataataccctctttaaagaggttagtttcttttgtttcaaaaacaaagtaatcaaaatgctgaaaaattcagtcattctagttaattcattaaaaatttttaaatgt

SEQ ID NO: 59494 - DNA, 1420 bp, Bovine  19866880356039
tcttctgtctatgggatttcccaggcaagaatactggagtgggctgccatttccttctccaggggatcttcccaacccagggatcgaacctgtgtctcctgcattgcaggcagattcattactgactgagccaccagggaagccaaagaggtgaccaccagcttcatcactgaggtcactgttgcctttctcctgtcactttttacctttcagttgttagacttaaaatattatgacaaagcatctcaggatagtaatttttctccttcctaaaatgtaattttcatcttaattttaattaacttctcccatctagtaatgtaattctcctgggtggtgaaagttggagtgatgggtgctgcttacaaatttcaggtggtacaatgttagtaatattctgatgtttacctaaatagaggagcagcaatgctgcacaaaagacagggctcgattttgatacaaaatctgatatacaaagagacttattttgggaacaaaacaactgaaaatactggggttgtatttaagttaacagctgtaggcattagtcatgagtgtcttacaaatgagttaattcagttccttgggtgaaagagatgcagaaggaagtctaacacagtcttctgatgagatgagtcactgtgattataacagaaaataacacaacggttgaagaaaactctgattcctaattggttgctacattgcaagatcagcctctctaaacagtcacagaccaatagtaaactcagagaaaaatagtttagtgcccagtaggacctcatagattcataaacaatttgagttttcccattacattttttttttttaaactgtattttcaaggaccaagggaaagtgaaccagttctttgattcttgactttggtggagtgagagagggttgagtttaggcagtcatttccccatcttgaatccaagtgttagagagtatatttatttcttaattaatgtgaacagctgtttatgacaaagaaaagatgaaagataagtaaatccattaatacttctttcaacctcatggtttactacattgttttcatttttctctttctctctcactcaccagtcttatattttaaggttctacccttaaatgcagtgtgtccattcctattggtccagcttcatttatcaataaattttttgaaaaaaatagttttgatttccctgtgttttccctgagttatttttcacaatagatgaaaagtatcattctcaaaaccaaatcattcacatcacttctcttcagttgctcccctgagtttccacattcacttaacattaatggcccttcgtaaagacatgtaaccttgacctcctctccagtcttactgacttgtggtttcttcttctgacattatactgtcgtagctattaaatgcatgtttcttttgtat

SEQ ID NO: 59495 - DNA, 2727 bp, Bovine  19866880431937
agagatgaagtatgaagtgacatgttcaatgtcatgaccagaagatggcaaggcacagattttaatccagtggaaataatttgacagttcattaaaaaatctttttttttaaagtgcaatatgtgcacatatccaactcattggaaaagaccctgatggtaggaaagattgagggcaggaggagaagggggcaacagaggatgagatggttcgatggtatcaccaactcagtagacatgagtctgagtaaaccccaggagatagtaaaagacagggaagcctggcatgctgcagtccatggggtcacagtcagacacgagttagtggctgaacaacatctacactgaaaagtgtacatgttttaagtggaaataaagcccatgttttaaaccactgtgctacttttatctttctgtaattcttttgcataaaacttattgactacctactgcataatcgtttaatgattattactgtggagaccatgctgctgaagagagctgggacttagtagggtagatagcctcatctgtcttcagatcacaaaaaaccctgaactccagactaaatagttcatacttatccttaagcaaatctgggtcattattgatttttaggtaggatagagacctgattaaaatgaaatctagtgtgtgtgctttgggcggggttaggacatcatgagaaatgctgggctggatgaagcacaagctggaatcaagattgctgggagaaatatcaataacctcagatatgcagatgacaccacccttatggcagaaagcaaagaagaactaaagagcctcttgatgaaagggaaagaggagagtgaaaaagttggcttaaagctcaacattcaggaaacaagatcatggcatctggtcccatcacttcatggcaaataaatggggaaacagtgagagactttacttttttgggctccaaaatcactgcagatggtgactgcagccatgaaattaaaagactcctgctccttggaagaaaagcagtgacaaacctagacagaatattattccttctgttattgtctagcatccctttacttccccttctaggactctttcaaaccatttcctgaagggcagttctaatcataatggattccttcagcttttgtttatctggaaatatcttcattttactctcactcttaaacagtttttcaatatatagtattcttagttggaagtgtttgttttcccttttagcactttgaatataccagactttgctttctggcttccaaagtttctgatgagaaatctgttgatggtcttattggggatacctaaagcttgctcatcctgtctccggcaaactatgtgctggcttatttaggaatatgggcacagctacctgacagcaggtgtagaatggatttgagtagatgctactgtgctaagggctgaaattacctgcatcttcctaatcaggcctttccttgaagttgcaaaccttctaggcactagagttccaaaacagttatatcagattcttcaagtgtaatgttgtctagttggagaaacagattcctgatgattcctactttaccatctttccagaatcctctcttatttggttctcttttgtagatttttatttcttctccaatatttgattttcttttctcattgcgatcatatttttatggaacatagttataacagttattttatatcatcttcttataattttagtaactgcttcttcttgggatggattttagttgatttttttttccagaatctgggttacacattcctgatacttcatgaataaagcagtttttaattgtttcctgtgcatcgtggattttatcttatggagtctctggattttgttatatttctcagaagtgtgttggtgacttgttttagttggtcattcctttggttggagtcaaattacaaactttgtctcttggctggcaacttagatatcagttcagttattttatctttaactgtatgtgtttgagttttcccagtacctgtgtagttcaggggtcagctaaatatatcaacagagtataaaagcataaatttggattcacaactatgactttgttatttctttgatttcacctttacttttgaatatctgtgagtttcctgaacttttctctcatcttctagtatagaaaggctgtgggttttgtattgaaatctcagccacttttatggtgctaacttcagtttgccatcaggataaaacctgtagtaaccaaaaacttactctaacctagccgcttctagtcctgtagaaacttagttattacagaagactggttttgagtatcttctaaaattttgtggactttaaaattattttaatatcataatttagagttttatattatcacctcattttatattcaaatgctgaatatttcatgatgattaaatctttctgaacactccttcaaacactttccaaaattgaattctcccaaattatattcagatactgatagagtgattttacaactacgaaaatagaatgtttttcactttgggtatttaaattaaccaacagtatgattaaactctattgggatgctgaatattgtgaagcaaactaaaagtctatgaagcaggtatttcagtattcagaaggcttcagtgggaattttgtctctgtaaagtccaaaggtttgtgatctatgttggtggtgaccttaggaaaaaaatcaagggaataaattat

SEQ ID NO: 59496 - DNA, 3062 bp, Bovine  19866880686251
atagatacttcactaaataagatacccggataacaaataagcacatgaaaagattctcagaaaacctctggcaagaagtctacagagaaatagaaagtgcaaataatgtaatgaatgaaaagggacacataactatacttacagcagatactaaaaagataagaaagtcatcatcaacttaatgccaagagattttaaaacttaggtagaataaattcctagaaaaaccacaacttttcaaaatcaactcaggagaagtcaaaatagccctataaatactaatacaattttgatacctaaattagacaaggccccccaaaaggaaaactacagccacttaatttacaaatgtagttgcaaaacctcctcctaaaatgtcaaaaaatcaaatttaacagtgtaacgcactgtgatgcagctaggtgaatcccaagaatgcaggatagtttagtattaggaaatctatgtcatactctgcacttatagataaaggagaaaaatcatatgatctccatagatagcagaaaaaaatttaataaaaatcaacagccagggaattccctggggctctagtggttatggactcggtggtttcactgctgggactgggttgaatccctaattggggaactaagagtcatgagccccacagtgtggccaaaaaaaaaaaaaaaaatcaacacccatttatcacaaacaccttaaactagaactagaaaggagctttcttaacttgataatagatatgtacaacaacaacagaaaatcccaaaatggaatatgacctgagaacaaaaactatacaaatatactctatatttaatcacattattggtggtagagttagtatcgttaccgcgagtgttttgtctacaggatgagacagaccaaatgaacaactgattgagaactgagaattttttttgtagtaaaatatacataatataaaatttaccattttaactacttttaagtgtaccgttcagtgacactaagtacattcacgttattgtaccaccgtgaccaccatctatctccaaaatgttcatcgccaacataaactctacatccattaaatactaacaccacattgctccccgccccactgaccaaccactgagaaccattattctacttcctgcccctatgaatgtgactattctgggtacctcaaatacgtggaattgtgcagtatttgtcctttggtgtctgccttagggacttccctatagctcagtgggtaaaagaatctgcctgcaatgcaggagacccaggttccattcctgggtcaggaagatcccctggagaaggaaatggcaacccactccagtattcttgcctggagaatcccatggacagaggttgcagagtcagacatgactcaacgactaacacattggacattggacccttgaacatttcagtggggtggtggggactggggagaggtgttagatgtacttatcctccccacagttaaaaatcatgtataactcatagtcagtcccctgcatccttgatttctccacatccattccagatttaaccaaccatggatcctgtaaactcccattgtttaagggtcaactgtatatcatttagaaatatggaatacatcaggaagtaatgtgaatattttcatttgtcttcatggccaaggttttctgaacagtgtaacagaagatagaaaatgtttctttccccaactgctcttcataccattaagggtagaaaccacttgtccttcatcttggaactctctggtccccctaaaaggcaattagggcaataaaacttttatctcccgcaaagacaagacctatatttgagggtagataccttcttatctttccttaagaaaggttctttgtcttgttactgtctctccctctgtctcttgctggaggggaggaggaatatatgtgatatctcctatataatctcctaatttcataatttatggaatcagatatacagatacctcctgcccccaacacacacacacacacacacacacacacacacatgcagcaaagtgatattttccatcatcttgttgccctgtggatgaaaatagaatgtggagaactgagcaaaggtattctgtagggaaataataggtctgcctatggtactaaaacctaatgtttactgttaggataaaattaatttgtataagtgaaaaaacttataagaatcatctaaaataattgaatttggttatttcaaaattggttaatagaattgatatcagtgatatcaaggctctttttcttattacaagcattttatctctttgactcaaaactgtgtgtgatatttggcaaaactaatccaattatgtaaagtttaaaaaaaaaaactgtgtgtgtaattttaatagtgaactttgagttaaaattttaaatgatcaccctataaacctcattatcaaaaaaaagggtaaccatttgacattgaccttaaaatcagcacttgtacaatgtttacatagcagtttggttttacttttactgaattgtatcttaccaagaatgaattaacctgcattacacacttatggttcaacacatgaattcaagacctttatggttaaaggagctgagctcatactgcaattatttaagtatggacacaaatacccttcgaagagtgccttgggattttttcattttcactgggtcaaaccttttctctccaggaccttttgctgcagatgtaattgcagtttatcaaggcagttagtcatacacaaaggatttctgagatgccagtttgagaaggtctgcacagtatttttctagctatcagctatataacttggtgacacaaagattttattcttgttgcacattttttcttcttaaccttgaatagtacttctttgtgtattagttatctcaacagcttttgttgaaaaatagatgaaaattgtctaaggaactgttaatacattttgatattaacatgaaatctgctgcttcagagaaggagattgctaagtaataagtaatgtgaatttcctaaatttgctggcaatcgaagttattacatatacagaa

SEQ ID NO: 59497 - DNA, 2517 bp, Bovine  19866880700574
tcactcagtcatgtccaactctttgtgaccctatggactgcagcataccaggcctccctgtccatcaccaactcctggagtttactcaaactcttgtccattgagtcggtgatgccatccaaccatctcatcttctgttgtccccttctcttcctgccttcactctttgccagcatcagggttttcccccagtgagtcagttctttgcatcaggtggccaaagtattggagtttcagcttcagcatcagtccttccaatgaatattcaggactgatttcctttagcatggactggttggatctccttgctgtccaagggactgtcaagagtcttttccaacaccacagttctgttataaaattgcttctcatcactttagacatgatacaagacatataaatccttaagaatatagaacatttcccttttttcttcttctcaatcccactctgcatattgaaaaaaagaaacaataccaggatctcagtatcagcataaattaaggaaaggaagttgaggaaatatttatggagcgccatccatttgccagttactttatattcatcatgccattccatctctgcaccaattgctttaatgcaggtaacataactgaagttcagagaatttaaagattttatctaaggtcacagagctaaatgatagagctagaattcatgtgggtctgactcaaagcctaggctctttacacctatgctgtctttttatctgcatcattcagcctttggatgatcagagaaggataagccatgggctcctactttcatcaagctgaaaatcctctggaggaaaattagcaaatgtgaatgtttttactaaattagaagtatgagaaccaatcataattctgcattggaggctaggttttatcaaaatctatataggactttggggaagccaggtggtacgagtggtaaagaacccacctgccaatgcaggagacataaataagggttcagtccctgatcaagaagatcccctggaggagggcatggcaacccacaccagtattcttgtctggagaatcccatgaacagaggagcctgatagtctacagtccatggggttgcaaaagtttggcgacaactgaagcaacttagcgtacacatacacacacacatatttaaaatataattttatatatttatcattcatatcatgtgactcagagctcttatatcttatattttatgaaaggtatataaaagcagttatgccattagctatataaaaagtcccatatgagttataaaatggatctggtcttcttaaaggtattcctgctttcaaacaaaaggaaacagagaatgtaatctagcaacaaaataataatataccagaagacttcagtttttactatgtttattttcatattttaaattatttacagatgaattgttttgtaatgtttcgatttgtgctgtcaaattgtgctgaactggttatttgcctagtgactttgtgcagtttctagaaaggagtgggactgtgagcctttctcctagaaaactcattcctggggtaaacaaatcaaactcatactgactaataagtttatctcgttaacatttcacatagcttttttatgtcataaaattttaataaatcgagggtttttttgttgttgaaatggttgtcctataaaattttcttttacgagggtaatttttcatctccctctacctgtaagactgtttctttacttatcattaatcacacttcatgcaaatcaactacacaggcaaaatgccaacaccaaaagtcttaatgaaaatttaaacattttttaaatgaaatactttcattatgaattaaactacattagttataagacatgatatctaattagcttctagatataaatatagttccattcccccctcaaagagctttacttcttaatttccttcaatattgaacatttcattttaacccttgaactgtgaaagtgttggttgcccagtggtgtcaaactcttggcgaccctgccaggctcctctgtccctgggaaactccaggcaagaatactggagtgggttgccattcccttctccaggaaatcttcccaacccagggattgaacccaggtctcctgcattgcagcagattgtttgccattcgagtcattgcagctaatcttcttataaatttctagagttccatattaaaggaaatgcagaatgtgagaacaatgcagttatcatggatggtgggcatgcatgcgtgcatactcagtagctcatttgtgtccaaatctttgagaccacatggactatagcccgccaggctcctctgcccctggaatttccctggcaagaatactggaatgggttgccatgccctctttcaggggatcttcctgacccaaggattgaactgaatgcatgtctcctgcagctcctgcaggctggttctttaccattaagacaccagggaagccctgatggggtttttatgtcataatttttttaacatagctttttttctgtgttggt

SEQ ID NO: 59498 - DNA, 1778 bp, Bovine  19866880706788
taaaatgagaaagaagagcctgaaggattatgcctcttcttgagactgaagcaattatctctcaatatctgaaattctgcttctttgtcaaaatgcagttcaaaagttgagtcctccgtgaagtattacttctgctttggaaggcttatcgcatctccctctacactctcttagaattgggttaaagcgtctgcctggaatgtgggagacccaggttcaatccctaggtcaggaagatcccctggagaaggaaatagccacccactccagtactctggcctggagaaacccatggagggaggagaccaaggatcaagcaacacgagtatcacctggaaacttgttagaaatgcaaattctcagattcttcccagactgtctgaggcagaaactcagggggtgggatccaacagtctgttaagtcctccaggtgtttccaatccccactaaaacttgagaactatggctttcgcaactcgtacaatatttcatttctgttttattgtagcttgcaacgattcctccactggctctccaaggctttaggtatgtctgtttagtcttttttttttttttttatcttgaactcctcatattgctaagaccatggagtttacagtattttgcattcagtattaatgaatatttgctgttaagttgatattatacttgaatttggtatgtcagtacattagttgtaaaatatatatattggatattttccctagaaaaatagcagagtacttgagaaaataattttacatattttctcttgatccagtgagtccttaaaaaaaaaaatgacacaggttttcaaagtctggtattccttgtaccatcctcagagaaggttccttagtgattctgctgtgtgcttcttatcctcttggtaaaattgtaatgattgaccacaggctttgaaatcagatcaatagaaattttgccccagccctgctacattttctctgtgcttgttcaacgtacttaacctttatattcttgagtttccatctgaaaaacagggtataatgctcattttgctaagttcttacaaggtttaaaagtaaaaactgtcacatgtaaagtaatcaataaacataatgctgttatttaatttttggctttattattatcaacttgaggaaagaacagatatacattttctactgtgaataattatagtatgttcaactgattattctaaaagtactgcataattgctctactgtgaaagaatatagtatttctgcactagggaaaaaatacctggacaatggtttattctctaaattgtccaattgatgaaattacttttttctaaagactgagttgttacaaaacccttaaaaagagacaacatgctgtttaagaaagaattgtagacttgaaatcagaaggcccacattagagtcctagttcccttctcttcatggttaggatttgagttaggttacaaatcaaggtgcaagttacttagcaatctgaacttcagtttttcacctttgtaaaataaaaccaataaaaatttgtaaattagttaatttcattgagttgctaaaagaaataacaaaaccataaatgtaaaagttgtaaagtagtacataaatacaaggtgtaaaaaacaccttgctgtggctattattataattattataaaaattgagtttctctgctactcattatttgctagtttcttgtattatgtgggacatggggttgttttggagtccaagtgagaacaaattgagtaatattattttaattaatttattttttaa

SEQ ID NO: 59499 - DNA, 2954 bp, Bovine  19866880735752
ttgagaaatttgtatgcaggtcatctatctactactactagctactactagcaataaagactgggtttgcccagtggttcagtggtaaagaatccatctgcaatgctgaacacataggctcaatcccagggtcaagaagtcgggaattctttcctgaagaatcccacagtcagaggagcctggcaggctacagttcatcggatcacaaagagttggacgtgactgaagctactgagcactcacacaagcatgcacagcaataaagactgaactgctatattcacatgtgtaaatttcagactccaaagagtacatataatatgcattcatttacatggagttctactgagcaacttcactttcacctttccctttcatgcattggagaaggaaatggcaacccactccagtgttcttgcatggagaatcccaggcacgggggagcctggtgggccgccgtcaatggggtcacacagagttggacacaactgaagcgacttagcagcagcagctaccaaaaaaactaaatagtggtgaaaaacatcatcataactgttacatactgaatatgaggaacagaagtgggtattaacttagtattcatagtaacattcaatatcttgataggagtttggattatgcacgtctatacattagttcagttcagttcagttcagtcactctcatcaaatgctacacttaagatgtatgcatttcccagttggtaaaacctcccttaataatggaaacataagtgtagagtcagttaattatatgcatgctgatgtgtctagggtaaagtatagagctgtctgcaactaactttgaaattaattcaaaaaccaagattgattgattggtaaagataaggatagatggattgatatatgattgagaaaatatggcaaaatattaattatagaatctaggttaagactatacaatctttaactattttgtatactttattttttttttttataatggatgggtgggaaaaggacagttttccctctttaagttttcaactcttttgaattgaaatactcaaaagtacttcctcacaacctgtcgggccttcaaaaatgccctttattaaataatataagacttgttagggcttcccaggtgacacagtggtaaataagtcacctgccaatgcaggagacacaggagatgtgcgttcgagacctgggtggggaagactccctcaagtaggaaatggcaacccactccagtattcttggaaaattccatggacagaggaacctagagagccccagttcacagggttgcaaagagacacaactgagcaactgaatacacatgcacagaagacttgttagattattttccagtatctttcttttgaaatgcaaactcagacacatgcaaaatatagggcattgctagaagaagaaaatctgtgtttaagcaactagttatgtacttggtactgtcattatctaatttaattcttgagaaaatttttaaaattaggtattattttaggtgccaaggtcatgattttagtatcagtggccccttaaattctataataacttagaaatcagtgttccatacaacactgtagattttattaatatcttgatgtctttggggcaacaagatcaaaaatgttttaaaaactctgaatacacattctgaagaatcattttaaaaaggagaaaagatcttccttactttccatcaaaatccagtcctgtatgttagcaagggagctccttaggagatgcttttctgtcttttcataagtccaagttcggttcaattcggttcagtcactcagtcgtgtcctactctttgtgaccccatgaaccgcagcacttcaggcctccctgtccatcaccaactgccggagtctacccaaacccatgtctattgagtcggtgatgccatccaaccatctcatcctctgtcgtccacttctcctgccctcaatctttcccagtatcagggtcctttcaaatgagtcagctctttgcatcaggtggccaaagtattggagtttcagcttcaacatcagtccttccaatggatattcaggactgatttaggactgactgattcgatctccttgccatccaagggactctcaagagtcttctcctgcactgcaatttgaaagcaataattccctgcgataaacaatgtacttttccttcattataatctggtgtcagtaaattggctctactatgtgttgagcaagcaaacccagtctggttttgtaatgggagatgcatccagcaccactggttctgcaagacccttgaatatatatgtcaccctaagaattctggttagtgtgcttcatgagaaacagaatattatagattagttacatataaattgtgcatcagaaagatgctaagcaatattgacataaagtgtatcgagagactagtttgagccatcttgcaattgtggttttatcattcataacatggtataaatttacaactattcctccattatattattgatattatcttctttgggggtaatgcctttcagtatcaatgatttcagaaagagaaagggtatattgaataaaacaatcgggcttaagatctaaatttctgttggaaatctgctgatgaattgatggatgactaatttgataaaatgttaatgttatttgccatgaggtccctgaggatatctctgactacatgaaaaccagaagacacaaatatgcttaaaaagtatcaatattcaacttgaatattttgtagcaatgctaaaactgtgccaaaaattaaccatgtaataaatgcaactacagaatttaagtacacagatcattctttggtacatgacttccacttgaatcaagtagaggtgatggaattccagctgagctatttcaaatcctaaaagatgatgccattaaagtgctgcactcaatatgccagcaaatttgaaaaact

SEQ ID NO: 59500 - DNA, 1355 bp, Bovine  19866880758621
cattgagagaaatattagaagggatttagagtattctgtttcccgagtacatgagcacaaatgaaaggttagagtgggatctgatattccaggtagaaatcaagttcagctaatcctgatattctaaaataataagcttacacaaagccactccccagtgtccctgaaggccatgcccaaatacgaactctctcattaaactttctaagaaatcccagccatcctttctaccttggtgttctaaagcaccaccatttgtctggttttattatgtttttcatagacatctcccaccccaatggcctccaaacccctaaaattagcaaccaggcattttccacatttgtgattcttccagtgaaaattatattatctggtacatcaaagctgtaaataaatccaaaatgaatgagaaattaaagacagtacatcaaattttttggatcataggtataatgtaggagttttctttcaatttaccttattaaaaccatatgctaacttccatttgcagttgaactttcatatcatagaagagcaaagaatgaccctgtgatgatgtaaagatggaataattcatcttctctttacctcaggtagacagagtacggaggccgttgagagcatgtttaaattgtgtgcaaggtacttgcacaccccataccttagtttcctcttctataaattcctggcaaaattagatgttcttgggggcttccctggtggctcagatggtaaagaatccacctgcaatgtagaagacctgggttggatccctgggttgagaagatcccctcgaggaggacatggcaactccagtattcttgcctggagaatctcttggacaaagaagcctggcgggctacagtcccttggatcacaaagagttggacactgaatgactgaccacatcacacagctgtgggaaagtgggcaggagaataacaattgtatgtgggttctgaaagaagatatgagggaagctctaaatttttagctagagatgaaaattattaatatgtgtgattaatgaacagaaaagggacatgcatgctcgagttggggagcgacagaatggggtggttcttacaatttgcagagacccatgcctctgaagtaagaagtatatgccaacatttagtcatgaaccaaaaaagatattgaagaaatggtaaccatgctaatgaaagaaataaagattaatggcaagaagaataacagggaggtaaaagattgcttagggaaaaaaatagctaattggcagtactcatttcaaaataaactatattctgcttcttacacccacacaaaagtgaaatcaaacttgccaaaaggaatttgccaatgtcaaagca

SEQ ID NO: 59501 - DNA, 3071 bp, Bovine  19866880881381
ctaaattcttcttcaattttctaccctctttttctctcttttttgcccaaacttatgtctagcttttctgtgtcttatacttgacacactgaagggctgggtcccagcgctcttcaaatccctatgtcccctgtcctctcacacggcttcactcttttgatcctctggtcccctctaccttgaatgaacttttctgcttctttctctctttgtgactcagtccagatggcgtatttgtcaggagacctttgctgaccctttcctcagctcagtctgagtgttgtgcctctcttagtaattctggcatcctgcccttactcaaatcatatttattgctttggtttaatatggtatgttttatgcagtctcctaagtttgaattatctcacttttttcattcatatttatatatcaattgttaggttcaatgtcaggtccagaatgagcagttaataaatggtttaaaaaagttgtactagttgggctaaatgatccaaaaatcttggtgaacaatgtagatcttttgtcttatctacttttaatctgcagggacaaagaacagtaaatatattttcacctgaccactaataaagtatttaattcagtctttagttgttataattaaaaataatattctagaaatcttagagtaatgattatctacaatagtctttcaaatgggtctgatcagttatttcccttcctgcgttacttgcttttccacgaggtagtgtcgatttcacattcccttaaatataagctgagttgttgacttgttttggtcaacaaaatgtggaagaagtgactgtaagaagattaaaggctttaattttcattttgtgggcatttgactgtaatatatgtggtatatctactgtgataccaccatactgtcaggacaaatagtcatgtggaggaagagaggccacatgaaggaaaacagtccatgtgaaggaaaactgaggcccagatttatgagtcaagcccttctgtacattttaacccagtcctgcagccaagttaaatgcacccaagtgtgtagtgccaggcacttccagctggaacagaataaccactcaactgagttaaacaaaccaacagaaataacaaatcattgctttaattcataaaagttgggtggccttgttgtacatcaatggattactgaattaccaggtttaactttgcattccctttaaaaatctatcttgacattataactttgtactaaaaaggttgatttctaattatggccctagctatgaaggaagtcaagcatggtcactcagtttataagaatcccattgagtgtttcccgtgggtggacccttatggagtgcactatggaatgagcacaacccagaactgtgcaccttgcccagtggtgataagcacacagtaaaccatcattagatgaataatgagtacagaagacctagaaaaaagagcaactggtaaggagatagtaagtaaaggaaaagcattgacataattaagaataaacttactaacctgaaatcatgcaattccctaataatttgtccagtataatgtagtaatgacaatagccataagaaaacttttatggaggttttctatgtgcccagggaatagcatctcatttaatactcagaacaatcacgtaagacagttactattaggaaatccactttacagtccatgaaattgaaatatagagaagttaaataacttatgccaagccacacagcaggagttaaagtctgaaaagttctctgacacggcagccttcagggttaactactagttgtactaatgtgtaatttttgtttgtataataacctgtattataaatgtatacacatataaaacatacaatgtaacagaatattcataaacctactatctatgtatatgtatatatgagtatatattatttatcatcttaataatgcatactgctgttccaagatgtgttggaacattgatgtagtgatttgccttgattagtggcttattgacagtctgaccactcttgcctcctcctccttccttcgcttatctggacattgttgtaaaattctccagtccccttcactgctcattggtcacagcatgaaccaacttgccatgcatatccattactaaagagtgagaatctgatggtcaaagagattaaatacattttgaacatatcaaaatcggttatttactcattactgtgctgtgctgtgcttagtcactcagtcatgtctgattctttgcaaccccacagatggtaagctcctcagtccatggagattcttcaggcagtaatactggagtgggttgccataccctcctctggggaatttgcccaacccagggatcaaatccaggtcttccacattacaggtgcattctttaccatctaagcaaccaggaaagcccaagaatactggagtgggtagcctatcccttctgcaggggatcttcccaacccaggaatcaaactggggtctcctgcattgcagtcagattcttcaccagctgagttacaagggaaggccttgctcattactattaccccaattaattattactccatagttttacaagtcagaaaaattcttattacctcctctgtgatcactcttataaaatatgcagtgaccagaataggagggttgggagaagtcaattttaaccattcaggcacatacacccatacacattctgaatgctatttcacccatcaactctttgccaccaacagtttatttgactcacagtcatggccaatcactgccagctgcagttggctgacagcctttattgatgttgtcaggaccttttattcatattttccattaatctcagatgctttacagcatatctaaagacaggaaaacatattgggtcaaatttagaactatttttgaactcagtggtaaaatctgataagccaaatctagatttaaaccagcaaagtagctttgaaatgttagtttgaaacaactcaaaagctttcttagatgtcagttccttgtgggagaaaaaagaaggaaatctcattttaaggatttaagtctagttatatcacaagtacaaca

SEQ ID NO: 59502 - DNA, 1855 bp, Bovine  19866880890935
tgacaggtaaagaaactgaaggcactaagaacttaagaaaatgaccatagaagagtaagcataaaggaagcataatttttaatctaacaaaaatgtattgtatagcatctcttgcttgaaaacgcctcacagagaatgaagcatgtgagttgatacttaagggatcaggcttctcttaataaattaatagaagtagaaaagagcattcaaagccacaaagaccgctcccataaatgcactatcaccatcacgcatttgacagttgcatgcaatcaggacactatatctccatggtttccaacctcaaatggcttgtgaagttgcccagcaagcctatttttcttgctagagtgttctctccaatgccatttcatgcttcttcatcatactgaaacctacaaataccctacttcctgctcactcctggtacatggctctgctttctatttcataggagctaatcaagttaatgtttgtaatcacctcaaattcctacaatgtttgggctaagattatcagagaaaatacccatctaccttatttatgttatatattggtatttttaaaaataagtaacatgtaacaaatcattatataattatttgtcacctaaatattccagaggtctcaggctaaataaatatgatgagcctaggaatcatgggttcagtaaatatgtaaagtaaatccttcttagacaaatgataataaacaaaatccagaggtaaaaagtcaaaggattatctaactagcccgtctgataagcttccatatttgcagacaagccaaataaggagctgaccaactgcagaatctttcctgtaacaagaagcagaacactgaggatgtcaagtgagacaggtagggtcattaggccagagagtcatgtgtctgtctcagagatgagattaagatttgcatctgccctaaaccaacccctagggtcttgccatgcaaaaaaagacatgccctaaggacagattcttccacaacattttctgtttctacatttaaattttgcatgtaccaatgtagaatcatctagaagaggtcctctcttcctatatataaccaaaaagaaaaaaaataaataaaaggaaaaaagagagcaatacatatagtattctgtgttttgaccacttcaccctcgtagttttagagactggatgtcaaaattacaaagttttaattagcctcctgcatggcagcaagaagtactgagaaatctatggttggttgcttttctcatccataggctctaaaattgccattctaactacgtttttgcttatattttacttcattgaaattcctttcccatattaagatcaattttgtgcagaacgttgtctcatccaatatcctcagagagctagcccttaaagattcttctttctgttccctgtatcttcaaatatttctctcttgtctccttttctctggcatttaaacatattaagctctatcactatcgcataaaccaacaatgatttgctttttacacaaaccagtggagacttctcagtcaatgctttactttatttgatctatcactctttgaaactctgtatctcaagaattttctttattatcatcattttcttcctgcttttctagtcatgttttatttcacttgtgaactctttcctccttattgacacttcaaatattgatattttaagtgacacaatcttagatgtagaacatccaaaggactacacacacacaaaattattagaactactacatgcatatagtaaagttgcaggatacatattaacatacaaaaataagttgcatttatatatactaatgatgaactacctgaaaaggaaattaagaacacaatctcatt

SEQ ID NO: 59503 - DNA, 1481 bp, Bovine  19866881017300
tctattgaaggctgtgcatagagaattgataatcaagagagatgttcaataaacttattttattgctattttagtattaattttatgattacccatgttctgttggccactgtacatacattgtggtaggctggataatgaaagatatctaggtgctaattctcagaatctgtgaataaatggtcttatatggcataaggaattttgcagatgagatcaaatgtaaaatcttaaaacaaggatatcatcttggattctgtgggtggtccactgtaatcacatgagtcctcataagaagggtgaaggatgagtcaagaaaaagagatgtggcaatggaatcagaggctcaagtgatgtggttcaaagattgagaaaatgtccataatgcagcttctataaactggaaaagacaaggtaatagattgtcttctcaagcttccagaaggagcacagccctagtgacactgctttgggacttctgatgtcaaaaaatttaaggaactttatttttgctgttttataccactgagtttctggtaatttgttatagtgacaatagggaacaaatacattgtattatgaaatcccaccagaattctctaaattgggactcagattttcaatttatagatgaagatttaattttggcaaattaaggaatatgttcagcttctcttcacaaagttgagatttgaacgtgggttcctcttcctctgaactttatactctttcacgcccttccatcaccagcatagtgcagaggccctggtgctcagctccctcagttggaattccactttattttttccagggcagagttattcaacatctccagaaagaatcataactccatttttcctaggattcttcatcaacaaaacagtagaataacagtacttaatctacagttttgtcataggaagtaaaggaaatagtctagtatttagtaatacatcttcatatctatctatatagtctggagtcctttataaccaaatacatccacaatttgatttattatccaaactctcaaacctgcctcacctcctatatagtctctggattcttatagcttcatcatctactttatattttttgcacgttattttctcttccaacctccagctagaaaacttgtcacctgtgactttcccttctgttgtacacacattctgaaaatctagttgtttacatgaaaaatgtatcacttggaacccagttatgggtattgcatctcatttatatggtcaattgtcttcctttcttccctcccacacaatctagaagcttatcctcctgtgattaccagtattttctaagatctccctctttaggctttaccttcccttagaaattgttaaagaattccagaaactgattccattcaaaaaaagtcactttttcttccaagggctagatgaagctttacactgataaagtacactgataaagggagttgctgatatagagaagcctggggg

SEQ ID NO: 59504 - DNA, 1488 bp, Bovine  19866881020535
aacacattacaacatatgtattttatttcttttcaggaagtgaatgttgtaaaatctttgggcataaacattttgttaatattgaataacaaattcctgtgattctcatctttgcttgcacttagttttaaatgactcctttcaaaaaagtttacacttttgcataagcagttatttcctaaaaaatcctaaagacaatggtaataaaaagatgggaatagagatgattaaataaaattaggcataagcatctttcaaatatccttactaagactgaatcatgaatagatacatttattaaataaatgtatatctatttctaaatagttaacaattcagcccaattcaatttgtctacatcagaaattatttaaagggatggtgaaaaaaattttaatttacatttggataagaagtaataaaagtatatatgtaaaagtagtcttatcttttgtctgttcaaaccacagttatacttagggagtctgtcctacctatttgccaggagtccattcaaccagaaagatttaaggagtttctttatgagaatcaaaaatagacccagggcattcagctgtcatgatgaatcagaaatctaatatatgaatcattttccacagtttgtgttttagattgattcattaacaaatggctctgatttacagaagttaataaattgtacttgatagttggaactaaaaccacttgagtaagtatgccatcatttactatgtaatgttagtcctgtttagacttgattcctattaaatcatttctgaggatcactgatttctttattctttctcctaacttgagggataagtttcagagaagcagtgtcttccactcactgccatgcatgattctgagtgatctattaagacttttaatttaaaaattttatccatgtttcttataaacacacagtctctgctttactcatatctatataatgatcactgacacattgtatttgtcaggcaaatgtcgatcataaagtttgctgaaaataaagacacagtaattttgactttcccattaggctccccctcaacaacaacaaaaaaagaaaatctagattgaagtctctactagccataatagaatacgctaatttcaggaaataagtgttttgatggactgttttatagagtaaggttggcattctcttggaaaatctgactttttattattttaatgacaagtatgttttataatgcatgaattacatgtgtagtgttgagatagtctctataataattgaattcagctaggtgggccataaaccagtttaaaaaaataaacgatctgttttaattatagagcttcccttggctcagctggtaaagaatctgcctgcagtgcgggagagctggattcaatccctgggttgggaagatcccctagagaagggaaaggctacccacgccagtattctggcctagacaattccatggactgtatagtccatggggttgcaaagagtcg

SEQ ID NO: 59505 - DNA, 857 bp, Bovine  19866881037088
tgaagcaagggaaaagggttataccattacaccttgcagaaaatccaaagagataaatatttatcacacatgtgaagttggaatcagattgccctaacacttacaagacagaaacctagtcttaatcatgtaaaataacaatatgataaatactaagtgcttgttatttgtcaatgattattttaaatgttttacatgcattaatttatacaatcttcataaaacctatgacatcattagtatgatcattcttgatttacagatgctggaatttaaatatacagatattatgaaatttttccaagttcatatacctaataaatggtgcaaaaaggattttaacataggtactcaataaatagaagctattttttacttaaaatattttaaagtgatgaactaaaaatctctataaaatactggctgaaacaacttttcaaattgaaaaaactctgcaaacatcatatttttattgctggttccccatttccagagattaatgtattacatatttcttatataaagactattcaaaagaagagtagattatacagaaatggaaatcagcctaaaatattcgttagccaggaggcattgttctactaaaaattactggaaatagtaaattaacctagggcaatactgtattgctgtatctaaatgataaaaaatgtaatttcatgagtcatttatcaaatgcaactgaataaattactaagagttcaaacaaacatgttaggaaaaaattaacaagtgtttaaaaaagaaaacattcaacattatgtccacatatttatagggtgtgtgtgtgtgtgtgtgtgtgtgtgtgtaaattcacagtaatctgtatacatgtt

SEQ ID NO: 59506 - DNA, 1453 bp, Bovine  19866881112246
tcatatatcatgttgtaattgcatatggtccttcaatgaatgtgcttatgtattatatgcctgataaactttcactaaacctaaattctaagtcatttaaaaattatgttgtaaagcatactcatttttaattttaatttagtgtcatactgtacaatctcattcctaaatcatggctatgtttccacttggaatcatttaacttttccgccttttatcatgttaactggtgggaagagtaatatgttacagttaaatattgtgtgattaatatccataattataagatgtgactgaattaaaatcaataaccctttatttgaagtagatatctcttaacccttaattgctgatttagtagttaattgagaaaatccttgttaatgatctgatgtagctctgaagactgttgaatgagtaagagatttctctccagtagaaatagttttcccaacagcatacgactgattcaaaagaaagattggtggaggggacaaggaaattcagtggttcagtctctctcagccacagtcagccatgacatacacacagaaaaaaatacgtaataggaatttttcgtctcaatgcgaatgttgatcaatggcactcaacataaaggaaaaagtcagaaagaataatattccctagaagctatgttttaggagcacatgaaacatacatattttgttacagaacacctatctgttcatccttctttgtctcatctgtcttttgcttgactacttcttccttcttattcactcactgcttactttgctgctgagataattgttcctggaaaggagattgttaatggttctggcagcaaaaattctccagaattaaacatctgatctcatctgtattatattccttatgctaattttaaaaaccattgcccttcacagactttacagagggatttctcattttaaatatgtgttatgtgggaaagaaacatgatcaattttatgagatattctgtgtagaggaaggtagaaggaaaaccatattcactgaagcccataaggcatcaagtattgtggtagatatttcagatacggtatttactcaaattctgacaaccaccatgctgctgctgctactaagtcacttcagtcatgtctgactctgtgcgaccccatagatggcagccccttagctcccccatccctgggattctccaggcaagaacactggagtgggttaccatttccttctccaatgcatgaaagtgaaaagtgaaagtgaagtcactcggtcgtgtcggactcttagcgaccccatggactgcagcttactaggctcctccgtccatgggattttccaggcaagagtactggagtggggtgccattgccttctccgataaccaccataagaagaacttattattattatttccatgttaaagataaaaaaaaaaaagactcacagttgttggggtaacttga

SEQ ID NO: 59507 - DNA, 2208 bp, Bovine  19866881156598
attttaaagccctatggcaagaagcatctttcccaggaaagttggtcctatttatgcaacttttacaaccaagagcatcaataaaactggctcactgaggcaaaactcatacatcaaatccccctgagccagtgacaaagtaagacaggtatgtagaaaccactgaattataaatgctatggttcaattcctaagctattgaccaaggaaagaaagccaatgtaatggccagtgatggctggactgtattatctactgatgacaggaatgacattttctcataggaaaaaagcctttgataactctctactttattttagcacttgcagtacttgcagtatcatctcacaagtatagtgataaaggaccatctttctgattttgggtggtgggaagaagaaaatattttaaccttaatttatttgaggaatctttaatatcagaagcatcaaaagttttccctttcctaatgaatactctcttcaacaatccataaaaggtcagcatgccaagccattaacactccctcagtttctaatcaactatcacaaaacacagtgtcttaattcactcagacacatatatctctagtaattccctttaatggtaacaaaagttcagtacatgaatcataaagataattcaagagacatgaattgaagcacttttcaaatgcaatctgagacttgttttggaacataagtttagatttacattcagatacttgctcaagtagaaaatatgactttttaaagatacaattttcttgccagctctctctctctgtcttaggatcaaacaggttgccttttacattgtcaaaaggttagttggctatttgtgatgaaatctgacacagaaactctttccatctcttctcaaagatgttatagaaacttaccaaatgtcagtactgctgacaactgtgtcccagcagacaatgaagtaaatttctcttctcattgcattttaaaatgtgatttaaaacttgagacattgtgaccaaatagaaactttaaaaaatatcagtaatattacatatgtacaatttatcttctagtgaatactgaaacctaaccttttggttttatgacaattttaagttttgtagagaattaacagatatgacaaatttaagatttctgtaaatttttacacaggtaccccacagctacaatgattatcccaaacacattttcctgaacatactttctataaagaaaaatctaaattaaatacatttctgcagttggaaaaaaaaaatcttgatcaccagaaggttgaaatgattttggagacataaatatactaaatataaatttatgataattgtgaattgaaatttgtaaatttaaatcactgagaaaagacaagtcaaaaaattattgtatcttggaaatacttaaaaatcaccattataagggaattgcagtaaaagtcttctaacatattgtttccaaaacagagctatattttgtcaaataatacactctcttgacaaatagactcaggaaatatttacagcaacccaaagctatcacaaagagagaatgaaattttcatgtagatggagaaagtggcagatttttaaagaaaagcctgttcatcaaatgttctttttacaaactgtagaagatttgacaggaagatgacaagaaagcaatggtttcataatccatagcataaaaggaaaacagatgtgaaaactggataaagatctgttgatgatcaacactcacctttagctaaaaatctttaattagcagactttatgggtaagtgtgtaaatttgagacacttaacccacaaattaatcagatatttttttctttttttcaggaccctagttcagttcagttcagtcattcagtcgtgtccaactctttgagaccccatggactcgaggagcctagtgggctgccatctatggggtggcacagagtcggacacaacggaagcgacttagcagcagcagcaatgctatattcaagctgagaatagaagtcaggatatatgctgagaactggtaatattagactagaacataaaataaacgttatcacaaaattttatttttccttggatttcattctctttcactgaactacttatgataagaattcaattaaatatactgtatgaaatatatgaactagatataaaccaaaaaaaaaaaaaaaaagaatttgctgaaaggtttgcaagtca

SEQ ID NO: 59508 - DNA, 1214 bp, Bovine  19866881247530
acatattttttaaagattaatctattacctttgtgtaggtctccatgttgtttcttttttaaggagagaactttaggcatattttccttttatttaagtagcatacattccttaagagatttgaccacattgaccacatcatctctcttcatcctagaaacgggaaggagcgggccataccacctcagaatctaaggtgacatgtatgggtttattgtacatgtttataaaaccttccgggtccattaattctgcagagttgcacaagtactttattatttgttctgggaggagtaattcaggtgcagcttggtgcaaactgtctcctggtcctttagggctcactttcacagtcttaaaaaggtgaagtgctagcttgtgtgtttggatgagaaattccatcatgacctcttgtagggactgtgtctgtgtcacatcatctagatacatgaccggcgcttttattactgaaacatgccactgcataaagagccttgttgggatattgtgggacatgacgataatcttcattccttggataaaaaattccatttcatcctttttatggctcaggtaatctaagagaatttggtaaaaagtaccactggaggactccaggatatgcagaatggaagtaggatatatgagcaacagtcctgtcactgcttctcccaggtgacgtttcaaaattgactgaaacaattgttcgtagtagtcagcaatatcttttttttctatgtttgctgttatcctggccactaggaacatcctatgaagaaggaatttctttagttgtagtctttgcttttcttcctgaaattgcaagtaattgctacgtggaacttgtggcattagagattccagtggcaaattctttttgttggtctttcggggatgggttccgaaggacatgatgagtcttatttattctgccagatgattccagtttttagcttattaaaatagttacattacttctttggtgataaactcatttttgtttcttgtgacaaaaaaaaaaaaaaatttagttgttcaaatgcttccaagtgtaatcaataaatagtgtctttgaaataaaagagactgttgaaacaagaatcaaattatagaattttgttttaaaatttacaatgagataactaacactcatatcctaggaagaaactctccaacaaactgggggtaggaagaagatagagctaatctagaat

SEQ ID NO: 59509 - DNA, 2589 bp, Bovine  19866881375990
catactaaaaagcaaagacattactttaccaacaaaggtctgtctagtcaaagctatggtttttcccatagtcatgtgtggatgtgagagttggactatcaaagaaagctgaacaccaaagaactgatggttttgaactgtgttttttggagaagagtcttgagagtcccttggactgcaaggagatcagtcctgaatattccttggaaggactgatgttgaagctgaaattccaatacttcggccacctgatacgaagaactgactcattggaaaagaccctgatgctgggaaagactgaaggcaggaggataaggggacaacagaggatgagatggttgcatggcatcaccaactcagtggacaagaatttgagtaaactccgggagttggtgatggacagggaggcctggcgtgctgtagtccatggggtcgcaaagagttgaacacgactgagcgactgaactgaactgaactgaagccatgatattgcatatggaaatgtccctattgttggtattacctgcagttttatgtgaagtgctcaggaattacctataatctagcccttggctcagtgaatatcagtcatacctatggaatccttactaacatggtactgattctgccccttaggttgcctgatgtttataatcaaacagagccattcaatttatggttactgcttgtaaaaccatcttaataggatcaagtgattcttttgtagacttttaagcccaggcaaagtataaattttttaattgaccatatttaggataatcctatttcattcatcactgagcaggggagtatcatcacattattgcccctttgcctgacattaatatcactaagtgattttttttcactatagttttggaactaaatctgaggcagacaatcacaatagcttatgaatatgttagatgaaaatatattgattattttcaaagacagttttaagttaccaacatataggagaaatagtgaaagttctgataatagaactacattattttttgcttataattactcactaaagcatgtattttttcactgcatgttaataaaccattaataataatatactaaaattatatatggtagaattatagtttttacatttaataaataatccagattcatgaagaatttggcctaggcttgattttttacttggtcataactagaggctgagttattactgaagctagtattattttatacttttatagcaggtgatggtatgctcagcactctcccaaacattggaatgaaatttgacttatcagaaaatcagaatatgacaggttgatgtatgtgtttcttttcagaggtctttcagaagttgcatatatgtcaggtaattatcttttcagtagaaaattaaagattgccttatgaaaacttttaagtttccagaaacatcaggaatatttggttaacatgtaagccttagttcttttcattaatgctgaatttttattattttactcaaagagaatatcagaaataactgtggaatgggaatacatgtactaccttttgttgaaagtgaaagtgaagtcgctcagtcgtatctgattctttgcaaccccatggactgtagcctaccagactcctccgtccatgggattccccaggggaaaatactggagtgggttgccatttccttctccaggggagcttcctgatccagggatcaaacccgggtctcctgcattggaggcagatgctttacctcctgagccaccagggaagcttttttagaaaatgcagttgttatatgcaccatccctgaaaagaaagaaacattatgaagatgtgctatgctaatcttgactgctatttacattagacttctacctactgttttcaggtggagggtcacccaagtcagatatacagatatatcaataataggctcaattctctttattggaaatttcttaaatgaataaaaatagtacttgagaacaaacatgtatataggaattgaaccatgcattttttaatatgtattgatacatttgaaaacacatataaaatttatataaatattgtaaagcactttctgacatcagtactgaatcttcttagctttcaaatgtagtactgtcagagctatagactctattttttatagacggcatttctcgagttaacctatcctcctcatcccacatgtgtatgccccatgtcattattgtaccacagtttgatactgtgatagtcattatttttggttaattcctaaaaattctcatttttgcattaataagtattcaaaattgatttacacatcatagcttaggtaaagtctacagtgattttgctccctgctattatgttctacagaatgctggctgcattttgcaggactgccttctatctgtcaggtaatatagctttcactttttcttaaatgtgtgttcttttgttaacttctgatagacaaatgtgaccaagagtatccttttcttgggaaatttccttttatcttgaaatctcagctgaggaatagatgcaaagggccatgcagcttcttaataatactagaaagactatgtggatccctctgctctagcg

SEQ ID NO: 59510 - DNA, 1051 bp, Bovine  19866881381757
aataaaatatactttgaaatgctgttgccatataagatgagtagtagtttaaatatgatataatgaaatgcatcattgagcagtatttggataaaacataaatcaaattataggaacaatgcaagggtaattaatcgaattcatttagcatctttgagaatcttttccacttggagtcaagataaaaagagataattttgttttgcttattttatctgcagcaagtaaagatggaggaaaatctgagacagtaatttaagaatgaatcagttggagttcaaatccaagcttgagaagtgaacagctactcctgagtgaaaataaatcctattgagaagcaaatgaagattagtaggattaaatgtcacatgtggaggatctaaaagtggatttgttttttattactgaagatatatttatgggttaattgtacggagattcggctcatttgtgttttctaaactgagatgagtcagaatgtctctggggcagaagaaacttgtattccttctgagaatgtgtattatttgtttcagtattatgcatttgcagctaacagtcccgaaaaaaagattataacttgatagtctcagaaggaattaagtgttattgacatggtagttatattaatagttacaatattttctttatccaagcaatataatttgtatacacattcaaattgctttagtattaatgcccagtatttcacacaaaattttaagaagttcaaggcaatagctaaaaaaatcattatttctaaaaacttgagttacatgtagaacatgattgtcaaatctagaaattcattttttattgttgaaattgaaaaaaaatagctttgtaattattgataagctttttctaaaagaagcatatctcaatttttattaaattatagaaaacattatttggagaaggcaaaggcaacccattccagtactcttgcctggaaaatcccctggacagaggagcctcctacgctgcagtccatgggggcgctaagagtcagacgtgactgagtgacttcactttcactcttcactttcat

SEQ ID NO: 59511 - DNA, 1145 bp, Bovine  19866881433394
gactgattataatttttaaaatctataaagctcttgaagctgagacaggcactaggaaagaacaaagtggcagtcctgtttctactggatgtacatatgtgtcctgattattgaaaaggaaaagaaggaatcaactgctcttcttagtatctccttgatggtattggagctttgaggattgaattcatattctttccatgaaagtttcatatttgacctttcactgttatgtgtaagagactgctttaagaattttaatattctctaatttgttctgttacactggccacgaataaaatcctgtttcaaagacagtgaattttcctcctcctctgaccaagtgactaacactgattgaaaaccctctctaggtccccactgtcttcctggatctctgtaacagtttgggtaatgaaacacttgctttagacagttttctttatgtgtttattttatgtttgtgacagggaaaaataatccttgaagactgactaacttggatctcagcctctttcttaaaagtttaaattcttaagtttttagttttatcagtattagaaattaaggggaataatgagtagcttgtaggattgttgagagtataaaatgagatcagtttcatgaagcacttactagagtatatgctaaaagtgggtacttgatgtttttggacattttgtgtgtgtatgtgtctgtcttttgtgtgtatcactgtattcatgtgacattaattttttaaaaatatcataccattctcctacaagtctacaaagtaactttcattttctgatgaaaatatgagcaagtgataggagtccttatcctcttcaacccaccatctcatatgaaagcacaatccctgatagtaaattcaaacctggtttatttgaatagaattttcagggtgtttttatctcacaatttctttttaacatttggactgtttagaaattccacaaataggcaaatgagcattggatgccctaacattaatattactaatattgatttccctaaatatgtgactggcttattttattaaaaaatggtcttgtattgtatctagtttgttacctgttacttagaaaatactcagtatttgttgaataaattaaattaatgataagaagtataacttcctacta

SEQ ID NO: 59512 - DNA, 881 bp, Bovine  19866881598533
ctgtataatttgctccattgcccaaatactaaaggcttcccaggtggagcttaaaaacctacctgtcaatgcagaagacataggagacacgggtttgattcctgggttggaaagatcccctggagaagggcatggcaacccactccagtgttcttgcctgaagaatcccatggatagagaagcctggtgcaccgtggtccatatggtcgcagggtcagacacgactgaagcgacttagcacgcgcacatgcatgcgtgactaactactatctagtctcatctcttgtgatttcctttcatatttcacgtcttcacttactgaaattctttccattcttctagcacactatgactcttcttgcccataaatatgaatgtatatcctctgccaggaacactcccctcctactccttgcctttaatttggctcacttctatttaactttcagaaatccttctattttttttccccctcagaagcatcccctgatcctttaaactaggtaaagttaggaaaggaaacaactgcaatttgtatacccactatgataacaattatcataattgtttcattttcttttatgtgtttggggtagtgggaggcagagactgtgtacactctaaggtagaaatgatatgtatttgcttgtgattacattgcacccctgagcccccatgactgacaaacggtctgacacagtttttcagttcatgcttgctgaatgacaaatgcagagagagaataaaactcattgtatgagaaaagcaagaggcaagtcattttacgataatgccaaaggatacgttttcacttaaatgtttattgcaaatggagtaaatggtgtaccaagaatcggagaggactctaggaaccttttatg

SEQ ID NO: 59513 - DNA, 1114 bp, Bovine  19866881734318
ttttctactagcatagcttgttatgtttggcacattctgatgagccgcctgattattctgaattaatgatgtttcttcactattcttaatgaaatctggttgatcacaatcttcaaaaaggcaaatgagaggtatgagaaatcaccaccatgtaggaagttggaaaacttaacttctctatttaagaggggaaggtgaaagtgaaagtgaagtctcccagtcatgtcttactcttagcaaccccatggactgcagcctaccaggctcctccgtccatgggattttccaggcaaaagtactggagtgggcaagggattagtttgaattcactctctgaactcatggctgacacttctgttgtcctctgtattctttaaggctcagtgtctaatgtgattcctttgtctccttgaagagcctcatgggcatagggcacactcatatcatctgaggaagcctgcagagcacctagcagaccaggatgcatagccattgttgataatttcaactttaatcttttgtacttacagtgagtttacagaaaaacaattcatgttggattaataacaaccttgtatataaaattgtcaaataagctcttcattaaataaaataaaatgactcagtttatccagcatatttccattagaaatgaacagtttataaattatctgtaaagtttggtgagcaattcctcagcatcaagaattaatctgcattcaacaagtgagcaatttaacttccttcccatccatacaatcagcagcaacatcatatccaaggggaggaaagcataaaacatgtttggatatcataatgaattcgattacaataacaccaaattaagcctattttcattttgatattataaaaaagcagcaggagggttgactagataacttgcttttactttattaaattccttatgttacagtcagctggattgagtgctcccttgggagtaaattaagaacatttgggccttgtctttacattccaaacagtggggcttttacaattcattttacttgggatgccagagggaaattaagaagagctccctagttccttggcttggttattgccttctttatgcagaaggggttactcccac

SEQ ID NO: 59514 - DNA, 4913 bp, Bovine  19866880339755
tgaggcggtggtatgagtgtggcaaatttagatggaaggatctgcagatgacctggtcctgagtctggaaggccatcacatattcctggaacagaaccaatgagtggtgggtggtgaatggaaagagaagaggcagagaggaagctggaactgcagatggaaacaagagcacatggggtctttcacatcatattaaggaacttgggttctattctgagaacaaccagagacaaagaatattagtattttgaatcggcttaatctctcttgctctttcttgttcaaccttttttagaggatcaaaccttatcactgcttgtaaacatgattttctcactttacccatcattctatattaaatgttcccccacaatgtatttttttaagtactgctaattaatttcattatatgaacttttccattatttacttagctgcactcctgttttgtccttctgcatttttaattgtttttagctcttgttaacactgatgtgataagcattatcatagataaatatctgcgcacattcatgactgttttttaaggaaaaattcacaaacagtccaaagggattgctctgtcaaaggaaaagccatttgcgagcttttcacatgaattgccaaatcgccttccagaaagattggagcagttattttcaggatagtgtaaaagaccatctgtgggaaatatactttttgaacctaagttacacagatgactgggggaaattttcagtttctgtgatacagtttaaatagatattcgtgagactgaaatctacttgaaggtttgtatttgataattaagtttgaagcgtgtgcctggaaatctataaaattcctgtcttcttatctaattgtttttagttaagaatgacattccccccgtgatatccttgtgcagtgatcactaaaatatgttgtcaagctttgaaattcgtagaccatctgtaattttgaacgttttgtacaggtagcaaaaagtttaacttatacactaaagacatatatttatagaaactctgttaatttgaatttggggcaaattattgaaatgaacaattaaccctctttgaggccatatctaaaaatacaaagcatgagagaaataaatgcaaaaggagattaaaagttatcaagaaaaattagaaaatatctttgcgcttagcatgattaagtctaacctcagatgctccaagctatttttaagaattgcttgaaattttcaacaccagggctgatatgctatcactgggtttctcactaattccacttctgactcttggcagtgtacgccagctttgatctgcctccggctctttggcttccacattcacattttgtcctctctagcttttgctcattgctcttcctaatgattttggtgtctttgggcgttttggtgttcttaccctgtgcagcattagacgggcagattctgcagcctctccttcctctcaccccacgtggctgcttggaaatgggcacgtccctggaaacattgctgggacagccctggtcatcgcattcttgggctggggctcatatttgaacaaaatatgtattttcttaaactgttcaagtacttgtttaaattacccggtacatccttagctatttagcatgatttccttttgtgcaattttggcaaaaaaaaaaaaaaaagttaatgaaagacaccctcctatgttctcgacacttaaaattgatagttagagtgaggtgtacctttgaagtaatggattgatgttttagttgaattaataaatgggatacagtatgttacaacataatcatcttgacagtgggtatactcactggaaagatgtatctgtgtgtgtgtgtgtttttttttttttttttttctgaatgctttcagcatttctctttttggagaactgagatttagacctggtaaatgtgaaatgtgagtggatatgttcttcctcttgtcccttttccctcctaagcgtgtggacttgtgtgctgctgacatacataatcaagtgctaagacaagtggctaatgcagcaagggctctcggagtttaggaaagggggctgctcattgtatgtttgagtagttagggaaagtttcttggagaaaataggccttgaagagtaaataatgtttaggtaagtgggaaggagaaagcagggttcggctgaagggaaccattctggcaaaataaaggaaacatatgacacggagaaaattttaatgaagctttcacagttttgccaacctttgtgctctggtaattgacaacatgtatttttcttcagacataaaattaatgcactcaactgacccacctcttttgggaggtgtgcattttaactgtagtttctaataatgctgatggctcctttctgcctcaacctgttttattcttactcaggaacacgtgagactcagagatgaaaccctgaaaagttatctctgtactaagcaaattgaatggagcaaacagttacctaatcctcccattttccagccttttggttattttttgtagtctttttctccctttctgctgccataaaacaatttttgacttttgttggattttccttcccaattgttcttgttttccttttggctcctcaagtctctgtgattcaaacatggaatatgatggcattctctcaactggtctctgagaccctctctctctactccaggtcatagatgtcacagtcattgaaatagtttaaaaataactttcatttcatttctgtgatcaaaattcctgtgttggtttctgtcacctggaagatgctctccacagtgccacccaactgcatctcccgctaaacgctttccaatggccctgtcactcaaacgttgttcatgacaagctcatgactggtagagggacttccctggtggtccagtggctaagactccacactccccatgcaggaggcctgagttccatccctggtcagggaactagatttcacatgctgcaactaagactcagggcagccaaataaataaatgaaaaggggggaaaaaaaaaagctcatcttctgttggttccctccccagcttgaagccttctgctgcgacccccttttgaattcatcgtggtcactttcaatgtttgcttcctttttcactaagcaaaaagtctcagcgtagatcctacaacctggatgatcagttttgttcagagaactttcttccattatgttccaaatggacttcaaactcacatggcacttacagtctagcttgtattatacaagcatttacaggcagacctcagtgatactgtgggtttcattcctgactattgcagtaaaggaaatatttcaataaagtgagtaatacagtttttttttttttggatttcagtacacataaaataatgtctatattgtactctattatgtataccatgatattatgtcttaaaaaatgtacttaccttagttaaaaaatcctttattgctaaaagaagctaaccatcttgtgaaccttcaagtgaatcataatctttttgctatagtaacatcaaagagtagagaaggaaatggcaacccactccagtgttcttgcctggagaatcccagggacgggggagcctggtgggctgctgtctatggggtcgcacagagtcggacacgactgaagcgacttagcagcagcagcagcaacatcaaagagaggcctgtgtgatgatcacagatcatcacaataaatataatactagtgaataagtttgaatactgtgagatttactaaaatgcggcatgaagtgagcaaacctcgtcggacgaatggtgctgatgacttgctggacgcaggtggacttggcacaaaccttcagctgtgaaaatgcaacatctctgaagcacagtaaaccgaagtgcaataaaacaaggtatgccagtatgtggctgtcgcagttaaaagagaacctctttgaagacaaagcagattttctttcttttttttttttttttgagttgttttatttggggcaaaatgggaattgtggtctgggatagcacctcagatagctctgaggaacggctccaaacaaatagtggggagaaggtcaatatgtaagattttggagaaggggagtgttcagtgcagtcaagtgcttttttatgaaaggctttgtgctggtcacgaggagctgatgtcaccataaagggacttagtgcttttctaggtatgaggagatgcaaggattaggatcacaaaatcagttcccgaaaatatctaactgtctgaagaccgttgcacctgtttccctggagaacagtgtctcactctccagcctgagctcccttcagggcaggtcaaaggtcaacagctgcagtagcatgggattcagcctcccccgaggcagatggcagatgctcttggcaagtgccaatttgtagttgacagggtcccctcatggtaataaattcgaccatactttggcaagcatttcacgaccattccgttccacatcgctgggaaggctcattcctagctcgagaagattttgctcgcaggcctctcgatgagctgtcgctggactaggtcttaatggtcaaaaatctctggacacctgcctcctagttgtgtgccaggagaatgttccctcttgttgaatcttcacatgtctagagttacactattgttgaccacaaagctggttttctactcccctgcccctgaaggtcaaggacagtgtttgcccacatagtagggctaactaatgacatttatgatgggggatgataaacattccttgatgagtatgctctttagaaaaattaagctatcaagaataaagtccaggactacagtctggtttgcgtcttgctttttgttgggttcggttgctaagtcatgtctgactctttgcaaccccatgggttgcctcacccaggcttcctgtc

SEQ ID NO: 59515 - DNA, 1696 bp, Bovine  19866880375688
ctaatgtcaggtggggggaaggagaagttgcagaagaaaaggaaatcataataagcctcaggtgaccccctctgagtaggaagactacaaaatagagcaaagaaatgagaaagttaggttgtgccagtaaatgtttgaaacttgagtgcatctgaggagatgctggaggcaaagatgccatctgatagcagaacttggtctgagaaggcagggctgggctacctcttccatcaggcagtcggagctgatgagccctgacaggcagctctgaataattgctctaatcgcttcagtgagccctctacttcatcctaggaaaggagtcatgcctcagctggcttcagaagccaggcacccctaacctgacatctctaacaaagatgcatttatttccagggaagcattgcttgtcggaagcagtgatggggggagttcaacagaaagttggccgtagatcaggacctcgttaaaccactctggagtttgtatttgcaggctgccttgatgtgatgaccagttagtagagactgataatcccaagaaaggcagaaatatgtcacccggaattgggttgtagattccactctcccagagagtaggagataattagggcagtgagtcatcaaaacttttcatgtcaagtgtagaacacactctctccaaataagaaactgtcagatccgcttaaagctgtgagcgacagggacctctttccagcctgtaccttctcatcggagatgccagcttattttagagggcaaagggctgagacacttcacttgagcctcagtctcctgtgcatttgtttgttttgctacagaatgaaacataaatgataaaatttctcagcccttgaggcaattatatgcttgtggctttccctgatactcgagcatttttgcctcactactcaggtaatttctacagaagacaaagtagttgattctgatactgagcaatgaattatcccaccagtccatctaaagggaaggaattttcatgggaagaaagtattccataaaattccccataatgtgttaaaaaaaactatgggagctcataggtgtcaatccaagtaacttttagagcaatgacatcaaccatgtactcaccaatgtgcacacttttctattactgattgtagcatatcttatttgagataattatttttgtgtccgtgcccccacatcaatttgagcttcaagagggctggaatcaccttgttcaccatataatcctagggcttatcctagtccctggcaattaacaggtgctcaatgaatgttgcacaatcaaccttttttcttggccgtgccatgaggcatgtgggatcgtagctccccaaccagagatcaagcccacacccctgcagtgaaagcacagagtcttaaccactggactgcagggaagtcagcacaacccattttcttaaaccctgagttaattctttccattagcacaatcccaaataatcatcttaactaaagctgtgcttctatacaaactttcatattgtattgataccattcctttactcttttctgttgttctctgtgtcgctttctttccccatccttcattcattctatttcatttactatgaggctaatgtagggttttcctgaagagtatgtcagaaaaaaaaaaaaagtgaaagagaatggatatttattgagtgattagggtgagtgctaat

SEQ ID NO: 59516 - DNA, 1945 bp, Bovine  19866880480561
aacatgagtttgagcaagctctggtaagatagtgaaggacagggaaggctggtgtgctgcggtccatgtggtcgccaagagtcagatactactgagtgacagaacaacaatcctaattacaaaataggttatcttctgtcctttgacatttgttttcttaagaatattgaccaaagcaaaagggttgaccaaacactcctctgaaccagcatgcatgaattcctgagatatccatggatgcccagtaagttgaattcacccacagtctcaaaaattaacaggggcccaatgatgaaaatgcacactattcttcattttaagcaccatgaatgagttcttgcgttgttcgtcctctgggctaccatggctcatttttacacttctaagcacgcttttatttttcctcatctcctctttgggcacaaagtgatcaatgagctctatgcttggcagatgatggattcttaataaagatatcatgaaatatattgaataaaggataactacagtgatagttgtaaggatacattttaaagtttatgggatgttttgagtgatccacctgtttttggagctgtgaaattagaaattcccacccacaaggaaatttcacagttcaatgaaaaggaaggctgttgttgatgggaccaccaatgtattagtcactgtctgcatgcatgacaaatgttccagaagcagaaacgcatcacagggctcttgtaagatttttagaaaaataaataatagggatacattttcctaaatatgtgttcagtttaaaaaaatgctaatcttgaccttcctaatccattatcctcacttctaaaatacaatttgctttggttttatataggtttttccatatgccagataattaaggatcctgccttagcaatttcagagaaatgtgaattaagccttttatgagaccatgtgggtacagtttgaatctactaaagaaggaaattgaacattaagcattaacaccttccttttgctcaaccacaccttccaagggctcacatacggagaacacttgtgatggggtgccagcttttggtgccgctccgcatagccagctcacatttagggctcctattaacttgaaagagagctccaggtgcattcaagttctgctgaagaaatggaaatttggaagctttattattagcttaggccattttcaactctcacgtgaataagagatggagaaaagttattagaatctattttttttttaaactactgctcttaggagtgacgtcaaactaaacacaaaggtaggtactgagacaaaggtgtcggggctctttctttctgagtggtaaaatgacgtgggtctccctcatctttaccaaggcaggcaggcttcaatatgactcaaaataaatgttgatataggtataaaacttgaagtatttgacactcaggtaacaggaatcctttggtgttaaggagtaaaaaactattctgacaagtgaaaatggagcattggttggaattctaaggggatagttcacagaatccaaggataggaggtagaaccagaaacagatgttacggaaaccacacaactgctaacatctctgatttctaaatgtgcactgggctccttttgctttctccatagggcagctgttttctggaatatatctacacacagcagccatgtcgccgccgtgttaccgagtttactaggtccttcagttcaagggagcagaaagaccacctactgtttctttgtcttttccagtccaaccttctgatctggaagatagaacttgatcagtctagttcaagggcaaaaccaagtatgcagcccttgtcaaggatgggaggaacaggatcacatagtacaaatcccgccacaggagtttcatcttgcttccttttttcttttaaaggtgtggacacctactctatgaggcaacgggccatcaagaca

SEQ ID NO: 59517 - DNA, 1457 bp, Bovine  19866880526420
tataaacagttggattccggcattgaggcagcataaacgtatgactgtgtttaaagagggaccacttgttactttctttgctacctatacaactggaggaaggactctggaaaatctcatgggtgtaacagaaacctccattctttcatttatgaatgcccgaaacatgcccaagcgagctagactgtggaactggaaccctccaaaggatctcccaggcaccatagcaacaaatcacaagggtttctgaacaatatatcatgtcagtgaggatatgactgccaaggctcctttgtgtgtagatggttgataagatcaactccagctatcctgaccattacagtattaaggagtctcatgtcaacacagctgccttatcaagtttaatgtttttatgactctgatgtggtaaatgtgcaattactttgatagttatgacttgcagtacttagaaacatgtggattaagcaagactgaaagtagacatgaatccaacctttgaaacactcaatctctgttgcaattccttctttctctcccttgaactaacactgattattaatagcggattattaagctaattaaaaatttttagagaaatagaaaaaatcaaatagcacaaagagaaaattaaaattcactcttaattttaccataaaaatataatcataaaatagagccaatcttaagcacttcatctttaaaatttttatttttatttaacattttatcctgagcattttactactatcctatttaacatataatgttccatgctctactttcagcattaagactatttctaatttctatatattataaaaaaggtattactggaatgtttttctgtgttttaacacatattcaacaagtagtctagaactgaaactactgaatcaaatattatacattcttctaaacttttgatataaatttcttccaggaaagtaagtgtaaaataatttgaatttactttcacttgcacagcactaggtgctactacggtttacaagccttgatggctatcttaataacattaatctacaactatgtattatattacttgtgtttacttttcagatttattgtcaatttgcttattttattgatgaagtgtgtgtgtttttatccagtttttataatcactggattagatttagactaatccttattatttgcacaaatactttgcttttcttctgacttgaaaacactttcttcactttttggtttgcttcacaattttacttatgtatcattacattcggaagtctgttgcttactcataaccaaatatattgaaaattttatttggaattctctacttacttttatgatccctatgccagattagataaatatttccaacttttccttttagatgttttattatttataatttcttatttaattttattacctatctggaaaataccccaatgctttttattattata

SEQ ID NO: 59518 - DNA, 1205 bp, Bovine  19866880539563
tcctgtatcctgggtaccctcagcctcaggaaaaccagggtggatgatcatcctcgttcacaccattccccagatctagggcttagctctgtgatgggaaattatgccgtgcttaaaatatttgcattaaacagaattgaatgatgcttaaagtgagtaaaaagggaattatcttttactctcaataaccttatgatctcaacaaaatattgctttgagaaggggagaaagatggtgaaaacttactcaaaatgacttttggggtgtgatcccgatcttttaccttgaaagtcgcaagatggatttaagactgaaaatacatggtcagaaattaataagaccagcctgctgagaatgggggcctgcattcattatctcttcattcattcagcaaacagaagttttttcctgcctgtcctctccatacccccagccctctaccagattcactagcaaatactattcattttcctgagaattttcagaaattccctaatcaaatgcaaatacgttgccaggacattaccttaaactctgtcagatgcaaatctgaagtggggagaggaggcttacatggaaccccaggacaaggaggactcctagggtggcctgggttaggctgtgtgacatcctgtttctatttcgatgtcccctcttcactcacatccctgggaacatgagtgtctctctcagtaaatgcctgatctgtgcttctgaagaaatgaagggcttacaaggaacaaaatgtcctgagtcacttaagtaaacaaatccagtaagtcccctataaaatcctttgtcattttaaacactctagactgctttcaactgtggaggagtatttatgaacacggcatgttgaagagacagcatccaggatttccatcttccaaacaagaaaattggaaagcatgtcctggtttccactgagacagtaagggcaaaagctattaggacacctcatcttctagaatattaaaaacaccctcgcacacttctccaggtcagaagaacagggacccacccgctggagaacagcggtaaggcagggcttctcagacaggtacgtggtacccgagccactgctcatgaagacagaggttaaagtggaaagaagggaaacaggaatgtttctctgtggacccgtgatccctacttacttctcaaaggatgaaactacttcagactttgggggaaagctggag

SEQ ID NO: 59519 - DNA, 1327 bp, Bovine  19866880597479
caatggatgtgagtctgggtgaactccgggagttggtgatggacagggaggcctggcgtgctgtgattcatggggtcacaaagagtcagacacgactgagcgtctggactgaactgaaacatgagtgacaaaatcataagggaaggtggtcatgtagactgagtacatgaggttgagtgtgtgtgaccacaccaccagggtgtgaccactcttagcgggtgtacagtatgctcaaagatattaatttctctgaacctaagacacgtgtagactaaggggaaagaggttagggaatggtgtgctctgtgaagagctctaaatcggaaattgaagctcttgcctttagagtaattagtcctggacactactgtatcggatggtgaaccttcttcatgaaataagtacactttcactagggaaatggatccatccaactggtgctttctgaaatggaacaggtacacactggccactaatagtttgcttccaaccctatggctaagatctggggtgccacagaagtataagctcatacagtagagccaatagagtcttgggttggacttgctagagtaacagtaaggcttaggtcgggcagtataggaatgcaaggcctacagacagtgctaagtgattatagatccacagcttccttgtgggtgtggtccatttcaagacccacaagaattagctatcacaatccaatgtttttactctgtttcagatccaatccattccagatgctttgtttctactacatttcagatctaatccatttcagatgctcaggctactgccaacctgatgctctccttaaaaaaaaaaaggaaaataaaaagaagtgtgatctagatccaaccatttgaacatctcgtaatggttttggcagaggagaaaggtaaaactctcgattaaatagcttaagaagacgtcacgtgtgtaaaggctctcacaataagagatcaaaactaacatttactatgtgattctacttttcaagctttttactctttgctattctaaattcactctgatgcctctcttgtttataaattttgacaacagctagagttccttgagatttagaaatagccgtatctccactctggttcccacttcttgcatccaggttggaactggcaaagtaggctgctgctgctctgggtgtgtagagcctgggtgtctctctgtgggaggccagggaggctgtgaagctacaggattggggcctgaactcagcttggatggcaagggaaggagcctattacaggatcacaaagctcctttccttccttcttggcaggagttgttgcttggcgtcagcagg

SEQ ID NO: 59520 - DNA, 1083 bp, Bovine  19866880668179
tctcttgaacaaaactgttggtagtgcccataatgagctcaactattacaaataattaacatattataacaaataattttttacctgtaaatatccataaattaggtaaaatacaaaaactccagcaacacatataaaaaactgagtcagtttgttgaatctgctgagatttatgccaagcacgacaatgtcatctatagacttgatgtgtggtgacattgcttgggttttggatgggacagtgatagaaatgtatttcctggagctgttgaacttgagatccattgttcttgttttgccgcattcagtgctaccaaagttatctttgttggtttcctctcctttgttcaggcctccttctgcctgctgagccaagtcctaaagaaggaaacaaacaattcaagcaaaacatttagaccatcaagtaaagtgctatgctccaaatactatctcagatcgcattttgaaatttatataggtaagagtcattctctctggattttaatacattaattctcttcttcaagcttccaattgaccaaaataggtttactctccaaacaatgtaccttcacctgataaaaaccaatacatcactaaatatacaccattcttatctccacagcaacacatcaaaagctaaccttgtatttatttcaaagaagggtgcctttattatgcttctatttgtagtgaggatataatttttaaagcccacaacagtatatgcagaacgtcttcaacattaaagtcaatttctaattgtagaaaagagtaaagaacagcccaaactcctacagctgctaagccaactgtaaaatttatttgctaatgacactgcaaaataaagtcaaacttatgtaagttatgtaaaaatccagatttatctgagattatagaaaagatactacgctttagcaacagcatctcttgagttaaaagggaaatgttttcttcctttggagaacattactgttatttaaaaagtctttggtatagttgttcagtgggtataaagcttcaattacaccagataactcggtcctagacatcacctgttgcagagaccctataacacagtgc

SEQ ID NO: 59521 - DNA, 1717 bp, Bovine  19866880706728
cccggaagtggtatgtgttgcttaaccacttggcaactccatttggaaccatatgaggaactgccctgcttacttttaaacgacatatttttatgattttaattgtgaaaaaaataagtgaacaacctttcaaatctccattcatccctcttgcttttccaactgggcaatattcacacaacactgtgaaaagcagactgattatctgccttgttgccgctaatagaaaggaggagaaaatgttcaatttctgtagaataaaaagcaaaacaggaagggaacttcgttgccaaattccattataaatggatggtgtctttttgaggaatactgaaaatccttcaagtccaggaatatttatgaagccttgaagcctggcttgctccgcgatgccaatgcacagcaaagagttttagagttttgaaacaaaaccccctagaagccctcatggaacctccccaggaagctggtctttccttatcttgctccttgaatcatttatttaagcggcaataataaaaggtgtcagcaattcagctgtgagctctggaagatttctgtgctcattgacctttaagcatttgcgtcttgacaggtgagctgttggtaacgtttcctgtgagatatggggcggccaggggtcaggcatgctaatgataaaattaccatttaccttttacctcggcaggcctggtgcctgacattataaatgtaggtaacctttcacctgaagctcttttttttttttttttgctctactagagactgcggggacgaacacagttctggaggcagatgacttatggaggggaaaagactgaatttagtgcattttttcccctcttgggcttctttttgggaatgccttgtcctctctcaacctggttagaacactgtctgtccttggggggtgggcttggggagcagggaggatgtgtgctttgtcatcctcttctcttgacatttttgaagcatggcggtggcccgtgttctttctctaaagctgcaggtattaatgaggttttattggtggcctgctttatctggaacatcaaccccttcctgctgattccagtagagtggcatttcactgctactggagaccggacacggtttagtaattagggacttggtggcaatttacagagacctgtgcttctggctggtgcaaaagaaatgtaaaacacagagggatgctggtaacagaagaaaccgctggcagctcagctcaatcagagaaagttaaagggaaatggtgttaatgcccgtttcccaggttggcgatttgatgcggtagaagctgtttttttttacatatttattgatttgtctttaaggagccttgggatgatctgattctccataagtaagtcttagtgacatctttgaagactctggactgggctgaaattgaaatcaaaatcctgtattatcagatagtaagattcatttttttggatatcattttaaaattaactttcatgggagtatgttggatttgcaatgttgtgttagtttctgctgtgtagcaaagggaatcatttatacatagaagtatatccaccgttttttagattcttttccccgtaggtcattacagtgtactgagtcaagttccctatactctacagtaggtccttattagttacctattttatatgtagtagtgtgtatatgtccattccaatctcccaatttatcctttccttccactccc

SEQ ID NO: 59522 - DNA, 1597 bp, Bovine  19866880732423
tgtcctgcatatatcctcttcttctattgactttttgcatatatatttctaacttataagaattatgcccaactttccttctgatttgggggcaagaggagaaggggacgacagaggatgagacggctggatggcatcactgactcaatggatgtgagtctcagtgaactccaggagttggtgatggacagggaggcctggcgtgctgcgattcatggggtcacaaagagtcggacatgactgagcgactgatctgatctgatcttccttctgattatttcttttttactacagtaggttgggtggcatcactgactcaatggacatgagtctgagtaaactccgggacttggtgatggacagggaggcctggtgtgttgcagtccatggggtcacaaagtcagacacaactgagcaactgaactgactgactgaagtactggggacttgatagatagaatggtttatcttaatgtatcatagtgagttagatgagacagtgagtatgtctggaatgagctgttttttattactaatcatgcccatgttttcctatcacttttgttaaacttcttagttaatttttaaagttcatagtctgctagagttatttaaaattaaatattcagcactttcccagggtttactagaagtaatcatttaactaggatttcatttgctgcttaagtacacacctccctcccccacacctataatttctgtgcacacaaatctacttatattttaacaacctaaatataaactttcctcaaaacactatacccactcagtgcttatttttccatgaatgattaatgacaacaatttacatagaatattctactaaaaatcaccttaaataacaacattgcctgtacaatcccatatctcattgcagtggagagctgtgcttagaataaatgctgctactttaactagttgcaaatcttccaagctgaatctctgaagaaataaaatagttgaaagaaagtatattaataggtatgggtgctgactattttatccctattcccagaagcagcgtcaagtaatcattataaattttccttctagagccagcggactgggttcagatcacaatttagctctatgctcttgggcaatctatttaacttttaagaccctggtttctctgtgttggcacaaggattttaaaaccatagtgcatatatttttaatgcactatatactacatactcccaggatacttagcataggcttagcacactgcaagcattcaaaaatattcatttttatgatcaacaaaccaaatggcaatctctcagaggaaaattattgcatctatgtaatccccaaagtgatttcatcttttttatttcttgtcaccacattgcattttgtttttacctccagaataggtcttactacactcaaattatgtgtataaagtcattttttctccatttccagctatacatttagaactgagtggccagagatagtcacctttacccttcagcatgactagtgtgaacattgcctgaatagctcaaatggtaaagcatctgcctgcagtgtgggagacctgggtttgaatcctgggtgggtaagatcc

SEQ ID NO: 59523 - DNA, 1161 bp, Bovine  19866880761498
ggaaaaaaaagggaggggaacaccctaatacactcatggatactacaaagcagtgaatggagatgaatacagggggttaacacttattaacatggacaaatcccacaaacaaaacgtcaagcacaaaagcaagtttcagaaggatatagcgattaatataaactttcgaaacaggcggcttctacaaggaagcaggaggggctgggtcggtttgcagttgctgggaggcacctggcgcggagaaaagggggcgcacccaggccagggtcccccacccccagcctgccgcaaacccgaggccgccggggctcgacccgcggctcggccccgggtcagagggcgccgcctggtcgctggggctgcgctgggaccaccaggcgagagccctgctacgccatacccttgataatgaggtgcgccggcgagcccgtgaacccctgagagtccttcttcttgccgcgccgccgccgccgccaccctgggcggcctcgcaacccaccggggtctccgtcccaccgctgctcatcccgaccagctccgcccacccgcgaccgcgctgcgcctgcgcacacctctgcggacggctctccctgcgcggggttttggcgtcatcaaagggcgtcggggaagcagagtcaatccaggggcggttcccgcaagggcactacggtgtagccagtgacctgaccttgaaggaagccggtgccgccatgctggattagggcagatgctgccggcagaggaggatgtctgaaagttagagctaaacttattcctcctccctaaacccgctggcagtggtaacccactccagtatttttgcctggaaaatcccatggatgggaggagcctggtgggctgcagtccatggggtcgctaagagtcggacacgactgagcgacttcactttcacttttcactttcatgcattggggaaggaaatagctacgcactccagtgttcttgcctggagaatcccagagacggcggagcctggtgggctgctgtctatggggtcgcagagagtcggacacgactgaagcgacttagcagcagcaaacccgcttgagaggtttggggaggttggcggagagggaatttagttatagaataatattaataatgtgtgtgtgttagtcagtcgtgtccgactctttgcga

SEQ ID NO: 59524 - DNA, 2162 bp, Bovine  19866880768066
tatttaaatacttggccagccagcgtgtcaagctgcttgtgttggggtgtgaccctgcgttggtgaccgaggaaggtttccgtggccactggatggccccgccccctgtcagtcactcagggccctcccatcaggccccacctactccacacgccccgcctcccctgctctgacctgctgggtgttaatacctctccgctctcactctgtccttacccccggcacagtttcctgacctcctgcctcctcccagttcactccacatccaactgctccatgtggtcttcatagtccgtcattctttgactagttccatcttttctcattcagtgaatctgaggctcctaattttgctaaagtcgggttgtggagacctcatgtgaggttttcatgcctcatatccaccttctggaggtttgttttcctccctccatggagaaaacttccaaaactccagatgtgagctaccttcagacttcacgagcaggaaaagagaaaggacaaggacttggaaagccagcatctatcaaccccacaccctggctctccattcttcctggacagccaggacatcacctttgaacagtaaaccatttgcttaatcactttgcttttccctgactgctggtaatgaaatgctgcactctctaaaataatttcctgactatttgctaagattcatctctgacatttcattaaatatgatcatttaactgtacaagtacaaatgcatttttaatttagcttaccgcagatattacagatgtggggaaatgaattcacattgctctaggacaaatatatcattcacatatgcaagcgacaaaagaacaaattattaaaaattactgaaacttccatgaagatttatatttaacttttccattttcaacctccacgtcactgggaaaacacatagcatatcacgctgtcagccatgattctgtgaagaatgtgggcggcattctgaaaggctctcgatcaacagccttgtctctgtcatcgacacactgaggcaggaaagagatggagacgatttcaagagcgaagttatgaggttggcagtcttatcactaaagcagtcgctaatttgccttccctacaaaaacaaaacagcaaaaggaagtatgtcttctatgccgtgtgctataatccaatcagaataaatgcgaaagttattgaataggaaagtgctcacatgcgaactgacattcttgagcatcttattgggatctattgtcattgaattcaaagctgactgaggaaggaacaagcttggtttggggccttgagctgtaaagtcaagaacttaaaaaagtcatgagctaacaattacaatctcatagggtgtcaagtgtttccacagaatgggcttttattactgtggaaagaaataggattcttttccaaaatctttaagatatggtatggcggctcagcagtaaagaacctgcctgccgacaggctaggatcaccttgctgcgtcatgaagcaattaggccagccagtaagagctctgattcctgagccccgagcctgtaaaatcccaccactcataagtgtcactgttctgctgctgtcacaagtgatgtcgccgagtgaggctgcacgcctgtgaggactctgctcattctcgacaaaggggattgaggggtgtctaaacctcccaaaatgattaaatgaccattagcaaagttgtttttttttttttttaaccacaggagcaagtgtgccatttgtcaaaagctgaaccttgatgtgctaatccaaaaggattttgaatgcaatgtgttgaaacattaagagactaactctgtctcttagcaaacagctggacccaggatagaagtggacgtgtctcctcccatcagtgtttgctttccagtttcgtaggtttgcatcacacctttcgtttcagaagcttggcggcaggcgcttttttgttttctggaagaacagcagcatggtttcagtcgcctctagtgcacagggggaaacttgaaccctctgttggttccaagaaatattttccctcctatcgtgagcggtaaggaaggagcagctgtactctgaaggcagcgggaatgacgggacggtctgctcacctgcaatgagacagagcttccagctcccccagcgatcccccaaggagaaatgcaggt

SEQ ID NO: 59525 - DNA, 1451 bp, Bovine  19866880770864
gagcaggaggcttgataaagttccccctgaacctcacccccaacttttagttccattagccaaataaaatgaaatgttgttgatccatagttttaggcgggtttatttcacttctgtgtgtgtgctcagtcacgtccaactctttcagaccctttggattgtagtctgccaggctcctctgaccaagggaattttcaggcaagaatactggggtgggtccttgtagccaaaaccatcacaactgatatgggaaaaattccatctgccaatcaggattatttaaagggctaaataaagaatccacgtgggttccctggtgactcagctgcatagaatctgcctgcaatgcaggagatgcaggtttgatccctgggtggggaagatcccctggaggaggaaatggcaacccactccagtagtcttgtctgggaaatcccatggacagaggagcctggagggtccatggggtcacaaagagtcaaaaatccatggagaataaccttgtagacatcaagggcaccgttaaaagtggcttccctccttcacctgtagcttcaccatctcttcccaacggtcactggaattaagaagtcgggatccatgaggaaataagttgattgaaagactaagtttcactttcatatgagtaagagtattaaaatataagttactgagttgcaaaattatgttttaagactacttatttatactatgttatatgataataatatgctaatagtacagtctttggactattggtctattttatacacacatatttatactatatacacacgtgtatgtatgtgggtgtgtatatatatcttcaggcgttacagagcactatcaaagccaataaaatagatacacctgggctattttatattttgtggtttccaagaaaatagtgcattttttcccaaaaatgtgtgtaagtgatattttaccttactttgaaacttcagttcttccagattttccatattgactacttgggaaaatatgttccttaaaaaaatgtgtttttagtacaacacttgctcaaatatgtatagaatgtttgctctgaattgtattcatttacgggaatattttaggatgttttcataagaggggaagcaaaacccaaggctttcagataggatctataataatgcttcacaactgaagacagttttcttggggtctttgctctttctaaaaaagaagaacaataatgcgccagagaccccaaagggaaatatattgttaatggaaaaaattgccttcattcactctttctatttaagggagctcttgctgccaggttataatgaaaacataaaggtctaatacaaaactgatcaaggggaaggaggcaggggaaagtaacccagcatacgcagcgtctaatccagatgttagcattagtggggtagccttagtgaaagacagccagcaattgttatcct

SEQ ID NO: 59526 - DNA, 869 bp, Bovine  19866880848903
aatatatttttgcactggttactggccctgttaaagcaattgaattattgccattatccattatgtaacagatttggatttctaggacagaaattaaaatacaaacaatcagacaacaaataagtacgaatttaaaaatatccaatgagaaaaagtcaaatctacaaataagaaagatcatcatcacctgattgttatgaaccatctgaatatagttttcaagatattgttcactctgaatagagaaaaaatgactcccactggataagagaaaaaaagcagtaagatctaaatcttaatcaaatgttattcagacctctgtatctaggggctggctttacaggaacatttagaaagttgtgtgtgtgtctccaggtctcaaatgttgctttaaagacctcgtgtggaatacaattgcattcaataatttcacattgtgtaactagaaattcaaagccagtaacaagtatttttgtcctcttttgaaataaagaataatatcttcatcgactgacaaaagggattcttaggagcagggactatgcctttaggctctaggacgatgacttttttagtgtctaaatgcaaactttagttgaattacggctctaattgatgggacttgaaaatcagagcacccacaggccactttgctacatagaacatcgtcattttcttccacattgaattaattttcaatcaacattgtttaaaaaaatgagcaagaggagaaactggctaccaatactctaatgctatttcaaatcccaaagcacaaagattaattaagaaccaattaatatagagggtatacgtcaaaagcagataaaggagagatgatgaggtcaaagtaaaagtcgttttgtttt

SEQ ID NO: 59527 - DNA, 1062 bp, Bovine  19866880864235
ctttattaactgaagctgtaagttaactcttttttttttttttcagagagaggtagtggggacagcccctcgtaaagtcagaggtgtaggttagagcacaaagcagaaagtaggcagactctggttttgggggtagatgctcgagaatttccagggggactcctgaggctcgatcccgcctttgcgtatgccgagcctccttcctcatgacctttgccacgggcagagctcctgctcccggcacagtcctgtgttcctatgtccttgggaatcactggctcagagaacacgcttcacagagtgtaactccccatcatctctgagacctgcattcaagagctcttttcatgaagtcactggattttcattagctcgcatgacctgttgcactgcatttgtaccaggactcttggggagctttattatccattatattgcttcactgcatgggccaggtacctctgtcattaggctgaaagaaacaataagcttgccttcctgggcacagcttgggcaatgccatcggatcagaaaggtgttgtaatctgggagacggcttaacggcccgcgagatgcagtggctctgcaaccttcactgagtctcagctctccttcccctttagagagcaggggaaacacaaagtataagcccgcatcctttggacgttcatttcaggtgggtttgctctaattatctattcccagacctctgtgttcattcattcttccccagctaggaaaggaatgcagtctttcagatgttttgatatttttaaggaaattttataaacatttttgcaaaatcattttgttatgttctcccttaactttcccaaaattcacaagttcaatttactgatttctagggacattacctcttgattctgccctgcctttctccctccattcaaaggcagtaactggctcaccagatatattatatagttagttcatggttatatatagggttttctttgactaataagagctaaactttctggtggctgtcttccttcgtttgggctacaccactcccatctcgcctccaagttcacagggtca

SEQ ID NO: 59528 - DNA, 1071 bp, Bovine  19866880871479
tggggaaaaggagaagagtcattgagttaagaagggtgtgccatattctgggattgagaagaattgggctggtctacagagctcttattgggaaggagtggagaatcaggttggataaataagactagattaccatcttgaaagtcaggcagaggcatttgacaggatcagcaactaatggctcttgagatgaattttttaggaagaatttccaagtgacattaaacagcaaggacaccaggaacagagccccgttagttatgaagtataacctaatgcgaggtgatgcggcagggacagtagcaactgaaaggaagggagagatgccagagatgttaaataggaaaaaataagatgtcaagttgtgtttaagaccaaagggaaaatctacctaggtacctgaaataatgaagcagcacaagtgtctaatttattctggaaatgaggacaggatcagcaatatttctaagccaacaggctgaccttaaagcttgctgtaaagcagagtaacaagcccatatcaggaaacaacactggcctcgacccaggagcaaaagagtctaacctaagacagaataacaaagatatatagatattggctatggtgaccttattttcagacttaatcagtctccttatttttaatgcacttacacaaagacttataaaaaggtgaaaacctaaatcatattcaatgaagtgtttttcaagggtctgtgttattcttattatattttaatttggtttgttgtaaaaattacatgatatctgaaaaaaaaatgtatcttttatatctttctaaacttttagacaaatcttgttccctacttttgaaaaatatactactccttcaaaaatattggcacttatcacatatttatatgtcattacatgatttcaaagaggcaattcaaaatactgatgtctgctttataaacagtgataattatttatagctattggaactaattctttttcccccctttcttcatttttaaacgatattttaattagtggaaaattgatttacacttttgtggtttgtttctgccatacaacaatgtgaatcag

SEQ ID NO: 59529 - DNA, 944 bp, Bovine  19866880912282
ccaggtaggatccaaataacttaaaagcgtgcttatttttcatattgtttccagcatgtatgactgcagagttctaaatgccttgtttacatggctaccatttgaatggctgaaagatacattgtgttgatttagacacctatttctagagatgaaaaggcacctaccaaaagcacaccacataataggtgtgcttttgctgcagacacaaaacacaaatataaaatgcagaaggtaaatcttcaccaggagaattctacttttcccctggtatgtttacacacaaagattacatcaaatgctgtcactggcaggatcatctcatgtcgttgataaaaacacatcacatcattaatccactaaactaaatgactgcttttagttgcttatgtattaaattcttataatgagtttatggtacagaggatataacattgtagatgcatgttagttacacaaaatatacctaattaatccaggcccttcatattattgaaaatatagacagatataaagcatccagtggaaaatcttatgatgtataaattctatgctatgtcttattaaaggggaatctattacaaatggaatttctttatgtccctctcctgcccatgttacttctttctgcaatacttggtattagaggaaccatcagagaaaatgaaaaataaatgtggacacttgtaaacccaatgatgttgctttctaattttgtgaggatggatgttgagcaaatctgtcccactctgtctgactctgggttggaggactgtggtactaagtgctggtttgaaccccatttaaaatttcctgaccatgcacaaacacacacacacacacacagaggaagaaaagccagtgcggagagagatcaaacttgagcccttctgctacataaaatttagcagccattcaacaaacaatgcttcatgttagaagcg

SEQ ID NO: 59530 - DNA, 1367 bp, Bovine  19866880933059
tgacctgctgtaggaggcgaagaaccgaggggtaacacctgtctgcagatgcagagatggggacccctctccccagcctgcagcaagcactcagctccccttctctgtgcagtaacagtcacacggctactgcttaactgaaaatttgccttttatgagtctgctttccatttgaaggtacctactactaacaccctggagaaggaaatggcaacccactccagtattcttgcctggacaatccccacggacagaggagcctggcgggctacagtccatgggatcgcagagttggatacgactgagcgactaacacagacacacacacacactactaacacccaggacttccctggtgggtcagacggtaaagaatctgcctgcaatgcaggagacatgggttcgatccctgggtcaggaagatcccctggaggagggcatggcaacccactccagtattcttgtctgaagaaccccatggacagaggagcctggcgagtatagtccatggggtcacaggtcactaagagtcagacactactgagcaacacacacacacacacacacacacacacacacacacacacacacacaccccacacatgttactaacacccaatcctcaacagcactctcctttttttcactatgctctctaagttcaagaggtgaaattcactgttcttttctgtttaaatgacaatccactttttatttcttgatcaaaaactacacaaaggtgacacgttaagctctggttgcctggattcacagtggatgtcttacaagtcatatacatatatatatatatacacacatgtatgtgcatatatatatgaatacatgtattatatgtctcaatatgtaaaaagaagaaagagaaaaagaaaggaaaactcaaagaaagagggaggaaaaaatctgtgtttcaagtaatgagcatgtgcacctttttgcctcaggccttcatacacaatttagccaggaagccagggtagatcatgatttagcttttgacatctcctgcctccaggccaggagagactaataccgatttctgactctgagcacgccacaggaaaaaaagtgagagagagagagaggccttttattgactaaatgataaagaggtttgtaatgataaataacagtcattttattgtggaattccccagaaaagatgcattctgctgtgtctgaaggagcctaaaagctgaggtcggttccctctggagccgaacctgttaaactccaatttttacagctgggaatggggggtcacaaattgtggggacctctggctattaaaactgcacgtgcatgctgcatacccctggttgcagcctgtttcaggctcaagaaaaagt

SEQ ID NO: 59531 - DNA, 1214 bp, Bovine  19866881008372
ctgacactgagcccatcttgctacatgtcactccagacccagggaaggataaggaagaatggatggatggtggaaggcctttgtctcataccgatgggattcttgttgggattctggcctcttgagtcagagctgcctcgaaaaataaagcaagaccaggcgatgccatgtgataagctgagaaatgactgtcagtccctcagcctccgtgaggctccttcaggaccctgtcaacacaggtcaacacgctggatctgatctcagagttgcaacaaaaacttaccctgtgtgctgtcacgctcaccagctcagagaggaagaatgggaagaccaaatcttcttgaagaggacaccatggcccttccttccatgcagcaaggacttcccaatcagcaagcttccgaggctatttggggcacagctcttcagtgagaattctctccgtgcctggaaagaatgaaaattagcagtccaaccatgtcatgggaacaacctgggacattacttaatagatctaattacatgagaataatttcattagcaccagctttcagttgaatatgctacaaatggtccccaaaatgtgtatttccttcctggaacctatccgtaatgagatttttgtggctgagggtttattccataggacacttccaaggcccccagttttgagctagatgaacacattaagcaatgaagcatgctcaggtttgtatctgtcgttatttattcacaaagtcttcctataaacaccaggataatgtcattgaagtcatgtgggcagtgttagagagactaagtggtggacacatttgcagaggccaggaattctggctcctcattgaccatccttctctcccaaggtgggaactaggggagccccatgcatcctcccgggctcctcacgagggagcacttcctctcattgtgatgcagtgacctgagtttcctgctatgaacaggcttcagatgaaatctaaccaaagatcttcccttcttttccttcctctcctctcctttcatatcttccttcttcttttcaatttctctctcttccttttttttccctttctttccctacttctctccctcttctgccctccaactctcaacacactggagagcaaacattcaaaacaaaccttgtacacacacacacacacatatatatatattatataatggaatattaagtcataaaaaagaatgaaata

SEQ ID NO: 59532 - DNA, 1071 bp, Bovine  19866881053355
ctggaaaaaccatagccttgactagacggacctttgttggcaaagtaatgtctctgcttttgaatatgctatctaggttggtcataacttttttttcaaggagtaagcgtcttttaatttcatggctgcagtcaccatctgcagtgattttggagcccaaaaagataaagtctgacactctttccactgttttccccatctatttcccatgaagtgatgggaccagatgccatgatcttcgttttctgaatgttgagcttctgggtgattgttatgattaaaaatatatttttaaccaataaagttttcttctggccagactctgaggcaatggtccatttcttctaccatggctctgcgtggtccctggattccagcttaccccacgtgctctgcctctctgaatggggcttgtgcctgtgttcatatttcagagttcctgtcctgaccatatgcccactgtctgtctttgcttttaaaaaaatagagacctggctcgatctttctagagttcatgtcccatgaatctatgtgatatataactaataataagataaggcaaacatgttataattatcatcttggataagtaaaggtgaagacccttagtgatcaatgctagaaattcatgtggaatataaggcttcaaatgaaaagaagtacaatgaaaaactgaattatgttcagggagagtcaccgagatgggaaagagtctggaaattgtactaaagaaggagccattttataaaaataaagaaatagaaggaaatttggaagagagtttttgactatcttaaagggctgtgatggggaaaagtacgtaggtgtgattatggtcagaaccagtaccaataaaaagaaagaaatcttttcaacacttagagcattagcatccatgaaaaatagctgacctggaaagcaaagacagtcccattctcagagaccactttctgtaccagcacataggttagagagaagagtcttattttaaagagaggcatgggattagatgcccccaactgtcattctaactctctgactttatgatctgatcatgcttcaaggaattag

SEQ ID NO: 59533 - DNA, 971 bp, Bovine  19866881091640
ttcttagtcactaattttcctgaagacatgtagaaacactctgagcgacccttttcagatcaaaggaaatgctggtctgtgggctttccggcagactccacgctgcctccgggacactcttgacagctggcgttcctggattgttcggtagctatttcttttttacttctttctttctaaaagaatgatacctccactggtgttccaaactccaaaacaaatgtatttcaattgataacaatcttatagttgagcagcacgtaacattacaacggattttaataatcttgagtaacagcttgttcatgggggctgctgtgtaccggtgaaatcacttcaagagatcaatgagtcactgggctgatcacaaatggccacagtaactggcagtgcaacaaaggagaaacaacgtaacgctccccagagggaattaacagaccagatctcaggagtgactgggccacagctgaaagcggcctcacgcgaaacaaaacacagcgggatcgtttgatgacttgaaggttccctgcttcatacagggtgctgattgcactgattacatattaagtattcaataatgtgaacaaggaaatgaaggaacatacgagggtaaaaacaaatacacagccaagggaaaacaagaagctatgggatgaacttgagcatggagctatctgaacctcccatcaaccctgcctgaaattaatacccagaaatcacttctcacctgggtaagtttacacccaactcagcaggggtgtcattcaacaccacagggcaacacggtcacagcacaggctccgtctgtgaggcctgttccttgagaaggtgtttcctgctccgatgtaacctgcctgcgtgtgcacggagtggaggctttggttgtggactcatttgatgaacccaaggggacggtgaagtgatttacatattattccactcaattttgtttcagaaaaaatagcatagat

SEQ ID NO: 59534 - DNA, 1469 bp, Bovine  19866881168125
ttttcttcattaaaaccaccacgcctcttcatttaactcatgttttagtatcttgattcaacaggatcataaaaacttttatttttgttgccgctgcttctttttgccccagggagacgtaaaagagaaacaagttaaagaatatacagtcagcccttctttaaaaatatataactagatttctaaaggaatgaaaaaatatagtactagcgggaaaacactgcagtcaaatctatatttaacttgaaataacataacttttgtgggtgtgtttgacattctctcatacctgctacaacccctgtgagtcctcagtaaatattaattatggataattgacaattcttttcttctaatggaagctgcagaaccaattctcaagttttcacttcgtgctgctacagcgaagtgcagccttcaacaaaggtctgcgttctctgtgccttggaatgtaaacatgatcatcctgtgagagatgagtgtgcgtctttctggatcctcaaaaagaaatcaagtttctacagagaatcctcacctaaagcaaacaaacaagtcagcctcatcttttgtctttctattttttaaagaaaaagaattaagcctgattccgaccaaccattctacgttccaaatatactttccaatttacaagtttctctgatgtgaatgccttttattgaccatcctgtaaatggcttaaatagttacaatctcctaattaggagaatttaatggcagtgacacatgccaccagagcccttaactgtgtttcctgtcaattctgatcaatctgttgtgtttgctgtaaatctaactgcttagtgatcagtgaataacatgaactcattgcctcagctcactttaggaatttattttgcaatgggcatggatgcatgttttaaactagacacaaacccaaacctatgtgtgtatatattaggttggccacccaaataactgttttggccaacctgatatatacagacaaacatttatatatactttatgaataatatatataccacatattatatgtgatgctatatataagtactttcataatctttccaaattaaattacatgtacctttagaatagagatgactatagaatccatctccactatgattgtttttggtaaataaagagtttcagagaagcttaattattatttttttaaaaaagatttaatttattgacaagtttccagaaacatagccattttctcaagcaaagttcacctttgttcgctctcttcatcaccaactgcacgccaacctacagcttctccatgtttctactacatgtttcaacaagtatgtaatgttagacatgctgcttgctttttagtgtgggttgatcatttcaaagggaatttgtgtttagtaagtgcagaacttttggtaagaattaaggtcattccacctagcctgtcaattgtacttattcaaatatgtatccaaatcaga

SEQ ID NO: 59535 - DNA, 1155 bp, Bovine  19866881179542
aaggaaattgtgacacaggctgcatcatggataaatcttaagaatattatgctaagtgaaataagccagtcacagaaagacaaataatagtacatgattctgctcatatacagcatatataaaatgctgtgaacaaaatcatagaaacagaaagcagaatagtgactgccagggccttggggatgagagaaaggggaagttggtttaaaaagttcagagcattagctttctgagatgaaaaagttttgaacattgattgcaccacagtgtggatgcccttaacattaagtgaattatgcacctaccaatggttgtggtggtagataaaaatctgattaattttaacatgttacacatatttattctcaattaagaagttaaaaatatacatatattaaaaaatctaacaaaccaatacattttaattctcttaagacgtaggagttgttgaggagctttttatatttaaatggagaaaataaatctaacgtgagcatgatttataaaatgtccccccatctccccaaatagttggagtctttgaaattaccatagatggcactgtgaatatcattttctaatattttcttatttatttaaaataaaataagatgaataatatcctattttttaaaatgagttgatgtatgatttgtgatttcaaataaatttctgttattgtcaaagattgaatttattaaatttcagtgttttgctttctaatggctttctaaatgtttcaaatcaaatgtataattaagtttatttttattggtttttaaattaatattttgttatttgtttttctaggatcttaattcatatcttgaagataaagtctaccttacaggatataacttcacattagcagatatcctattatattatgggcttcatcgctttattgtgagtattcaaatagttactggctctttttgtctgcagtgttcagaatgcctttttttcatttgtcttgaatttaaatcaaatttgcattttcaccttatcaaatgaaagggattatttttatataaggcaccttatgcaaatatccctcccttccctggacccatcacacagaggagcttcctgctccttgacatgcctggttttgttcctgttcttgggcttgcttttctttgtggccccttggga

SEQ ID NO: 59536 - DNA, 3328 bp, Bovine  19866881242005
catttagtcaaggctatggtttttccagtagtcacggatggatgtgagagttggactataaagaaaactgagtcactgaagaattgatgcttttgaactgtggtgttggagaagactcttgagagtcccttggacagcaaggagatccaaccagtccatcctagaggaaaccagtcctgaatattcactggaaggactggtgctgaagctgaaactccagcactttggccacctgatgcaaagaactgacatactggaaaagaccctgagggtgggaaagattgaaggcagaaggagaaggggatgacagaggatgagatggttggatggcatcaccgactcgatggacacaagtagagtaagctacgggagttggtgctggacaggaaacctggcgtgctgccgtccttggggtcgtaaagagtcagacacgaccgagggactgaactgaactgaaccgtgcccagttttgatgctattggaacagggaccgttggaggagaaagggtggccagccttacacagatgctcagagtcaccggtgtgtgggacctagaacgtcacctcctagagcagtggctgcagctgaaccagcggcaccaatccttttggatttttcagctgcttttggaaatcactgacttcgaagttgattgacttcgggcgtgctggcttcactcttcagcagctgcacttacttgttcaaggagggcaattgtgctcagccgcacaaaagggtgcttcttagcgacatgtttattttccgatctttcttattcatggaaagctccaagtttaaaaacagaagagatgattttactgtatttttttaatcataaaaggaacttagtcctgttaagactagtgcattgctataaaggtgtagataaaactagatctgtagattgtaggcacctaagtgtgaaagctatccaagccctgttaacctcttcacatacatataaactcagatactcaacttttctgccaattctacaattcctcattaaggaagtttcaggaatacttgaagtaagcatgaatagcaaaaatcccctgttgaaacaaaaccacttatttctcactatgcaaccaaattaatctttaaaataatctatttctcttcatttgcgtctctttcatgcctacctgaattctgtcttcacttctttttatatatttttttccatttctcttttttccttggttctcattaattaaacaagagctgttaggtagctacagaatgcaggaagttcaattctagcttctcagctcacattctgaaggtagaaacaatagcaattttttacaggtgaatactataaagtaaaatgctaaattgatgcagtatatgtagagtgagacagactgtacattgcattttaggaattctttctcatttttctatatctctcaatctctagatccaactatgtatctatatagccacatatatacacatactatggttgattagcctatgcgggatgatagcattcaataggcaagaatacccaagagttttccccacttgatggtgctagaataaggactccaaggtaatccatttcccttcatgctacttaaaaataagcaaggtgcattttacattatgcactcggaggcaatattcagctactgcttaacattcagaggggcttctgcgatcctccacactgtcacggctgctctccctctccctgcggtacaagaaaacatggttatttaccctgggacacaggtgactgaacttataaaaatcactacaagacaagatgtattgaggcctggcatggaatgacaaattctggggaggttcaccaagaagagacatattgattcttaaatgattaataaggagaatataattgtatttcattaagatggatgggatttcatttagtctgtcttctccctttccacttcagatgcaagaggaaatcaagtcatcatcagtggcacctcgtgttagcctgccatggcaacaagctcattgatgagtcagagaactttgagatgcactggctggtctttaatgggttgctgaaagcagagataacagggccaagggagccaactcagtcaaaggaagagtggaaaatcacaatcagatttctcagtggttcctaacagagttaagcccttttataaatctcaggctggagtacaaaatgatacccacttccttcatttgggagagaggaggatttgccttgtagcataatcaggtctctgcgtgaggattttatgctggtaaattacatcaatacaaaaataatagttaagatattttgtatgtgctagacatttttttgcactgtcttaattatttttctaaacctccctcagtgctctgtaccatcaccattttactgaggagaaagcagatgtttagagtgacttgcacctatgaaggatcagattcagccttgaactcaataaaccgatcctgtttttaaaggaactcagttttcttacaaaggcctgtttgtttatagagaaaacgagctaaaggcagcaacagtggttcctgggtgtactttggagccagacgctctgggacaaagtccaactccaccctaaataattatataaactgatgagttattcaacctactaggtctctttgcttgtctgtattatggggttgttgtgaggcttgaatgaattgatgtagctaaagtactgtgaatgcattgtctcaatggtgcatagttaagtgtgaaatacacagacatgtgcctgggtttgagttctgctctgttggaacggcagatacccaagaggactgccttcctggtgacagcatattccaagcctagctttctctgttgcaaagcaagttctgagactatttgacttcaaagtgcagaggaaggacagtccgtccattcagaggtgggatgctgaaaatgtttgctgaacaataacttaaactattgaattgcttaactgctgcaggacttttgtcttctgtgaaagataatttaaaaatagtaaccatcacagcatacggtgaaagaaatgtgagaggaagcttagggtctgggaagaattccatacaagtcagccatcatatttattattattgttactattaagacagcatgggaataatagtaataggaatatagaaagatctaccaaatccaaaattctatttaataagagctttactacatggagcctctgtggtttccaactttcaaagaattagcacgtaataactcaatgcaaagagctgactcattggaaaagactcttgatgctgggagggattgggggcatgaggaaaaggggatgacagaggatgagatggctggat

SEQ ID NO: 59537 - DNA, 1188 bp, Bovine  19866881253650
cccccgcctcggacccccttccccggatcgaccgccccccgagcccccacttggaacacttttgcaaagatgtctttcacgggtgtgtggtaatgtgtttcattttccaatctatgtggttcctggtgactgagcctgttgtgagaagggttatgcagtctgagagctcgactaatgacactgccttttttttttctacataaaacacaaactccactagagtgatttccatattggaaaaaaatgcataaccacaatccagccagtagtgtcattgttgctgtgtgcatttccatgtctgtactatttgcagaagcaagagagattctggttcgcatatcagacgttatagtcaaggataaagcaaatgcagaagaatcagaaggggaggggcataggcattttgatggaatttggtgtgttcctgccatttccaaagaatttaaaaatgagaacaatttgtgtttcttgatgatttgatggattccctgatggcttggatggtaaagaatctgcctgcaatgcaggagacgtgagttcaatccctggattgggaagaagggtatggaaaacccactccagtattcttgtctggagaattccttggacagataagcctggtgggctatagtccatgggatcacaagaatcggacatgacttagtggctaaatgactactaccatgatccttaaatcattgccgtaggatggcccaggtgagcccagctggggtggttggtgtgttattggccaactccggcttctaagagacaccactcagccacttccacctgctcagtttcctccacttcacagggggtgccctgcagttagactccctcccggcctggtgtgaatgagctgtagacggcctctgtgtattgatccttgcattctttatttctttccggtaggctgtgacctgttagctcaaaagccaatcaacaccaaactcaaatttttacatgccagttatttaacaaatcacctggaatggttttagagtctttattgaattttaaaagtaattatcaaagattataattgtacagtattgacaagtatagagtgaaatgcagtgattagaagacagttgctctccaacactgctttaaagtctttattgaatttgttacaatttgttacaatttgcttctgttggattatgttctggggggttttggcca

SEQ ID NO: 59538 - DNA, 1027 bp, Bovine  19866881258464
acttaattttatacaacaacctattgaacaagctgttcttggacattcccatctcaactaaatgttaaaagtattaaaattcacattagcacaagaggaaattttgcatgggtaatcctttaatacagtgttttatggctctattagctgcacagcagctggtgacatgatgaatttaatccattaaaaaattcaggaagaggtttaaaagtcagctttttaaaacattatcttgctacaaggaaagggaacttctcctcggggccagaagtggcctggcttcacactgaggcaggtgtgcaaaacacacgtgcctgacaaatgcacatgctcagaggctggctcccagagaggggttagtgtgatggtgagccagggctcagggcgggggagccagagcaggctgaaacagctgagcatctttgacttaggtcttctgctttctccttgcttttcagagaaggttttacatggatagtaaacaatggtattgtttttagatgggtgcagcatttttgtgtcgaggtctgtatttctgtaaaatcagaaattccctgagcctttagtggtatgattatttatctgacaagggcataagtaagaaaagatgtttcaacccttgctataaataagcgtctgccaaatcccttgggtataaaagctttggtgcaagggatccagggcctcaccttgaagagatgctcccgcttggtacctctggagggccttgggagggagcctggatgcaatgcagtgaggtagcatcttggatggcttagtaagttggggacctgccttggaagtagatggatggcactggcgtgtcttaaccactagcctgctgctactgctgctaagttgcttcagttgtgtctgactctgtgcgaccccatagacgtcagcccaccaggctcccccgtccccaggactctccaggcaagaacactgggagtgggttgctatttccttcttcaatgcatgaaagtgaaaagggaaagtgaagtcgctcagtcgagtccgactctta

SEQ ID NO: 59539 - DNA, 1388 bp, Bovine  19866881347790
aagagatgtctatattgcctctagatgaccttcttgcttctgacattttctttaggaaaaacagcctactagggtcagatttgccattttttcaagtactgatttactgtattatttttctgtaaaatgaatctcctgaacacacacacacacacactctctctctctctctctctctctttcacatggcatattaaatctcaacacccacataaattcccacagatttttggtgtgtgaggatcaagaactgacctgagttttttttaaaactctctgtgtaggggtttgcaagtgaaaatttgcaagtgattgtgctacaaattagagaatatgagaaacattattcattatgtatctaagccgtgtccaactctgcgaccccatggacagcagcacaccactatctcccagaatttactcaaactcttgtccattgagttggtgatgccatctaatcatctcatcctctcctccttctcctcctgacttcaatctttcccagcatcagggtcttttccaatgagtcggctcttcatatcaagtggctcaaaatattggaacttcaccttcagcatcagtcctttcaatgaatattcaaggttgatttcctttaggattgactaatttgatttccttgctgtccaagggactctcaagagtcttctccagaaccacagttcgaaagcatcaaatcttctgctgtccgtagttccttcaccaggggtcagactcgaatcccctgtattggaaggcagattctgaaccactggaccaccagggaagtcatgagcaatgtggtggatttaagaagcccagatggttttgcagaggtgacagtggttgtgatctactcttcctctgtgtggttgctccagggttgaaggtaacaaataatatccgtatcaagtgaaattgactctttgaaggaggcagccaacgtttcaatctcttttcattcttgctaagggtctaagctccattatcgaaggcagtaacagcaggatggatgaagacttgtaaaacacgtaccatggcagccttcacatattgtaaaaggtgaagtccatttacacttctcatttagctgaatgagaatgagtcatttgcttaatggataattttaacttgatttccaataagtggattaagtaactgaagcacttcaacacaaggcagaatatttgttatagcatttggaaaagaaaccatagccagatctgtcagcaacttaagatggaaaattcctattagtcaatctatcaatcacggttcattattaagcaacattctaatggtctggcctgctgtgctgacacgttgccgggcgtttgcaatgttacaccaaggttgcaggctatcctgataggcatcctgctgttagtcta

SEQ ID NO: 59540 - DNA, 995 bp, Bovine  19866881455450
caaggtcccaactatactttgatctgtgtcagaattactccagatgtattgcctctaaatgttgctctgagtatgccatcattgatcaaaatagaagaaataccctaagactatctttagagatgaatctgaaaaatgccttcagtatgattttcaccatggttaaaacagttatatctctaaggcagatgaaaatgctaggagccttggcctgaaaacacaggctgcttgcacaaagtagaaaatgtttcttcttttttttaaagaaaaaaataattaaaatgtgaacctctcttgccttattcatggccctgccattgagctgtgtatggttcggttaagacaaaatgtatgcttattgttcttttatatatcagttaataaaaaattaagcccattaggactacagcatttagacaagagagaatgatatttttttaatgtcacactcaaaaccacatctcttttaatcaacatctgctccctgttaggccgcctataaaatctggtgccctgttgacagtagaagatgaaaacaagcaaacaggaaaactacaaaaggcgtggtattaacatcaaaggagaagagccctgctcgctttctttggcattttaaaaacgtctttattttgaccccaaacaattggattttctccccaccagtcttgattttggagctctggattaagaagactcgcatgcgaactgaaacatgagaggagagggggctgcgggcgaacgaggaactgtttgaacacattaaaccattcgcaattataaacccgcgttgaggacaatcagaaaacagcgccacgtttgttcgtagagtaaacccacgctctttagctgcagtggcaggtaccacataggaggggaagtgatccctgctgtggtcttagaatgctgcaaataaaggggttcaaaggttggctattacggagaaggaagagatcctttggattttactgtggatgcggcgtttaggagcaccacta

SEQ ID NO: 59541 - DNA, 792 bp, Bovine  19866881551297
ggtgaggctgctgctcctgctgctaacgtgtggctttgccaaggtatggcatggttgacttgcttccaggaggatggaggtgagaagcagagggaaaagggtgcgagcggccattcagcccctcacttgcgagctaactaggaatgatttctgatgatagcccctgcctccatcaagggcatttcttccatttaatgagcacgcggggaggcaggcatggctcaagaacaagagttcagtttgcagtcagccacaaatcacatttcatttatcaggccctacagatgacaggatatcatcgaatccctggagagccatattcattaaaaagaaatcttaagtaattacaacaattaattgacttgaaacagtttctggtggataaggtttacataattcatttgccagacaaaacaagcctgatcaagcctggaaaaagctatttccaagccttcctctatctgacactgtgtggtcctggaaagggggtttaccttttagaggtctccctccccctcttttttgggggcaggcaacagtagtttgtaaagtgagaaatgagaacctgaaagaattttatcgactcaatttggggtccttgagatggctctgcagcccttttattttttacttaccattgttcctaaaactgatgaatgaacataaatatgggttggatcaatcatgaactctctgaatttgtggttttgaggaggcagacatggatccaagacaaggctttccagaaacctaagagattatttaggacaaggtcaaggctccttccaagag

SEQ ID NO: 59542 - DNA, 1428 bp, Bovine  19866881899202
cagcagggccaaagaaaaaactgggtacactctctatttgagctgagatagaaaatgagttactctgagcatttcctgcggctggagttctcctccgaagcctgggcagcctctctgctcaaccgcttcggaggatgagcacgtgttctgtggtgcctaacgacacattggataaacaagcagatgcgcattaaaatgaacgagtgtcaaaactttttcatgcttatttgttattaacgacagaaagtgaaggtgcagttcgaatagtttgttattcttttacgtttgtggcaatatattacaatttatgcctcggcttagaggttgattacaagttttatgagactgagtgcctgttattggcaatcttgatgttttcttttctcctgtaacgtgtcacagacaatggatttatatgcagtcagtgatttttgttttatatcatttcaataaaaaaaaattaaagaagaaagtgtggagtggggagcaaaaaggggataatgaaggttacattcgtcatatgggaggatttaaagtatattaataatatgtgttctttctggcatccattctcagagcactttatattctttgcaagagacaaaacaacaagtcatcagggactttttataaacacaggtggcgcttattaaactgagaaataaaaattttacactcctgatgattagcctagacaagttttcatgagctcctgcacttatgaaaaacggtgcttattttctttcctactttctccctcaattctgatgactttcattctctgtgaacagcttgagttagtggtgcagtgatacctaaaatatttctggcagatttttgaggcaagatattaacaatctattttacaacgatcgtcgtaataaaataccgcactctacaaattttaacagacatggccatgaacctcaatgcaaataaagacttcatatgtgaagagagaattaaggtttatatcaacaaatatttgactaaaaagaggaaaatccaacttgcctcttctatttgtcattgtcgcacattgcttgtgtgatttttttcttaaagtggcctgaattgattactttaatattgtttcaatacatatggagggcaaaccccaaaaaacacaaaacaaaattgagcagattctgttaaatattggggacagagcacacgaaattattgtgcaacattttcatttaaagaaagccttacatattacaactgagaatacatatttaaatgtgcaatgagtatttgtagtaacatctaaaagcatagggatacacattaaaaaaattaagatccaacaaaaattaagatttccccaacaagggggaaaacattcgtaaacaagatggaaacacgtctctaattacacacggtagcagctacctcttatgcttatccttcgtcctcagtcttttt

SEQ ID NO: 59543 - DNA, 1144 bp, Bovine  19866880340829
ggtttgatccctgggtcaggaagatccactggagaagggaatggcaacccactccagtattcttgcctaggaaatcccatggacagaggagcctggtgggctgcagtccacggggtctcaaaagagacacgactgaacaactaaacaacaggcagcggggctgatactcagtgtatgcagcaacccactgggaagggtggtagaataggatcctggagggttgtggctgtggtaggtgttaaccttttagttgctggattgtggggagaagctggactcagggggagcccagggtggggctcaggaggctcagagaagaggctacttctcaaacagcacagaatatttcaatattttaacaaccacagtcatactgctcaccatcagtcaagagtgaggagctcataaaggaaagactgagataggcagggagaaatggggaagaggggttcaaattagttagggccccctgctgggttcaatcccttggttgggaagatcccctagagaagaagatggcaacccactccagtgttcttgcctggagaatcccatggacagaggagcctggtgggctacagtccaaggggtcgcaaggagtcagactcgactgggtgactaagcacagccctgcttggaaaggcttgttgctgccaagaatgactatttggggtcactacgggttagcaatcccaggggcctggaactgggcagagaccaggggcttaccggaaatgaaggagatttcgctgaagagtagccagggccccgcaaagagaaagcggcattgcaggaagcggcccatgcggccgcccaggggcactgacacagtccgggctcttggggtcccccaggctgccccccagagcatggcgcacgggctccccctcccaggccatggccgggcccctcttgaagcgacactccaccccaccgggcaggcgggctcccagcgtgtgcatgttgttgcagtggacctgggggaaagggaggagggacacaaggtcaaggccaggagagcccaagcgagcaccccggggcacccagcctggtctcagagcccttcctgggagctggccgcacccacctgcatggccttggaaggccctcagccggtcaaactcaaactccatcttccacgtag

SEQ ID NO: 59544 - DNA, 4066 bp, Bovine  19866880458625
ccctcgaggtgggaggaagaggacccgggactcaggggacctcagcatgcgcgcatgcacttgtatgcacacgcaggcgttcagggctcacctgcagacatgtcaggtggtggaaggtgcagtggttctccttcccctttgctccaggtggacagaaagcccgagttgtgtttgcagagctggcctgtcgggagcccgatgtcctcatcttggtgagtgaatggggctgcggggcggggctgacaccaggaaaggtaggggtcgttaacacttggtttcgggatgcctcctccccataggacgagcccaccaataacctggacatcgagtctatcgacgctctaggggaggccatcaacgaatacaagggtggtgagtcagctcgggcctgccctcctcctgccccgcttggggatgggactgtaggtgtcctggggctgggcaccctcctcgcaggttttgattcccctcttcctttctgcctgtcctccattctcgctgtcttgccttgaagctgtgatcgtcgtcagccacgatgcccgactcatcacagaaaccaactgccagctgtgggtggtggaggagcagagtgttagccagattgacggtgacttcgaagactacaagcgggaggtgttggaggccctgggagaagtcatggtcagccggccccgagagtgagctttccttcctggacatcccctgtctcctctccactcggaagcttgctctggtctgcagccggcgtggcagctgctcgggcgtgtgaaagcggagtgtggtcttgatgtgaccaggatatttgattgcttctttttctctgaatgactcgtctgttctgcttctcttgagataactggagtggtgcttgtccttgaagtccctctgtacaggcagaggtgacatttgtcatcatggggttccatccagccagctcacgcagccagttgtctgagcctctgtcctcaccgggaagcctgcctctgggccgccccaagcttcgggtgcagctgccgtgtggtctgagtggtgctgcactcctccggtggattcagtgctgacctaatggataccaacagctgctgctgctcctgccacccaggatctggtgcctgcagtatctggtctgatgggggacttggggacaggaaaggaatgctgctgaactcgaatcaccctttacaaggggaagaaataaaggaaaggagttgccgccgccttgttgctgtttggagattcgtgagagctggaactcttgtgaatcttgatttgctgtgtccgcttttctagcagtgggtggcagcctgtcttccccactggtgcaggcgggtgtcacttgcagtcttacctcactttaggtagtgctcgctgtttgaggagcctctcccttcccccagcccttcaaatgagtgctagggaaagggagtcctcccttctagctaggactaggacactcgggtttctcactatccaagctccaccccggggtcagggaccagagtgtctgtccccacagacactgtgtagcactgtggggtatacgggaagggcgcagacgtggtctgccttcgtgcataatctagacagagaagacttagaagatgtgagtgtacagcgttgatacaggtaattgccaaatgtgcagagttgtagattctaagtggccttgagctcatagatgagaaaggttactcagaacttggttttgtggcaggatcacttgagggaggaccttgagaaatagtaaggcttttaaccatgagcagggagccatttttgaaatgtaggaaaaagagcggatctaaggaagaaagaactgttttgggagttaatgaagaacatggctcgtgtggccactttttttattagtgttagattggagagatgggtttggaaagtaaaacccaagtggttggttggtgatcatttcagtgagtgatgggtgaggtggactatatagacttacagcacaggccccagaaacttcctagtgcggatgaggtaatacatcctgaattaggatgtgagaggggtggaaaggacggacagatggatagagccaggtgtgtaaattgcagagaaaacaggtgcatccaattctcaggggaacgtgaagaaccatctcagggcttcctgaggtgggatgtcttaactttgggaagttacattctggccggaaatactactggactgcagttacaaggtttatactgaaagttaagatttggtatgaagatagtcacagagctagtaccatcaggtatgtgtccagccagattagaaaggatcttggaattcgagggaaaaaaaatcaaggtcttatgccaagtaagatgttacatgttaaagtagtctccatagtaaggtcctttgtaaaacaatgagaacagacttcaagtccatgactaacggagtgaccttgaacttagcttcttcgtacctgtttcctcatttgtgacatgaaggtgataaaaagtacatacctcacaaggttattaagattttagataagtatttataaagtgttttttttttttaattacatgtatttcatgtacaacttaacactttgcacttcagttgttcagtagtatagatgagatgatatataaaacagaggaatgttataagatgaacaccagaattttgcatttcaagtatttgatgctaatttcactacaaatacttcagatactgaaagtaacttccatccacaggcagaagttttgtttcctcaatatatatactgttgtaatgcacctaaatctggacaaaagaatgcgcttctccagaaaggggagcctaatacagtacagtgtatggctaacccaaagcctgaaaaatgaaatttcattaacaaaattaaatgtttgtattcatgacagtctttgtcacctacaaatcaggcaccaatgtggttcataatgagcactttggaatggttcaaaaaattcctgattattctgcacaccttcccaatgaggaaacagagaccctgagctgcccctggccacccagcctggaggagactgttcctgcgacggcagcccttgttttctgaccccagcaccctgggcattctccctgggctgtaggatgtggacagatcctcactatttctcaaggtcctcccttacgtgatcctgccaaatcatcagattctaggtaatctttctctcttctgagctcaaggcaacttagaatctacaacgcccacacgtttggcagtgtggacaaggtgaccgaaggatgagtcctcagggggcacaagagccaggacaggtgttttagggaagactgtcacgtcagcaatacagtgggaaaggggaacgccagggaggagcaccatggccatgagcgccgtggccgtgcagaactcagaggaggcctgggtacgtgagaagtggcccttgtgaggccagtgctgatgcagcagctcagatgcttgaactagctgctctaggaccatggttctcaacgtgtcctagaccagcatcagcagcagcacccagagtttgctagaaatgcaaagatagggttgacacagaggtcagaagttacaaggttatttggggggtgggggtggaaacggaataagaaggaagaagaggtcagttggaacaggagagctgtgcctgcaaggcttggtgaagaagcagaaatgggcacagtagcgcctttggagtttgtcacaggaaatggtgttagagtggaaggtagggtcgcctttagtgtgagtgataagggaagacttctcaggaagtaacactaaagacaaggcctgtaggtggacaaggaaccaactagatggataagaaagagccttcatggaagggaccagaatgtgcaatggctcagaagctggaaagagctggtcctggaagatggcttgagcttagagcttgagcagcagataggacacatgaggccttacacaccttgatagggagttaggatatggttctaggagcattagaaggccatcggagtgtatgcaggagtgtgaattttcacaaaattgttctggctgctgggtagagtggtgggtggggggtatagggagagg

SEQ ID NO: 59545 - DNA, 2124 bp, Bovine  19866880565667
aaatcgacgcgggcgtcctcggaagcacccaatgagcaaccccagggctccccctgcagttgggggcggggagccctgtgcagccccttgttgctgcctaccccaagaagagacagtggcctgggttcagtgtgatggctgtgacatctggttccacgtggcctgtgttggttgcagcattcaggctgccagggaggccgacttccggtgcccaggctgtcgtgcaggcatccagacctaaggcccaccgccaaagcaccagaggacagagccagcacctccaggccagggatggacagtgagggtgccaatgggtcctaagagctgccctcttctatccttgcctctccaggagggaatgactcaggagaagggtccactcctgtggattatcaattcaaggcctggagcagggccttgtggccaaggtgacagaagagatggcttcctgccaaagatattgctgcctccaggaagttaccagtgagctggaaatacccactgtcacaagctgtaggtccttgttgtcatggacactagaatgtttgtggtcaagagcatccatcaattgtagaggtcatgcctgggaagttataagccccagccttgaacaaggaagttcttaatgtttttgatggtatccctaaggcatctctgggaaaacctagagcacagaccccaaacttccttacattgtgggtggtcctgctgctgaccacaatcactgtgacctgacttctcagagctttgcttccatttccaaataaagaatgagcagctttatacgctctaaagtatttactctttgtgtgggtctgatactccttgctttctagttcttgagagaatggagttggttagtctggaaaattaattcagatacttataggaagagacaagcagatgaggcagaggaaaacaggaataggggatctaggtaattacagttgctaatttaaaagaaaacattcactgccgttaaaatgtcatttggatttgatcaaattcatgagggtggtggaacttctacaagtttcatcggtactaccaagaagagaaaacctgagacagcagctagagcagatgtcaacctggtgcagtatcaataaaacccacatatgctacattgagtctcttctgagttgcacaccaagtcagcacactgtcaaagcagtgtttctatagttcttactaggaaagtcctgtcttgacctatcttattgcaccctgcatgtccatccccttccttctctacttagacttaccaacccaagtttttttacggatcaaagaaaagctccagaggaagagccccagttaggaagtggcagagtcaggactaagtgtgtgtagtggtaggtgagtcacagacaaggcaaaaaccttaagtgaaaaccaaatggaccccagtatcaagaaagcacaaagtggagtttctggttggggtgatagaagaaatgagtaaaggtttgatttcttagcacatagccactgaggactacagagtagaatgggggaaagcaaaaaaccagatcctaatagggaacagactatgtaataactgcatctttgggcaaaggtgttcatctccaatttctgcaggaccgcaagtcagaggctcctaagaactagctcacacttataaagagccctatccatataaacttgggatccaaccccacacctccctctgacattgtgactctgcgcaatgtaaacagcaaccttcgtttcggggtcatttgggtcagagagctattaatacccactattaatatcctatccactcttcaataactagaggataaaccaaagacaaaaatatccacctactaggtcccaggcttctttatttaagaacaaagtgatgagtgatgtggggattaaagtcaagagcatcattgaacttcaccctccctccaaccagtttccccaaactccctgcccccacacccattgtgttcccaattcctttcttagtgaatgaaaaacttaatcccaaagccctggtacaaaccccagggttctctccctagctctccccttcctctgccccccattcctggggtgagcaggcacctcagtttgaatgcataggagagcccagagcggtgacagacaccg

SEQ ID NO: 59546 - DNA, 989 bp, Bovine  19866880572343
atgttttttccttgtttagctcctactgtaaacaatgtcattttcgcagtatgttcactgctacatattttgcacttttgtgctctgtgttggtgatttcacagttcagaatgcccccaagtgtggtgctgagtgccgtctagagttcctaagtccaagaagacttgatgtgcttgatggagaatatacatgtgttagataagctgctttcaggcatgagttatagtgctgttggatgtgagttcattgctaatgaatcaacaaatacattacatatggtgtctttacgcagaaatgcataaaacaaagatacataggactttcctgacaatccagtggttaaaactctgtgcttccagtgcaggggtcgatccctggttggggaactaagatcccacaataagtattggttaatccagtgttcacggctactttgtgaaaaccggaactaccatgaataatgagaatcaactgtactttgagacctttacccaatattatgaaattcatttttgccaagagttggtgtaggctgaaagcattaagtgtaacacatctttagttatgatattaaatccctgggtggcttgataggtgcctgagtgtggcatagtactcactgctcaaagtgtggtctgcctcccagcaacagcatatccctggggagcttgttataaatacaaaatccgaggctccagcccaacagaccaaatcagaatctatattttaacaaaatctctaggtgattcatgtacacattgaagtttgagaagtattgatttagtgaaaaccaccagcttgggtgggactttatcttctcaacatggctttccttgtctgctaatcaaaggatagcctggtttgggttctgttcaacttttattagtccctcgttttgtgtcagatttttgtgctaggtgctggaaaaataaggatttattcaacagagatctattaaatgcctactatatgccaggcattgttttgga

SEQ ID NO: 59547 - DNA, 3262 bp, Bovine  19866880575807
ctcccggtcgccgcttgggtccctaaccgcgccttgcgcaaagcgggcaggttggcgggacgctcttaagcctgtagggttaccactcctgaaggaggcggggaaaaggcgcacgcaggcgcagtagtgtctaaagccaggcccaattaaggcgttaggggcatctccgcgccctggcggctcctcccaactccgggaacccgggaaaacttgtgaactaatcagaaaaagcgaaaggcgggagatcccagagcgtcgcccaatggagaaaaggagggcaaacgaaatggccaatcaaaaacggctcgggggacgcgctcactccgctcgaagtccggacccgggaattccgaaggcggggtcagcgatgcccgcgcgcggaggccgcgcccctcctggcccgggcttcttcgctgtcaaacagccgcaggagcaccaaccccggccggatcccgagaggtcctgggctgcggcataagctggcattgcctggagagggaaccattccgagactgcacagcgcggtagatacgaatccgggctggggcggggagggaaaaggctggatttgtcttgaatcatcccgggaagccctttcctctgtttttatcccacctggagaaaccagaaagcaggggtttagctccaccttgttggacaacgtagagccccgtttgcactgcctttgaggggtgactgagtacgcttcccactggggttcaaactagctagttatgaatgagggattggtttagaagagtgaagcgtgagctagcaggagggttactctattaggaaaagcaggtttgacaggaagaagcttctcttctccaaattacactgaagtggcaagttagtatatcacacagaagcagcacccctccccccgccacacacacacctacagttctaatttccctagaaactgcctaatgtattgttgacttgcccagattgaaggctcctggaatattttgcggtctgagaatccgattcaacttcgtgccacaggacgcgttctattttgcactacactggaactttcaccaaattttttcagttgcaaagctgttgacagccaattttacatcgcatcctaggctccctgcaccctgaatttgccctactcagggagtgtgctcaaagtcgaacttgcacaaaacatagctcaagtttgcgtcagacggaaagtgaatttaggccagctgtgcacggcccagggagaggacaaggtgatggattcctgaggtgaagtggtggtgccgagggggccccgcccatgctgccctgcttccagctgctgcgcattggggtcggcaagggtgtcgatctccacaccttccacccacccagtggagctggctgcacctaccgcttgggctgcagggccgatctctgtgatgtgaccctgcggccacagcacgagccaggcttcatctctggggtccacgcagagctgcatgcggagcgccagggtgatgactggagggtcagcctggagaaccacagcagccaaggtgaggagtgagcagggcagccttatgctggggcagtcgcagttctgggctataatgaattaaaagagccaacagggattctgccggcctcccaaactccccatcaggttggatggacggttgtcatgcagacttatgtctttccaccagaaatgtgcagtgtcagaagctctttgtggggctgatcctgtttagctcatagagggggtgggaggtagatccacagactggagccatcacagtggggttgttctgagaccatggtgggtggtgagggggcaagcttagacttcagtttctagattgtttagacatttgttcttgccttagggcagttgtgaaatctgttgaattatcttaattatctggacatgtgccttactccctgacttggaggcagttaggcagcctcagaaggcctgggtttacatgagttctgctgttggcccctggtaacgtcactcagacctgccactccacctctctaggtcttagtttcctagaatatgtctttgtgagtgaggagtgttgtgggtattggataatttcaactggccaacattaatttcctgtttattattatgagccaagaactgttttatgtgcattaaatataggtgagcacaaatgccccattttacaaagaaaatgaaacataaagaggctgacttgtccagggtcacatgacaggtaaatggtggaatttgaacccagatagtctgagctatgctgataagtgctgagttggagctgagagttgagcgtctctgagacccagacctcagtggattgaggggaagttcgttccatgtgccttgagggagagcataaggaaaaataataatattcttagctcacagggagtttcttatctgatgacacctactactgagggacttagaatgtaaggatttcatgacatgcatgtgttcttcctcgtattccccagaaaaccagacaggaccagatttctccactgctgaccagtcatttgtttttgtcattctctgtatctgtctggtgccccacaatcaacagggactttggtcaataatgtccgactcccaaggggtcacaggctggagttgagtgatggtgatcttctgacctttggccctgaagggcccccaggaaccagcccttcagagttctacttgtttcagcaagtccgagtcaaacctcaagattttgctgccattaccacccccgcggtctaggggagaagagggaaccgggattggtttccggcccatgctgccctcccagggggctccacagcgtcccctcagcaccctctccccagcccccaaagcaacccctgatcctcaactccattggcagcctcagcaagctccactcccagcccctcaccttctcacggagtgggggtgggccacagagtccgcctggtcccactcccaccggggaagtggggactgccccttctgccccacccccaagaaaccggaggaagtcagctcaccgcgtgttggaagaactggatgatgagagagaggctcccaagagcccctcaccagtcttgctggagcctaggaagaaactccgtgtagaaaaaaccccaatgacacccagtgggtaagtcaacttggctttatttcactgcctttggttttttaagagccctaggctgagatgtacctatctgcttgggtggtgggggtgggaggtggaacacctgttgtgatgacaaaatctgggttagctgtgctagccagattcaccat

SEQ ID NO: 59548 - DNA, 674 bp, Bovine  19866880688147
cctgtttggctttcgcagcaaaaaaagaagcgagacacccgaaaagggaggcggaaaaaggatgtggatgatgatggagaggagaaggagctcatggagcgtcttaagaagctgtcagtaccagccagcgatgaggaggacgagggtaaatgcactgaggggagatgggtacctggaacccttgagtcaggaagagtctagggttcattccttgatcttggagttggagtagattgaggagtggacatggccattctctttcccagctcaccttctccccttgtcatttcagtacctgccccagtaccccgaggagggaagaaaaccaaggtaagccatctgtctcagtggtagacagagaccccaggggtgcagccttgaccatcctactgacttctgccctttcattctccagggtggtaatgtttttgcggccctgattcaggatcagagtgaagatgaggaggaagaggaggaaaaacatcctcctaagccggccaagccagagaagaatcggatcaataaggtgatatggctctgtcaagtccctcccaccccatgtggcacctctggctacagtgtggtgattccctggcttcttttcatgctttcaactagcttttctaggccaggccagtcttgcttatactgtcagcttatcctgtcaaagtcag

SEQ ID NO: 59549 - DNA, 1598 bp, Bovine  19866880723318
cttcttgtctgaccgctcaggacgtttcgagtccgatccttgtcccgctgccgaacccgctcggcaaacgcatcgcgttcctccaggtcctgaaggcgctctcgctctgtccgctcccactcatcctctgactctggcttttccgtctgctctttcttctccctgcagcccagcccagaggattaactgagggcactcagaggcttcccgtcccatcaaccacctgccccattctctcgccccctacttctgacttaccctgtcttcctctttcctttctcagaaacttgttcctcctcctcgtcttcctcttccgcctcacgtttcttcctgaggtgtttccgttttttccgcttcttctggatactgctcccggccctgcccacagtctcctcgctgctctcctcactgtcctccaacaacatataagagcggttcttttccagcagggctcgggcttctcgctcagctgcccgagctggcttttccaccactgccttccgtgggacctgtcgggagagagaggaaaagtcaaggggatgtgagcaactcctgatctctgcccacctactctgcccggttcctaatttaaggagtaactgatcttaagccagctgtcattctctctcttccgcaaggcttcataccatgtccatcagcccaaatggggtctctcagtttctaagcctatcccgtgcaccccctgctaggtactagggatatagggataaagagacaaaacttcctgccctcacggagtttacattctcacacccaattctcgactgctcagcctctgttctccccaatgactaagtcattcctacccaaggactggacaaggattgtccagattgttttgcagagccctgtcacgggccggcactgtaccagcctccagagataccctggtgaacagattaacactgagctcctaccctcacatcaagtacattctaacctcatctttcaccaagtgcatatgggacagccacaccaggttatctgccattctctgaacaagttcaacacttttagtcttactgtatatttctgagctcttgttctgcagggtacaattagatggtatgaatacaaagacaaaaaacacagtcttgtcttccaggagctcaccattacacctttactcttcccctttctctacccaacaaattccagagaatctttgggctgcttttcgccatcaccgctacaccacttctaccctcccacaacactgcccacacatctcttctatagcctcactcttcgaagggtgggtaagtttccagcatcacccggaaacttgtaagatttgttagaaatgaagaaaggaagaaaccatcccagacctaccgaatcggaacaaaagccgtggatgaatcctaaacctgtttgagaaacactgctctatagacccttaagccctcctcaatcttctccacgggagtggtcgtccagcccgaaagtaataactgcttgcaaagtgaagtcgctcagtcgtgtccgactccttgcgaccccatggactgtagcccaccaggctcctccgtccatgggattctccaggcaagaatactggagtggcttgccatttc

SEQ ID NO: 59550 - DNA, 1869 bp, Bovine  19866880724399
ttagtatactgtatttatgtttttccttctggcttacttcactctgtatactaggctccagtttcatccacctcattagaactgattcaaatgtattctttttaatggctgagtaatactccattgtgtatatgtaccacagctttcttatccattcatctgctgatggacatctaggttgcttccatgtcctggctattataaacagtgctgcgatgaacattggggtacacgtgtctctttcccttctggtttcctcagtgtgtatgcccagcagtgggattgctgggtcataaggcagttctatttccagttttttaaggaatctccacactgttctccatagtggctgtactagtttgcattcccaccaacagtgtaggagggttcccttttctccacaccctctccagcatttattatttgtagacttttggatcgcagccatcctgactggtgtgaaatggtacacggttgcaaaaccacactcggaccacgtccttctccagcccgagctgctgggcgatgtggctaatttgctgcagggtgggcttcgggcactgcaggaacatgctctctaggttgcctctcacttggttctcgatactcgtccgctttctctttcgggcctgcacaagggtctctgccttgcatatctcctgcagattctcgttgttgtcagcttcctccacccacttctgcagcaggggccgcagcttacacatgttcttgaaactgagctgcaaagcctcaaaatggcagatagtcgtttggctgaacacctttccaaagagaacccccagggtgagccccacatcagcctgggtatatcctagtgtgatcctcttctgctttaggagcttggcaaattgttcaaggtctttctgaagagctttgatgtcctgggactcctcagggttcggttccagcttctccttgtccagcttcgcggcgcctgcgagtgcggcgcaggggtccggggaggccccctcggagttgttctccaccccggctcccgcctggccctcgggctgaggggtctccaggccgcctgggggcaccggccccactccaacctgcggcgcacagtaggccatccctccacacaagtcatagggcggggggcacgggggaagcccccacacctcggctccaggcacaacccccggcccgatccccgacccaccgggaggcccttggaagctcatccaggtccgaggatcaacccagcccggctctggccctcccggcccatcgcctccaccgcccggcgggggcgagaaggcgaagtcagaagcgaggtgtcccgccatggggaaggaaggcaccccgagccgggggcctaggaaaacgagggatctcctagagactgctcaacacctctctccctccccaatcccacccactagccttgacctctggccccgccccctggatgggtgggggggaagggacggtgggggtgggagaaactgaggcggagggtgtttgcctgctggtggcggtggtgtctggaaggggaaagccagggatctccacccaggcccctctccaggccccagactcctagactctcggtgcaggtcccccatgcgggccttcacttccagctcccaacaggctgcccagccctccccaggcccacatacaccaggggtgaggggtcccttccataccccctgcacgttcttcaggacccctctccagacaccctggcacctgagaccagccaccctctcaactcctcaaacacatttatgctgtatgtgtcaagtcccactggggctacccctcaattcttaacaggctccttccccgttgtcctccagcatcccagtccaggaacctaggcagttcccatttagcaca

SEQ ID NO: 59551 - DNA, 1699 bp, Bovine  19866880834326
tactggagacagaggcagacctagggccaggtatcccctgtgacctcctgccccctcccaggcttgaaagcagcgacggagatggcgcctggtgccctgcagggccggtgttccccaaggaggaggaatacctccaggtggacctgcggcggctgcacctggtggcactggtaggcacccagggacggcacgcagggggcctgggcaaggagttctctcccagctaccgactgcgttactcccgggacggccaccgctggatggactggagggaccgctggggccaggaggtgaggctggggggatagccctggaagtctaggtcccctctgtgccccagctgtgtgctgtacactaatgactctgcagtgtgtgccctctctagcctgggcatctcccctgagctccatcaagtgttgcaaacctgaccacttcccacctagatgtgtaataggcttctcaaacttaccataaacttctcaggctgaacttgatccccattcccaccccaaacctcctccgcctccagcattctctaactcaggaaatggtaccactgtaagctaagatgctatccctgattcctcttttctttccacctcctactttaaagcatcagcaaagcaagtctgttctgcctccatgatatttcctgaaatctgctcacttcttagcacctccatctctactgccccaggccaggccccaccatcccctgcttagacgaatgcaatagtctccaaatggctctccttgcttctttctttcctgaagtcatctcccacctggaggctacatccaagggtgcctgagaaaatgccaagcagatgcctcatgcctggctcactccctctgctggctttcctccccgccagcacaaaagctgagctccctcctgggtgcagaagctcagcccaggctggctcttgtccacaccccttagtcctctccctgttcatacaggccatgctgattttcttgctgttcctggaacattctagggctcaccccacagtctcaagataccttcacttgcaagtctctgtgcctggaaagctctctctccccagctgtgcccaggctttcctccctccattcagttctcccccaagatatcacctcctcagagcctttttggactccccacctcctgctgcctcttgcttgtagagctgcctctcctcttggactctacaggggagggatggatgctcaccccctagaggctgtgcctggctggtgcagagtaagtgctcagccagtggctgctgagtgaacagagggattggggtgacggaagagggaagccagagcaggggtgcagagctgcgagggcctgggtggaatccgggcacaacaggatgagcagagccaggcaaggaagggatgggagagctgacgctggaggtcaggacagacggtccggctgggagggggtgtcagagggctctgctgcagccccttgacgtattgaaggccccggctgtaccccacggccccgggtgcttggtgccaccctttgtgggtctctctgtgaccactaagggctgggccaggaagcccctggtggctggggaagttagatctgatctggagccttcttctctcatctatcccatgtcctggcccacaggtgatcttaggtaatgaggatcctggggggagtggtgctgaagaccttgggccccccatggtggcc

SEQ ID NO: 59552 - DNA, 1853 bp, Bovine  19866880882602
gtgccgtcacagttaaagaacatattcactggacttccctggtggtccggggaagggatcacccttccatgggttaagggttaagaactcgcctgccagtgcaggggacatgggtttgatccctggtgtgggaagattccacatgttgcagggcaactaagcccacgcaccacacctacgaagccctcgctctagaatctgtgctctgcaacaagagaagcctgggcaccgcaactagagagcagtccccactcgacacaactagagaaagcccacaaacagcaaggaagacccagcacagcaaaaaatacagaagtaaatattcactgagcacttaaaccacacgcaggtattatgccagcctcctaggagttctcgctgaattctcacaacacccctgtgatgcaggtatttccatcagccctgaattttacagacccaggagactgaggctgacaggctaacagcctgtcaggagccacatcgctgggaggtggccagattcagatgtgaatcccggcaggctggctccagagtccgagctctcccccgggctcagagctctcacaaacccgcctctcctctgcctcacctcaatatccgagatggcggagcgtaaggcacacgaccaattgaccagctgccggctccggtacaacaacccagccttgtagagccgcacgaaagcttctgtcacggccactgaggagccctaggatgacctgagtgtccacatccaacagcctcctctcagcccaccccctgccaggggcccaggcgtccccctggcccccctaacatacacagcaacccgcctccttgcacagaactctgaacacctccctgacacccacagggaccacagcaccaaacactcacggtatccatggtaaagcactctcggtcccagtccagggaggcccccagcgctcggagctgctcacagatctcgccacctttcctgtgcccagacagatttgggtcagcaaacatgtcccagacatcaactatgtcccgggcctagtgaagccccagcggtgctggactctggagtgagttcgagactgatctagcctcaagaagctaatggagacacacaggcccagtatatggctttctgtgatattgaaagaaacataacatttctagtaaaaggggaaggggcagccgatttgtgggaaacacaaagaagctttacagagaagacagcatgtgataacagacctggaagaaaaagggtaatttcaagaggatgcaaagtgggaacaggtgaggagagatgatgaaatccaagcaaaggaaaatgggataaatggaagaaaaaacatatatatatatacacacacatataaatatatgggggagcgcatgcatgcttagttactcagtcacgtccaactctttgacaccccgtggactgcggcctactgggctcctctgtccatggaaatttccaggcaagaatattggagtgggttgccttttcctcctccaggggatattccctaaccagggactgaacatgtgtctcctgtggctcctgcattggcaggcagattctttaccactgagccacctggggagcccatatatatgtgtacatatatatatatatatgcacttacacataaatatatgcattttaacatatacaatacacaacaaatgcacacacaccaagcttggagaccccaccaaatgctaagggacttcagagcttacactcccacgggaagttagagctgaatgggaaaagccctgactacaagttaggagaggggctgggaagcccagatccaaacctgctgtctcagcccctcctgccctgccccccatactcactcctccttcca

SEQ ID NO: 59553 - DNA, 1083 bp, Bovine  19866880911363
tagtgtgactgtcaggcccagcatgccaggcttcagttgatgaaaagctggtctcactgttttacagtttccagaaagagctgtaggcaagggtggaccaccaccatggcctcacctctgccagctacaactttcacgggctgcaggtgtgatctgccatcactgaacctagcacactcaaggcgcaaaacttgagtgtcctcgaaggttgcaaaagtctcacttgagaaaggactcaatgtaaaaagcctgtgttcggggaggggtggggacaatgtgttccagaactcaaatccagcctgattgagccctctcagtgcagtggggtacacggtacccctttacatccccacccatggggaaatgaacgtggctgggaggatttcgtaagtgcagctgatcccacgtcagagttccttgtgcatgtcgaagacccacagcaggagagcagaggtgttctccaggataaccagctctaggttctcaggcgtgaagggcaataccggaaaggggcttgggatacagggcaaaactcctcaaagagtgaagccaactgggtctcctcttcagcagtccagggtacagaatgtgtccagtctctctcctccccagactggaggaaaatatgtacattgatgcgcaccagtgatcagaaaacccccagaacccaggcgtgtgggcactgaggggccggctcctcatcagctgggggaaggggaaatgggcctcacagaagccataagagagtggaaggagcaaggctgcagtccacagggcggggcgggcgggggcctagggcaggggcggcccgttgacgcccgggtggtagaaggcacagttgttctcgtagcggcagttgcccttcatcatgaaatgccgacacacggggcggttcgacatgtctgtggggatgaggatgggggtcgttagacaggaaggctcagaggccagtgccactcacccccccagtccaaggcatcctgagcgccgtctttcagagacctagtcttgggggcctgggagaaaggcaaaaggggatgctgggaactgggactgaggtgacctcatgtcctgcctgacata

SEQ ID NO: 59554 - DNA, 945 bp, Bovine  19866880927765
tctttacttttttcatcgcctgcggcattcctgacagccctcatgagccggatcctgagccctatgagcctatccctccaaagctcatccccctagatgaggtgagtattgcatgctgatggaggttgtgattgttaatgcctctttcatgtgagacagtctcttcattctttgttggtcccgattgtccacttgttcttccaggaatgttccatggatgagaccccatatgttgagaccctggaacctgggggagccggtgggtcacctgatggagcaggtggttccaagttgcctcccgttctggctaatcttatggggagcatgggcgccgggaagagcccgcagggtcctggaggagggggcatcaacgtgcaggagatcctcacctccatcatggtacgagcctctctcctgcccctctcctgcctcccttgctcttcactccccttctgctcgcctccccatctgcttgcgcctcagggtattacccttcttctctgttgaccttgtcctcaatgtccttgccttacagggtagccccaacagtcacccctcagaagaactgctgaagcaagcagactattcagacaagatcaagcagatgctgggtaatgctcagggccagcccctgggcctgggcgaggggaccggcagtggacttgggggagctcgggtgttgaggggaagactggatagagagtggcactctgccaggttggtgggaagggctggctggacgtgcctaagcgggaggacatcatgctgctcttctcgaattctcttgctgactgcttcactccttattcaacagtgccacatggactcttaggccctggtccgatagccaatggtttcccacctggaggtcctgggggccccaagggcatgcagcacttcccccctggacctggggggcctatgccaggtaggggagagcaagcg

SEQ ID NO: 59555 - DNA, 847 bp, Bovine  19866880964461
cgggtcagctggctaggatcactgggactctccactggcttcacatccaaagctcctggctccaaagaggctgaaagcagaagtgatttcagaccagtcccttcctttcaaagaacccccaaacctgatccaggttctgaactcaccagtatccatgagctctgggacttcaacagggggaactggggtcccgggacgttctgtgtccatagtctcaggaggtgctggctctggggaagaaggtttggccacgcttggttctgtgcttgtttttccttcaaatgggcttggctattgtggaagaaaaagaagtcactgggcacacaggaaaggcaaggtcaaggcagggcaatcagttcaggttctaggaaggatcccgacacttcctgtcaaggaagaccacctctgacaacgctctgctgctgccaccagtctacgtctgagacaacgtctcttgcatcccccaagcgctccaagctgctgggcccttcttttccctgtaccttttctacctggtcactggcacctactgcccagtgcccgtaccttggcagctgtgggtgacagcaccttcttcttcttcttaattttgatgcctgggacaggagctgaattgagtgcatccagaaagcccaggccctccatagctgcaaaagaaaaaaaacataacatagcatcatcagacctctttatgagcctattcttacaaagtctgggcagaaaattggtcaatagaaattctgctgcctgaatgttggatacaataagctcaaggtaaccaggaagcgtatgtaggaggatttgcccaagaaattcttgtcattctttcttctaaaggcaggtaagc

SEQ ID NO: 59556 - DNA, 791 bp, Bovine  19866880969483
gggggtgccagcgattgagtgagattgttttttccctaacttggttctgagtcacacagggcaactttccttcccagaaaaccgcctcaaggctcaccccctggcagccggtcaagccccagtcctaacacgcgatcctctggggctgtaaacgggatagccgggagcacccgccccgccccgcgaggcctctctgggcggagcgtgggtctctcccaaccttcaaagaaaaagggcctatggccgctgctttggaggcagcagggaggcacggctgaattttgaaccagaggagacgccaatgaatcacagagctgcaggggagggaggcccctaggagagcctttaatcttaagttcgactttacgaatcaactcatgcggtaaatacagggtgtctgaaaaggcaagacaaaaaggggaatactttatttattgcacttcctgcccgccccccgccatgattatgtgggttagtcgttcggtcacgtcggactctttcggtcgtgtcggactctgcgacctcatggattgtagcctgccaggcttctccatccatgggattttccaagcaagaatactgaagtcgattaccatttccttctccagggtatcttcccgacccaggggttgaacccgggtctcctgcaatggaggcagactctttaccatctgagccaccagggaagccccccatgatcatggtttgagttaaatctcaatcatatactccagtgctgacactggagcagtggacagagcaatatccacatgaacaactttagcattaat

SEQ ID NO: 59557 - DNA, 1036 bp, Bovine  19866881011788
atgggattcaggaggctgggtgtgtgtcctcccgtttgaatctagcagacccttagtgttaaagctctataatgagacttaatactgcacttacagggctcttctgctcagatcataaatgtgcaccccacttatttgccagtaattaagactacttgtacacatttaattaacattttcacaagcatcaagtcttagctaagtatctccaccaacaggaagttctagaattataccgtatgagccctaaggatttggagaacattatacacccatcttaattcaaaaagttgggtgcctgattaatgaggtcttgatcatggccaggctgtatatttaggtcaggcctgtttgtgcagctttatatgctcagtgcttagcgtaagtctagacacagttagacctcaataaatatgttgttgaatttgaataaatcctgttaaaaaatctcacttggagacatcagctgtgacatctcttactgctgcttctcccagaagttcctggtataacccaggactgacagcagggggcgcataggggttgttccaacaccagagggaccaaaggggattggactttgaccaggcctcaaaagcctgaaatgacctcccctcaccatgttgatgacacagttcctaaggtacaagtgggagcatgagcagagggagtggttttgggcctcagaacccactgaattaactcctaaaagaactcttcttttgcaaagagaatgcatgaaaagagaagggagaagagcagccagcctcccacagctgtcagcctgagagctgctctcacctcagtccatctagggaaggggctacaaagcagacaatctttattcacaactggggcggcagacgggagagacccccgggtcagtccaaaagcaaagatactggggaggtggggagatggagtagggcagggactcagcactcgtcctcgcccagcagggcgtaagggtttcgggcggccaggctggaccctggagccgaggttggggtgtcctcatccccttccccctcctcat

SEQ ID NO: 59558 - DNA, 1554 bp, Bovine  19866881046787
attctgaattagagaagtctgaaggacactgagactgctgaattctgacttaagggcagggaaaagtttgatggaggtacaaagagaggtgatggcttccagtgtcagtatggcaaagccaggcgccagttaagattatttaactgttagatatcctgcatgagaagtctgagagggcagcacctcaataaatcacaaagtcccaacctctagagagctgaaaccagcttataagatgattcttgacacagttccctcacttaggcccagaaccaaagcactttaaaaaaattattttttccgctgtgctgtgcagcttgtgggatcttagttcccaaagcagggactgaacccatgtccttctcagtgaaagcttgggatcctaaccactggactccccagtacttttttacaggatctgtagcctatagaaattaagtgactggacaaaggacccctagggggtagccaaacaagccacagagagtctccatcccctgatgctctcacactcctctttcatcatcctgcttctttccctttgacagggtcccagggagacccaactgcaatcctactcaagaacaaaatggcagaaggatggtccagtacatgtgggaaaagactcacacgaaacatcaagaattttcatagacaacacactgacagagagcatggccagctccaccagatgaactcatacaactacagcacccagtctgtgtcccagcccacacttcttcagcctgccttatactacacttagtacaatcagctatgggtcaaccaatttcttcccttaggatttaaaattctttgatatcaggatctcttatttatttttgttatctttgtccctagcatctagcacactgctattatttatgcattgtagacaccaacaattgcttctggaaaaaatgaacaaattgtggaactaagggttgaaatagggtaaggactctattacagtgaagaaggttcactggcaagcaagtccaagagaacagttacattagatcgtacctgcctctccactctggttcctgccccttgccagaaacttcctgttcccacatggtcacttgaggtctctggttgtctggccgcctctctaagacatcttgatgggttgggcgctggaccaggggagtgtctgaggcccatgtgggagccattctcggcagtgttggaaggggccgaacttggaagtgggatgggggaatcagcccagtggaacctaaagaatcataaggacaaaggtactcagttctccagggagacacaatcaccagtccccatgccagatcccactaacctgaaggtcgaaacatctcccacattatttgaagtctctagagtcggtgtacagccatctatgaccccctgaacaataggagaaacaaggacactccaattcaattttcaggccttcttccaaagagagagcccctacaataacaaagtcataatccttaaataacagccaggtccatccaactcatagcttttcttatcctatttcccaaaagaagcagaagtaccccaagatcc

SEQ ID NO: 59559 - DNA, 1475 bp, Bovine  19866881051537
cacactcccacacactgcagccggccctgctgctgagtaggcagatgctcaaactgattgcttcagctcctcccggccacaccaacttcccccaggcacttaccccctccgcccctcctgccctccccacagtgactcctgtcctgagaatgtcctgccctggcataaaggccccgggtgtccaggagctgctgtcagtcaggaggccacgcggtccaagatgggctcttcacgagcatcccagatagggtgtgtgggagggcgaggggtgctggctttgctgctggctggtctcctcctgcaaggtaggaggttggggccctgggagtggggagagtggggagagaagggagattcaggcgcgcagacaaccggtcagggaaggctggagggatgagagtccaggagaggactcagagaggggagatttgggggagggctggggctctgggaacctgaggcttgagtctagaggctgctcctcactgccttggcacctcaggcaagctacttaaactttctgagcctccctttccgaaagttaaaaaatgagcttaatgttaacacctcgctctagtttctctgagtctctaattaagtaatgcatgtgacactgctgtggaaattctagacggttatatgttgatggatattgttgtaattatattattattggggtgctagaagatgaagattggatatttagtagtcataattgctaccattcatagaggcccttttatatgccagaaactattagcactatatttatttttaattttttaaccatgctgcgaggcctgtgggatcctaattccctgaccagggatcaaacccgtgccccctgcgttgggagcacagcagtcttaaccagtggactgagagggaagttgcatgtactagcactttaagtacattagcttttttaatcagtagaactgtgtgagagatttgttattcccactctgcaaaggaggacacagagcttggagagctgaggaaactggctcaagattacaaattagaaggcagttaagctgggctccaaaccccaggctgggtgactctggggtctctactgggtgaccacagctgtgtggcatgggggagcaggggaggatagtggggtgctggctgattggtgcagtggagtggagggggctgtgggcagagctgggggttggtgtgaaggtggacgtgttgaatttcttttttaggagagaatggggactgcacaaattgtggagatctggtttttggtgggggttgaagggggagtaataaatcatggaggttgagggaggagtaaataaatcatggataacgctgtctgtttttgtaaagcagtttctaatagatgatcacatccagtggtcacagtaacgctgggaggaaggcagggccaatctggcctctccaaatatataagctgaagcacatggctcttggacggagggggtcgaggaggggagcag

SEQ ID NO: 59560 - DNA, 1021 bp, Bovine  19866881053251
ggaggaccagacccctcccgcaggccatacctcagatctgtcccagaaatggactgcactgggcaggctgagcccacggagaccagctgcacgtggtgtgctatatgttaatatcctgccctggagccttggccctccctgcttcccaggcgcttgctccgcaactctgactctgagcatccctcctacgcaggtggccaagacgaaacagcagatcgaggagcagcgggtgcaggtgcaggtggtggagcgggcccagcaggtggcagtgcaggagcaggagatcgcccgccgggagaaggaactggaggcccgcgtgcgcaagccggcggaagccgagcgctacaagctggagcgcctggcggaggcagagaagtaaacaccccctccctgcccccctcagggttctttcaccacctgggcgcccccagacaaaaagctgaggccttttctacctgtcctcctcctgccgaatctttctcccagagcaagggctcttcttcaactaccccctccactcccctttgcccaggtcccagctgatcatgcaggcggaggcagaagccgaggctgtgcgggtgagttagccaactgatggagggagtggggtgctgctggtgctggggtctctcatccttacctaccgtatctcacgtgtcttgtaccctcctcagatgcgtggagaagccgaggcctttgctataggggcccgagccagggccgaggctgagcagatggccaagaaggcagaagcattccagctgtaccaggaggctgctcagctggacatgctgctggagaagctgccccaggtctggggtagggatgggggtgggggcggtggagggcatatggacaagagcagtggagggacaggagggaacgaggggccaggggagaaccaggctaggggccatgaattaggggcgggaattaccagccagtgaccagaacaaggaagggtgatgctcacaaaagcgaagaacacaggtcttaaaaacccagagtaaggagtcttagg

SEQ ID NO: 59561 - DNA, 2783 bp, Bovine  19866881075970
cgattgggcagggatgtggggttggggccactgaaagagaggcaggggaacactgtaggctgaccagcccatggaggcactacatttagctctaggcagtgaagagtcaacttcatggaattacattataacttgggttttgaatcctggctctgtcattacagctgtgtgaccttgtgcaagttactcagcctctctgtgttctgtattactccatttaagtaataactgacacttaaatagcacttattctgtgccaggtattgtacatatcttagctcacagcaaccctgtgatacaagcaatattattgtctcttattctacggatgaggtaattgagtcctggataaaatgagaaggatattgatagtatccagctcaaagggctgttggggggtaaaatgagcttacacatgtaaaccgcttaggtgcttggcacatagtaagtgaagtgaagtcactcagtcgtgtccaactctttgcgaccccctggactgtagcccaccaagctcctctatctatgggattctccaggcaagaatactggagtgggttgccatttccttctccagggaatcttcccaactcagggatcgaacccaggtctcctgcattgcaggcagatgccttaacctctgagccacctgggaagccctggcacatagtaagtgctcagcaaattagtctggttcattatccttactgtttttgcagaaagaggagctctgagaaactgagttgttgagggaggccgcagtccatggggagagctgagggctgggcagcttagttaacccttcctatccatccctcatctcataggcctgcgagttccggaaggagatgaatatgggtgttgggtttgtggctctgtgaccccttatggctgccaccacgagcccaccagccagcactactccgtcaagtgaaggggcacgaccgggattgcctatgcccctctcccgatggccttcctccttccttccctgagcagactcattcaagtcactcgtgactctgatgcagttttctcatctgtagaaggaaggaccagggcaccatggtctccaggggtcttccagcctttatggcatcccgatctgggcagtgggaacctcctctcctcattctttcttcctgttcccattctcttccccaactatcagagaacttagctgaggacactgcttgggacccctggggaacaggatgggggtccccctttctataaggagcccccttgggctggctcctgaccctcttgagaccttcaattctctcacctcagtacaggtgaggaaccctgctctgtgacgccccctgcttagaccactccaggtgggtggtggacacaactcttgctaaataaaacagtagtgctcccctggtctcccagccactgtgtaattatccaagtgctttgccgtcgggcaggcaccgaccaggtctggtctctgcctcttaccagatatgtgaccttgggcatttaaatcatttccctgaaccaagcttgtttgttctcaagctgtaaaatgaggctgacattgctaacctcataggttacaacaaggtaaagtgctcggcacatatctctgtacctagaacagctcagacatcagtagctggtagggttgttttgtgaccctctcagcccaggttgtgcagtggtatagaatctcctgccaacacaggagatgcaaaagacacgggtttgatccctgggtcaggaatatcccctggaggaggaaatggcaacccactccagtattcttgcctggagaatcccatagacagaggagcctggtgggttgcagtccacagggtcgcaaaagagtcggacatgactgagccattgtgcacacacaacctaactattacagctcagacacaacaacctcttctgacatcaagagcctgcacatacctctaagttcctccacctctgatgcgtgtgtcctctgggggacgttgtggctaaagaagaatggggaatatttatttacacagtgaaggcagagagtctcaacctgagcaccacttgatgtgagctggagagttctttgctggggggctgtcctgtgccttgcaggatggccaggaccccctctggcctctacccgctgggtgccaggagcaaccccctccaaggtgggacaaggttgtctctagacatggcgaaatgtccccaggggacagagttgcctctccttgttgagaacttctctcctagagacctgggtccctggaggaaagtgtgggggtggggccagattagtggaaagggggattttcagtccctcctgggtccagatggagaggcagaggaggtctacctctgcctcagtctccctaccctacaggacgcattgcctgggaggcaggctacccagttctgagcagtcaggctttggtctgattccatggagcctaattacttgcctaatcatgttaatgagcagctggcctctcctcttcccttccactccagccctgcctaggtcttagggaccaatcatgcccagtactagatggattcacaagttcggccctctagtcctcccatgagccccgtggccccagggccctggcaccgtgccctccaggtcaggccgtctccaccccctctgcctgctccactcacccctagaggtaggagccagccctggcttccactccgttcagccgagtcaacacgattgactgcgtcccgtgtgccaggccctcactctggtgctggggctgcagcagcaatcaggcaaagaccggccggctgcgactccc

SEQ ID NO: 59562 - DNA, 1191 bp, Bovine  19866881088665
gagctggaagatgcagggaaatggattctcccctgggggcctccagaaaggctctacctggacttctgatcttcacaattgtaagatagtaaatttgtgttgtaagacattcagtttgtggttacttgttatagtagccgtaggaagccaatataccaccatcttttaaggatgggaaccaggtctatttcccatgacacagggtcttatctaggagcagcccctcagatgggggccacttctgtaccgcagaagctcctgcagttcgaggtcacgatgatggagctttggggatacatgagaaagtgctggaaggcataatctggatcccaaacagaaagagaatcaagtgtttctattgctaagaagtgaagagatggagaccccaagggtgaaggtcctcatgtgcttggcatagggaaccaggaagagtagggctggcaaccagcgatgagccgaaagccagaacacctggattcggaaggggtggggagcttgaggaaaagagcagggtgggaacacctagcttccctgggtctttcaagtggcacctgttgccacagaatgaattagaaatgagggtggaatgtggggatttattgtctccataaccactggctcagcctgtttttggtgtcccccaccccactgacaggataaagggctgcatgtctaggggctgagggagacgcagagcaagatgcagggctgcgtggtggggaagcgggctcccctggggctgctcctggtctgtcttcatctcccaggtagagaggctgtgccgctccttggacaggagcagactagggggcctcaggggagctgggattgagggaaggggtaaaggtgggaggctgtacacttgggtccctgaggaggtaagagctggctcagggaaagtgaagggacttgaaacaaaggggctcagggaatcagggaggagagggcattgggaccaaacatctggtccactggatgcatcctcttccccttccccctcccccaggcctccttgcccggagcatcggtgtgatggaggagaaagttcctcgagacttggggatcagcttgcctctgctgggaccatctcccttgaccggcccctccaatgccgagcatcctcagcccaaaccagcccctgggcctaatgatttggccagggctgctctgaagcccaatccttctccaccg

SEQ ID NO: 59563 - DNA, 1265 bp, Bovine  19866881098553
cggacatgactgagcgactgaactgaactgaataccatcccaacaggagagaatgaagtggctcctagggcaggggtcagttcctttgcagccaagcagaggctctgggaggtgccctgtgcttcaggttgaggcccttcctgtagggataagcacagttcactgtcccctccttggggtgtgagagctgcctcggccttggcgtctcccctgttgtctccaggacatagtcacgtggccctcggtacattctccacaatcttggtgttctctgggggaggccacctctccttcccactgtagcgcttccctctcacctctccagctctcactgtagacccacagcagaggcagcaagagagtgcaggcagaaaggacactgctggccgtgttctaccccggctggggcctgtcaccgtaggccagtgagtcaccgtgctgggctgcacaccctgcgtgctgccgcactctccgtcttttactctctccacccacagctcccaaaacagcacccgcctgggctcctactcagtccccaggaatctggtctgggctgttgtgttccagccttcccaaggctccaggtgtcccagaaacccaggaaatcgatgctcaggacacccagagaggatggcgtctgaaagatgaggccaactaaaggtagaggagaaggagccgggtgtggggcggggagggaatcattagggctcttcgtaaggagaggggaggacccctgggtgaatgggcagtggagagaatgaatttcctggggagttcgagagaagagacatgggaggaaagagctgggagaccaaggttgcttgacctcctgctttcggttcaataaatatttattgttttcctcctttgtgggaggagatgtaagatgtaagaaataccagggccaatttacaaatgaaagtgggggacacaggacctttagaggcagaggagagcatcacccaggtcctaagaggaaaccctggacaccaagaaggcgaagagtctaatctagttctcacagtttattgaaacatctgtgctggacccagtgagagcagggaggctgtcccagtctccgcagagagcctggtatctccccaacgcagggtgcgaagcatctgagtgctggactgagatggagtctgagagacaaggaggagtgtttgggaactcacaaagggcgtggtgagctctataatggagggcgggagtggaactgggagtgtgagaacccaatagcatatctcgcggtgaccagatgg

SEQ ID NO: 59564 - DNA, 1211 bp, Bovine  19866881200062
cccagcctgttgtcttctactgccagctcctcgaagaactacaacaggagttaagatctaggtaaacacagctcagagaccaatcaagcccttcaccaccacgcatgtacccagggacctgccatgcacatcatcccaccttgctccctctcccgacaagacctctttcccctccctcctgcccccaccgacttcacagtgccaccttctgctcggaaacaccacagtcccctctcctcacccctcactgcctcaccgtctttttggtcttcttgtccttcttccctttcttcaccactttgtctagaagggttaagcagatgttgtaaatgatgatgtgcaaattccaaagccaccctgatctcacctgccaatcctcagtggactctactctccctagtcactgtttttctagctccctccctggacactgtcccatgagacagacaatcgtggctggtctagtgggaggcagcaaaggagaatccacaaggtgatggcagaggtgggaagtaagacagttttcagagatgatgccaatgttattaagtggcaaaattagctgagctagtggtaccatgaataactcaggatatactgagagagaaagacctttccccactccagtcatccatgggggagaaaagtaggacaaagtattatatgtcatttttagaacctgcagaccatgaaaacaaagccatctgctaagtcaacaaacacctgggtctctgccgaacctgctccgcttgcacttccggcacaaactgcgctgtgttaggcttaactgggcatcggtccttcatctcagagtgacctgagacactgcttagcttcgtgttcccagggagcaaagtgggaagttgaaaaaagttcactgacaaatcccagcctctcctttctgtccatctcctttccttttccctgaagatggagggttacgtctaactccttcccaacataagacggggaggcagccagcagcctcgtgatttctctctactcctaggcctatctaccatcacattcacccctaaccatcccaccgcctactgctgttcgattctatccaaaggcactcctggagtcacttaatttcccccatccccaaacaaaaacaaagccttctgctatctaccacattaagtattctcagaccagaatgccaccgagtccaaaacaatcatttattcagatgctgagcatctaca

SEQ ID NO: 59565 - DNA, 722 bp, Bovine  19866881201497
ccgggctgggtcgggaccgggcaggagacagagaaaaggacagaggagcccggggctccaggggaacagctgcctctgtgaggagaccgggtagtgtgggactgagggtccagggggggtgcagggagagggctgggtgggcttgggacggaggcagagaacctgaccggactcccaggtccctccctccgatactgatactgtgggcaataccagtgagcaattaattggctggggtggggccagggttaaaagcagagggtggggagtacaggggagagggaccgcccccctcttagcagaccttggagttctgctcctccaggcctgcccttcatcctcagggactcgggagtccggtgacccttctttgtcctacccaggatcctacccaggccgagccagctgcttcctgttcgctcattcaggccgggcagccagttaatgggcggcagggccaccaccttcccaattagtcttattagcctcttgctcacccactggagtcagggtcacccctagaggaggggctgtgagtggcctgtgagtaaccgaggcccagctatgacaggggtccccagcccaggccggtccccagactgaggcccttggcgtccagcgcccacatgctgtccctggagccccccagaaggggagagatcagggggcctggtttttgggagtgcagactttcgaaggcccactcactgctggaacacaga

SEQ ID NO: 59566 - DNA, 1302 bp, Bovine  19866881230302
tgagttggggggaggctcggtgcagggtttggggtgggactcgggctgtggagcaggagccccggggagtttctggggacctcccctctgacctctgttttccctctggcagtctgcatcgtgggccctaacggcgtggggaagagcaccctgctgctgctgctgacaggcaagctgacgccggtgagtccaggagtcagggaggggcgtggtgacgggcgagcagaggcatgagcacacggctatccctggaggctccaatgggggagccctctcttctatggagagttaaatacagaacttgtcatggatggttcttttccttaagaggtgctatagaggaggacagtttagatcagtcagggagacagacctggagaagtgggcccagatgaagggcatgcctcccccatcccgcttgtgtgttctggttatataatcgttagaaattgtgtgaaccagggaattccttggcagtccagtagttaggactcagggcttttactggcatgagcccgggttagatccctgatcagggaactaagcaagggacagatgaaaaacaaattgcataagccgcagaaaaatctagagataacccgtattaattttaatggatcgttttccttttttttccttacaagcatatatgtaattatttttcttaacaaaagtgggttatcctgtgaattgttttgtagctaccttttttcagataatgtattttaagcatttttttgtgcctgtaatcttacatgcatttttctcatggatctgttataatttgtttcacatctgtcgtttagaacatttctggtttttcactgaaggacagtactatagtaaagagtcttactatacttgttcatgaatttagtttttccttaaggtaaattccctagaattgctttggggacttttgcggtatatgtagtgctgctgctgctaagtcgcttcagtcgtgtccagctctgtgcaaccccattgacagcagcccaccaggcttccccgcccctgggattctccaggcaagaacactggagtgggttgccatttccttctccaatatgtagtgctaggtggttgtaaccatctgtctgccctccaggcaagtgtggagaaggcacattgcctcacacccacagagtagatctttagaaaggtgtcctagatcctcgcacaaactcattgccatctgaggtggaaccctgaaaaattctggctggaaggcggggacagggtttttctgctcgtggtcagcctgctcctggttctgaatctccacttacctcctcgcttttc

SEQ ID NO: 59567 - DNA, 1729 bp, Bovine  19866881425042
atgggcggcacacggggtccccagctctgtgactcagggagccatggacgctttgtggcattcagtctcttctgtacagatggaggggtggctgatgctctagaatcttgtgaatctatgaacccaaagtacctcccccatccctgaagcttcctggaggacaggagggaaaatctgaatagggactggatatcagattttgtgttcattttcttaaagtgtgaccatggtattgaggttacataggaaaatattctccttgtgggatatgcagctgaatagtcaggttgtttgcagcttactctcaataactgccccccaaaatgtatatgtatcaatatgtgtaaatatgcagatagacaggaaatgtgatcaaaggttataaactgctgctctaacgggagaaggtagatgagtatccatcacatgattcttttaacttggctaagtgtttgaaattcttcccaataagaattgggggtaatcgttggtatgtcacgttgcctctgtgactggggggtgactgggacgagctggggggatctggggctggtccaagtgctattgttggatctgggcactggctatacaggtgtgtttaccacttgagaattcatcttccttgataacttcatgacttgcatacttcaaagagaaaaagctttcaaaatagttttgacaataatctcatgccttaatacctcctccttcttggaagcccacgtgcctcccagccactctcaccagccttggtgtgttccctacgagcctcgttcagtctcctctctgattctgagagctgttcccgcagccgaccttccacttcggccaccttctcctgcagcgctggggtggaggtgcacacagcgcatcaggggagcctggggtcatggttcccaccgctcccgaccccaggactgcccctgtccgctcctgcacaccttgcccatagatctcctgctgctgggtcagctccttccggaggctggcagcctctgccgtgctctcctgctggccctggcgagctgcctccaactgtagccccagactggccagggactcctgcgtgcgctgcagctcctgctccagctgctgggccacctcactcagcttctgccgctctgcctcccctgggaagaggaggtgcccactcaagttcctccctgccctagaccccagctcttccctcctcctctttctccccaaggccccatgactctggcccccggcttgtgctcgctgacttggaagcaccaggcgtaccttgctcccgggcccggcccacctcctgctggatgatgtgggcgctcagctgcagttctgcgtccagacggttccgctcctcccgcagctgctccagctcaaggctcatgtctgtggtcggtgggggtggcgggcagctgagacaggaagggaaacagagatgggggaaatcacccagctgcctgacccctaagcccttatccttcctccatcctcgtgtttttcaggtcccagcaaccaacaccctaaagccccactcctgccccccagtaaatctaaagtggcccggacttcacctctcctggcgcagctgagcaagggccacttttcgagccatcaggcctggggagaaaaggcagagagcgtgagacgtgcgtttgcaaagaggaggggaaacaggggcgtaaggagatgctcagaccggggaggaggaggcaggagggtaggtgtaggatgagagagctgg

SEQ ID NO: 59568 - DNA, 1425 bp, Bovine  19866881513434
caggtttgatccctggtccgggaggatcccacgtgcttcagagcctgtgctccacaactactgagcctgtgctctagagcccgtgagccacaactgctgaaccagtaggccacaagtattgaagcccgcacaccctagagtctgctccacagcaagagaagccaccgctatgagaagcccacacaccacaactagagtagcccctagagaaaagcctgggcagcaacaaagccccagcacagccaaaaataagtatttaaaaaaaggaagaaagaaaaaaagtgcatttgcacaaagaaactttggaagggtaaaaaagtcactattatattaaaaatggttacttacggggcaaagtgacagaaaacagagagaaggacctaaatgggagtgatgtttctcatgtaccttttgatatgtgtttcattttaaactacataaatgtaatctctttaaaagattggaaatgtaaaaactccatacatgatttgttaaaatcaaagaatccagaggccagatgttcagtaagtgaaaagcaaaggacatgcatcaaaaatatttgggttttacttttctgagcaagccctcctcagtttccatgccctttttatttaaataattaaataaatccaaatcttggagacgtttcacgaaaatcctgccaaggaaaataccaagaattcaatggccagaggagccctcaatgcaataaaggaaaagccatgaaatgttccagatggcttgagaagcatgttacatttatcatttttggttacaaagtgtgcatgaaatatcacattcctcatttttttctcaattaaatggaatctgttctgtgtcccaaactgccagactgcaaggaaattcaaccctagtcattagtggggctccctcctcccttcaggagactgtaaaacatcaggggtttaagcagtgccagaagagctgagagcaagtccctggacttgctaactggggtagctggcagctcaggctgctgcaacaaaataccacagacaaggtggcttaaagaacactcgtctctttctcacagttctagaggctgggagtccaggtgctggaagcttcagtgtctggtaagagttctcttcctggtttgcagatggccacgttctcactgtgtcctcacatgacatggtgttaaggggaggcgtgctctgatcgcttcctctttttatatgggctccaccctcatgacctcatctagacctgattacctcccacccattacaacaccatcacactggggatagggctttaacacaggactctggggatgacacaaacattcagtccatagcagcagccattgtttctgttgttctctctgatttcagaggttgctgtcaaccctggagccccctgtgtcaggcccagcattgccccttacagatgcccgtatca

SEQ ID NO: 59569 - DNA, 774 bp, Bovine  19866881528178
tgacctctggagagtccagcacaacctctgacactggatctagcatgacctctggagagtccagcacaacctctgacactggatccagtgtgacctctggagagtccagcacaacctctgatactggatccagtgtgacctctggaggggccagcacaacctccagtactggatccagtgggacctctggaggggccagcacaacctccagatactggatccagtgggacctctggaagggccagcacaacctcctgatactggatccagtgggacctctggaggggccagcacaacctccagatactggatccagtgggacctctggaggggccagcacaacctctgatactggatccagtgggacctctggaaggaccagcacaacctccagtactggatccagtgggacctctggaggggccagcacaacctctgattctggatccagtgggacctctggaagggccagcacaacctctgatactgggtccagcacagcctccagtgggaccagcacggcctccaaaactggatccagtgcaaccacaggaggctctgatacatcttttccaactggaatacacacaacttctaacaaaagtagcacaagtgctggaactccagtggaggatgtgaagcccagtgggtccctgaagccatgggaaatcttcctcatcactctggtctcagttgtagtggtcgtgggattctttgctgggctcttcttctgcgtggtgagtgcctaatacgtaggaaagtgcctgggggaag

SEQ ID NO: 59570 - DNA, 1662 bp, Bovine  19866881545189
accaaggagtccatcaaaggtaagggatggagggcagggggaccctgggaacctttcccccaggccctctgcagggcttgagccttgttctctgtgaccctggaggcccacagcctgccttgggccaagagctctctcccttataaccctcacacatccggtaggcccacagcctgccttgggccaagagctctctcccttataaccctcacacatccggtagctgcgctgttcctcggcactgtgactgacacccttgtccacctcccgtccctccaggatccctttctgtcttgctcgatgatctgcagggcctgagtgaggccatttccaaagaggaagccatttgtgaaggggacagccagacctcctcttcagtctgcctctgaccagctgtgaggaccaggaggatgaggatggaaggggaatgggtcgggaaggggacttcctccagccgccctcagggacaccagccgccaagatgtcatgaattctcccgtggctcaataaagatgacaacagtcagagtcatggtttggtcacttctttctgggaatataaggaagttttctccccgtagcctctcttgtccgggaagtgtgagaaccagtccctcatacagctcttcctctagatggttcctttttcaaaacccctttcctaggctgcccaggaggtttttggagaagctccaggttttgttttattcttaacttttattttaaaactacctctggaaaatggtcagggcaagggcacgaggcagatagaacattcacgtgctcagcaggactcacagagccaggcagcgtcctgccttggggggccactggtgggtttgattaacgggtaggtccctgctccagagacacttaccttctggtgggagagacagacgatgggcgggtacctacatgaacaaacgaatgtttcaaacaagtgctgtgaagaggaaaaaatgacagtggcatgatagaaactagctgtgtggggaggggtgactttagatgagggacaggcagggcttctctccggagggatgtgctgctgaggccggagtgcggtaaggagcgggctgtgcagccacctgggagaagcaccaggatggacaggtcctgaggctgcggggagccaagggagggtgctgcagggagaggccaggcctggtggagcttgggttttactctaagtcaataaaaagcccttggagggacgttcctggtggtccagtggctaagactctgcgctcccaaagcagggggcccgggttcgatccctggtcagggagctagatttctacatgccacaactaaagatcctgtatgccgcaactcagacctggtccagccaaattaaagtaaataaataaatagacagcccttggagtactttttaaactgagaacagccacacaatttgacttacatatttaagagacccatcaactggctgtggaggatgggtttgggggcatgggatgaggaaagagaggaatggagtctttgaaaacttgagccgcaggggactggtaatcctggccactggggagcagaccaggttgtggaggaagtgagttcagttttgggcatttgcttctgagcggctcgggagatcctcacagaggagtccttgctgcagaaaagttcaagggacatctctgag

SEQ ID NO: 59571 - DNA, 710 bp, Bovine  19866881736647
aagacacaatgaaaagacacaacagagaagagagtggggtgtgtgggggacacagtaacaggatgagagctctaggaactgtgggaaattccggagggaaattatacactagggacatgagtaacgtagagggctgggaccagggacacagaaataaaaaaatgagttgaaactgggaaagacagtttggtaaaggaaaagaaaggaacggtaaaggagagaggaaaggacacactaggaagacaggcagaggatggaggtgggactggaaaaaggcaggtcttacccgagctgttggggacactgggagcagagtggggtggattcccacgaggccgcggctcctgataagggggtggctctcgggggcctgggcggttgttgatgaggatggtatccccggggacagagagatgaaccgtcagctcctcttctaataccctacgctcggccttgtcgtggggaacaggaaacattaagcgcagctactgctcagctgtttgttaaatgctctacacgtgtgccctccttcaggcctcactacaggcctgtatcgtgtctactattactccatctcaccggcaaagaaacaggcttcagtgcatttaagtcccacaatgtggttccaacccaaatcctaccagttcataactatcaactttaacacgttatcaccaccactggactctcgcccagaagatgtgggcagg

SEQ ID NO: 59572 - DNA, 2577 bp, Bovine  19866880341813
ctaaaggaaatcaggcctgaatattcattggaaggactgatgctgaagctgaaactccaatactttggccacctgatgcgaagaactgattcatttgaaaagaccctgatgctgggaaagattgaaggtgggaggagaaggggacgacagaggatgagatgattggatggcatcactgactcaatggacatgagtttgagtaaactccgggagctggtgatggacagggaggcctggcgtgctgcagttcatggggtcacaaagagttggacatgactgagcgactgaactgaacagaactgaagttagtgtgagtctcccagtggttgacaccaggttcatgggactcccagctcaaggatggagacttccattgtttccctggggtgagaaaagctggccattctttttcctcaggaagcacagctgctgacacataaaccagagcatctccctcattctttgcccatactctctgatgtgggcctcaggccctggctgtggggtgttctttaaataatagctttttcttcaaggccttgcctgtgatctgattgatggtggcctgggagaagccagctgcttcagtgggcaccacacacagacgctgcactgtgtttcctgtgtgtctttggcaggtcttactctgagctcctgcttctttccttcattcagcaagtgttttctgaggggtagctttgtaccagatactggggtgcagggatgagcagtaacacatggtccccaacctccagagactcagatttaggacagaggactggctttttagaatatctatctatctatgtatctataatttatttatttatttgtttgttttggctgtgctgagtcttcactgttgctagagctttttctctagttgtggtgagctggggctactctcttgtggtgtgcaggcttctccttgcactgtcttctcttgttgcggagcacaggctccagggcatgcgggtttcagcagttgtggcacatgggctcagtagttgtggctcctgggctctagtagttgtgcacagaggactggtttttgcaataaagtatggaacgagctgtaacagtggactatacagaggatctgggagcccaagggggcagggaagctgacacagattgggaagaagagggaagccttcctggaggagatgttgtctccacagaaatttagcaaagacaaaggatggctggattggcagggtcccaacagggaatgatggcacactaagttaagataatttgaggaggctttacatacagaggggttatttgcaagagtgtgggtagggggtggaggaacattataaaatatcacagaaacacaggctagcagcagcccctaggccagaagaaatgaggagggggtctctgtaccacagaagaaaagtcctgcagatgagtctgcctcgataggaggaacggacctccatctgggaacaggcagccttataggactgtccagggaggcagtaactaccctggcttcactctctcctgtgttacagttgctcctggtgcttcccgttgggccccggagtttacttatggaatccatacagggcagcctctggggcacagagcaggatgcagagtaaatcaggaggggccagcaggtcttatccagaatactgggttagggaagggtaggtgtagaaaagcatgtagatgggggaactgtgttctttatggctgtagtgtggagtaaactgggctgaaagctgtccatcatgaaaaccttgcatatcttcctgaggaatttgaaaatttatcctaaaggcaggaggagcactgaaggattttaggcaggaagtgacaagtttagatttgtgtctgtaaacccttctagccctggcatgcagctgacctggaagtaccatttcagattagagatggtgagggctgaatcaagacaacagccatggagagaggaagatgtggatggatttgaggaatttttaagaagtagactcaagatgtgatcagcaattggataggaaagtgtcaaggcctcagtttttggctcgaagctctggcacaagagggaacttcatgggagcgggttggctgtccagctgtcacctcttgggctttgcttactggattcagaagacttagattggccctcattagcaggactgtgagctttcaagggggggctttggaggggctttttagacatgcagcaggttggccccaccttggctattccgtgagcaaatcaagctggagagcacgagacggcatcttctgctgcctgcctgggatcccctgagccaggacctgctcccctccaacccttgcccctttccatatggagacaggatgtgttttcttttaaagtgcttcactgcaggggcaaatgaggcccagctgaggggggagagccagcaatgaggcagagcatgggctccacaagctggggcgagccctgggttcctgtcatcccccgtttccttcctcgcttttctgaaggccctggtccccgtaggctcatatttcatcactcggcaactctgaggaacctgctatccagtaacagggcccattcctcagagttct

SEQ ID NO: 59573 - DNA, 795 bp, Bovine  19866880438085
taaacatcagccatctttgctacctcaggcaatacaaatacttgcacatatagtatttctcattattacttatcagtttataacaaatgtcagcatcctatgggctacaataagttcagaaacaatccagatccctgggttttcttcttcctcctgtccgctgtcttctggctatttcactatttataatcttcattaaagagtgagcaagggaaaaaagaaaaggcgctaagaaggaatttacaaaagcattcacagtaacaaccaaggaattatcatctgatttgcttttttatacactctcttcttgactgtagtcatttacctaatcacgtccaagatgtaccccagtaaaaaccctattaaaatactcacccgatctgcaacaatagcctttcgcttactggcatcccctgataaccctgcagagaagcaaaacccacataaatccgaagttaatccacatcttcaggagtgaaattgctctggtcttctattgataacctatgctaacaatagatataacaaatctaggtaacaaaatattgggtaatatgccataacaggaacacctcccatcaactggcccagacagcatgtcagtgtactttccttttgttctaacagttaagttttccttacgaaatgaattttaaaagtgacatttaaaattctatatcctgtatttgtcattaaccttttttcctgaaaatctgtaaggtctgataacatcttgcttataaaacacttgaacactaagtcaaaagtattctgtgaatgattaatattattcat

SEQ ID NO: 59574 - DNA, 1945 bp, Bovine  19866880583899
ttgaaatagtaactctaagtggaccgtgaaaagttaaggatgtatgttgtaatccctggggcaatcattaaaaaattaatgcaaagaagtatagctacaaatccaatagatatatttatatggaattctaaaaatccaaaagaaggcagggaaggaggaacaaagaaatagaaaacagagggggcaaatgaaactaaaatcaaccatatcaataattacattaaatgttaatgggctaaacattgcaattaaaaggcagagattgtcagaatagatttttttttttctgtaaaaaagatgtaactatttgcagtgtgcaagagaagtattttaaagtcacagataagttttaaataatgggtgaaaaattataaacattcaaaagctggagagactatctcaccagataaaatagacttcaagacaaaaggtattaccagagataaagggggacattttataatggtagaagggttgactcatcagaagggaaaatactcctatgtatttatgtgtatgcaacatatagcagtaattcaaacacacaaagcaaaaactgacagaattaaagggagaaatagataatattgatcctattaatataatcagagatggagatttcatcagtgaaaatggagtttcatctccaggacaaatgggtttgggaggttagccccctaaacaagtgctggtctgtgagctgcggtgagacacctcaaagaagaagccaggagggagccaagtagccgttcaacagaacctggagagatcctttgaggccggcacactgacggccccaggtgattgtcatggacagcctgcagcccagctctcccctgaggtggggaggcagtcgctgagggtgttgaagctggttctgaagataggggtgataaagcccaagtggcaatggttacttttgtaggctattctggaacaagaggccaagttgtggagtggaaagcaacagtgaaggccaaaaagagcttcccgcagttcattattagcagctaaacctgatgagggctcaggtgtcaacaatcacaacaaaagctaacctttcccttaatcattgccaagaactgatggggtctgaagaagcaagaggcagcccaatggttatcaaacttgagtgtgcagcagaatcacctggagggcttgttaaaacagaatgctgggccccatgcccagaatttctgattcagcaggtatgaggtgggatcagacgctgacgctgctggtctggagatacacttggagaaccactaaaggtaaacaagtgccaaggggacccagaagaggggagtcttttatgacacactgagtcagtgtggaaggtcatagttgggggtgagtgcgagggacatgccaagtagaggagacagaaaaaacaaggttcatttatggggctgaactataatgtccatataaggagtggagcaggaaagcctggtaagttgtaccagaacccaaatcaggctttgcctaacttagaaataaagagctcaggctcagaaatcagataggtgaattcaaaacctggttctgccacttattggctgtgtaacttaaaagatggagaaggaaatgttaacccactccagtcttgcctggagaatcccatggtcagagacgcctggcaggctgcagtccatggggtcacaagaatcaggcaggacttagcaactacaccaccaacctaaaagaggttacttaaactcttggagcctcagttctacaatctgaaaaatgggcctaagtctgatacctcctctcaggagtgtcttgtgagggagtgcaagcgaaatcctggcccagagtaagcgctcaggctgtcaacactcagattctggctgaacacaaggctagggtttgcaggcagagtgcatggctgacccatccgtgggccagtgttgaccatatcaggccggtctgcaactttagc

SEQ ID NO: 59575 - DNA, 1255 bp, Bovine  19866880598745
ttttttaggatggactggttggatctccttgcagtccaagggactctcaagagtcttctccaacaccacagtccaaagcatctattcttcagcgctcagctttcttcacagtccaactctcaatgctttagccagtgggaaaaatagaaaacatgcatagatttccaaagaacctgctcattgaaatttactttttctttctgtgcttgaaaccatgagagcaaaatgtatacaagctggaacaagcctgctggaggatgaaatgtcttgtggaggagaatggaggtgcccccagatgataaggcccagataattgtctatcaagcaatagaagcatagtatagaagtatagtgaggctatactagattaccctggacctacctgctgatcacagaagtgagaagtccagtagaaccctgcggagccagtcctgggcagagcaaccatgaggatacaccacggaatcaggagctacataaaacagctgttgtttcaagaggctgagttttgagtattttcttacagagtaaaagctcactgatgacatccactgattctatcttgttgtgggcaaagtaatagaggattcaagaggctaagtgacttgctcagagtcacagttcagcaggcaaagtgtgacaggttctctgggactgggcatcagaacaatggagatggttcaaatctaagctctgttgttttctggttaggaggcctgggcaaatcatttgtgctttcctgacttcagtttctttgtcagcaaaacaaaaatgatttcccagaatatctcttggcactcaaaactatgacctgcccacttggttatagatggagcaagtgctagaaaccttttggttcagttgtcatttgtgaatagtcagccattctcgattgcacgtttttgtctaatgctaatgtgagttttgtccacacacaccaaccactctgaacactttgataaatcgagtcattaaaaatcagttacttttggttgcttgattgaaccaagcaactaattccaccatggttataaataacctgctagtaattggtcaatttgtcatattaaagcaattagaatgatgaagtggatggagaagcttccaaatgaggtgcaactatattaagagtcttcagtggggagggaggctgcctctttagcattgccactggcataattcagaccctcatcatccactttgatgtaaaggaaagagcagtagacttggaatcagacagagcagaatcaaagct

SEQ ID NO: 59576 - DNA, 1819 bp, Bovine  19866880614276
ttccaaaatgactggtggtgttaggcatctctgtatatgcttattggccatttgtatatcttctttggagaaatgtttattaggtcctttgcctaattttaaattcagttgtctttttactgttgagttcaagttctttatatattctgatacaagtaccttgtctgatatatgatttgaagacatttttttcccatcctgtgggttttttttcactttcttttttgtgtcctttgaaacacagaagtttttaattttaacgatgttcaatttatccgtttttttccctttgactgcttgtgttattgatgtcatttctaagaaatcattgcctaatccaaggtcatgaagatttcctcataagagttttatagttttagctcttgctttggtgtttgatcattttaagttaatttttatgtatggtgtgaagtagaagttcaacatcgttcttttatgtgtgaatatccagttgtcccagcaccgtttgttgaaaaagtctattctttccccattggattatattggcacccttgttaaaaattgattttccatacgtgtgtgaatttatttccagactcagttctatctcgttgatctatgtgtctgtcctttatgccactatcacactgtcttgaatactgtagatttgtcaaaagttttgaaattgggaagaatgaatcttaaaactttgttctttctttttctatactgttttggctattctgcatttcttgtatttctatatgagttttagaatcagcttgttaatttctgcacaataccagttggacttttgatagttattgcactgaatctgcagatttacttgggtagtattgccatcttaacaatattgtcttctgatccacgaacatggatctttcaatttatttaggttttctttcatttctttcagtaatgttctttggtttctcatgtgcaagtcttaaagttcttcctcaaatttattctgaagtattttattctttttaatgctattaaaagtggaattgttttcttaatttcatacttagattgtttattatagaaatacaattgatttttatatattgatcttgcaccctacaatcttgctgaacttgtttactatttcgaatagtgtgtgtgtgtgaatcctttttattgttttaccccctggagcacttaatacagttcctaacattaactagtattcaatctacctgtagtccttgagttgctatctctgaatgccacgtttccacagaaaccttccattcactgaattatttcccattttccaataccattgactcattcttctctttcacgcttatctgcaggcttaggaacaatgggccgaggcattgtcatttcttttgcaaaggcccagatccctgtgattgccgtagaatcagacaagaagcagctagagactgcaagcaagataataacctccatcttggaaaaagaagcatccaaaatgcagcagagtgggcacccttggtcaggaccaaaacccaggttaactacatctatgaaagagctcagtggtgtagatttagtcattgaagcagtttatgaggacatgaacttgaagaagcatgtctttgctgaactatcagctgtgtgcaagccagaagcacttttatgcaccaacacttcagccctggacattgatgagattgcttcttccagtgaccgtcctcacttggtcattggcacccacttcttctcaccagctcatgtcatgaagttgttagaggttattcccagccgattctcttcccccaccaccattgccacggttagaatttatcaaaaaagattaagaaga

SEQ ID NO: 59577 - DNA, 2294 bp, Bovine  19866880637927
gactgtcttaatgagttctttatctgccacgtgcctgtccctgacagcttagtccaggcacctccacggaggctgcagaggagacttggtttattgggaagggcagagtccatccccatccggggtcccgagaatggactggaagagaacagctgggtctcagtgggctttcttgctgtgcgggatggtcttggggaagggctgggggcccagccagagctgcagcaggatgactgcatggcatgcatgcagagcagcagagctgcaggacgtggatgggtatgtgttccaggagagctcgatgagccccagcaccagcaacctagaaagaagggagaagctctgggtctcatcctgtctctagacctgcagctcttcagctccccactacccctccacggtcatggccttgggatgaggagcttcccacccctgtcctccccccagggttgtcccagccagtacctgagcaggtgagtgagccagcgggcaggcgtggcccacaggaggtagggcagtgtgtggaaataccaaacgtagaactggtagtgaagggagcggctgaagcagatgccaatgaagttggaggtgaagagggtagaaacaatctgtaggcggtggtcaaggccaagggcaggagcagaggggtagggagatttcaaagcaggggggacaaaagtttgggggggtctaacagcacctggctctgtagttcctagatacatacttttgggcaaatttctgaacctctttggacctgttcctcagtctgtgtggaggcaataaaatctagaggtgtaaggcctagggagccatcactcactagctgtgtgactttggcaaattacttaaccttttaaaaccctaattttgtcatctgtaaaatgaggataaaacggggtttcttgtgagctttaaacatacgtaaagctcttaagacaccgctaagcagagggtgccccctcataatggtaactcaatgatatttagaattaagaataaaacacgcttaaatatgtacagtgctcagcacagggtttggtacagagtaggagctctatgaatggaccctgtagctattactggaacctcctttccctctcccagagcagcagctgtccagggttagttgaccaggaccctgtctgcacctggagagggcaagacttaccttcccatgacttaaaggatatggttgggtgtgaggggctggggtggaaccttccttttggagggatccttcagcagcgacaggataccttcccctgtcctggggagaaaccattgagacaacttatcaaaccaccacagtgggccacacagagctcaacgtgtccccaagcagcccctaaggcctaggcccttcactctttcccccatgtctgcccaaggaactgccccgctttctcacctgtgccacctgcagagcgcaaagagcaagagcacggtgaggtgggcagtcaacagtgccaggtggaaggcacgatgcaggaagagggcctcggggagaaagcgccagttcactgtccatcggaagagaaactggcggccaaggtcaaaggagcgggataggtagccgacggggttcttcagcaggaagggcagccctagcaccacctgaggatgagcgtgacatcagcagagctgcccaggctcagcctcagcctcatgctaatcactgaggggaggggagatagggtatagatcccagaggttccctaattgccactaggaatagcaagaaagccagcccacccagtcagaccaaaatcttgggccaaaaaggccaaggaaggacataataacagtgctttatatttaaattcatctagtcataaatgtgcacagctagaacggttctctgagaccatctaattcaacacccttgttttatagctaaagaaaccaaagtctagaggtgatggctgtccagatcagaatcaactccaaaactgtcccctggctttgaagatgtctcaaaaacgaaaggagtccagacagagtggccgccacttcatcagaaaggggacagggtagggatggaatacctgaaggacagcacagatgcccaacttggggagggccccacggaggccaaattttgtgaggagaaggaatagtaatccaggggcgaagagcagcacactcatcttcacagagactgccaggctggagtggatagtggggaaggaagagtgaagatcagcttcatcagggccatgtacccctgaccatcaccacagcagctccctgttccctgccagcaagctccaggcagagggtgagcattcata

SEQ ID NO: 59578 - DNA, 2032 bp, Bovine  19866880665586
atgtacacgaagccagctgggtacctggaagagagggaacatgagtccaggtcaagctactcagcctggcatccagtcaaccccctcccatcctcgctgaacctccggatcctactcacacaagaggtccagtgtcaccttgcagttgagtgtagtcataggtgccattgatgacgccctctacctcagccatgtaggctttccagtcaatctctgtatctgcaaaaggacaggatggtgtggttactttgtggtccagaattgctctgcctcactccatcaaagcacagagttccagctcattcttgggatttctatcataatcccttctctaactaatctattctctgcatgaacccaagtatctcaaaatcaaacatgtctgtaatggaactcagaactttccactccatatgtggtccccttcctgggttccatgaatggcaccattaacctctcacttgcccaagtcacaaacctgggaaacatccttgatacttctctttcatttccaaccctcagtcaccaagtcctgcctcttcttcatcctaaatatctgtctcatccttctccgctcaatttgggtgtaacaatctctagcctcaatggtgcaatagctccctaattaggctcccagcttccactttccctgcactacattttattgtccaccctgcaaccacagagctcatcctataatagaaacatcacatttctctgcttaaaacccttcagtgattccccaaggctcttagataaagaccaagtttttttattattcccatttttagaagagaaaattatgaattaacaaggttaagtaactagctcaagatcagtaagctaggaagggaagagttgagattggcacatatggagctctaaattctttttcttgagctctaaattcttaatcaccatactatctccttaacacagcttacagattccttcatgatgtgaaatctcatctcttagtactaccctcacttgatttctgtgttccaactctaattatttcatttctttaaaggaagtagactttctttcaatgggagctctttggaacaagattctctcctagactataatctgccccctacccctttctctctttcctcaaggaactagctcttattgttggaaaaggactctaggaagccttctctgactcctcaggtctggctgaagtgcccacctttgtccattatagaacttggtctagtaccattatgatgaatataatgtaatataattttctgtcaacttatctttgtccaggtccgcatacacaagtaggaaatctgtctatctttttcgccactatacccttggcacctagtatggtgttagccatataataagcactcagcaaatatgtagtgaactaactgtctttagcaagtaagcttgaaatccagtgctttctgcctggaaaggagtgaccaataatgcccaactgactgcaacaaaacgctatcacagagaaaatacttcgagacctcagaattcaacagatgaggagactgagacccagcaagggatgtaacgtgtccaaagccatagagacaagcagttgctgctgctgctgctgctgctaagtcgcttcagtcgtgtccgactctgtgcgaccccatagacggcctcccaccaggctccccggtccctgggattctccaggcaagagcactggagtgggttgccatttccttctccaatgcatgatactgaaaagtgaacgtgaagtcgctcagtggtgtccgactcttagcgacctcatggactgcagcctaccaggctcctccatgggattttccaagcaagagtactggagtggggtgtcactgccttctccggagacaagcagcagcagccattaatttagacccaggttttatgggggagattaagatcgagtttggttttctgtggagcagactttggatttgggtaaaagatattggtctgcaattgatggctgagtggatcaggagtctgagttccgaatgtgggtcccagttttgattggggg

SEQ ID NO: 59579 - DNA, 1416 bp, Bovine  19866880795029
ctgctggctaatgcctaaaattcctttagatgtgggtaaagctaaagatttttcctatttcaactggagatgaaaggtttaaaatgactgactgagatatcacagtgactgaaactcatctgctcaagattaatctatcagtcaacaagcacagatgactgttatcaggcactgtctccttctgagacccaggagcactcagatgacagcagatgatgaaatggggtgagacaaactagagactcgtggtcacttttggtgtgggggctggtaataaaggttagttctgtttacctttacttaccctgtggacaaaataggagttgggagtaaaggaatttaggtccaacacagctgtgtactagccccattttctggaatgtggccaccctgacatatggttcccatcaactatatttttgcatgattcttgaatcctgcctcccaccccccacctttttctattcgactgcactgacttcattacaatggaacttctcttccatgggttctaattgaggcatgaccagtgccttgttcaagaagagtttcttctgctgcttgtttctgcagaactaggaatacatagaaaacaatcagatgggttggagggatacagacatatggaaaataacagaatgacaagaaatgttcacaccaagcctggccctacctgtgaacggagaaaggtatggacaggggactgagaaggacttgaatgtttatttattttttaaaatcctgaagcaaaacatgacaaaatgttaacacttattcattctgtgttggcatttgctattttatattactctttttacttgtcttcatgccctttggtgtctttaaaagttgtcagtattgcatatatatctttataaataactgtacacatgattatagatgaataaagaaatattttgatgactaaagagaattcttacagttttttatgttaatgattttatcataaaattaaattaataaagcctcacagaaaagttgaaaaatataagaaaatagagatgcaaattaacatttcccataaaactaccatccagaatgtgccacagttaaaaatttttagcaatttatttctttttattatttttgtttgcactgggtcttcattgctgttcatgggcttttctctgattgcggtgagcgggggctactctctaattgcagtggaggagcttctcattatggtggcttttttgttgcagagtctagatggggtctagatgcatgggcttccgtagtggcagcatatgggctcagtagttgaagcacacaggcttagttgctcacagcctgtggaatcttcccagagcaggaatcgaacccatgtcctctcaattggtaggtggattcctatccactgtaccaccatggaagttccagaatttgccacattgt

SEQ ID NO: 59580 - DNA, 1030 bp, Bovine  19866880808984
tgtggaagaaggaatgaccccccacacacacactgacccctgaagcctaacaccccttctctgggcactcccagcctccacacaacttgtggcccccagaaggaggctggtcgctcagacctctgcctcaggcctgagaatgtgggcctgagaatgtgggcgctggggctctgccagctgtccttcctggggcctggttcaccccacctgtgctgggagcagaggatgttctagagctgagcccagagcccagccctgccctcggtagaacttagctgccaaactagatgcaaatctccaccttactagccacccctgcctgcctcaaacaccttctctagtcccctggagcagaaaaactctatgtttcgggtagtgcagcaggggtatcaagaggaaactggccctgtgcacagctagccttgtgaaaaaaatcataggcagacccccccgggtgctggttcatgctccctaactgtcttcaccagcagaaaggtcaggcggagaacctcttcaactcccaccattcccaagactttgctctggcccagagtcagacccccacagcgtagaaggtctcttcctccaggccctatacccagaaggtaggcagaaaaggttttcttcctttgtttataaaaaaaggagtttgaggcccagaaatatttagtaatgtgtctaagatcacagcaggacttgagccctggccaccgccgaggctgagttgtccaccaccctgcactgctgggtctgggtcagcctggaggccactcttcagcccaggacacctggccctcataggggctgctgatcagccatctgcaaacccctatcctgggagatgatcctggagatgggtccaacaatctgttctgccgttcaggtgtgtcatttcctgagccctcgggtgggggctggtttgggtacggccctgttggcactgattcagcatcttcattttgcatatgcagaactaggctcctagcacagagaggcacgtcaagccgcagccctggtgctaagccaaacg

SEQ ID NO: 59581 - DNA, 938 bp, Bovine  19866880837990
tgtctgactctttgcgactccatggactgcagcatgccaggcttccctgtccatcatcaactcctggagcttgctcaaactcatgtccattgagtcggtaatgccattcgaccatctgatcctctgtcgttcccttctcctcctgacttcagtctttcccatcctagggtcttttgcagtgattcagttctttgcatcaggtggccagagtatttcagcatcagtccttccaatgaatattcaggactgatttcctttaggactgactggtttgatctcccaagccaagggactctcaagagatagtagatagtgactaagtattcttgagtgaatgaatgaataaattttattgtcttgtgcttttcaggaagaagtctttaactacattcacaatatcttatccattcctggatacagtgtggaggagaagcagtctgtatggcagaaggctatggatcatattgaggtactgattcagtagaattttgaaaactttgccgtatttgtatagatatctcccaaattaagtttttgctaactaagtagtgggagatatattattaagttgatttgcttgagggttaacatctttttcagataatttattccacctcacatttgtggaaaacccatgctgtatacagcttattatgtcatgacttctgaaaataactcatgttaaatcagctagttcacaaactggaattttagtgttttttcacaatgttctgaggaattctgagactactattgatcttttcccctattatgtgacaggagccattccctcagttacttgatggaattttagaaacatcactgcaacgagttattctctctgatgtatttcccttacgtaagaggatgtatttctcttatgcaaaaggatgatgattctcattttgtttattaatgctgttttataggaatgcagt

SEQ ID NO: 59582 - DNA, 1374 bp, Bovine  19866880917345
tgaaaccatcattgctgtcctgggcttgtgttcccagcatggtcagctccttactgtttgagctcagtcagcaacactctgacatgatcagtgtgaggctcagcgttactgagccttgttacttccctagttcggcacgtgtatctgtgtttgtttgtgcatatctgtgtatcctggttgtcatcttggatctgcagtcactcttcccaaagctgcactgacagatgggagcaccagcagtatctgttgaacagtgtgactgccagagtgacatgtgtaagaaacacaaaagagcagcagtgttcttgatttgagccaaagcttttttctgttgaccagtaaccacaggaagtgtttggtgactctgctgtcagtgttggccctgccaagagccacattcaagtgctgaggagccgggagctgtgttggctcagggtgggtatctcgtggaggagtcattctattctgctgccgtgtcaggacctggcagattccatgagcatttcgtattttagaaattcctttggaaagctccggattagaaatacttatcatgtgtaataatttatctatagtgcttaaaatttgtataccatattttttgtatataaaatttcttcttaatgcgctctaactgataagttcaataaaaaaaagtaggaagacgcatatactttcctaggacttctgtatcttgaatgtatcttgatcttggatgactagaaatttgaaaattagatacattttccttagatagaaattgtcatagagttcattgcaataaactccatagcatagatcaagattggaggtactgttggtgtttgaggtggattaaagaagtgtagagagttagtggaaggcagcattaaaaacctcttagctataatgcatcatttcttcactacactagaaacaccaaccagaacttgtgtggcaaagttgacattgctgttcactcactcagttgtgtccaactctttgcaaccccatggactgcagcacaccagacttccctgtccttcactgtctcccagaacttgctcagactcatgtctgttgagtcgatgatgccatccagccacctcattctttgttaccccctcctcctcccatcttctgtctttcccagcatcaggatcttttccagtgagttggctcttcgcatccagtggacaaagtattggagcttcagcatcaatcattccaatgaatatttagaatgaacaatggcattgttacatgcataataatcagagaaagcagttttgtcttattcttgattacaaaagcatggttacactctctgagccatccctgttttagacgagctttctctgctgttgtggaagcatcaggggctgggtactctgg

SEQ ID NO: 59583 - DNA, 1703 bp, Bovine  19866881018716
tcattagattgaacagtggttattgtctacactcagagcagcataagaaagaacaagttcaaatctcagcatgagcattcgggttggatatacagagctgtctcttcagatccttgaaacagaataaaagtacctgaaatctcattgactccatacaaacagtagcagtactcccaacttttgtgaaatccaggtcagaagaaatcattacagctgaaggaattttcagtccatcctgtgggtatctcttgtctctgctgttcagttgccccaaagatccttttagtagctgcattttcatattccattctatgtctctttgggccccttaatgtggggagtctgatttgctcatccctcacttaagtggttttatacctgggagacttcacccttgaagccacttacccactcctccctgtcctcctcaccccaggaggagatctggaggcctgccttcagaggcatttccagcagactgcccaaatattgctgttacagagtgacccctgcccaaaatcattgaattgtctatctgatcaagaaaacccattgttagctcgctgaagcactaataagaaccaggaatgaagggtttgctttggagatggcatccaccaacactctgaaagagcagcaaagactgtggaggagttgtgcctgcaagactgatttggtgcttgctcttcagaaggccaaggtggtgctagtggtaaagaacccacctgccaatgcaggagacacaagagatgcaggttcgattcctgggttgggaagatcctctacagaagaatgtggcaacccactccagtattcttgcctggagaatcccatggacagacgagcctggcctacaacctacagtccatggggtcgcaaagagttggatacagctgaagcaagttagctcgcacaaacacttcagaagcacagatgatgctggcaagcgagctgtgtgtcactgtctctccttctgcccttgtgttgaggaatgcttatattccttaacgtcctacttcagagtatgcagatcaaattacatatttatacccgttgaggaacttgagagtgatgataaccctcatcaaattcctgtaagccccgagagcttccaatctattattataccagaggctgccagcgccacctctggacaggaggtgctcctggcaccaccatctccaccagctgttgtttacttcagctgaaaaccatcaattaagccctccatttgtccagtttgggattatgggccacatcctgatgccaggtctgaagaaacaattgtctgatcatctctacttcttttttacattcctttttggttccaaagctcacacattagcaatttcacaaactaaggaaggagttgagatgctgggtagccaaaatacacaaaggtccatcctattttcctgtgatattttgattatatcttatacaatatcaacttaataatgctttcccacagtcaatccaactatatttacgtttgaggactcttcataatcagtggcaacacttggtatatgttagtataagaacagatagtactacaactgctcttttcttactacctttattattttttaactgtattattataaagactcaatcctcttatatgttgtatagagatttaaaatttataaagtgcttctaggagatttaaagaataaaaggaaaatgtttattttcactta

SEQ ID NO: 59584 - DNA, 1093 bp, Bovine  19866881080159
gactaccctctccagaattcttgcctggacaatccaatgaacagaggagcctggcaggctacagtccatggtgtcacagagtcagacatgacttagtgagtaaataacaacatatgccaggcacttgaagtgtttatctcacttaatcccctaaactttattatgttggagaacagtgtgaagaaaaatggttcagggcagtaacctctgctgacacaggttcaagttgtcctgtagctcattaggacaaacttgggacagtctctgaacctccacagcctcagtgtccttatctgtaaaatggggttaagatgatttgtcttatcaggaatgtggtaaatatttattgccaccagcctcattttatagaccaacaaactaaagcccagttgtaaacagttgtaggtatttgtactcaggtctgctggatggtccaggctctttcctccaccactccaccaccaggcagcgtggcgttggtgagaggagtgtgtgccatgggcgggctcctggcagaggctgggggtctccctgggggctgggggtggggaagagcacctgtggccattaggaatggcttttataagcctgttccaccaactggctccctcccccaggtctgcagcacattgaagctcttcctgtttgctcccaagcagatggtgctggaatctctctacaccaactcccattcataaatcacggcctttcccctggtgctggagcaaccattctaattagagtgggggaggtgtgcatgcaggggtgtgtgtgagtgaatgtgtgtgaagagacagagaccgtggccaggagaccccctcgtcttcccactggggctagagccccttccctcagcagctcccccttctttacagagtgaagtctaggggtcccaagtctgaggggggaggccctgtaagagtgtttcctgcttcacatggcactacctgccacccctacccaacaggagagaccttgggtccaggtagccattcctaaccccacatccagtctcactgcatggtggtataggatagaggggtcgggtggggggatgttaacagagcccctagtgtgtcgctggaaccctgat

SEQ ID NO: 59585 - DNA, 659 bp, Bovine  19866881087893
caacactgtgaatgtcaaggagagccccacaggtgagcccaccagctagcacgatggagccagagaccggccccggagacccacaaggtccctgcccagatgcaccagaatagcaataggatgcctctcccctgccctcctcacctctcctggtcctctccagcaaagatggcactgccctcagggccttgtgtttgggaacacagggaacgtggagcaggctggcatcaccctcagaagcctcttctgtggcagtccacccgccgagcccgcctcagaggtgagtggtcggagcctctccatctggcactttctctccgtctctctctgacactgagaccgcctctccattagcctgcagtgcctgcctccatcctccctgcccttctgtcctcctagatgtcagcagtccctgcggtgtgcccttcctcccagccccaccactttccctcacctccctcctccctataacatcaagtcctcttctttctggtttggctctaacaaagttggagaagtcggggaaatgtgacaagcgcaagctgaagcgggtccgaatctccttggcggtaagtgctccctttcctcctctggctcctctggagcaggagacagggagggccaggctgtaggtggggcaagcttccctatgctggggg

SEQ ID NO: 59586 - DNA, 4727 bp, Bovine  19866881091014
cttgatgggcgtaaaccgggctgccctagacacactaacacatatggggaccctgtccatacacaactgctttctagaaggttatcctgagtgtgggatgcccggagttggggctatgccttctctggggtttaatctcccctgactaaggtgatattccatccaagctcttttgagccattgggagagggggcaggggccaggccagcctggttgtcatgggaaccagcatgcatttcctgccagggacctgcagagtgttagcccctcttcaggctgtcaggctcatcacccccaccccctttctccacttaggaggaggaagtctgggggcaggttcccatagtgaagtggagaggcgccgggcaaggcactgttcaccttcccatgacagcacagacatgaagtctcacagccaggttgggccaccagcccccccacaccgagggctgtgctaagagctggctcccaccctttgggcgcttcaggctgcaagccccaggagggcagacaaggcccttagcaccttgacacgcatggaacagcagctgaatgaggctgtggtcccagtgcccacatttcgcaccatgagacctggagagcagaacctctctgagcctccttattggctaaacagaggaggtaactggaatctaccatacaagattgtggtgaggctcagatgagagaacctctcgtgaatggggattatagctggaaagtctagtactctgtgaggtcttattgagtcttggcaagctaccagaggcaggcccctaccctccttgtatgcctgcatctgcatgtgcttagctgctcagtcgtatctgactctgcgactccatggactgtagccctccaggctcctctgtccatgggatttccccaacaagaatactggagtgagttggcatttccaagggatcttcccaacccagggatcgaacccacatcttctgcattggcaggtggatactttactactgtgccacctgggaaacctgctcttgtgtatgaatcaaggacaaaacaatccctgtccccttcatcccaggactcctgcaagtcacagcagacacttacatggtgctctgcttccccatgtgccaggcactgttccaagggcgcccatgcattgactcagttcagccccattacagctccatgaaggaatcaccactaatgcccccattttgcatataataaggaaaccagggttcagagttcagtgacctgcccaaggtctcacaggtggtaagtggcagagtcagaactcaggagttcagagactgggcctctgatctctgtactataaatgtagcgtcttaagatgcagacgagacccccaggttaaagggccaagcatgaggtgcctggagctccaaggcccacctgatatttccaggtgacacatacacttgggcctggacaagcgggcatctctgctggcctcacgaggctctgagcacgttctccaggtgcctctttgtcaaggattccccatggcttccttcctctctctttagtttcattatttctcttacgatcctggtgtctctcctcattttctctcatctcccttcttgtacaacatttttggcacctgatacccctcttccctttcctccctctgccccaaatctggcaggcaagaaagtggtggttagggggcagtgggcagtggtggcccaggcacgtcctccatcccttcccccaggccagtcctcactcacggcggcactgggactccttggcggctggctcgtggccggtggcacaggtacaggcgccaacaggcaccatccactccccgtcaccgttgcagtagagcttgaggggcacagacacctccacggcattggcaatgcaggtgccaggggcgatgaccagtgaggtgggctcagccccagtgagggtctcagggaagagtgcaaagcctgcggtggtggacgcacacttcttgtagaatgcgcgcacggagatgagcgacatgcaggcgccctggtcctggaaggccaagtagaagccagccttggagagcggcccaaagctgcgcaccttggtgttgacacggccagcatcgagccgggagaagctctcatccggtgcgatggtgtccaccttcacataggggttctccatccagaagggggaggaggctgaggccacgtcactgtcagcctcatagtagaagaggttgaaggtctccttgcaggagccagggatgttgggaatgctattgcagtcccgcacagtgaacttgagctccacgtagacccgctgcacatctcgccgccagatgaaccctgtgcgaagccagttgttctggctggactcccgcacgttacacacctggtacgtacggatggggttcatggcttcatcatagccgctcacctcttcccactgtgcaagtgagaaagacggacagtgagaccagcatttgccgggtgttgatcacaagcccagatctgacctgttatatttacttcacagagatgcttctgtggtgccgtggttgagcatatagactagtgggctccagtctcagttctctgctgtgtgactacaggtaagtcatttaacctccctggcctccctttccccatctggaacatggtaagaataaagatatttaaggaataaatgactttaactgaataaagcacttagaatggggcacctgataagtactttgtaattatcagatatattacttattatcattatgcctcagtttcattgtctataaaatgggactgattgaaagtaaatgaggctgtgaggaattaaataggtccaataaacactgattactactattaccatcacatttaaccttcacagttccttggaagatacatctgttgttcccactccagagaagaggaagccaagactcacaaaggcagggacttgcccaaggtcacagaatcaggtctggtgacttgagggtctgtaacgtcacccaaacccagtgttccagaacttagtacagttgtgaaggccatcgagggaggtcagttagaacactttagagatgtcaaggactataggaatgtaacattcaagaaacagaggcccagaaaggtaaactgtcttgctcaaagtcacagcaagtcagagatctggaaccaaagcttccttgttcccaagccagtgctcttcccaaggacccaggaaggagggagatgacagacatgcaaagggctgccaggtagaaagggatgggaacaggttgaagacaggctgaggggcgggcagagggagaatgggacaaagatggtgtgtatgtgggaggaaggacagaggcaggctgaagggtcagagaggaaagcattttcagagatggaccagcaggtaaggaggaaggtgacaggtgcagacgatgtggatgccacaggtggggaaactgacaagtagggcacagaggcggccttgctgaggcaagggggctaactggcaagcagcactcaggagaaatggagaggaggtcttaccccactttccggatgagaggtccatgccaactcagatgtcacccattttgtatccatgagggtctctgtggaagcaacaagagaaaaaaggccaggggccaagcttaggatacggagaaagaggaggctgcccaggaaagtccaggatgccagacatcagttcccaccaggtactcccaggttcccaaagctctcagctccccaggcccagaggagaccctgcagccactcccagagatgtcacagcctcaaagatgtcttgtcaggccagctgggagtgggtgttagttgctgaccccaggtctgggttaatgaggcaggatccagggccggttcacacacctacaggctctgctaatctccacacaaaggggctggcaggtcctttatcctggaacaaagggccgtgtgcttcagaccctgttgcccaggcctcccctgactccattcccaacacaaaggcgcagccccacacacgcccaggggaatgggagaacagtcacaggccagagcccacacccacccagcctcctacacaaccagctctggtggacaggacaggaatgctctttgagaatggggtaaggaccaccaaggcccagccagctcctctagagctagttcagttgttcctgaaatccttggataaaagtactgttggtgtatcccttttacagatgagaaaactgatgcctggatacagtatgtgaaaaaagtgaaagtattagtcgctcagttgtgcccgactctgccatcccacggactgtagcccacccagctcctctgtccatgggactctccaagcaagaatactggagtgggtagctattcccttttccaggtgttcttcccaacccagggatcgaattcaggtctcctgcatagcaggcagattctatatagtctaagccaccagggaagcccaagtacaatatatataggacctaagaaagctgagtgccgaagaattgatgctcttgaactgtggtgttggagaagactcttgagagtcccttggactacaaggagatccaaccagtccattctaaagatcagccctgggtgttctttgaaaggaatgatgctaaagctgaaactccagtactttggccacttcatgcgaagagttgactcattggaaaagactctgatgctgggagggattgggggcaggaggagaaggggacgacagaggatgagatggctggatggcatcaccaactcgat

SEQ ID NO: 59587 - DNA, 1687 bp, Bovine  19866881118587
gatccttcagagcagcctttatggcaggttggggataacaagaaaaataaccagagaaagaataacatgacttcatataatctcatttgcaagatatgacttgatcatgagggctcagggcccacttatcctagcgtggggctgcctctgtgtagtcaaaaccatcacagcagtcccagaaagcctgtccagctgccctcttgagagttcaggtgaatccaccaaaataatgaagccaagaaagagatgagttactcttctctctggtgtcagcctctaaattccagcttcctatcccacgagctgcctttttctgggatgattgaaatgattgttcctttttatggggagtagaactcagattcacgtaaggttttgatggtcattcattgaggctgcatacagcaaggaaaggggtgggcgcacatcagcttacctcaatgacttgactagttttgccagaggtacggtttatacccacaaagatgatgatttttctttagatatgtccagttgagagacagcattgtgaaatcctctggtgttgattcacaatggagccatagatgggcagactgagggttatttatagaccactgatgatgtgcttttcaaagaggtcccaatagttgttccaggagaaaagtacaaggatcaatccgtctgctgaggattcttctctacctggaagtctatgtgatgtagctcttgcctaatatggtgatttccttctgcatactcttcaagagagacttcattccttgtgcatgggggaatgaccttaccctaggcgcttcagttgtgtctgactcttagcaactccatggactgtagcctgccaggcccttctgtccatgggattctccaggcaagagtacttgagtgggttgcattgccctcctccaggggatctccccaacccagggatcgaacccgaatctcttatgtctacttgcattggcaggtgggttctttgccactagcaccacctaggaagcccgaaacaagaatgtagacagacagaacaaatcactggagtctgagtgtgaaatgctgatagattttcctaatgctttctgtctggtctgtgttcctggaggttgaatggccatcatcctgcattccttctgggttcggtaaccccataaactctggcccactgatcctcaatggagacagtgctgccccctagaggcattttagaaatacctagtgtatttatattaccctggttggtggggcactacttaaaggagacagagagggccaaacttcttgccttacatgaggcagttttatccaatgatttgtcctgcacttcatgtgacatttgacatttgaatgtcccacccgacagtcatacaggtagaaaatctctttatattggtctgagcctagaacctaattccattttgaatataaacacaaagtactttttgcatagttttaatatacactgaatttttcatgaatgctactatcatataaatcaagagaatactgtattttatctttcccaggagttgttcaccatttcagaaccacaatatgaacagcaaaatcctcactgtatttgagtgccaaaataacacacctctgttcagctgcattcatatgtatctgtatgaatatgtagtatttgtttaatcttgttttagcacatcaaatctaaagaagtacccataat

SEQ ID NO: 59588 - DNA, 1233 bp, Bovine  19866881126413
tatgagtctgtgtctgctcctccaactccaaaaccctatatttcttctaaatatgtccagtaatgtgcataagaaaagttattttgactagactattaacttcaagataacaaggagcacacatcttttgcacactatcgtccactgcctagaacatattagaccagaggctgcacactttgacccgtgggccaagtcctgtccacagcctgtttttgaatggctcccagctacgaatggtttttacatttctaaagcgttgtttaaaaacaagtaaaaaaaaaaaaaaatcacatggatgaacgtgtgacagggaccatatgtaccccacaaagcttaaattttaccatctggccctttttagaaaatgtttgctgactgctataccagaccctcaaatatttgttgagagaggagacagggggaggggagcaagacctcagagtgaaaaagaagaaacagattcccaacaaatatactttgagatgattgcaaatggtaaatactctcataataaacactgtgcagatctttaaatcattccttgacttctattttcagagtttcaagagaaactgaaggttttttattagtatatttaagagatcataattttttggcaatgtacctattcttgaatcacaggtgctcctaagagaactaaatttaaaccttggtagtccacttgtccaacaagtcaacagaagtgttagtcatcagcaaggtgtatggcgtcaattcacaggtatgcaccctcatacacacatctgttccttccatgaagcaccaagtacctaagcactgacaccccacaacattttactcatctgttcccatgtgtctgtacacctgttacttcaaattttaataactgagatgttccacaaaccctgtaataaatctctgaatactgaaaaatgtttaagcaaaagatgaaagttccattctcaaataatatcaaagaccagtactagacctgttcatagtaatgtctattagaagcacttgtgtacctgaaaatgttgctccatcacttggatttttccctggtctgggcacttttttagagctcggtctgcataatgcaataggatttctaccatctggaaggaaaacagtaattaaaatatgtctctaaagctttgtaatacttaatatatgtcatcttaatatatatgatcttaaataatacagaatcaggcttggctattttatgaaaaaatacaatttaaa

SEQ ID NO: 59589 - DNA, 1617 bp, Bovine  19866881162482
agccatccaggaattcaggtcatcagctgcccatttgccatgcatggcaccttgcaataaatagtgtgcttgccttcaccaccaaccccaatgtcagtaggttggcttcgctttgtgttggtaaagcccacccaagttcagttttgtaacaccctgagcaatcccgaacagcaattcctgtagtctttttgaagcagtggaagtggtagatatttgtggatcatcttaatataattttcaaaattcaccattccatcccttagctgccctttaaagggatacaccaagttttgtcccaatttatcttatcaactagagaaatatctttatctatgaaaaatttgttatggaaaaataacctccagagtggattttgaacataagaggagggcaaaaggcctatgattaatgtgccaagccatcacccccctgtgggcatctgtacacaccctcaatgttcaagcccaataaccaccggacttttcctgagtaatatgatgtgacactaatggaagtaggatctaggtcaattttgtgctccacacagtataacctttctttacactccagtggtccacactcacttctggaagcagcagacccatcataatttcgaaacaagaacattctggcttcttttaatggtaggataacacacacagtttgccatttccattcaaaaaaaaaaccttttttcttgatgattagcaattaaaataattcagctttaattagctcatttcagtaagcagctaaaggctaaaatgacagtgaagagcaatctggaatacaatgactgtctcatggattataaatgagacagccaaggtgccacatgcaacccttgaagatgccgggctgcggtcagcactccgtccacacccagggccccaagcattgaggcagcgtcaagcatccagtgccgggcttgtttattcactccacaaacagcggctgagcatcttgtgcgtgccaggctctgggttagatgctggagaaaatttagaagggaaacataaaccaaccataagaatacaaaagataattgctttatctaagggggttaaacaaagcacagtaaaagaatgaggaggaaacaaaaatctgcctggagcaaaaaatatttcatggaaaggatgagttagccctggcaatgcagtcagcctgggctggggtatgatggaatagagcacagcatgcatgcaggcaagaaaggcaaagggcaactctgtaagtctgtcttgcttgaaagtcatgctggcctgataggccagtcagatgaggcgtggaataggcaggagggacagatcatgaacagccctacaaagtttagacagagtcccctaaaccagtggtttttaaatacttttcagctggaagcactttgttcaataaaaatacaccataaaacatgaatgaaacaaattcatgaagtccacctgctgccactgaagctgatacatattggttgggaatactagaacctcatttctttgcaagcccataagagcagagccaaactacagcttcaggagagtgcaggttgtggtaagaagcttctaacatggcccccagggatcaccacctcctggtattcacactcggaatattccctcc

SEQ ID NO: 59590 - DNA, 3336 bp, Bovine  19866881190234
tgccagtgttcagcaggctgaaggccaataaaaataatatgtggcatcacaccaaatgtcaagacttttttcagtacaagcaggacttcactttctgtccacattttatatgatcctaaaggtcatggtactcttgcctggaaaatcccatggacagaggagcctggtaggctgcagtccatggggtcgctaagagttggacatgactgagtgacttcactttcacttttcactttcatgcactggaggaggaaatggcaacccactccagtgttcttgcctggagaatcccagggacagtggggcctggtgggctgccatctatggggttgtacagagtcggacacgactgaagcgacttagcagcagcagcagcagcaaagatcatggtttatggcaaaaatcctgggagccttaacataacatggactcaaaacaattacataaagtaaatgggggtatttcgtttcaataatactcacagtaaagttgatgaggtcatagtataggtgaagatgcttttgcttagtaacatgtatcgctccagattcgtctctcttaacctgatgatgaaataaaaacaacctgaatatcagctactgtttgagacactttaaaagtttctcacctagtcaatccacctagaacatgatttccattcagaatatgggtaaaacaaatactgataactaaagtaactattaaacaaatgaaataaatcactcacaagtgtatgtagtatatctggtataatccatggtatacctggtcagtggtcaagctgtctgtttaggcataccattgttttaaatgcacttcactttattgtgcttccagatattgtgtgttttacaaactgtggcagccttgcatcaatctattgacaccatttttccaacaacatttgctcacttgcttcctgtctctgtgtcacattttggtaatttttgcagtagttcaaactttttcagtattatttgttatagtaatccatgattagtgatctttgatgttactattgtaattgttttggctttttctaagcaatgaagtattttttaattaaggtatgtacactgctttttttcagagataataacacacttaaaagactacaatatagtgcaaacataacttttctatgccctgggaaaccaatcaacttatgtaactcactgcactgcagtatttgctttattgcagtggtctgaaacagaaaccaataatatccccagggtatgcatgtactggcaaatgtaatattcactctgttatactcagaacaaactaacttcatcacatcaataactgtatttagccagagttaaagcataaaataggattagtggcatggtgtaaaaaaaagtaaaacaaaagtacattaaaaggaaaataaggtgctgcagttaccaaaactaggcttttctgaaatatgataccgttgctgctgctaagtcgcttcagtcgtgtgcgactctgtgcgaccccatagacggcagcccagcaggctcccccgtccctgggattctccaggcaagaacactggagtgggctgccatttccttctccaatgcatgaactagtatagctcaaacagcccgaaatttcccagaacttcaagtgttactattttatttatatatgcatatgtatacactctataatcttcatctgtccttatcatttgttctatttctgctccaaggcgacagagcactgaagaagacagacacaatatagtgacctgcctgaaatagaacaggacatcatcaattccagtgtaataccaataccaaagagagatcaaagcagactgaaggcaaggccaccagatacgtaagaagtgatgtcctaaagcctctcctcctccgtcttttgtgtgatgccatactgttctatttccccacctacctccacatgcctttacaggatcctcctttctattgcctttgttgtccttttccttacacgagtgtccactaacattatggatgctcttgcttttgatttacacagcttcaactaccttctcgatcctggaattttcatttgcaccccagacctggattgccagtctgcccaaagaacattccctaatataccactcaagtctcaccttcactttcaacccaacactatccttcccgaaccctaactctttgaatacgtcatgctcctaaaatacaaagccagaaatgcaatgttttatgtccttcagtccccatgaaaaaccttgtctttccttcaaaatgccatccctaactctcactgcacccatccttgtctaaagacctcagttgctttattacaagagcaaaacccttcatttccggccaacctcctataatctgttctttttgctatatctacagtgctattcctaaaatgtcactttaatcgtatcactttaattacctaagaacctgtgatggtttccccttaccaatctagggcaattattatacaatctagatcagaggttagcaaactttttctgtaaaaggccatacagtaaatattttgggatctgcagagcatacaatctctgtcataactactcaactctgccactgttgagttttgcactattgtgcaaaagcagccataaataagacataaccaaatgggcatgaaataaaacttcacaaaatcaagtagccagccaggtctggcccacaggccacagtttgccaatttctaatctagatccatccatatattcaactttattttcaacaataagcttctccctgttattaattgtaacacttgttactggccttctatatatttaagtactatcctagtacttggaatacagcagtagggttggttttagacttatggagctttcagtctagtgatgaagaaaaatgttaaataaggaattttagaagtgctgaatgttataaaagaaggtattatggatgtttgtagtgggaaatgctaactgagatcagtaggtcagggaaggcaatgctaatcatgagctaggatactgttgaagagagcacagagctttcctggcagagacgttggcatatgcaaagacaccaaggccaaaaacatggaagcatcctaaatgtccatcaatagatgaatggataaagatgtggtacataaatacaatgcagtgttactcagacacaaggagaatgaaacaatgcctttgcagcaccgtggatggacctggagactgtcatactaagcaaatcagacagagaaagacaaatacatgatatcgctcatatgtggaatctaaaaaaatggtacaagtgaacttatttacaaaaccgaaacaggctcacagacaggaaacagacttaggttaccacg

SEQ ID NO: 59591 - DNA, 1064 bp, Bovine  19866881205041
aaatacccccatgaggaggcatggagctgagggttttccatgttaatcactaaagcctcaaaaattaaataggtcactctctttccaaagaattacaatagtatatttctttgaaacaatattaaattactggtgaatcagaatgataacctatgacaaaggacatcagcacagatgtagcatcatattaggacttaccaggagaaaatgaacaacatctcctctgcagaaggctagcatgggattcacgtaattatgcactgccacgaagtgccaggccagcaatggaacgctggaaggatccatctgggtaagaaggaaaaaaaaaaaatcattgttaacacaagaagaataaagagaaaactctggtttaatacagcaatggactggtgttccttgataaaaactcctcctaatttctcattaaaattccagaggagtagagactgattaggaaccgtcaagagggaaccttctttgtggacagaaatgttccacatcttgacagaagtttgggttacctaagtatctatatttggcaaagtttagcaaatgtacactcaagatctgtgtgttttgttgtatataaatttttctaccaaaggaaagactttgactactgaactgtacttaatcatatacatgttgaatatttagggggaaaaaaaagagtactaatttctgcaatttacttggaagcacattaaaaaaaaaacaatttgatgagtgaatgacaataaacaggtatataatgaagtatacaataaaatactaatggtacagttttacaatggtaggtatatagatgtttaatgtaaaatcctttcaacttctctatttatttgaaaatgttcataataaaatattggggggaaaatcgacaaaaacaaagatgcaaacacataccatgataagtctcaattagccagtgaaggtcacctaagtacaattaacggtaacctgagcaggctctaccatctgaaagggcagggctgcttcccctggggcccagagatacagtgaataagaaagctgaagactgagctccctctttacagggccta

SEQ ID NO: 59592 - DNA, 840 bp, Bovine  19866881268217
tgataaaaagtaaattcagaataatgattcccaccactgttatcttactgcctatgaggctaagtgattaataaatcaaaattttattagatattcttttagcagaattaaacttctgacaaatatctaggtggttaaagaaaacattactaccatgatttgtttctcagtaaattttaaaatctgttttagaaaccatcatctacagtccctgtcatgctgattccttaatatttctctgtcagaatatcacttttcattccttttttcttttatagctctctaccaggttcttccccaacaaagtggtttccaccttatgtgtatattcacacgcatgccatgtgtacacacgcacacacacacacatcctcctcattaacccctctaagcatgccctattggatgttccttttcaccaaagtacaccttccaacaaccagagttcttacatgaataccatcctaccacttcttgataacagatattctcttgttaaaatgctgagtttgcttttctctatatactgtagtgatatacaaaatcatttatataccaggtactattcctaaatagttctgtccccaaatgctttctctctgccatatgttttcctcctagcttatctatttctataaccttatataagctcctttctcttcttcactacaaattcaatgagccacaaggtaataaatgttactttgctagaagcccactactatggcattcaatagtacagttcaggaaaccaaatcctgctctgataccctccaactgttcactgccgtatctactcttgtcttccagagttaagagcatcaaatgcaaacataaaaa

SEQ ID NO: 59593 - DNA, 1239 bp, Bovine  19866881305144
ggggcaggaaatcagggggagctgtggatgcaagcctgtcttacatctccagaccctcagaacccagaaaggccaccagccaaagtttcccccccttccacggacactcaaaagggaattcttgaaggacctcagtatttgggccactcagggaggtatggagtgccaatcaagactaaagtcacaggaagggacttttcccagcctgtgtcccattcccctgtgtccctagaaatgttgagctcataacaccctctctagccctcaatccccactccttagccccaatattctgggagtgtggaaggggaagtttttaggaagatctgggttcaaaaccagctctggcaagttctagatgggagacctcgagcacccttagcttccccatctccagaagggaggtgataatctccactataagtgttgctgaagatcgtgtgtacagacctattccagtgtgcgacaccaaggaggcactccgtgaagggcaatttccagactctcattcttgctctgccaccaacgagccatgtgatcttggggaggacacaccacctctcgtgctcagctgcatctgtcaaacgggagggttggatcagatcatctggaaggccccttccagctctaacttgcttggttctattctgagcagggagccccacctctggggcaggggcaacaggaacattctttcagctcagattcaacccaggcacatgcctgcccagccccatcccgcacatttagcctggagctgttgccacgttggccgcgcccttggcaccaggctgttccccgaccccgccctccttgccaaggccacaggtgggtggctccattgctggcggatggtaggagcccaggaggacagaggaagaggacgggagagaagagggaagggtaacctggctggaggaatgtagtgagggctagggcagggccttgaaccctgtggagttcattccagcgccgccactttctagtcgtgtgggtccttgggcaattggctgtaacttctcagaagcctgtttcctcatttatgaaccaataataataacaatttctacaaccccattggattgctgtgagattaaataagaatacatgtcaagtgactggtattctggagttttgttctcgggggtgggggtgtggaaggctcacacatcctttcctcagcccctggggagggggaagtttcttgaaggcatatgcgggcgctggggcgactttcca

SEQ ID NO: 59594 - DNA, 694 bp, Bovine  19866881402918
ggtgagactgtatgctatgctctgtccgcctccaatgtggggaatcagtgaatgctgtgatcatcatcattgcctccctaaattattattgttgttattataataactggtgggtagagttgagtgggtggtagatacaagataattactaagaccccagaattaaagtgttgagtctctacttttccacggccgctcagagatgaaaatgaaagctgtcctccagggaactctgagaagagccctaatcttgagatagcgtgaatccgagaggggaagacaacggagaaaggccaggagagacttggaagccagccttggagatgctgggattcttgactgtggatggcacaggaggctgcgaaggcacaatccagcagcttcaaatcctggttctgccactcctttgctgtgtgaccatggaaaagttacctaacctctctgaagttcagtttcctcagctgtgaaatggggataataatcatccctagccctaagtctgttgtaagtaaagattagaggaaagactgtgagagctagaaaacaaaaacctgagcctagagcttgccagtgaggagggccagaaactgtggggctgtgtgactctcccgacctcaggacgacactggcacttttctcaggactatccaggttcagcagagaataactttggccttagtttcccccctattta

SEQ ID NO: 59595 - DNA, 847 bp, Bovine  19866881471302
gttggcagcctcgtggccacgctgcacaactctgcgcctttcctcctcagtttattccttccagatactcagttgctgctttttctttggatcacttttctgtgttatggtatttcagttgtttttccactccctttcccccaccctcctaccttccccccatggcaggattcctgagaagacttgcttttggagaaagctgcacgcacatctgctctctagctgcagggagggccctgtcaggggctcgggtctcagggagccacgccacactgggcagtggaggccggggggcagggtccatggggcatggcagcagaggcccgtggtgggcatgcttcctacagcaggcagagctgagcctcagggcctgggggtgctgccaaagacctggggctgcagctcaccagctccctggctctgctggctgtggctgctggctcgctcggctcagatctgcgtatgccagacttgaggtgagagagaaaccaggagccttggaaaatgccctggctctccatcttttttcgttggaacttttttgtcagtggttctgaggggttaggggtcttgtgtgtggtcgatgtgggtgcagttgtgtgtgctagagagtatatgctggttgcatgcaggcttggaagtcacagagcctaggtttgattcctgacttcccatcaaaggcagtgtgaacttgggcaagtcaccatgaagtgggtgtgataccatgcctccttttcagccttgttataagggtgaactgagttaatacatgagaatacttcccggcacatcgtaagtgctcaataaatattttagctatcattattatatatgcatgaggatatgt

SEQ ID NO: 59596 - DNA, 1279 bp, Bovine  19866881565080
aagatactaaaaccatatataaaagtgaaaatccaaatgatttcattttagggtaatcatagtaataatatttgaatgatcttgggcccttttattcctcatcttattcatcctcagtagtattcaacacagttaacaactcccagaaacagtctgtccctttggcttttctggtttctgagttctctgttaacagtgttctccaactctaaagctgccaagtgaactgtggaagcattttcatgtatttttggttattttatcttgctacatttatctttgtttgttcatgttacagagtagaggttaaataaataaacccaaagcatttaaaaaatatgaatcaaccttaaaaagatttgaaaagttatataatttaaaaatatctttaaagtgaaaccttacgttaatcattaccaggctcccttcccagtttcattttacatttccatgtcaataagaacattcagagcctttgttattgcagccgttggcatttatttttgtattaagagttcatgccaaagagtggacagggactaaaagctaaatgtaggatgaagcagtagagctttccttgtctaattcatgcttccctgaaatgattcgaagaaggaaaaacagtactggtgtccagcacactgctttgtttctgaggcttgtttaaaaatgttggttctagggagtcagatttttttccttatgaggttattttgttataattatatctgaaaagaaaaaagaaggaaaaatacatatacacacttacgcatacagagagctatttatatatagctgttcacggtgtttgtgtactaatactggaataccagctgtttaattctgagcgcctgcagagatggattcatctgttgatctttctatctgagatgtgtgtgtgtgtttaggtatgtgtatctgctttggtgtacatatatattctagactttaattaagattttgaattattatcaaactgcattttttattgcctgattgatttttagaatataaattacgagaattacattgctctagttatattgcaaaggaatctgcatctactatctcatttcttttcacatcatccccatgaaatagggaaagccagagattatatcttcagttggcagatggtaagacagtcacaatgcaataaaatgatctattcagtcactcagacgattgacatgcttaaatttaggtcttctgtgagctcagcatgtaagtcacatattcatattggcttttaaaattaatcttaaatatacacagatat

SEQ ID NO: 59597 - DNA, 595 bp, Bovine  19866881865450
tatcttgtctccgtaaaggtaatgcttactgtattaggttatcatgagattaaattgccagttgaaatgaaaattgtatgtaaacacttaatacagtacctaataggaataaatgacagatctattaatttatctcataaactaattttctcataaataaatttccaacctcattctgtggttgggaatattaattgaaataatggtaacttcgacttcttagtttatgatgactgaggaaatacaaaataatgcttgacacaggagaaaacttgagataattgtattcatttatcttgcttgatgtcaagctgacaagaaatgggaggagggtagttgtgaggtagttctctgtccccttctgcattacataggtccgtttagacagttaagaatagctggaggctctgctctggctcctttgaacctcccctcttctgagacacagaagattgcagttccaaggtctagacttacttaacttcagcttccttaattttcccaaggtgcatggtaaaggtatctgttgtggttatggtttttgctttttattgtctcttccttgtcaggtgttccatcttttcttttcctgatt

SEQ ID NO: 59598 - DNA, 835 bp, Bovine  19866881867964
taaaacaaaaacaataaaagcatggctgcatggaagctcaaagacactgagctgtttcttcctaattctgaaagaaaattattttatatctagacctctctaggcagtcaaactgttaataaacatgaacaaaattactcgcagacatgccaagtttcaaaaagtgtgtctctgatgtgcccattcttataaagctactaacggatagaatgaggaataaaccaagaaagaagatatgggatccaagaaaggaagagaatctaatacatgagaaagactaaagaattttccaaaaagatgatcaaggaagctctgggatgacagttgtgcggcaacccaggggagccactgatccagcctggggcaggaaaacctcaggctccaggagtgaagttttcaagaagatagtagaacatatgtatagataatccaatttatttgagtattagaaagagttctagcctataagagagtttggagaaggattggtgataagtgcatagaaaactaatcgcaggggagaaaagaagcaattattaactttagtggggaaacgctattaaaaaaaaaaagaaatgtagtcatacatagtttattattgtcagtcaactgtgagcagtatttacatagtcatagtcatgtaaatgctgaatgttaatttaacaaaaaaccgtgcttcaataatattgaaagaatgtgtgtgtggagggggggtgggtagggaaagagcctgtaagaaagatgcatccttgaatttccccagaggtagaacctgggactaggacaggtagtttatttggatctgaaggacactcagagagaagcaggaaagcaa

SEQ ID NO: 59599 - DNA, 944 bp, Bovine  19866881973831
cagtgttgcttataataggcaaaaatgtatcctttgtccctggtccaccctagtgccccatccctgttcttccagattcttgaaataaggctgagcatctggagagggtgaaaaagaaacatgatttgtcttttattacctacaaagatgtaagtggcagtgtttataataggcaaaaatgacagcagcttaaatgtccaatatagaggacaggaagaacaaattgtgactagggtggattataaggcagcattaaattgatgattgttaagtgaaaaaaaaggttttttatatatatatatatatgttgcacaacataattctatattatatatgaatatcccatcagggaaagacattagaaataggtaatcaaaatgttagagttatctctgagtgataggattgttttgtttttttttttggccgtgccgtgtcacgcaggacgaccagggatcaaaaccttgccctctgcattgggagtccagagtcttaaccacttaggctgccagagaagtccctgagggatagggtttttaaatgatctattttcttcgactcctttcagttttccagttttctgctattaatgcctgccttttataatcagataaaaatcaaagcactatattaaattataatgttaattcagttaacttattagtttttttgattcatttggaaaaaaaccatgacagtcccagtgctttcacgaatcacgtgtctttctcatcctctccggatgctcaaccttatttcaagagtctggaaggacaggaatggggcaccagggtggacagggacaaggatgcattaatgtgtgtgggaggctgacttgtgcaccctccctcccaggcagaggggatgatcagcgagatccgagccgcctttgaggaggctctgggacactggtttggaggacgagaagacccgccaggcagcca

SEQ ID NO: 59600 - DNA, 1336 bp, Bovine  19866880368041
ttgaacattcagcatccttcggctggtatgttaattatgcattctgctgctgctgctgctaagtcacttcagtcgtgtccgactctgtgcgaccccatagacggcagcccaccaggctcctccgtccctgggattctccaggcaagaacactagagtgggttgccatttccttctccagtgcatgaaagtgaaaagggaaagtgaagtcgctcagtcatgtccgactcttcgagacctcatggactgtagcctaccaggctcctctatccatgggattttccaggcaagagtactggagtggcgtgccattgccttctccgtaattatgcattactcatagtgaaaggttcaaatttgttatgctgcaactgttcagtccttgacagatgactctgataggtcacacccatttttaagtaaataaagaacagcaagagcagaatttcttctttaaaaaaaatgtgtagtactgggagtttctttggcaagttaccatttgcccttttactttaagtctagaaaactcatgtgctttccagcagagttaataatatttttaggacagggtcctcttggagcttccttagtggcttccacatctattacccctttggcttactctactctctgcatttaacaaacattatggtagcttctactttatccttttaaaatatactgggactacttttagggttggaaactcttatgtgttctcatttattttcttaacaattttttattgagcgtttttacgtactaggcaatgtccctggtgctagctgtgcaaagaggaacgtattcacttggagcacgcgtgaagaattactaagttggttctgctgagatgctgaatacctggagggaacagaggaagatgagattggaaaagtggtctgaatgctagactaaagtttttgcattctatcccttggtggcattttgtgcagtggaagtatatagtcagagatgtccgtaaggaagattaagggcaatatgtttattatgttggagagggggagctaggatttcatttagaattttataattgtctgggtagatggaattgaagacctaaattgaggccaaataagtggaatcagaagaaataattggtgtaagatatattgcagaatgggcaagaaagacagcgagtagtcaaagtttgtaaggttagaacctgaaggaaagtataacacttaagagaaatgaaacccaaggggtacatctgagggcaagataagttatgttttgaaaattttgtatttgagaaatctgaaagttctctgtgtagacatataagactcttcggagtgcaggcttgtatcttgtatg

SEQ ID NO: 59601 - DNA, 2148 bp, Bovine  19866880424784
tatgtctcctgcattggcaaacagttcctttaccattagtgccacctgaatgtaatgtaaataatttgtttttatagggtttgttttaaggatagggcttgtacataaataggtgttcaaataaatgtttcctgagactgaagcatcttcagcatctgaaagcacctgggatttcaacattaaaaaattctgatttcttgagcccttgctttaaaaagatgacattaagtttagatttccatttttattttttgaaaaccatggaaaatgaataaaattagttcaaattttctatttaataagactgatacacacggtacttgaatttcaaatcagtacagttcaaatcaatgtgagttttctatgagtgtgtgacagtatgtgtatttttagttacaatgtataagatgagatgagctaaaggtattcagtggcatagtccagagcccccactgaacaacaaatggatttcatttgccgtgtctgttagatcaattatcccaatctccttccttccatgactattcacgctttaaaaaccttaaagcttctcttttaagtacagctgggactcattagcttctttctgccaatctaactatcattctgtcacttttccttctttctctttatgtcctcaatcaaataagtgtcattttcctgctttcattttggctggaaattcaactgaatctgctttccaaccaatctggtgtataaaattccaatcttccctattacttttggctcacaaatcaaaacaatgaagccaacttctagtggtgctctgactctgctgtttatttgggttctgcattcagagttggaacaggtgccattttttcctggggcctaaacatcaaaatatttgtgaaatgggctttgcactctgctgatctgtatcaagtcggttacagtgaagcatatttccaatgaaaagatttcctggagctgtgagaacacaagtcttattaaggttctgattgttgcactacgccattgcttttgtctttggacattaatgccaaataacgcattcattaatataaaacaaatatgtaaattacagtctgtggctagtggcttttttcaagaattctgaattcctttattttttattgctgagtgatattagacatctttagtgaattcgatatatcggacagttttcatgctagttaggactggaaatctgcgagaagaaatttgtttacaggcagtggaaaagaatcatgtaaataacatgccactgaaattggaaagtgaattttaatcaaatttctagaaaatggatatgctcaatgaagtctttgttaggaatttttttaacaagtatggttttcttcaatttcatgaaatggaaggaaaatggaaactttgtgctttagacaaaagtttgtaagagggaacaaaaaccctataggaatgtctataacatcttaagtagatttaaataatccttgaaattgaaccagaagtccattttataaaactcatctttctctctcaagagtcccattcaagacaacatgtgtgcaaatcctaggcaatatatggctgcaaagtgaggcaagagacacatcaggagttgagccaagttcttcctgagttatgccccataactcctctatattttctatcactaattccacctacggtagcacaaagtaaagccttttgcccacagcttattcaatggatgaagaacaagtttgagaacattcaagaaaaacaaatattcattgtttcagggactgctcttgaaatgtatcatcataacgtttttagcattttaagaaaagggtcagtataattacacttgtaacagtgattaaaatgatgagattttgtcttgtcttctactttctgagactagcttcccctcttttctctctccctccaagcttccctctccctttcttttgagacatacttaatgtgcattagcttagggccagacaccccattgacaacatggatatataggctcttatggtctagtagaaaaagaccaccactgataaacttatcaacaattttggatagatagaggtggaaggttgatggattcctgatttctagaactagagaaacaatttagtaaagactgttcatcttgccctccattcatatactaatatatcctta

SEQ ID NO: 59602 - DNA, 1679 bp, Bovine  19866880686277
tgccctgagctgacctttccttctcctcctctggcttctcattcagcccagacataaaccagacatttcttaacagtttcctacttcctgctcttaccactgccctaagaaaataagtagcgtataattttaactgaatgaaagttactttattattatattattgatcatattcagtgaatatgtcttccatttttatgatcaaaaatgttaaatatggtattttttggcaaatcttccttctccagatatctgtggtgaaagcaagacgacttcttaacatttcaagtaaatttaacagcctcagtgagagttctatgcaagaaagaaaggccagaaaacaatgggtgtaacttgctccacacatactgggaataagctagtatctatttctgtttccaaaagcaggtgaagttaagcacataataatactgaatggtaaagactttattttgattataccaaacagctgataggagattaaatgagagatcctgatttgatggatgacccagtgaactccttcagagataaaatctcatcctaatcaataagaatattttactcaataaaaataaaggcagcattaaaatgtaggaaaaatcagagacaactaactgataagctctttctttccagatatgtagcggtatattttcatatctggaaagaaagagcttatcagttaatcttttctgtgttattttacatttaatgctgcctttacttttaatgagtaaaagactcttatttatttgaatgagattttaaaattttgagtttcccaggtggtgacagtggtaaagaaccagcctgccaatgaaggagacataagagactcaggttcagattccctggaggagggtatggcaacccactccagtactgttgcctgggaaatcccaaggacagaagagcctggtgggctatagtccatagggtcgcgaagagtcgaacatgactgaaatgaatgagcgtgcagcaataaattttaatgtctttggggaaaacaataattcatttacaaatccaaaaaatacaacagaaaaggtcatcagtaatgacattaataaatttcctttgctttctttcaacaatgtttggttagtaaaacacaatcattatctttgcattaaatatgagcatttctatataattatctgtctcactaaaaagattatatgatgttgctatgtgggaaatagatggggaaacagtggaaacaatgtcagactttattttttggggctccaaaatcactgcagatggtgattgcagccatgaaattaaaaggcacttactccttggaaggaaagttatgactaacctagatagcatattgaaaagcagagacattactttgctaacaaaggtccgtctagtcaaggctatggtttttcctgtggtcatgtatggatgtgagagttggactgtgaagaaggctgaacgccaaagaattgatgcttttgaactgtggtgttggagaagactcttgagagtcccttggactgcaaggagatccaaccagtccagatcagccctgggatttttttggaaggaatgatgctaaagctgaaactccagtactttggccacctcatgcgaagagttgactcattggaaaagactctgatgctgggagggattgggggcaggaggagaaggggacgacagaagat

SEQ ID NO: 59603 - DNA, 2697 bp, Bovine  19866880774522
tagacagtaagtacaaatagctgtaggttggcgagaatagagaaggggaaaaatggagtgggtgctcactcgaatctctgagtgctcctggaacagcgtttgcagccgccttgtcctttgtggtgggtgtcctgagcattctcagcagcgctcgctcaccactgaatgacaggaccaggaatttccttaaatttgtaccttaaaacagccatccacaacaactttttgtacaagggactggtttcatggaagacagttctgtggatgggggaggggcaagggggatagtttggggatgattcaagagcattacatttattgtgcactttatttctattattgttacattgtgatatataatgaaataattatacagctcaccataatacagaatcagtgggagcccggaacttgttttcctgagctcaggtggtaatgtgagggatggggagcgactgtaaatacaaatgaagctttgcttgcttaccactcaccttctgctgtgcggcccagttcctaacaggccacagacggggagaggtctgtggcccgggggctggggacccctgccttaagggagacaatgtggtgtggcctgaagggcaagaaacacagaagatgtgagtagatggtgatcttggacacttccggtgatccatggctactactttcttctaccctgagtgatgaggagttaatgcagaactttaaaagaaaagctcttcccagcgattatttgttctttgactctatagcacacactcagtctctctgaatcttctcatgttattcaaggtgtatctacatcagaaataaaattatttgaatttttaaatactctatttatacatttggcttccttggtagcttagctggtaaagaatatgcctgccatgcaggagaccctgattcgattcctaggtcgggaagatcccctggagaagggataggctccccactctggtattcttgggcttccctggtggctcagctggtaaagaatccacctgcaatgcgggagacctgggtttgggaagatccctggagaagggaacagctacccactccagtattctggcctggagaattccatggtctgtgtagtccatggggttgcaaagagttggatgtgactgagtgactttcactttcacatgcatatattttaatgtttctataatgtatgcatatgtatatattttgtgtttcagagtctgcacagaaataaatataaactaaacacaatattttatttctatgtccaaggaaaaaagtaggcatttttttaacctaaacggtaaaattttcaaaaacgtttcctaccaaatgctctaaacaattagctgtattttcacacaagatatagatttcatgtaacttggacatgtacataaataggtttataaagtatgttgaacatttatgctgatactttttagatttgtattttaaaaacaaaaggatgggaagagttgatcacatggaattcaaagttaaaggaatttaaagaaaaaatgttgttatacatcgatccctttctctactcaaaggtacgctgtgtacccatgagacacagacaatgagagaaagaacaaagagtttggatttattttaaagtatgtctttgttttgagaagtcattagtagtcatactggtgacctggttttgggtaaagcccatccgtttctgatacttgttactgtgactttagagatgtcagcattattctctgtataggggatggtattgctctctgttcattttaggtgaagttgcatgatgaaaggggagggataactgactttaatctcctctgttttcctctccccaccccagacatttccatgtttctcttgtcaacagtaaaaagtgttatcttgctatatgacaattcgttagttttcttctcgtgatggaaataggtgaaaaattttatattagctcaaggggaactgtaatacatattacccacttctgaactgttatgttgaggtctaaacattaaaatgtctggtcatctttgaggatgaaaggtgggtgaaatctgtaaataacagactttgtggaaaatacctcttggagatctcatgaaggtaagaaacccagaaaaaaatgtttccttgggaatttcatggaggtgggggcaagtgtttttagtaacagcctcattttctttaatatcactttttgtctaaattgtttcattgggacttatggtaagtactgtatctatcattaggttttacattaagttaagaaaccttttactggagcacttattacattctgaaagaatattgagaattatacatgcatggaattatacatgcaacatgaaatattgctccatttggatgagacctttaatttctattctttaatatattttgtccattgttgataagacatagagacaaatgcttttatttgtattcttcctatgtagcaattttatttatttattttctatggcttctgaaatagctgaatgcttcttcaaggtattcatgtgttatgaataatactataaagtagctgtgatgaaaaagcatgtcagtctttatggccagcctctcataaaatatatagtttcagaatttcgtagatctcccttttggggagggcaaattttaaggtaaagaaaacacccttgcactcacaaaataaatataaatgtcaatgtttgttttaagtag

SEQ ID NO: 59604 - DNA, 3576 bp, Bovine  19866881089253
tgtattgcctttgttcctctttcaggatcagttgcctctatttgtgtgaatctagttctaggatgtctcttctgtttcatttgtctatttgtatgtatatattgccaataccacactgtcttgattactgaagctttgtaataagtcttgaagttggtagtgtcagtcctccaactttgttcttcttcaacattgtgttggctattctgagtctattgcctttccatttaaattttaaaaccagtctgtcagtatccacaaaagaacttgctgcaatcttgattggtattgcattgagtctatggatcaagttaggaagaactgacattctaacaatattgagtcttcttatccatgattgtggtatatctcttcattaattttgtcctttgatttctttcatttgagttttatagtttttctcacatgaatctttacatattttattagatttatacctattttattttttattttggtaaattaaatggtatttgtttcaaattccaatttttattgttggtacacgggaaagcaattgtatctgtttattaactttgtatcctgcagtcttgctataattgcttattagttctaggaggtttctttttctttttccagttctttgggattttctacattaagaacttgctgtctatggaaaaaatagttttatttatttcttctcaatctgtatacttttaatatccttttcttgtcttgttgcattagctggaactttcagtatgatgtttaatgggagtagtaagagtgggcatccttgtgttgacctcgtattagagacaaagcttctagtttctcagcattaggtctgatgtaagtttggttttagtagatgttctttgtcaagttgaggaagtcctcttctgttagttttctgggaaattttataatgaatgggcattggattttgccaggtatttttttctgcatctgttgatatgatcatagggattttcttcctttagcctgttgatatggtggattacattaattgatttttgaatattgaaccagtcttgcacagctggaataaatcttacttgcttgtggcatatagttatttttaaacataataggattcaatttctctataaggtttatttactgtgttctttatgataaattactgaaccaagtaatcaccaacagaaaatgtagcctttttttcatagtagtcttgtgataaatgtttcttaataaaataggatttagaaactgattgtgtttggtgagtaagaggacatgactgaagatcattctaaacagttgagatttgttgagaaggaaaagacaagagatggaaaagaaaagaggagaaatagatattcaaaaataaagtatttcaaaagatattaaagaatacttatttttcgtggttctagtattatggctggagaaagcaatggcaccccactccagtactcttgtctggaaaatcccatggacggaggatcctggaaggttgcagtccatggggtccctaagagtcggactggactgggcgacttcactttgacttttcactttcatgcatcggggaaggaaatggcaacccactccagtgttcttgcctggagaatcccagggacgggggagcctggtgggctgcagtctatggggttgcacagagttggacacgactgaagcgacttagcagcatcagtattatggccagaaagaggtatatatctaagtaaccgaataagcaggaaataagttgaagacagagaattttggaaattgtctatgtattagtgacagttgaagctgtataagtgtaagtgtatgatattgttaagtgggggaatggaaaaaagatgaaaggtttgaaatggacactcaggaatacttatacatagatagataaaagagaatcaacaagagatagagaagatgcatatcaatggagaaccaaaatgttataatatcacagaagtaaaaggaggaattgcaaggaccaaggattgtaatcaacaatgaatgtgaaagaaaaattggaaaaacgggagccaaacaaagagccatgtatttgataaatataagttcattgataaaacttttccccttaaagtataaggagtggacgttagaatgcataaggtaaaacaggaagtggaggcagtgattgtagactatgctttcagaaatgttgacagtgaaaagaagagagaagttaattcaaaggcatagcaagattgaaggaggtatctcatcagcagtaaggttttagcatgtctgattgctgcgtcaaaggagaccactggagagatagtgtgaagattcaagatggaaaggaaatattagacagaatgaggttgccatttaatatattgctgcctcaaaataagccaacatgtaagtgatcggttactgaatgatttagatgtcttttagaaagctttaatatataaaggtgtatatcagttagtttagctgaggctgttcttcagtaatccacaatccccaagtctcagcggcttaaaagaactaagttgtatttcttgcggacactctgtgtatatcatgtaacaggtcagctggggattttgctgcagttcattcttactctaggatccagggtaatagaacagctctttttctgaagattgctagtcactctgatacaggaaaaaagagacatgataaattaaacactgacttcttaagctttcagttgtaagtgacttttggtcacttgcactcacagttcattcaccaaatcaagtcacatggctgtgctgtctccccagggatgggaagtacaatcttaatttaatacttgtcaggaaggagagcagaatatttgcaaaccagagtatttgcaaacagtcctaatgagcaccataaggaatatatttacctggagtaatatattgagttacagttatcaaaaatctaacatttatgatcatttctgtaaatagttgagcagtacatttttcttcaggaaaataatcctatactacaactttgctcctaaggggaaaatatgattggaattagagctcatttacagttacaatgtcattttcagtactctgtctcagaagtatacaatatgatgatagaaacataaaaggaatacattgggttttaccaattatcacttttaaatgtgaaataatgaactttggtaaaaaaagtaacattttttcttagaacttgttgacttaaagacccttttcattctttaaaattctagataattcctttaaatagtgtcaagttctataaaggaggaaaatagaagatgaaacaaagatctgacccagttctcaggctaatagtttagtcccctctaactgtacagttgcagtttaaaacattccgtattatcccaacaggaaacatttcctttgtacaagtgatggtgcacgtttggttcagtgtagattcagttcccagttgcaacttatacatgctgcacagggaagtgtttagtgttcaaacaagaattatacttcattatcctagtttcaagtttctgcatcatctcatgaatctgacagcttcttcacaaatgtacttatttagaagtcttcagagaagcgt

SEQ ID NO: 59605 - DNA, 845 bp, Bovine  19866881267349
gaaaaaaactttggcctgcagggatctgcaaggtctgctgggccaagtgaggtagaggctgcagctatgtttagggtgtggagcagtgtctgcgacaaagagagaggccttggtagatgtttgctgaatgaatgcaggtagtccacaagaacatgccgtgctaagtgattattatttttggtttactgggttgcctgtgttcagaagcataaacatcagcctaaaagctccagtcaaagcagtttttcctagactgactgcatggtacatggaagggttcgcttcagagttgttattcaatgcttatattttagctcttctagtcatatgattttccattattgcatgttaaactctaattggctgaggacatatggcaagagtacacatgtgtgtctctataattcttttttaagccacaaggcacctagtttatgatccctgggaaaagaggtgattacaatgtgtctgctttagaaagactaggaaaggccttccagtgattgtggaagaagctttagaatgtcttagcaacaggtgttgtgatgtcttgttggaaaacttaaaaaaaattatttatgtatttttggcttcgtcagatcttagttgcggcccattgcatcatgcaggatcttttttgtagcatgtggactctctagttgtagtgttcagggttagttgccccacagcatgtgggatcttagttccctgacgagggattgaacccacatctctcgctttgcaaggtggattcttaactgctggaccatcagggaagtcccaggaaagctattctttaatggcgtgtgcctactactgttcttggaagctctgtgtagattaga

SEQ ID NO: 59606 - DNA, 851 bp, Bovine  19866881640449
tataataagatctcaattctcattgtgaactgattattctcttctatctgccgggatcataattcagtgagagctgttcctaaccaaggaaatgagggcagaaattatataattgagagtaatggcttgaaatccatgaatatctagaaacatgtacaagtctgacacatactagcttggtggtcttcataggcaactcactgaagaaaaagagtttttttctccactttaaaaatgagatcgtcataaagactaaacacttattgaatgacaataatgagctagccctttagaaaaatgagaccaatagttactccctaaatgctttccaattaaaagcattctgattttaagtcagtgtgttattagagaaattccaatataaaaaaattcacatttaataataaataaaataataataatgtttaataaaatagaaatatttgtaaaattatttacattactagtatatacatttaactaactgccaactaaatattttcaaaagaagtttgatgaatgtgactgaagagaagctgtaatcatttttacttagtgctttcaattattaatatactgaaatcttcagaaaagaaattttcctaagagacatgaaatctcaacaccaattttcttataaaccctttcttactgatgatatctaggcaagatgaacaaaaattctgaatctttagtgtttctagtaacacatcattggttagagatctaggacagcttttataattaaatgcagctaaatagttacgctgggataccagagacaaagttagcctttacaaatcactggtccttttcatgttagtcaaaacagtgctaaaatatatagaaat

SEQ ID NO: 59607 - DNA, 753 bp, Bovine  19866882216163
atcaaatataaaattatttatatttctccaatttctttgtcatttagtttgaataaaatgaccagagttttttaatataattttttgtcatagataattacaaacaaatgcaaaagcatagagactagcttaatgaaattagtttttcctcaaccagcctgaacaatgatccatatacggcctgtattcctaccttctttctcccaatgctaagattattttgaaaagtttcaaaataaaatattcttttatatgcagatatttcattatttatctctaagagtttaggactctgttgtaatcacaaccctgttatcatatataatacttagcaataattgctgaatatcaccaaagattcacaagtattttcatttccttgattttatatagacttagtgtttctcttgtttgaatcagaatccaagcttttcaaaattggttgatatgtctcatacatatttttcatttgtaggttgcctctctcattcattactgttggtgaagaagttaggtaattgtcctatagtttcctacagtctggactttattattgcattcccaaaggtgtcttttaatgtgtccctctgttcccagtatttccttcaaattggtagttagagtagtgatttttctaatttagtattcctttttcacttattagttgaaatatttttgaaagaggaacttcttatcatcatctattcgagttactctgagctacaatttctatagaaaaggaaggagccatac

SEQ ID NO: 59608 - DNA, 2633 bp, Bovine  19866880344560
ggggcaggaccactaccatcatgctgagctctgtgggccgggcagggacagaaaatccaaacaattctagatccaatgggggcgcatccctgccaggttttaagcacagaaggtgaatttaagttttgagaaaacaacgccgtatgagaaggagttaggagagaaggggctggtccagctcagccggagactgcttcttcggccccagagttccagtctgaaagacaggcagggccctctcggccctgccgagcccacaccccaggttcggaggaacccttctggggtctgccaaagcccctttaaaagcactggtgcaagggactccccaccgctgagcgtgtgagtagcttaccagagctcttcaagttcactgctgcctcctagtccagcacagcccagccccacagccaggaggggaccaagcacctctttcctaacccatccttgctggactgcctgtgttcccaggactgagtaggtggtgatttcccccacgacagagttcaaagagcaaggtgtacatataaccccgtgtgtggcagggaccctttatggcctgtggcgaggagagtgggcaggtcggggctggctcctcccagggtggctgaggccacacggggtggtgccgctccttctggcccagcatctctggcctcagcctggctggcggacgcactttaacttgggttcagaactcttcccaagagagtcagcaatcacaaggcagaagccaaaggtgggagctcggaaataaaaaggaagtcggacaacccagggagcagagcagggttcctctctctttcccactttagagcagcggtccctaacatttttagccctggggaccagtttcatggaagccaatttcttggcggttgggaggggtgggaggatgttaacgccgagtgacggggggcaggcgtgcgcttgtaaaatacagatgaagctttgcacgcccactgctcgcctctggctgtgtggcctgaggaacctcagctttggaagtcactgtcctgtgcgggaggggccggcccacctgaatccctgtgtaatacacgggccctggcaccagaccagccaccaacagggtgttctttgttactttttttttctgacgaggataaataagaactactttttgttcaccctaatatgccctcttgggtttgaggacataaaaacaacagtgaaaaagttgaaaaccatttgttgttgctcaggatctctaatcagtgtattcatatcctcgtaaaacatatgcaaatctcaggtcacctagatttttaacattttcaaatcctttccttacctaagatttccctatttaaaaagttcagacctatttgcatttttgtcgagttgcgtgtaatttggtttttttttttttttttacttaaaatctacttatttatttggctgcattgggtcttagctgtgatatgcaagatctttagttgtagcatgtgggatctagctccctcaccagggattgaaccagactccctgcatctacagcatggagtctcggccactggaccaccagggaagtcccctaacttggttcttcttatttctgtcgagttactcaaaggactctcaatacaatgcactgacattacaacacagggttttgacaattaaggaaataaaaggcaggatctctgttaaccttactaagtgttagttactcagttgtgtctgacttttgggatgggctgtagcctgccaagctcctctgtccatggaattctccaggtaagaatactggagtgggttgctttttctttctccaggggatcttcctgacctaggaattatcccaggtctcctgcactgcaggcagattctttaccttctgagccaccagggaagcccaactatacagtccatggaattttccaggccagaatactggagtgggtagcctgtcccttctccaggggatcttcccagggatggaacccaggtctcccgcattgcaggcagattctttactgagctgagccaccagggaagcccaacaatactggaatgggtggccctatcccttctccaggggatcttcctgacccaggaatcaaaatggggtctcctgcattgcaggcagattctttgccagctgagtgaccagggaagccccgtttcagttttctaactgaaactcattctttaaattcaatgaagcatttttgtacaagagcatgtatacaatccataccatctgattttcttcattgagtaagacgaaacatatttcatgacttgttttgcaacgatgtcggaattaaaataattatgagagaccacgtccttcgggggagccacccacaactacctgctcgtgtaatccttccacttgtctgggtctcccaccagcttcacgtaggtgcggtcaatagcagctctgagctccttgagggtcacgtgacaggtctcaggtgtgttccggactgcatcccggactggaagtttcagacacagttcttcaatgagctgtaaccttttctcacagagatggtgagggcccttgtcactgaagaagatctagtgagcaataaacatttatatgatctctgtgagaatccacacaatactgccatattttcatggctgattcccatctagtctag

SEQ ID NO: 59609 - DNA, 1300 bp, Bovine  19866880414725
acagaggagcctggaaggaagcagtccgtagggttgcacagtagtcagacatgactgaagcaacttatcatgcacgcacaaaaaagattgaggagaagttgtccaaaggcttgattagagtgaatctaagtgtcacaggcttagtcagcatcccagtttacaaaatttgactctctctactttcaggtactttctgatcactgtgtttgttcagggctcatcattcttgtgttccaggtgacagaccacagctcccaaagacccttcactgggtcccacagcacttactaacagaaagtaggatcctggtggtctgccttgaccttccagagttcagaattaagatgcaaattaactctcaatcaccagcatcaccctgcctctcaggcattagtatgaaaacacacacaaactgaatgtacagaattattattttgtttaagggatctaatggcgaaaactcaaaattgcacattaatgctaagcattataaattagaaactatcctgtgacttttcttgtcattaaggccaaccacatgattttcatccctttctaaattgagagtggtgatgctaacaattatagcactgaggagatgtaattctaattcagtgcttacccatcatttgaacttaacaagtatattaatgctctaaggagagggaaggaaatataaataatgtataatttcttgtatcaccacaaatctaacattttccatctgacctacttttgctaacttttgctgtctgtacctaaattctgcaaattctgggacagtgctgcctacatggaaagctaatggtatcctaatacctaaattggtttttggcttctggaatgatactttaaaaatcctaagatatgatagaattactctaggttttttttttttttttttttttttgatgctgcaaaaacactttatcgtttccatttggtccaaggcttgagagagggctcctgagtgttaaaaagctgcctagtggctgcagagaggggtttcaggcagccctgacgttacggggacttctcaatggccactggtctccagaagttcctagtcgtgcttgagagtgagcctttcgaagacgtatttgcccaacccagcctggggaccagccagcctgcagaagtggtcaggtggtcacccgtgttcttgatgagtttcacctcctcatctagaaagtggttctccagcaagtcacagatgtgggggtctgcacgggcagaacccaggccatgcagatcccaaagggcctggctcaggttcttctctgtgagaagggcagcttcc

SEQ ID NO: 59610 - DNA, 990 bp, Bovine  19866880452364
atataaatagaaaaaggcacatcataatgtgaaattacaggtatatgctttacttatccatgaaacttaaataaaattaaaagaacttaaaaacaacactcaatgttattgtcatattatatcaaagtgtgatttaaatttttaaatatatcaaaattcagtttgaagacacagtgcacattgccacttctaagagaagtggctacagggaaaaaaattgccttctttatcaatattaaaagcgtgtagagaataactcactgtcttatatatttacattagaagatagatatttggtgagtctataccatatatctatgaaggatatttttgtaggagggtaaatagatctcttaaatctggaagggcttctaactcaatatacactctgtgcggtttgtagaagtaaaaacaaaaggtctgtatgtgacatttgcagatactaaaaatgatacttaaatacaaacatgattttcccactggagaaggagggcttgctggtaaaataagagcattgctttcagaatcctcttctgattctgatcctctaggccagcctccatgattagtctgcttttgccaaagtcagatatattactggaacttaaggtaatccaagattgaaaatcactgggccccaagatattagagatgatgggaaaacttagcatttaggaaaaatgagaacatctacagatattgaagaagactttaaattatggtatttactcattttgttcatgatctttattttttttaaatcaatctttctttccctccacctttctcaagcatcttccattcccaaaaggttgtcctactctctgtagtccaaacaaaccaccacatccagcatccacatctttgttcacagtgtcttttccattttccatctcccatgtctccaaccatcaaaatgtcagtaactctacgaagcccacgttaagccacagtcatcagggtgggatgccagtcacccttctgctctca

SEQ ID NO: 59611 - DNA, 2372 bp, Bovine  19866880480844
atgaattaaggatttaattgagagataacatttaaagttttctaggaaaatgtaggaaaatatctatttcagatttgagagtgaacttgagaactcaagaaggacagtcctaagtgttctgtctaagcagggcacaaaaactactattgctggaagaaatattgcaatgttgatctctctaaaatgagcaactttaaaaagaaaataaaaataaggtgggttgctggagaaatgggtatttattttttcaatatgttttaccaaacatatatgatcaaaattctgttgtctgaatcaaatattaggctgaaaatgaagtcaggaaacagagaataacctaacagcccagaatgagcacccctttacatccatcaccagctcagtcaggaacctgcgccactcttcagttttctgaaatgtgaaatggaaatccttgtgaaggaccctcacagatgcatttagaaatgtatgttcagaaaatggaattgaaatgttttagtaagagtcatgggctcaatccttgaaatagatgatggttgaatttcctatagtatgtaattacaacacaataagactcaaaagcagcttctataaagggtgggtggaagagaagcagcctgcttctagggcttcattagcttctgcccactggagctctccaggctatggggaggaaccctgtttaccttggttcagaatcaattttaaccatcactgaggccctgggggtcagagtgcagcacggagtccttgggaatacaccaggccaggaaagaaaagatgaaaatggtttttgaaaagccccgagacgggctgcagttttgtggaccagttattcccagaacaatgtgttgtagtgccagtcactgatgaaatgatacttagacccctactttagtttcttcaagaagtttctggtaaattagagcaatgccattggcctgatttaggctattctgtctaaatataatttctacatattctgcagccctgggaatatttaataaggggagagaggcagcaaaaaagaaaggatcataaaaacaaatgaacaacagaataagaaacaaaaccttgccctttatggtaaggatgctgagaaagacgcacttatccgtaaaggacatgtagataatttctcatttctctcctgagaatgctagcacacattgctctggttggagtagaataggttcatctggcctttgaggtcacactgatgatgttgtgccttgctgttaatgaaactttgtgaattattcttaatttttatttcagtttctaataagcattcatgagctataacctttccatctcctagattgcatgcttcaaaaaaaatccttagaaccatgcttctagaaaataaggttatgttttaagtaataattataattctacagtgtgtcatacttgtggtttctaatgtgctaacctccacattctctcattatccctgaaatagctctttgaggatattaagataggcattataatgttcacctttcctctgggaaaatgaggtttatagctgttagtgtatctacttaccgttgtaaggctctctagtggcaggaatcaaaactccttactccagcgtcagtgttttttggttgttgttcagtcgctcagtcgtgtctgattctttgtgaccccacgaactgcagcatgccaggcttccctgtccttcgccatttcccggagtttgctcaaacttatgtccattgagttgatgatgccatccaaccatctcatcttctgtcacccccttctcctcttgccctcaatctttcttagcatcagggtcttttccagtgagtcaactcttcatatcaggtggccaaagtattggagcttcagcttcagcattaggctttccgatgtattttcagggttgatttcctttaggattgactggtttgatctccttgctgtccaagggattctcaagagtcttctgtagcatcatatggtgccagaatgttttttcactctaccattaatgatctagattaataagatcaacatttacctgggaattagaaatataagatacaaccctgtcctctgatagcatataatctattagaggtgtggggtgtagtaggacagttacatgaatatatatggcttaacatgagtcagtaacaagtagctaagtgccaaatgaggcttccctggtggctcagccggtaaagaatctgcctgcaatgcaggcaacccagggagtcccttctggtatgtaaactggcctataggtgggaaagtgtgagaaacctccccgaagcctgagttaggagaatcccctggatcccctggagaagggaacagctacccactcatagaggaggtaagtgctgcctatgggtata

SEQ ID NO: 59612 - DNA, 2930 bp, Bovine  19866880488440
acagagtgatggaggtggccacttttttcttctgagagtactgcattgtcatttgatctgcccaaggtttgagatgtggtgtttgtaatctgaacttccaggagccagcaaatacaattaagtaattctggtgaaaccaatcacagagatctgggctatgacatttacttcatcatttaattacatacagaaagaaacattaatagaagaagttaagattttaatcaaacaaatatgcaaatatggaaaacattcctcacattccccagcatgctccatctttatttttgcctctgtctttgcttttgtcatttctctactgatagcctggaaatattttcccatatctgttccattatacaaattacaaaatcttattttctaacataatttaaaaaaattttctgaagtcagtaacctgagacacttgacttttaaaaaaatttttaatttatcttaattggaagataattagtttacaatattgttatgttttttgccatacatcaacatgaatccgcataggtagacatgtgtcttcccaatcctgaattgcccctcccacttctgtctccaccctatccctctgggttgttccagagcattggctttgggtgccccacttcatacaacttgcattggtcatctgttttacatatggtaatgtacatgtttcagtgctattctcccaaatcacttgacttttgactgtatcttttttttctctagtagtttcattcacatgtcttctatctctaaatagttgctaagcatctgaagggtaagaatcatgaaggaataatccacaatcctttctctttattatacatacaaagaaactggagcccagaaaacttaaattcattcagtttacttattcagtaaatgtttgagcattcgtgctgtgcctgacactttgctaagtgctagatatacaatgcagagtgataactaacaacagtcctgttgccatggcttcagtcaagtggagggattcagccactcatcaaatgatgacttaaaaggtgaaatctatgggggagaatggatacatgtatatgaatggctgggttgctttgctatatacctgaaactatcataacattgttaattggctatatttcaatataaaataaaaagtttacataaaaaactgaaatgtatagatacaataagcctcctgaggagaggtgtgtgaaagtgtgactgttgctcagtcatgtccaactctttgtaacccccatggactatatactctgtggaattctccagcccagaatactggagtgggtagcctttcccttctccaaaggatcttccccaacccaaggatcaaacccaggtctcccacattgcaggtggattctttaccagctgagccacaagggaagcccaagaatactagagtgggtagcctatctcttctcctgtggatcttcccaatctgaatcaaactggggtctcctgcactgcaggcagagtctttaccaactgagctatcagggaagcctgaggagaggtgtaagtttatataaaaagatataaccagggcaatgatcatttcataggctctatcatcagttagagcatcaatcatagcacaaatctacttcatagaaccattccctagattgtccactatattgtatgtgctagagaaatttctcctaaccagttgattgatctgctgtccaggtgatctagtgttgaaaatatcagctgtatataaatctgaagactgaggccagttgtcactctagccatggtttcatatgactgcttttctgcactcttgaaaccagttccaagcaaacctgtagaagctgtcatttacactgaattttgccagcatggcacaggttagttaatcagacccctagctgctgtgttctgtgactaagcttttaacactgggacttcagagtcagccaaaacatgcttaaccgtcacctggtgcttgaaattgcaattgaacatcatagctacgtggaatttttagggtatacaggaatatttcaagtgctgagaagatccctcttaaggcagcatgtccccatgtttagtgagttctttagaatggtaaagattttttactagggtggggagaatactggtttaaggtatacctacatcctgagaattaaaactcggtaccatttgctaattggtattgaatacccactccagtattcttgcctggagaatcccatggtcagagaagcctggggggctgtagtgcatgggttcgcagagagtcgaacatgactgagtgactaacacctattctactacactgagatacatgaccacaatggaaatgtgatgcaaaatacatgcatacacatgtatatgatagtccaggtttccatcttgtcagtgatggtgtacttgacaatgtcaattcgcaggaaaaaaatatccaaagtttgctctgtgtattaaaatatccatttaaaaatagttagaaacagccaccaaacacctgtaagcatatgtgcttatgcaagcagttctctttggtctggaaaatattcaagctactgctctgtttcataagtaacagcaatttgggacaatcatggatcgctgggcatcatcaacttgcattgttatctgtagcacaatttaatgagcaagccttagtttgattatgggccagtgcctgctaccttaactgctctcttccagtttgaggactaaattttatctcatcatgttaatatatttgagaaaatacctaaacattctcaagtgttttgcttgccatattataccttcccatcaagaaaatcatattacagtgcttgacgtcagcttaaaaatgttctcaaatgagttaaataacaatttctggacataataataccttcattttggatagattttctaatctacagtgttgtttatatcaagtgaatatgagactgtat

SEQ ID NO: 59613 - DNA, 1067 bp, Bovine  19866880522126
gtaggagtctagtggatcttcccaactctaggattgaacctgtgtctcctgtgtttcctgcattgcaggcagattctttcctgctgagccactgggaagatttaatttagttccagaccaaataaaaaacaaatgacatcagtgtatcagctcagtgctgggcctgaagacttccattaaatttccgcagattttatgtaagcattcattatcactcatgaagacatagctctaactcctagggatgaattaagagattatatttaaaaatatgatagtgtttcagatcatgggattttaagtagagttcaaaattatccctattacattctgccctttgacccagaagagaaagattgcccctactagggcaactctacgaagaacctaacattcaattgcttcacaatttaaattgtggtttcagcttggcttgtgctacccactgaaaatcaaaaccatcccaagagcattctattttcttatcttcttggactctgtaccatatctcaattgtacatgaattacatgaagccttcctacagtaagtcaactaaaatcacataagttcctaacattaaatttttatgttggaaacattataattgtttgctggcatggagggtgtattggaaattttagtgagtgcattgctaggcatgaatgtgataaaccaattccatgagcatttgagagtataattacttatgatctgcaatatttattctcctcgtagggatcattatgttttcctttgtgagcaactttataaattgtgtatctgtaaaggaccaaagatattcaagtaagtttatacttaattccattcaaaatatctatattatattcattctcaactttacaaagatacagatgagggattatgtgaaactaatcaccagcacaaaaaaaacattaagtataaacatttaaaaataagtttgacttcaaatgatacatgatagttttccaagcataaactataaaatatatatgttacataaaatgtgaaaatactaacttttctataggtaattattactgctattcactcactaatttgctat

SEQ ID NO: 59614 - DNA, 1142 bp, Bovine  19866880553334
aggttattttgtgagtgcatgctaagtcgcttcagttgagtcttactctttgtgaccttatggactgtccttgggattctccaggcaagaatactggagtgggttgccatgccctcctccagggatcttcctgaccagggtttgaacccacatcatctatgtctcctgcattgcaggcggattcttaaccactagtgctacctgggaagcccagaggtagtaccctattataattcccttaaagtgtttgtggtccattgttcattatcatgtcataaagacactattcccttatatgttgggttacatttctctagtgcactctgcttttatattaacataaaaaaccacattattcaaaagtcttattttattttttttcccccagaactgctagtagcttatattgatcagttggtgttctatttaatgtttctgtatctgatggcatatcttacatggcttttaagaactgggcttgagtttattcagagagaagtcaactagtttctataagaattattcccactgtaccctattatgactaatctggtttggggaaatataattagaaatgaaatctcctgacattccaatgaatcttctctatgtagaaaagaaggaaaaagttttattattgaataaacattaaatcaggctgagatgcacatcacaggcaatctgctaaggagactgcaaatggagaaacaaacctcaccctgttatacagctaggcagatacagtctactgcatacatgttaattgtctttgtcaaaaataaaacccaaaacttcttgtatctttatgacaagcaggaagtagtgttgcagggaaaagttaattgtgactccctgttggaattatttctttgacaagctttccgtggcttttgttattataatcatacataatggcctgcctcagagaatcttgtccctctgtgtgactgttaaacttaagtgcctttcttcagaatcctgcccaccttctgaaggcaggaaggacgaaattaacatatcccctaccagagttttggcattctaggagatatttgcaagattactgtcctttttgctttgtttcctcacctcccccctctccccgcaatctctgttctataaaagaacccggtgtgcagact

SEQ ID NO: 59615 - DNA, 1317 bp, Bovine  19866880566671
ataaaaaagttaagaaatcctacttaggattcagggaaaacctttaatgattgatttaggctggtgagggtggtgttgaaaggccaatccgaagactattattgtaccgttggaaatcaggatggcccagactgtggaaagtgttgatggtgaaggagatattggaagaagggagagtcaccagatgactcagtttccatgggaagtggtggactttgcaggaaaggatggaaagttgagttcctgaaggttgattttcttggaaaggtattggcttgttccaaggaagcttgttgctgaaaagggaggctcgccaggctgaggttgctttgatgttcacaggcactgtgatggtaaaatccagttctcttgaggccatgggtataagaagccctagatctctggcctgaactctactgtgagatgagggtgctggctctttgtgacaaagctcaaataaatcctccagttacaagtacagttgccacggataccatgaaggatattatagcatcctctgctagtgttggagggtctcctgtggaggcatgggtcaacagtggctcacagaccggatagggtcgctggcaacagcactcctctttgctctgatatttgtcgtctccttccttctgccagctttggactttgtttttcttttctaattcttcagtgtgtaaatttaggtggtttcttttttttcttttcctaacgtaggcatggattgctgtgaacttcctgcttagaattacttttgctgcatcccatatgttttatttctattttcacttgattcaagatatttttgatttttttttttctttgatgatccgattgtccaggagtgtgttatttaacttccacatgttggtcaaattttcagttttcttccttttgatttctattttcatagcattgtggtcagaaaagatacttggtatgatttattctttaaagtttgctagtatgtgttctgtgatctaatatgatttatcttggagagtgttctatgtgcacttaagaagaatgttctgctgctgttggatcaactattctctctatatgtattagattcatttgatctaaatatttcaagtctaatgtttccttgttgactttctgtcagtatgatttatccattgtttatgtggtatgttgaagtttgctactattatactgttgtagctttcttccttcaaacctgatatactcattgttttaaaaattttagacattctggtagatactagaggcagacatcctggagtgtgaagtcaagtgcatcttaggaagcattactacgaacaaagctagagg

SEQ ID NO: 59616 - DNA, 1718 bp, Bovine  19866880574311
tggatgtgagagttggactgtgaagaaagctgagtgccaaagaattgatgcttttgaactgtggtgttggagaagactcttgagagtcccttggactgcaaggagatccaaccagtccatactaaaggagattggtcctgggtgttcattggaaggactgatgctgaagctgaaactccaatacttttagccacctcatgagaagaattgactcattggaaaagaccctgatgctgggagggattgggggcaggcaaagaaggggatgacagaggatgagatggctggatggcatcactgactcgatggaagtgagtctgagtgaactccgggagttggtgatggacagggaggcctggcgcgctccgattcatggggtcgcaaagagttggacacaactgagcgactgaactgaactgaagctttatcatttctatgtgacgggaatggactgacatgaagtgggtgatggaatctgccttagagctgcaggatattcaggctggagagacagcacattggtcatccaacagccaccctttttagcatcagagaaactgtactgtttctggcacctgctgttactgggagtagatatttctttcgcctacagtgtgtttgtgtgttcatgacaggatttcacaagtgaatgtctgaagtcttacctgcaaaagcatttcttaaaaccaacaatattactacgatgcagtagatttaccaataaataaagagataaacaaacaagtaaatagataaataaaagctagtagagaacacttcttatgacttaactgtcatctatgtcgggagaattcacgccttctaaggtctgaatacgaaactcatgtgtgccagtggcttgtgacctcctgtagctgtgttactgaaagcacatgcattcttaaataaactgggtaaaataaaatgccacaattgtggtgctaacagggtcagcagtaatggttacaagaggattttcggatgtaacagaatcaaaagtagtgtcctgttaacgaaagttttcgagtcgcttttttattttgagccagatttgtaagagcagtgattgaaagaaaagacactctattctgacaagtactccattcagagtctttctgaaatggataaagatggtgcttgtttggtctcctgcaggaaattcgacacaatgatgtctgttgagagcttacctgctgactgcttgacatgtctaataacttctccagctccttgatatgacgactgacctccttcaagagaagtttgagtcgatttccaatcacgtggactttttctttggcttctaaacagtctgtgccttcagcattcaccaacagttggcaagacatgtcttgcagtgaggccactttgagttgagattccaacagctcatgtcttatttgctaagaatataataaaaaatatttttctgagaatttctgatacttggagaaagtgcctatgtgcaggatgacatcactttaactcagtggacaattatacctaagcatcacacgaggaaggatatagcagcaatgacctttgggaatcagggacatatgttctaatcctacctctcccaaaaagcatcctataaaatccttgaacctttctgatctgttttctcatttggtgggggggtttttttttcagtcactaagttcaactctttgtgaccctcacggactgcaacatgccccccctgtccttcactatct

SEQ ID NO: 59617 - DNA, 1659 bp, Bovine  19866880601896
ttatgtctaatttttccctagagtaataaattagatgttttttggtaagaacttgaactcagataattacaataacttcagtgccttgcttagaaaggagttgtgtataagatctgaaaaccaatggtaggaattgtaatgcatgggtatttaagctgtgagagaaagaaaaatgtctcattcaagacgattttatgctccatattttattttttccataggattttcatgaaatgagtcacggtttgctgcttatgctggagaacatcgacagaaggaaaaatgaaattgtccccattgattctaaccttgatgcagaaatacttcaggaccatcacaaacagcttaaggtgagatatgtgggcttggacagcctctgcttatgttatagttggttgtgcttgtttaccttttatgttgtagtctcttagtcttttttacccctcatgatttctcatctctgtgaagcaagcatgtgcatagaagatggcatatgctggctttagaatcttgttctaaagccattgctcatctaaaaatctgtcttcatctttgttttttttaagctaattttttaatagacttttgtaaaaagtttttttcctgagacatttttttaaagtcttaattgaatttgttacaatcttgcttttgtttaatgttcttggttttttggccactaggcatgtggaatcttagctccctgaccaggaatcaaacccacatcccctgcattggaaggcaaagtcttaactgttgtaccaccagggaagtcctcagatggtcttcatcttaattagcctcattttatcaaggcagttctattcttatttacaatttatttctaatttaaactttatatattgaatctatgtcacaatactatttcggataactgataataaaaggacattaaatctattaaaatagagaatctattaaaatagagaccattaaggattcttaagaagaattaagtatgtagattcaacttcagtatcaagttttctgaaatctaagacaagggaaacatggtaagttaaacgattttcattacctgacaaaaaggaaatatactagttttcaaggaataggaaactttttctagtactaaattcaaaaggatatttgcaagatttttgtgtagattcttatgcaaagaacttcggacaatataatgtgccatatacttaagtgattttatggaagataaggaagcatatttgagttccattaggagaaaataatttgcactttgtcactttctgtatttttaaaatgctatttcttaacatttaacactcacagtgacctaaccaacagaattggcagcttttagttcagtactataaaggtcttagaaacccagaggaaatagctatgcagctacattttcaccagacttttgacctcagacattaagttgtgagtgatgaatcacccgtataccttttttaaaaatctcaaatagatatcagagtatacctcaaccaagctgagtttttctgcatttatgttagttttacttttctttttaaatgattattttatggatcatttgcataatactttatattttaaataatttgacatgcattcaccaatatgcagtggtgaatattggtgacttgaataatatgcagtattattccaataata

SEQ ID NO: 59618 - DNA, 1079 bp, Bovine  19866880759617
gaagaggtgcataccaagaaaagcagggatctgagcacaggattttgtgtgcagtatgagtcagacaaggaggcagggtggagacaattaaccaattgaaagatgtcacattaaccgtttgaagaagtggaggctggaccaggttgagatggtgagaatggagagggactgactgagagcagaccttgatgagagcatccttctttccagctcgatgttgcttgcagttggtcctcagcggttccagtgactggctggcaccatcctccattctcagtcttgactgtatccaattatatacatcattctcactgaagcttattaaaagccttcttccttcgagctgtttttcttctcttgctttactttctcaggtcagagttgtaattaatcctcctatgcagtaggatctttgaataatagcaaatgctttgtattacctttgtttcccgaaacagaacattctggactcggtcagtgatggacagagcaagcttgatgcggtgacccgagaaggacaaactttgtatgcacatttatctaaacaaattgtcagtagcattcaggaacaagttacaaaagctaatgaagagtttcaggcatttctgaaacagtgccttaaagacagacaggcgctacaagactgtgctttggaacttgggaggtaagttttttcaacaggtacagatttcattatgcacggactatttcttcagtgatttaaagtaaagaggcattgggaataaacaaaaatatttttaaattgtgagtttaaattataatgttttgactttaagtacatgttcatactaggacaataactgattgctcaaactctgatggtatcatttggctttattttctatacagaaaaagaaaagaattatattcactaataattatgaatgacataaatgtatgtactttttgtctatttggttaactctagatattagaattttgacacccgaatttttgattatccaagtcctttcctcactgtgtctacttcagtgaggttggaattatggcagaaaacacttattatatttctctgaatcaagattccaatcaggaag

SEQ ID NO: 59619 - DNA, 1131 bp, Bovine  19866880760454
aatttataaagtcttttggaatcaagatcatccagactctaagaatagctgaaattgtgatagatagtagattgcaggcttcactctaataatagaaacagttcctgcatgacagcatgagattcagactacaagctctatcttgattcatagagatgtattttagaaagatctttgagtataaagcatcactaaacatctctcctctaagagcaaaaggaccatattgacaaaagtgggactgttaaaaacgttacgtgctctgtaatcaaggcgggcagtttactaacataagccttggcaactgcttgtcacatgcagtgtttaactagattatacctggattcaaaccgtttgaacccagcagtattttcttcaaagcacagttccgttcgtaatacagagtagtgctacctcattctcagaggagacaggaagacttgaggactgactaattcacatcaaaggtgcattttttcccctgttctaatagtttcagcttcgatgtggtcacagatgtcttcactatcctttcacttggtgatttgaagggagatgtatttttctctattaaaatactgcattttatttacttaatttggttaattttagtattaaaaccatggaaatggtgaaaaacaagtgggatcattttggcactaactttgagaccctgtccgtctggataactgagaaagaaaaagaactcaatgccttggagacgtcatcatctgccatggatacacaaatcaaccaaattaaggtgacctgctcacaagttacatttataatccatctctagcttttaagagcacctttcttatgtttcgtcaaatgctatctgaccccaggacaaatctttcattgctatgtgactctattaaaattaaatttacacaaaatgctgagctaagaggtcttgactgatactgggcaatgcttaatagatggaattatgtattaatactgactgacttatgcattcaaagtcattcttgtgtgcaatatcattaaaatgtttttatggttacattattcttttccttgattttgaattagcgccattagagtcccctgttgatggggtttatatgccatgaaatatattcatcatctacaaccttactatgt

SEQ ID NO: 59620 - DNA, 1611 bp, Bovine  19866880847170
aaatgtctatggtttgcagtaaacatgtgtctgctatatgaaatgtcttatgtactggaacactggaggctcataatagaatctattcttcaaagaagaaaataattcaagaaagtgaccagtagatcttaaagagctaacaaaagttaaatgctcagtcacttcagtcgtgtccaattctttgcaacaccatggatcatagaccaccaagctcctctgtccatgagattttccgagcaagaatactagagtaggttgccatgccctcctctgggggatcttcccaatcctgggattgaacccaagtctccagtgtctcctgcactgcaggtggatactttaccacgtgagccctcagagaagcccaacaaaagttaagtctacttaactactgttactactagtagtacaactatatacgaaatttgcgttttaacacttttttctctttgacatgcatgtattcatgaagcagcttgaatacatgtttctagttttttcacacaccatgcaagtgttattttcattttacttgcttagacagaatagcagttgaaagaaggaacaggtaggccataaacactggttacaaactggtgccaaaagcttttcaaaagatttacattaataatggggacagcattttcctttcggtttttcctttgagctcagtggaagccctcaacttatttatcagtttagcacatatttgtgttttctcaagggtttaaacgcattgcactgccaacagctgacaaacaccagctaaaacctccagagcgggaggcagctgaacaggaaacacatcctcttctgcttcagatatttttaccatgacaatctgaaagaacaccaagcaatgacaatgatgatatatttaaatctcagctggaattacacacagctctacaaaccaaggcaggaatgaaagcaaacagaagccatgactatccacaggcacaagagtcctttccggggctctacttgaaggcaggacacttttccgttacctcaactctgcagtggtcacgcacagggcggccctctcctcctcgtctggagccccagtcagatcgtacttctcaccagttgctttcattggaatgtgaacacactacttggtctttaacaaggggattatgccttgcttcacttaagtttttaactttttaaaatgagacataggcacaagctcatttccttttgtggttgcatgcttgacagaagttctccggaaatactaactcaagaagtagtaactggtctacacttctccttccggctatatcctggcaactttggtatgaatacacatgactaaacttttgctgatttaattgtttgtgtgctgtgctcagccactcagtcggtgtctgattcttgcaaacccatagactctaggctgccagactcctctgtccatgggattctccaggcaagaatactggagtgggtagccacttccttctccaggggatcttcccaacccaagaatcaaacctgggtctcctgcattgcaagtagacactttattgactgagctacaagggaatctttagactgaagcaatgtgagaagggcatgcttcagcttcaggccttaagatgttca

SEQ ID NO: 59621 - DNA, 2865 bp, Bovine  19866880851895
taaactcccccaacagagttcgcctgtgtggacggccctagcctatagatgggcatgttttgtatgcgtgtagttgctcagtcgtgtctgactctttgcgaccccatggacggtagcctcccaggcacctctgtcaatggggattctccaggcaagaatactggagtgggttgccatttccctctccagaatgtttctgtatagccgtggcaattccgaagcacaggcagaggacgaatggaatgtggaacccagccccaccttggccttcccgagagctgctgttttctcccgcagttccgcgtgctgcctctcggacgcgttcaggctggcctccacgccgtccatccaactgcaaaactgtcgaacatcatcctggtaacttgtccacttagaaagagctccttcaagttgactgaaaggtaattgaaaggtcagtaatctacagtgagaagccgtctgcatgcagtctgtctgatctctgtcacgtgtctgctctgtccacttccccggcaggaagcccatagatcaggtcagggcaggcttgagggggactgaatggtcacggcttatcaaatccaagcctgggtctctggaaagcacaactttgaaaagcaaaggatggtgaagcccaggctgacaggtggagaagtgggacagggcatacaacttggagtcagtaaccaagtcatgtgagacacaggaagaggtctgaaggcaaaaggagagatgccccaagcaaggcttttcttgagccaagactcaagaaaataagagtatcaatattttattccatcagaggagagaaacaaaaaaggaataaaagacaggaaactgactcatggtttctcccaagggtaattttcagagacactctgtctacactggctcccgcagcgccttttgggggagtaaatttcagctccctttacggactgccctcttttcctcatggctctttcccgccacccactggtgtgttctggggctacttcccaaggaaacagtttagttttaactaatacatcttcacatgattaaacatttatttatcctgtggttttctaagcagtgaacaccaacatgaagaaacatatagttatagttacgtaaaaacacagacacagtactgtcagtcaacgtaaatgcaaggttgcacctgccactttcttttcttccaagaagaaaaaagaaaagaagggaaggagggaatgaaggaaggaaggaggcaaaaaataagggagcagggcaatagagagagtgaaagagacgcaaagagaggatagggggaaccctgtacagtgtgttactgagctattctatagatattttagcaatgacttgcagtagccctttggcttcactaaccttttacaacgaattgctgcagacaaaagtgacgcccacatatccttcacactcgccagctgctgctgaatggcagggatgccttccggggaggtgttctgaaggacagattctcctctggtcactatcatcttcatctggatctctttttcctgtttcactgataacagagcctgtaaaagcccatacagaagtcctttgtcatctgtatgtttaacatcgctagctttaaatatttcagagtccctgtggatagcagatgacctgccgtcgtgttgagccctggatctcttgggctgatcaggaggccaggagagtcactggctggtggtatcaggaaccagtaaccagttaccagtcacccactggtctccaagtggccttggcctttcagatctttattattctctgaatgaataatccctgatttccactgaagtttaagttcactgttttttaataagcaaaaaatagacaacaaataggattcctaaattctcaaaggtcacaggatgaagagctctatgcatgttaaggtctctcatacaacaaactgaaagaaatagataaattcatagtctatattaaatttatacatttcaagttcttcacaagcactcttctttttctatataataaagatgcttgaattcaaagttataaaactggtgtttatcacctaaaaggtaaaacttcatctctctccctcatctggagcttgcccatctctgcagattcagtttcagccactcctggccatcagcttctgccgcagcagaaaggaagtgctagcagcgactcacacaccacaccattggctttcttcagcttttgctcattgggttccatcctcaagtctcaggttttctgagaaatctgctccaactctcaacaccatctgtccttgcccagctctggtcctctatgtgcccacagctccatcagcatgccccatctgctattactgtctcctgtgcctcagcctctagcctcagactataaaatcctgaggacatactttattcatttttcaacccttggtatcaagacagagcaccagtctcctagaagacactcagcatataaatggcaggtgaatgaatgaagaatgattgccttactacaaactgtaaactcatattgaacgaatttcttatgacgggagaagaatggactaactgatacaagcaggcaagttaattgaacaagatgggaaatgtttctgataaacatttctgataaaatgtttcattgaagtatcttcttagaatagatatgtctgaaatcatttgaaactagcctattcactggctatatcaagcacgtaaccacctttgggttgttatttctttttttgtaaagtattgctgggcaagtctatctgggctcaaatgattcaggaatgcttaggcaaggcctccctgtgtcaacaggatcataacagcagagtattcttggacttctttttttctttttaatattttattatatattcat

SEQ ID NO: 59622 - DNA, 749 bp, Bovine  19866880856979
gacgaagagggtccggaagataaagatttctacctcaggggagctgttggcttatcaggtaggaaagagctcctcctatgcgtatgctagcttgaaagaaaatacaaaggaatggatactgtcctgaaaacccatagctaagcagaatcatcttccttctcccatcaagggaacttggactcaatggtgtaattggatatttacatggttcacaaatgcaaaattgatatgaccactgatttatcccacatatgcttacattcttactacatgactggcgctttataagtactggaaatacacagttccttttcttttcaaagagcttacattctagggtggtagtgtggtagtatggaggtggttcagtcgctaagtcgtgtccgactctttttgatcccatggactggagcccaccagactcctctgttccgtgggattctccaggcaagaatactggagtgggttgccatttcctgctccaggggatttcccaatccaggggtcgaatctgcatcccctgtattgcaggcaaattctttacttctgagctaccaaggaagccctaacactctagggtggaacacagacaaataagaaacacctgtgtgaaatgtttggcactggagtagcagggtacacaaggtgatgtgaaaacagcccaggggtggctgagccggagctttggagaaaggctttagagaagagacctgtgctgagacctgcaggatgaatagaagtcagccagg

SEQ ID NO: 59623 - DNA, 1461 bp, Bovine  19866880892834
gttgtatgaaaactagggggaataaagacaagcctagaggcatgttgttttgatgaaagtcttaatgaagcagtgggtttctctgtgagacgcggtctttgcagaggcgcccaggctgtgtcagtttcaacttcatttctgttgtcctagaatatgctggtggaaatagagcagaaggtggtggccttatcagagctctcggtccacaatgaaaacctgctgctggagggcaaggctcacacaaaggacgaggccgagcagctggcggtgaagctgagaaccctcaaggggagcctcctggagctgcagagggcgctgcaggacaggcaactccacatccaggtgaggctccagccacgccatgagtgtggcgctacagagaggctcatctttgcacaagactggtctgccctctgagcacgggacacatgaaggggatggctgggaaacagcacatacttatgtacgtacctgcttcacacacattctggcgtagttgtttgtttgtttgtttttaatatttactcatttggccgctctgggtcttaactgtagcagtcaggatcttcagtcttcgttgggatgtgtagggtctttagttgtggcatgtgggacctagttccctgaccaggcatcgaacccaggtcccctgaatcaggtgctctgagtctcagccactggaccaccaagggaagtccctggcataggtttccaaataggctttgtaagagttgtttgaatccagagacctggaaattgcagcataggaaaggaaaatgaaaataattaccaaatgctagcagctgtatcattgaaaagtaaatgtttaaatatagattaaacatagattaaatcatagattaagataccctgtggcagtgttatatttctcctttatatctcctatgttctacttttcagatagactattttatttagtgcccacaagtttagacttggcatgtattccaggcgaattgaacatttttactatcatgcagtgtccttcatgtttccttatagtgatttagagcttttttttgtataatatttgcatggtatatctttcacttttctgttgatttaaccctttctgagtccttattttttagatttgtttcatataaagaacatttaggtgtattttgttggttctaagcacatctaatcagaaaacctctgacttttaaagagcaggtttaatctatttaaattctttgtgattattgatatgtttgaaattttattcttgcttttttttttctattttgtcctgctctttctattcttctttctccattttaacttttgcttctaggtggttgaatgctttcctttgttttttgtctctactttttatcatgcctacctaataaattctaagttattatttcattcttgttccagatcaacataagaaactcataacacattcactcagatttctccccatgcgccttg

SEQ ID NO: 59624 - DNA, 2570 bp, Bovine  19866880937949
taaaaagtgctctaattagaggtaaatataaagtgcatggttttatgtgaagtaaaccacaccactaaatatcagctttgcttttcaactcagaacaaaggctaaagagacaatgcttattaatgggtcatatgattttatcatgagaagaaaattcataaaatttcataattctggagacagtcagataatctaaggttcaagtcctattttgtcttaactaaatgcatgattttgtacaaatcacttaatctttaggaatctcagttacttatctttaaaaattagaggtagacaagatcttttaagatttttccctcaaaaattttataaccctttcaggatatttagctttcaatcttgagtgtcacctagaaaatctttaaaaaatgaagatttttttataggcaatgttaaataaacaaagtgatatttttaatataactggtcatcttccaaatatttatagatacttatgtggtcattgctatcatcatgttaaactcagaaagtatcaccaagactgaatgctgtcatgaaactattctttctaaaattataaagtttcaaaagaagaaaatatacaagatttaaaatttatcagaaataccgttctttttttgtctgtctgattattgttgaggtggtgagctattattttgaaaaggagccattttatcacaaagatgagacacgtgtatttcatagaaaatagacattataaaaccaaatagaaaatcttaacaagtgctatatgtaaatgggcaaaagatctaaatagacatttctccaaagaagacatacagatggccacctggcacatgaaaagatgtccatcgttaactattattagagaattacaaatcaaaactacagtgaggtaccaattcacactggtcagcagagccatcattaaaaagtctacaaataacaaatgctgaggagggtgtagagataaaggaaccctcctacactgttggtgggaatgtaaattggtgtagccactatggaaatggagcttcctcaaaaaactaaaaacagagctctcgtatgatccagcagtcccattcctgggcatgtatctagataaaactacaatttgaaaaaaaattacatgcgcacctatattcatagcagcactatttacaacagccaaaacacgggagcaacctaaatgtccctcaacagatgaatggagaaataatgggtgtaagggttaaatacactggggacctgggagccttcccatcacttacaatctttatttttctgggttcaaaacagcttatcaaaaaatgattcatggccacttagtgaattaaagcttgctgacacatttcctcaaaaggaaacatcatttggattattaatacacagtggaataaactcagccataaaaaaagaatgaaataatgccatttgcagcaacgtggatggacctagagatcatcattctaagtgaactaagtcccaaagagaaagataagcaccatatgatatcacttatgtgtggaatctaaactatgatacaaatgaatgtatctaatgacacaaaaacagactcacagatataaagaatagacttatggtttcccaggggagtcggggagggatggattgggagtttgggattagcagatgcaaactattgtatacagaatgaataaatgacaaggccctactgtatagcacaaggaactatattcagtatcctgcaataaaccataatggaaaagaatatggaaaataattttttaaaaaagagtgttatttgtttacaatgtgtctccagtctgatttagatatgttttacactaattcattaaattcactagttatacataggtattttcccaccacaattatgaaaataaagaagtatcacaacatcagaacatgaaattatctcagaatatcttactctcactgcatgagatctatgaatttggcaatgctttcaaacaacatgttttcacgccttttgacttgtgaacacaagagccatgcactcgttagggaattttcacaactttactgaataagatgaagtcaagagacaagaaattttcaccaaatctttctatacactctatatcccatttcttacaaatctcactgtagtgctactaactgtagaacagagaaattaaagggatataattagcacgaaaatatctagaaacaagaaatttattgctagtttctcatcgttattcagtacaacccaaatgtttctggtagaaaactggatattaaaataattaataaccaaaacgatctttccttttgaggaaatatatcagcaagcatcaattcactaagtggtcatgaatcatctttttgataagttattttgaacccagaaagataagattgtaagtgatgggaagtatgtttaactcacagatgtttaactgtgagttatgtttaaccccggtatgtttaactcacagatcagttgactgactgtctctcgtgctcaaggaccagcttggtgttctggtcaagggagagttgagatgaggatgagagaaagagtcctccttttataggctgttccaaatacaatt

SEQ ID NO: 59625 - DNA, 885 bp, Bovine  19866880990266
tatagttattttaagacattttcacaacttttgatagtatcaaactgtttgaatcaaataaggcaatgaagaattctggcatttggtggttttgctttaatttttaatagtcatatgtgactatatatatattatacatatgtcttaaaatggtaaatattttgaagggagaacaatgtaaagaaaaggtatatggattcacatttttctctgtattgtcatgatatacgtctgtgtattcctacacaactaagactgagctgtgattctgaaaacagtcagtgacatttgttgaaattggggaaggaatgagtgaataaataattgaaagtttgagaaatgagagcgataaaccagtgggtctattgcatttattaataatttagcactaattatccaaggaatacttttaaggaaaaagttctttatcaattttactgactgaagtaagaaaaacatggcactatttccaatcagaaaatcagatttaaaatagtatctataaaataactaatttaaatacattcataaaggggatataagaatcaaaaagaagggaaaatgaaagcctgatagatatgttgatgccaatattttttaaaatgaattttaaaaacgatttactaaaacttgagtacaaaagtaatgtggacttcaaggggtgacaccaaccctaatgtgtatagtctataaaatcttcaaggttcattagacagaatgagagggccactaagttgcattaaacaaaagtaagtcatacatcataaaaaataatgattttctatttaaaatattcatatttagatgttcatactctacattacccctcattttaaaaagggtaacacttataacacgctttcctcaaaatattttttaaactct

SEQ ID NO: 59626 - DNA, 1100 bp, Bovine  19866881033431
ttctacttctgatctttccatacctttgctgcactgcagagatcctggtaatcgctttgaagctgatcgattttgtcctttaaagtaacatcttgcaccagctccaagagggcttcacctttctctctcaccgattttactgatggttcgtgggacagcactgtttgttgaagtgacttgaattacaagggaaaaaacaagagccagctcattcatgtgatcaaggagaatatgagacacatgcattgccatatataagatgattatctcaaacaaagatctaatatatattttataaatcaataaatgtaaaataataaagagaaaatgactcttatggctaatacagtttttttcagagtaaaagtaacacatcaaatagtcctcacacatgcagagaaaagtatagaaaagaattgtatttgggtgaatttagcataatgcatattgctggcttccacctcattcctttcagcagagaaataaatcttaatgttatatgaagggagagaagtgttatcttttgattttgaatcgtaaactcaattgtagcttgagttggatgtgaggtttgggagacaaattccagttgcaacgttgctgtgacagccttaaagtgctatttaaatatatcaagaactcagggagaagaaaaaaaggagaagcagttgtgcttcttacattacactttcaaagacacactgtcaggcttggcagaaaaaccaagggcagaaatagacatattggctggaggaggaaaaagcttccaccaggaaaagctttgaggtaaggcatcacactgtaattcttaaagaccattgctaaacaatttgggtcaaattttaaaagcagactatcccatgtataagctttaataattgtttcacaaatttgagcaggtgaaatgtttatatctacagcatgtatagcaatatctatatcaccatttattttttcaaaaattaatttctaaaatgttttacctacagttggttaattagaatttattttcttaggagtattaagtctcatttggaatttaccatagatgtgcttataggcttttggtaccaaaagataaggagagactctagataaaa

SEQ ID NO: 59627 - DNA, 1907 bp, Bovine  19866881071815
acaagctttgccaatgcctggactgatgggagggaaaccccaaagctgatgaatggatctccccagggactaaggagcttgctgtagagacattcccttgttactattttcataatatttctatcatcggtaaggctgttcatgtttctgaaacttctaaagtttgccattttggcagaaaatggaactaacaaatttgttactaaagcttctgagaaaaattttcttagttggaaatacctccaacatgtcatcagtaacctgaggttacttatctaagtacaaaaaaagattagcctcaaaagactggtagcccatcttcctccaggattggcaagctaaattgcaaaggaagcagagcattaaggtcttactagaaggagctgagtgcctggctttcactgagtgtgaaggttatattctcccacttaaagagtaacatctgctctaccaaaataagtaagagcagatgcttcgccatctagatgaagatgaattttgcattctggattgaatttatcagtactgttgctgccaattttaaagactaaacaaattgttgctgccagtgccccctcctgcagtcatgcttagctccttggtccaacagcccattatctgactgcttccagttgtaagaactggagactagattacacttagtccttgggatccatgagatcagacagggcattcctggaaccagcagtttcttgatcactagagaagggcacagctagaggggctttcctggtggcctagatggtaaagaaactgcctgcaatgcgggagacctgggtttgatccctgggttgggaagatcccctggaggagggcatggcaaccccctctgtattcttacttggagaatctccatagacagaggagcctggcaggctacagtccatggagttgcaaagagtcggacacaactgagcaactaagcacagagcagccgcggggtcacatggtaaactgttcgtccgagctggttattgacaaggaaaagtcatgtcaatcacacaaacccagaacccagagcacatgaaagctttgggagaccaggttctccttccagagatgagattttaaagggaggttaaacttacagccattcaacctcttggctctctgtttgtaaatatccctcaataaaaacagtggcaaagggatcaaagacagaaggtaagaaactaaatgccagccctctgtgcatcctgactgcctggaataagagcagttcaccagcacagtgtctgtgcaagtcataaaattgaaaaatgatgtaacaaacaactacatacataatagattgtaaaatatgaccacattctctgatacgataaattgcttcaaaaggagtgagcttggggtgtttgcaatatgacgtttataatatgctctgtgtagaaactcctgcctgggggttttcacagctgagggcagtagcttgaggggagcaagctgtctactgtctttgctgttccaggagataccccacttctgtcttctgcatacatgataaggttacatttatataaatgtgtaatttaataaagctttctgggcagtaggcaatatgtatgaaaagatttaatgaaccttatactcttctactaatgccaaagaagctgaatggttctatgaagatctacaagaccttccagaactaatatcaaaaaagatgtccttttcatcatagaggactggaatgcaaaagtaggaggtcaagaggtacctggtataacagggaagtttggccttggagtacaaaatgaagaagggaaggctaacagagttttgccaagagaacacattggtcatagtgaacaccctcttccaacaacacaagagaagactctacacatggccatcaccagaggtcaataccggaatcagacggtcat

SEQ ID NO: 59628 - DNA, 940 bp, Bovine  19866881094396
caagacctatcccaaatgagcaaatacatccctaatagatgtattttcataagaaagctccgtagcatttacttgtcctcagtggtacaatggtagtgcttttttttacatcaaaatttaacaatacacaggaaatatcattaaagagtatctctggagatctgtaagcacaaaacgacctcataatgaagaaaacattcctgagagctatgaatagtgccctgagcttatggtctttcatggccttcgatgcaatttgtggctttgtttttttaaaggtcaaagactgttactccccactcctttctgagtctcagcagctgttggtaccgttggaggaattagaaaagcagatgacggccttttatgactcacttgggaaaatcgatgaaattatgacagttcttgaacatgaggcacagtctagtcctctttttaaacagaaacatcaggtaaggaaatttttctttcaggagacctagttaattgaatgcataggtagtaacactgaggtgcatataatgatagaaattcagtgataagagaagaaaacttttaatagaatagtactggcaactcaaaacaaaatcacatggccaaagatgaaaagcctatgcactatagatagaataaaaaatgttatatctctctatatatttatatataggtatatttacataggggcttccctggtggctcagtggtaaagaatccatctgccaatgcagaagccaaggagatgtgggttcgatccctgggctagaaagatcccctggaggagggcatggcaacccactccagtattcttgcctggagaattccatggacagaggagcctggcagactacaatccatgggtcacagagggtcagacatgactgaagcgacttaggcatacctgcatatttatgtagataaaaattggatagataaattttaa

SEQ ID NO: 59629 - DNA, 1173 bp, Bovine  19866881103225
atggaagtttctcacttgcacaaagtgactcagcttaatggtcacagaagtggggctaaatcccagatactggggtccagagcaccattctattccatttcattccaggggctaggactgtgagacttttccaatagcaagataaatgaatttaaggatgtaaatcatgttaagcatttccaacatatatttctttccttgtagcttgttgaaaaaagtcccacattgccatttccttatctcttatataatcaaattttgtattttttaagttacactcacctctcatggaatgagaagagaatttttaaaatttaaaggtaggaagaagtatcgttctggcgaccctctcctgagaacaataagctttttggattagtaaaaggtttttttggatatgagactagcatggctcaatttcagtgcaccccagagttccataatagaataatttaaaatgattatttcttcatctttcaggatctggaagacttgattaaagcaaaagagaaagaggtagagaaaattgagcagaatggacttgctttggttcagaacaagaaagaagaagtctctggcattgtcaggagcacgcttcaggagctcaaccaaacttgggcaaatttagaccacatggtaatgttgcttgtggagagttggccccaagaccgcacttaccatcttgtgtccaaatgtgaatgtgacatgggctttgattttcataaagtaactgaaaaaataatcgctgaatctaaacagcatgtatttatactgttaagtccactttgttaacctttcaaaaagagtctagcttcagctgtttcctataattaacagtattatggacattcctttctcaataatcttatctattcggggtctatcgataccatttaggcacaggtgattctcaaatgtgtatactcaggttgaacttctcccctaaactcagtcagagacagacacagagggaagtcctctatcaacatctccactcacatggccagtagacatctcaaacttcctgcgcgaatcaactcccatcagtccccctcaaacgcacacttttgccgtctcggttcatgacagctctacccttccagcagcatgggctggaacccttggagtcgttcattcctctctttctctcagacccactttccagtccagcag

SEQ ID NO: 59630 - DNA, 1117 bp, Bovine  19866881128273
cttgaagagaaataactcctgttaataattctaattctctgattacatgtaaatggaaactacagtagggcctacttccctcattaatgcagggctactcgtctatgtacatacaggattatctatactgatagcccaaagtagaaaatactcttcaaaaattaagttcttacaggctcacagacaaaattttacttttcctaggcacacacaggaagtaatgaaactcacagcatggccataaacaaggcatgcttgaactaatctaaaaaaaaaaaaaaaattagttcccactgaacaattgagaattgtcctaaactactcatgattggattttagaaagcttaaaatgtttaagtattctaagtcagcttcagtagtgagctcacaatcagttgtatgcaatacaaaaactttctttttttaagcaagaaagctcatcaaaattggttcaacatgattaaagctgcaaaacattttatactccaaagaatacaggtgtatatttcagattgctgtgaaaagctcacagatttacactaaacccattttacacactggtaacttaaggtttaaattcaagataaaagtaacaatgtccaataaactggaaggtattagatactaaacccaggggacctctgacctctgtcagagcggcagggagacttacgatgtagttttgcagaagtagctccactgaatctctccccccatacttgatgatccaagacttcagctttgactctgcaagaaccagcagtgagagcagacggtactttaattctagaaattccattttcattaagtgtagctctgatgtggaggaaacaaaatgaaacctagaaacaaaacaccagagaatttacagaatgtaactaatagtaacagaatggggcttacttaacctgttacacgtcagtattaaataaaatgcaggcacaaggtcttctaaactctggctgatcaattactctcaggaaagctggtttggtttctagctctgggtttaaaggcaaatcacgattgattgaagtctttgatttagttctttctcctgccaagatcgctctcatctgtttcttttaaaagctgtttttgcaatattacataatgt

SEQ ID NO: 59631 - DNA, 978 bp, Bovine  19866881190670
gggattttcccgacccagggattgaacccaggtctcccacgttgcaggcagatcctttaccgtttgagccgccatttaacatgtcagaataggtcatgtgctatgacctgtttggaactgatggatttgccccatcagtttcttgagttttcttgcaatcttagatcttgcttgttatatcttcaggtgactattttaaaatgaacacaatttgcaaatttattggtgataaaaaataaaatttattagttctcattcccatgttaagtgaaatatacttttgtgtataaagactgtaggttcaaactagcaagcaaactgtttaaatatgaaagttgtgcaagggaaaaaataatggattcaattaagatttgctaagccctttattctattttgagttaatgttccaggtgaataactgtacttcatgtttagttaggaaaaccacactggattgtcacactggccctttgctgtccccctgacatcccttagggttgggaacatgattcttgtttgactcaaagctgtcaaaaattaatagcaatctgaattggtggataaaatgttgactgcagacttctcctgcaaaaagtcccccttcagttctatctttgtacctttcaaattataatttatatcatgcacctctgtctgtttagatccatttgatacccaaattcatttctgtgattgattttctagtaagaggatgaaaagttttcatattaatgggtttttatttaaagcccgtaaaagctaagaatttgaaatcagctagatttatattaaatttcctgataggaaatggttttctgagattactagttgcctttttttagaatactaaagctattaataaaccatctctttattacatcttccttcaataacaccacagaatggctataaaatattccaaatatctcttaaaaaggactgaaattgaaacatttaaaaactctgggctttcccagt

SEQ ID NO: 59632 - DNA, 1173 bp, Bovine  19866881194481
tggtgttgtgtttgctgcacacgtgaagatgacattatagtctgtggtctgtaggtcatgcaatcctccttgcaaaattaaattatttagactctagaaactcgataagcatgcactgtgatctctctcaaaaacactgtgtgcagaacatagaaaagggctcctaagactatggctgcgggttaatgactcacaaataaataaacaaagctgttagcactgttctggatatatcactgcagctcaacccaagcttccaccttaggatggcttcttggaggaccgctgacattaaccctatgatggtagatctacttaagagtcaactttgtgaggacttccctggttttctagtggctaaaactctgtgtgcaggggggcctggcttcgatccctggtcagggaactagatcccacatgttacaactaaaggttccacatgctgcaactaagacccagcacaagtaaatacatattttttttttaaaaaagagtcaattctgtgaggagatggaatgtatttgccccaaacacctgtctagccagtgcctcccctttctcaccaatcctgcccagcttcttccagatttcccatcccaattcaccatctcacactcatgtctctattctgcccagaaggaccaattttcaagaacctattgattctttccttctattgttttacactttacctgctgctcgttaagctttttctgtatttcttctgagtcacaggaatcgtagacgatgggtttggccagctctgactcgatgtgggctaaccacgtcctcagactgctcatgttcttatccagctgttgtactgcaaccagagtctccttcagcttctttaccctgtgggcagaaaaggagagatgtcaacttcagggagaggcctcactcatgcttccctcaggaacagaagccagagctgggtctaaacccagagtccagcctggttcagccacctactgtctgtgtgattgtgggcggtggcatagcccttctgtgtctctgtttgcttgtctataaaatagagaagaagtcacagtatttatgaaattcaaattaggtgaataacgatggtgccagtacatgggaaacattaaaaagaatattagccatggttatcctcaacacaactataatgatacaacagttacagaaacctca

SEQ ID NO: 59633 - DNA, 2028 bp, Bovine  19866881350388
tagctatagcgtttgtattttacttcctgctcaagctaagcattggaagattttgtctttaaatggttaataactgaattttatatggcattacttaaattggcatctcttcatgaagaagaattcattcatgtctttaagaagtgtttacttttaaagaactctttcttccaatggaagaacacaatttcaattagtccctcatttttttttataaattatttgctcagttaggacagaacgtctaaaggcaccctagtgaaggtcaaagtacattggattattccattctcccccatccttaggcttagaggcttttttctttcagttttttggtgatagaaaatgagctgggtgttggaattcctttttatctgactccaagaaattattgtttgacttccttatcctcatgtttcgtagcaatagcatctcagaagaccagggaccaatcaaacgccactcagatgctgtcttcactgacaactacacacgccttcgaaaacaaatggctgtgaagaaatacctgaactcaattctaaatggaaagcgaaggtaaagaaatgagaacttgctaacatgggaaattacaacggactttccaaatagtagttgcatatggagacatatctccctctctacctttgaagcagtaattctcaaccttagctaacattagattaccctggagaatataaaaaatactgatgtctgaccctaacccaaaaccaattgccaggaaattagtgtccctaggcatgtggctgtggacactggtattttttgagttccccagttgatgctaatgtgcctccagggttaaaaatgatgactgtagagacatctagtctgggtctaagaaaaggttttatcaaaagtgctgctttttaaaacatgtgaaggacagttaactggcaatttgttaccacatggaattccctttttacctgaaaattcaattatctgtattttaccaaattaaaccatgaattattttgtcttctcggattcagtaaaacctgtctttccatggtatgtaaatattggaacacaatttataggaaatacgatcctttctctcttttattccagtaatttttatttagatggggagtatgcaagacaattctgtttgggtgagatcaagcaagatggatctctttgcccaccagattataattctttaggaaagcttttagacaatttaagactgaagagccagtcaaaggtaatgactcacctgaaacagaagtgtttagcccccagagcacttaactgagtaccttgtacagtctaggccattcctcaccttttctttagaagctttctcatccaagagccttcacaagcacaattctctctttctggtctgcagcagtgaaggagagtctcctgactttcttgaagagttagaaaaatgatgagaaagctctttggagcaaagctgctgacaacttcccagtggtgagtatatctgtgtgttcttatatgctagtaggaatcatctcagtatttaagtaggtaggactcacttggtaaaaaacatcataatgttcttccagtgagaccttatctaagaaggacgcttctacctaagtggatcacagcttagtagagcttgaaaccattcatacagtgttctgatagcgtgaaagagacagttcacaatgagtaaacagttcagtacctcctacttgctcagactcattcctgtcattttgaagaaatattgaaaaaagagactgaatcatactactgagaaaaactggctttatctttgatagtaaagccatgttgctgttattaaagtccagtctcacaattgactgttagcatctcatttaagtataaggaaatactaccaaattaaagtgtggcttgttactgtgaaaataacaagacaccctgggtctcattatatttcttttttttaaaactttttattttacattggggtatagccaattaacaaagttgtgatagcttcagggaacagcagatattgtagttcttaaacataataaactt

SEQ ID NO: 59634 - DNA, 884 bp, Bovine  19866881371437
tgagcttttaactcaatttactcaaagtattccattattacaaaggaggccaactggtgcaatgttttgcttgtcctattcattcaggtcctcaaggtattttccttttctcttatacagttcttgaatttgcctaattttttttctcttgataattcctcaacttattcaggtaactgggatttatattcttgtatgtagattcttcttcctgcttttctccttaacaccagatcccaatgtcttcttcacaaactgtagcttactgttgaatgcaataacagtgccattgattaactttggaaatttcataaactagacacaagaaaataaattcagtcaaatatttctatttcactaaactgttctttcaaatctcttgcacaaccgctttcagttatataggatttatcacaggaattgctggccctaaaacataaaatattacagaattgaactttatcatcctatttcatatcttccttctgtcctacatttaaatttggtcattgaggaagctgctgataatgatgtcatacatggtagaaaaccaaggtcccttaaaccatggtaccttttaatgatggtggaattaactgtttaaaacagtttgcagatccttggagatcaaagtgagtgccggctcttaacaggagcacacgtactcctttgattgatctatggattggaatggaagtgatatatctgtgaagtaaaaactggggcaagattcgttgttcagccactaaagaagctcattttactctgcacagttgatgtggtcttacttgttcagttgatattttggcatggctcacataggccaaatatttcgagactcattttctcatacttttgagcttgcagtatttcataaaggaagt

SEQ ID NO: 59635 - DNA, 1925 bp, Bovine  19866881463623
cacaggcagtagctgctcttacgacattaacacctaagagaaggcttggaatccctgtctcctagcacagtgcacgcacacttctcaaggagagcaggctggagggaggacgagtacaggagggggaaccagcagtgggaggtgggctgcacttccaaggagcctgcgtgccgaggctctggcctccgctggcgaggggagggtgccacgcggggtctcaacacgtccgcagctctgtaccagccgctctcaccccgggtgcccaagcaggacgagcaggtgcagaggcgtggaagctcctccgttctgtggtttccttgaacaagaatgggatgattggtgagtgaggccagcatcctgggtggtaacaacaaaaaaaaaggaaattggtagaaaatgcatcatccaagttggattcagtcagctctgtggcctgggcaggttcccaggatattccagccagacggcagggcttctgagagacaccaggctagaatgtgtgtgtgatgacataagggcagggagaggcagggccgtggggctcagcaggggctgtcccgggccccccaacccactggtgcacacctccctggccacccgttacctccgggtccaccccaaggcactggacatgtgcccttttttctaatgagcacaacctttctctatcagaagcccacagggaacataagtaatccagcaatttctttctcgtcccactgcctgtccactgcttacttatgctgggctctgtttcctttggacaagaacgcctccgggtaccaaaagctacattattctacagcctgtaagccaggagcctggccgttctggttttgttgttgctgtatttgttttgaatattagctgtttcccattctgggcagttacaactgtgtttactatgagttcctctgtgtgggcgttttccccattttcatcctacaggctgcggcgtgagcagtaactcatcactgcgccaccagcacagagtcggggattcataaactggggggcctttaacttgaaaatacccagtgaggatggggggaggggagaaggagaaatatatttatgggagggccagtggactaataagaccgaaaataatgttgttaaatagatgtatgctaagtcacttcagttgtgtccgactctgtgcgaccccatagacggcagcccaccaggctcccccgtccctgggattctccaggcaagaacactggagtgggttgccatttccttctccagtgcatgaaagtgaaaagtgaaagtgtagtcactcagtcgtgtccgactcttatcgaccccatggactgcagcccaccaggctcctctgtccacgggattttccaggcaagaatattggagtggggtgccattgccttcgtcatctgctcccttcaaggggctgtgctttgagcaggacaagttggcttctgcagtgctcacttgatagagcatccatcgctgcagtctcgagacaagactgctccatcctgccttccgtttgctttcaatacttctcacctcttatcactcaccttccttgtctcctgaactcccaacttgaagcgtctggattctttcagttgcaagtcacagaaatccaactcacactgtcttaagcaaacaggaaatttatggatctgtgtgtttaaaaggatatgatggaagctttaaggtcagatggaagaagtagggacgaggaccttatgaggggaaccgcgatttctcccctccctccccgccccctcccccatccacggaactatcacctctggaactatcacctctgccggttgttttttggctccactcagcagggggagcctctcctactgggaaggtggcacttacaagccccatatcctcatcctccaagcacctcccccctagaggaaggaatttgcatccacagcttc

SEQ ID NO: 59636 - DNA, 2322 bp, Bovine  19866881866268
acttgcacctaacgtaacaaatataagtggcagcaaaagcaaaagaactcgaaactgacaactgagtctcagagagtcttacaaagaaaagaaatgggttgattaacattctgagtggagaaggatgaagaacaaataaacaataatcccaaaattgcatagagagaaaaactcacagtcatccattggtgagaaatgaccctttatgtaatatacctgttcactaaagatatagtttcattttttatttctatttttaaattttttaattggaggataatggctttacaatgttatgttggtttctgctatacaacaaagtgaataagctgtatatatatgtgtgtatatatacatatatacacataacgtgtacatatatacataatgcatatattatatatatatatcccctccttcttcagcctcccttgcaacctccacaccaattcccctaaaatttaacctacagtgtattctttacctgaaccttgacgtttttcctttgctataaagcactaaccttggaaacggtcagtatgtcattaaactgtgttttcagttcctcttgagccgtatccgtgagagcctcatcctcagtcttctggtagagctccctggcctttgctgtgagtcgctgcagggctccggcatggtcttccgcctctgatacaacggactgaaagtgatccaggagggaaaacttctctttcagaccaggctgtggttgcaagggatgttctactttttgatccaccgattccatccactgctccaactggtttttccactctagatagtcattccactggctaatcacagattctaaagtgctagaaccaatgtcacatattacaaaagtaagttatcatcacatctctactaaaaaccaaccatgagggcattgcacccatgtaagctcttttaccgaatggtattgtaagtgatgaaaacagtgttttcaagtgaaggggaaaacattactcttctgacctacaacacagcttcttccaaataaaaataaatttatccccaaatttgaagatgtcttagtcgcatatgcatctggagatttgtcttccagatgctaattgccctaaatgaatagacacatatacatgttacattgtcaaaacatcagccagggggcaccagttaaattttatttaatatacattaattctgtattttcttggatttggtttatcctattaaagataatggaattcaaaatgtgaagtattcttttgggtaaatgacataattagattgattttttcacttgcagatataatatataatgtttagcgcttctgtgttgaatgtgtgaagggatgaaggctcagtgtgctaatagtattagaaatatagtcgccgaagttaatagtcaagtcaatagctctcccaatagtcaactaaaaggctctctagactggcatttttaaaatacctccaacatttagctttacaaactattctaactcatcttcagtgacccctcccactctcccttgcatataattctatgaccctgaagttatatctgtggtgaatgtacttccaaattgtttcttttgctcaaaatttcccctttgcaccaatgtacaccttatcatatataccttaaagccctattctttctgcaaataattttctggaaagtccaaatccatctcacttctccaaaagccatccaagccctactcttttccacaatccacagcatcttaggaacacaatctgagtcagaggcttggttgttttatttttattttttttgaatatatcctaccctagcttttgagccccgagagagcaaaaactactttgtttcattattttagcacaataatttgagcactgctacggctcaaaatgcagtttccaaagtgaattccttgctgaaagagaagaatcaaggatttaaatccgcttcctgtatttaacatcttattctaacatccggaaaatattcacccgtattgctattcacttttatgaagctggcctgttaccaagcattggggagttgagttcatgccccagcagtctgatctatagaataacagaactatggaatctgattttttttttctttgctgaccattatgagttgtgatgaagattcaaaatcctgctgactctgtggagttaccacctaccctccatatgcaaagtaaacaaagcacatttttagctgtcaccgtggttcactgtttacactgcagtgagtaactggagtgttattttgttttgtgatgagctctaatcttctgttcatctatttatgaagatcattttgagcacacacttcttccgcga

SEQ ID NO: 59637 - DNA, 1469 bp, Bovine  19866880108811
ctctgccttttctaaaaccagcttgaacatcaaagaagttcacagctcacatattgctgaagcctggcttggagaattttgagcattactttactggcatgtgagatgagtgcaattgtgtggtagtttgagcgttctttggcattgcctttctttgggattggaatgaaaatggaccttttctagtcttgtggccactgctgagttttccaaatttgctggcatattgagtgcagcactttcacagcatcatctttcaggatttgaaatagctcaactggaattccatcacctccactagctttgttcgtagtgatgctttctaaggcccacttgacttcacattccaggatgtctggctctaggtcagtgatcacaccatcgtgattatttgggtcatgaagatcttttttgtacagttcttctgtgtattcttgccatctcttcttaatatcttctgcttctgttaggtccataccatttctgtcctttattgagctcatctttgcatgaaatattcctttggtatctctgatttgtgctcaaaaacttgtattagcctacatttgggcaaaatcatctaacacaaagcttattttgtaataaagtactgcatatctcatgtacttattgaatagtgtattgaaaatgaaagcagagtaattatacgggtacagatgattgtaagtgcgttggttgtctactcctgtgatcgtgtgtctgtgtgactgggagatttgtcacactgcaactgtccagcatcatgagatgtctagcctggcaaaagttcaaaatttaaagtactgtttctactgaaagtgtatcatttttcactgttgtaaagtcaaaaaattacaaatcaaaccattataagttagatatatttggtataaacaatgctcatatgaatatcattgaacatacatcattttgttcatgtctgagagtatctgaagaatgtattctttgcagtagttttgtggggaagaggaatgtgtgcatttgtagttttgatttttgatgcaataaaagttgacttccatagaggttgcattaatttatatttgtactatcactgccatagaacattttcttcttattccccagttaaaatactttttatatttctgccatttgcatagttgaaaaacataacttcattttttaaaatgaaaaataatatatgttcagaaaaatgtacaaaatctgaactggattaattaatttttaccaggtgaacaagtccatgtaagagaaaggaactaatgattaaaaaataaaaataaaaagatgaaacataattggacttaacaaagtagagatatgtgttcattacacccttagtttctctttttgaaaaatatagtttctgtattgtctcattttaaactactcacattcccctttataagcatattacttaatttatttaatattagacccactgtcaaatatttaatgctcactaa

SEQ ID NO: 59638 - DNA, 2507 bp, Bovine  19866880344904
catgtccagttctaattgttgcttcctgacctgcctataggtttcttaagagacaggtcaggtggtctggtattcccatgtctttcagaattttccacagtttattgtgatccacacagtcaaaggctttggcatagtcaataaaacagaagtagatatttttctggaactctcttgctttttcaatgatccagcagatgttggcaatttgatctctggttcctctgccttttctataaaggtgacatatattgtgaatttttgtttttgagttttattttcatatttctgtagaattaagtttgtttttgttacagtcacttaggatcagtttacttttttccaaggttttcctttaaacttgcaggctagttaatctgtagctgcctttgtcctactactgtgggagtttccttataatcatcagtccaaggcccagtgggttattttcatgaaatagtcccagtgctgtgtgatatttgagaattgttttatctgctccttttggatagtttggagaaggcaatggcaaaccactccagtatccttgcttggaaaatctcatggaccgaagagcctggtggtctgcagtcaatgggatcacagagtcaggcatgactgagagaccaacacttttgggtagctattttccagacctcgagcagtttcctaacatacatggttgataattgcttagcatcagcatcaagcgaaacctttagcaagtatcaaaagcccctactctttcttaatgttccctcttcttcattaatctgacctatgggctctcaatactttgatcttttgggactcccagatctgtcttctcgatttagggagtctgccagatttcaacagttttcacgtagaagaaaggaagtagagactaatccagacatggtgaaatcaaagcaggatagatgtgggaatacgaatagtaataagtatgtgaataacaaaactaaagttgtagtagagcaaccatattaggtcagagcagcagatgaagcttgacatgatttgcttcattttatgtggatgtgggctaaaaagcagaaaaccaaaaaccatgaaatcagattattcagattccaactccttaaggatctgaaactagattaattagtacattttaaagcaataataagtatttatcccaaatgggagacaaagcttaatgatgttattatatgcttctttttagcaagttggatttcaaatacttcaaaatgtctctgaatctaagacggttgttttttattttttaataaaaagtcagagtaattataaaataattgggcaaagttaagtcttccataaaacatataatttgatgaaataatttattaaaaaagaaaagactagaaataaaattaattagagcttaacaagagcaaataaaacctgtaattgtgacacatttcacattctaccctaggtaaacattggcttgatgtttgatttacaggaagttgaacataattatttgcactctatcataaacagacttgaaattcttttacagttaatattttataagcacaagtacacatggacacaaatacaaacatgcaacacatacaagtaattaaatgtgattataaaaaaactacattcttcagtttattcttttcccatcttaataattttcacatttgtttcctaaatctgatgtgctgtgaaaaaaataagctttttaattcaaattagcacaaggcagattgattcaagtagtaatttagtatctctagtaatttaatccttccaatagtaacctaccatttctctaataaaagagaaatatctaaacttcaccttcaatatattctgaccatattttacccatctaacaaaatctcccccaatacccaaactaaatatttctctattaagtcaatctatacctatttgttgttgttgtttagtcactaatttgtgtccacctctttgccacaccatggactgtagcctgactagctcctctatctgtgggatttcccaggcaagaatacctgcatgggtcatgatttccttctctaggggatcttccccactcagaaatccaaccttcatctcctgtgttgcctggcagattcttgaccaccgagccaccaatctatacctatattttgaaattattttttcctcattgcttgtctcccactctgctggacatgaaaataatatctatccttaaaagttcagtttaatctaatactctttcatgaaagactcaaatcctccacacatttccctcccttctcaacccctactacaatgttagtggtaaagaacccacttgccaatgcagaagacataggagacacgagttcgacccttgggttggttagagatcccctggaggagggcagggcaaccattccagtattcttgcctggagaatctactggacagaggaacctggccatctatagtctatggggtttcaaagagttggacacaactgagtgacttagtacacaagcactgcaatattagaccacaca

SEQ ID NO: 59639 - DNA, 1219 bp, Bovine  19866880451641
taactgctggggaatacactacttaccctagaaatgccacagtttcttcattagcaaaatggagaaaattatatatgactttctggggttttgtgatgattaaacaaaattaaaccatgggtcttctaatcctgagagagacgcagagagacagaaaaatattttagtgttttcttttctttttcctcttaagactcaggaattttttgaaaaagacacaaatattgtcttcccaaaaggtatgttttaggcctatggacctgaatacattagcaatagttatcttgaaggagaaattatgcataggggatacaccactgactctaggtatatatgaatagcttctcaagaaagggaaaatgtacttatttaaccccaatatcaatgagaaaagaatataagatagtagtctttttatctcaaggttatggaaaaatgctttttagaattcaaattgtatgcctcttataatatataattatatttctcttttcataatatattcagatcattctccagtaatcagggatgctcaacactgccttaagacacagtaaaatcgccatcactggaggtcaggtgtaaagtgtgcatgatccttaaaaagacagtatttcttgaatgtcttaggaggtagacttaatggtcttgaagacctgctctagtcataacatcctgattctatgggttttttggtaagaacttttaatggcttatacaaatagagttacagatggtggaatctcaggatggcagggaatatatcttggagcatgaatgcctccaaccaactacatctttttaaattttacttggataaactatcaaaatatgacacctgcagccccagagatatgtttattttacagttaacaaaagagaaggcaactgtttctgaaagtgactgttttgcttcaagaatctcaatctaaatgtatgtgtctcatgggaaatggagaaagaatatatgctatggacatctgttttatttttattgcatttttgccttttttcaaaataaaacacatcattggaggagtttaccattcccatttccatgtagcttctgataggctgtatttaagtattttgactacagaaggatgcatgtgacccaataatgcctaatcattgtaccccatccccttgctccttctttcatcatgatcagttaaacgatgggtccattatccattgatttccatgagagtcctttcct

SEQ ID NO: 59640 - DNA, 1015 bp, Bovine  19866880456600
ctgcttacttcacctgatttgtaacaaagtcatactctatcatctttaacatcacctttaatattagattaaaagtgcttatactccctgtaatgtatcacctttaaatgcctacaagtattggcataaactctagtaaatatgaggtcaaaatgtaataaagaggatcatttaaaacattctgtttagtgatatgactaatagtagagaagaaatatatagcagatatttattgttgagagaaatcaggataatgaataaaaacaataagtgaatgaaatgaatagaaagacagtttctctaaaggatgagaaaagttctagggaggaaactttcagtgtcttagttacaatagtacatgtcatgcctcagtcttggagaaccagtaagttaacactgtaagcctctacttgctcaatgggctgtactctcaatagttatcatctacaaatcttgttaaagcaatttaagagtggaaaaaaaaaaaaagttgaatcctaggggagctgctattcagaaagagaaggagctaaaatattgcagaagtctgcaaagctaatgagtactctgaggagtggatctccacaggggagtttgtcaggtcaagtcatttactgtgcatcattttaacatttacaccagaataagagtaattatatgctctttctatgtaagatccagcatagggagatgtcattgcacctgagaactgcatgtttccacaactattcttgtaaaagcattatattagtgagcatgacagagaaaaacaacttatagatgtatagaataacttgcaaagtgaacaccagaccctaaattaaaaagtaaagctgcttagagagtatgcaggctttaagttcagaaaaacaacacaaataaaccacttcccatgtctctctctgtccttgaccgtttcactcatgtgctctctttgtggtagtgtcacccatgcctctaataatctgatgttctaaatggtgttgggggaggtttaaactatttattaccagta

SEQ ID NO: 59641 - DNA, 1143 bp, Bovine  19866880910978
atttcaatcctagctgtgcaattgaaataaatatgttatttggagcatagttcttaagctctctatataatggtaattgttgtgaggcaaactctgaatagcagttgcctctgtggtaagtactcagttagcacagtcataacaattgaaaatgtgtactgaaagaggaaaacacattttcccactgaggcagtctggggaggacaactttagaaaccagtcttcacagccacatggaagttctaccacaaagacagatattatctatgcataattggcacctagtttcttttttacaattagtagagcatggactagttaattggttaacagtttttcctgctgtgttcattttcatccacacatgcctattttagagaatttctcagggtatttttttatcattgaaatcatataatttctgatatttagaatttaggcagcagcttaatgaatttctgtaagattcatttccaaaacatggaatttgtgaaatgttaaagtatgtctcattcatttcagaaaatgaaccaccctggtgttgaaattgaatagttgtatccaaaatgtcacaaaaggggccgttttcctgtaatacatcacttttctgtttagattgaaagtgataaagagggcaaggcaaataatagatgatatgcttcattctgagtgcttttttactcaaaagaaaaaagaaaaactcacagccatctgttatctgtgtgtcagtttgttgcaagtgaatgacatttttcttttttatttgagaagaaatttatggaaaagctgagcaaagttaactttaaaatatatggtaatattaataaagtacctatgtagatattaaagcctcattatgttttgcatatctggacttggattaggtctttagctgtactgtgtaagctgcagaacaatcattcctactcaaagtaacgtgaagacttagatggaaatggcaacccactccagtattcttgcctggaaaatcccatggacagagaagactgtcctacaggcttccaaggctacaatccatggggtcgcaaagagtcggacacgactgagcaactttacttttctatgagggtaagagggcttccctggggctcagggtaaagaatccacctaaatcaggagacg

SEQ ID NO: 59642 - DNA, 1550 bp, Bovine  19866881019013
actttgtccccagagcacagaaatgcctcactcttgatctcccccccgaactcgtttcagagagtgttgaagatcagcagtgacagtaacttgtgatgtaatccttgtagaggcagatggaaagtgccaatttttagtttgcaatagtatataaacataattattaataaacattaatataaattaatgaaatataactaatacataataaatagatataaatattataatataaaatagaaaatgaaaattagttatcatatggtttattgttattattcccaaactcctctgtccatggtagtcttcaggcaagagtactagagtgggttgccatttctttctccaggatattttccttatccagggatcaaacttgaatctcctgtgtctcctgcattgaaggctgattctttacttgctaagccatttgggatgcctggtatgatctgattttgtcaaataagaagttggaaaaaagtgaaagtcttagtcactcagttgtgtcccactctttgtgaccacatgggttgtagccctctaggctcctctgtccataggatttcccaggcaagaatattggagcaggaagctatttctttttccaggggatcttcctgacccagagatcaaacccaggtctcctgtattgcaggcgggttctttgtcttctgagccaccagagaagcccaagtattaggaaggaaagagcaaatttaggcctccataatctcttttctcactttacatttaccaagagtttccttggttaaaaacaaacgcagttagaattttcaatagatgcaacattttaaaaaacctaaaagacagcctaaaataaaataataaatgtcaagaagatgatagattcatgagagcccttaatccaaatggtaccaaattccgtttatctgaaatgattcacagtcaggatcaccaggctgtaacaggtggctacttttaagtacagatgctaaatgtcatacctgcagatggttcatcagtagaacatgtaaaaaaacatcttaattatatattatgaagccttttcataaaaaattaaaagataggcattcattatgcttgtttgagttatatcagtgagtacagatgctgttatgagttagctggtgctttaatcaaaacaagtatccgtggatcaatttaatgatatgaaagttctgacttcaggttggaaagtttctggcaatgcaaatttcttgcaatttcctgatttatgaatcaaagcagaggacgctcctccaccaaaatcccacatcaatttgtgttaaagaaaaagatactcagcctatatccttaaatagaagcattccagattgacttggaatgcgcccacaggcatatcacacctgaagcctaaagctggaaacatttaattcctcacacggactttaaaatcattatggcaggtttatcaatgatcacaggtcattcattaacacgtgtttaatagtcaaatatatatatatatattttaccatcattagccaatccatacaacagacattgctggaatgacttaactacag

SEQ ID NO: 59643 - DNA, 943 bp, Bovine  19866881053782
taaattgagatagtgcaatgattcttgcaaatattcatggtgctatattaatttttctgatggagtggatatatggaattttgaaatatctgagtgtaaaagtaactgctgttatcgaacttcttgcattcctttatggcctgacaatgtggaatctctggataagaacagacatcaattgcttgcacttccatcttcaggctatagaatcagttggatgttatctttacttctaggatagaaaaactctaacgattctctgccatactatgtagttaagaacagaatgaaagaaaaagaaaaaaagggagagaggaaggaaagaaggaagtgaggcaggaaggaaagaaagaaagaaggtagggaggaaagaaaaaagcagagagacaaaagatttttaacttatatatgagacttttatcaagctaattgttctcaggcacactgactctcaggcaagagtcaccttctatgtgtggcagaagaattactaatcatcatgccttttgaaatataaatcaagaagcccctgagaaatcctaaatcattacctgactacacacatagctgtaattaatgactgtttgtaaaagactctagagatgaaaagcaccttaactggagtaactctcaatcatgcagatggataaaatctaaagcaaatggaaatattaggatggatgcattattttactagagtaacaggacattaaatgcaatttttttcccctcttggtatttcacttggtgtttcaagctaaaaacaatgtgttatgcattctaaatagagctatgttcatgtcccatgggacataataagaaaaaatctgtaattgctcgtttggctcttacttcccttaaaatacctccagtctaagcaagaaacagaaaattacattgaaaggaatttttttttcttttgaaaggaatttgtaggagcaaa

SEQ ID NO: 59644 - DNA, 930 bp, Bovine  19866881191175
ttcttctttagggtatattctgacccggaatattcctgagatcaacccaggtctcctgcattccaatcagatgctttaccatctaagccactaaggaagcccctacaagctcgtggtttctgtaaatttagttttgtgtgagaaaaatcaagtacaaacatataatggcatagtttggagatgataaaataattcacagaatgttctcttatgcagcatctgtatgttctgttgtctgatattcttttgaagaagaatttctaaaaccagtagtattctgttatactcatttgtcatatggatgcatatgaggaggaaaattagatttattattttagattgttttaaccactgactcagaacagcttggaggtaggacccctgagtttttgtattagcttcattaatagtgttctgggctttcatattttatcatagaacagagtttggatctgttacagaatttcatttaccaaatggaacacaaagtactgggggcaggattccagaaattgggaaggatctggcaagatcaattcagggatgcaggtgttgctggggtattagacaggttgttggatgaggaatttagaaagcagaccaaaatgaaatagaaacccagttacatgagctagaagcagatggagagagattcaggttcaacaattggattaggaaatgccaatggaggagtcttgaattctaacaagaacattattttggggatgttgtgaatcgaatagatgagtcaatattgaaaaaaaactgaaaagggggaaaaatggtgaagaaagccacaatgacttcatccttctaggttatataactaacttatacagacagcttgggtgttaggaactttgctaagaactttacatctctcaccatgttgatttgtctaatctaccggggtaggtatgtgtgcccctt

SEQ ID NO: 59645 - DNA, 863 bp, Bovine  19866881342736
cagacaaaaatagaaaaatgcatatgcattttagtggagaaggaaatggaaacttagtccattcttgccttgaaaatctcatgaagagagaagcctggagaactgcgttcatggtgtcacaagggtcagacaagataacaactgaacaacaaatgcattttaaaatagcagttcaaatacatagtagatacatattgctaatattctgataatgtctaatgcatgcatgattgatgaactccttccagtttgtggcctctcctcaggagactatggactttagagtagaaaccatgacttaaggaatacaatttccaatttggaatttcaatgggatttattatctaaattaattgacaatccctaggttatggaaatgcaattgaaaattagtactttaaatgattcatagaatgaattaccttttcagcagcaaaatgttatcctagggctgtaaaaatatataccatagtttcacaaattattttttccataaatggctttgtattaattttattattcaataagtatttatatttgtgtttatgaatcttgttttgctgctgtattttagaggtataacaggaagaaaagttgttactattaaattgttcttatagagtttataatcaattctgagaagatggatctgattttcatcctctctgatggctcaatggtaaagaatttgcccgcagtgcaggagtcacaggtttgatccctggtttgggaagatcctttggagaaggggatggcaattcactccagtattcttacctgggaaagccatggacgaaggagccttgcaggctacagtccataggatcacaagtgactaaatcactacccaccacctgggataa

SEQ ID NO: 59646 - DNA, 655 bp, Bovine  19866881805115
tttggagtctagaaatcgctgatggctgtgacatttccgtttattaatatggcaggagatatttttattttacacaggattcttgctaaaagtgagtaatgcaaagaaaccttggcttaatcaagaagggggttcagaggagcttgactaaaatttggtcaaggtaagtgtctttgtcagtaagaatgtacgaagtccagagagatggcagcagtgacaggaacaaataccaagtaggatgatactctaaaattctttttatatattaaaaattactaccactgacttctttctgcttttctgtttcttttcttccattccttcaaaaaaaaaatttttctatgttaagcttgaatctcatccattggttcacatttactttataggtaattatgtttactggcagagatgttatgccttcaggcatcaaataattttaaattcaaagagtttgggagagttagaaaccaatgggactaactactctgatgaggtcagagcccttagtggagaacaatattgatcattaaggaaaagctttgctatagttgctcttgaatggactgaattgctcagtgagagattctattgaaaagaagttgtcagagttgctcaaattcctctttcttaattaggcctttgaatttgagctata

SEQ ID NO: 59647 - DNA, 1759 bp, Bovine  19866880171556
ctattgctattgctaagtcacttcagtcgtgtccgactctgtgtgaccccatagacgggcagcccaccaggctccccctgtccctgggattctccaggcaagaacactgggagtggggttgccatttcctttcttccagtgcatgaaagtgataagtgaaagggaagtcactcagtcgtgtccgaccctcagtgacccccatggactgcagccttccaggctcctccatccatgggattttccaggcaagagtactggagtggggtgccattgccttctccacagggagagtgtacattacagaaaatatacaaagtatcaaagactggacaaggctattgcattataatggaaaaggaacttatactaacagtcagaagtactggattctaattctttctgagttcttcataggttgagtttccattatgtagttataaatgataaggtcaatctcagcatgggcttaggctttattctgcactacattatttttgtttgatttctctcataaatgtggttgccatcaccactgaaacacagaaagctcagcagctaattctctggcctggagctcattgagttccaggctcctgtagccaacagtctatatgacatcttctctggtgtatctccaaggtacctcaaatactgctgttcagaacaaactcatgcaaagcacacgtacaatctctactcctcttgtttcacctcctcccaacatcccctacaggcagagggtgaaaccatcccatcttttcccagaccttcatgtttcactggatgtcagcaccagtcatttgcctgtgagagatgtcgtccatctcctttccctttctcaccttcacaacccaattgatcccacatttggtccacctgacttcccatgtggcctgtgcaagtggccatcttctctttcctggatggctacaattacctcattcctggtcctttcacacctgcccttgaccctttgcggtgcactgatggtttaaaagacattaaaaagctaacacaatattataaagcaattatcctccaattaaaaatacataaatttaaaaaatatgtataaaaagcaaaaaatcctatgataaaccattatggaaaagaatagtttaaaaatgtgtatgtaagtataatcaaatcactttgctgtacagcaggaattaacaacattgtaaatcaactacatttcaaaaaaaataaataagaaaaaagacactaaattaaaaaaaaaaaccctgtatttcagaaattgccccatgtgacattaagttgtgttggataatggtgcagagcagtttgagagaaataacaaccagtcgtgtggaattccgttatttgtgttggatgtttttaatgagaaaatataatatggttcagtcacgccttttcctaaacaatcccctattccagtttattccaccttctatattaactatacatcttatacatccctcagttacatgtgtgacttcattttatggctgtgtatatttgtctacttctatcaagaggctgtgagctccttgagggccatgattgtgtctctgaatatttgtgctggcatgcccagcttgtagctgactgttggcacctgttcaggaactagttcctgaatggagttctacctgaataactgttaatctcttatcccatagcgtggtgtatttcattatatcttttgcccccatgaaacaagacaagaaataccaaatgttgatacatctttagaaacagaaataatgaaacaaaa

SEQ ID NO: 59648 - DNA, 4001 bp, Bovine  19866880523502
tatgatcgtgggcagaaagctttgtaggttctttaatgtatgaacatgccaggcaactgttgacttggcagttactttttagaagagacaagttgtattgtgaatatccagatcatcttaaaaggagagaaagaatgggcttgctgaaggggatggcatctgagttgaattctgaagcatgagaaagagctagcaggctaagattacacggggacaggtattctaaacataggacacagtgtgtgcaaatacaaggaaatgagagaccaaggtgtcccgctgagaaaaatagttctgaaacagaaaactcaaagcagttcagcagaactagagaggatagggtgagggggtggggagatgaacctggagaggtgggcagaggccagataaggagggaccttgtgtaagtccctgaagactgcaatttatttcctggtgaaggaggagccagttgaagatttcaagcaggaaagtcacaaggttaagtcttacagaaagataactttggaagtagagtgagccacacatctaaatgaagcagcacttgagaagacctgggaatgaatgctatacttccaaggtgtatagagccgagaaagtgcctcatgtgtgagtaagaggcactggctgagattcattacagccttctttgtaggagcaaagaatcagaaacaatccactcatttttaagaaattgaatatgtcaaatgaggtagagttatttgaatacatgtactaacgtaacatactaacataattaaatggtgtgaatttgatttttctgtagcagcataaactgaccttaaaataatgtcaccctcccaaaaatgaaaattttagcatgtgatcatctatctaaatttaaaaaacatagaaccaaataacatatgacatgtgtgtaagtaaaaatttttaatgaactggaaggctgtacactgatttcatgataatggcggagaaggagggcagagaaggaaatatgattgaataagggtgatgggttaaagaagcttttgctttacctgaaatgcagtagtttatttttgtttttaaaggataatataggattattattacttatttacttttcttaaggtataattagggggaaaaatgaatctgatagcaaatatcacacagtgttaatagatattgattctgagttgtgagtttgttaaattatactttacattgttctatacttgaaaagacaattctctccttttaagtagaaaagaatactgcacgtgtgtgtgtgtgtttaagcagtggcctgagaagtgtgagcgccaatagtatgatgactataaagccaaggaatgtgaaagttcaagaactgtcaacagggtcaagatgagaactgaaaagagttgaattaatttgtgatttagcaggtcgatggtggccttgatgtgaatgatttcagcacagtgatgttgagtcgaagtctagggcagttgacagagtaagtggaagataaagacatgacaacaaattccatttgttttcagaactttgaccataagaatgaagaaatagatggatttgtacctagagagggatgtcagtttaagaagaatggttgttattttagaaaaacttgatattgttcatctgagacaggaaaaatatgagaaggaggtggctgaaggtacatctaagagaggagataactgatggggcaggagaaagaaggaaggaatagaatctaccgtgagaaggtggaaccctccccggggagtggaagttgatgggtgtaagcagaaactcagggctctggggagagagggctggaatgattttgaggaagttcagatcaacagcttcaatttttttaaaatcaaaatgcaaattatagttctgcctttactgaatattgccacttatatagaataaatattttaagatatgtactttcatgtacataggtaactgtgcaactatttttcttatcattattagaaatgatcaaaagtagtaaaaatattatcctttgggcaatgagatcacttttggtttctgcaggtataatgaatattagaaagaaaaacaaattaccaagtaatgtagatagagatatggttttaaatgaagcatatgcccatagagcatggaggttaggtttacttttcactgatagatcatggaggaaattacatcaaagtaatatgttctgtcctgtcctaagcacatgaaatacttcatagaacttgatcatggcaaaacccttaagggatctgttgccctcctcttccttccctgccctgctgaattaatcttgtatttcacctaataaactaggttggtggatattttagcttttttttcatgacattttctttttaaataatgcaaacatacttgtaaatactgtctgttgattttattcattcaagaatactattgggatttccctggtggtacaatggatgagaatctgcctgccaacgcaggggacacggattccatccctggtctgggaagattccatatgcctctgagcaactaggcccatgcacacaaatactgagctcacacacctagagcctgtggtctgccacgagagaagccactacagtgagaagcctgagcactgcaactagagagtagccgctgctcactgcaactggaagaagcttgtgtacagcaatatcaaatatataaatatttcatatatttatcaaatatataaatcaaatataaaatatataaatcagtaagatcaatgccatattataaatacaatgctaatgagctcctgatatcagtatctcattattgtaaaaaattaattttcataggattccatgattggaagaaatgttatatggcttctgctcatctatttcagcttccatccatcggattagaatgaaaacctggagggatatcaggaccccagtgagagaatagaaaaaaaaaaaaaaaacagcaacgttttcctctttctctagctgaggcaatcatgtgtgaccgattgctcactgatgaatgtgctaagagcagcagtgaggttttttttgttttgtttttttggtgttcatttggcgaggagtgactgagcatatgtttatcaaataaatgcaaagttatatagaaaagggttacctcctttgtcaaccaggagcttccagtcaaataagatacaaaaccccccagaaatccagtaagatgcccaaataccccatacccaaggtaaagcagaactggttttgtagtcatacagcaacagttacttgtttgtggacatatatattgctataaagacgtatacttgacagagagtcaggtattccattggggaatcaggaagtcttttctccttattttccccttcttagctggattacaagtaggtacatggccactggttttactctatgttgagagaggagggagtgtaaattatggttatgtcagagcaaggtgagtgataaagctttactcatggggagctgatgtctgcagataagtgtggtgtcagaccctccctgtcctctccatactctgactcatcagctgtgcttattatatctgttcatagcagcttatttgtgctaaatctgattggttgtatcatattaccgatattttgtggtgctggagaagacccttgagagtcccttggagagcaaggtgatgaaaccagtcaatcctaaagaaaatcaaccctgaatattcactggaaggactgatgctgaagctgaagctccaatactttgactgcctgatgagaagagccgactcattggaaaagaccctgatgctgggaaagactgatggcaggagaagaagtgggtgacagaggatgagatggttagatagtatcactgactcaatggacatgaatttgagcaaactcctggagacagtggaggacagaggagtctgacgtgctgcagtccatgaggcggcaaagagtgggacacgactgagcgactgcacaacaacattaccaattatacttttgactttccctcacaaaaccctgcactcttcag

SEQ ID NO: 59649 - DNA, 1189 bp, Bovine  19866880566914
actcaagtttttccataccatcttatgggaaaccccgaaggaattctgtggttaactcaatactttggtcttttctactcatgcctcaactgactttagttctacagagcctgaaggcaaacacaacttactattgtgataattatcttctaatgagcacataaatccttctatttaactgatagatatgactttagaacacatcttcatcttattatcctattactgttatgaatatgacaaaaatttccccagaaataaaaataaaattaagctttcttgactgactattcattcattcaacagatatttattgaatgcctattacacaggccaacacatggatacagaggatgaatttctctggctgatgggccaacccgaggtcctgaagacattgtctctcccagaatgtggacacggtaaataatatcatcagtaatgtgaaagagtttgcttaagagcagaaggagggtagaatctgaagttcatgcttgagagactagacttccaataggagaagataaaaagattaagaaaaaaagaagagctgtttggtgattgtagatcataatcctgtatcatatatttgaatgctgctaaagactagattgtgtatgtgtgtgtgtgtgtgtgtattgttgggcagttttattttaaatttaattttaatttttgaacagctaatacattcacatgtttcaaaaaccaaaagacctaaaaatgtacctagtgaaaagttctccctctgtctctttccctcatctgtcaatctaagtaagagagtagatcttaaatgttctcaacacaaaaaacatggtaactatgggacaggatggaggtggtggctaatactgtggtgataatcatgtggcattttataaatgtatcaaatcaaccgaaatgggaaggaaatacaaaaaagaggggatatatgtatacgcatggctgattcattctgctgtacagcagaaactaacacagctttgtaaagcaactgtgtgtgctccgttgttcagtcatggccaactctttgtgacctcacggactgtagagcccaccaggatcctctgtccatggaattttccaggcaagaatgtttggagtgggttgccatttccttctccagcaaagtaattatactctgattaaaaaaaatcaattaaaaataaataaaaacattatatac

SEQ ID NO: 59650 - DNA, 1476 bp, Bovine  19866880708907
tttggggtgagaatgggggcgcagaagagaactcttgttttggtgaaatggatccgcccactcggtataccaacattctccatctgctggctcctctacttttccactccatttgactcccccacctgcaaggtcagctgctccaaggagcaatttataaacttgcagctcatattgtggttgctgttccagaactgacatgaaattaaatcagtcttgagtgccgcaggatacaaaagctaccttccgagtttacggagccctccacgactcctcataaatcttggaaaggtagcattccaccagtaactgcccagtttctctgctcacaaaaggaccttgaaatggaaacaacgggagttttctttgaggccatatttcataccacggagagaaagatgtatgtggaagccacattcttaaatgcccttttccaactctaggcgagcactggggaagtcagtgtgaaataaacccttaacttatgcctccatgttcaaaattatgggggccacaggatatgaaaacacccacaaaaaatctgtctgtactcacaaagtttctttattgtttttcaagagcagaaggtaagtttttaaaaacgcaatgagtctagaaacatgcctttgctacaaatgtgtcacccctcaatgtccagagactccaaaacttattactgggaggctcatcagtagactgagaaggaagcagatgctgtcacgtggtcctattgaatctacccaatggtaactcattcatgtcctttttaatgttttaaaacttggtcttaaacgatgaatcgaatctgccttaacattgtgggacacagtctgttactaagtcctatgcaaagtgtcttttaggcattaacatttattttccccaaagctctctgagcagagattattatgatcccctgtgatggttaattttatgtgtcagctagctcagccatggtacccagtttttggccaagcaccagttgagatgtcactgtgaaggtatgttttagttgagattaacacttaaatccatcgactttgagtaacgcagtttaccttctgtaatgtgagtgagctcttctaatcagttgaaggccttaaaaaatgactaaattccacccaagaaagagggaattctgcctccagactgcttttagactcaggctgcagaatcagtcttccctgagccccaggcctgccttgcaaatttcccactcaccaacccccacaatccatgcaccagttccttaaaataaatctctgtataaataaatggatagatattatatctatagatatattgcattatatatatggaaagaaaaagagagagttctctggagaaccctgactaataatctctattgtacaaatgatgaaacaaagtctcagacacatccaataatttgccctcagccacacagctaggtagtggcgggcagagtatgggggccatctcttttgccgggccatt

SEQ ID NO: 59651 - DNA, 847 bp, Bovine  19866881016558
aggatgaagattaccacagttcttttcaagacaggtttaagaaacagcagttagaacaaaggaatagcaaatggaattgtgtattgagggcggtaaaggcaaaaacacacagcccttaagtattagttgtccaactgcgcaatggattcctgatggtcagatggggggttatgtgacttactgggtctacattccaatttgacaagagtgaagaaaaagcagaaatatgattctgatttcactatatgtgaaatcatggttcctgtattctatataaaaggtagactctctgtttctcttcatattttctgccagtcactatgtacagggattatccttgctaataagttcaggttggactttacctcgaattatctgagtgggtagaaagctcatttactagaacacacattgtaatgataaggagtaatatgtgtaataactattaagctagaatacaaatgtcaatactggatccctgcttaataatttacagtagggaaatgcattcgacaatgaagtattgaattagatcctaccacttggtattaaaacactgtgttgaaaaactctgtgcatggaaccctgtgtgctgtgttcccaccagaataaattccccaccttcaggctgttcctaacacacctgatgtcatgttgagatgaggccccaattaatagaccttctgttatacatgaattttactatatgtagcgtctgttatttctgtatattttgtttgctgctgatgacaataaatgtaaaatctatatagtcaccccagggattattgtgtaagccttctattattaatacatttatttttagattgcaaaaacacctccatca

SEQ ID NO: 59652 - DNA, 948 bp, Bovine  19866881084816
ataaaataaacttacatggtagtcttgggaggacttgtcttctgtggagggcatcacgcaaaaatctaaaagtacctttgagagaaaaagactggcaaagctattgggcaggagactagatccaagacggaatttggtcccatttctaaaataatacccacgatattaccttccccttcctttgcttcttgtacctcaacgtcttgtacactatgatctaagtcattcaggaaaaaagtctaaaacatgaagaattaacacgtaccactgcatgcctcagcaacaccaagtgatatagaaaaatacgcacctgagaatgaaattgcatttactaaattttaggtaagaaatattccatttgctttgcctaaaacttgatgtctttctgggttcctagaaaatatgtggatgattgaggattcctttgcttagcattttctagtgataacttaattgtctctaaccgagaccttccagctgagtcctgagttcttcccacagtctaggttgcttcttctgtatctgatcctgtacctgatcctggaatattatgtttgcttctgtacctggcttactgagcaacactgacaaagttcacatccaaagtggtgtggacaggatgttaggccacggatattataatgacaaacagttggacgccctcgagatgctcagttaagggagaaatcacttaagagttaagcgttagatcctcccctgggaagtgtagggacagatattttttgtgggggttcctgtctactacataaacaatttgagtaaccccaaatctgtgtgcttggacctttctggtggccccaaatcatgatcctgagaaagaaattctgcccagtcagtctgccctcctgaaaccagatgtggacacaaagccccaggtaaccccattaatgggtcccttaaagttcctgggacatctggtcgacccca

SEQ ID NO: 59653 - DNA, 899 bp, Bovine  19866881105649
ttctcccccatctgtaaaaaaataataaacacaattcttaaactttctgttgtgtgcaacaacagaactaccagttgaaattcgagattattatgtttaggagaaactgattggttccaatggaatcaatatgtgaactgaaatcaatccaatagagtccttgttcattcatggaaattagaaatgtgtgcaaattcaaggatggctgttataatcactgttctgactctttatctaaatgctttttcaagaaggtaggttttgaccttgatttccccctgaagtcatgaaggggcattactttcaaagctggtcatgctgtatggagatacccacattcacaaacatacaacagcaacatagtactgggagcatgacactttacctttaacccaggcacacatcatgtattgaattaaactacaaagtaacatgtgtcagggcttcccaggggctcagtggtaaagaatctgcctgccaagcgggagacagtgggttcggtccctgtgttgggaagatcccctggagaagggaatggcaatccattccagtattgttgcctgggaaatcacgtggacagaggagcctggtgggctacagttcattgggttgcaaaagagcaggacatgactgcacaactaaataagaacaacatgtattaagtacattaataagcacgggctctgtgagaacatcacagatttgcatctttctttactgccatctggttggacaggataaggagatgtttatgataccaagaatgaaagaaatctataacaggaagtaaaaaagagcccatttatctccaagatcctatctttgtaataggaggctagttctaaaagctacccagacatattttctgttaaccctatcagtaaagtccatctaggata

SEQ ID NO: 59654 - DNA, 902 bp, Bovine  19866881481060
gcctggagaattcctggactatatgtagtcctggggtctcaaagagtcagacacggctgagcgactttcacttcacccctgtcttgtccaaaagtaaaatattttcattttaagttacgatgaagtgcaggttaatctgtgtgccctcacttttcatgagaacacgtatgactactggacccactgatgtgaccaccactgttgcaaaggtctacaggcttttgcaggcttttgtacagcatgtaagcacagtgtcttaaggccctgctagtaaatttcaagcccactctgactgtagtcaaagggacaacacacagacttttagatgagtcattaaaccaatagtgattcgctgccctgttgtccttcagattggtttggcagttggtgacattgctgaggtccagaaacatgcactgttgaagagaattgccatgcaggtaagtgttctattccatcatgacttactgaactcactaatgacttcccaattattcatggataaacactgctgatttctgagaacacagttatttaatacaggcattgtctgagccctgagaggcaccccaccctgccggttctttgtgtcagtggagcattcctgctctggtctgagagtcagtaatcatgaaaaagatttcccccaacaacctcagcagagaaactgggtaattgcctgagcctctttctgtgttggcatttggccagccaggtagttagaggctggaccaagaacgtcagtgattcttgtcaataaatcccaaatgtactttaggtggaacttcacaccagcttggagaagaagctgccgctctggttcctacacaaagttgatcagaaatccatcatcgtgtatcccaacagacccagatacagcagagggatattagtaagtacat

SEQ ID NO: 59655 - DNA, 624 bp, Bovine  19866880525280
ctgctgtgtgtgagcaacctgctttctttctttcttttttaaacttgtcattttacattgcagaatagccaagtaacaatgtggtgatcgtttcaggtgagcagcaaagggactcagccatatatatacatgtatccattctccccaaaactcccctcccatccaggctgtcacataacgttgagcagagctccctgtgctgtatacagtaggtccttgttggttatctgttttagatgtagcagtgtgtacatgttcatcccaaactcaactacccctcctcctaatttcttaaactctgaccttttgttccacacaggcaggtaccttctctggcagtttttgggggatggaggagaattttgcctagagagaacccccgaactgcagatgttccccagttgttacagtcctagaaaggaagagccagctgccagctgccccgtgttcaacctgggctgtggctgtgattgggttctgttgatgtttctggagcactgtcagagtttgccagtgtctgactgtgcccacagctcccgatggggagagaggaggttgagaacccccagtcatcccccatctgggtgttctttctgcctggggcagggactgctttgacacgtt

SEQ ID NO: 59656 - DNA, 1677 bp, Bovine  19866880957792
taaatatatatattttaaattctcccttgggtcttggctttgaaaagaacaagacaggagacctcatatggtcactgtgcagacatcctcaaaatgtgccttttgcattttgttgctaggggtttctgctcacctttacccttaacaaccctcctggtcaggctggttgtctcttttgttctcttttgtcacactgctcaactcttaggaaatccctttacctcgggggttgctaaataatgaaggaatacgtccccgagtttttactcagcttttacataaaggaaaaggtctgactgtgtcagcaaaattgctcagtctgtgagttagaaatggtatcttgcatatttcccgttattcaagaaccaaaatagtatctgggaagcccccattaaatgctgcctcctccatacccctagtacttcagctcctcacttcccctgctgcaccaatggaggggctgtgggcagtgtctgttgactttttttttacacatgattacttgctcttgatgtttgatctctcacacattcgaaggcacttggcacgtacctctttagtttttgttctgtcttattgtctctctctctgtcccctctccttccctctctgggccttctaagttatttttttacctgcctccaacccaacttgcactccttaagggcacagcttgctgctgctgctgccgctaagtcgcttcagtcgtgtccaactctgtgcgaccccatagatggcagcccatcaggctccctcgtccctgggattctccaggcaagaacactggagtgggttgccatttccttctccagtgcatgaaagtaaaaagtgaaagtgaagtcgctcagtcgtgttagactcttagcgaccccattgactgtagcccaccaggctcctccgtccatgtgattttccaggcaagagtactggagtgggtgccattgccttctcttaggtttctgcttatgtttatgtatgatcttaatatttataagtagatacagtaagtaggtattgaaatagtgcattaaatttagaattcaaacagcctaactcacataccctgcaaaggagaaacctatgcccagaggattaaatgacctgtccaagctatataggttcagatggaagtaggatccatttctctcctcaaggtttgggagctttgtgaaagattaatgtcaaggcaactgagcctgaatggattgtgttccccaaagttacaactcatcaaagttcttgaaagtgtagtcatatcttctaggactagggactttcagcctgtcatttcagctgtctctctgtttggggttggactgatgtggaggacttctcttgttctttaattagctgctgagattagggaacgtgcacctgggcacaggaagtctctgttctacttgtaaaactggtaggttggctttttccttgacctgtgacttcagaatgtccttccgtctcttgggtgctaatggagacatggagccatgtgctggggacaaggtgaagggtactggataagctctggcctggcaggcagaaagcagcctagccagggcccttgtgagtggtttgggggaattggaagtagaagaaaggacatataatcaggtgccagaagttcatagataggtcatttgggcggtagggtggcaggaaacagtagtcatccgtcag

SEQ ID NO: 59657 - DNA, 733 bp, Bovine  19866881100018
tgggtgtgccccggaaggaccctgagtcaaagagattggccaaagacaacccggaaactaaccccatcggcatcagacccgagactaagagccacatgacacagcagttctcctggttcccttgccctcttgctctccacccaggcatccctttccaatagaggctcttgctttgtcagcatgtgtgtctcattggacaattcatttccaagtgttagacaagagccccctttcaggtcctggaaggggtcccccttcctgcaacagagggagaaagtaggcacaaaatcttgaaggcagtatagcctcaaagtgctaatatccattattcctgagtgattcaaaatcacatagaataaaaaagttttgctttgggtgtacacacggaacatatgatttatctatgtaaaaaactttgttcctcaaaagagactaaaaatgttgcaacacttacttcaactttactaagaatataatgtacaaaggtgcagaactagatgtgttccctagaacaaggttcctcaaagacggagtcccagagaaaagactcaagaacaatgacactccagaaaacctcgtctaaccacttcagtcctcactgctccctttccctcagccacccaaaatttagagactacaccacacactccagcattttcagtagctattgtcttgggggggtgcactcgtttcccgtgtggttggtcacgtcaactgggagggcaggatctga

SEQ ID NO: 59658 - DNA, 1569 bp, Bovine  19866881426636
atctgctcatgattttggagggcaggagtctggaactagggtgttagccgggccacactccgtccagcggctgtcaggagaatccttccttccttcttgcagcccctgatggcaccttgacttgtgattacatcactccaatctctacccctgtcttcacgtgacagtctcctcctctttttgtgtctctcctgtgagtgtcttggtctgaggacacctgtcattggatgtcaggtgtaccagtataatgcagggtgacctcattttgagatccttaacttaattacatctgcaaagtccttttttccaaataaggtcacatttacaggtttctggggttaggacctgggctgtcactcaggtcactgcaagggtggaggagacaagaagctggagttacacgaaaaccttttttttacctggcagggaaaggaaacgaggtgctatggagagtagcttggctgaaccccttacatgggcacctgcggtattgctgtcactctccctggaagctcttggattgaattgctagctccacagggagaggactgaggtggcctgaccaggcctggtttcaccagagatagttgatgagacgttatctcatctctgtctaacttgttcccgtataatgccctgttggtcttccttccataagcccctttacttccttctctccttccttctagatgctttctcttcagtgatttgctttcctgtggtactgttttatccccatcatggacagtaaatgaagcagaagtgtgtattttagtaatcttaatatttatcaagtaactctctgttgcttgtcatctgagctgactcagctgatgatggtgctagagcccagcagtgaccttttccctttgacctttctccttgctaggctcttgatatttggccacatgctttgggatgtgattctcagaggcattgggactgcacaaagcatataccttcaaatgcttgtgtctgcttttccttgccaagagcacctattattattggacttggggagaagataggcctcctgagaccttgaatcacctactttcattggacttttcttgatttcctgccagatctagagcttaagccatcatagtagtagtgtagtgttaattgatcagttgtgtctgactctttgtgagcccacggactgtagcctccaggactcctctgtccatgggattctctaggcaagaatactggagtgggttgccatgccctcctctaagccattatcagtggttaaattactttgttaaaatggagatccccccagtggataagaatacttctgaaggacttaaaagcccaatcagcacttctcaaataatactgtgtgttagttgctcagtcgtgtctgaatctttgcaaccccatggactgtagcctgccaggctcctctgtccgtggaattctccaggcacaaatactggagtgggttgccatgtctttctccaggggatcttcctgacccagggattgaacctgggtctcttgcattgcaggcagattctttactgtcgagccagcagggaagcctagagaaacacggcagat

SEQ ID NO: 59659 - DNA, 3360 bp, Bovine  19866880347102
ctcgcctattattattctcttcctctgacctagggcgtcaatatgatcaggcctgtgactctgcctgtcctgttttcctatttttgcatttaatgctgggacccagctgcccccagattaccatcaaaactcgcagcaaagaccagaggggtgagatggtctcattgctccaacctaaggctccttttttctgagtcttctaccagacaatgccagcctctgcattcccaggacccacattctggaaaccagtctttttaaaaaatagtcatctctagcttcactaagccccaaagtgcctagaatgacagttttgaaactcagagatctagaagaagatcccagtccacagctattatcgctgtggtcaactgtacaaaagaaaaacttcgctcagtgcaccaggacactaacaataggacttagtgcattcttacactttagcggggatttgtatccatactctgtccaaccagaataagaaaaatgaagtccgacttcaactaaatggagccttgtttcccccagtgatggaaacccagccctaaatcttggacacatcaccataaagtagctgaggatactcttcccctgcacctgtgcacaggtgtgtgggggtgctcttggcccctccttctgcttctcagactgtgccccagaagataagaaagagaaaggactgtggcaagaacttaatctcagtactatctctaaaagctttggagtgaaggaggtttctgtttaaattacttttatctattaaaaagttgtcatttcctcctgctttagggcaagggataagggtgggaaacaccttcaggcttcattgttaggaagtcattgaatgttagtcctttgaaaaggaaatttcagaaaggtaactaagagccaccaatcccctcaagttgtgtccctgctatttcagtataaacaagctgtattaatgccaaatagaatttgccttgtacactgatggaatgtgtcctttatgctgtctcccctgtaaggcctcatactcaccactcaaaatttagcagactttctttgataaattactcaatgtaatccttgaaatagctagactgcctgcgtgatatggttttagaagtcttcaagccatgcctgtctataaaatattcacttgtggactacaaaagagggggtcacttttaatgatgagattgagaacatgagaaaaggagaaacagaatatccacaaattcaaataatttcattttacaatactgaacttagaacattacatcttactggtttacacagtagtaaaggtaaaatagaatcatccgtatgtgagacatggacaaacacagatttggcaagaatatgaagaatgggcgtttcaactttcagaaaacttttccttcttcaaaaccgtttatgacatggagacggacgcacatttagaaacttgtaaaatgtatatatagacaataacatataaatctatgtggaaattttttaattgggaagacattgtgctgcataattaaagatattaatttctgttctttttaaaagtaaatgtttattgtgtctcacaagaactggcagcttggaaatgcattttccttgcttcttacaaatgcatctctaagcctgtaagtcttcaagctctaaggaggttttcattaaaggagccagctgcctctttgtgtggattggttgtttaaagctgaagctctaaagtggaaacctcagttttgacattctgtaggcccttagcaaagaagttccatttaaatgtggggaagctctcaaacaactcctggatactagcagaagagcagaaagtacaggaatacaatgactggaataagggagaaaggagaataagagaagggacttggaatcctcctccaaggtggatatattaaaaagaaaatcccagtaggtaattttacccaagtttaaaccagctgccaccttggaagaaaattccctttgtttcctgatttccattatcataaaactattaaaacatcaataagaaataaattaagatctatcaaatgaataaataccatctcacctctatcttaataagtgcatcctttcagctcaatgtttaggagtgattatggcggtttttctgccaagacttggtatggagcaatacaataaatgatattttacacatggtgtgtttactagatgaagttaaaatctagttcaaattagagtgtacaggttgatatcattagtgttactcatgtgaagactttgggagattctggtcaaggtgctgggcactactaagacccaggtctggctcacgcttttgagaagtgtgacaatgtggggataaatatccttttggtttagctcggattctgagttattttctctccaagcagtgcagtaggaagtccgcaccaattcctcagaccagtccaggtcaggataccgactcagctgagcccttgctgagacctagaggaaggggatgggctggtgaggttgctcaggacgcccggagcttgttctcgtgaaaggggcccgggggacccagcagtcagccaaggaggctgcgaggccggcgtgaaccgcttgctcagccattgtcctagccagtgatctcggggaactgtactggagtgagggagatatcaagacaccttgtcagttcaaagcattttaggtttgtttgaaatcctctccacgtcaacgtaagcagcctctgtattcgaacagtgctttgaacagtgaaagggaatgagctgaatcaaaacctggaggtgtctccccgagacactttcaacgtgcttttatgagggtggagaaatgcagggagacgcgtggactctgctccggtggtgtcagccgcaaagaaaggcgcccacgacggtgggaggaaaggaagggaggaccaaaaacccctcatcgggggtctaaaacctctgaggttcctggagccccaggaaggggcttcgccgggaggcagactggaagccgaggtacccaggacccggcgttcgcgccaaccgggcctccggcgacaggcggagaggcgggggtggcgcggggggaggtggtacccagagacactgtgcgcgcccagcccagcccgcccggtgattggccaggctgcgggggtgggggtggggtgcagaggctgaggctcaggggtagggcagtgctttgtgtactcccggggatttattgggtgcattaatcgagtagaaccacccggcttaccctgttgggaatgtttcggctccgttgcctgccagcgaaatgaagcgaaggtggggggaaggggtggagtggagacctgggacgtcagcatgggctgaatctccgagcagtcatcgtcagtgaagtcccgctgcagacaggaag

SEQ ID NO: 59660 - DNA, 1475 bp, Bovine  19866880391606
ttttggactctgtgggagagggagagggtgggatgatttgggagaatggcattgaaacatgtataatatcatatatgaaatgagtcaccagtccaggttcgatgcacgatactggatgcttggggctcgtgcactgggacaacccagaaggatggtacggggagggaggagggaggagggttcaggatggggaacacgtgtatacctgtggcagattcatgttggcaaaaccaatacaatattgtaaagttaaaaaataaaataaataaataaaattttaaaaaaagaaaaaaagttatctgaagctcaggatgagactttctacagggacaatttacctttgcttctgtcagacagagaaactggccatctgagattcccttaactgaagttcagggatcaagatgatttaaagttgggcagcaatccctgaggggcttccccgatggctcagcaggtaaagaatctacccgcaatgcaggagacacgggagacacaagttctatccctgtttggggagatcccctggaggaagaaatggcaacccagtgcagtgttcttgcctggaaaatcccatacggaggagactggcaggctacaatccaaagagtctcaaacagttgaactgagtggttaaacaaatacatcagtccctgagagagctacttgtattgatagttcactcttactcctaagacaaaagctgctcactccttgaactctgagccaaattttcagaaatagcagatgtccttaggaaaaaagtgatcctaatcgccaagcttacctgtctaagtctcagcttcttctccaatcttggccttcaatcctttgttagttttttagtacattcaaatagtatttagctactttttctgatctttactcagcttttctagagtttttagcaggagtgttaggagttatttaatccactattaccagaaatagatgtctgaagtttatactttgtaaataaccaaataaccaaacttcaaagatgtaaattgctataacacagtcacataaaataagtaagaccataatactaaagttgtcctagaatgttgtacctttgctagaactacactaatatatagctgaatggggagccacttttcctgagagtgaagcaagattttcagtcttacctaatggtcagagtttctttctattgggttgtcagtttctatataagatattactaaaataaaagaaaaagaacacatattcaagagaggatacacactctcattcatagaatgtcaagcttttttatcagttccatatgatgagctatcatcatatatggaataatctgtgttgattttcttgattaaaaagataaatatttagacagtatttcaatcactcttctccaatgcctactggtaggaattcagggcttttcaacaaagttcgaagtacagttgccgtagaaaagaaggaaagagggcaataatgatggttagtgt

SEQ ID NO: 59661 - DNA, 942 bp, Bovine  19866880472792
tgatttgacatctggtacactttgactccagttctatgctcttatccatgtctctacctaaagtatccttcccactccagtgacaccagccccaccttaccctttcctttaagactcaattcagatgacctattcttaatcctctacatgaaatgatcttttccttctctaagtatccaaggcaaggatgtccatacttttttatggcaggcttcacagttagcatagttattcttttttaggtatttgcccaagagctcaattgcaagattctcagggagagtccacatttatatactcccatacacttggtaaagccagcacagagccttatacatactcaattgtagtatgtatatgtaggtactcaacatacatcaatttaaataagtagtcaaaattacaaatagcaatttccttaacttccttcaagttgcattgcaatgtgtgttttcttaagactatttctatttttaactacagcatatacttggtaaaggattttacaactctctaaattagcccatggtgattacccctactgtgcaatttaccactattttattaaagcaagattaaagataatacttcattggaagaagtaacagcggcattaacctctatttaccttgacataataaagctttaataaaacatgggcaaattgcattgagggggataattattctaacataaaatttaaaaggaacttaatttcttattctgcatgttcagtgctttaagattagtgtcattaatgtcctttttctcatttatagaagatacataaaaatgttcaaccctctccaatttgttttcttattaaataattctgaatttatactcaaattcataaccataagaacataactttaaatgcaagttttcagaagtaaatatcctcatagaatgtcagagcagggagaattctagggaaaggtt

SEQ ID NO: 59662 - DNA, 869 bp, Bovine  19866880627278
attatatctacaatttaagtatatttcatatttttcaaagaatgtatggttttagatttttacatgctagtcacacacattgttgaaaatttgatgatgatatgtcacaagaagataaaaacggtaagatgaattcactttttaaaattacagaacatgacatagttagctaacagggacaatcttaaagcttcccataattgaagaatattagaaagaaaatataatgccattatatacattatggtgttctttcacctttcaattagggtcatttttcttggagagacaggcatacaaattttttaagagtataccaaaagagacattgaaaatgctttaaagacatggaacacttacatgcatgaaaggtttaagaaaaactaggacttttgtctggtgaaactactttcattacatggataaaactcagatctattcacctctagcttctgtttctctgcttgtgtctaagaaatttctcagatgtcttgctgctatctcaattggatgaaagtcttgtcagtcaataacattccttaagcatcactgggtggctaataaatatttctgcgcattatgacaggtaccctagggagatgcaatggaacagaggatacagtctctggcatcaaggaactttcaatagtactaattattcacactgtataaacagactaaaatagggtttccaaggaaatacataatttaattattgcaaattaaaacaatacaattattatatgtatgctgaagtgattcagtgtgtgatctgagtgggggaagcgaacagaatattttatatcatgtattataagggtcaaaaagatacagattaatgagctaaggaaggagagtttttggagggt

SEQ ID NO: 59663 - DNA, 1130 bp, Bovine  19866880629549
tataatatgataattttttgtctcctctgactttcctgatactcagattgtttaaaagtattaacatttgtttgtccagttaaaatgtgagtcctgttgctaaatgctatgaattgtaatctgtttaataattaatttgattaatatttaaatgaaacattttctgatggaaggagccaatgtcataaagaaaaggaaattctttatatataacaaattgatgaatgactccttttgatagggagaaaaagggactgttccttggccataaatgcttttcttaggtttttgacgtgtatcaggtttttgatgtgtatctgagagtagatttgagatctgtgaggtgaacgacattactggaacccttagacagggaggtaccacctcatttcctttgaggcctgtttcttaaactgggagaagatagatcactaacccaacaaaggggaaattaacctcaggctaaagagtccagggtaaaatacagtgtgttcagtttgggagtctgtagggttagactgaactgctaattgtatagctaatatttagtcaggcaagatatcaattaagtatcatgggaaacatttaaagcatttttaatatttatttaaataataattacattccatttgaaaagattttcaaaaaggaaattagttctgattataatactaacaatctatactttaaaatacatgagccagtggattcaaagaaccagcagtccagcacagaacctggcaaagagattcatagattcattgaacaaatgaatgacggcttagatactaggaaatggagttccggctgctgagactacaacactgagcactacccccacctagtggcagtctaccgggagtgcatgggtaattacaaagtgaaaacaggcccctctggacgggattatacctgctttgacttttcgctgagtgaccccttacctacattaaattattctttcaacattattgaacttcctgagggaaacagccctataaaatccaaatctcaattttctttggaaatgttgaagattttgttcctgacattcatcagtcaatgtagtttaatggaagctatagtctttttttttttgtaatttatttttacttatttttaaaaattaa

SEQ ID NO: 59664 - DNA, 832 bp, Bovine  19866880745599
cgtagcttgggttcaagtttgccgtgtactaggaacattttctctatgcctctatgttagcaatgggagcacaacatacaaagtatttaaaactttgcagagctagcttcagagaggctttgctgaatgattgacctttgaattcacaagtcagtgaataaatgtgtctttttttcaagtcaaaggaataatagcttacacaaagacagattaaaatgagaaagatggcttcaatactgagacatcctttttgacaaaagtgcttgttcaacacccacaagggaggagtagaagataaaattataaacgtaggtagtcttagttttaggactttatgtgttatatccaggagtttacacttaattctacagacagaattaccagaggttaagatggaaagcaaggtgatcagatgtgtgttttgtaaagataatcttggcattgaggcatatgaatttttttggctgcactgtggggcatgtgggatcttatttcccatactggggatcaaatccattccccctgcagtggaagtgcagagtcttaaccactgtgcctccagggaaatcccaaggtgtatgaatttaatggggcaaaacagaaggcaaagagacaggttatgcacttgtggtaatagagtgtaagtgatggggagagatgtttttctcaggccacaagcttgagccctgaacagaacctcctctgtctcagacactgatgatgcttctttatcatacttatattttatagtaataacctacatgttagaccttcaaatggcacggccttgaaaattcagggaactcaatgcttttatgagccatcactggtt

SEQ ID NO: 59665 - DNA, 889 bp, Bovine  19866880757431
tactgggttaaattggacttaaagttctcttttgagtttagtatgcactgaaatatttctttgtctaaaagcgagttagtggactgggcaatgcacttaaaaatgaggaaaagtgcttataagaatcactgatcatggatataaagttgaaaaaagttagaaagtatgtctaatgatacattattataaaaaataagttaaaagcccaatctcctaaccgatatttagtattgatttttctttgttacctagtttagggaacataattatgaaataaatcaaaagaaacagtagttttagggagcattagaaatgacatttaggtactgtgcatgacattgaagctcctgaaccctgaggcactcctttatttaatttaaagacaatgtggctaaagctgactagattattttctggtatgtaagaagctgtttgttgttagaaaatttgactaatttgcttcccatttttactaagaacaggataaattacacataatatacattttattcacttagaattctctttggaatggtgcctgtaagaggcaggggactccaagaggcttatgattctgtttttaaaagaccaacaaaaaagaataaaaagatatgagcttttctcaactaaatgattatataaagaggaaaactttactcaactctagattaatgatgttactcattttcttctctttggcaatgctgctgataggggagcagtgacctcagactttctccttcctatttatctgcagatatatcacttttctgtttctgaaagaagtgcttaacatattatatgaaactatgacaaaggttttaccactgctattttaaaaaatactgtgtacatatccctgtggtttggagaactctttcatttcagt

SEQ ID NO: 59666 - DNA, 1577 bp, Bovine  19866880774397
ttctagaagacagaagtcaagtttggaggtatggctttatttaatttaaaaattttcaaattatggtagaatgtaatttttaaaaagttgactaattcattcacaaaatgctacatttgcctatagatttctcaactttctttaaaaaaatattctaagtgattaagtgaagtttttttaaagtgttattatgcattcccattttagatatcaatatttattaaggatcctaatacttgggttttggaaatgagcacaaatcttaaactgacaaataataaagcaataagatcttattaataaagattaatatcagtcttcaaacgtatcccaagcagaatcagcatgttcttcaaaaagaaacaaaatcactgtaaagatctcaacttagtcattaaactttagaactaatactgcaaaatgacttcccaaagttagcatacattttcaaagtattgttaagagttctggatagtctattataagattttatcatttatgacagaacacttatggcaggatcactaaagaaaacctgacaactctaaactgacaaagtgtaagaaattccaaagttgcaccgacaattcagatctacttcctttcatgcccagattcacttaatttctcatttggttttcaaacctcccctcagaagcaattggaacaaaaccatgagcaagctcaatctccatttgggcatgtaacccttttacaaacacaattacagccaaacactattgtaacctgatttgcatttgcactaagttacaaagcacattggaaatgcctgctacgcatactacagacttattaggaggatatattgcagggcttctgtgaacactaattaaaaaggttttatctttcccctctggtccactgaaattgttcaaatgccttgtctgctacaactttgttcaaaaacagttttcaaacatgtgatcagagctaggcaactatttcaggtggcttgattctgtttccagggtgtacaaggccggagagacaaagtttcagtctaaactttgagcttcctttcctttgttattttgtattgcaaccttagcattatccaactgtggacttttatctgtgaatatctaaatcctgtcttgtggaaaactaattactgaaccactgagagcttcataatgtcctgcatttaagtcctgagcatcatacataatgcataggcagcagtctctgcactctgattacagaacactgtcattaagtgagcaaattaaagatgtgaataattcactggctgagcttattgtcagtgctgcattgtgaaattagaatttctaataagtactgcaatttttttaacccaattaacacagagaacatcttgagactgattagtacaataaaaattattaccttattcttttgcttcacaacagccaaattaaatactgtacttaattatgcagcattcattccttctctgctaaagaaaagcctatcattttaataagagttctaatatttgtatgtgagctaaaaatacagcacatgcatctgtagctctctgtctttttgcaaagttttttttaagagtctgaaca

SEQ ID NO: 59667 - DNA, 1514 bp, Bovine  19866880867986
ttaaatgatgaccattcaaaaaattatcacaaaagcatgcattacccagttgccagtcagaggtctgaaatagcatttttaagggtgttaatattgagttcacagatcatcacagaatgattatttatcatatttctatgggaagaaggtagttgaaaaaatacacctcacttaattatacaaatatcatattgcttatttcctagctcacattctatacaaaacacaacacttaagaaaagttaggtttaattgcccttaaaccaatggcacctacaactcaagtatttccttcatcacacattggaatttaatgtcaataactactaatttaaatcaataattgaatgaaactttgtaaaaagtttgaaatacaatttcactgttccacagaacattttaatatctcaaactgggtcaaccatagtttatccttcaagggggattcaacaatttcaaacaatcatataggtccagaatatgaggtcactcatgatttacagacgcaagggtctgacctcagacaggcaagagtgagctgtttgaatggcaagtaaacctagatctcagtgtccaatttttttgctcttgacttactcatacaagtagagtaacacttaagagtgagtaagtgagtgattttaactttgcttctttgtgtatattggccatcaggaaatctttaactgctagaaaatagaatgaaaattcaaattcttagaatatgactgttgtctgaaaataaaagtttagaataaattaaagggtagagtgtagaacgcaacaggccaacagggagcctgaactttggcactggtagatccaccataagtaagtgttccagtaatgaaaaactcattcaccaagtgatgggtagaacttcagtaaacaatggaaatatagttaacctgtttgtgactattcatgggaatcaagacactcagaagaaagcctgaacggcccctggagtgaagaatagttactgaagcttctttcatcacaagcaaagtttggtcaaagaattttaagaagtgtttttattctttttgccagatagaaggcaacgaggggaaacagattaggtgccaagctgaagcattttcttctgagttgaagaagatcctagaggaaaaagacaataggtactcagtgatatccaaccctatctgaactgttttactgttttacctctgagaacatgcacatctcagaggaaactgtgaacagtatagcagctgaaaaatatcagttcttctgattggtggccctgctgcagacctggtgattaagtcagattttttctgtccttctttaagccccaggatattaaagggcaaacataaggacctcccacacatgaactggcagttcagtgaaaagtcttgggtcatagccaatacttttgcagactgattttaccggtgtggtgaatgacaagtggaacagaatcttgctttactgaacatcagttaatgattctgctcatcaaagatactgcaaagggccatccgcag

SEQ ID NO: 59668 - DNA, 1265 bp, Bovine  19866880878329
gtagtaaatatttccaggtttgtggactatataaatcttggtggcatatttttgatattgtcattctagtcctttaaaattgtaaaaatctttctcagttttagtcatagaacaggctgtaagttagatttcacttggaggccatagtttattgacatctgtagaaagtaaagggaaaaaagagttaaagagtaaatagctgttcagatttagctatattgctctttttttccattgacgtatagttgattttcaatgttgtgttattttctgctgtgcagcaaagtgactcatatatatatatatatatatatatatatatatatatatatacacaccacacatatacacatatatacattctttttcatattcttttacattttggtttatcacaggatattgaatatagttccgtaggaccttcttgtttatccattctctgttacaattgtttgcagatttagttatctcttttaacatccaagttgctgtggtgtctatgtatacattacagtagcaaaactcagcaatgaaaagtcaagcaggttatactgatgtcagtagccttctagattatcattacattctggtagcaatgacaacccactccagtattcttgtttggaaagtcccatggacagaggaacctgatgggctacagcctatgaggtcacaaagagttggactcgactgagtgaacaacaacaagcaccattctagaggcatgtcttctagtattggagaagatgcttcataatgtcaaggtgagtcataatacaaaattgaaaggaaagaattgcagtttccagttgcagtcctgatgttattcataacagcagagctaagttctgttacaaaatccatccactgatgagaacaccaaacttatttcgctgaaagattgaatggtgtaggtatgccttcttcacaaccaagcatcctaaaatagaaatctactctttattgttgtgcccatctactcctcagccaacaatttgtagcaatctggttttgtgatgccctcccacttgcccttgtgatgccctcccacttgctcttgtgatcttagccaccttcaggcactccacttaacttcctggtgtaataaagacttttcagttcttatcttacttgagtcatcaactataagctgataactatctagataaaatgcaaacagccagaattcctctcccaaatgctctttacttgtgcctcctcaacaattcctccgagtattctttctcacattccaaaattca

SEQ ID NO: 59669 - DNA, 1701 bp, Bovine  19866880992461
aagctaggctgaaaggttacacaatgtatgattccaactacatgacattctttaaaagccaaaactgaaaacggtaaaaagatcattggcttctaggggtgggcagaacataggggacttttaggacagtgaaaatattctatataattttaataataaattttaataacattggagacagaagagattaaaagcattctgacagaaaaatgctgctttgaaaagagtggcaattagactggcagctgatttctcaacagccatagaggccagtgggaatggtatcatcattttactaaaacaaactaattttcaacatacaattcttcgtccagcacagtctttcaagacttggatgaaacagttttcaatgaagcaaaattaaagggaatcctgaaagataagtttagtagaataataataatgccaaagtgaaaaggaaggttatttgagctataggaagggagtaatgaaagtggtaaatgttgtgtataaattataatcgagtggggttaagaaataaagtacacagtaatactagcgtataaattgggtggggcataaatgagaattttaaagtctttgtttagtccaagagaaaagcaagatatatgtgaacttaccgagatatttgaatgtatgctgttgtttctagggtatcactaaaagaaaaagtagattatttaacttgcagcctgataaaggggaaaatagtgaaattgtcaacccaaaagaaggcaggaaggaggtgtagatgggaaaagtaggtgtataaatagaaatatagaataaggtggtagatttaaaactaaatttgagtcattacagtaactgcaaatggactactaattgctcatttaaaacatatactgtcaaagactgtaagctgtttataagagaatctaaaacaaagtttagaggaatttggaactgatagtaaaagatatgacaagatatatatcaagttattaaacaatggaaacaagctacatgagaatacaaacacacaaaaaaagatgaagccagacaacatgtaattaaggcttgtatatttaagtggcaaaatttacaaaactagggaatgataaagaagtcagaataatggttacccctggatggaagaagatgtgggagttgcaagagctagtcattttctagtttttaacctgggtatttttattattctctaagttttacatatgtgttttatattcttttgtatttccttataaatatgaaggaaaaaacccaaatcaagatttctggatcagtgtctgaatttaactaaatcataatacctctgtttccatagtcattttggaactggttgaataaactactcaaaacacttcttgaaaaatcaaatgaccagagaagatctgtgcttatagtccagcccagggacccattgggttttagttggtggattattactcatgtagcatcattttatcagttcgatcgccatggaacaccagatgaaatggtaagattttatgtttttaaactttcttaaattattgttaatacatttttttggtaaacaaattagaaagtgagcagaaacaataatttaacaagcttttgaaattagacatgctggatctttctaaatctttaaaaagtgataactaaaatctcttaagattgccaaaaggaaagcctacatctccagaaatagttagagaagttctgggggaa

SEQ ID NO: 59670 - DNA, 4368 bp, Bovine  19866881040001
aaatacaaagctttggcctatctcatgatgacaacaggtgaataagcccctactatttggcagttctttcattaaaccacctagaaatctgtcaaagatcttatacacaagcaaataccagagtaggagaagaaaaaatacaattacttgctttcattatttttggcctggattctgaataattccttaaaactatttaaaggaatttatgactttaaatttatgaatttaaagaaattatttaaattatttatgacagcttttcaggaagaagtcaatataaaatttaaaaaattgatgtctcaaagttctttcttcagtatctcaaggaagtaatttttaccaaattacgtaaaagcaaaggttagtaatcaacttttaatatattcaatattagaaaaacaatatgtcaaatcccaaattccaagccctatgctctgtcttatttaagtagaatgatgacagtatattacagtattaatttacgtatcagaaaatcattcaaagcactaaatctaatataactagcaaaataagatattatcaaaatggcagaatttcaaaagaatatcagtataaatatacttttaggatcaaatatcttcatttgcatatagatttacattaaccaaataagagctttaatttgccacaaatattgatacatcaatagagcaataatcttaggaactaactaataactctaaagttttcttgatacttaagtaactaaaaccctttgattagggtttattacatattgtttgttcatcctttcttctatcggttcaacacttacttctctctgggtgcttgaccctgggatacaaagaataatgagatactcctaactgtccattaggagttcacagtctgagacaacaacacacacaaacaaataactgtggtatttaaagtggcaaatattatgacagaaacaagaacaaaggatagatctggagcacagtggagggaaagattttatctggagagtttaaagaaagttcaaaaaagaaaataaacatttgatctggaactagaaccatgataagcctttcacactgaatttactctatcaaaaggagattcctggggtgcttaggaatttttatttcaaaggtagatatttgtaatagaaaaccctctttttttaaaagttcctaaaagtaactttaggaagttacatcctaaacaaagcagaattttgaaatttaacaacatgacttcatattagcttaattacaggacaaaaaacataattacaacctcaagtcaacaaaggcaaaaatcatttagcctgagtttgaaatgggaaaaataagaattaggttcttctttcaccaaacagtgagaactagctctaagatcctgcaaaagaagtctcaaaaataaataccacttgccaatgaagagcaaagacttagcacattttcaaaatgtaggctccacctcctgctgtggtaggaagaatgaaggaaggacctatcttttagatgtaggaactctacaagattctgcactgtggttgctaaatgtcagatgccctttggcaattccttatgactcctggctctgaggtaagaatcagaataaggaacccatacactgaaggataaaccccaatgtttccaagacccatagcccggcagacatttgtgtacccaataacgtttgttgtatgtgaactgattcttgtatgatcttagtaggccaggaagtacattctctcttgacttaagatttctgaaatagctctctgcatttcaattaatccattgctaaagctcttttttatagcatgtcagctgctgaaacagtgataatgatagcttctaattaacccagaaagttcagaggagagaggaagaaaaatgtgccttgttggctccagggcataagtcaactttatagacgagtaatgttaaaacttcacacatgccagaagcatctcctggctgcattcagaatcaggacaccaacatttataagacatctgacaaatcttttttttgaagtctccccagggaatgaggtttcccattgtcctgtgagtagccatttccatggaaagagtgttgtatatctcacataatcgcctgcttctaaattcttcttgacattctcttcctttaaataataaagttaaaataaatccatgcatctaaatgttaagaaaaaagataactcaatcttcatagttaaaaattcccccttcttctcattgtttccacaagaggaaaaacactcttagtctgagaggctaggaaatgttatcaaatactgcctacacttaatgttttatgttagccagttattatttttaatttttcaggaacaacagatcatatgctgcacaattggccttgcctcaggaaatatgcagagaaggcaatggcactccactccagtactctttcctggaaaatcccatggacggagaggcctggtaggctgcagtccacagggtcgctatgagtcagatacgactgagcgacttcactttcacttttcactttcatgcattggagaaggaaatggcaacctactccagtgttcttgcctggagaatcccagggacggggcagcctggtgggctgctgtctatggggtcgcacagagtcggacatgactaaagcgacttagcagcagcagcagcagcaggaaatatgggaaggaatttccagaaaacttggtaactcccacttgctcaaatgccacagaaagagatgtttttggctcaattttagtcctattgggaggctgaaaatgatgggcaaggagtatactcaggtccaagtacactgtacactgtacattttgtactctatgattctgagattaatgatgtgccaagcccgggtgtgaaaacactgagcacgtatcccagcaaagttgtattctgaaatgttttaacccctcataattaaagctgggcagtaatgggaacatttaagcttccagaagttttgatctgatcattattagcccagatctaacatctgcaattgtgtgaaataacttggggagacctagaaacacctcggtctgtcactgaagattgctgctgatattcgtcctgtactactatcctctataggacttatatcagagtttaccaaagggtgaattgtagtgcattaccacacatccagtggtgtagaggaatatgcagaaatgctggtccattcagacttttgacttcaataagcattttccgtgtcttccgcgtctcagacggtaaagtgtctgtctacgatgcgggagaccagggcttcgatccctgggttgggaagatcccttggagaaggaaacgcaatccactccagtactattgcctggaaaatcccatggacagaggagcctggtaggctacagtccattgggtctcagagtcggacacgactgagcgacttcacgttcacgttcacgttcaagcattttccaggactcctcagagaagggtgagaggttaggatcatgctcaccttgtggtgcccacagatggggagcaaaagatgtgaccgtgtgcatttaccactcctttatggcatcaagagcttccccagagaggtggtctattacctggatatctgcattaacatcctggggcagacactttcactcttcatctttctcaagagtcctatggaactgatagaagagttcacacccaagaagtaaaggaccacagcgcaaaaacgtgctcgaattacagagatttgggggaactccagtctctgtcttcccatagattcaatacctctgtctgcttgtgcccgtgtaggggcattcaaactgactaaaagtaaaaaaatatgcatatacattctgcaattagaacttgattgttgttttgaaatctttgctataaaaatgtaaaattgtaattgaaattcatttgaattcatcacagtaaattttaccattatatttgccattgaaagaaaaataatagctatgtgattctttaaatatttgttttaatttttgaaaaattggggttgctgtaaaaataagaggtttaaaatgaagtttcttatctgcaatatatgactaccaaatatggaagagattagcattaaaatgtcttaatcagaaattatatgttcactaaagcaagtcaagtttatttaaatgttgataagatttgaaagttttacatatatttaattttcatttttcaaaacacttaatgtttatctcttctatcataaatatataacataaagaaaacaatttttctttaccaaacctcatgttagatgcctttccaaaaatcctccattttacccctgaataccaaatacatcatctgttagatgcctttccaataatcctccattttacccctagtaccaaatacatcat

SEQ ID NO: 59671 - DNA, 1811 bp, Bovine  19866881074141
ttgaagcagctccatcgtagtttttattggaaaatatgtgaatacccttaaaagtgtactttaacacaatttagattttttaaaaaatatcccagtgtaagaggttcctgtttgtatacatctgtttatggaattgattggctttttgtccttggaattcttgttcttccgtatgtgtatttgaacatctgggctgaactgaaaaggaagaaatctaccttactcattttcttggaagtgatttaaaggaaatattatcaaagtgaaatgcattagaaatgtgctgcaaactgctaaagacctgaacattcattgccatatgacttaagtaacagtaagcatgatactgcaggtgaagaatttacttggtaactggtttgtcttacaagtaataaccacagattttgttagtaaaacttactgcctagactctaggcacttagactggaatctgtaccatcaccattttgaaattgctcaaataccattaaatggattcagattttagataaatgatcatcatataagactcataagataatataaatgatcctctttcatagacaccattaataatgattaatctgtcttgaaaacctacgtgcaaaacaaggaaccctaaaaatatagatatggtcagatattataatttttaaatgcacagttttgttcaattttatttggttataaaaagtaatttctcttaaggctttttaaacaatgatttcctaaaagtcttaatacatcttaaacaaagtactgccaagcctaaattagtccctaaaatgagaaggaattagagagaccaaaatcactcttttccttggttaagaagctaaattaatgcttcatgtacttagttgccagtcacttcagttaatttgtggcaccattaatgagtgaaggatgaattcatatcatgacaagtaagtatcaatatgatagatatgttaagggataaaataattgtggatttcatagctttcattttgtaaagcatatttgactttccatgtagatatgccaaacagaattctatagcaaaggcatctaaagatggtaatgacagattagcataaattaagttggcaccattctgtaatacttccactgtagttctcaaacactctaggcagcttctatgccaggaccttccctgtgtgtgacagacaccatttttctttatatttccactgagtttggtcactcatttcttttgggctttgatcaaatgccaccttcttagtgagttctttttgaataccttatttttatattgcatttctcaccctcaaatcatacatcctaattgctagctgccttatttttcttcacaagtacatattattatttgatagcccaagtattacccacttatttatttgcaaattatactttttagaatttaaagtttgtgacagcaggtggtctgtatattttgtctattgctggattcaagagcctgaaatacaacaggcattcaagtgatatatgctgagtaaatgaattggggttctaaatctcccatatctcacacactagctctttgagcttacacagcttacttagcctactgatttctgtttccttatttacacaatgtgagaaataatgatgcctcttaacattttgctgattgaaccgaacactgtagatgaaagattttgctgagggcaaatgatgttttgctgttgaaacatcaaatggttttcatgaaactctgtgaaagtaatagattttggcttgcttggattatgggcttacaggagacctaaactggtttaggaagtggtctggaacacaagttaaag

SEQ ID NO: 59672 - DNA, 982 bp, Bovine  19866881313379
gaagaaggaaagtgagtcttgaaaccgagacagaaacttctaattcaacagacttaaaatttcatagcaactgcaaatagcagatctagaagttgtaggaaaaagaaaaggaacaataacaacaaccacaaaaaaaggacattttttcctattttgtttaataaacaagaaaacctcctcagctccaaaaataaataaatcaacaaagaaattgggttaagactgtaaagcattcgaaaagaaggggggaaaaaaaaacacctctcatggtctgtgtaaaatttttccttaaataatagaagaatcatatgggacaaaggaattgtcaaaagtagataattggcattacatgcgaaaaccacaagtgacatattctgcattttaatatcagaagtatagtattgtggcttagatgataaagagtccatctgcaatgcagggttcaatccctgggttggaaagataccctgaaggagggcatggtaatccactccagtattctcgcctggagaatcccatggacagagaagcctggtgggctatagtccatggggtcacctagagtcagacacgactgagtgactaacaactatagtatggtttttaccttccggagagacaccttttgcagctgtaacctatggcaaagtgctactggctataatcagtttaaggttgtcattcacatagccaactactccttttgaagttctaggagtaaaacaatgaggaggcagagtgaccaagactacaggaagttggctggtattctgggcaacgagccttccaccagaggtgctggttggataacagtttgaccagaaggaagcaaaagttaattctataatctgtaagtggggaatttcaaggaatggactaatgtttatagtccccctacaacatggcaagcattgtaaatgaacattgcatggtctctgccttcaggaagccagaattcagtgggaaaaataaacttaaaatg

SEQ ID NO: 59673 - DNA, 972 bp, Bovine  19866881539061
tatagtgaaataatttaatattctcaaattcatacctcctgatattttaaagccccaaactttctcttattatttcacagaccaacaaattgggcttaataatttccaagatgatctagctcaggaagatagtgttcccatcaaattttctctaggatgtttacacgaaagtatgatatgataatagtaattctaatgatggtgcagtctgcctgaaaaatatttggtttgcatcagttacaaagaaatataaaatagacttttcctagacgcacgtaaagtgtatagattttagctaaccaataataatcgatgcagaatcatagactgctaaataggctgtgacaattccactgctctgccctgccgtgttgtaaagcccctcgaggtcaagcaggagaagagtctttctccttcatttcttggcctccaggctgagaatgctacctcaagtgccaatttgtgattattgtgatggtggtgttctgagacatagactaataccttgggaattggacagagatcaaacaattcactgctccctgggtagcaagctgacactggatgatgataacttttagccactaccaacatgttctaagttataccaatagccagacgtaaaacaccgattcatctattcatgcctgaaatgttatattgatagtaccttctgggataggataggaaagattgtgatttttatttaccactataaatggatgaaatgcattagaaatttagtgctttctaactttttcactcaatggtaagagatgctaaccaaaaatgcaaatattcatatataaaattgtctatgtttaaccagtagtatgtaagaggcatgtataaaaacatctgcttgtaaggttccattttctatgatggtgatagtgatgatttcttaatttgataaaattgaaatatatcattagtgtgctataaaactatacatatatatataattttaaa

SEQ ID NO: 59674 - DNA, 715 bp, Bovine  19866881554653
tgcttaaaccctcttgaaaaaaagaaaaatatttttgtttacatctcactaatatgccaacctttggctagttaatgtttactcctatttgtcacaggtagattgcatgggacatgagacattcattatagagacaagtacgctctgttcacaaagttagatgacagaacaagtcatggtgtgtattgtaatttctgtgctactgtacatcttcaggctgtctggggtaagatacttactaagcattgcattatggctgtcagaatgcttcatggatggtaattaaataaaggaagtgttattggtttgtagagttaaaccagtatcagacatattctagaaatctcttctagaaagcttttactttgaacattaagttttgggaaaagtatattttgcatttgttgactaatcttttattaaaagctcattttctaggatgttcactgaaattatccacttctattttcttgtgataagtcagtggccatttcgcctatcagagaactgaattgtaagcagtgctgccctgtgaaatgttagttttccctctttctgtctgaacagttactatattcaaaacacaacaaaaaactttgaagggcaaatagaaagaccaaaagcagaaggattaaaaagaagtatgtttgtttaatttttgtcatttttcagaaaattttctcggaatttaatgctaaatttaatatctaatgca

SEQ ID NO: 59675 - DNA, 1087 bp, Bovine  19866881661105
taatatttaatctattttaactcctgatattcagacttgcactaagatcatgaaaagatcttggtcttactgagcaggtaactccaggtgggagcacacagcatctgctttgaacctattcttaagacttaaatcccaaccctgaaagctgaaaatgaacaatagggatgaatattttatttcatcactttgtaaattgtgtgtttcttttcaactgttatgccaagtataaactttcagaatttgttagtagaaggaagccatgttagacctaattttgctactgattcaaccaagtttaatattgctaatgttatattataattgtgtggaataaggtatttttaaaagcctaagaagtaaatttggtttaaactctaagaaggcaatttcacttcaaggttgtcacttaatagtttgcagatattgcaaaatgcagatattgcaaattgtcatttacttttcatttcttttttttaattttatgagagaaaaagtatagtttctaggattttttttttattttacaaatttcctttttttcctttcttgcaaatcctgtaaaaagaataacaaaatattctaagtttagcttcttagtattttatctaatttattttagaaaattcattcaaataccatatttaggtaatttctgcttaagcaaagattcctgaactatcagaggaaatatgatgttgaagagaaagagtttgtttcagtcttgaaacatgattgttcatgtatttaaaagaaatctctaatcattcatctttgtaataattgcttataaaatgaatttacaactccgtaagttttatttgctctagggtattttaagacttcttttcctagaacagtgacatcaaatcatcaacaagcattcagagagatcatgtgggttgcagcacttccctggagtcagggacagaaaaaggaacagacatgtttgaatatattcaattgactaaagaagagagggggtgtatattttattttagatccagccagaaagatgacagtgactgtcatgggaattttgtcactgctttgagaggtaaaatactgaggtaatgatgtccaaaga

SEQ ID NO: 59676 - DNA, 1605 bp, Bovine  19866880488587
aactgcaacctctagcaaaagggtaatgtaatttatataagagtgggaaaagcgctaatgaatagataacattaagaaaaagagaccagaaagagatgattgttcagaactaggtttttctattttaaagggtgaaactttctattcagcaataccctctccttgtggcgtttaagtttgaaagggtcactccttcagttgaagttgctgtgggtaagtttttaacatacctgcccagattaccgcagtggaaaaattgtatccttggtctttgactgttcataaagtccctgctgctgctgctgctaagtcccttcagtcgtgtctgactctgtgcaaccccatagacggcagcccaccaggctcccctatccctgggattctccaggcaagaacactggagtgggttgccatttccttctccaatgcatgaaagtgaaaagtgaaagtgaagtcgctcagtcgtgtccgactcttagcaaccccatggactgcagcccaccagtctcctccgtccatgggattttccaggcaagagtactggagtggggtgctatcgccttctctgtcgtaaagtccctaaacaactacaataattatgggtactgttcctttctgacaccgtctccaagaacttggtctgtcctgaaactgaagataaggttttgcttttcccttgggaagaataaaggagctgggtgttattaaaaaaacaaaaacagtagtggatgttatgacaaagaaagggcattttctaagctacataaggatggaaccatttgagaacctgcagaattttgagagaatgctgaatggtctgagtttctaaagacgggtgcttaacaccagtaactacacttcctgggctttgagtcattttgtgatcatgttttaatttttttttttccttcttacatagttactgatgagcctgagggctcagacaatgaaaatcaaagcaggaatcgtgagaaaaacagtttgctcttcttttgtattttgctgagcattaaaattacatttttgtttttaagtagaaattgcagtgtaaaagataccataatccatattttggttcatttggggtggctgaattcgggtgtaatgggatttgcttatattctactgtctgataaatgcgacaccataaacctgcctggagctttcttgtgtaaacaaaagaccagagaaattagcatttggatgaactgcatttataaaacgctattagcttttaagaaagatttagattcttttctctagtttgtaaaaatcctctacttctgtccttgttctagtctgttatctactgaattcaatgttataaacacaaaagtgtccaataaatataactcaatgatgacaggcctggatatgaaaacaaaacagcactcaaaattgctaaaggaagttggttattgttagagtttttaaagggccatgatagtacaatttggtggaattcccagcttcccttaaataatgacaaaaggtggccagtgctgtctctgtgaggcccaggggtatctagaataaagacgaattaggagggaagtgtccagaagacttagccaagagctttgtcctaataggatggaggggtgg

SEQ ID NO: 59677 - DNA, 3679 bp, Bovine  19866880516058
ctttttggcttctgactaataaaaaaaatgttctttttactgatgtgtactaccactgggtgccctgctttatcattccattattgagctgaaccttttaaatgtcatttagaagaacattatattgagctgctcacaaagaaatgcctttcatgttgggattcaatatgggaatttaattcagccttgccctgagatactggaaagattaacagattatacgatgagaatggaaatttaaatgatagatcaaagagagttgagtaggctgtggtcttgatttccccaactaagagacctacgagtaaaataaaagtatgcatattggggaaaaaagcaggtataaaagcaagttatacacatttatttgaaatctctacattagaacttgggtgttggaatctgtagatgcatggaaatttgaggagcatagggttgctaagacgaagacttccttcccatccatcatgtgtttttatcttcactctgtcccgtgctaagttgattcagtcgtgtccgactctctgcgaccctatggactgtagcctgccaggatcctctgtccatggattctccaggcaaggatactggagtgggttgccatttcctactccgggggatcttcctgcatctcttatgtctcctgcattggcaggcaggttatcactggcaccacctgagaagccctgtcccaaccgttcctgctccatctcctgcttcagcttctttagatcttgtgcagaattttctcgtagctcctcctaggcattgagtaggttgaccagtggttccagtttgatgggaccatcacatttggagcattgagattcccacgatgctccacagtcccagtcaaactgggcaggtggtcaccccagcactgagtgttctttgcatattctttcctgctttccacgtcctgtttcctatcactgctctgtgtgcaaccactgtattacttgtcaatggtccgtacaagtgcagtataatatgtcaaccactagctccctgtgattatttaaatttaaaattattaaagtaaaatgaaaaattcagctcctcagtctctagccaagtacctgaaaggcaggtggccaccctctggacagtgcagtatagaacatttctaggctctcagatgttctattggatagtgctgatctatctaacagagctcctgagaatggggcaggggcacgcatgcaaattttctctgcaatttatggcttagatataatgttccttgggcacattaaatgctagaagaaccaagtaatcctcaggtttcattttctttgaatttctccttataccaactgtggaacatataataaggctatctgtcatccttattggctcatttgtcaagcaggtattgagcacctgtgctaggataccatgatgaattatggtgtctgccttccagtaacttatggtctaaaatgagaagaagagttgtgatagttatcatataataagtctcttcatgaggcgtataagaggggttgatgagcagttggggttctcagagaaaattttgcagaagagatgatacagaacgaggattgaagaagcagaggcagtgcagtgtgtggataaggagcgggaacatctgagtttgaatcctgcttccttgcttctcccagcagtttacttaatgtgtgactttggacaagtttcctaactgatctgtgctgaagtgtcctcctctctaaaatgaggacaataatagtatctttctcacagggatgtaatgattgagttaatactcataaggctcattgaataagatgtggcccatggtaagagctctgcaactgttaataaacaagaagggaaggtaattgagatgcagcatatggtagtgcagaacatgcattacagaagcacgatgtgttagagaaccagactttttagaaccgtaggacttgaaatggtggtggtgggcggtggccatgctagggacatggggatacagaacagggaggggcagggaggattaaggacaaagtagatgaacatatcagtggaccatccccatgactggtgacacgattctgtaagtgacaggaagttgattttttttaagcagggaagggatgaaattagatattcagttcacacaggtcccaatctgatgactgggaggatgtatttgagaagattgacagcatctgaagtatgagaaggcctgaaaggagacaacagatttgagagacatttagaaggtttaaaaaaaagaactgtggggaatgagcaaaagggagaagtactatgtaacaatatattagttaacctagtgcacttaaaagtaagaacatagggttaaatttgggggctaattccaaagacagtcttccctgcttctagaagatgttgtcacaaagaatatgctattattcttactgctttatcgtaaacttgtaaatggagtcttaatttttttaaagaaaatttccctattatatatagagaaatttccctattatatatagagaaagaaagagggaaaatgtgagggtagaaagtggtagagagtttaacatcattctgttattctaagttattgctttgtctttggaaaagtaataaaagcttatttcctttataacttcatctgtgttctcggggctgtcacattaaccccacattagtattagattttaataaaggacaacactgcaggaagaaagatgtttgctaaatctaggagcaggccatataattttgtttttggaaggtttctaatattgtttttattttttcattgtcttgaaaatgatatttaactttgtcagataactgcaacagaaaacaaaggctcttttgaatagaacttgggaggtgtggacttctgtttctttaccagtttacctcttggtagcattttggagccaaaagggtgttggacgccatgattgggaagagtccccagagttcatttctgggttgaggtatgttgcctttcttcccatattttatactcagtgagtctgaggatgatgttacagtatatgacctcgtgtcatctgtgagcctctgatggctaatgagctttgctgctcaatccaaggctggttcctactgcacaggcacctcaagatgtccttggagtgtttcttctggaacctctaccctcacagctccttttgagggcctcagatttcctacagtatcttaggtgattcaaacctaagtgtttccatggatggaagatctttccatctaataccccacctctaagatttagttccccgaccaaagattgaacctggacccttgacagtaagagtgcagagccctaaccattggacagcagggaattcccccttcagacttaatttcaagtgagatcaatcattctataactccttctcatggcagcatcattaatatcaaaatataattatattaatgggtaacattttgcatgctgaatgtgctgaatacattcactatttcttttattctttaatagaacctactgaagtttgtgcagttattatccacactttacaggggaaggaatggaaagttggagaggatggtgaatctgtaacaagtcacacaacagaaggagatggagctgggtgatctagctctagaatccagtctcttaaccaatatcctgtaaggatcacttcccctgcagccaccagcctttctcacaggcacctcg

SEQ ID NO: 59678 - DNA, 1868 bp, Bovine  19866880538417
gactgtagcctgccgactcttctgtccttgggattctctgagcaagaatactggagtgggttgccattcctttctccaagagatcatcccaacccagtcatcgatcccagatctcccaccttgcaggcagattctttaccatctgagccacacaggatttaggaaggccagtgaatatatcagaaactagaattagtatttaaacatatttaaagctgagcatagaagaattgatgcttttgaactgtgatgttggagaagacttttgagagtcccttggactgcaaggagatccaaccagtccattctgaaggagatcagccctgggtgttctttggaaggaatgatgctaaagctgaaactccagtactttggccacctcatgcaaagagttgactcattggaaaagactctgatgctgaggtggattggggacaggaggagaaggggatgacagagaatgagatggctggatggcatcaccgactcgatggatgtcagttccggtgaactccaggagttggtgatggacagggaggcctggcgtgctgtgattcatggggtcgcaaagagtcggacacaactgagtgactgaactgaactgaactgaactgaatggcctgggacaatggaaaagatctcagaggatgaactgtttgaacataatgactcatatctgactactacattaaattatacaaagagcctccataaaccttatttggtgtagtcctcacaatagagctggagtgggttgaatggtggctccccaaaagatctgcccacccagaacacatggatgcgacttcattaggaaaagaggggctttacaggtgcaattaagatcaagtcgcgataagatcatcttggactaggatgaaggctaaagccaacgacaatggttttttgaaaagaaggggataagacacagagatgttgatggagacaaagatggagggatgcctctataagccaagggacactgagggctgtcagcagccaccagaagccaggagagagataggtaaaggattctccctcaaagactcccctgttggtccagtggttaagaatccccctgccaatgcaggggacatgggttgattcctggtccaagaagatcccacatgccaaggagcaactaagccctgtgtgctacaaatactgaggccatgaactgaaactacctgaagtctgcaggccctagaacctgtgctctgcaacaagaaaagccactgcaatgagaagcctacatattggaactaaacaggagcccctgcatgccacgccgcaattagagaaagcctgcgcacagcagtgatgacttcagtgtgaccaaaaataaatacacaaaatttaaaacaaccacaaaaaaaggattctccctcagagcctgaaagcaaacagaaccaaccttcctgataccttagattttggattttcagcctccagaactatgagagaataaaggtctactgttttaagccaagtgggtgatacttcattataacacctctatgaaattaacacaaacactattcattttttattctattttatgttcttttacaaagaaatcaaagtcagaaatgtaacaatattctgaaaaactcatttgacgtatatgtgttgtatgcctactatgtaccaggcattattctaggtgttgggattcagcaataaataaaacagtcttgaccttcaggaattatcattatagttgaggaacacagccagtaatgcaaccaagtgaatatgttgttaaattaactaaacatggaggccagtagactgacgtggctctaatgtttggtgggcagtgtaaagaaactaaaacctgtaaatgcctcaagagtataaatcaaact

SEQ ID NO: 59679 - DNA, 1445 bp, Bovine  19866880618192
ggtaatctcaaatcctagagttctcctgattatgtgtggagtcaaggtatggatgacttcttaataaatgaccaggtggtagttttgtagtctgtgtcattttgatgattatgttatcactgggcaaagatggggattttttacatatgttttttaagagaataatatgttgattacttatgtattcttagccagctgactgccaacctcttccttattttaccaattttctatttttttaaatcagtggagtttcagtaaacactgtctttctgaaaactttttttttttttgcagtatgtgtgtggtggaaaggaggtggtgagggtctcagaggatgcataatatctgtagtcattttgtacactgaccacagagtacagaatttaggcaaaactgcttcctcctctaactcttttgcatttattaaaatttggtcatctagtgtacctgttaatagtgacctctgctgtccagaatcagtactacacccatacaaatcagcatgggaatcagtgtttgataaggtaatagatttactgaagttgtatagaaaggaaaagggctatagcttactgcagaattgttcagctcctcctgaataaaaacactttgcatttgtcttgaaaataaaaataatattgtttctctttcattgccagttaccaaatgtcacctttgatggcattcctcagtagggtaggaaattactagaaataaagacaaggaagtcaacatgctctcctaaccaccaagacagttttcagttttagcaagtgagtgccatcgttacttaatactaggttaccttacctctgatcatctgaaacgaaatcttacatttctcaaaacatttatttttatatgccttaaaataacttgaattgtggaactggtgggaccagggttcccacaatatccagtaggtgatcagaaatatttgttgaatgattatctaaggacaagtggtatgaagttaaagtgctacacctgcaacatctaagacgatcttgcttacagtagaggcaatcaagatggcgcttgcctttctgaagtgtaggatccaactcagaatttaaggaccgtcatccaaatgcccttttactgtgtgtaaaagaattgccactgagtaatttaagcaccctgtgacaggaattaactatccaactagtattttataaactaagcttttggatgctactcttgtatcaatcagtttagaaacatttactgaatacctaacactgtgttttggttaagaaggaaatggcaacccactccagtgttcttgcctggagaatcccagggacgggggagcctggtgggctgccgtctctggggtcgcacagagtctgacacgactgaagcgacttagcagcaacactgtgtttatgtgtctaactgtatagcatagtagaagaaagcgggcttggaatcagataaac

SEQ ID NO: 59680 - DNA, 1470 bp, Bovine  19866880687983
tcatgttcctattaaatattgtgatagtaataccttgtacttgttcaactttaaaaaacccagccatctgttttcacatttaatgctgtctcttttaataagtattgcacacagggacccacaaaagtaggatatttgagcacagtgcatggtgccaccctcccaggaactgtaaacagtggtacattcgtggaggcctttgggcactgggtttcacttcagggctgacgtttctgaatctgttcaaatgaatgctcctagttcagcccagttgcttaaagaaggaatggttcctgtgcctgtgacagtcttggtgatggcagctggctgctgcattttgttcttaggctcagggaagctgtggacaggctggagtgagccactttttgttctctagctacgcatggtcttaccactcctgcctttctttcttttttttgtgcattttacctttattttacttgatcattgcaatttctctctattgccttgctatcctctctcctaaaaatatctcatatcttatcagctggagtggatgcctccctggcttttctgtgaagacctgtgagatggttgatggggagtcagaggtgaggggggcaccgctgccagaagcacagggaaaccttgccctggagaagccaggacagagaagcaggatgtagaacccagtctttttgtttttgttttcttttcattgaattgtggctgcttgctacttggggttgtcacatgaaaccacaagacatcttgttgttacactgggtctcctgacagttgcaaccaggagatctgggagagtcgctggcacgtaggaagcccttggccaatgtgtgccgtttctgagacagctggatagttacaaagaatgtcatggttgtctccttagtgtcattctgtatcacatcatttattggttatttgatgaagacattttaatgaaaccacaaccattgtttacaaagagaggggaattacttgcatctgaactcaattgtctttaccatgcctaaatcaactcatgctttctttgagactaacctagaatttgtttcccattttaattgcaattaaatataaacttgaaaactgtgtcaataaaatgctgtgaaaacatttttttttctgtttggaaattccctttggggttaaaactctctctggagtttttttttggagtttgttttttcattatccataaatgtatatgatgctcaagtttgatggccatatctatatttctatttaccttccttcttaggcatattattttctatcctaaaattctttgaaatttgtttactcatttattgtcctttggttcactaggttctttttcacaatagccatgattttattaatctcttggtccagaatgaaatagttggctggagacagaggagggagagaaaaacaggttcaatttgggagcaaccctgagatcaaagaagagatgagatctgtgaa

SEQ ID NO: 59681 - DNA, 3155 bp, Bovine  19866880767554
ttggttggttgctttccacattaagattttggatgaatactttgttcaaaactttttccctcataattgttttttggggctttaaaaaacttatttatctattttggcagtgctgggtcttcattgccacacacgggctttctctagctgtggtgcgtgggcttctcattgtggtgacttctcttgttgaggagcttggactctagaactcagattcagtagctgcagcatacaggtttagttgccccttggcacgtgggatcttaattccctgaccaaggatcgaacacattccctgcattggcaggcagattcttaaccactggaccacgagggacgtccccctcataatgttattatctactgctttatattatagaggttactctatcactggtatttaatatggtagagatgaagtctgaattctgcttgatttctgttcctctgcaaaaactttgtgaattcgagatttcatagcaatgtttttgtctataaagttgaattatttttgctgggacatgcctgaaagcaagtcttaccctgtttattttctgtgggaattactgagtgctatcaaatgctgactcagtctttcttccatttgggaaggttttcttctttatatcttttagtattactttgataccatttgtgctgactttatcttcagaaactccctacactcatggtttcattatctcatctctgcattccatatggataaacttcattattaccatgttcatctcattacttttgcattctaaaggagcctctcaacttcctcttcatggtaactgacatcgtgttttctgtctcgataatgtcctttcttccttccaaagaagatttcagaaatatgttttagttccatttaacaggtcatttctcaaagtatgcattccatatgtcttctcaagacaacagtcccttttttagaagttgcagaaactatccaaaggttccatgttgattttatttgtttgtttggtcaccctttacagaagagttttatccagttcctctcttcagatggataagttgcaaatattgctgttaatcccctttcttctcacccccaaataaatacaccctagattgcaagcattccctgttgtctagatgccagtagaattcccctctcagactccaaagcagggggaaacaaaggtgactattttacatgcaatagtcatatccttatgacagaagattgtatttcattgtccacaaaagccatgagaatatctgctcttctatatgctcttctataatgtacccttacctctcctccatcaagaggtggtatctaacaccatcccctgaatgtgggctggcctcagtgattcacatactatcagagcacaacaacactgactgcttcatgatttctgaaagtagatcatattataataggccatgtattttccatctgcttgatctccaaattctcccacttagaacccagctgctgtgctgagagaagtccaagccacacaggccatatgtaggtgctgcgactgacatttccagttgatcgcagccttcaagttatcctcacccaggtgccagacatatgagtgaaaatacttctagatgattccagccccaagccatctggagggcccatacactgtggagatgagaccaaccatccaagttactgactcactgaatccatgagcatcattcaatggttgttgctttcagcacttatgttacagagtggtttgttacacaacagtaactaaagcttccaactaaatttcttatatgactcagccacttacccactataattttgacaggctaagaaggaaagaattctggttcctgctgtttggggtactatgactaagtttatttatttatggatacatttcatttgaatttgggaaagagttgaaagaaggctaacagttcttgttttgatgtcacttcttatctccatttctttctatggctgacttcacatcccagatatagtgttcccttgtctgtctgctccaaatgtcagtcttttgcacgactgaggagaaggcagaaaggtcttgcctgcctcaagaaggaatttccatgtgtgactctgaggagtattcacatggctttctcactagtagagaccccagggggtacacagtggcatcaggggtgtctcttcctgcctttgccctctttggccctgctcacatgtttaggagttccacaatgcagcctcctctacagtcgtctcattcccacccaagcttccctgtgtcactgaaaacagccccccaaaactgacaaactatggctttaaagatgggatagagagttttcttaaggcaagaaatctctacatagtgagaaaattatttccattatttaaaagttttaagatccctgactgaatagggtgtttcccccatgagcacataaattttgtcattttagatcacctgcagagtaaacacagcttagcattctgtctcagacatgggagcagtccaaacacaagatgccaaaggggtgtaattcacactcaagaaccattgtgtctctacaattcataaatatattatgccttctgtgaacctttattattttcaatccagaccctatcttgggaataacttgtttcaaaagtttatgactcactgtgtaaactaatgtgtttttttcttctatttgtcctaaatttctcttctttcaggcttcaaagagttctccctgcccattcttgtgctttggaatttggtgaactcaaacattttgatgcccttcatggctttgtcgactttgatcatctccccatgcagccttcatctctgtgggctgaaagtcttaatcttcttagtttgacctcatgtttcagcccacatattcccttaattctttcatctgcccttcactggcccttctaagaatcatatttctttgttaaggggtactaaccacagacactatttcaagagcaggtgttcccagccttatctttaactctctctagtggactatttagtcaagcagacttgtatgtttccaggaggtgggggcaaacaggaaggtagaaatatttcaaagtcaatatcagagcacagtttggaaatattttgtcgccagaatgatgcaaagggaaattactccctgggctcctttggtatctattcaaa

SEQ ID NO: 59682 - DNA, 808 bp, Bovine  19866880809771
taaaagcaattatacctctagagaatctcgttgcctctgatttctaagtgctggttgtttatagaattactgctcagatccctttagttcaaaatgaacatgccaatgaaactgaaatgagaatctgcacttctaaattggattatcggcttccctagtgtaccagtttgcaccattcctccttcagcaaagttgcccgtgattctcagcagtttagttttatagcttatgctggatggttggagctaggtgcctctagttaacttattagttatgctgcgtcttggggatgactgttgccacagtaacagaccaacagaccttctcaaccttttcaaatagattccagaccttttttattccttaaattatattgagagaagggtaagatccaactaccagttctaaattagcatgttccaatggaataataataataataaaaacctaggacatattctcttgcatctttctcttttgctttctgcttggaaaacactttactgcttttctttgtacaatgggaatcaagttgaaatcaatatggctattttgatacaatcgcaattcatacagcatgtttccattgcttactatttctgtttgacactggaatacttgactgatgtcaacgaagctggattcatgtttatcagttaactgcaacagagctgtgcagaggaggtaacacaatgcagtgtttgcatgaacttgataaaaagagtgggtggtttaatttctccctgaatggagtattagaagaattagcagactttctggaacatggtatgctttcaggtaaatcagg

SEQ ID NO: 59683 - DNA, 1275 bp, Bovine  19866880884781
agctgagttagttggaaatgactggaaagattcctggtgtgaaagtaccgaatggaaagaagggagaggaaggctggagtataaaatcgcccattaaaaatgaaacggaactaagagagagcagggccattcaaaatattttccattacagatgcccttcagctctgccttcttctgtgatagcaaagtcaggaatgtgccaccgttgggctttctctgggattctgaggttcagaatcatcaaagtgatctggccatgctaagtttagaccaaaggaggaagaaaacacaggagatggatggtaaaatgtcactaaatcaaaataactctggcagtacaaaaacgtggaggaattcatcaaaggggtaacttggaagaggttcacagtgatgaagaagagagcatctcatcatcattgggcctcccagatggctgctgctgctgctgctaagtcgcttcagtcatgtccgactctgtgcgaccccatagacggcggcccaccaggctcccccatccctgggattctccaggcaagaacactggagtgggttgccatttccttctccaatgcatgaaagtgaaaagtgaaagtgaagtcgctcagtcgtgtccgactcttagcgaccccatggactgcagcctactaggctcctccatccatgggattttccaggcaagagtactggagtgagatgccattgccttctcctcccagatggcagggagccacatttaacatgctcacaccttctgacgcacctgtcaaaagcatccaagttacccacagtggactattcctggtgttccttttgagtacgtttggtctagtcttgacctctcttatttgttccttttagatatgtggatttcattacatagctccaaagctatagtgaagccccaactttctcgtctctgttagaagatactttatgttcacattaaccataattaactacagcacacaatttcctgtcttatttttgctttttattggtaacagtaatttctacagactttaggctggaacagtactaacaatattcatttttcctaacttcttttgaaagcatttagcatgcttactttttatcatttgtatagtttctcaggaatgtttcctttccttttctttcttcctttaaaaacaaacaacaaaaaaaaacatttccttcatttttatagatgaggtactgagtcaaggaaggaaagttccaggaagttgcccagaactggaaattaaacatgtaagggcctcctcctgccctgcctga

SEQ ID NO: 59684 - DNA, 1775 bp, Bovine  19866880927905
ttctgtgttctgtgtgtgtgtgcgtgctcagttgtgtcccactctgtgaccccatggactgtagccctccaggctcctctgtccacaggatttcccaggcaagaatactggagtgggttgccatttcctcctctagtggatcttcccaatccagggatcaaactcacatctcttgcatctcctgcattggcaggagaattctttaccaccgcccacacgggaagttctcctaacattgtcttccatcttgtgggtaggatagtgtttattcaatcatttctaataaacatctgtgttgctccatttctcacttttataaataatgcttcagtggttgtatatatacggctagatctttgagtgtcatattaattacctaggatatgttgctagaagtgaggttgttttggataaatcacacacacatattgaaatcttttgaaatgtgttggtaatgccttctaattgtaaaatgtgcattaactaatatggcatcctgtaaagagcactgtgtttgtggtactaagttgggctggtgctttatttcactgattgctcactgtataattttgatcaaatcggtatttctaacattccggtgtcttcacctgtaaaataaaaatagtctaactcactgtatctacctcagatagaaggatttatatgcacaagggcagtggccttcaggaaatagtccatcatatccactgaattgcatctcttctgagaacttttgattgtgctaaaatttcccaagagtgtcctgtggatctaatgacagtcctttgagtataccacttgctgtagtcctgatctgaaggtatgcttccatatttgtgtgtctgttgcttttcttgcccattgaagtctgtgaagtaggaactctgctctctgtggttactgtatttatttatgtttttgttaccttgctttttcaagctggctattcactcattcccctgctgatctattatgttctctatgaggttgtctttattggtattcataggtggcatttagcactcaatggcacttttcatcttgaaagcactttacagacattagctaattaattttcacatcacagtgcgataggtggggaactaatctaagcatttgagctatggcgatgaaaggtgtgttcaagtacaacaaattattattgtattattctttggaagaagatgagctggttgtgtaattcgtcccaaacttcagaaagtatgtacattatgattgaaattcaagccggatctgataggtagttgtatcatgggccttcttactaatgctgatccggcttgctcccaaaagcagtgtcacgggaatgaaacccaccagctggtttccctttctgctctgcaggtggagcagcattattggcatttgagtcactttctttccttctttcccttctgaatgatggcacttacgtgaaatgaacctgattgaaagtttgaaaatatttcagagaagcctccaagtttatgagagaggcaataccccatgtagagcaattgtggttggaccgttgtttgcttttgaaatcttaagtttatctcattggtaaaacgatgataccgctcttgcttgggcaggtggggaagtagtaagggtgaaaacctcttggcttggctctcctgagctgtaccagcagggatcctagagtagagaaagaaggcaggaaaaggaggacccaggagcagaggatctggcttttgctcttcagccccctgggcttctctgggaccaagatttccggattgccctctgat

SEQ ID NO: 59685 - DNA, 1818 bp, Bovine  19866881006251
cagatgaaaagcttggaacctcattcccacagtagaaatgatgcaaattcaaaaaggcataaagtcaattttatcccacttatgcaagggcatgtctcacaagggcttcaggatgtttaaatctcttactgactagaaccttaggagtaagcaaaagtggaaaagagcctagaaatcacatttaggcttcgttgcatttggcctgagaaaagctgttacgaggtggcgttgaactagcagtaacatgatgactcgcagcctaacctggctgcagtgggcatttcagatgactaagctcgaaattaaggctctggaagtttataagaacaacttaagagctgggaatagggagaaactgatttcttcctgatgaatttttcactcttagtttggtttcttctacatgtaatccccactgtgagacaattaaaataaaaccaaaagtgattggatatgagaaaatgataactttgatgtggaaaaaaatgtacacagaatgaaatgaatgctgctctcaaataaaacctttcaggtattgtgaaacaagacagacctaatctctcaaataacaaagattaagcaaaaatgatagaatgtgaaagtcaaagagactcaccggtataactggaaaattgatagacacccgggagtttccaaaatgctttttaaaaacctgaacacattctttgatacaatacaaaatctgtggcattccatgggaaaataaatgtttatttccaatcttagctttcaaatatttaaatgaaagcagacaggctcttttccctaatactgaaggcactggcatgctaataagcatttcaatgagaaaaaaaatacatgtatctctctgaattaaagtgaagtctatctcactcttcctcgtctacctacctttttttctccttctgtcagctctattttgtctgtcttccctatctctccttctattactaatataatagtaacaactgtccttccattttccatctcactgtaactctattttcaatcaaatgacctattcattgtgatcctaccctctgggagtaaatctgctagccctcgggacaaacatgaatacattgtggggttctcatcagactggaaagtacaaacaagctgaaagataagacaggaaccagatttccaccataccaagcagcatctgaccgtaaatgctggcatgtttcaagaactgggccctggacgatgaccctaagtaggaagaaagaacgttcacccagggaattttgcaagcagagatataggggtaagagaaggcattatttgctaagaagttcagtccagtagactactttgccttaaatgaagagtttacataggcaggtggtgagagagggttgcaaaagcagaggggatgcaactgtgaatgagtaagtgagtgagtgagtgagtgaaagtctctcagtcttgtctgactcgtttcaaccccatggactatagactccatggaattctccaggccagaacactggagtgggtagtctttcccttctctaggggatcttctcaacccagggatcaaacccaagtctcctgcattgaagatggattctttacctgctaagccaccaggtaggctgccttgaaagccaggtaagggatttagactccactgcccaccaaagaaagccaatggtgttttttggtggggttttaaagatttgtctttgagatcctcccctccctctcctttcattttagccaaccatcatttttctgttatttgttacacttacagaataaaatgcactccttatgctattctctattataaaatcaggtagctaaagg

SEQ ID NO: 59686 - DNA, 790 bp, Bovine  19866881066461
tcttttaagtctgtgaacctccaatattgagaaatccctgtagcctcattgactttgaccagctccatattcttggatggcactctaaatgccatcctgtccaagcctttaaaaagtgatcagtaaaccttagaaagtcgcagtgaaaatgtagacagctcaggcaaccgatccatcttctcacagagtagagccactgttaggtaccaatggagtcaagagcttaacgataaaagccagcggaggtggtttcagaaagcaaacagcagattcaagtctacgagagaaatgtacccctgaaataaatgtgagcttttatgtccttccacctaacctcttgtatatatcctttaaacactactgcaggcatcattttagggcccaaaatggggaggtcttctactcagttccgtgggctgacaaacagtaaatgggctactactgatgcttttccaacctttgggatttttgctgtatgcttagtattctcccttagtgagaagtagcctgctaacagtcaaggtttgctttgatcccacaggctttgtctttgttcttagggaccaaagtcagactatctcagtcttagactcctttacagccacactagaaactctattaactctgggcagaaagcaattccaaaaattcccttcttgatttttttcttcatgtcaattgaagctataaaagctgacggagctctttgttaatccaaacacacaaaatgatactagatatataatgctttctatattggcatatatttgctacatcatgcactacaaaa

SEQ ID NO: 59687 - DNA, 1577 bp, Bovine  19866881081020
cttgcataggtgtatctgtttggctaaacccaggtccatatagatgagaaaacaatggaaacagtggcagactttattttggggggctccaaaatcactgcagatagtgactgcagccatgaaattaaaagatgcttactccttggaaggaaagttatgaccagcctagacagcatattaaaaagcagagacattactttgccaacaaaggtccgtctagtcaaggctatggttattccagtagtcatgtatggatgtgagagttggactataaagaaagctgaagaccaaagaattgatgcttttgaactgtggtgttggagaagactcttgagagtcccttggattgcaaggagatccaaccagtccatcctaaaggagataagtcctgagtgttcattggaaggactgatgttgaagctgaaactccaatactttggccacctgatgcgaagagctgactcatttaaaaggaacctgatgctgggaaagattgaatgcaggagaagaaggggatgacagaggatgagatggttggatggcatcactgactcaatggacatgagtctgggtaaactccaggagttggtgatggacaggaaagcctggcgtgttgcagtccatggggtctcaaagagtcggacacaactgaacaactgaactgaggtcatatatgggaccagagctgcaagggagtctgaacactagcctgcatggtacaggaaattagagtggaagagaataaagtgggttaatagtggtaccagacacaatcatttactggccacaaccttgggtatatttgaattttcctgtagaaaaaaaatagggctaaaatacattttatagtgttaataagcttttttgcaaaacacctgacacataataataagtgctcaataaatgaacattttaaactacagttgaccctaacaacatgggagttagggacactaacctgcataattgaaaatccatatataactttacagtcagctctccatatccatggttctgcatccctggattcaactaccatggatcatgtagtactctggtgcatatatattgaaaaaatttgtttataagtggatccatgcagttcaaaattgtgttttcaagggtcagctatatatgaggatacaatgagctcattaaggaaagttttctcatagaaaaataatgaaaatggaacaagcttctcacctcagtaattttagtgttctgaaactctgtcattctgtcttttgatcagttcaaacaattatcaaaatgctctttgatgtgtgttcattgaatcaaatgctttcagtctgactccaacctctaaaattcacccacatctttttactcataaaacatataaatttgatacatgatcactgtaggaaaactggaaaatacagaaaagtataaagaagaaagtaaagatcacaggcaattcacactcattcctcacttatgcatggtaaagtaaaacggcgtgcatggcagccaattcaggtgttcattgtttgaggctaatggaactgaggtcggggttcagcaaaaactggagcacaggccactgggttttg

SEQ ID NO: 59688 - DNA, 1364 bp, Bovine  19866881096036
caggtctgtgtgacagttctatcgcagcttatctgaaaggtcatctatatcccggaggttggggacagtgagagaaagacacaggtttgcccttgtggtttcctaattggcctcagctatgccccacctttcttccttccctattgctagccctgtcgactgcaggtccaacaccagaagcagccctataataaatccctcttgtatgtcattcacagtggttgtgtgtttctgatcaactcctaactaatgcaattctttacgaatgcaatcccaaagaaatttcatagaaattaacaggctgatctgaaaattaatttggatgatgaagaagtcaagaataagctaagagaattttgaaaaaataaagaaggtggatgggggagatttgctctagcagatatcaagagttatttattatacagctatttaatgaaaacagtatgatactggtggagtaataaagcagagattaatagaaaagaatggagagcccataaagacaaacatacaagaaaacgtaagataaaggcacattacaaatcaataagggaaatgataaactattcaatggtgttgtggtatttggatatcttatatgagaaatatgaaaatatatctctactgctgatgctaagttgctgcagtcatgtccaactttttgcagccctgtggattgtagccctccaggctcctctgtccatagggattctccaggcaagaatactggagtggtttgccatttcctcctccaggggatctttctgacccagggatcgaacccaggtctcctgcattgcaggcaaattcttaacccactgaaccactggggaagcgtgtgtgaacatatacatacatctatatgtttgttgacctatatttacatctataacaaatctatactgtccttgtatttatatctctacctattgagagaatgagaatgataaaaagagactggaaggaactacatactaaaaagtcataatggtagtactttgatcgatgttgacttctttatatttttttatattttcttagtattccccttatttatattcttacccagtttcttcactaatatgctgtgtctaatttaaaatttgggccccaagagtagaaaccgcatctaatcatctgattctgcatccagcatcccaccccacatggcctcagtgtgaaatgacccggtggttagcattgccacagccgtagcagatctatctggcacccttgagggggtcttttttggaaaagagtcaatttttaacaatttaagtgtggatcatctagtcttaaagtatctatatccttatattctacaacatttccctcttgcgaccacattgacagtttcatggctc

SEQ ID NO: 59689 - DNA, 1265 bp, Bovine  19866881281372
gataatgcgattcctgccagtagcctctcgaacatgctgggctgctgaccttctgtattaaccactgccatacactgtttgtctctcagtttatgatgtgttgtgacttactgcctgtctactctctgagctcttgatgggctattctgtattttttgtctgactgtagcaaaggaaacagaacagtttggttttatttttggttttatatttgtgggaagggcaactttctgattgctgaaaactgacttttttcttccttaacctatttatgttccaatgccactggtcttgaatacacccatctcccctctggcttcccctgtgggggactgtatgtttctcatcatgccatgcccagtacagaatagactccaacccctctgaggatggctttgctttttttcaaatcctacaaattactgaaactttgcttatgggtagaagtagagatcaaggctctaagaaaaaaaaggaaattctacaaaacccagaagtgagtttaataggaaagaatccctctctctgtgatccttgcccttttctgataagaatgaaatgaagatctcttgcctctttcttccttaaatactccttttctccccccttcaaccctatttcctagacacaataaagcttgaagattaagaccaccaagcatctgtggctcaagaggtacaataagtagagactcaagttaaaggcttgtgaataaatgccattgcctaaaaaggatatggtaaattcagagggaagagatgtgagtgctaatggatgcctccagaggaatgagggcaaagagcaagagtccaggagaaaaacccaagacttcacaagaaagtaattatgttgcagatagaataggaccagaatctatttttaaaaaatgaaaaatccaagggccaagaaaaatgggtctaaaaccagggacaatcaacagctaactgaatgtattgagagaaaaaaggtgagaatggggaggttggacaagtgaatggaaaatcacccaaatacgaacctgaaatatggtgcttctccctaatgatccttgtatccagccagaggaagaaaggacattcagaagaaattgacagaccactctcttccagatgacaaaagggaggctaaacatagaaacagctccactttggactgaagagtagaagcaaggtgagtgaaccaagattcaaaattgaaggggacagaagcaagggaagaggctgtggcaggaagtggagataaatctctgccattaccaacacaat

SEQ ID NO: 59690 - DNA, 1141 bp, Bovine  19866881343799
attctaaagtgtattttaactagtattaacaagttagggatgagatgcacaagcaaaccttaaactggagaatattaatgggcaactagctgccacttagctcaataacattcatgaggaattaggaaagagcagaaaaaatggatgaaataccttagtgcttctgaggacggatagataattaaagaacttctatcatgacaggacagagaagggcagactggaccttaggtcatgggggcagctggatgtcttgaaagtcagcattttaaagatgaggaaaaatctaggatgtgtgtttctgagacaacagcatttctgtgctgctctcagacctaaaccattgtgttgtatttggttctagtatatttgttcccagctgtgctgctacccccatatacgtagcaggtgctcaataaataataataataagagccatcactttttttactgagttcagctttttatgtgtcaggactgctctctctctcttgatattaacaaatctgaatgaagaatcacatggataacttatattcccataacttacattcaacatgcaagtacaacactctccatgggcaacttcattccatgtcatgggtttaactacaatgtagttaaaataaaagatttatacaagacccatgtgatgaaaataaaattaactgcaatgatgataacaacacacagtaggtgggctttgcatggaggagtctgtaggcttttttaaaaatatagcatcgagttttcatttaagatgtaaaattataaccattttagtagtctagaatctctctctctctcaacatgtttgaaaagttaaataacctacatcatgttagaaaccttgcaaagcataaacattacatggcatgggcatataaaagattttctactatgacactgaccttacaaagcaaaatagcacctttggaatgacaatagcaggtgaaaatgtgtgtaatgaagtaggtcagttgaatgtttcagaccaacatcaatttaccaaccactacctcttacaactgctttctagcatcctagaactgatcatctagaagcccaatttaataaaatagcttagtgggagggtttttttttaaacttacctacatctcaaattagagtttaaagagat

SEQ ID NO: 59691 - DNA, 778 bp, Bovine  19866881374393
cccccagctggtgctctgcctagagacctgctccagtactgaagccaggctaaatctgattcttagactcaagatcttcccaaaaccacactcaggaatgtgcctcattctgactgtcccaggcccaggaagactagaacttagtatttatcatggacatttgttttgtcacagcacaacttagcactgaaggcaaagctttacagggttttgataaacagctgccttcatgacctcctggttgaaaggcacagtggcaccttccccagcagggttgctttcaatgcatgattcacccaggtattgctttattggcattctttccctgccacttacaaataagcagcttttccaaaaataggtaaataaatacaaagttgaaaagagcaatcatttctattaatctctagcaaagggcaggaacaggaaataggaaagatcttcatgtttgctctatctgccttgggatttggtttcctaaaattaaggccaaaacaaagtttgcagtctcctctgacaatatgtgtggatattcaggtaaggtcattcgcctgccagacagcattttggtgttatcaagacagccacttaaagaaccacagtggattaaggaaatccttcagaaaagaaaggcatctgacagggcaaggacaatgaaggaattaactctgggggagagtcatctccagcctgggaaatgcaagcccaggaaatagaatcagggaagatgataagaatgaagcagtccaatctctcctcttggttattattgcctctt

SEQ ID NO: 59692 - DNA, 1571 bp, Bovine  19866881635604
tttttttttcttatatttaaactgaaggagttgaaatgatgatctttcaagttctttccaggtctaagtatactttcatttcattcactagtttttttttttttttccccctctattcttatgtgactctcataaagtgcttcttctacttcataaaggagataaaagagataaaattcaaaccagcatttcagctgtcttttgactgccaacaagatgacagttttaggagtgtcttggtttagtgatgtgtaacagtaatgatagtgagcagtgttgtatataatttaattcgtaagcatgcctccaccatttaatgttattttctatacacttaaaatgataaaatagtgagcagaatttttttaaacgttattttgttattgtatatgtcctattcccgcaggagaaagtgtagtgatttttttcttcttttcaagctcatgcaaagtgacaggtttagaatatatttctaaatcaaagaatgaccattataggactcgatcatacaagttacttccctaactaccatttatttgtgataaaattggctacattcctgatgataattctgcaagacagcagtaggatatgacttgccttcccactgtttgatataaatctcccctgatacgaattgagttcagctgcagtgaacttaaatgctaatgttgaaaacataaggcagcctgctgcttcatttataccagaaagttttaacttctccagtctcctgtataccccctcccatcttaagttagatcaaattagaaccactccatttctgtctgaagggtgaaattcacaatcttgatttacataactcaacatgaaaatggaagaaggaattaatcctaaggatgggtgcactcctcttgtctttgaataatataccataacaattaggggaaaacggtcagtgcaatagcatttatcaggtagccaaccagtgtttgtgaagtactggcagagccagtactgtataaagcattctaagatcaagaaaataatgatagtcaaaatgaataatggaatttgttgggtgctctgtgtgtgccaggcagtgtggtaagcactttacacctgtgatatcaagaaatcctcaaaataaccccatgaagtacgcacctataaggagaaactgaatccctgagagacttaaaacaaaatggcccagggactttcttggtggtccaatgtttaagaatctgcctgccaatgcaggggacacaggttcaatgtctagtctgagaagataccacatgccttggggcaactaagcccatgtgccacaactgctgaagcccacgctccttaaagcccatgttcagtgacaggataagccaccacaatgagaagcctgcccaccacaactagagagcagcctctgcttgccgcaactagagaaagcctgcacacagtaacccagtgcagctaaataatgaaaatacatttaaaaaagcggcccaaggactccaaaaccaggattcaaacatgggtatccatattcttggcttcttgatgttccctaactttaaacagcttacaatctgagttaggaacacaaggaa

SEQ ID NO: 59693 - DNA, 781 bp, Bovine  19866881761599
accaactgcaaggcaggttcatgaggggcaagtagttcctgtgactggagtcctggaagcacaggagaaatggcagactagatcagagcagagcttcttcaactcagcactacatacattttgttcctctctttgttgtggaagctgtctggtgcattgtagactgtttaatagtatctctggcttctacccactaaatgacagtacacacacacaaacacacacacactcatggtgaccatcaaaaatgtctataggcattgtcaaatgtcctctgtgaggtaaaactgacaaattttgatcctggttgaaaacaactaaattacagaggtagaaatgggtcaatttatgaatggttttacatgggatttggatattttcttctaagcagtggaaatcgtggaaggaattgacatgatcatatatgatcctgagacctatcacttttgtttggaggatctgcagagggacaaagctggagtaagaagcccagtcgggggaagtctacaggaagagtccaagcaagggcaggggatgcaagcctgaccagagtcagtagcattagagcagagagaggagagcagaagataggaaagagctgataaaatgatgtcatgttcccctccctgccttctcagtcaaaataataaccaaaaagccaacaaagtaagtcttaaaatgattagaactggtaaatagatttacaatgtgatgatagaaaaatgaatacttcatgaagctttcctgagaacgtattactgctttttcgaaaatcatttca

SEQ ID NO: 59694 - DNA, 3593 bp, Bovine  19866880347827
atttttatatccaaaacagcaatcttgtggtctgatacagatacatggtgtgtgtttgtgtgcatgtcacttaactgtgtccaactctttgtgaccccatggactgtagcccgccaggctcctgtgtccatggcttctccaggcaagaatacttgagtgggttgttattttctcctccaggggatctttctgacccagggatggaactctcatctcttccattttctgcattggtaggcagattctttatcactgagccacctgggaagcccagatacaccgtagagatagaaaaacagatgaatagctattaatatgagatagcagatattgtcatctattcttctgtgtacctttaagttttaaattcatggtgatatgtcatgaaaatactttagattttgataaacagatatttagcaatcttttacttatgagttttggtttttgtatatggatttaaaatgctaccttttattctaaaatgataaagatattaaccattttctttcaaatagcttcaaagctctgtttttcatctttagattttaatctgttaccatctatgctatggagatagagatctaattaattttttttcctttttcctagatagaaagccaaatatctctacattgtttactgaattcaaatatatgaaagggcatatatttgggggtcagtttctgtacccacacatccaggattttattacagcactttgcaaaaatcttgatttttcagttacaaaagaaccctttattatgttcttgtttttcagaatttccattattattctggttattttgcaaagactgctattattcataaacctaaccatgtttgccaaacatcaacaaaacaaaataaatttatttattaggatttttattaaatgttctctaaactttttcacctctttctagagaatcaatattattatcataaagtctatccatcaaacaggacttcaggtggctcactggtaaagaattcatttgccaagcaagagacatgggttcaatccctaggtagggaagatcccctggaggaggaaatggcaacccactccagtactcttgcctggagaagcccatggacagaggaacctggtgggctatagtctacagggtcacaaaagagttgcatatgacttagcaactaaataacaagaacatccatcaatcaactcatgttattccatttattgggtctacctatattgctgagcattatttcataatttttctgtgtgcacatacatcttttgcttggtatattcctggaaaatgtcctgatggccagactggttattcaactctctaacatattcacttgaaagtcccaaaatggaaatagttactctctttttccctatgtccataaatgtcactattatccattccccgccttgctcaagcggctcaccagccttccttggtttagtctctctcctcatattcaatccttctgggagtcctacacgttccaccctctcatgaaaaattttagtttccactggagattgctggcttcaggtctcctcacacacagacctacacacagaaacacacggcacttattagacgcagtgtttctgatgtgatagatactgggcatgtatatgtgttgaagtgaaatagctcagtggtgtccaactcttttcgaccccacagactgtagcccaccaggctcctctgtccaggggcttctccaggcaagaatactgcagtgggttgccatttccttccccaggggatctttccgacccgaggatcgaacctgagtctccagcactgcaggcaggctcttgaccgtctgagccaccagggaagccagtttgtatgtattagtcatccactgttagatgacaagtacgactaaatgaagggctcggctttcaaacatttgttagcagcaagcacttattacctcacagattctaggcgaggtggagccacagattctgcaggcgctgtgatcacgttaaggctcagctgagcatagacgagctcgtgacctcactcagctatttgtgtgccacgcttacgcctcaccggccgttgagccaaatacaccattttttctttatttacatggacttctgcacagggcagctcccaacactgcaactgggttcctcagagcaagccagcacaatcaaaagaaagaccgtgcactcaagacagaagtcacagtccttgacattttcgtctcgaagtggcatccatccctttcgctctattctatttgtaagcggcaagttactagacctggatgacacttgagaagaatggattatagaaagacacgatacggatcccaaaagaccgttaatgttccccgcaactcatccaaactttagacagattgcttcttgactacctttacttaaggaattcgcttcagaaaattggaattgcaaattctttctgtggctctttgagatcagccagctggctttccttttggctcagctggtaaagaatctgcctgcaatgcctgggatcagtccccgagttgggaagatcccctggagaagggaaaggctacccactcctgtattctggcctggaaaattctatggactatacagttgccaagagttgggcaggactgagtgactttcacttgagatcagcaccttctttccaagatcctgccagtctcaacacccaggagagtctttttcaggcatcctggagccctcctttggaaacttaatgatcagggaagacaggacccccagctcccagtctctgcacaagggcaggagtctaactgttaccaaccagcaaacatagataatcttaccaccccgagcaacctcccccaacatcctccaacagtttacaactagtgttccacaggacttaaaatctctatcaattttttgtttcaggaaaattgaactcagtttctctcccttactgcaagagtcttgaataaaatctttcttgccactttaaagaaacatccagaggcatttttcttttacaataggaagagacagggaatctagagaccctttcagaagctgtctaccactgcgtgttactagactgcatgtatataatcaaaaatgtcatttcagctccttttaactgatactttttttttttttttggcatatctacatagtaaagagacacatttggtgttgtgaagttgagctggcagattataatggatacaaaaaaaagctttaatatcctttataggatcaatgctatttagatgacctgctactgacaacctacagaatcaccaagaaaaaaacccacttggtacaaccagaattaccacatctcagcagtacccccttcaaaggggaaaaagattaatttctcaccggtaaccggtaatctgtgccccattagaccgagggctgcccctggccctcatcacgaatattcaccaaatgaaaacaaacacaatttggtagaaataaacaaacctccactgccttcattgggaatttactatactacagccaggcttgacattaacatcttaatagctctgacagaatcacttaagaacccagcttcatgtaaacaggaaaaaaaaaaaaaaagttaatgaggagaaaa

SEQ ID NO: 59695 - DNA, 1706 bp, Bovine  19866880386512
tccccccttccctacatgggcttagctggtatagaatctgcctgcaatgaaggagacctcggtttgattcttggttgggaagatccccttgagaagggatagggtgtccactccagtattcttgggcttcgcttgcggctcagctaggaaataatctgcctgaaatgccagagacctgggttcgatccctgggttgggaagatcccctagagaagggaaagcctacccacttcagtagtcagccctggagaattccatggactgtataatccatgtggtcgtcaagagtcagacacaactgagcggctttcactttcctcttccccatcaaatgcagtaaaactctccaatcaataagcctgtaaaagactcctctataaaaatccagaagtatcctggggcaacccaccaggtgcaatgacagttcactgcactgccatgtaatgtgttaaatgtttcagtttggtgtaaaagtggcttccctgggagtcagacacaaagaatctgactgcaatgaaggagatggtttggggagaaaggtaatccctagttcaggaagatcccctggaggagggcatggcaacccactccagtattcttgcctggagaatcccatggacagaggagcctggtgggctacagtccatggggtcgcaaaaagttgaatacgactgaactcctcttgggtggaacaaactcttcagtggcctcataatgtataaaggttaaatgtcagggacctggtggttatttatttccaaagtgttaaacacactgggctctgataaacatgctcaatgtgtcacagtcaattagaaagccttccagagtgaacgagcttctgactctgaggaatgccactggcatgagataaacagagagctggacaatgtccgggaccaccaccttccgtcagataccaaatgcaatcccaaccgaccgcaaaggcaagcgtgcaaaggagctgctcgctctttgggactaaaaatatattgtttttcttcaggcagtggggtttcttgtgactccagcacaactttgtgtagctcaaagataaagaatgggcatcatacatcacaagtttcaactgggctctttctgtaaggatgggacagtaggtatatatgcatcaggatggacagatggaactagaaatgtcttctttacagtgtgaccaaaccttagtctgagtcatgcctaggcaaaggaccccttagggagagcaccctggtcataaagagtccgacttgctttgttgttgttctcccgctaagttgtgtccaactcttagctgcccatgggctgcagcacactagtcccctgtccttcactatctcctggagttgctcaaacgcacgtccattgagctaccgtgacggaaaactggtatgtgtaaagggttgatgccaaattacatgctgcaaagttatacaaaggtcaacagaggtcctttttgccaacatagatctgtctagtcaaggctatggtttttccagtaatcatgtacagacgtgtaagttggactataaagaaagctgagcaccaaagaattgatgcttttgaactgtggtgttggagagtccctcggactgcaaggagattcaaccagtccttcctaaaggagatcagtcctgagtgttcattgaaaggactgatgctaaagctgaaactccaatccttggccacctgatgcaaagaacagactc

SEQ ID NO: 59696 - DNA, 919 bp, Bovine  19866880511080
aggaaggaaaggaaaaaagaaagaagagaaagagagaggcagagtagtagagtaaaaaaaagtaaagaaacaggagaacggaaggaggcaaggaaggaggggagagagaaggcaggccatccttacaaagtgcactcttgaagccagtgcatccctcgcaccaatggaaaatgaactcacccacactggtcgctccgctctgaaaggacgcagttgagagaagtcctttctttattgtgtggttttaaagactattctttgacctctgctatttatgacttgaaagctgtgaagacagggccaggcccctttggctccaaaaggcgctgacacacaaaagcttttcacctttgttccacgtacctcattccaccccccacccccttgactcaggacacatccctaccgcagccccctggtttcacagactgaattctcccctttctctggcccagttacagccattgccgagctgacaagtggccaccttcactcctttgcagggaatgaagccctggtcgtcaccacccggctgagagggggtctggtaggaatatagatgtcttgtcatctcacgtcagttaaccatgaaattgtaggcagaatggttcaggaaaccaagcaacgcacgggggcaagtttcagccacaatgtgggatttctcgagttattcttttacgatttacagatttatctgttccctttctcactcttaatagcattcgagacagttttcaaagttccatcggatatagccagaaaaacagataaaaactggacaataaaaactggatcagtgataaagctagttcccaaaatacatgagataaatttcagtaaccttgctaaagtaagtgattttatttaccgctgagccttccaacagccaactctaaggggaaaatacagtgtccaaggg

SEQ ID NO: 59697 - DNA, 1942 bp, Bovine  19866880638956
attatttttattagtttttcatttcatcttcatcatacaagggtttctttcagtaaaacggcttccagtttgatgggggcaaaatggatctttgcgtttccctcctgagtcgcaggggtgcagatggcaaaataaccccttataacaacgcttcgggtggaaacggtcctttcctttttttttgagatgaacttggtagactcctccaaccagctgaggctgatggtgaaaatgtaaagtgaaaattcagcgctgcgtgtgtgttttcaactagctggggaacacacattatgtccctgaggaccacttggccagtgtaactttggagagaggtctgtgggggagaccataggtttcatttcaagaggagccgaaggaagcctgtctcctgcttttttcgagatggcgaggattatccctacccgaaaaaataggttccctagcaacaagagataagagaacgtactcataaatttcccctacctactcatttaaaaaaaaaaaaaaatgctgtgaagcagatggtttggatcaggcaggtattccagggtcttaatttactcagtgtcggtacatggagcataaatattgaagtgtttgcacgctgccgtttgcaaaactgcagcctgacaactctttcaaagaggagaggtttccaaagacccagcttccccccatcaataatccaaacaggatgctggcagagagaaagccacgggggacccagatccctgggcatgtgtgaaggaaataggcagggcagagaattcaggatgctcggtatagcacaggataaaaaagaaagcaaagctgtcagaaggataactgggaagaaacggaggtctggagttcaaaactggaaacggttgcacattggcaagaaatctttacaaaatctatttattttatgtagctatgcaatgtagcatcggacagtgccgcttccaaatgaagctctatctttgcatttacccgactccattgctttttttaaaaaattgccttacctggctacatcttggtggaggtggttcctgggctttatgactaaaggtacctcatgtgtgtatagaagtgcgtcaggaggcagttttgccctgggtctcgggtgggaaagagctaagagatgagaattttcactcacaggtcagaaatcgaaaagctctttgtcccttccactgtaaattattgaaaataatttccgtcttgtgtctgtgcgcaatgaaaacttcagtccctttaatgtttctctggtgctcataacctagattcttactctgctaagaccaggatgtgatccacggacaagctatttttttatttatatttttcttataatttttgtcaagtacagctgatgtatagtattacatgtttcaggggtacagtatagtgactcacaattttttatgtgtctgtgattcataatttttaaaggttatactccatttatggttataaaatattgggtatattccctatgctatacactataaattttgaaaatgaaatttgaaacattcataaatataagtatatatatatatacatatatatatatatacagtccatgaaattctctgggccagaatactggagtgggttgcctttcctttcttctccagtggatcttcccaatccagggatcaaacccaggtctcctgcattgcaggcggattctttaccagctgagccaccagggaagcccaagaatactggagtgggtagcctatcccttctccagcggatcttcccaacccaggaatagaaacagtttctcctgcattgcaggtggattctttaccaacttagctatcagggaagcacatacagttacatataaacatctctgtctctgtctttctcttctctcactggtatatccacctgagtcgtgtgtctctttttaagacatgcagatatattttcccttcatatacat

SEQ ID NO: 59698 - DNA, 2207 bp, Bovine  19866880641766
ccatctcccgggttcactcaaactcacgtccactgagttggtgatgccatccagccatctcatcctctgtcgtccccttctcctcctgcccccaatccctcccagcatcacagtcttttccaatgaatcaactcttcgcgtgaggtggccgaaatactggagtttcagcttcagcatcattccttccaaagaacacccagggctgatctccttcagaatggactggttggatgtccttgcagtccaagggactctcaagagtcttctccaacaccacagttccaaagcatcaattcttctgtgctcagccttcttcacagtccaactctcacatccatacatgaccacaggaaaaaacatagccttgactagacggacctttgtaggcaaagtaatgtctctgcttttgaatatgctatctaggttggtcataactttccttccaaggagtgtcttttaatttcatggctgcagtcaccatctgcagtgattttggagccccccaaaataaagtctgacactgtttccactgtttccccatctatttcccagggtataactttagttaaagcagtcatcaggaagaaactgtttatggcgtcagatgcagatgacttatttttagaacaaacaccttacattttcaataggaaaaaaataaatgagtctgtgcattggaggtgtgagataaaattaacatgaggcggacaggaacaatgcagattgtgtgggtaggaatttatttcccttttggcttccaagaatcagtgctatcagagtaaaaattggccctcttcaagagataacgaggtttcgtgccagctttgttttgttattattcttcatgctattatttttggcttgcacacaagctgcctttctgcagcaaggattggaaaatggtttctccacgtttgacataaatgtaaagtctgtccattcctgagcctgcatgttttgcaaaaatatcatgcaccagcatcttcgttctagtttggaacggattcaggaaaaatgtccttggctccagagtggctttaaacccggtctggacgctctggaaggctggactgggtttcagcacatttccctgtgccccttgcagtaaggttggagacccgggggcgacactgagacctgagcctagaaatagacacagctctgtttctccatgctacctggcccctggcacattttgcacagagatgcaccgtctgaaaggaacataagacagtcacacgtgaaaggccacaaaaacagcgagaaagaaacgtctatctcaccgagaacgcctcgctcacctcgccaaggtttacagcctgtgggcgcctgattcaggctgccctgggtttcaggaaccggtgaacgccagagataaaaacaggaggctggcttcccgtggggttttgcaagttcctctgcaatcctgaaggcctttagccgagtcttccagtggcgataggcgtgtggaccccaagggtctgtggcatcagctggcctatttgacccggagccccgggggtgccgactccctctcttaaactgtcgtctccttgtgttttgatgtgcgagtagcggactgttctctgggttcctccagcctgcctcgttctgtcccgtgctggggcatttgcacgtgcagaattgttgatttgcagccctttcccccagcagggggcgctagcggcaaagaacgcgcctggctacgccggagacaagagacgtgggtccgatccctgagtgcggaagatcccctggaggagggcactgcatcctactccggtattcttgcctggacaatccccatggacagaggagcctggggagatatggtccatggcgtcgcaaagggtcagaaacgactgacgtgattgagcacgtgcgtgcacgcacacacacacagataggcacataactcttcatttccccaagaggccttttctgaccattcatgctcaggtaccaccccaaacccccgaaatctttcgcggcttactatgccagagtatataaatgatgatatgatgagtaaataaattcgtacatgaatgtgttcctaacataggagatttgatttgggtgatgtatcgtacattcagttcagttcagtcactcagtcgtgtccgactctttgcgaccccatgaatcgcagcacaccaggcctccctgtccatcaccaactcctggagttcacccagactcacgtc

SEQ ID NO: 59699 - DNA, 1846 bp, Bovine  19866880708456
atgtgaataatagagaggatggcaaattagctcgacatgaatctcaagagctttgcagaaagatgggtaaaaagttaaaggagagagtggccctaaagaggattttgagtttttaggctgaatgattgaatgaatattcatgtttttcattaacatggagattccagggagaggacttggtttggggaaggcaaataagcaactggggccaggtcacagagtttacaaatcacagcctcaggcccatggcccaaagaccagacttgccacatgccattcacagcctctcatgcacagggcagaagaaacgtgtctcactcagggcacagtgacttaaagggcttttaaagaaccataaatcagaacggattgatttgagtcgagtccacacctcaggatagaaatactgtttcagggaagaacctgtttacgttaacctttgcttcccagtgcttttactaaaagggtacctctgtacataaaggcctgcctcggggaaccctgccctctgcctgaaagttaacacattccccttcccaactgtccccaaggctggccattccaggagatatttgcaagatcaatggccttttaaactttacttcctaatctcctgtctctgcgtgttctataaaagaacctggcatccagactccagtaagacagttattttgagacatcagtctgccatcttctcagtctgctggctctcccaataaagtcattattccttgctgcatcacctcgtctcccaacttacttgcctgtcatgcactcagcagagcaaatttggactcggtaagaatatggtggtggtttatgcacatatggacagagcaatatcagaaagaatgaggcaggtaaagaaaggacatttcattgaccaaaaatgacattctcattcttccttccaaatatcagagggcaagtaccactgtcccatttccattagacactagggattcagaaagagccttcaactccatacattaaggatcttaaggcttgatttatactactataaaggcattcttgatgcactcttacaagtgaaaggagaatgcaggccgcctagccttgacttcctcctgagcaaaacacaacctctcaacagatggcagctaatgtaataacgtacaagctttctgcacagtggctcacagagggctggagatgggactcacccaacctaggttattttttttcctcccaaactctgtcccaggagtgagcagaaaatgatttagaagtcaaagagaagagcctccgagtgtgcataattcaacattccaccagagttcacgtctcctaataatattctccattaccagttggaaaacaaaagttgtaaggcgtttcattgtctttttgtctccaagtgacaaagagatgaaataaacatacgtgggatgccaagcataaaagcagagaatgggtgcaggacggagctgcatcccagacccttaaaatacagcaaaccgatgtgttggtggcaaacctgccctggggtcttgaaattagtgtctgtctttaaagcaacaggctttcctggggaacaggacacttttcgatgtagctcctcgcagtaggttggggatggccgagatttacagttgattaacctgcatagctgagttgctttctcaaaggcttctaggaagggattacttctgtgcccaaagagcccgagagaatggggagggcggctcgcggccgtaatgtgcattccccaggctccgtacactgtgctcattgaagcagataaagcaaagttaaagaagcatttagttcttcagaatggcagccttaataagtatctttttttgtgtggaaggatttaggagga

SEQ ID NO: 59700 - DNA, 1325 bp, Bovine  19866880862611
cagttgggctccaagtcggataactttctagatctgggtttctgcaaagcagacccccaagacagggtctgagttcaggcaacaggctgatgtgtgagcaaatctgggaggcagcttggcagactgaggaaatgagaaagggaagtgaaggcagacgatgaagggagcctcgcccagcccatgagtgtgagcgccatgggcagaggaagccccacctccctggggccctgagggagctggtatagctctgtacctcagaagctctccttgtacaggaggagggagctggggtatttatactctggctcccagagctgtgtgccaggtgccagtggcatctgctccccgcatcatgatgagtaaaaatgtctccagacagggccccatgtccccagtgggtaaaatcacccaggctgagaactccactgcagaaggaagtgaggatggagtttgacacgcagctcaaaggcaccatcccttgcctgaaaaatgggttccttccctgcatccaggcaaactctcctttgaaataatgatttattattttttggctgagctgggtcttcgttgctgtgtgtgacaaagttgccggaagtgggggctgtctctagctgtggggctcgggcttgtcatcgaggcggcttctcttgttttggagcatcggctccagggcgcgtaggctcagtagctgtggtgcacaggctcagctggcctgcagcgtgtgggatcttcctggaccagggatcaaacccgtgtccgctgcactggcaggcggattcttcaacactgtggagatccagggaagtccaacccttcctttcttattcaaggtccagccatggtgctgttatttccaggtctgacacccctctagtcttgatgggagccgtcgtgtgatgttttgccgctacttctgaccttgtcagctccacgtctggggcaccctcttggagagtctgtgaactacttactattccctaataaattcattttctgtttaaactagccagagtgaagccctgtggttcacaaccaagaacccaggctgatacaatcggcctcattaagattcacccccgatccccttctaaaacctaggtcttttgttcttcaggttcagaagtcaggcagatactccaggaagagctcacaaaggccaattcccatgcctgagacccatgggaacatgccaatttccacatgaacgctgaggttcaatgctgtctctattattttccccccccctccccctttcaggactacttgagaaagtttgtaggaatcaaaattccatctgatctctacacatttatgctttttgtcct

SEQ ID NO: 59701 - DNA, 901 bp, Bovine  19866881040713
acggagaggtaatgaggtggacatggaaggcacgaacaggataggaccaatggatgatctagggagacaagaaagggtggtctcaagaaagtgggtccaaggaccaccctggaccccctgcagaaccagctgatcacccactcccatgaatcctcatcctcgggcacttcctcagctgctgccaggacctgatcttcttggtccctcccaggccatcagtctgcccttgaatcccccgggcctaagcccagcaccctcccttctagccagcacgtcacccattgtttgtcagatctagtttctttctaactttctttaataaagacacaggactgaaaaaaaaaacaaaggtaatttggagttttaaggggctctccaatcaagttgggaatcagctgaaatagatgtgctaaagtcagagattttaaaaaacatagcagttttattgaagtattaattttggagggcaaggtttaggtctggccagaggacttgctcggagaaggcaatggcaccccactccagtactcttgcctggaaaatcccatggatggaggagcctggtaggttgcagtccatggggtccctaagagtcagacaggactgaacgacttcactttcacttttcactttcatgcattggagaaggaaatggcagaccactccagtgttcttgcctggagaatcccagggacgggggagcctggtggctgccgtctatggggtcacacagagtcggacacaactgaagtgacttagcagcagcagcagcagaggacttgctaacactctcttgagctatgattcatgtcccagaattcaagctttgctcctcagggagagatcctgcttgtctaggtttactgcatggttaagaacagatgagaatgcatggtttcaa

SEQ ID NO: 59702 - DNA, 1883 bp, Bovine  19866881657360
ctctggggtgctgcgtgctctccttctccttctggatgttgtaactctgttggttgacttttgtttcccatttggttgtgaggatttgagttgaaaagcagtaattcagagctcaatcttggtgtggtggcttgttactttgatctcagtgggagttctgttcttataagggccataactccagatgcttagtgattttccaggcgtattctgaagccaaatttggaggtgaggaagattggttttgcttgtatgaacatctggacggcttcatttggcatctgtgaaatttattggataaaggtcaaaccccagaaacataactgaatgtgactgttggaggcttttgttttgtgttaaatgctttccatgatttatgtggtaatgactgtaagtccatagagccccaggaaaatacatcctaaggaggaaaatgaaaactcaggcacccatggaaatgtgctatgtccaaatagccaaaaaaccaaagttgaacagtttatcttttacagtgctgtaatatgcaacagtttgaaattccagttgttccttatactttaaaacacttaaaacctatggtaatacttaccgatattcatgcagttttccctgactttgtataaatatccatttcagggacaaagttgatgtatattgagcatctcttgtccaacgtactgatgtcttttgggagtttacaaagtatttcattaagcttcctggtggctcagaggttaaagtgtctgcctccaatgtgggagacctgggttcgatccctgggtcgggaagatcccctggagaaggaagtggcaacccactccagtattcttgcttggagaatcccatggacggaggagcctggtaggctacagtccatagcgtcgcaaagagttggacacgactgagcgacttcactttctttcataagtacagtctccagtaatgtgtcaagagaagttgtaggtttatgctgctgcaagagtagaaaacttctcgagtgttgtaattaattccctttatttttaatattagtgttattattttcataagtaatgatcatggcattgttcttcacttgctaagtcgtgcctgaccctttgcaaccccacggacatgataggtttccctgtcctttccgatctccctgagtttgcttaaactcatgttcactgagtcaatgatgccatccaaccatcttgtcctctgccacccccttgattataacttcatttttaagtaaatgggatgtgataatttaggaagagagatattctatttctttaaaccagtggtggaattaaaatgtgtatggaacacataggaaaagaaatcgtgaggtgtgttaaagtttggctactgttcttttgaaaaatcggtcagtaatgcaatattgtgccagcatgatgaataaaacctgttgaatgcacatttttcagactctgctataacaccatgacagtaaatggcataatctcgaggacgccaaagaccgctgagtgctcgccaagcgaatgaagtctctcctctgggagacctgagctcttagagttcctggtctccgtgcagttgcaaatcacacagtcagcaagtctgagttagggttccacgtgccaccatagtctccagtcctccatccagtatcgctgtagggaaacatgcaagtcgatatgatctctgacttaaagggcagaagtggagaaaagagaaagaacgaagtgggaagaatgtggagcccatgaaaacaaaaacaagttacagatggtttgtttgttggttcagttgcaaagtcgtatccaactctgcgaccacatggactgcagcacaccaggctttccctgtccttcagtgtgtcctggaatttgctcacacccatgtccgttgag

SEQ ID NO: 59703 - DNA, 858 bp, Bovine  19866881744220
atgagcgagcaagtgagtgaaagttgctcagttgtgtcagactctttgcgacccccatgcaaagtccatggaattctgtgggtcagaatactggaatgggttgctgtaatcttctccagggcatcttcccaacccagggatcaaacccaggtctcctgcactgcaggcggattcttcaccagctgagccaccctggaagcccaagaatactggagtgggtagtctaccccttctccagcggaatcttcccgacccaggaatcgaaccgagatctcctgcattacaggtggatccttaaccagctgagttacctgggaagctccttaaatgagtaggttatctctgttaattctccaaagagagcagagcacccctctaaaaatttaggttcccagaaaagacaaataatcatgtctcccaaaatttacattattaattacacagtaattgcaatgggaaaatctgtttattttttattcaaattacatcaactgttttccagaagtaaattaaacttcagtttccccactcagcttttaaaaacaaaatccttccaaaacaagtgagggagatatttcagataaacatatcctcattatgtatctcctccaggccctgtacctaatggggatatattctgatacacgtatacactgtacatactatttctgtgtaagaagttgattacagatatatcaaaaataacttatccagttatatggatataactcagtaacatgtacatgtaattgcatataagattacgttcggatattcatatggggcttccccggtggctgagacagtgaagaatccgcctgcaatgctgaagacccgggttcaatccctgagtcgtga

SEQ ID NO: 59704 - DNA, 2315 bp, Bovine  19866880348180
aaaaaaaaatctctgctcaaatatcattctaatgataagtgtgacatttacttgtagaaatgtgcttctaatctccttatgggggttagaagcatatacagaacaaggaaagctgtgggctggctgagctcccaagacaagagctgaggtgcggagactgagctcagagagttgagacatcagagaggcaagaaggaaccagccaaggagactgagaaggagcagccaggggcagcaactaggagatggtggtgtcagggaaactcagtgaaaggagggttttaggaagagagcagtggttaactgaatcaaaaggtgctgagagatcaagtgagaagaggattagccagtgggcttggcaatgaggaggtcactgatgatcatgggaagagccacataccaagcctctggtccctatttcctgagacaggggcacctgctttaatagccagaaggagactgtggcatggacagggcgggtgctacgcgtgctgacatccagggctcctctggctcaggcgaacttactttctggggtagatgaccatcttggagtcaaggtcagatctgccagcccctcttttaccattgaggagcctgctccccaggctggggcctttgattcccctctttggtggggctcagagagcacgctttccagggagcaccagcttgagttactggtgtttccagttgggaagggacttggggcactttaatcctcatcccttattcacagaagtggaaaccaacccagggagagccagggctgattagaagcagagcttctggggcagaaacccacttctgcaaggggcaataaaccagcgcagttaagacagggcactttaaactcaggtcgtcctggtttgagccacctcctgacctcatggacacagcaagttacttaatatactgagtcccaattgtgccatctgcaaaatgtcttgctgcatgctgaaatgagatagtacatgttgcttggtggttattctgactatgaaatcagagtccttagggactttagttagagaacatgcactgtttctaggagccagccagaataggaggctttcttgaatttggccccaaaaggtttggccctaagatggttgaacttcccgtggtctctagatacttcctttggtctggcctagaaggctaaggctgggaagggtttctgacaacagggaaaaggagctctgcttgagcccttaggtcacaccaggcagcttcttgcctctcttttttgctggtcaggtccactatgggtgggtgaggacatagcctgtgtctcactcggctcctctgctctctctgcagatcagcaacgccgtcctcatcatcttcgtcagctactttggcagccgggtgcaccgtccaaggctgattggcattgggggtcttctgctagctttgggggcctttatcctcaccctcccacacttcctctcagagccttaccaatacaccaagaccatcatgggtaagtggcctcccattactgcttcaagggaatgagggtacatagttctgtgtgttctgactgtcagatacaatctggggaggaaagccaaggaaactttctggtgggataggacagcagagctcagagtggtatccattgcccagaagcccccctgccaacttagtgagacaccccctcaatcctcctgtgcttttggtgcacatttaagaatgttttgctacattccagtcaggaaagacttctaccctgtgtttttataagtttcatagtttcacatttacgttttgagttagttttttataaggttgtttttcttctttttgcatatggatgttaaatcctttaagcatcgtttgtcaaaaagactctcttttctccattaaatattttttgcatcgttataaaaaatcagttggacatttttttaaaataaaataagagacacatttttaatttattattcgctgtgctgggtcttccttgttgcatgggctttctctagttgcagtcagcagcgggggctcctctttagttgtggtgtgcaggcttctcattgcggtagcttttcttgttgcagagcataggctctagggtgtgcaggcttcagtagctgtggcccggaggctcagcagttgcggcttccaagctctagagcgcaggcttaatagttgtggtgcatgggcttagttgttccatggcaagcgggatcttcccggacgagggttcagactcttgtctccggtactggcaggcagattctttaccactgagccaccagggaagccctcagttggacatatgtgtaagggtccatttctagacttgt

SEQ ID NO: 59705 - DNA, 732 bp, Bovine  19866880794576
ctgcataatatctaatatcttaacaacactgtttctatatttgtccaattttctgttatttggggtggaagaaaatctggttcattaatccatcttggtcatgattagaagttgtaaatgttcaccttttgatagcataagattgaaatgtcttgttagtcatccaggtggagatataaagttcatgattttaagagtcaaagactttgtgggaaaccaacatgtttactccatttagttccttggaacttgctgcaaataccttgactgctgacagataagagttgattccaggatgttctgtacatggagagaggtggggtacaggctcaacactcactgcacagccactgccactgtgatgattgttttaaatcttgaacaggcagagttgatttttgtccaggcttgtcgtagcttacaaaatttaattccttcaaacactgggttgggttggtaatctacttgctttccatttcatttattaatcataaccaaggttttttcctggtcatagttctcaaatcctgaagtgttttcttacccttttcctttgcctttctctcagtgtaaaggcagctaatttgagcttgaacaaaaaagatcaaaatttaaaatttgcactgagtacttagttcaactgctacactttactgagcctttattgtttaaagctttaaaaattcctatatcttactatttggagacttcaaaatacttggtcttttcctt

SEQ ID NO: 59706 - DNA, 1213 bp, Bovine  19866880905507
atccctgggttgggaagatcccctggagaagggcatagcaacccactccagtattcttgcctggagaatcccatggacagaggatcctggcgggccgcagtttatggggtctcatagagtcagatatgactgagcgactaagcacagcatgtagtatagttttgagagctctcagggagggaaaagtgttaaaacattgtacagcatatgatttcaactgatatatggggtcagtatttcttcattgaaaatattatatctcatgtcacgcttttgtctcttgaaaactttgcatttgaaatatggaaatgctagtgcaaagtttctgagaaaatcctttcttgtcttctggtttaaatgtacttcattgacaacactgtgggctttttaaaccttttgcctgcctgagccctattggaaacagcattggaaagctttcagtgatgaaggtcacccagctcttacacagagttcccagtgggcattatttccatgaggtgtgaggtatataattagcagagagtcagcaaataagattttaaggaatgtgattatggaagcagaagagtcatttcaggcaagtttgtaatatgtgtttcaggaaaggagcagaagtcaaccagtgagggcctggaccacagccctgattccagctgccttaataccctcgttagaaactcagatttcaagctcccaagctccaggcctcatgtgcatttccttgtcaacaggtgccgtgctaagtgtctggcttgacctaccactcaattcttgtaggtcttatcttcattttacagataagaaaactgaggccaagagagttaatcgtgctaaagtgtaattctcaaaaagataaaatcagaactcatgggcaaatataaaaaggaaaggaaagggaaagggttagttgttcagttatgtctgactctttgcgaccccatggactgtagcctgccaggctcctctgtccacgggattgtccagataagaatattagagtggactgcatgcccttcttcaggggatcttcacgacccaggggtcaaacctgggtctcccacagtggaggcagattccttatcatctgagccaccagggaagcactaatataaaaagggcaaggtataaaatattttattgaatttattagttaaggagaggaaaagatgtgatgaattcaaagagcttgtaagaagctagtgtatttgttggt

SEQ ID NO: 59707 - DNA, 934 bp, Bovine  19866881009387
gtcattaaagttgactgtgaggcatgtgtgctctgaagaaaagggtcagtgcataggacaggggaccaaccattccaggatccataaaggggttctggggaagggagtggggagctggggccgaaggaagagcaggagtcaccaggggaagatggaggagaggttatttcaggcagaggagggagggggcagagctgtgagggccagaggaggcctgtgtgcctcaagaggggacacctcaggtagctgaggatgtccagagggcaggtgggaccggaagcggtgtgtcttgtccaccagcagagacacacgcccttccctagagcggctcagggactgggagcaggcaggggccctgggcctcatagcaccttgcggagggaggctcccaggtcagttcctgctcagcagaggccaagtagctccaagagctctgcccagcagagagggggccgctagtccccactgcctgtccactgtcggctccaagcagaccaggaggcccgggccttccttctgctgtgagttttctgatggaggcggaaaggccaaaccctggaatgtgctgacctctgccccctgcaaggtccaggagctaagtcccattcttcccagtgccaaagccctgctaaagccaagggtgggtgtggcccagcatggggcaggccaagcaggagaaacatttcccctaggatggttcccagaagggtctccttcagcatccccagcctccttccctaatgaggagaggaaggcccctgaggccagggtcagcacagcataccccggccagtactggctcagcgcttcctgggcagggccctgccacaacccttgaaactggcggccctggagctcctttcaggaaacttcacagttggttttggaatccacccccgtcacataggaacagagctctgtggcctgtgttggg

SEQ ID NO: 59708 - DNA, 1916 bp, Bovine  19866881319861
ggcctctgttctctgggaagagagagaggatgttgtcttgaccaggtgctagttcccttgatgagtaaagtgagatcatgcattcatccaacaaatacttgtgtcctgtgctttctcttcagcttcggttaacttgagccctggagacccccgatggataggagcctggtggttgggcctgctcatttcctctgcctgtttggttgtcacttctttccccttcttcttctttcctcgagcaatacccacaaaaatggaggtaagcttctgagaacccacaattctacctattataagagtttcctaaaaggaggtactgtgtcagtcatttagtcctgtctaactttttgagaccccatggactacagcctgccaggctcctctatccatggaattttacagcaagaatactggagtggtttgccatttccttctccaggggatcttcctgactcagggatcaaacctgggtctcccacactgcaggtagattctttaccatctgagccaccaggaggtatggaggggtagataataaagctgagaagtttcagtaagttaattctgggtgaaatctaatcaagtttcttgatgcaggacttctcagaggctttgaaaggtgagcgtgcttgtgaatttcccaaagatgtgatttcatgtgttccctcaccatggtagcatctcagggattaggagggctccagggaatatagtctgggggaagttctgagttatgtaaagtgagataaagaattaagagtcaataaaaactgaatatgtgacctggagcagttgacttttgcatgtaatagggctggtcatgtctaatcctaaaggactgagtaaaaaagacattcctagtgctgaagagtgtgagattgggctgagagtggagcatactttgagcagactgacctgcatgcatcttccagtcatatctgttggggaaagaaatcaggaaaggatgagattggaaagcagtggggagaagtctgagtgggggccttgacattagcctgaaggatctgaaacttgttctgatctcgtgaagttctaagtgactggagcccacttgggtgataactacatggggttgtggccggggagtcgggaaggaatgaaggctggagacgtgatgcagccagtgtggagatgatacagctgaggaccagggccctggctgccaggcacctggaacagggcagtacagatgtcctcggaggggttgctcagaaggacttagccgtgagcagctgaagtttgtgccaaggcttagagccagaggctgagctggatgttctgcaataaggtgtgtgagactgggtgaaatctaggcctggccggggcgggggtggggcagggatagacggcctcaacttgtcttgaagaagaatttcaaagtgtggcagcacatcatcaggatgctggagtcggacaaacctgagtctgaatctagctctgctacttctaaactagctgagagatcctaggcaagttttcttgctcctaagtttcctctactttaaagtactggagatagagacttctctgggggtcccatggctaagaatctgtgctctcagtgattcctggtctaggaactaagattcgacatgccgcagctaagacctggcacagctgaataagtaaataaaaataaatacaaaagtaccagagataagagcatctatctgaggaggaggttgtgaggaatgggacagtgtatgcagaatgctgggcacagggcccaccatggaggaagcatgacataagtgggagcgcctgcacctggtgatgagtctgctgggggatcccaacagtgtctgagctcgggggccttgcatctgtttagtggttcagagctgggcctcgggctgcagctgacaagttcagaagtggaaggcgagttcactgag

SEQ ID NO: 59709 - DNA, 1117 bp, Bovine  19866881345104
attctttacccgctgagcccctgggaagcccttattaagcctttcattacctggccctttactgcactgtaaccacaggaggttagcaaggctctggtggtgcttcctgcttgatgtgctagtcagaggccaaaggctagaagggtgaagtcacagccaagagccacacaggaggtcaggggtcatgccctgaccaccctgctacatccacatggtcaagttcaccagtgaattggcccccatcattcccttgggtacttgatgggactgcatcagtattttgcaacctcagctgccaaaaacacacgtgctggatgctggcaccctctgccagagattctgcccccactgctcgaaggtggggcctgggcatctgtatttcttaaagctctcctggggagcttaaagtataggggcttgagaatcactgggccccacagtccttatccaggtgaatgtcttcaagcccttggagaagaaaaacacccagcggcatcttgcctagctcccagctcaatccgtgctctttcctctcttgtccttgatgatgtcagagcctctgggagacagtcaggctttcagcccctctgacagggaggaagcagcccccaacctccacccactcctgcccagaattataggggcccaagaaatctgccaagaacattctggattgccaaccaggaaaaatgtccttaaaatcctttctcctgggcaagaacccgctggctcctgcccttatccggtctggtggcgcacctccctggatgaacgggggaaggcccggctgcggcagccctggggactcaccgatgaggaagttggcataagctgcggaggcgccgtactgcttctccaggaacttgttgaggaaggtagagaggccggcgatgacggaggagaaggtgcactgagccaggaccaccagcatgaagagtgggttcatcaggagcctcaggaagatgcgggggaaccctgtggacagactgctctcagggctgcgcctccaggcagtggtcactgggctccgcaagcctgacctctgcccttcctgcccccccggcagtttcccctctcttcctccggacagaaatccaggccccaggctgctcagtgg

SEQ ID NO: 59710 - DNA, 1053 bp, Bovine  19866881369255
cccccaggtcctgcaatattagttagaggagcaaagatttgaaccccttgtcactgtatgaaccagccttggtagtcaactctttgtaatgattcagtaatgttaacttgttttttattcataaagaatgttggaatctatcaggtctgtgcagataattatctctcatagccaaggcatctctgaagcacaagggttctctggatggcaaaaccatctgaatcaatcaataaacatcaatctgaagtaatagcaccttttatttctacattagtggagactgctgagaccacagacctcaggaacatgaacatggccgtgagaatgacattgagcatcttttcacgtgcctgttggtcctctatatgtcttttttggaaaaatacctgatacttccgcccatttttaaatcagtctttttttgttttgatattgagttgtatgcgttcattatctattttggatagtaatcccttgattacaaggaagcaatgtatggcccagggaatatagccaatgtgttataataactatttatagagtataatctataaaactattgaaccactgtaatatacctgaagctattattttaagtaataaccatactccaatttaaaaaatggcacttaaatggcacctaaatttttacttctgtatctatagtgaaacatttgagaaacagaaaggtttaggcagggagcatattctataaactgctttgcaaggtagtgacttgaagtttagggaatgtctcttggaataagaaatagataaatagatgctgatatttgggcattctcctgccaaccttctttcttgttttacatttgaagtaggctaataatagggggtttccaaactgggttctcagaaaaggggctctcatgtaatcactgaacacgtcatgtcaccaggatgagtcatgaatgccaggaaaatagcatgaaggttagaggttgggagtcaggaggctgaccctaagttaggaaaaacagaaaagtcacttcacttttctgtacattagctgtttcttcctatatgtggatcgca

SEQ ID NO: 59711 - DNA, 1441 bp, Bovine  19866880421553
aacatagggcagtgatatgaactctctggcgttttattgagatggtttgtaatggaataatatataaagactaaggataaataaatttaattatttgaacataaaaggctgcaggtcccaaacaacaaagactaaagtgaagagtcaagctaaattgggacaactatttataataaatgtgaggaaggttaattgttttagtatttcaatagtactttcaaattgagaaccacagcattaagaaaatcctcgaagataacagtgtgacactaacagaacttagcagcatgcaaattaaaacaagagggaggtctcagtttttgctttttgtcaaatgaagaaatttttgaaaaaagaatgatagactgcccaatgctaacaaaaatatggtatgaaaggggttttcatgcatcgatggtgggagcataaattaatataatctttgtagacacaactgtgttttgagtttgcaaattgcccacaattagtgacccaggaatctctcatcttggaattttacctgaggaagaaatctgaagtacagaatgaaatggtctttcctgatgcttaaatgagatgatttatttttaaacactggtacatataagcacaaaatgaatattattgttattgttattggcacaaatataggccacaaaatatgttccaaattcacttccagtagcattcatttagaatattgtggtacaaataataacaaaattcaaatttgttgcaccacattatattattttaaaagaggtctcaggagataatttgacaatcatgacaagaaatacctgtcttgagacattttgcatctagaaggatcctcttacacaatcataagtaatattacacttaatcgttagtgaagagtgatgcagtttggagagaaatttgaaataaaaaaaaatccagtctaacatctagtcagagaacggagaatagtacagctgactctcaaacaagtatgtgctcttatctgaaattatcttaaaatgggagaattaaggtaagatttgaggcaatttttcttatggccaggaggttgtaaccctagctggaagcaggagagtagaaagcaaaattataagtgaatgatggaaaatgacttaaattatacttctggaaactgcatgtggtccaaaatttgggacaagtcattttttcttttttttttttctgtttgaaagaactttctcaggcttgaaactgcataatgaatcagactcactcaaatcaggcagcaaatagggattgacatttggtaaaatatacacagttgcagtttcagtgttcaagactaatttttcttttgaaatgcatttgtcccaaagaactgtgatgtgcacagcatgttatagccgataaagtgtaagaaaaattgacctgttagatgggctcccacctacacacttacagaaaggcacacacctgc

SEQ ID NO: 59712 - DNA, 3145 bp, Bovine  19866880503618
taagtgtaaagtcagtactatacttctctccttttgcagatgataaaacagaagcctacgggtttcagtaaactgcaacttctcatgggtcaatccagggtggagtcaaaactctattccaggtgtgttgacctgaatgtccatgttgctaatcacaataaatggattaagagagaccattactgcagaaagtcaagagtggaaaagggatggaggtgggggatgagagttggggaactgatgcttccctatcctgaacttgggcctccctatggctcagacggtaaagaatctgcctgcaatgctggagacccaggttcaatccctgggttgggaagaccccctggaaaagggagtgatggcaacccagtccaatattcttgcctggagaatctcatggacagaggagcctggagtccatggggtcgcacggtctaatacgaccaagtgactgagcatggcagaggcatcccccgcctcagcttctatgttctccaaaccacagatacatgtatctggatcttcaggaggttttcatgcagcgcctctcaacagatttgaagaataggatgagaattagtaaacagttcaccatcccaacacacacatccatgctcctgtgcacacacatacctcttggggaggggacgggcacagcacaccaactctgaagaaatcctttatcttccacttaccttatctctccactttaatctctttatcactttggatgcagatcggacacattacagctgtctcctttgtaagtcaggcctctctgaagtcttcctcactttgctgtgtagaaactgtcttcctggagatttggccaaacctgagatcacacgaactctatgttaacacaggttgctcgaaaggaaaaggaactttgaactctttcattcaacaagaaatctatcttctttatcttgtccctcttcaaaagcttccctttttccactgctggttgcataacagcagatctgtgatgagggtaatgacttgcattgtatagctatgcaaatgaattccaagtgctccgtcagacgatgaaaggaaaaatgatgactattttattcggctcgttctagagtaaacaccggtaaactcactacaggatacaccttcactgaatatctatgaatgaaggaagagtctctgattactggttttgtctttatttctatttgataaattacatttaattatggcataaaaattagccatgtaataaggtataatttctgagaacagcataaattctaatgattgtaaataaagagaccgcatgacaactctgcaaactcatcagaatggtttggtttatatttctttaaaagattagtgtgcataatatggaactttcttcaaagtgttaattctagaattctttatgaaaaagcaattgaagaaatcagtattacatggaaatgcattttataatagatacaatctacccactaaatgaagctgtggaaattaaaaaaaaattacccaccaaattcttctctaattgagcaactgctaattaaatcaagtgctcaactagttaatcacagttaagcagtgcatttcgaagcctctcccagttgacatttagccaagaactgcctgtgtctcttcctgcagcctcccacaccgtccactggttcccgcatttcacgttcagttagcagggtgagatatctgaaaccactttcacaaggtccatgcgtccaaggacagttcagcacgtctttttgatcaaaatacaagaaaaagacagtgactactattcataactgacttccatactctgttgtgtaaaatgtcaacaaagagcaggcagaattatcaacagtaactgcaatgactccaaatgctgctccacaccacagcggagaccaggagtcaggaaaaggaagggtatcttgatgactttcaccccaccattcgcctattcttttccaaacaacccctgacctgtgaagaagtgaaggaagcctttgtgccatatcacagtaacacgcgagggccaatgacaaacttctgaacgtgccagaaatcacgtcttctttagcaagtcttactgtgaaagttcgaacattgttctctttgacccctttccagttataaatccctccttgcgtgctaactctaaaaagcgtctagactgtattttctcccttcaattctattgttccataatgatcagagagtcctactgaaaatcatacttaaaccccatttgctactgccgtcagcacttcttgcctcactcactgcaggtttgggatcatggtctcaatctccattccagcgcttttgtgtcttgcctgatgcctgctcagttgcttcagtcgtatccgcctctttgtgaccccatggactgcagcccgccaggctcctctgcccatgggattctccaggcaagaacactggagtgggtggccgtgccctcctccaggggatcttcccgacacagtggtcgcagccacgtctcctgcattgcaggcggattcttcactgctgagccaccggggaagcctgaggtcttagacgattccgagtcaacgttgaggacccaaaccacacagcagttttgccacaagggagtcagctgacaactcgttcaggcacactctggataccatcacccgcagaatttccctggctttgcaatactaaactcagacctcatcatccctgaacttgccttccaatcctttcaggaaacaaggtggatggtctgcccacctcgtgtgagctgtggagttgatgcaaacacacacatgtgaggggactaaaaccatcataagctaaactggggcttcagtccggctcaggaatcctacgaggtttctcttatttctcttgttgactctcttacctcctgttatttctctttctctttctctcaagagtttatctatatatttcacagaaaatataaaagtctttagaaaataatcaactcaactttgccccatcatattcatgattccctggtggctcagacagtatagaatctgcctgcaatgcaggagaccaggatttgatccctgggtcaggaaaaacccctggaggagggcacggcaacccactccagtgttcttgcctggagaaacccaggacagaggagcctggagggctacagtccgtgggg

SEQ ID NO: 59713 - DNA, 929 bp, Bovine  19866880541064
attcaatttatgggaaaatccccttggttttaatactatattattaaactcaattattggctaataaggttatttgaaggaaaaaaaccaatctttcagagatgaaaatgcttaacataagacgattctctgtgtgtagtttgccatctggtgttgatttgtggaaataagaaaggctagtacaataattttcaaatcatgctcactaggtggctaagggatgactcaaagcaacatttcaattctaagacatcaaattatatcatgaaactctgaggtttgtggagctgggagagtgtgtgggtggatgaggtggctacttctaacaaattgttacttctggaagcagtacagtgtaggaaacagttcccagttctggccactctgagaatcacctaggaaattttttttaaatgcggatggccaggtcactctccaggtctgtaaatcagattcactcagtgagacccacggtgatcctaacatgcagccagggagatgaccactgggtagtgggatttaatgatgatcccgagttcagcctgagggctgacctctccctgagaactaccagatttcttacgcagtcagttatccccagtcattggaaaagaccctgatgctgggaaagattgaaggcaggaagagaaggggatggcagaggatgaaatggttggatggcatcaccgacttgatggacatgagtctgagcaagctccaggagatagtgaaggacagggaagcctggtgtgctgcagtccttggagttgcaaagagtcagacacgactttagtaactgaacaacaaatcattcctaatttctgttctatttgtattgctgattgggttcaaaatgcttaattccctagcaaatttcacttgtcctgcttgggtgagaggtcatctcggaattcatcagggggcagaac

SEQ ID NO: 59714 - DNA, 1364 bp, Bovine  19866880549923
ctgcatctgaaatttttgctcaaatttatacaactatattgaatgataaaacagtaaggactaatatatttaatgatctaagatataatgtctcaaaaaatgaaatttggaaacattttagtatatggaaacttaagaccaacattttgaggggaacaaaaaacaaaaactgactgggagttaaagatttaaaaggctcttcattgggccaactgtttttatttgatattagatgaaatgtctaccaaataccctaaaacagattaatgatagaagtcagttaactcattttttcctttccacgtgtgggaatattggaatttctatagctggtaatactatgttccatatgtttaaatattaaacacatacaccagtgtaacctctaggccacaagatgaagtgaaccaaatttatatttctctttctaggtttttttaaaaaatatatcttcctctttgccttgggaaaattcatttcaggaaaagttatgagtacctttgaaaagtcattatgttaccttttccagaagaaggtccatgttttggtcatctctacttaaggaatacaaattaactgaacatgagtaatcatagaggtcatgcgatactgcaaagagtgagacactgtttatttctgctccttacttagtgatgcaaatttaagcaagatatataccttctttgacccatgatttcctagtatatactgagatcatgatatcattctgtttcttggtgtgttttttttttttttttttggctgcatgtgggatcttagttccctgaccagggattgaacccctgcccaggaagcacagagtcttaaccactggaccacctggaaagtcctagaccaccactcttttagggtaacagaaaagattaaccaggggaaagacccagaattgtcaaagcaatggtgaggaaaaggacaaagctgaaggcgtagccctcctggactccaaagtacaatggttgactggaaaatttttcagtgaaagattctggagaaaggctctttaagggacaccattcaaatgcccaggatccataattgttccagagatctgacgcagctggtcatttcacgaatcatttaagtgagaatggttggtagcttcatagagctattcctgccaactcaattcctaagcaagaatacttccctgactttatgcacaagcctcttctgtcctccactcagtagtcatatgatggatacgactggctatgaaagactccccactccgtatcacacattttcaatacgtatttggccaagttgcttcagctgtgtccaactctttgtgaccctctggactgtagcccacccacttccctctgtcattgggattctccagg

SEQ ID NO: 59715 - DNA, 875 bp, Bovine  19866880594498
tcacctggagtaggaagttgcaacccactccagtgttcttgcctggagaatcccatggacagaggagcctggtgggctacagtctatgggttcgcaaagagtcagacacgaccgagcaactaacactgtggtctgatatttataagcacttttatggggttaagcatttgtattggctgttaagtctaggaaatagatgatatcatagaggggatgggtatgtaatggggaatgtggagatcctgggaaagaaaccagatgtactccaacatttattggtcaggaagaaaaggcagactagcaaattagaaattcatgaagttgaaggtaggaaaactaaagttggctttcactgaaagcaagagctgagagtcttttttaagacctttaaataaggtctttgtcaagtgctactgaaggtttttggagatggaaagagaaaatgattagaaagaccaaataaacttaccgattgtttatgtgctggtacttctggtggtaaaaggataatactgttgagcgagttgtcttatttactgatttgtttacttatttatttgtattatctgtataatttgggtgtaggcaaaaagaaaatagtggtgtttagctgggtagatgcttacagagtaaaacagcaaagggccctggattttgataagacagagcctgaaatgatgaaacagataatttagattaagtagggtattaaaaaaaggatacaattacattttgcggcagagctatcttctaaactgcaaatacagacgagtttgaaactaacagcaggacttcagattaaacattgcagaccaaacacacctgtttgctgagtgctccttgagataccacaaaaacaagagtaacatgaattt

SEQ ID NO: 59716 - DNA, 934 bp, Bovine  19866880658217
aaggggcgtgttgcttggccctctcctgcggtttgctcacacatacagtagatatgtgtcctgttcagtctactgtgagttaattagactttggccttctattttcttttttggttttaaggttttacttttgccgtggaccattttcaaagtctttattgaatttttttaccatgttgtttctgttttatgttttggttttctggccatgaggcatgtgggatcttagctcctcaagcagggatcgaacccacaccccctgcactggaaggttaagagttaaccgctggactaccagggaagtctcctgagctcctattttttggtttagcttctattagcaacatagctgacgttccaatcccctccttctccttcttccttctttctctctagatttcaaactgatgaggataacaaaagactcctaattactcatcctttaatatccaaatgattaccattttacttgtcataatgtaatataaaagtgcaaatatgaaattcaaatatagacagataattaaaatacaagataaaagtgtagatatgatatagagtaggtgaaagaaaggataggctcgctaatgttcttattaacaagaaggtgagtggagacacactgtaattaatgccatttaaatgtttagatatactttaaccaatatttacgttttctgatctttttgtagtcccattcttagaggtactttgtacatccaaattctgtacctgtcagagttcctgaatcagcctaattctgtgctgtccctggggctgacataattgtaattcactcagttctgccaagttagttaccactcaatcttcctctgcttcctctgttttgcaaatattgtagcttgcctcttgccccaggttctccttgccagatagacttcacacctttatgaaaattcatgttactcttgtt

SEQ ID NO: 59717 - DNA, 2856 bp, Bovine  19866880840456
acaaagatgcataggtacaacaatgtttgctaaagttttttaacaatgaaaagtggaagtatttgctaagatatggtgcatatgtaaatggaatacttggaagcaatttttttaaatgaggtatagttacattccttggcatgaagagatgactatgatatattactaagtgaagatgaaagctatgggagaccaagtgtatatgaagccttaacatatcatccaatgtctttataaaaattcatactcagattccatgtgtttgtacatggctagactgaaagaatactcatcgaatcactaaaaggaatgatctagagagtagaacaattcctttctcctctatatctatattgcttgaatttttacatcaagcctatgttatttttttaaaaaatattaagctatttccatttggggaggaaaatttacccccgtgagaggaaagaaggattaacatggtatcatgataatggcatcacgttcttgaggaaaaaaactttcttgttctgaaccatggatatcaagaaaactctttttgaatgtcattattcctatggtctcatgactggactttcactcttgaatcattgtttggagaaagctcaatgttttgagagttctaaaccaaagatgattgaaagtaagactattttgcattagagaacattttctaattcttctcagtccgggactcatatcccaagaatgtggtttatcttctggtgatttattattattatcatcattactactcctgtcagtactaactgtcatatgtcgttaggtgtatgtgaggcaacaagtataagtatatgctgggaaacatacaaagtatctgacatttaagattgctaatttaaacaccaccgtaatatagtttctcagttttacagatgagaaagctgagtgtcctagaaattaactagcttgcaaaaggtcacaagctagtgaatagtagaaacagaatttcaacatgtctccagagctcatgattccttcttttatataacactgcctataaggcaaccagaaaaatatcacaaatatattagtgttcattgaataaaaaattcagcataatgacaaaattttaatgaatggctgtatccttacaacataaaaatcattatcaagaatctggtggaaggggtaataatacccagatttggagaatcttggcaaaccactgaataatacaggaatgcacatttcacccagtgagagaggattttcgtcaagagggaagttaacacccacgcggcaaacatagtttgcagatgcctgacatttgtgctttctttctcgatcagagttcactggagggaagtcatggccacagcaaaagggccccacagaaagaatactcagtgtttcctcgtaatcaaaatcgtccttggatgggctgctcctgttttgtctctctatcagcatctagtcatagtcgatacctgttgtggcatctgctgtctgatattttcattctagtatgtgatcctcattttgtctgcaacctcagggtacccacgtgttcatcccaagcatgctctctcactatcccttcctctcctctccttttcttcatttttttcttctttttctattcctcctccctgacctctttttccttcttctctctcttaaactattttgtttcccaagtgcctattatgaacccaaaactatgtcaaccatcagccagaaacactctggatgcctatcccttcacagtcctcacctgccttccctgcttgttttattcattcttgtgccacagtatcaaacacaaagactggtacttattaaacgtttaatgaatacatagctgaatatcttcttcacctttagctttatatatctaatttaaaactatatgtgtacaattttaaagcctatagaatgtaactggggtgagagatggtgaaaagcaaggatatgaatagaagtttggaaaagatagggtgtgttcattatttgtggattgagaagagttcttacaagcacaagtaacagttagcatgctactaaacttcagggcaccaagctagttcttttgtatggtttatccccaacatatataccttaatatgatgaaagcccatctgattgatttcctcttaattcaacaatgaactctacagcagggattcccaaccctcttgtcaggaactgggccatatagcaggaggcgagtggcagatgagagcaagcgaagcttcatctgtatttacagccactccccaccgctcgcattaccgcattcctgctcaagctccacctcctgtcagatcagcggtggcactagattgtcataggagctcgaaccctactgtgaaccgcgcatgcaagggatctaggttgcatgctccttagtttcaggaaaacaaacacaagctcccactgattctgcattatggtgggttgtatattattatatatgtaaatattatattattcattatacatatcacagtgtaattataatagaaataaagtgcacagtaaatgttatgcatttgaatcatcctgaaaccatttccccaaccctgcctccagtccatgattgtcttccatgagactggtctctggtgccaaaaattttggagactggtgatctacagaactaccaagtcatacagagtaaaatccctagccctaaagagctcatagctagaagagaaaaatcttgacagtgtgcatgtgtgtttctgtctttctggacattttcttggtgatgtcttctggttcatttgcacatttctttctggtttttctagttaatattttcacttttgcctacggtcagttctccataatggtgcttgctttatacacaaagaaaatgcaggacgcact

SEQ ID NO: 59718 - DNA, 1807 bp, Bovine  19866880918285
tcaaatctttgctctagattttgccaccagggaagtcctctaaattttacatccattgacaattcttatctgaaccagctttgactgaaatggttggaaaaatgtcagtttttccaatcccagcattttttccacatttaccagtcagactgtgacattctactgtaaggaagacactttcttctcctctctctcaccctctttttttttttttttcagtgtattcatggattattctctttctcccaatgttttattaatttatattttttcaacttgtccccattttggtcagttgagagtaccctcaagctgactctgatattttggtgacatatctctattattttttggaaaacttccttaatttctggcataaaaagatattttacacttatgttgtacctactctgctctcacatcttaattagccatttctctaaggaaccatcattccttttagtggagaatatattagacaccaagatctgagcgctgggcatactcattcctacagagttgtctttgcttctgagttctttaggtagaaaaatctaagaaaaatatgcatgtgcatacatacccatacatatgaatttacatttattccaatctatttgtacctggttctgtcttgtctcccctctgtcatatttgcatgttccttcttccagaaggaaaattctagctgctaacaacatcaacacatcttctcatttgctcaatcatgtaatatatctgaaatagttttattacttgggcagaatgttaccctattcttgcctgccaaaaataagttggactcagtaatttcatgcctagttaatattcaaaagaaaaggaactcatatttccacaaacagccttttacaagaatgtttatagcagctttattcatagaagccaaaacctggaaatagcttattgtcttaagagacgaacaggtaactaagctgtgatatatttatacaatggaatattactccatgataagaaggaacaaattattgctgcatgcaacaatatgaatgaatttttaaatcattatgctgactttaaaaaagcaaatagaaaagaacacataatgcatgattccatttgtatcaagtttgattacaggcaaaactaatctatggtgatagaaactaaatcagtacttgcttctgttggagctgggacaggacaggacaatcactgggaagaagcatgagaaaacattctgggattagggaaatgtgctatatctcagtcaggatgtgaattatatgagtgcacacattcatcacaatggtttgaactctatctttaatatctgttcatttcactgtctgtaaattagccaccttgtctatgaccacaccactctgaacacacctggtcttgtctgtaaattaacgctcaatttttaaattggttggagtagtggctgctatttttagctgaagctagaactcctcattttaaaacagatcctttagtttgcctcacttccgatcttctaacccccatcactctcctggtctttgaatgcacttgagcttgctacccggatcaatttactcacttcctttgactatcttattatttccttttactatcattgcaaatatttaaaatacagcataagttagaatgtgacagataattaaatgacattatccattctttaggtctggccaatatacatactttaatctttaatatagtaaacatgcacacaaattgaaaatgtttaaataatactgaaatttagattaatgctcagtgtaagactttgcttatctgatctattaagacaagagcaaaa

SEQ ID NO: 59719 - DNA, 1309 bp, Bovine  19866880929042
aaattcataagtcattgagatggagataattggaaacaacagttaatacatgtgtagccttctctatatgccgtggcacttttacatagattaacccatataatcatcatacctaccccttaggtacatattatgcttttctgcattttatgcagaaggaaataaagctcagaaaaaaagagactgcccaacatcacatagctagtagatctgggcactagctatctgggcaccaagaattaaattcagacagcatgacttcaaaatccatgctctgacctctgtgagagtcagcctctcgatgttaaatgtcccaaaactggaggctggtcaaaaacagtaggataaatgtatgcgtgcctgctaagttgcttcagtctgtccgactctttgtgaccctgtggactgtagcccgcgaggctcctctgtccacgggattctccagacaagagtactggagtgcactgccatttcctcctccaggggatcttcccaacccagggatcgaacccgcgtctcttgtctcctgcattggcaggcaagttctttaccagtagcaccacctgggaaggataaatacatatgtctttgaaaaatggaaaccgcttatatataatgttaaatgaaaaaggaatagactgaactgtgtaagtgcgatataacctcagttgtgttgtttttaccccctataagtgaatatgtatagaaagaacagattaaaaattaataaaaagcagctgaccagaaatatacccaatatgttaagtatggtttgaggtaagattatatatgaatttgatttttatatgaatttggtttttaaatacatttcaaattttctgaagcaacaggtactacttccattaaaaaataaataaggctgattgtttggtatgaatggtgaccattgatagaatagttacaatttttctaaaaatagtattttttaaatgagacattcagacacaaaacgttcccttgccttaacctttttcaaaatatacgaaatcaactgagaaacaattataaccaaagctaaaatatccttccttccgaatccaactcccatcacacccttccctcctgctcccaaacatacatgataacacaggctaacaaaaatttatgtttgataaatatataaaatcgatatttactggaatatcccagaaagtcacatagttacccatttcaaatagtataaaaaacttattttagtcttttactattcaattcatatacaaagatcagcaccagtccgtccagttacagatcatggtgattttaggcttcattgcaatctttttcc

SEQ ID NO: 59720 - DNA, 1254 bp, Bovine  19866880947143
atgcttcagtacatatttgtggagtgactgaaaatgaccagatgagcaatatatattttatataaataagaaggccagggagaattcattaaggcctggccctggacaaatacatgagtgttagaattctctaatatttcactggctgtttcccatctaacctgtgactttgaagagagacattttgtttttattccatttatggaatgctcgtggtggtgattactcagattgtgttttttgagaacaatagcagggagccataaattgaaggtactggataatcaagtgagttttatgtgagtcacaggacttgcattaaagtttctcatataaaacagcacaattatgagactactcagttaaaaacaaaagagaaccataagcaattatgcgtggcatgcatcaattaagcgctgtctaggattaaatcttccaggcttcgtctttttaggccttctccagaaatcatccattcctgggagagagaggagctgtcataacgcagttgcatatttcacaaacagttttgtctatagtccctgggtatgatggttccgaaaaggtttttttgccacctgatggatgaacaatggacatgtttatacatcttgaatgagcaaagaacaaatcgacctttctaaccgggatgccctgtaccttatctgagcagtgaaactgctgctcttctctgctgtttgaagttatttttttagtgggtgactgaaagccttcctcctctggcaatgtgataaagtcgcatagggctagttgaattttggttcaagtgggtagttcttacatttcagctccaaatgctcagtgcatgtacaggaagggctcttcctggatccctcgacagaacacatacagcacgttctgcaaccattgctggaggaacatcaccattaggcaaagagacaaaacccctacaagtttttccccctcaacggggtacagcagattcctttgttttcaaaaggatgttccccaggtttcatcagctgcctaaaaccgcatgtaggagcttggaagattgagttgcacattttacacaggttaaattacaggattctaaaagtgtccttctttgcggaaactggaggcatggttgatttgcaacatttgttgtatgtctttggggaaaaaaaatacagctgtttctttcctagattggttattaggaaacaaagcctgtccaactacttggtgggcggtagcatcatcatttcatagaaacagttcacagagaga

SEQ ID NO: 59721 - DNA, 969 bp, Bovine  19866881030268
tcctgcacaaagtggtgggcagcgctctctctgtgccttttatgagagcagaataacaggccacgtggtttgttaacatttcagcaagactcctgttgcttgagtgtgacacatgcccagctgcactgcatgggcaataaggttcgcatttactttcagcgttccccagattattcactttttcatatattctttcaccaaagactacttaatgatagatattgtcagtttaagcaagacacagatcctgctcttaggtaggtcacagtccagctctgtgactttgggaaagtttcttaacttctctgaggctgaaatccctttatgatgtaataggaagactatatccttgacatcactggattatcatgaaaattaaatgggaatatatatgtaaaactagtacagtacctggtacaaaattaatgcttaataatttactttcttcctcctcttgccaattctcaaagcaacagaggcaatttaggtaacacttgtcaccatctgtcatgtgctaattctatgccaactgagtgcaaaaggtcttattcagtatatcactagtttgtaaaacatggctttgaattagatattaattaattgatatatgtagtcattaataaatctgaaagtggctcaaaaagatgaagcaactttctgaggtcatacaattgctaattagaatgaagaatttgaaatcaagtttccttggtggctcagatggtaaagaatcttcctgcaacgtaggagatgtgggttccatccctgggtcaggaagatcccctggagaagggatggcaacccactccagggttcttgcctgggaaacctcatggacagaggagccggtcagactacagtccatggggctgcagagacttggcaaaaccgagtgactaacactcttagttcaatacctacatccttcatttcttaccctgtatttctgctatacaagtgcttccttca

SEQ ID NO: 59722 - DNA, 1259 bp, Bovine  19866881031406
ataacagtattattgagctatttccttgcaatacttaacaatactccgtggtttttattcaacgtctcaatccttaaaataacttgtgagttaagtattattatccccactttacaaacaaggccactaatgcctagggagagcaaataacttctccctggtcacatagctattacattacagagctaggattcatactcatatttctctttttgaaatgcctcaaatccttaaactagccctttatcgttctttgaaagtttcattcttcctatttctatttgtggtacctggaatggaattacttgcttggctgtctcgtggcggccggatacggtgcacacaggcgtgggggaatcaagttttactcctgttatctactcgctgacttttctcgtaagatggtttcagttcctactgtgttatggttcctcggaagtttaaacaacaggtcatgaagcaaatgaaatgatgagtagcggtatttattcacccagctcttttgagttcagtaaaaaataataaattggctttctattttaatgttaaccgagacgcaagagagccctcatgcagtccagagaggaggggaagaaatatggacagtggcaagtacagttaattgaacattttatagaacattgagagagttcaaggaaagtgcatttcccattttttatcttcccgtgtttaatgaaaatccacctattatgactgcatagaaaaagaagaaataaaagagaattatcatttttatttctacttagcagctcatccaagcatttgagtttgccgggtctagaggcaaaacgtggggagttggttgaaagagacaggagagaacaaagatatccacctccaacccctcctcacccgagttagaaccagccttaacagagacgtccacctccaacccctcacccgaattagaacccgcctttccctggctgcgcagtttagcttttacagtggattctgaaggaggcgaagattcctttccattcccagggctcctcctgtctggggcttcaccttccatctctccagtgggtgccctgctccgctctcccttgggtgtctgtatccagatgaactaaaacgtgtgctcgatcggtttggtggaacgcggtactggggtccagtaccacttatactccactgacgatcaggatcaatagtgagaaggatggagccccagcgtgaaacgttaggaaaggggattactcatcagaagctgggcttttgaaaagcacgttcag

SEQ ID NO: 59723 - DNA, 1456 bp, Bovine  19866881088242
ttgaagtttacatttctgtgatttttttttattaatgtctttatcctttactagagtaaaggataaaatgtcatgaaagccattttggtgctaatgttactgctcatacttagtaataaaggtgaataaaataaaagaaagaggtgaaatggaggtgacttaggagcattggttgattgaataagcaagtttgctcagaatgaataatgcagtgcagtgcccatagatacatcactgcccataactgttatcactacgagaattgtaggcatcatttccattaggaagacaaagctcttgtctgtatccattacagaagtatcacaacaccaatctccaatttgagtgaaaaccccttttctgtgaattctctttatataaaattatgatgaacatttaaaattttactgctatttctagaatctaaatactacagtctcaaaggtatgtgtaagaagtgtttctaagatcgtgcaagtgttaaatatacacataaagtttgtaatacctagagctctagtcaacacttgcgtactacgatcccatgtactcaggctaggtttctttatgctaggcacggtttttaagtgctttacagatgttaacttatttaattttcaaaacaacattatagggtaggtagtattattatccctattttttagatgaagaagcagaggtacagacatgttcaataattgtctaatgttcaacaatagaatcaagattcaaactcaggttctctggctttagagagctgagcatttgcttagattctccttgtgtggcctcgatcatctagccaggtacttgaaagccataagaacttgaggggaaaagtttggtgtttctttttggttttttaatgtgtagtacactctaggttttaaaaatctacatctcctttttcacctcagcaaagaagcaggtgctaaaagtgagtactcacatgaaggcaggagagataccttgctaacactctcaagaacgtgtttctctcacctcatacttaacctgtagaaaggcagtgttaattgcaaaacatttgtgggagttgtgaaatcaccagaacttaagaatttcaatgtgactcgctagattgaatgagagaagccagaaaattaaagatactcaatttggtaaatggtctgtcaggatttgattttaaaaaatccttttaagcagagtgtagctttttgtaggtttggcagagtgtcaaaacttatgaaatatttggaggtctcagttctgcagtggtctcaaaatagattctctttaatgagagttaaacgttaaaaggcagaactgaatacagcctgccttaatgtttcacaaaattgccagattgccagatgatacttaattggaagctcagaaaataatgatgagcaacctaatcaggaaaaatctatttggtctaaatctcctagagaaggaggtgaacagacagtaaaca

SEQ ID NO: 59724 - DNA, 1220 bp, Bovine  19866881129726
cacaaaatataagcccatacatgggtaactttttctttaacatacctcaacaggaaaagttgtcttctaagtgacccagagagaccagacgtctggagttgtgctttgtaatagtgatgagcctttgaagcattaatattttggctacattgatacaagtgaaaatattatgaagctaattccatatttttttaaatttaaacaacatacctttttatttacaataaagccaattgaaagagctacaaaaggaaatctttcaaacaaaacacaaatttaccaagatagaacttattttcagcaaacacatttttccataatataactttacaaagtttttcatatgaattgtttcatgcctcctcccctagaacgtgtacaggatgcaaccctttccctaaatggtggggggcagggtggatagaatgtacagatgcatacatacaggatgcttcataggcacgagacatctctgcaaggattcacagaaactcataacaatggtcacctctagagatgggtcctgagaagctggggttagaagtgagaagcccacttggtactgcatgccattttataccttttaaatgtcgaattccatgaatacagttttaactttaacaaaaatgggatcatactctacactgtattataatctctatgttatatgatgttacaagcatctttcctcattaacactccatcatgtatagattctacatcttagctttatggctttaacaattctgttagtaaagataaaataactatgtgtcatcccaccaaacttggctaatcatttgaattctccctggcaattccatcaggcttccttcgatatatcctgaattatgtacttactttatgccaggccctggtggctcagatggtgaagaatctgactgcagtgcaggagacctgggttcagttcttgggttagggaagatcccctggagaagataatggctgtctactccagtattattgcctgggagaattccatggacagaggagcctggtgggctatagtccatggagacgcagagttagacacaactgagcaactaacacttttacctttcactttgtgccaggcactatattatatatatatacataatatatataataaatgtacgactcattgagtcctatcaacaattctatgaggcaggtaccatgaatatgcctattttataaaatttaaaacacaaaactga

SEQ ID NO: 59725 - DNA, 1430 bp, Bovine  19866881227323
agaagtattatttttgtaacatgacctgactactttgacagtgttaatattacctctcaattcatttatcggttacaaaactctagttctgttattatcccttgcagaggttacacgctgacccaggtaagagcctggaaaatatttctttaaccagggaataaaatcaaatgactttttcctctcatttatatctgtgacaaagaggctgtccacttcatttcaccatctttagtgaaattatcttttttttcttcagcagctcagtaggaaaaataatataatgctgaaaggtgaaatatgagtctgaagatttagaagtaatagcgacgtgagtgagaagaattgcttgtcattcatcctgggctccgtgcagctgcaaagtccctgtccaacagatgcagctgttcagactcgcgttgccttgtaatttttccagaagcacttcccttacaaagtgtcgtcgactattatgatcatctatctcatgtaaaaacagagtgctatttaattgcaaccaagttcctcttcatagctgtcttctcacaatagcaacatgaagtaaaggggagtttgtgttcttattatagtttcatctacagattttactggctatgctttgtcatcttgttgtagcttggtggttccagccagtgtagactcaaagtctactaatcttgtattaatccatcagaattcacctggtgttaaaaggcagggtagttctatgatcttttttgctttgtttgtttctttgttttcccttcaagtggaagaatttgtgtccagagtgtatccattagaaagaaaagaaggaaacaagtcataacatctcgaagtcaagcgttcttttgattctcttttccccaggtttattggactgaattgcaacgctatggccagcaagctctttaattccaaatctgtagagatgtgagagatgatagttcttaaaaactgattggaaaatgtgtttattttccgttgaagttcattttgcagtgaggcacttgagagtctttaataatagttctctactgagttcttgaagcaactgagaaatctgatggaaaggtcaacacacaggggacaaaatatcacctttattttataaaaggtctgtgtttatgggcagtattgaatccaagaaatagcaatcttagctgtgggtctggactgggccaggcctctccctggtctctttaggagcctcctttaaaagcaacggaatggaagaagagattggggggatgtatttcttgaagggacatcagtttcaagaaggccagaagcaagctgtgttctactcttgagcaattcttctttcaaatacagaattaggggaaaaggagagagttgagactggccagggtggttatagccagtgaactccaccccgtggggaggggtgttagaaatagggcatttcc

SEQ ID NO: 59726 - DNA, 1252 bp, Bovine  19866881280719
aagctgcttctggatattagcagggcacttttagctctttaggacagattaatgcagaatattttgaatgagacccaaaagttccagattaatcattttgtttttctctctattgtagaaatcttgatgtgaaaagtggttgctatttgttgaagatctctgacaatattcttagttaattcatttctttccataacaattgaatgtcgaaaatccttgaacactgtttcaggaggtaggggccttagacttatgatatataaaacctctgctcttgagaatatgagtcttatatccaaaagcagcaaataagcaggtataaacaaataaaataagcccaaagaatttgcaatgaaaactccaaacttgcaatgcatttataaagctaaaagcttgttataggaaacaaaaaaaggtggaaatttattgaaattgtgatatattcagaaattcttgggagtttggcaagactttccaagctagatcttgccttattttatcaattcatattatggcaagttgatgtaaaaagcataacatgctttgtaaaactttgttcctgaagtctcagtcagcttctctctctccacacgtgccctaagaggatgacatgtaaaatgccactttaagaagtatggaaaaacaggcaagaagagatggagaaaacttgataggttcagagtcagaaggagaaacgggaagtgtgccttgaccttgcaggtcccactgcaagagatttgttggctagcttaaacgcagcttgtgagcttgggcgcacccatgcagggcgcagctcccagctcaaaggcagccaactgtacacagacttcaagtgaaagaggttcatttgcttacattaaagcctggccgcaggggtctccatcttgttcagtacacactggggaccgccggatccctctccgggaacggagactgcggcggccatcttggtgctggccctctccttgcgctcaccaagggcgccattttgttttcttcagcctcagcccttacgctcccctccctgctgccttactccagtcaccaggtgctgtgtttgtgctctccctctgtctccatctagatcttttctttattatttctttttctattggcgggaggggggatggtttctttttcagcaggtaccatatctgtgcttctcctccgccttgctacagccagtgggtgccattttcgtgtcttacctctgctgtgcttcagagaacatgtatccggaagggagcttcga

SEQ ID NO: 59727 - DNA, 932 bp, Bovine  19866881324344
agtagttgtccaaccccccacacagaagtgaagagtacgtgagacggtgtgagcggcacagggaggcacgaaacaggactctggaagcagggcaggtctgtgtagggtagtagaaaccaaagcagagggctcttgaagaagggcggggacttggaatgtgtctaatgggtagcacaatcttaagaagggtaaatttctcttaatgttcagatttagatgtgattttaaaagtgtgttcattaaacagtaacgtatttagaagagcatataaattcaaagtgaacagtcataaatttgagtcacctccatgcttgtgatattttatagatgatcttagaaacatgggattccaaatgaaaagaaacagatgttaaaacaattatttttgttatgtcagatgtttataaaatgctagcgtaagttgaatacttcaatatggtgcccagaattgttttcgaaagcaagacaatgggaaaaaagactgtaaacatcctgggaaaaatataattatacatttcactttttgctgaggccagtgttatgaatcttagattagaaggccagttatatttttaatgcttcctctagttttaaccagaaaaagtgcagagctgttaaattaagcatctttgttaccttacaattcttgcaataaatcaaagaaatctaaattagatactattgtctttgcaaagataacatggtagcagtatatatcacaacaattttcacaaaattcttactgaatttcaaactttctattccagtttagtgaatttttgagaagacttcaggaaataaattactttatcatacataatactttctgaagtttgcttcattggaaaatagattaaaatgagtaattaataagacacaagtgccctttaaacttaatcagtgtaatttttcttcattcttacaaagttgta

SEQ ID NO: 59728 - DNA, 2148 bp, Bovine  19866881325929
tagtgaatcttaattaaggttcactagagaagcagaaccaagattatttattataaggaattggctcacatgattatggagactcgaggtcccaagatctatagttaataagctggggacccaagagcagtgatagtctgagtaccagtcacactctaagttcaaaggcagagacccagtgtccaagctcaaaggcaggtggagaaaatgagttctgttgtggtggtgttcagtcgctgagtcgtgtctgattctctgcagccccatggactgcagcatgccaggcctccccgtctctcaccctcccagtcctgcctccaaacttttgttctcttcaggaattcagtggattaggcgaagctcattcacctggggagagcattctgctttattctgctacagattcagatattaatctcatccagacacaccctcatagacacaccccaaataatgtttaaccaattatctagggactgtgtggagcaattaagttagcacacaacagttgccatctcaaccttctagaatcattctggccacctctcttctcaagacaaactgctgtgacccaggtcctgatgagactgttcttactctcctacctccttctgtagctctgtctgtcctcacgccagcactcacacacgtctccctcgcctgcttacacacgtccttaaagaccctagttcctgctcctccttccctttgtgattcctactttaggagttagaaagtatactttggcacttaggtgttcaataaatatgcattgaatgcatgagctattctattaacctttagcttgaatcctcatgaacattaaattattttggcttgatcactgatataaaaccaacatttactcctgcccaattatggctgaatatatatgtaaccatattcaacattctggtttcattaactttcccctgcgatttatacactaaacttgctcactctgtggtctagatactctgtactgattaaaagtgtggctaccttgttagaattctcttggttgatcaccaccagggaaaagggcattccgtttcgctgttccaagttagatagtggcatgtgaagggggcagaggctttggaataaagcacagcccagggtaggagaccagctcttctgatcttcattctgtcttattgacttctgcagactgagcatataggaaagtgcttggcagaaattaggttttaaaaattgttagatactttgataagttataaaagttattttagtcccaggcttctcacttggtgatggtaattgtatccatttcacaaagatatttgcgactacaaatgagttaatgtgctcacattgagtgcaaagaatatgccaaatgaaactctgtttatatttgttgttttcgtagttttggagtatctgtgaatgtgtttataagtgcaaaattaattttccatcctgtaacctccaattgcatacattttccctctatttttaagtacttacatgtgccaggtactacctaagtgctttacatatgtcatcatttctttaatatggtgttgttcttctcagttaacagagaaaatctggtttcataaagactgaataactttgcaagttcacacaacttgcaaaacctaaactggcacctgaaattgtaccaaaattcagtggcaagtccattctctaggtctgtgagtctgcttctgttttgtaagtaagtatcatttgtatcatttctttttagagtccacatataagggatgtcatatgatatttctcctctgtcggacttacctcactcagaatgacactctgtaacatatggttgctgggggaagagaggggaagggagagtgagggagtttgggatggatgtgttcgcactgctatacttaaaatggataaccaagaaggacccgctgtgtagagcacatggaactcactcgatgccatgaggcagctgggatggaaagggagttagggggacaatggattcatgtatacgtaagactaaatccctttgctgttcacctgaaaccatcacagcattgttaatcgaatataccacaatgcaaaataaaaagatcaaaaagttcattggtgataagtgtgctcaattttaaaacaccgaaataaagtctgtgttcataagttaatttc

SEQ ID NO: 59729 - DNA, 1161 bp, Bovine  19866881617930
ctgaagcccagggttttgggatgtgtaaggagtctatttgagtgagaaagatgaagagaacgaaatggccaagggaactgggtccacaagcatcattgtaatcaatttttaaatctatcataaattacagtcttacataaaatattttggggagaaaaataatttctagctaaaaaaataggtaaattacctctaatggaattctgttctgccaaaggaaaatactccaaatctaattctagtcttcaccctgtaaaaatgatcattatttttagtggtttccaagataatgtgcttcaattatgctcagctattggtttaggtaatttcatattaagtgaatctcaaatgtagtcaaatatcacaaaacatttaagtcacacttttaatctaaaaaaaatctagatatttagacaccttttcctaaaacaaatatattacctttcacaataaccatcaaaatgaggtaaatttttcttttgtttttcatacctatcaataatgtttcttagttatttgcacttaaactgactattttctctccaaagtattctactgtctccactagtttatttttctattattctatgtgaataaaaatgaggcattcctatcatacaacaaaattaaattatgttatatgcctgaagctcaaggataatttaattttacatttattcacttgtggtatttctaaatttatttgaagtgctatcttattgtacagaaaaatgtttccatctttataatgaaaaatacctcagtaatttcatcaagattccatttaaagttatagagataagaaatagtcaaaatctcatcaacacaattccttcataaatgtcaataggtgatcaacatgtgtgagttgtgagaaatgttttatacagaattaaactgcatgtagatctttttttattcttcatcacctccttaaaatacgggaaattaatagattgacaacactggatagaaactttgaaattagtttatctaacacattgttatattggttaacatggtgaatttaaagtcccccaaaactcttccatctaaagcccttccaattacatcatcatgaaacagaatactataggcagtggcatgcacggaatgcagctgcatgtcaagacagcctcccataattcctatcctccaaca

SEQ ID NO: 59730 - DNA, 707 bp, Bovine  19866881783162
acagataatcataaggttatactatcgtgtctttcttattcttatttctatcgcaggttaggaatgaaggcaagaagtgccaaagatattttgtaataattataatgttaaaattgtatgtgttctaaactgctgcatggccatcagctaaagaattattttcggtttctgcctcactatgatgacactaagcttgatctctcctccagctctgcacagaaccagagaacagaggactcgtaacaagtaaccatggaaaccaaactccacaagtgtttgcacagaatgaagaaggttatattgctgtggaattccatttaaatgtaattttctgattgccttatgagttcagattctccagaaaacaaagcatttctcgagtcaataggtcattcatcaagtgcaggaactgtgctctctgtcagggaaaatggtgttccataagacagacattttcagggaacatggtgttccataagacagatattttcaagacatttacaaagaagaaatagaccaaactatcccagttgaaaatcttccttggcaaggagcagagaggcttttcttactattgggctggagaaattaattctgagaaaagaacagttatcctagaatgaagaaatctttaaactccattatcagattgactggtcaatgtcttttctgctccttttcaaaagaaaccatcgactaaacaaaac

SEQ ID NO: 59731 - DNA, 1401 bp, Bovine  19866880395013
atggaattgtacatttaaaatagtgaaatctattataggtaaactatatctcaatgaagcttctaaaaataacatattctaattacatgtaattttgttgtatttctctccttatagatacttttctctatatgatttcaaaaactaaaaaatatgtaagctgtattttctagtttccaacttaatctcaaataacaagcattccccatgttactaaaacctttggacacatttagttcctgcatgatatcccatttatcaatatgccaccttgaccattcccctattggtgaggatttaagattgttttcaatttttttttctatactaatattctgatatacagggcttccctggtggctcagtggtttggaagctacctggagatccaggatccagatctctggatcctctggaagaaggtgtggcaacacactccagtatttttgcctgggaaatcctatgcacaggggagcctggtgggtccagtgcatatagagtgggacacaactcagtaactaaacaacaacaacaaattctgatatctttgtgtatgtgttcttgtatgttttccctgataacagatttttcaaagatgaaatttcaaggtcaaaatataagaacattttaaggatctgaaattcactattaaattggtttccaggaaaactgcactgatttaattctcactagtagtatatgtaaggaccagttgtactgcactcctgctggaattgaatgttattttgaattattatttgaggtatttgcttaaatcttgctcttcagcttgacactggtttggaattctttcctgtacttttgtccatacagagtcagtccatattattcacccacctggattccatccattcccaaggatttgagacatttgcagaccatgtggcactgtgaggatctcctctgagatcatcttcctgatattccagagcctgagtcttactgtctccatttcttgcctctatctgatagttatctcctaatgtgtttttgagtcctcaatgtttatatcatttccagtgcctaagactttaacatagcataccttagctattatatacagcatctattttcctgtgaagtaggtcagcaacatagaattcattttccatgtagcacagttgtgatttgttctcattcctatttaccaccatatcctcatccttccccttagttctcttctcatctctcccacctggtacctctttcccaattattaatacaagcaatgattgaataatagagaaatgaagatgatgcaaaagagagcggagtcttatcctttcagtggctaggctgggtcaaatttcagcccatcttctcagctccttccctgctggactcagtgttcccttccccttgctccaggtcagtcctgtg

SEQ ID NO: 59732 - DNA, 1418 bp, Bovine  19866880424620
tttgaaggagactttggaggccctgcaatgccaagagctctgatgatcagtacaggacattctgatggtcatgcagcaaggaagggcaaacgggcacaaaagaactgatgaagaggccacagatccaggagaaagcttcccacagggagactaagcaggagaagatacaatgatgtagaggactgggccagaaaaggaagaagcttgctgatgaaaacggggaaaatagttacaggagatatcaccagagccacatccagaaatgtgggttacaaaggggactgaagtgggggcacccaggctcaggactcagttctgccatcaactctgattttgggttagggttagtaacttctctgagccttgatttttttggcctgccaagtgggttaacagtctctgcttcatcacaaggctcttaccagtactagacaaaatcagggacacgaaagcagtctgtctgtgatcaggcttcaggctgtgatgtggccactttgcagcccctggtgtcttctcccactgtttccagcacagactccagtgcaaaacactgggactgtttaaaggtcactgggtgggtgtgcctactttctgctggctccaggattgggctctgtcttcccacctactctcccctggccccattccaggggagaatggaaaataaaatcggtttaaaagcaaacatttacaaataatggtggtgggggcggaacacagcagagagcagcatggttttccacctcctactggctcctgtccaaaaggaaacactagtatttactgccgcagctttgttctctttcaatctcgttccaggaagtcaagagtaaagatacgttggggagggagaaagaaagaaatgaaaacccaagaagacgagtatgcaatgagcattagaaaatacattcccacccaacactgtaaagcaactatattccaataaaagaaaaaaaaaggaaagaaaatacattcacaggtgtggaatcagaagacagctgttcaggtttaaaaacaacacacatcatcagaaagtgcttttctacctcattccacagccaggctcttcacaggctcatgttcaaatgtcaggatggcagcttgttcctggacaccaaagtagaagtatatccatgttgtatggggcaggcgtgacacgctgagggacaaatctacaaagtcccatggattcccaaactctatcccttcctgttgcacctttgtatccaatggggccattgtcactaactgggaatcactggctcccaaggcttatctgctgctgctaacaaggtttttacccataaaaactcagtggaacaccatccaaaggtatatgagggagattccactctgtcagatacagaaccatttcttgtatcatgtggcagacacttgggtttgggaacacacagttg

SEQ ID NO: 59733 - DNA, 1989 bp, Bovine  19866880501877
cattcaggtcaccatggtgcatgaaagagtttcctgtgctatacagtatgttcttattagttatctattgtacacatagtatcaatagtgcagaatggtctttcaaaagggcattttcccattgtttttaggattactgaatacttcatattttgacctataagactgtatattgtcctgtatggtctggcttctatctaccatttcatcttcattttgcctccatttgtttctctttttgtcatgttctctcttgtcatgtggtctttgcacatgctgtttcatctgcctgtgttcctcctgttagccaagttatttcttccttaccttctgtatttcagagcaagctttgctttccaagggtgctctgccctgacctccttgactcagtgccattgtccttagcagaccgtaacacttccacaagagcatgggctgtgtttcttttagctgccctttctctagcacttagcataccacctaacagagaatagacacttaagaaatatttgctgaaggaatgaaagtataaataagcatatatggtcacaagtgggtcactttggcttatagatgtattttgtttattcccacactatgtttaaaatgtcttttgatgcctctggattgacatgtgcatttccatttccctagtctctgatgtgcctgtccttcattcatgttagagtgtttatgttccttggtttggctgcatgagggcatggcagatgcacagtgggtatctatggggaagtcaagggtctttttactttgtccacatggagaacagtcatattcctatcccagtgctgttccttctcattattgttagaaactcaactgagaatttagaatgacattctcatggacacctaaaaactcaggacccaattaatttttgagtgaagttttcagtgaaaaatcagatatgtaggggtctgacaaataggttgttagtgactttataaaatctaacctttcacacatggaaaaggatgagctgttgttatggaaaggtatcttaaaaggctcttatgattgatttggaaatgacttcagacattaatgaaagagtaatcttccttaaatcacccaaaagctagtaatccctagggctgcatgttggtgattaaaaaagaaaagtaggagcagctgtctttttgttcagtttaattatgacccaatatctgggggagtgttaatttcctggtggcactggaggtgggtggagaaaggtgttaggtttctgtacacttcagggactgaatgtgcagacatggattctacctggtttgtgcccaaggatgctgacaatgttcaggggaggtcatgctcatgtgctcagattgcatggcattcaatttctgccctttatgtctgagacatgaacctctgtgtgccagaggacacaagagtgctatcggatgtcagttagactacacaccttaattaatagcccctcacctccagcaagccatctgctgcacctgtgagatagaactcctttatgtcatcaggaagaagaggaacatttagccctcttaattccttcggcagcatttaaggctggaagtcactgaactgggcatctgctttcccaagttccgagttttgaatattcaagttggtgtctgagtgtgtattcacaaacggtctgtgaactgctggctgttcttgaaaattaacaccctgctagtggtgaacatgaacaccattcctcccaacttttctccttttgtatttgatatattgagaatggccctgtcatctgcccagtcatccagccagatgcttggtatcatgtgccttctaaatagctatcacatctactgtgtcctctcctccatggcatctaccctgttctccttcaccacccaacctgagatttctgcagcattctccctgcctgcctgaaatcccatcactttcctgtccagcttccacagactactaaagcactcttccagaagtgtcaatctcaggttgtgt

SEQ ID NO: 59734 - DNA, 1505 bp, Bovine  19866880600501
gagaccaagtaaatcagtcctaaaggaaatcaaccactgaatattaattggaaagactgatgctgaagctgaagctgcaatactttcactgcctgatgctaagagccaactcattggaaaagaccctgatgattgaaggcaggaggagaaggcgacgacagagaatgagatgggtagatgacatcactgactcaatgcacatgaatttgagcaaactccaggaaacagtggaggacagaggagcctggcgtgttgcagttcatggggtcgtaaagagtcagacacgactgagcgactgagcaacaacagcagcatggaggcattttggacagctggctgaagtccctgccccatcagagagcttctgctctcagatgactttgagctctgaatttaccattcatcactgcttcaaacagaaaagtgctgcctgtccctagagacactgtgccctacttgagcatctgtggagttgtttggttacagagaataagcgtgacccacaaggctgtttttccaagcatcacatcacactgtggagagatatgtcacttgagtgagtcaaccttcaaatgttgacacttattcttttgttctaagtagaaatgtctgacttgtttccagactgaagaacttgggacaagttgtgttgtcaacatccaatgcaagttatcagaatttatatatactcaaaggccaggtcctttttaagtctatgattatatactatgtttggcactctgacctggaaaaaggctggatcttcaaaagaagtcctgaaagaaaacatagggtcccagatatgtccagtgtccttggatgtgatgagaagttataatgatagagacagaaaagagcactgcaacaggagtctgtaaacttcagcttagaggtgaaccaccatgaaataagctggctggtctggggcaagtcacgtttttgctctattgctcttttttttttttgcttttctaccaaaagagggatgcaggagcactgggttgatgacctgtaaggtccctcccagtgtgaatactactctggccttttctttcatctatccatccccttctataggctgctgctgctgctgctaagtcacttcagtcgtgtccgactctgtgcgaccccatagatggcagcccaccaggctcctctgtccctgggattctccaggcaagaacactggagtgggttgccatttccttctcccttctatagactagctgctatatttaaaacttgtttgtgatggcttatgcttatctgaaactagaaatgtggaccaaagcacaccccccaagctcccttccagtcccagtagcctaaagggattgcgtttggctgccaggctcaccagcaggaatatgggcatctcttgctgtagcgacagcagtaaaattgccactcgcgatccagcactgactcgaagtagcggctctggaaccctgccaccagtccattgttggagcatgtctggtacctaagagaagagaaaactccaa

SEQ ID NO: 59735 - DNA, 1428 bp, Bovine  19866880645051
cattttgttgatggtttccctgtaccgtgccaaataaaacttttaagttttattaggtcccatttgtttacttttgcttttgtttcttttgccttgggagactgatctaaataaatattgctacaatttatgtcagagaatatttgcctgtgctctcttctaggaattttatggggttgtgtcttatattcaagtctttaaataatcttcagtttatttttgtatatggtgtgagaggatgttatgatcttattgatttacatgtagctattcaggttgtttggagaaggcaatggcacctcactccagtactcttggaaaatcccatggatggaggagcctggtgggctgcagtccatggaatcgcacagagtcggacacgactgagcgacttcacttttacttttcactctcatgcattggagaaggaaatggcaaccactccaatgttcttgcctggagaatcccagggacgggggagcctggtgggctgccgtctatggggtcgcacagagtcggacatttctgaagcgacttggcagcagcattcaggttgctatgtatgtgttcattagtaataatcatggatagaacacacatgactgtgaccagactagcacttggaggtggagatgaatttgcactggactcttagtttcaatgtctatgtgataaatgagtaaaaagacaaacagatgaagcatatattgactctcaaaccctataaaatatttttttttctatttcctcctgtccaaaaacttccactttctctattcagcttttagtgactgcctcctctcatcagatttgcagtggttagcttctgagttttatatttatatattatcttttattgcaagagggtacctccttccacccaaacagattatgagctgcttaagtgctgttatttcattattcccccactgtgaccatgtggtgctgtccccacaagatccttttaataaatgcttgttgaccaattgactggaaccttgcctgatgagaaggggcattgtggggtggcaaatagtgaggcagagcgtgtaatggaatgcagtcagctactgtttatagtaaccaataaatgcagtgatgctaatgtcatgtgttattagtttagaaactaacaaactaacattttaattttctacttatcttttatggtataatcaaatttcaatttgtaaagcagattttcttccgtggaaaacctttggtgagaaatacaagtcccctaccattctgagatacattaaatttagactcctggaaggcctgatctttgttcaaaagtttgctttcctttgcaacacttttctggccatctaactactgtgtctatttcagatattattaattcagtacccattgatgagtacatgctcgaacagaagctgtagtagctactagggattcagagat

SEQ ID NO: 59736 - DNA, 1786 bp, Bovine  19866880703696
ccttcaactgcaaaaaaaatacatgtgctccccacatacctacccactgggatacaaatgcacacccagatatgcaaactcataataaaaattcaacacagtcaattctgtaggtaggcagacaagtggaaaggtacatgactagatgagctgaagaatggacaaatctaaattacaagagataaactgggaaaaagttacaggtgaacaagaaacaaccaattaatgctagaataatgaaatatgttaaatgatacaaagaaaactttgtcactagttagtgtcacaaccttagattaacttttggggcctcatctagagaggctaggctaaatgattctctaaaaattcattacaattctcaaatcctatgattctacagaaaactcagctttaaaacacatttattgctgcttttgacttactgttttcattccttattattatttaaatcacaatatcagtatcatgctccaaaaacaatgtttgatgctgggcctttgtttctggcagtccttatgataagtgctataatgggaggggtttaaaaaaaagtatttaaagaagtaggtgggaggcggtcctaagatggtagaggaataggacggggagaccactttctcccccacaaattcatcgacagaacatctgaacgctgagcaaattccacaaaacaacttctgaatgctggcagaggacattaagcacccagaaaggcagcccattgtcttcgaaaggaggtaggacaaaatataaaagataaagagagacaaaagaggtagggatggagacccatcccgggaagggagtcttaaaagaggagaaatttccaaacaccaggaaaccctctcactggcgggtctgtggggagttttgtaatctcagagggcaacataaccaggaggaaaaataaataaataataaataaaacccacagcttacatgcctaacagcaactcccagcagaaaagtagcccagacattggcattcgccaccagcaagtgggggttgaacagaaaggcctggtctgcattgagggcaatctgagggagctaaaatgagatagcaacccaaactgtgggatagccagagagagaaaggggaaaaaagagagaaagagagaactgtccctcgaaaagccctacctaaggcaccgttgggcccactcacagaacaaaggatgaggaataccaaaggagagctagcctgctgtggactggcccattccccactggaggcagggaggcaggcaggcaggcagcagcgagagctggaaaggcaaggggcaaattcgaccccagagccggcatcctctaccaaactgtgagcaggctcccagttgctaaccaagacttttgggatccaggacggttgacatccgccgggagggtcacagccagagatcagctccccagaagagactcacagcacacctgagagggccctttcactgcgcatccaggaaaccaagtggcccgggatcggggaggtgataagatgcacccccctacctagggagagtgcactcgccaagcaactggttgcctgagctgcttggacctaggaagggcacaaaacgcaggcctatcccagtctgcgtctttgtggagtacccaagaacctgaacctgagttgcgtagacctggggaagtacacgcaacccagggcccactttagacaattaccctgcagagcaacctggagcctgaacaatgcagactgggaaagcacacacaccatgagcaggggcaaacccagcgcgggccgggacactgcgagcactcc

SEQ ID NO: 59737 - DNA, 1762 bp, Bovine  19866880730803
caactgaaactatcacaatattgttaatcggctgtgtgtgtgtgtgtgtgtgtgtgtgcgcttagtagctcagtcgtgtccgactctttgagaccccatattctacagcccaccaggctcttctgtccattcggattctccaggcaagaatactagagtgagttgccatgccctcctccaggggatcttcctgacccaagaatcaaactggggtctcctgtattgcaggtggattctttaccagctgagctaccagggaagcccattaatgggctatactccaatacaaaataaaaaactcaaaaaaatgtcttttcagtaaagagaaaaatgtcaaaaaaataaagatgaaggtctagcaaatagctagaacatagaaaagtgggcataattccctggatcccaacactggatggtttattctcacaatgtcccttcataggaagacatttatgaggggtccatgaccaggtataataactgaccttggccttggcactgaccctgagcctatgagtcctcccgacacaccggccctacgcccctcttttggcctgaacatctccatagtcgctatattggaaccccactcagtaggttcccaccccaggtcctccctaactgaggatcatcaaaaaggcagaagagtgacctacaaccagaggttgtacatatgaacaatctgtatggttgtacctacaaccatatgaacctctgagtcagctgactcaacactgattatgccccatgggagagggtccagaccaggaaaagggaaggagtcctccagtctccagattcacagcaaggactcaggactcacctcccttacttaggagaaatcaagcttgaaatagtcaaagagacaattttctccacctgttgtccaacagataaaactaaaacccttttcggaccaaaggataagctgagcatttcactgacttgcagagtccaaccaaaaggagtggtgttggtatggaacagtaaggaaaactagcccttgcaccagccttgtttatcagaattcccattcagccctctgtctgctaagaatgttcatgctgtatttatcctaattcctttggtacacatctcctttctggggatacccccaacaagtgcctcctaatacttggagtgaaggaaaaagacaaagttgacaagagaaaggacaggggaaagagggacctcataacttttgtgtgttgcctcccaactctggctggccatcactggcatcacagctggcgccacgtgatgccccactacccaagggcctcccatacaggaccccactagcactgcacaccagaccaagactcctccctcacgggccattttgctgtgcctttctcagagtttctcaggaacctttgtgttactgtgctgtgtgctgtgcttagctgctcagtcatgtctgactttttgtgaccccatggactgtagcccatcaggttcctctgtccttggagattctccaggcaagaacactggagtgggttgccatgccctcctccaggggatcatcccaacccagggatcgaacccaggtctcctgcattccagacggattctttaccagctaagctaccagggaagccccctcttgtcacttactttctacaacttcccatatccaaatcacaacttaatgaaattttatttatccttttcatgacatgttaacaatttctgtcttgacaccttgtcttgacatgagcttcaaagtaatatacagtaatatttctggaaatagaag

SEQ ID NO: 59738 - DNA, 1519 bp, Bovine  19866880732674
gaatctgtaagaagaagctatcaggcaccaggctgaggaattctgagaatacttgagggtttgcatgtgctttatagagaggattgctgtcctttctcatgctgccttgtattcttgagaaaaaccccctgccaatgatgggctgaaaactttcttctacacagcttcttaggtaacctccccagctggaaatgaattccacaagccacacctgaggtcttcattgctttatctgaaaatctccctcacttttgtacattcaaatgagagtattttggagacaatttcttattaaccagaggcatctcttgtgatacacttggccatcttgaagcatctcctgccaatcttatttatatgtacctttactgcttccccaactcattccacatccccatagtcttaccatgtgagggataaaacagacctacaccacaaatatctcgaatatctcaaaatgttcaaagtagtagggattagacaagaatatttggttgctcctcctcagggggctctgcctgaagccttcaagggaagtctttttccttcctactggcgagtgtactccagagaccctgagctcagaaggttgagcttatccagagaggcctgggttgccacttctgtcccaatcaagtgaaggctagagggaggaggttgtgaatggtcaacattgattctctgagcttactcctcttgaagtgaaaggattaagtgcaaccagaaagaactggtttagcaagaattttcaataaggaagggacttaccatttgatttcatgctttacaaagggcaggtcttggtttccaaagcatgtcaaccattctgctcctgtcctgagaataggaaagccgctggggtcaggtggggccaagtcagaggcccaggcttcctagcatccttggctgtgttgaaaggtgatcagttggatgaatagctaagaggcatgtggtttgggggaatctctgctttatactgcctcctttcagcctggagaaaaatcaattgaatccactttttaaaaacaactattgatcaccatgtgcaaagctcaatgctggagccactggggattcagggggtgaaaagtacatggtttctgacttcaagatttcatcagccaattaaaatgactaacacatctaaataactttgagacaattctgtaatgagtgctaaattatggttacaaacatgctttatgagagaaaggattctttctttctctgtgaatctgagaaggcttcttgaaagatttaagatataaatggaccttgaaggaaatgcaggagtttaataaataaataagtgctagagaagattagcaagggaggagaaagcctttcatataaaagctaaaacttaaactggggtccaaagcagaaggatgaagggcattatttgagaaatacagagtaatctcagatgaatttactaggtggagaggaggagatgaattgcataattagaggccagcctgtggaaggctggactgaatggtttggaatttatcctgta

SEQ ID NO: 59739 - DNA, 1492 bp, Bovine  19866880782390
agtgaaatgagaacagagtccagagatagagatcactgaaagtgctaatttaaggaggtcttgaggtcagaagctcaaagtgagaaggggtgaaactattcttagttatcatgagtcctttcaggccaaggtggggccaagtgagttgcccaaggtcatactgctttcattagaaaactgcagtcctccagagttctggccctgcttacttccctttatgaattcttttctgaaatgttccatcagtgggatagggcaagaaaacaagcatgaaccttccatgctttgctcagtgattattaaggtgataatcacctttaagaaaatatccacaaagttacaggttaaaaaaagcaataaggaatccatctatctatctatctatcacagcagaatgttcccagcatcaggaattggtagacctgggtcaatgaccatcactggttgtattataggtggggctggggatgagcctcagcttacaaatgtataaaatcataaaacagatgtataacatctgcctatttgtctcaaggatttttcgtaaccatataatagcatgagctctataaaaccaccctaaactaaaaggacctgtgcaaacatatcctcatccccaaatacttgatgttacagtcctaaggagagtcagtcttaccttgcaaatggtatgtaggaaagactgtacctacaatgaaaaacagacaaaagatctagtcagatgaagcgagtggaaggttacagagtgaactgggcttctgagcatctgcaatgtgtggagggtgcacgaacacacacacaagcacacacacacacactgtcatgtgtataacaaggaagcaagtattatctgtaatcaaagttggagggcaaaaggcccatgtggtggtaattgtcacctcagcctcacggggttaatctttaaccaaatgagccagcaacatcacctacaacatacagattccagatatcctagaagccctattctttttttttcttttggaagccctattcttaaggaacactaaataagatccagatcagttgtcccctaatattttacaaatcctcaacagaatgtaccttctacccaactgggacaaattttctggtctgtgcctattaattgtaaaagaagtgaaaagagaataggtaaaggtggggaaacacataccaaccgctctagggatgaaagtataagcaagctatgattctttctttttttaaactatgattctttaagaacccaagcccacagatttcttggtggtctcagttaactcagccccttccccaggagggaaccacacagggaggaagctggccacaccctaaaagaccaggcctgggtgtcaggcaggctggaagtcaatcagccctaagaaggcgcatacagttgaaacacatcagcattgtaacagggccatttgcttctgcccatatgaatgctaaacctttaaaaactggcttcataatcagtcgataagcaaag

SEQ ID NO: 59740 - DNA, 1419 bp, Bovine  19866880793029
ggtcctggttaggctggattgttttccttttggttaaaatgttgtctttcgagaagaagtttgtctcaggatatagcaactacattaagtgtaaaagcttgaaagtcaggccaagatgtttagaatgcagctgacagatacccaggggacatcttagtagctacagtccaacacaaagctgctgaaggcaaagaggctgatacctgagaggtacacttaggaggtatctcttattgtggtatttaaaaatcattctcactgatgttcattatttgaggaagcaggaacacaccctaggagaaaagaaagctgaaagtttgccttgaacatttcacactgtcttcccaaatagtgtggaactagaagccccagaaggttctcttcatggcaattcagattaatagtctaagacacacttagaatgtcctagaaaagtggaacattcttgtgattatttagtaattacataatgttcaagtcatagtgatattaatatattcaacattattagaaattaaagaaataaataataggatattgtgtaagagtacagagatatgaaagaaaccagaagagactatctaaatattttggagtagccaaagtactttttttagaacctataatagccaaaatgcagttttaatgagggcatggtgctcaaaaggaattcagtgtattatttgtcataacactgaaggaatgaagtcatattaagtctggctaagactatggtttggtttcactcttaaatggtgtaactgttgtggttaaaacacccacttaagaaagtcagatatactgtttatttcttcatcgccctgattggttggttgatggagcaattcagtcataatggctgctttatggcagaattggtgcccataaatacagtctagagaggactagagattagaagccatagtatatagtttcttgtccactatctgtaatcaattgtgcttttatagatctcatctataaaatctcatgctggaaggggatttgataggactaatgatactttttggcaaaatttgacctttgcttcttgcatgatgtttgaaaagagcttgggctttgaagtcggaagatagttcaaagtcttggtcctgtctcaatatctatgtaaactcggtcaagtcacaatcgctgggtgtctacttcctcatttgtaaaatagggttaataatacctaacacacaggtctattgaggagctatatgggtatgttttttttttggttgcattatttttaggttccacatacaaaaattatcctttagtatttttctttttctgtttgatctacttcactaagtataatattccataggtccattcatgctgctgaaaaaggcaatatttcactcttttgtggctgaataatacacacacacacacacacacacacacaca

SEQ ID NO: 59741 - DNA, 1073 bp, Bovine  19866880939603
tgtttcaggaaaatatcacttaggttttccatcgaacgtcctgttgctatttctagctgatattgtgcaggcactgtctccttgcaggcagcctttcactctgcagctgactggtgttattgaggccagtgttgtggactcaggtcagaacagttggctttgcatgaagaacttgactgaggggcaggaccctccaatctgctcagggtcctcatgcttctgtgctgtcgttcccaaagggaacaagttggagtaaatgtctccagaagagaagcttgggatgtcctctgtcttcttcagtctgaagggcaggccaatcaattattaatgatctaaatttgaaattgtcactttaagtgagagataatatatttgtgacaagagtgatgggctatgtgtgcttagttgctcagtcatgtccgactctttgcaaccctgtggactctagcttgccaggctcctctgtccatgaagattctccaggcaagaatactggactgggttgccatgctctcctccaggggaatcttcccaacccagggatcgaacccaggtatcccgcattgcaggtggattctttactgtctgaaccactagggaagtccgagaagactgatgggatagaaggagtcctgccttctctctggttgactgttatttgttttcatggactcaggaatatcacataacctctacatcctccttagcttatctctaagatgaggaaggtggtaatgcttcttaatcttttcaaccaaattaatagaaaagagtaaatatatagatacagtggctgtgtctgagagtaccaaattgttcacaagttccctttacctataggctattacaaacctctgtacttgccattaaggccacctacaatttggttccaatacatctttctgccctgctgtgaaatcccttgccttcatgaatgtgtctctccaatgtatcaccagcatggcttcctttgtgtcttttcttcattgtctcctcatcgtgaactgtgtctctttttttctctacatcctaggcatctcttaggcctgggctctgaaagttttgtttgattc

SEQ ID NO: 59742 - DNA, 945 bp, Bovine  19866880975072
tggctcctatttggaattcagggcacattaaggagcaaggatgaaattggcgtcagctctcctcccacgctctctcctaggttctgcaaacaaggacttcaaggacaaagacatgagcaatttcgctgtgttctctggggataagcaggaagcatctgggggaaaacaaggagagaaaaacgcaaaccaggcttgtgtaagactggatgatgggatgggggcagagaaggttgagggaatgctagtatatacattgcttggtttaaagtctattggcttaatgtggggtctggtaaaactatgattatcaaaatgccttgcatctatgggagtagctgtgggaatctattgcagccaggacaatatcatcctctctaggatccatcttcacatctgcctgtgtcttggaagagaagcagctactttgtgacccataaatagtccacatttcccaaacagctctcgtacatatttagtaatgctagagctatctccagtagcagagagtctgtcagcctacaattagaaaaaagaaaagactcaaactactgagatcagcttctttccagaaacagcatttctttggtgggagggagaagaggaaggagaaagaatgagggctcctgcagtggaggtggggacacaatgtccagagaagaaacaggggacttcagggacagactgtcaatggttcaaggttgacccagattttcccatggtgtgggactaatagaggctgaggttgtcaggcttgggagtgatgggagggaaagtggatgtacagtatagttattttcattcaggtcactgaaaataaagtgcttcactccctactttctgtacacactttacatgcataatctcacttagccctcaggccaaccctgtcacagaggtctttaagagctgcctttaagttttgcagggcataggtcaagagaataa

SEQ ID NO: 59743 - DNA, 1944 bp, Bovine  19866881027507
aaaactaatgggttatctatgctgattctgaggaaggttttttttttttttttggtcaaaacatattatgcagtgaacctgaggaaaggctatgaatctggaaaagaaccatttaggaaaggaaacacatgctcaattcaaaactgttggtccctgcgacatggtctacacctggacagcctcagcgtgctgatgggggacagcctgatgcatggcaagcagccactggagctgtgtggagactggggaattattcagtctctgaaaggttgtggcttcctcagtgacacatgtttgtggtttgcagatgaatggactaagaatgcatattctcacacataaataaatctgtgtaacaacatttacgtctgtatccagtcccagtggggacttgagagtgatgccatgtctgcttctatcaggaatttgctttcttaccagacttcagtgatgctataatatctcatgagaaactgcagagactgaaatgggagcggcgccttggtccccaccaaacaaataaatcccgcacttatgtgggagttgcttggatgatttacttttttttcctgtgcacagggtgctattcctgaatccctaaaagcttgcaagctcggagaggatagatgttcacttctcaatgtcaggctcagtgctatagaacagccttccaagtgggaagagaaaaatgtttccacccacatatgcccagttccctgggaggtgattcaagttagttaaagtgatgtgagggaaggtttagaggaagagggttatcaggagctttcactgtgggaaggtgtgggaaaacagttctcgctccgaagggctgttaaaagggtcggataaaataatgcacttgaagaaagacttttttccactatgaaacctcctcatatcaatgtcaggtttccctactgttactgttccaaggggcctttgatgctcaactattcatttgaaaaatttattgcctactttgtgccaagcaatatgctgagatgccagagaaataagacctaattcatgccctagaggtttcatgcaatgtagaaaaacatagaatgtcatgactcaggaaacttaaagatgccactgaaatgtctagacatgccggcgggacagtgactcatgccctgcataccacagtgcttcctgcaatctcattgtgctgttccaagtgtccctttggaaaaggactatttccttgacaaccaaagtagttctcagctctgacaccacacaaccaggaagaggtccagtcaagggaagcctttcttagagggaccacttcaaagtggactttctgtgtcttttggaggaattatctcctctctccattcttctctctctctccacagtttgattctaccaactgtcagtgtcaagtctgggtgatggagtgggatgaggaatggggagagtgggggtggtgggaaggatgggcagaccattgcagaccacggccaaggataaattttgttaccagagattttaatgtcttgggtaacttaagttgctcatctctgtcagccttttatctcaagactttggtcccacatacacggctccatgctcattaaattcttagcctcttagaaactggtgggctcctgctactctaccctgaatgtaagaccgtttaggtctcggattcaggaactttcagagttataacctacaccctagtcatgtctgttcaccaaccatggtggagtaagaccagctttatggaggcatctggtcccatcacttcatggcaaatagatggggaaaaagtggaagcaatgacagattttactttcttgggctccaaaatcactgtggatggtgactgtagccacaaaattaaaaacaaacaaacaaacaaacaaacaaaacaacgcttgttcctggaaggaaagcttgacaaatcggacagcgtattaaaaagcagagacatca

SEQ ID NO: 59744 - DNA, 765 bp, Bovine  19866881163308
cagctgcaggtgggggcccctttatcaggccttattcatccatccccactgcctccagcgagcatatttaattatctaaaacccttccagacagatggctgactcagagtccagcctcacctcaatgacagtctccagtggcttcccgtaggcaggccattgcctggcacagagcctggggatgacctaattacaactgtctgtctagtcctccaatttaggggaccagtagatgggtgtggcccctttctaatggccccttttagagccacacaaaacagcactcagatgattttttaaatcctaaaggaagagctggactctgaatcaggaggcctggacttggatcctgcttctgaagacaacttgcctggtgaccttggaccatgggttcagctctttaggctcccacctcatttggaaaataagcagttagactgcctaatcttgtagggctccaaggctcctaatctctgcttggctctgaaaatacagctggattgttctttcattctgttgatctttgtgtttatccctgctagggagagaaggcaaattgtgtttagtttcaaacttgccaacgtgtgacttgtttgtcattaactcccaaactatttgaagaaaagcatgagagggagtgcaaattatatgattttgtttggccaatgggaatcaaatgagaagctgacagacacaatctctcttccgccttcacttcctccacatttttgattgtgcacagtcaaatgattttttttttctttc

SEQ ID NO: 59745 - DNA, 1708 bp, Bovine  19866881235239
atctctataagtagttttgctaagttaaatgctagaaattcattgactatctagatcacttccaggtaagataaaacacaggtacattaattatgttgaacatgatttttgcttttggttgcctattacagagaaacaaaagttcatggtggtagtttaatcgctaagtcatgtccaattcttgcaaccctgtggactgtagcccaccaggctcctctgtccatgggcttctccaggcaagaatactgccgtggattccatttccttctccaggggattttcccaacccaggaattgaacccgggtctcctgcattgcaggcaaattctttaccaactgagctgagaagcccaaacaaaagagacttggactcattagtaaacatgtcttgctccacattgaaaaattatactatgagaaagtatatgcatctagaaattatgaaatgcattcacaaatgtgtcagtgtaaagaatgtttgtgtagcacagttcacagttgcttatttcttagttttcaatagaaattaaggttttaagggataagatgtattaataatagtcatgggctgcaaagagacatagctgagcgactgatgcacatactagaaataataagggaagcaactctgtatgcaaaggaactaggatgtgtttgggcgtaagaaaggtgtgaggtatggaggtgcatttttgtaaagataaaagaaattaatttgcccaaaagtcaaactggttatttctgaatgagaaagaggaaagtaaaggacaaactaagttgatagaaaaacttggcaggagagaaagaaagggggttttatttcgtgtaactcaaactgtctaaaaatgtaataaatttattacaatagattttaaatagtgtacttatgcttatgtaaagttaaaacttaattttctttcatctactaaaaactcaatgttttcttggaccactggtcagctcttgataagattagaaaggtgatttatggcaaaaccaatacaatattgtaaagtaattaacctccaattaaaataaagaaatttatatttaaaaaaaattagaaaggttttctttaccttttaagtaatctgcttggaaagcaaagattttatgtcttactgaaaaaattgactgtgcttcacgttgtctttatcaggtctttgattatctaaaaccaagtcttctccattaaaagagctaaggtttttttgacaaccatgtaactttctgtttttgtctctgtcactttggtttaaatgggtaacacagtattgtttcacgtaatcaatgaacccatctatttaagtgttttaaaacctttttataaaaaaaaaaatcttagcaaacttcccacactccctctccccccaattaaattctaaatgaagtttttctgacctcaaactactggaatttattttcaggagactctggaacatctcaaaaacaaaatttgctctcttgccttattaaactacaacaacaacaacaacaaaaatgagagaggggggaggggttaaactaatttactttatttgatatgttaaactacatggagtggttaaactaatcagctttattttatatgttaagttacaagagaaacattatcaaataaggagttaatactaagccttctttatgttttacttgtagaggtgtataactgttccagaaattttatgaagttcctagaaatctgata

SEQ ID NO: 59746 - DNA, 676 bp, Bovine  19866881236574
tgtcccatgaaactgtgagctgcgaagataatatacccgagtcacagaaagtcctgccaaatgaggtctgcatttcaactgttctaagccagactttgtgtgtccttaacatttacctctatacctgaacccagccccatccccacacgctctcacagacacacacagagaaatgctcacacacacacagacacacacatagaaatgctctcacacacacagacacatacacagatgctcacagacatacacacaaatgcacacacacacacaaatggacacacagacacacacagaaatgcacacacagatgcacacaagtgctcacacatacacacatatgtacacacacagggtgatgggccaggacaggggcacaggtgagaggagattgtcacctgccttatcttagttgctcagctggtaaggaatctgcctgcaatgcaggagacccccgtccaattcctgggttgggaagatctgctggagaagggataggctacccactccaatattcttgggctttcctcgtggctcacctggtaaagaatcagcctgcaatgagggagacctgggtttgattcctgggttgggaagatcacctagagaagggaaaggctactctctcgagtatcctggcctggagaattccatggactgtatagtccatgggggt

SEQ ID NO: 59747 - DNA, 3923 bp, Bovine  19866881335285
atttataagattttctattattgccttgagtggaacatctcttgtaaagcagccaaagtatttggtacacaaccttcccattaatcatatcccccaaggaaatatatgagttgaacacaccattgctctaatttcacaaaggtagagagagaaggtgcagaagcaaagtgatttttcaagtttacctaaggtctcaccatgtaagtggttggaaagagtgggctggcttctagccagcctagagactttgttctccccagttcttagttttattcaaagtacaagagaacaagcaatttaatatcagtgtcaccaatacatcatccatatgaaggatggtactgccacgttaatatgcaaataagctgaatataaagtatctaatcttactaagcacagtgctccctgtttctcagaaaaatttatgtctatatgaaaagagaataaaattgcagaggatattcaataatgtatattcattaacatatgaaggggaacacggagctgtattccactcttaagattaacccttagagtttgggaaaaaagaaaataaaattgcccataggcatttggtatcaatactctttctgcaaatattctctctctaaaggctttaaagttatgaggaaaatctcagataaatggctgaaaggtgatcccataaaaccagtaattaaccctgcatcattttcttctttcttcaagattgaaagcattaattattagcaccaagcatataggtctgtctccagatgccaagaagctggtgatcagaaatggatgctaggatatgctgtcatctagaatctactccccacatgtgggcaggaatggaacccagtccctctgttccccaaagctctctgtagactttgctgcctcctttctgcacaatgagaaaaacattaacagaaaacattccctcgaggtatttggaataggggaactctttggtcttattgggctttcctgctggctcaaatggtaaagaatctgcctgcaatccaggagacttgggttcgattcctgggttgggatgatcccctagaaaaggaaatggcaatccactccagtattctagcctgaaaaaccctttggacataagagcctggtgggctacagtccatggggttgcaaagagtcagacaagactgagcgactaacactttcacttcacaggtttggtcttattaggaggtgaggaaaataggaaagaaatcaagagcagcatctaaacaggattaagttattattattcctgataacaatgaaaagaactaaaacccacacatgcttagcacttcatcatttataaacactttccatccattttctcatttgatcctcacaacaatcctgtgagataagtaagatggatatttactctaactttcaactgtgaaaattaaaaatacacagagaagtagatgaagcagtgttaataacctgaatatccatcttctggatctcacaatatgaacatcctgctctacatgtacatttattttttgcttaagtattttagcagattataagcaacgtgggatttaaccttttcacatgtaacaaaattaataatacttctctagtatcatttcccatccaaattgtaatcagatagccccaggtgtaagataagcattacttctcattttgcagatgtgactttttttgacataacaaaatgaaccaacgggcttgaggacacatagataataaacaaggaacctgagaactcaggtttagaactcatgatttcttggtctcaattcttctcactttgaagcaaagttccataaaaatagtctcaattggaagaagacagaaaagctacacagacctctgcgtattatttgagcagaagtgatcttaagaaaatgtaaagcgaatatatgagtttatcttcaacaatgtcttatttttagtggcccttctcattccctgtagttctgtatttaccctcccccaactcacccttcattgtccctaattcaaaccccagtcaatgctgcttataatatttgttgttgttcagtcattcagtcatgtccaactctttgtgaccccatggactgtagcctaccaggctcctctgtccttgctgggatttcccaggcaagaatactggagtgggttgccattttctcctccaggggatcttcctgacccagagattgaaccccgagtctccttcattggtaggcagattctttggagctgagccaatatactggctatctaagtgccctatcaatacttccctctccccatctataaggtcaacaccatcttgcagccatcaaacatcttaaaagagcgtgatagactcatctctctgagatgagttattagtcatcgttactgacaccatgaacccctctgagtattcctggaactataggatgacattattttgcctcatggaatcaacaaatcattctgatgtcatgattcttacaccaccatgagcattagcaatgtattcctgcttagctcaaaagtgtatattcaatttagacaattccccttgtagatttatacaatctctgcagtaaaaggtttcctctcccatctaaatgttttaccatcttctcccactttgagcccctttccctcatcacaagtatcacacatgtaatcagtggtagactcagcttgccattcacgtttcacctctactccacaaatgtttgcattgacttcttctgggttcctggcatcttttgacaagacctgccaatggttgctgaaaattttccagatggatatgggtatgttccaaatcataacatcaacggtatctcttggctcgactcacttgtttagtctaaatggatcagacaaatacaaaaacattatataaattttaagtgtcacccaagggaaagaatgtaaaacattctgagataaagagaaattctggtcatcatcaggctactctggaaatgtgataagacaaagccatgtcatgttgccaagtcctggagaactagggaggagtcggtttaaccagaacatatctgattccaggctcaagatgcttagacaggaattcaggttagcaattcctagttccatacaaagcatattacacgataacaatagtcaaaagctttatgtgtgatagatcccttccaggattgccatgtgttgacatgcaacgtataagaaaattcttttaaggactattccctcatactagaatatcagatatgcaaaatagcccagaaggtcttccctgtcatctctgaaatcatgttacaattgtatcagccacagttcttgattacaaacaatagaatctacttggcataattaaaggggaaaaaagaatttattaagagatattttagctcaaggcaggagaaggagacaacagaggacaagatggttggatggcatcactgacttaatggccatgagtttgagtaagctctgggagatggtgaaggacagggtgaaggacagatgctgcagtccatggggctgcaaagagtcagacctgactgagcaacagaacaacaattttagttcacagattcattaaactagctgtaaaaacaggttagagttgaagctcccgggaataatgcctaaaactacacagaactgacccagtggagaaattgcctgctgtgtttaaattcctagaacctgatgactgctactaacatcaatgccactgcaatctgtgactaggggaaaggctatatacctttacaaccacctgtgcccacaactcagagctccatgcagagttagctgctgtctcatattgttcacatctgaactaagtctcatgctcatgtctgattggagagtccagcccctgtcccaactcttattaatcactcactatgtgtcatgccttcttctaagccttttataagaattaaatcacttaagccttagacaaccct

SEQ ID NO: 59748 - DNA, 826 bp, Bovine  19866881369725
tttttaaagtacattataagcattctttttctgcctatgtgcttactctgatctctccaaatagatttatgtttctttccttttcttcttcttcagttggactgtttgcttaaagtcaaaataaatttcatctcctctggactctcccctaatgcactgatctataatcacagtccttatatcctttgacactttgaatttctaaagtctgcaccactcatttggcacttagtttttgataaccttagaccacatctttttctgtattccttggatctccaagaaaaatataaattatttgaaagcagggacatttttgccagcccaatgccctgttcatgcagacattctctaaacattattgctgtggatgacaatgacaacagcatctcaattatgaagcataatcattcttaggtaaattgaagattcacaatgtcaatacgttgaaactcttcatgcattgttaattttatactggcaattacagttcacaattgttcacagggcacttcacaattgttcatcagtttttgtcaagatagtctcaagagatggatgataaaaagcatttgctgccattttttttctaaattgagcaaagcaaaatatttttatgagatatactgagaattttcagtatattaattaacatgaggaagcaaaataaattatttttcttggtcccttataccaatagcaatactgccccagcaatttttcccatagaaaagcaaatagtgacttatttaattgaacttctggtagtccttaaagacggagaggttctagccttctatgcaaactaaacttctactttaatgcc

SEQ ID NO: 59749 - DNA, 889 bp, Bovine  19866881395300
gccctaaggcagaaggtctgttctctgtgaagatcctaggtttccttcaaacagacagagctccagagagcattcctggtccccttcttcaatttctgccccttcattccactgctaaacctcctcacaggtactgctcagcactaggcaactcactgggtagtaaaagcaacagcaaggctgagacaggtgctcaagcaactaggcttgttttcaggctgtgcctgtgcacacagaatatatggtgtgcaacacagccatcgtcactcatacaaaagggtttctatggaacatgttgaaagtgagaaattagggattttattataagcgtgatactagtcagaaggcccagaaaactggcattccagctaccaaccagcttgagcagaagaaaagagagcaacagaaaccacttaggagtccctgctgatgttaacgtctgtggagtcctcaggcctcctggacctcttcccttcactcagattggtaggttgcagatctaaacatttgcaaattcacagtcatagtcagtcatccggcacattatgaatttccactggcgatccctgtagggagagagtcagagagctaatgtcagtgagaaaagacaccttgggaagaataaagcaatgagcaatctttggagaatttaggaacgtaagggacagctaacctcactttcctctcaggaaacatctctaagaagtctctagaaaacctattggtaattgtctatgaggtcaggactcctggacccctcctcccagttcaaggtgcatcttggacgggactaactaggttgccagtgtgtttaggtcctgtttatcaccagtgatcagctgatcactggtccatctcaaaagcaccttctggacatacaggttaacag

SEQ ID NO: 59750 - DNA, 1425 bp, Bovine  19866881562687
tctctgatcatttgttctgctacccatttggctatgattatggagaaaagttacagtaaaactactttcttaaaaggacacaggctttttttttttttttaattattcttcattgcatcaagccaaaatagtcaatctattcgactataataaactttatctgttactactgataatcaacattctaattatcaaaacagtatttcagtttttatctctctagtattgtgggcatgttttattcttttctttttcttaaaatttgacctcattaagtgaattaacttgctttgattcttcttaaaacagcatttcaggggcctccctgatggctcaatgataaacaatctgcctgccaatgaaagagacatgggtttgatctctgaccggggaaggtcccacatgccgtggagccactaaccctttgtgccacaattattgagcctgagcgctagagcccaagagctgcaaccgctgggccctcatgccactgctactgcagtccacgtgcctagagctcaagctctgcagcaagaggagccactgcaatgagaagcccacacaccacaactacagagtaactcccatttggtgcaactagagaaagcccacacagcagtgaaggcacagcacaaccaaaaaatatatacataaataaataaaattattaagcatttcaggaacaaagtgaaatatgttctataataaatataacaaaaatcttacttcatcagcaagttttcggttaaaaatccttgattcctctagtggtgaccagatttttatgtcataatctatgccagatgaagcgagaactagaaaaaatagttcacattaatataaagcttagaaatgtcattaattcacttaaatgtgtaatgtatatatgcatggatgtatatattcagcaaaactgagttagaatggacattgtacttgatacgtttaactgttaaccgagaatacctgttttgaagatttcctaaaagttaccctataatacaattttaaaaccatcttgaaatcactcaaatttttttcctatttactgttcttttatgagaaacatgggaatgtcaaatggaaggtaagaacaagtcattgctcctttgttctggtaaattaattctgatatgtaaagactaacaggcacagaacttccatttggttaagcagggaaaagtccaatcaactgaagctcttatagctgataaaactaagaagaactattaggagaataaactttttaatctatttccctctattttcagccaaaaacaggttgtaaactttttttgttttaaacccaagaagagcaatacttgaccctagtagctgcctactaggataatttggattattcttacaactagaaaaaagttgaagctgattaatcatactaatgattttgaacccttgccttat

SEQ ID NO: 59751 - DNA, 764 bp, Bovine  19866881618017
acaacaaaatactttttaaagaaatatggtttcattacttttacaattatgaaagaatgttagaggttgaccaaagtataatctgctaatagtctttgaagaaagtgccttaatgaataaagataatttgcaattagcaaatcattattagtatacaaagagcttgagaatatatttttatcttacaatcatcattgtctcaaatcttgttttactaatttaattaaaattaatatatatatatatacaaatatatataattcttgctcaaagcacctcaaatttatacccaccaccttttaaaatcttgtcttccttatagtcacatatacaccaaaaagataaaacacaggagtatccaatttagttgacttcattccatcaagacaggtggttaaatggggaaatttctaacccattaggagagaaaataattagaacataaaatatatgaaatcatgtactttagtattgcaataaaatcaattaaccatagcttttcccagttttctagaacattctagacctcataaattgaataatttaatcataattttttaaggacatacttgacctcttttgactaactggaatttcaacattaatgacccaaacctaactttccacaatcactggccaagggatttctgtgacttttcaacactaaatatagaaatgaaatttatattaccacacggctctttttcaatttggcatttataccgaacttgaaaaccactctaaattcctcttaatgttttatg

SEQ ID NO: 59752 - DNA, 949 bp, Bovine  19866881749404
taccctgtaatttaatgctaaatccagctcaatttggtttctgtggcaacggagagaaccagttctctatggctcatatgtcagatttctaaatgcagggtgcctacaacatgctcaacatccccaaacatctgaagctctgatgtgctcagaagctcttgattctcagcttgagccacaggtacaaggatgcagtatggaagcttctgttaaagtctttacccagcctagaaaatgtagaaaagggtagattagggagctttcaagcctagaaatcttcagagatgggaaagctgcttaactggtttgagaagacttgggagagggtcttggtgaagaccaaaggaggtcttagacctgatgtagtcattggtaacccttagtagaagccttagcagatgtacatgttctctatgaatggacccctgtgggcagtcatgagccctcaaaagtaaatctgctttctttcatgtccttcctctcagcgagtagcatgcatgggactggggaagagtgggtttatactctggctgtagcattgactttgatacatgagatgtctccttacctctaggtccagagatacggaaccctcctagaaaaccctctgccatcctggccaaagccccaagattggaatgaatttctaaagcccctcctcctttcagtactgagtttttttttccttggatgctgaaactgaagctccagtactttgactacatgatgcagagaactgactcattagaaaaggcccgcatgcttggaaagcttgaaggtaagaggaaaaggggacaacagaggatgagatggttggatggcatcaccaattcaatagacatgagtttgagcaagctctgggagatagtgaaagacagggaagtctggcgtgctgcagtccatggggttgcaaagagtcagacacaactagccactaacaacaacagaa

SEQ ID NO: 59753 - DNA, 1221 bp, Bovine  19866881840488
tgagtgcagaatggctatgtgggggctgtgtgtagaacataccttctgtaaagagatagcaggtgtgacaaggttctagcactttgcttaatctgaaatgggggaggcgggcggtggaaagttgcaaatttttaaggaagaaagctccatgtttttaaaattggcaactaattcaaaacagttttcaaaatatgctgggcaaccaaatcatgtgtgtaggctcgttgtagcctgcagactgccagcttgcaaccttaggaagtacttgctgtcattctgagaagcaataaagcataactggagggcagaagtgatgttttcttgctgtttttctttgagatcaacaaacatcaacaaagatggaggtagtgctacctggaatttggagtaaggattgactttatgactcaatacttcattcattcagccagtactagtactgatctactctgtgattttagtcctgcaccaagagaatactttcaactagtttttgttagccagtttaacaaatctggaaatagaggtgaatatgaatgcataatatatagtttattgatattatattataaaacacgatgaagtactatttgcatttccaactttaggaccaaccttagtatattggatatgcctttaaaaatacataaatggggatcatatataattatatgctccatgacttaattttttgacttaataatcagacttggatgtcttctaatggcaataacatagatatacttcattctttttaatggctacatagtattttatagtgtagattcaccagaattcatttaaacattttcctattgaggggctttgagattttttttccagcttcatctattatcaatgctatagtaaacatattgaatggtttgccttggaaatgaacagagatcattctgtcctatgcaatattgttctttacagcatcggactttacttctatcaccagtcacatccacaactggggttgttttgctttggctgtgtctctttactttctggagttatttctccactcttctccagtagcatattgggtacctactgacctggggagttcatctttcagcatcatatctttttgccttttcatactattcatggagttctcaaggcaagaataccgaactggtttgccatttcagtcccttctccagtggaccacatttggtcttcatgacccagatcttcacattactaaaagat

SEQ ID NO: 59754 - DNA, 777 bp, Bovine  19866880374343
ccctcactcgaacctgctggcaccctcactgtggccttccgcctccagaactgtgagcaatactttttgctgttttgtttatttggctgcatctcgtggcatcaggatctgccccaacgagggactgaatccatgcccctgcactgaaaactcagtcttaaaccactggaccaccagggaggtccaataatttctgctgcttatgagtcacccagtctgtgatattttgttatggcagcaggaagagactaaaacagatggggtgagtaggcagggccatttctgaggtttaaaaagccaccaccacacacccagaatgcccttcttaattactcccacagagcagcaaagttaagtacagttgattctctttatttgcagtaattacattctataaagccatgtagacactgaattagcaaacactgaaccactggtcctaggggaaacataggggtaggttcctgtgagccactggccatagaatttttgtcaactgatcaaaatataaccttgttttatgtgagtttctgttttaaaatactttatttaatatgcagctaatcagatcagatcagatcagtcgctcagtcgtatctgactctttgtgaccccatgaatcgcagcatgccaggcctccctgtccatcaccaactcctggagttcactcagactcacgtccatcgagtcagtgatgccatccagccatctcatcctctgtcgtccccttctcctcctgcccccaatccctcccagcatcagggtcttttccaatga

SEQ ID NO: 59755 - DNA, 2382 bp, Bovine  19866880423655
atagctctaatgtttgccagggtttgggagaactaatgatcagttgtgtgagaataagatgacttttaaaaacttgctccaaataaacatgctccaaagttgaagtgttttgatagaaacatgtttctgggaggcaggtgatccaagtgataatggtcaagaagtacaaactagacagagataggacccaaacaaatgcaatgaaagtttatgttattttgttcaaagtagaaacttccagtggagaatgaccctgccctccacctccatcagcgcagaaaattttgacttaataattctttatgtgtaattttcagcatgtgagctcagtcatgtatgactctttgaggccccttgaactgtagcctgccaggctcctctgtccatgggattctccaggcaagaatactggagggggttgtcatttccttctccaggggatcttcccagcccagggatcaaatccacatctcttgtatctcccgtgttggcagatggattctttattactagtgtatttgagcaaaagacatcactggcttcctttctcatccagttaaggtcatgtccccacaagggaaattgtgggttactgtgggcttcaggatggtgattgtctaggctagagatccttctaaaggattcagtcccttacccagggccaaactgcttgtctggttcagcaggaaatgactacttgaatatactttaattgctttcaactgcttgtgactctgaattcactggtgccctggggaagtcttcccccaaatctttgacccaatactccttggtaagccactgacatggcttaaatgatttcagagtcatgctctaaatactgttgcatcacctcaagaacaaatcttcatgcttttgtggtaaaacttgtttctgtggtattcagacatatattaggtagtatctcgactcagttaaacatatgctgtgcaccatgataggttttagggatatggaggaagaaatacatggtttttgctctaaaagactgtggagtctagtgaagaagaccgcagtgtcagaatgtaaaaaagtgccaattgaaaagatgtcactttttattaaacataagaaaaggtaaaataatttttagaagggcttgtgaaggggcattttctggtgctttaggaagacaacccattaatgctttagagcaatggtccccaacctctgggatctaatgcctgatgattgaaggtagaggtaacatgatgataatagaaataaagggcacaataaatgtaatgcacttgaatcatccccaaatcatcctccccaccccagtccatggaaaatttgtcttgcacagaaatgatccctagtgccaaaaaggctagggactgctgctttagagggggcccaaagcagaaggtcctggggtgatgtgtcctttcaagcttcctcgtgaggggatagtgtagggtgcctcctgagggcagtattggtattgccagcctggtcatgggccagagtttattgcttgaatctttgtagcccacatcgcatgagctcgctctttgtgggcacctccctaaattggtcatcatgcgtagatacaaacaagtaaaataccattttcaagtataataccttacaagtaaaggtaagccttacaagtaaaataccactgttcaactcaatgagtttttgtgtgatttctttctaaaatggagagaagtgaaacctagtatttgttcaccattgcttcttcttcttctttttatagttcagcattttaacacattgagttataattggcatataacattgtataagtttgaggaatacagtgttttggtttggtacattatatattgcaatacaattactacaatagcgttagctgatgcttttatgaagtcatataattactgtttctttttttgtgttgagacctactaaaatctagtctcttagcaactttgaagtttcatatattacagtattgttgactgtagtcactgtgctgtgcattagatctccagagctttttaacctgttggtttcaagtttgtaccctaaaacaaatctttccaacttccccatcccccagcctgtggtaaccaacattctactattttcactgaaggaggaaacagacagagctggactccatcttaggcctgtccatgctgatcacgctcagccacctctccaatggactctgaactctgtgcttagtgtctatggaaaccacaacagaaggataagacctcttctagccaggggaatcttgaagctcatatccaggttactcattgcctaagagaaaacatactctaatcacccctgcctccggacagggcataaattcgttctgtatctattggagtgtaaccacaagcttattgattattataa

SEQ ID NO: 59756 - DNA, 2649 bp, Bovine  19866880465028
gccttgtgggccatgataaggaatttgaactttacgctgagagtaatataaagcaattaaagattttaaagcaggatttatgtttctaaaagattcctctgtatactatttgagaatggactcgagggaaatgggaatggaaagagtgagatcagttggagtgaaattttagtagcaatagatatgactagggtgacagctgtgatgatggtgactagttgggtttcaaaaatattttgaaactacaattgctgaaatatattgatagatgactgggctttccaggtggcgctagtggtaaagaacccacctgccattgcaggagacttaagagacacaggttcaatgccttgttcaggaagatccccgggaggaggacacagcaaacccactccagcattcttgcctggagaatcccacggacagaggagcctggtgggctacagtccataccatcacacagagtcggacacaactgaggtgacttagcatgcacacattcattttattgtgcttaacttgataacatatatatgtatatatatatatttttttttttttttacaaattgaagttttgtggcaaacttgcatcaagcaaatctatcagtgccatttttcaaaaagtcattttctcaattgtctttctgtcaccttttggtaattctcacaatatttcaaactttttcattattttatttgttatggtggtctgtgatcagtgatctttgatgttgctattataattattttgggacaccatgaaccacacccatataagaaggtgaacttaatattgaaatgatgacataggatttagaatattacataaacttagttgagaaagtagagtttgagagggttgactccaattatgaaagttcatggcatctgatcccatcacttcatgctaaaaagacggggaaacaatggaaatagtgatagactttattttctttggctccaaaatcactgtgtatggtgactgcagctatgaaattaaaagatgcttgctccttggaataaaatctatgcaaacctagacagtgtattaaaaaaatggagacttactttgccaacaaaggtccatctagtcaatgctatggtttttccagtagtcatgtatggatgtaagagttggaccataaagaaagctgagcattgaagaattgattcttttgaactgtggtgctggagaagactcttgaaagtcccttggactgcaaggagatcaaaccagccaatcctaaaggaaatcaaccctgaacagtcattggaaagacttatgctgaagctaaaactccagtactttgaccacctgatttgaagagctgactcacttgaaaagaccctaatgctgggaaaggttgaaggcaggaggagaaggggacaacagaggatgagacagttggatggtatcaccaactcaatggacatgagtttgagcaagctctgggagatagtgaaggacagggaagcctggtgtgcaacaatccatggggttgaaagagtcggacatgactgagcaactgaacaacaagaaccccagctttcagcagccaccactttgatcagccaacagtcatcaacatggaggcaagatcctccagcagtaagaaagattacagctcactaaagagagttagcatttttcagcaataaagtatgttttaaccatgtattatgcacattgtttttttaggtataatgctgttgcacacttaattacagcatagtgtaagcataacttttatatgaattgggaaactaaaacaatctgtgtgacttgctgcattgtgatattccctttgttgtagtggtctgaaattaaacctgcaatatctccacggtatacatgtactctatgattccagaagccttttgaagggcgatgattgttttttacatgatttggaatctctcacagcaacctagcataattcccaataaatgtttggaaggttgagtatgtgggtttaaaattagcagaaaaactcctttaaactgagaatcttctgagtgctgctggaagcgggcagggtaaccattgaaggattaacaagtgcttcctgatccactgttggcacaactgtgggtctgactcttacttacacattcttattcatgacctggatggaaaaagggaagaggctggatgtttttggaattcactaatggttccaatttggaaagtgttgtgagcagctcaggcaacagaaataaaatgcaaacaacctttgagacttgagggatgtaggctgggaataataactttgtgagcatttgaaaaaggcaaggcagtgaatacacctgggggaagagaatccaaacatagagctgttttcggggaaggcgacaccagaacgcagcgatgccaaagtaggcccagggggcacggcggccgcaaattaaattcagggcagccaggcagtctggcaggatgaaagggaagtccaggctgaagctgcctgtgcagaagggcacggagtaacagttcctctgtggccagttctagctgagtagcacctggcccctcaggctgtgttcctgccaccttggttcctagggaagcacgggcaatttggaagaagtgcggagaataacaagagtgaatgagtccaggagcctgaggagaggactcggatgaaag

SEQ ID NO: 59757 - DNA, 1918 bp, Bovine  19866880562008
atcttggctagcccctgtgccttggagtccttatgtaaaattagatcttagagtccccatatgggatctgacatacaacttttaaccaggagctcttatttaaaaaatgaaaaccaatgcttcaaagaaaagataccagctattcatcacatagtccaccatgtcactgagcctgggcttccatacctaaagaaaggttcccggatcctggcgcatgaatattatgattggtgaacactccttggctcacattcttttccctgtaggtctacatcagtgtgctgttgcttcacgattcttcacctatgcggtgggggcaccatcaacccccttaacactctgagtcagaaacctgagttacttttgtaactgtccccactcctatattttgttatcatcaaaactctctccttgatatcttctaacctagtctaccccaatccacctacattctactacttcattttaggctctcactggaattaaacagatggcaatccactcttggtcccatgtgccctctttgttttagccttattcctgtttaattgtttctaccccccgtagttggaatgattgctcccaaataaaaatgttctattattattcccttcctccaagtccttcagtggctctccactaccatcagataacacacaagcaatgatgcccagaatgtcctaccctttctttttctattaataagtgattctgatttgtcctctggaacatgccttgtagatgtttttcatattcttgtgcattcctctaaaataacttttttgtttgtctctctccttgagctcctttgggggatgggagaatgctctgtatatttggtctgtgaatcctcagcacaatgatagtgtctgacacagtctaggttctcaatatgtttggtgagtgaatcaatgatgcaattaatgaatagtcttccctcttcctaattggccacaaaggacataaatggatatgaccatagttttaaggtgttattaaaatcacaagatggagaaaaaactcaattgttctatttttacactgaaattgttagtgtgtttgtcatgggatgttgaaaagaaacctaagaaagatatctttccaatgataattataatggaatttaatttctcctgcatatcaagattaacatttgttatggcttaaaccaagatatttcatcactggcttctccaagacatacactgcatgttagaggctcttctctgctacaaaaatagatatttgggctacttcaaactgcaattccatattcagagtttccactaaaataactcagctattcagatacctttgaccaaagagaagtccagatggagcttaaaagatcaactcttttgccttgggatacagtgtgagagggcttccccggtggctcagaggttaaagcgtctgcccgcaatgcaggagacctgggttcgatccctgggtcgggaagatcccctggagaaggaaatggcaacccactccagtattcttgcctggagaatcccatgtacagaagagcttggcgggctatagtccacagggtcacaaagagtcagacatgactgagtgacttcactttcacagtgtgaggcaggccacacgcggaccagtgagcgaggaaggggccacctttccaactaattaaacagataaagtcagctctgcagacaaaaggagtggcagatgccaaagccagatgacctcaggcctagcgcttccataccccactggtgtttccttactccctccatggtcttcctcacttgttttatggcgagaatctagcacctggacactttcggggctcttcctggttacttgacctctgatgcctgagaaagaaatctgctcctcgagcctcaacttcactgcctggagacagttcctgagacttgcacatgactttcaa

SEQ ID NO: 59758 - DNA, 569 bp, Bovine  19866880568120
tcaagtggaagtttagtcaccaaatattgagtacgtgcttgttcagttccagacaatgagctaaggatcaacaatgaactctatttaaaaaagaaattaagattgggattcactaaagaagaaactggaggagggcatggcaacccactccagtattcttgcctggagcatcccatggacaaaggagcctggtgggctgtggtccatagggttgcaaagagtcagacacaactgaatgacttagcatgcatgcacacacaaggaagagaaccaaataggtttaatatgatcataagtatcttggaacaacactacctagacagcactgacatttcaccataacaaatttattctgttgctattaagaatagatagctttcgagtcatttcaactaagcaattgtattcaatgtctggaagataatttgtcactaagtagatggcatcaaattgtgatttctcattttccagagtaggcttacaaagacttatttacaaaagaaaaatattcattaaagaatttttatttcataagtaactatataatgcctatatcaaatattattcca

SEQ ID NO: 59759 - DNA, 2200 bp, Bovine  19866880587237
cctggctttctcctactttcctggacttgttttcaattggcaaagtcctgttgcttttcctaaatggaaaattcacttctctgttaacttttgccctccatttccagaccatgtcttatcttagaaaccccaagtgtccatgatagtattttactaaacaatgagctatgaatgtatgttcaataaatgtatcttgagcaccatctttataccaggtattatatgaggatgatgtagtaccaacaaaaagacaaatagttcccaccccttatagaatttcaacctaataagaaagaatgacattaaattaaattattttataagaaatacattagcttttcttcttcatattttttctgctatcaccagcttttttattttaggagaacagactgaactcagaccatgtatagacatggtgtatgtatatatgtgtttagtcacccagttgtatctgactctttgcaaccctatggactgtagcctgccaggctcctctgcccatggaattttcccagcaagaatactggattggttgccatttcctcctccagggaatcttcctgacccagagatcaaaccagtgtctcccgcatctcttgcattgcaggcagattctttactgctgaacgaccaaggaagcttcaaaaaagttagacatggtgtaggtgctcaataagtgtgcactgatttgtagaaaatattaaattctttagtcctcatcattctgcttacaaaagtattattttaaaaataaatagtctttaaggaaaatcatcctgtgtagttgactgtcaaaatcagtcaacatgtgtattgaaattaggtgtttatgaagaaagggcttttgatagcctttgatcccctggaaaaggtcatagctactcactctagtattcttgcctggaaaattccacggacaaaggagcctggtgggctacagtccatggagtcacaaagaatcagacactactgagcgactaacactttcatttttcactttcctaagagttaaagctcataaatttttgaggaaggggctcttataatctccattttacattttaggaatctgtagataggaactaatttgtccactatggagctaagattatagtctcttgtctccaaatcatcttttgactacactgcctcttgaaaatgattaaaacaaagcatcagaatatgtacaagcatctcagtttccactcataataactatttttttttcatttgaaaagcacagaggcaaattattgcattcatttaatttattgattcatcaacatttctttctttttcttcaccaacatttcttgagcaccttgtatatgccaaagaatgagtttccaaaactaagtgtccaaaatgcaatcttttccttcaaagcattatagttaattgaagttgacaaagatataacttaataaatacagagctatgagataagatatctttgaggtataatgggaaagatcactagattcctggagagtctggtttgaatcttgacatcactactaattagttcttatcctgggacaatcatttttcccctttgaccagcagtttcctcaactgtgaagttggggataaaagtatttatgtgtatttcagttgtaaatattagaggaaatgtgtgtaaagggtctagcacaattccacacaagtaataggtgctcaattagtgctactacaattacaacatgactgaaccagtgcaaattatacatatatatgtatatattttgtttttatgtctctatttgttctttatctctctttcttttcctctcatctggccaggaactccccaagatctagggacggatttcctgatgaggcagtagaaaggctaggggaactgtctgaaaggaggtaaagttttttagagtgtgaagacagattttttgggggttttgttttgttgtgggtttttttttttaacccctgaactgaacttttggatagaaggaattatgccagtgtatgaagctatcaaaaagcatagagcctttcaagaagcacaggatgcttactgtagccaaagtatgaagaatgggctttggaatactgagagctaggctggacacacagtcacgggtcagatcatagaggggcttgtatgtcatgctaagccacctggactttacttaccatacaagcaacttctcacctaaagagaaaaggacaagcctag

SEQ ID NO: 59760 - DNA, 1344 bp, Bovine  19866880606158
tttctgtaaaggggccctctctcagtgggagtggtatgtggtatccctcagcagagcagatttatttgttttcttaagcttttctttatgtcccagaggtggattctaaaagctcctaaagtattttgattttgaattctcacaaaagtattttttccttcacagtaattcaatataaaaggcaataaaagtgatatattcagaagtattcgggacctgctatcagtgccacacgggaataaactaccttgccacttgctcatcccacaggaggaaagactcacaattcacatacaggaaatactgcatgtgtttgcctccgttttgcttgtattgtctgctctgctgaaaggcagatttttttgcagataaaagccgccctgtcttgctgaactgctcatctgttttgctcaggaagaaaaggctttgttaaaatcaggagcaaagcctgatttgcaaaatatcacctaaaaataacaaatcacagaaaaatgtcaaaatatgctgactatggtccaacttcatgctttgggaaattatcgaacaaaatcagcaatactgttttttttaaagtgaacaggaatgatgtgttttctaagcaccatcctagtcattggtggttagatggttagagagcaaacaagggtgtggaggtggcctcgcccttctaactgactttttggtgtttactcgctaagtcatgtccaactcttggtgacctcatgaactgtagccctccaggctcctcggtccatggaatttcccacgcaagattattggagtgggttgtcattttctccagggtatcttcctgacccaaggatggaacccgagtctcctgcattggaaggtggattctttactctctcagccaccggggaagtcctgtagctgactaagaccaggagacatgtagttagagaagatgatctgtgccacactcaggcaggcctccaaagctgtttccagattcctcatgtgttttggaggtctgtttacacaaggctgctggcttggctgcttttgtgggtggtgaagcactggtgaacatgagaggtagagctttggtttttcaagagttcatagtcctgcaggaagagagatgttaagctagtcattccaacagtgaacagagacacttactgaataggaagttcaatgttagggatggtggttaaaccctttagcggttgtgaaagtttaatcgttggacctagttctgtaaaagaatacccacctaggcagggtcttgggcaccagagctgaaattttagtttaaatattaagatctagcacaagcttacctctcatccactgaatctgtttctaaatctggggaaatgg

SEQ ID NO: 59761 - DNA, 962 bp, Bovine  19866880625668
ggtggtgcattgggagaagttatgtaacccggtgtctctccttatcccttgctctttgcatttcctccctttgtaataaaccagtaagtgtgttttatctgagttctgtgagtcattcttgcaaattatcaaacctgagggcagggacatggaatacccaaatttgtaaccaaagtggacagaagtgtgggtggcctggggatccaggatttacaagtggtgttgaaagtgagataccacttcaggcagagtgggccagagttcttaaacctgtggagtctgatgctaactattctgcattattgtcagaataagattgaactgtggatgcccagttggtatcagaattggaaaataagtgacataaggtcacatttggtcctttcattattccatcttgatattttctaataatgcaatctaataaaaacatgaacagctaactttatgcagttcaaaatcaaaacatgaatttttttccatcatagtaaataaatcaagtatacactattacatgaaataataagacttcttgaaaagaatacaaacagatacacaaattgaacagatacataatactgaacaaatttatttttagaatgtatgtgcatgaaatcagattgtatacaacagaccaaaggttaaccagagaccaacagagtcatataaaaataatttaagggaaactgtattgactttttaaaaataaggcaagtgaaatgtgggctcagaattatgtgggttcaaaattaaaaacttctatgtaacttctggtcactgtttaaagggagaatatgaacatcaaatttttgactattactgtacaaaagagaaaccaaatgctttccaaattgcagtaaaattaattcttctaatataagaccattaagtctacaaagtcactgacaggttatttaaatcctagaatattttctcaatgtaaattttggaacattctgaat

SEQ ID NO: 59762 - DNA, 2505 bp, Bovine  19866880651630
actgaaggtcatttttctggagactacaatattcacttagatttatttgatattagggctattacaaaccatgacagggagaaatgtttgttacaacacaatttattttatatgagcatcctttatgccaagagtcataatacattttacagtgatacataagctaatggtccttgtacaatgctgatttttcgatgtttatttcacatgggataaaaaatcggttgttttattttctggcaggtaacagctgacttttcaacaactgtgttaaagaaaataatcccagaggttaagaaaagaccagaaagaccacagacctggaacatcatgatttaccctctcccagtgcctcatacggaactgaggaaatacagcattgtggtgaaaacaaaggaggagagaaaagaacaggaaacgatggtattcctcactaacagggaaaatctgtcaaccaaggaatatttgttcctaaaagaagtgaaaaacactcccttgtattttgccagtaagtgtgcagctcctcagctgctttcagggtaccgatgttctaacatttaaatgataaagtaagacaatttgaagttcaccatatcaaatataccaacagctccccaaggaacaagaaagaagaatcaatggctgtactgctgaatgctttaggcctgtggtaatattttcataaattaaatttataaccaactggtttgctttcttttgctctttcattgaagtcaaaacatcgtatctccccatcaagagagatgatactgacagtttcagacagattttttggctttctcttttcttttagccccagtccctcatcttagcatagaaactctgggaaattcttgcttccaagggaatagagggtatgcagggttcttctaaaaccacatagaagtgactcagctggtcaatggtaaagccttttattccccaaggacacaaattcaggagaaagtctcattgggttttagggcaaatgactcaatatctaaagtgcagaaaatccaatgcttcattggtattcacttgaggatttccaaaatctcctgctaatatgtagttcatttattcctcctccttctcctttaaattccatgctctttttttatcactcaaagggaagacatagatctaatcagatttattatttttttaatttataaaatgcctgcttgttaaaatatgtttgaatttttaagaaggtcagatatgatggcaaatgagatttttggcaaagttaatggcaaaaacaaagaggctttgaggagatagagtagtgaaagaatgcttctgaattagatgaggctagagtttgagccttagtcctgaaactagctgtgtaatcctggacaagtcacttctcctttttaactcccagattttcatctataaaatggagttaagagacaccttgtagagtgattgcaatgactaaatgcaatgataatataaagattctagtatgatgcctctcatatagaaagcctggcatacagcaggcaatgaatagatgacaacaggctttgtcattgctgctgccagaggtttaagttatcacccccatacttttgcattcttccttgagaacagatgacggacaataccgaacttggactcacaaagtaggggctagttgttaacaaggtggtcagttctctcattcttccataagactcttcctcccaagatacttactacaaagcctagtgagctggataattaacaaggaagtctatgaccacttcatgggtcatgatcaatatcacccacaatgacaaatatttattgagcttttcaagtatttgttagatagagataaagtactgtgtaggaaccagaggttgtggttttaaataacttttcatattgattaataagatagcttcctggaaacacatataaaaataaataactcttttgaaattgtttcaaatgtgtctgtcataaaattagctgaagcataagtcaggagagctggaaggtcttacagggaaatattagagtaaaagtggagctctgtcaaggcatacaatgccaaggaggtgatctagaaagatgtgatcagggtagagaaaccatagtgatacactgtaccccacgtctagcaaaagaggggcatcggaggaacaagaggagggggagtggttactggaatgcagagacagaaacaactgcgtggagacaaagcctgaaaggatctctgattttcgatattgcaatagagcctgcctgccatgaccttgcaaggagggagaataaatactccttcttcactgtccttcctccctctgatcttctgctagggcatccattggctaaacccaaccagatggcagagagcaagagagttcttgcaatccgtgtggaccagtctcccagggcagagagcaaggtgaaggtcatagagtgggcctgaagggcagatggaggacctgcagtctacccatagactcaggcaagataaaccaagtcttaaagtggaaaattcataaa

SEQ ID NO: 59763 - DNA, 1341 bp, Bovine  19866880690598
cacagagaactgggttgagctccctgtgtcacacagcaaattcccacttggaacaggttgagttttgatgtactacttaaccaaacacattaataataatgttcatttttatatattataatagagcctttatatttaaacaaattcagacatgttcaggcagtctgggtagagctccctgaaggattgatatgtgtgagcagaacaggaagtccattcactttcctttgtcccatcagcttaggagagggcccaaggggtcaggacctatgtgtctcctgaaatcaacaatgtaaagaaaatctggcttggctggtacaactagccttctccaagtctttttttttttttaataattttatttatctatttatttttggctgtgctgggtcttcactgttgtgcgggctttcttctagttgctgtgagtggggactatatgtagttgccgtgaacgagcttctcattgcagtgacttctcttgttgcggagcacatcttggtctctcaggcttcagtagttacaacccctaggctttagagcatagtttcaatagttgtggcccgtggacttagttggtctgaggcatgtgggattatcctccatcagggattaaccatgtctcctggattggcaggcagatttttttaccactgagccatcagggaagcctacttctccatggcttgccctttttgatcttcttaagtttgggtttgaaatgttaaccctacacatcttgtcatgactttaaatagattattttcctttgcaacaaggtccgttttctctatgatttctatgtttctttgacgccgctgagatgggaggagtcaggaaatataatacaggcattcacttttgtgttttcactgcatttcttttgtatgtttcttccaaggtgaacccgagtgtgatcacagttagctaataaataaaaaggtgtcattctttcttcagatgatgaggtttgaatttcttagaaaatcacgtgttgagcctaacttacagacttcatgtgaccatgcaaaagggaacctttatgaatatgttattaggaatgtgatctctttgtcattcatcctttttgtgcccttgcttgttggaagatgagaattttgtaattggtttaaaccaatggaaatgtcagagaactgagttagatatgcatagggtattgaaaggacagaaatttatgccttaaggtattaccattattagatttataattttaatttttcctcccatctttgataaggtgaattgttgacaggtctctgagaccagaaggaaattagaaggtaaatgtgtgtaggtaacactaaggatcagagagagaaa

SEQ ID NO: 59764 - DNA, 770 bp, Bovine  19866880700118
agttttatttgacacatactatgccaataaacttcagaatgttgctgagtcccatggaaatggggtctgtgagatacaagtagtcttctgctttcattaggtagtcctctgcaccctattgaatcttggggtcttgcaaatctttattagccaatgtatatccaaagggagagaaaagctacttctactatcactgaaatattacagaagttcaatagtagtagaataatactgccctgatgtggaataaaagaagactcttgtctcaagacaaaaaggagtctgggcccatcccaggcaaaagtgtgaattaagtgaaaaatctctaacactaaaacctcatctttcctttaatggtcactttctctctttcagtgacccgaataagcagatgttcattgccctgaggctttccctggctctgtgaatcttcccagggctgaggttatcaacatagcaaaaccctccttagactgtgctgcttgctccataccttcccaacccattctttagaaacattattgaacaactgactctgtactggggtaaatatgtgggggtatatcattatgctttcctttccaaggcacatttatagttcaaggaggacttctttgccttattccaaaggagagataataatgggggtttcacattcaagacatgaagattagctaaactagtgaaaaggggagactggagacaatttggttgaggaggcttggatcagatgacaacactcagatcatgttgtaaaggcaatcagctat

SEQ ID NO: 59765 - DNA, 874 bp, Bovine  19866880708429
tatccctataaaattttatgctgttaaatttgtctattatgttgtaatctctgtggttctatactataatccaacagacttgttacattcccacatctgtatcacatgccaatatgatttgcatggtggattctttactgactgagccaccagggaagccattacttgcatggcagcaacagtcttttccaaggcatcattaagactgttgaagagcaaagaccaatgacaaatccttgtggttatgtccctagaaacctctgtccacatgacattgatccattaaaccacactctttggcattgtgcaccaataagttacgagcccatgactaactgactcaaaaattaactgacaattcttgcctggaaaatcccacggatggtggaacctggtaggctacagtccatggggtcgcaaagagtcggacacgactgagcaacttcacttcatttcaagtaaattatattgaaattgtcatagaaaaacaaggaaagcctaagaaactgtgatagaccagaagaaactaaggaaacatgacaaatcaatgcagcaaagtaccttgaataggatcctggacagaagaagaacattagtgggaaaactggtgaaaaccaaataaagcctgagttttatcaacattcatttcttagttttgataaatgtacaacggttctaaaacatgttaacattaggagatgagtgaagggtatgtgaggactttctatactatcttacaactctcctacccatctaaaattatttcaaaattaaaagtttttaaagtttcacaaaaaagtttttggaaacggcaataaatgcttaaaatgtcacttcccagttttactacattttactattaactataaaagtg

SEQ ID NO: 59766 - DNA, 792 bp, Bovine  19866880756748
cataataacaagcatccagttggaacatagaaatctaggcaatgtagcccatttcactgctcctgtgcacaggaaaccatgagctggtttaggattatttattcaaaggattcaggggatctatgagagacccccaaaggcatgaatgagctggatcttgagaatttactggaacttgggactgagatgctccagagaagtctaggaattctttctctctgttgcttgtctttgctcctcatccttcatccttctgtgtctgtagatctgatttctcaatttcagtattcacacagcagaaaatggccacatccaaagataggctggaaatctggtagaaccaactgcaaagtcccagaggcaggggctggttagcatagcttagtattgaaattcaattttggcccaatcagtcactactaaaaagtggtatatacaaaaatgatttctcctataaagcaatggcaacccactccagtactcttgcctggaaaatcccatggacagtggagactggtaggctgcagttcatggggtcgctaagagttggacacggctgagcaacttcactttcacttttcactttcatgcactggagaaggaaatggcaacccactccagtgttctggcctggagaatcccaggaacgggggagcctggtgggctgccgtctctggggtcgcatagagtcagacacaactgacacaacttagcatagtcaccacacagagttgggtaggtggaactaccaggagatgggaccctccactaagtttggagatattcactaga

SEQ ID NO: 59767 - DNA, 1288 bp, Bovine  19866880763809
ttgaaatgcccaagaggctgacaagcttattgcccatttcagagattaaatagtttcagaaaaattttctcccctggtggttgtaattgtgtctgtgaaataagtgttcattccgcttgagcaacgtggtttgaatgcttccttgtctatgttcccccagtagattgattcttaaaagatctgcccagatttccctgtaccagtgcaaattaacccatgaacttgataccatctcctttgccttgtcccatgctaatgggtaatcagaggcaccatcaagtgcctttatcatgcattatctttgtaactgtttgaagggagggaaaggagttgaaaaaccttccaggttaataatgtggtaataggaaatgaacaaaagctaccatcagtaaccttgagagtcctaagctgccctgctggcatagcactcatgagtaggtaaagtggtcatttagttattggaacttccaaggcatctgggagggcttcaattgctccagataaaatagggtgaggataacatctccagaagagggaacaagcagaaaaacacaggctcatcacagacacatcatctattccctgactttgcccaaggtcaacatcgcatattagtttgctaactgctggcaaggatctgacctttggggtgatttacagcatttttgtttctagtctgggtagataaaaatgactatgtgttaacacaaaccacagcatattcactttacacaggcagtcattatctagaattcctggatttatcattttaaagaagtctcaatatcatacctcagaattgaatgtgaaaacatctaagaactctggagacagttaataatctttatttctgagcattcagtaaattcctgtcactgggctgagcctatgagtgaactatcttatgtaatcccatagtaattttaccatgtgggtattaccctgtggaaactgatactccaagagattgagcaacctgcctgggatcatacagttaagttattagcttaatcaatttgaagccaggtcaggatgagctcatgctggaaaatgattgtttactaaccaagattatatgctcacctgcattcagtctgatttttatgccattctattaaggggattgccttctcaataattttaaaagtattgcttatggctccaaatcctcttagccctattaccttgttcagtacctttctctctccacttttttgggttgtcagtggtgatcagcctccataactgaggagaagtaccgtagtcacagtatacaagcgaaaaagca

SEQ ID NO: 59768 - DNA, 939 bp, Bovine  19866880808415
cccttggtgggtgcattgttcattctccaaatgcaggacgactgatctatctcattccccaccttctggccgaccatctgacccgagtttgacacaatggcacaaagattccagtccagttgccaaaggctgaaaaccagaaagagaaaccagggcaggtaggggagaaatgtgtaaattaggaagttcctcatattcccaacaagtttttctgggaaaacaaattccagatattgtgcataattgctaagtgtgggaatatagctgaaatatatttatactaatccaaaactagctccataggatatcaagcttggggcatgcctccatttaaaaagtgaatgtggattgctaagaaataactttcatttctctttcttgtgttgctttgaaattcaatgaaaaagcagtcatttgtttcccaccttttatgatgtcttttcattcaaaactgttatttcaaatgaaataaggaaatacagaaagatttgctctctttaataagggtgatggctaaaaaaaagaaatgcaaaaggagtatatataggcatcaatttgaagtttacttatatgtatgaatgattatgtagcagttgacaaaaatataaaaaactcagcaaatgatgagattctgaattttcaaaacccagaactactgaagataaatttcagggtagcaaaaatattatagagaatcttaaaaaattcccttgcatcaccatggttaaacaaccgttgtgctcttgtttattctagttggataggaaaggcttctttttaagaactcaaggaaggcacatacaaagacagtctccaccatccttttctttttttattggagtttaattgctttacaatgctgtgctaatttctgctgtacaatgaagtgaatcagctatacctatacatatatccccttgctactggacttccctcctg

SEQ ID NO: 59769 - DNA, 1697 bp, Bovine  19866880942115
tccaaagaggctccttagggcattggtaaatttttaaaaatataaggagtacagccacctgctattattgtttttattaaatagatgtgaaaatgtaggttgagagggagctaaacacaaaaatgactaggttttgggagctctgactcagacccacatctgtggtgcctgcagagcctgtacttttattcactaccccattctgcctcctggtggcttgctctgagggtgaggaaagaactttctgacctacctttctccaggtattttccttgcttcccttgctcccaaatccctctgtactggcctgggacctgttactgcttttctctggtaggatctgagatcccacctccttggcatcattgttagccaggaagtgctccaggacaaattttggctgctgggttggaggaatggatatttgcattttaaaattatgctgaggaattgcccaaagttagcaatttgaaactgtgtgctttgtgttgaaactgaaagtgttagtctctcagtcgtgtctgactctgcaaccccatagactgtagcctgtcagtctcctctgtccatgggattctccaggcaagactactggagtgagttgccattcctttctccaggggatgtttccgatcagaccccggtctcttgcgctgcaggcagattctttactgtctgagctgccagtgctttgtggacccacgcaaatcataacagaaagcagatgcttgtctctgaccgacgccttgtcagccacatgccttcatctgaccctcttgactagaatctcctgctgctgttttataaactaggctctacacctgagtttctctgtgtagcaattccaagaacattcaatcttcaaacacatttcatcgttaacagaggcagccatgagaaacactttgtagtcgctgtgaaaggttgttgctttggaaaaattgaatagacagtctcagctttttaaccagggtttctaggatcagtttatcaggaataagatttctttttcttcttcccagagggcccatggatgatgaggaatttaagcaataatagcaaatctatcaaatttacctttaaacgcttctttcacaagagcaccccagagggccctacttagataatcagataccagtagcctaccctttcctccatccaatacaggcccacctctggtcagaaccaggaagaaggggcttcagcttctccagagatcccagtgtttaaacctgagggattggagccccaatgtgggtaccttttgtagggggcgccaagaggcagtccctcagctgatggtctctggctctcaaaggcaaaacaagaactgttcagagccgtcgttcaaaagagaaaaatggctacttcccatgtatttagtacccaaactcacacatgtgagtaaacaccttacctatctgagaagtctatcaaagccaggattattttcttagaacaataagtaaataagtgtcccttacttgatagaataatagtctcttggatgcctcagttccccatctttaaaatggggatcataagaacacccacctatattagttttcaagggctgctataacaaataccacaagcaggggcttaaacaacaggaatttattgagtcacaatgctggagactagaaatcttagatcaaggtgttggtaaggtggttccttctgaggtattttgatgt

SEQ ID NO: 59770 - DNA, 1477 bp, Bovine  19866880971707
acctggggtctgaactcagtccaaccaaggaagacagtctgatttgcttctgtgttcttgctgcttctcagaaaaaatgtgcccccacatgcctcacagacagagatcagtggagtttattccaaataaaactgtcacttttctgtcatatttacagcacacagaggttgagattaaaggtaacgcatcagagtataagtaacataagttcctgtaggcacagatttcaagaacacaagtggaaagacaaaacaaacatgtttttacccgagttcatggcacctaaaaataaagcttcttgaacaagaaaagaacacacactagcaggagacatcactctggagggtgaagactggctccacttgccatacacaaaaatcagatttttgagcttcacgccttcatacaccagtgagcaaagtatacgttttcctcctccctgtgggagagcctgggtcactaggtatctttccaacctcatctcctaggactcctaaaacaattctccctccctggctctggccatgcctgtttctcacatttccagaggctctgcacaagcaatgccattctctccagtcatccaagtccaacctgcttttgagggtctacctcaaatccagtctccttcccatctaaaacaagcccacatcctgttgcctccttggagattcctgcccacccagcaagatctgatttgtcgcttgtttgagcttcctggcatataatgagtacactgctcatctgaagctctttgctgtaagggttgacttggttctgcatgtcattctctctgagaccatcgttaactggcagaaaggcctggctagcactgacacttctaggtacttgccacagagcccagcaaatagtgactgatgggttggcatgtttggggaactggggtctgatatggtttgttgcttacaatgtgcgtaccaaaacacctatttagaggagtatggaaagacattgttttggtcactccgaaagcagacactggaccacaggacttcaaaaaacatttacactggatgggaattccctgatgatccagtgatcagggctctgcacttctactgcaggggacataggttcaatccctagtcagggaactaagagtcttcatgacacgcagagtagtcaaaaacaaacaaataaacaaaaatcattaacactggatataaggttgaggaggataaaataatcaccacttcactttcagcttccacagtgattttatctcctttaacccaaaacttttagacaatagtcacagagttggcccacaaactaaaaaggtagcagatgaaaatcctagtgagcagaagggcttgccctctcagtcaaataatgctacctctgagaaaggcagtggagtgtaaccaataagagcgctagttcccaaggcagtctgattgttactcccagctcttctgcccacaagctgtgcagccttagaaaacttgtggaacaa

SEQ ID NO: 59771 - DNA, 968 bp, Bovine  19866880975872
taagtatataaaatgctaaaggtaaccaatgctattggggaaagaaaggaaaagtaaaccaaagtaaagcgaactgggaatgctgcttatgaggggcagggatttcaattttaaatagcatcatggtagactcactgagtgggtgacaggagcaaaagcttgaaggagttgattatgcaatatatgaagagaaaggtgatccagcaaagagctgagatgtaggcctgcgggagggagcttgcccagtgtgtttggttcatagaagtcagagaagaaacaagaggtcagatcaccctggaaggcattataagtcattgtaaaaacttgtacttttactctaagagaaacaggggactaagcagaagagtgacatgatctgaactctgccaaagcacttattagttttcctctatgtagaatttcatcaaccatctatgaagcaggttaaaagacactgctactatttttttttcttttatgttcttcctgaagttatttcaaagtatttccactaagtcaattcactttctttgttgtcagtgaagaaaatgttatctagaaaatgattagaagataaattgggcagtaatcagttctccgttccttgggttttttcttttctgccttttgtggtggtggttgtgtttgctgcctacggtccaagagtacaaccttgggtcctaggaactgttttttcactgggcaactgacatctaacaactgtgagcgaagtcttggaaactgctttgtcactgaagtgaaactaaaatggaaacctgtatttgaagaatggctctgtcactgacttattaaaaaaccagtgcccggctacaaaatctctggaaaaggtaatagtcttgccaacctttgggtaagacagagcaaggggtggtctgcctgagtagaaccgtggaaacttttctatcaaaagccaattctataacttgcctcacttggtattactgtga

SEQ ID NO: 59772 - DNA, 1966 bp, Bovine  19866881084559
aaaacagagtctcaaatagaataaagtgccttgatagcatgtgactgagttggaatttgaacaagaagttgatctgaatccaaatctttgtaccacaccatgcatataacattaataatggtgataacagctaccatttacttcattctcaattctgtgcccattatttcacttcattcttacaagaatccttagcaatagtacaaaggaccagcccctgccactgcacatggtgccatcaactcaatcttctgtccctggtggcatcagtgaaggacaggccgatcaaagatcacagtcctcacccttgttcgaaatgattatgaatttagctcccacaatagcacactgggtattcatttgctaaaaaatagtaagtgctgaaagaatcatacaaaaaatgtaattcacctacccaaactggaaaggactccgtagttctaaaatgcagagacatttgcaagcagcagtctccagtatttctttattagcaacatatttttaagaacatagtcttcgtttactcacaccaaaaacttaaacgatgaaataaatatagaaaggacttctggtattgttcccaaatttctactttggcgttttgactcagaacataacaagtggtagaggggagaaaagaggagacagaggcaagaaaaggaaagagaaagagaaatgggtgggagagaagggatggtaaaaatgacagatgacaggagaatgggcagaagtgaaggggtgaggagaggcaagagaggaaaggaaacagaaaaaaaagatgatttctgaccatctgttttcgtaaaagcttttatggtaggaaagcatttagaactcttctggccaaataacgtatatccaccatgtttctgaaatcacatctatgtttggaaactttcaacctaattcttcctatttcatttttggattctgaggcgacacaggtgaggagacccaggtgaggcacctgagtgcctggtacaggatggctggtacaggaatcacagttgtgctcttgctctaaaaagcagggagactgactgaggctgtggcccccacgggccccacttctgccttggacagctggcagacattaccccaggcaccacagctgaaaccagcactttcatatgccgcactcacttgataatggccactacctgtctctaacaagccatcaagatcactagtcatctcttccccacaaaggctcctcctgtatctcctgtaacaacatcccaccaaagctcccaaggcctgctgaagagagtaggttgattggtaacaactgtgtcttccagcggacgatttcacccatgaggatcacagatggccagatgactcgaggtaattttctcaccaaagaacattgggctcaggcatgcaggccatattcagcagagaatccttcccagtcaaatccacagaggagatttttcacagctgtaagcttttacttgagttgttatcagagtcttccatcactgactgtttaagaaaatattaaaagactgcacacagacttccgcattactattttcagttccccagactggctgtgcacattgacaagcagtctaagggaagcatgccagtgatgcctgctatctgcttcctcaggtatgtaaaaactcttccctaggggccagttggtctcctcagccagcaacagtgacaagaggaaaggaactgagtgctatcaaacctctgctgactttggggagggggtgggaatgtcacataattgggctatagaatgaattattcattccagtcattgtattcagcgcttagaaaattctgaacatactttttgcctgagggaaaagcacaatatgatgagtaaaaccattttggagtgaaattcacttacttttaaatcctggctttgccataaacacattaacttcaagcaagttacttggcttctctaaaccttggattcctcgtcattgaaacaggaata

SEQ ID NO: 59773 - DNA, 1161 bp, Bovine  19866881095930
gcagaggaaaatccatggaagcaagtccctttctatgatttcaacacagtggttcttccataattgcaagaatgattccagtacttaaaaaaaaaaaaaattagcttgaaaatacagataatacctctgacttaaaatttaaaaaaaaataaaataaaacttttccctgaaaaataggaatttgtgccatttaaaacaatttttttctccaaacttttcttgcaacactgttgataaagctaaaaactggaaatgacctaaatatccaaaaatcaagttttagcatatggttagtatagagttttaggcaatattaataatcatagtgtagttttaaacattttgacatggcaagatgttcataataaacttgaaagttcaaacagatttaaaaaaaagattaaatatggtataatctcattttatattgtctatgtatatatcattatgaaattatatacttacgttatataaaatataaatacaatatgaatatgtatttgtgtccattaacctcttactgtctccctctaaccctgaaatccatacaagacaggacaaaaagaaggaaaggaacatataaagacggaactccttcagcaagcagaaagagagaaaaaaatgagaaatacacgtaatgtgattcttatcttctcacacaaggtggttatatattgtttctaatcacttcagatgatttgagcacatgaattttggaatcaaaaaggtttcgaggcattctaccttttccatttccacttcccatgcatcctaccctctacattaaccttttccttccttttccattactgctgaagatatttctgcttctctcgtgtcatcaattcagcgaacacaagtagaaatgctgtcaaggcacctggcacctgctgtgtgctcagtgtacagtctcttcctccctcttctgactgtcaattgtgcctaaaaacatgttaatgatcttcaagaataatgaatgtaggccattttctttgaaagctcctaaatcggcagttaattgtgtggcagagtgaggtttggggccttcccaaggaccaaacatttgaaaatgagaacaagatgctgaataaacccaaaccacagccagtttgtagtcattatcctctggaccggctccccagttcggtaaacagaagggtg

SEQ ID NO: 59774 - DNA, 1311 bp, Bovine  19866881104505
ctgactgtggagcacaggcacataattctttatactatagaatcttaacataatactgactccccttagaggagatgcagtatgctttagtttttcgctttttttccccccacaaatactgcacagcctggcaaatgggaagtcatgacattgcctgctaggtgaggccttaggcctcaggggtctcagcctcctccctatgcgtgaacacaacacacacacacaccacagacatcctgcttaagacacaaaggcaccctttgggaaggtttaagaattcataaaagaaaaacatctcttgtcatttcattgtgatataaaaagctaaggttagagtttcttattttcatttgaggttatttaaagggagaatctgtgaatatgataattttagttgagtgtgtatgttgtgtttcttacttttatttaagcagtgtagccttccaagaggtgtaactaaaataaggtacaatcccacaggatacgacgctgcttgttttctctcatgtgtgtgtcctctccctctcctttctttctgccttctgcttgatgtttctgcttttgcaactaaacacaggaaaaaggagttagaaaacaccctttaggctggaacaaaagggaaggagagctagttgcctctttttgttgaaacccctagggattctggtcctgactcagccctcagctccagcctgtgagcctagctgctatgggagcagttttaaagggaagctatgttgtcatatcaaaattaactataaacttgacttacattcctcaagaatacagttctttacctagacggattgctgtccacaacccagacatagagtttcataatcattttattttcctttctcctttgctcccgtccaatcatcgggtcatactgaacctggccgccgactgttctcccacattttcccctacttctctttctgtacttggccgctcatcacctgaccctggattatgtctgagggcttttaatttgacctcctgtcttgagatctttcccttcatgttcctttgcagcataacaaagctttcaaaatctggaggcttaaagtggaaaccaccatttagctgctcatgtttctgtaaggtgggcagagctcagcggcaatggcttgtttttgctccacatgtgttggttcaggaacttgattaaggctgcaggaatcaagctggcaatactaacacgtctggcaacactgttggggtcgttgagctagctggggctacacgggcctatctcttctcatgctttttcatcccccaaggcctctatctacctgcctctccctccag

SEQ ID NO: 59775 - DNA, 1383 bp, Bovine  19866881116749
atcttgtggattctcctgactccgatcaaaccttgttaaatttagtcattttttttgtttccaaggtgaaaatcacctggacaaagtgcatagggccaaactcctagaaatcttctcaatagcaatggcccagaatagtcagttctcttggattctttccttcttcttcttcttctttttttttttttttttgtaaaaattagctcttttcctttccttctgttgcctattgaaacaactgactcttggtagcaggaatgaaccaacagatcttctggatgttttaagcaaaagccttgaatgtttgctactaggattacaacaaagcaaagagattattttgcaaagctcaaataaagttgaaattaacattgctggacattttcatttattctgtccatcttgaagctttccttgaatctcccagtggtaattaatcattttctccttagtacttctctctcatacaacttatcagaatctctcatcaaagatctatgtaattacaatttataatataggctttgggccatattttgtttatctccatatgctactacctgctttagagccaaatacatagcacatgttgagttaatacatagctataaggaaatgggacatttagacctcacttatccaacaaatatttattgagaatttactcaatactaagtattgttctaggcattgaatatatcatgataagtaagataagatagtcaaagtttctgccttcctggaggtttcactctagtgggagagatgacagtatgcagagaatatataatataatgtcaagcagtgaagtgttaacaaagaaatacagaatgacatgacatggtaataaagaggatggagtgggagggggtggggcacaatttttaagagaacttggaggagatgacagatatttgaagtaataacactccaagcagagtgagcaacatgggcaaagactctgcaacaagaacaaatcaggcttagcccaggaactgcaaggccaatgtgacaagcaagaaatggttggagcaaaggttggaattggcaagaccagatcacatggggtcttgcaggcctgcaaaagcttatattctgtgtgatgagaagccagtgaaaagttgggcaagagggagatatgatcagatgtgcattttaaaaagatcgtcctgggtgtgatatccaggatggattacatgtggtacaagtgaatgcaatgaaatagacttggagaaaatatctccagtagatgtagattagagtataggtgatgagggtactaagctgtggttagattcctcctacagtttgcaattcaggctatcaggatttattttgacatattaaaactctcccatgagtaggctcaggaaactcaaacag

SEQ ID NO: 59776 - DNA, 1073 bp, Bovine  19866881171828
tgcaataaaataaacagtggtttcaatcaagagggttcttaacggaccagtaagagttatcagtcttactaaaccttgagtacacttccttttaatattctatatgatgaaatgggggaaataccaaaagtacttccatataggtaaatataattgttacaaggaaaagcatgtgtccggctatttgggtcaagagctcagctggttccttttttccttaaacacaagttttatttgaaaggaaaactaacaaagtatgattatttagacttggtcatttggcaaacccttttctgaaaaatgaaggaagtgatcctaccacttcaagaaaagcaactaacagtacttgatgcctgtgataaaagtttagtttttcaaatgaaaattaagactttataaaacttatatctgccaacatgagcttgacagctttccagtacttaaaaaatttttctgatgagatatttgaagtgatattaaggaatgtaatatttggctactgtgtaataaaatgtgtcgttatttgaaagatcttcattaactcagtgaaccaatactttcatatgaccaatgcaagatgtgacaaaatcatgaatgggtaaaagtttcactcagagtacaagctagacagtgaattttaatgtaacagaatatgaaaagtctgttgattccctttcagatttcacactgcaactaatttttaagaaatttggggttttggtatggtaccaaagcaaaatgtccttaattatcagaaaagggtattcaaatattcttcccttttccaatatccacgtaaaattgcattttcttcatatacttcaaccagcacaacatgttgcaacaagctgaatgcagaagatatgagaatccagctgtcttctattaaggcagattagagagatttgcaaaaagaaaagttttaatgctaacattctcactaatttttttggaaaatataatcacttcttatctgtgtgcatgctcagtcactcagtcatgcccagctctttgtgaccctatggactgtagcctgccaggctcctctatccagggattttcccaccaagaat

SEQ ID NO: 59777 - DNA, 1615 bp, Bovine  19866881219611
tctgactttttgcaatcccatggactgcagcccaccaggctcctctgtccttgggattccccaggcaagaatactgtggtaggttgccatgccatactccacatcttcccaacccagggattgaactcacatttcttgcgtctcttgcatctctgtctcttgcattgacaggcaaattctttaccactgtatgacctaggaagccctgcacacatatatgtaattataataccaattattttttggtaaaaagtaacaaaattatttctcctctagccttaagactcaatgttgatctgttgaaagtaaatgttgacatttatacttcttcctctttggaaccatgcaaaatactcaaccaaataaaagcactcactcttttttcattattgactatggtgactatgccaggatgatgtgtttcataatcaataaattagtattcttcagtatccttgtaacaaatgttaagatgaattggtatggtatatatgtcagggtccagaaaagaaaacaaaaaacacaggaggaatttttaacatgaaattacttcagggaattggttttccagatggtagaagactgaatgggccgacagggtcaccgcggtaaccctgatatacaacagcaggagcagctgctatccaggaaagaggttggaattaccagagctcagaagctcagagagagccccacagagatagggctcagatccccgaggaggggatgaccccactactgctaacattctgagaacatgcccaagggctggtttcgagagcgccaagtgagactgcagaccagaactaactgctgttgtcagacaaaggccattgctggagtgatactgagacgaacaacaggaaaacagggaggagaaaggcccttcctccatccttgcagtctctctgctgtccctatttgcagaccctaacccaggtggtgctagtagtaaagaatctgcctgccaacgcagggggcataagagacagagttggatccctgggttgggacgatcccctggaggagggcatggcaatctactccaatgttcttgcctgaagaatctcatggacaaaggagcctggcggactacagtccatggggtcgcaaagagtcggacacaactgaagcgacttagcctgcacgcaacaggaagccagctggcaaaggagaaatgtatagaatcccagcccgccccacagagtaatgtgtgaaagaaggcatttgcagctgagaggtgacacctgcccaaccatctcagcacatggctgagtcagccttgagtttgtcacctagatgaaagaggctgcctctcccaccagaaggtgggcactgtgctttgctttttccccattcttgcatcctaatgcctgaaacagagtctagcacttagtaggtactcaataaacatttgtgaaagaagaaatttaaacagatctctctaattgcaaagcccatgacattaactcttcttactatcactacaacatcatccactgtctttaaggaagaataattcaaagagaatatctttcccactttataaaattgcctacaaggggttttagcagcctattttattgtctctaatgctgctagagtgaatcagaaa

SEQ ID NO: 59778 - DNA, 1674 bp, Bovine  19866881235445
tctgcttttttttgctcagtgccacttactcattcccgctcccttctttctataaaatctcttgccttttatagctctttgaagctcctttctgtctgctagttggaatgctgcctgattcatgaatcactgaataaagccagtaagatcttaaaatttactcagttgaattttgcttttttaacagcactatgctattttttttaaagcacatgagatgtttttaagattgttgtaatataaattctggaaaagtttctagaacaagtcacaaaaggatgatttctgagtactcataaaagaaagtttgacaattagaagccatcaagggttcacaagtgaaattatgacagattcctttcatttttctctgtgattggcataacaatataaacttcatgaaagatgaaatttttaaatctatttttcattgctgagttctcatattttcattgcttatagcgcagaaggtattcagtaaatatctgttgaaccactattagaggaataaggtggatgcagttagtttaatttatcaagacaaagggaacagttcttttgctgtctatgaagcagtcattgctgggtaataagacagttgggtgagttgctaactagttaaataaccgcgagaagcagctaatgaaaagagctttcaacttgcagttggatttagagttagcttcaattcttggctctttcacttaatctgtgtgatccttggcagtcatttcacttctctgaatcactggtttctcatcttcagattgtgcataataatttcgacattatgaggtggttgtgggtgtcagatatggtgatttaaaaggctagtgtgaacacagtatgaaaggaggtctcaagtggaattttaaagggtgagtcttcacttcaatccagctaatgttcgtatctctcatatccatagggatatattgattggatttgtggatgacctaagctgaactaaaaatcagaattcagagagacttcaatagactgaaaaagatagtttaatcctttaaggtgaaatcaggagaaatatgatttacacttgatttaaagaaatgttgcagtggtcgtggacagagtttgtggcttacagtgtcatgccacatgtgctgtggctgtcagaagttagttttagaaatagcataagacaccggggttgcacactggaactcctgggaagttaagcatgctgatgactgagccattggcacggtttctcatttaattggtgtgggactcagtgttagcactgagatttttaacttcccttccattacccccggtgcttctaatgtgcagctaagtttgggaaccacagatctaagatgagggagtctctccatatgttcactccatgtttacagtctttaaatattacttgcatggaaaaatgcctgctgcaggaagttcagaatgtcctacttaggcttgcagtgtctttagggaagatgtcaggacaatgggtggactggcagttctaacattctgaggggaagttgaaggaaacaaagccctttgtgtggagaagagttggaagaggtaacagtcttggacattgcttgcttgtcctgtcataggaagctaagcttagttcctctctctggcatttcagagggtagaaagagatcttccgaatggaagcctcaggaaaggactaggaaa

SEQ ID NO: 59779 - DNA, 1402 bp, Bovine  19866881252885
aatccctcctctgtcattttcctgctgtataattctgaccagttactgaacaaatctgagttttggctttccaatcaaaaaagtaagttaaaaatatcaacttcataagctattataaaactaggtaggatgttacttttcaagcacttagagctgacactggataaacaatggttagcatcagtaccaggatgtgtatgagaatagccatttttaagacctatatatttcagcagaccttgggggaaatatctcatcaaagggttagtgacaaagattacgattccaagtcatcctaaccatgggattgtaaagaaagacataacttcccaaatatttcaaactttcctaaacaacaacaatgttcctgaaataggcatgcacaaaagatgtcatataattcaggggtcacaggccttcccacctctgatgcttactcaactgtgaaagctatttagtaccaagcatcttctggggcttgctcatctaaaaggagtatttcacacaaacacacacacacaaacacacacacacatacacacactttagtagacagtcctcttggggatattttttcctgtgaaaatcaagtagaatagaattagcttaaagatctctacagagaatcagagaagacaccactcaaaattgattctacatcctattgtatagcacatggaaacaaacacaagtgtagtacctatgaacaaaaaataaaataaaacagtctatcaaagatgactagatgatacattacagactgcaactttaccactaatttcaaaaccctcacacattaaccagtcctataaatgaatgaatgtatttgttaggcacatatcaaggaacgaagagtctactgacaacaaagctattttggagaaagtctgcctcccaacagaagtaaatgcatttaaaatagctgttgaccaggctcctgccttttagtaaaccctctgaattttgtttctagaagtgcatctataaatggcctatagctgtctcgttttattagctctttacaatgcacgatataaatttctcaaataaagcacctgtaatgaaattccgctgtgagcctgtttgtggtaggcagcactgcttcccagacctgtacagcggattccagaagactacagacaagccaccgccaaaggcccgaccccacaagagcccactccgcacacagggctccaatggaaccagagcagaaaactcccggggtgtgcaaccaagtcacagattcagggctacaactctacaatgggtgtagagcctttcaagagcactgctggtgggggcccctttgccacaacacaattagggacatgtgtgacacctggaaccaattcagatgtgcccaggtacacaggtagagtcccatggacagaaatctacacca

SEQ ID NO: 59780 - DNA, 1561 bp, Bovine  19866881287749
ggggagttgaatggtgaataaatattctccttctgatgagaataatttctcgacccgagttctcccactgtcccacagaggaaatctaagtaacaattttgacccattcttaagactgcactgcaagcttcaaaagacgaccaaggccaggaaaattccattaatggttgtctgtctcctctgagtgacaatcagatagtcccaagtcaaacaccttgggctttgtttcttaaacaaaaggataagttaaactattttttaattaatctcaaaatagattcttggctggatgttaggaagactgttctcaaaaaaataaagtgttatttgtagtctttttggaaaactagttaggttttatgtgtagtatggataaccacagatggcagtaaagtgtataatgtatgcaaaggggaatggttccaggttgatatttttttcccctgaaaaactttctaatattcccacatcaataatggaccattattcagaaattgaaggtgctaagtccaaacaccacaggacttgtagttatgctttgaatgtgttcttgcaattatccagctgcaagttaaatgcagtgtagactatggcttcccaagctgaattctgactgttatttctagccagctgacctgtgctcttgtttttgactgcaacatgagtttgatccacaaaaatatcctggatgaatgagatgacattgccaccaaactctgagttctaactctcaagctggaagtctaacctctaatttactttagtcccagaatgattagacctattatttaatgaagcctctcttggttgcctgtctatcaaattatttgtattcatggagacaaagtgataagccaaaatgctaattatccatttttctaaaataaaatatccatgctaagaataacaatcagttattaacatagcactttcatctgacataatatatcttaacaagttctttatatccagggattttcattactggacatcttatctaataaaaaggaagatgcttactttctatctcttcaggctttgttagcattgggcataagcttttgaatttgaaatactgttggaaataatgagataaattggggaaatctagtctttaaaaacagatttttttcctttttatttttttgttgaaggataattgctttgtacaattttgttttctgtcaaacctcaacatgaataagccattggtatccaaccagtccattctgaaggagatcagccctgggatttctttggaaagaatgatgctgaagctgaaactccaatactttggccacctcatgtgaagagttgattcattggcaaagactctgatgctgggagggattggggtcaggaggagaaggggacaacagaggatgagatggctggatggcatcactgactcgatggacgtgagtctgagtgaactccgggagttggtgatggacagggaggcctggcgtgctgtgattcaagggggcacaaagagtcggacacgattgagtgactgaactgaactgaactgatacatatatccccatccttttgaaccttc

SEQ ID NO: 59781 - DNA, 643 bp, Bovine  19866881325412
ctctgattttgatgacaaactgtcaaatggaatgcattttgatccctccaagggaattgttttgtaggaaggccatgctaggtttccatagccattgcatccttcagctgggaaggtaacctttagtgagagctgtggcctcttaatcttttagtggtaattttttcttgtgaaaaggggacctgatagaatcttggctcactaattcatgccatgtgggccaaattgaagcattaaaatttcatagatataatatcatttataaatcatgtcataaaagcattcatttcctgtagaccttgaaaaataggcatgcctttctccagctgttgcttaagagttcattacatacatactagtaattgtgaaaaataaagctatggtaaaggaggggaatattttttatcaacaccctaagatcatcaaggtgctgtcctttccctgtaaacacactgctcacatcagtggtgatttaacctgcatgcctgcctccacacaatgatggagccctacagagttgtattcataggccaagcaattccaggagggcagctttctcatttttttatgacagtattctgttcagatggagaaagagactgtttattactttccccaagtttctcttctataaaatttcaat

SEQ ID NO: 59782 - DNA, 1611 bp, Bovine  19866881480922
atcgtctttaaaggaaaaaactgtttttaatattatgttctgtctctcaatccaagaatttttctactttgcctattttcttttgggccaggttttcctgaggttagtacccatttatcctgagttagaaatgattaggcatctttgtttttggagtccaggtagggtaacagtacctttttgggcaacgaggcatgggtctgtgccttgtggctggctctctggccaacacagcttctgagttttgtttctgccaccactcccaccttgctgtactgcatttgttgagcagtttgcctgttttgtgtcccaacaaagggggacattcagggagttcccaaattctcaaaggagaggcttgaaacctctttccactctaggaactactaagggttgcaaacctaagggatgtgagccaatttaatccctaaaatcgatcacacagtagcacaaaaaactttcaaaatggtcaaagctatgttaactgtaaattggctcttgacaagagcatttgccagtgagtgaacaaccgcaataagggcatttgccacctgcctctgtggaggtcgaaccctgtgctgctacagctgctcaccttcaacacccccttagggaatttagagtgaagtgaagcactctgctccagggattctgttggaacaggtctttaggtagttaaatattttcagaaagtgatttcatgatcccaatccttgcatctcttcatatctagaaaagcactaaatcacttcttactgacattagcttctcgtggctagcagaaaaccttttgtaagtaaggacttgactgcactgaactcctccttcaccaaaaccttatatattgaccttccccaactgcctctttggagcagtctctcagagctatctgaggtgctgtctccctggctgcagtcctcattttgccccaaataaaacttaactcacaactttcaagttgtacatcttattagtcgacagctaaaacagcgaagctgcacttaaaacccactgggctgcacttaaaacccacaccggatgacaactccatctccaacatcagacagtgaggaataacacattgctgatttctttttctctctgcaagattgaatgggaatggatggagcacacaaacaaagactcgccatgcatggctggtacttaccaatccgtttctcactttgacagtgtcttctgaaagtgacttttgtatctcctgttttctaaatgctttagaagtaactccttccctttacatcctttgaacctaaagcagtaacatcttgaaacattgatctatttgctgctagctttcattaatttcatccattcctgaaggcagagccacatttggtgtccacttagtgaagacctacttagggcagctcaggtccctttatcaggcccgaattagctttgcagttttaataagaactatagctttctcaattattatttaattcaataatgtgcccacatttgctaatgtatttctaaagtgggaggcaagctgcaactgcctatctgtccataggtaagcagaatgtgtcacacaggctgtgccacctctccgggagagttaacattcatttgcatctgtacaggcca

SEQ ID NO: 59783 - DNA, 897 bp, Bovine  19866881506170
ccttggggatagagacactctgtggaagagaaagaatgacagactctcctgtggctcagtggaaatcctgtgtcagcaatcttagaacacactcggggccaagcactgcctatgaaaatgtactttgcgaaaaagagcattgcaatttcccagcatttgtttatacattgtgggagcgtctgaattctctctgagggaagagaggggaaggaaataacagagagaaagaaacaaagatacagataaataaagataaaaacatttaaacagttttgccctgaagtgggaaacctgtttgcctcaaagagggaaaaatgaatgaaacgggcaaatgaaacctgaaaggaaaataaactccagccactcgccaccctcccgtctctcagttcttagaccgttctctcctaatgtgatgagcaattgaaatttttgcaacacaagctctgtaacggaccaaagaaacatcttttaggaaaaaaaaaaaaactttggggaagcaaaaattcccattaagtgactgttgaggatgtcaagcactcacgtggcaggctcaagtgagggacacaggcgtgcgagcactgccgcacccaccctgtgcagcccagacacggacagggctcaccttacaagaagcacgggctcgggtctgttccctccacgtatacatttactgagcatattccacagtgctgtaaaacgaaaacatgagtaccccacgatcgtgtttcagcttaaaagtaactttactgaaacattgactatatttactgacaaaacaggtataaacaacagcattccataagaagggtacttacaatgagagaagggtcatgattagagaagactttttggaagaaacagtacttagagaggtagatgttgaagcgggatagagag

SEQ ID NO: 59784 - DNA, 862 bp, Bovine  19866881593299
tttggagtcaaagaaacctaagaacagatagagaaagcccatatacaagacttgtgtccaacctcaagatccagttataaggaaaagctattattttaatcttctttcagcagtacagaggagaagtcttgcttgttatcactggagattctaatttatctgcataaaatgaattctaaatgattattgatagtggtaactcttatgcaaatctatttcagatcagtagttgaatgttaattttgcaccataatgaaaagcaaatcctctaagttctcactctcattatttaatacaaattgatgtcacaacatgaccagtaaacaaaaaaatatctttctctatttcttctatttgttagtttcacacatttaattatagacgtgggagttgtcagttttttgtttcttttattaaccaattttttgtttcttttattaaccaacaactgtagacaatttcactactttctggtcagtatgctatattaaaaaatgtgattttttttttttttttttgtataggtggattgaccagtaaaaggataaaaaatttggataataagagtttgacactcatgtactcagggaagtccttacaggctatatatcagcttcttgtttgactgtatgacattaagtgaggtttggggaaaaaataagattgttgactttgtacactccaatgactgtccccccctaacccacttcctggagtaagtagcctcttctaagatgtgaagatgtatgtagactggacagtatttcagttgtgctgtatgtctccagaatagcattttaagcatgttgatactgtgtggcggaaagagtattggaattaggactagaggaagagttacagc

SEQ ID NO: 59785 - DNA, 1016 bp, Bovine  19866881618907
tataagttgatattgactccaaattaacattaacctgttttgaatatttggggttaaataaaatatattattaaataaattctgcctacttctttttgctttctttttaatgtggttcttacaaataaaaaattacctaagtggcctgcattatattcctactggatagtactgctgcagaatattaaataaaggtattattgtcattactcaaactcatcacaaaactggaatcagacttggagtccgtaacacggtctttttcctgtccacaccctagagaacagctcttctttcttggttacccttttccctgattgataaggcaaaccctttacagagagagactttctcatctctttctccaaagtcaggcacaccgttggggccaagaacaccaaacatgtcctcctattgtccaaaggaggggaattgtctaaggacagtcatttgctcactccaatccttaaaatctaagatgagctccacatgcacagtttaagcccacattacaacccactcccaatgcaggacatatacattttacttcgtttccttgtgatcgtgatctttcagagcaagatgcaaacagagttttcaaaactgaccgaaccttttattttgtgtctggtaaacacacagctaataaattccctaggaaacagatttgaatgttagacagaagtcccttccaaaaaaggatcttacatacaagggttttcaaacctcaatacatattaagatatgattgaataaatgtgggtgcccatttctctttatatttactatgtgtatgtagagagacatattttttacacaaacactagaatgtcttaggacaaggactctcttttcctggcccctgagcaatctctttaggagttaactgtttccagtctcccaaataccagaagttgtaagcccccacccctccacatctcacaggaaatgaaacagaggcctggagatgtggggtgtggacaaagggctctctgaaaatattacctaccctgagg

SEQ ID NO: 59786 - DNA, 817 bp, Bovine  19866881652442
tctaataggaaatacttaattcaactaattcacttgcattagacatagagccctgaacaaggcaaacacagttcctggccctacagtacctgcagcattcaactcctaaactacggactttcctgtaactgattcatgtggtaattgggatactcttcattacattgtgagcttagttgatggatctttttagtagatctgattagccatgttgccatccttagagaccctcagaaggatgtcaggccacagaacacgtttccagacacataaaacttagttacctcaatggtagaatacagccaagtaagtaaaactgtgatttcagtaaaaatgaactaagggttatatagagaactcttttgcctcaattcttatggttaaaaaaaatgcttctgaatgtgcttgtccactttataagagcaataccgcaaacagaattattattcctttgaaagctgatgtttttcaaggccactcttagcaataattgctttcactaagcagaactacacatggagatgggctaggaaactgggctttacatatagtgattcaaaaccatgctcaggaactcaatgaaaaaaattctctcattggttactgtcttagcattgctttttttttcatcaaacctaagtgcaaggggaaaaatccaattatttggaggttccagttagctggaacctttggtctgctaggctacagctgggcaaacttcagctatggagagatgctctctgatcatctacctgtggtgtgatggattatctctcttggtatttaatcagtaactgcaaattacccagatttcgga

SEQ ID NO: 59787 - DNA, 696 bp, Bovine  19866881658215
tgctgaagaaggtccaggaaggagccttggcttctatgaagaatcggcaaaccaccatggaggagatagcttttggactgagctctgaggaatgggtagattttctacatgtgaagataacacagagaaccttgccaatctgaactaagccatgaaggtgagaaatggaagggccaatatagaatacattatttttcttttaacatcatttttttctagtagttaggccaacaagcattgagaaatgagtaagagaagaaatcctaagtgcaatctcttaattggctttctgcatacttaacatcatgtatgggaaaacaagtcatgggggcaggatgcagtagcctatagaatttgaggcattcttctattttaaaagtaaaaaagaaaaaagaaaggttcctgctagcaggaaaatgccaaggtagctcagatggtgaatattattctgttgtcatgattcccatggttttgtcagcataagtgtttttaacacaggcacaccactcactgaagagatgaatgacctcatgttaggtaaccccattcccagcttctaagtggggagtaataacaacaggccgagcgtgggttatttaatgaaaaggagagttatagtgatcatgctggttttgagaagcaagtaagcgaattgaccacagacccatgcactaaaaatacataaataaaattctg

SEQ ID NO: 59788 - DNA, 717 bp, Bovine  19866881712092
cttcttgtctctttgccaagctatgagactaacaatacttttgacaagatgaaaaattctttagctgcctgctgtctctgcaacaaatttccttcatcaactaattcactaatttgggccttcttgagaactcggctaatttgtaagaacaggtggctcattccataagtgttcaataaagatttgcacatgattacacacacagcattgcctcaaaaacaaatgaagaaatgtgtgtatttatgaagaagctaaagagacagacaagagattcttcagtagctaagagtgcatctggtggtctggtaaaattatttcaaaaactggtgggggtagggagtagaagcaggtgacataaggatataaagttcttgtcacatggacaattaacaattcttgggaaactaccaagcagtgttggatatgaaaacaaagaaacaaactaaccacagcctcattctgattttttctttattttttatcctggatttgagttcattcattcatacaacatttttgagcatctactacatgtcaggcaccatttcagccacctcaaagtcacctattttctattatacaaagaggagaaggtatgttataaggctaaaaaaaaatcttaattttgtttaaatcataaattagatgttgggctattactggaacaggttaaaaaaaataagctcatgtcaaaaaactgtagagccagtcaatcca

SEQ ID NO: 59789 - DNA, 975 bp, Bovine  19866881872968
aataaaatagcatcatgtggtccacagagacatccaggtacaatggataatgcatgtgccatagactcaggttaaactctgcctggcaacctgccaactgcctgaacgtggactaagcacctctgacatgaggtgtttattctcacaatcataccatggatttggacttatctctactttataataaagaaacagactcagagaagctaagtaacatgcccaccaacacagctggtgagcagcaaagctaaagtgatgagctgtaagtctggacaatggagaagtcacagtggatttcagagaattttggcacacattttttgaagttcttttttttcccctggtcctataccccaaactaagtgctaagcctttgacgaactgacactgacaaatatctgtttccaaaaactttctgaccaactctgatcttcagttaagggtttatgatgaaagtccaataatatgtaactgaaacaacaatgggcaccactataattaaatagaatttagaaaaggcaaaccaataaaaatgcggagaatcaacagtaggcactatgttaaactgccatctgtacagactgtgttcaaatcaaggggtggcctttcaaggcaaattatgtggctcattgctggggcaaaccagagttggaagagccaaattatagacaagctcccagtaaaattgattttgacacctctttcctcaggagactgggaattatcttcccagtgcgtactttagaacatcagtgtcagcccatctgctacctaaatttagatctcaatacagtatgtaatggagaaggaaatggcaacccactccagtactcttgcctggaaaatcccatggatgcgggagcctggtaggctacagtccatggggtcgcaaagagtcggacacaactgagcaacttcacttcactcacttcatactttctcacggagaaggcaatggcaacccactccagtatt

SEQ ID NO: 59790 - DNA, 1184 bp, Bovine  19866880233449
gaaatcagtcctgaatattcattggaaggactgatgttgaagctgaaactccaatactctggccacctaatgtgaagagctgactcgtttgaaaagaccctgatgctgggaaagattgagggcaggagagaaggggacaacagaggatgagatggttggatggcatcactgactcaatggacatgagtttgggtaaactctgggagttggtgatgggcagggaggcctggtgtgcatggggtcgcaaagagttggacatgactgagcaactgaactgaaagaatcaccagctggctagcaactgtcagcttaagtttggccttttgcactggcatttctgggttgccttaaaaatgcataaagaagtgatcagagagagagagtaaaaaaaaatgagaatgcaattctgccatttgaagtaacacagatggtcctagagaatcttatgctcggtgaaataagttacacaaaggaagacaaatactggaagatatcacttatgtgtgaaaattaaaagagaatacaaatgaatgactatgcaaaacagaaacagactcacacgtagagaaaacaaaccagtgctgccctaggggagaggaagatgagcaggggcaaatcagggtacgcagtggagagatgcggactgctacatgaaggaagatgagcaggggcaaatcagggtatgcagtggagagatgcggactactacatgaaggaagatgagcaggggcaaatcagggtatgcagtggagagatgcggactgttacatgaaaatgggtaagaggcaaggctatagtgtgcagcacagggcatcatagccattattttgtaatagctttttaaaaagattacttatcttaattgggggtaattactttacaatattgtgatggttttccccatacattgacatgaatcagctgtggttgtacatgggtcccaccatcttgaaccccgctcccacctcccccagccaccttatccctctgggctgtccctgagcaccagcttggagtgccctgcttcattttgtaaaaacttttaatgaagtacaatctgtaaaaatattgaatcactatgctgtacacctgaaattaagattatattgtaaatcaactatcagttcagttcagtcactcagttgtgtccgactctttgcgaccccagaattgcagcacaccag

SEQ ID NO: 59791 - DNA, 1200 bp, Bovine  19866880398724
tctgtagtatctaagagtaaaaagttgcaacatgtatttcatatgtccacttttgtattatattgcccatttctgctaggggcctccaaaaaagatctttctttttttttaagagatacatacatcactgcatacatgttaaaaataattctaaggacattcatctttgttttaatctatggatccttccagtataaaaagaaaacaattccaagatacattattcaaaaatcaaagaggatgatgcttttctttctaacatttgtaaatcactaataattgttcctgacaaatgataagtactcgattttaggatctaattttaaattacatttactatcatttgcatttacttaaactgcttatatatagttcagtttccaaacaaataagtttgaatttatactaagataaggcaaaatcaaaagatacacatacattattcaaattttaccctatttcatagttctattctccttccttgagaagtgttagtttttaggaagtaaattaagttaaaattcattttcaatttctagttattccttagtggcaatggcaaacaccaacaaaagaccaagagacaagagctgcaaggggaatttctatcaagtcaaacagtaagtgcatgaaaaacaagctgatgatttatttctaattcatcctgcaggtctgagaaacctcaaacacaagctaaagtttatgaatctttattagtcccactataaagtgtaaaacaaaaacaaaacagtcaccatcaactttgcaaatcgcctgcttgtttcaccaattaaattatgaaaaaaatcgtgactaaatctcccaagtgaaattttaaaaccaatctgaaaaaagatcatatatcaatttctgttagagatttatttttagaatgtatgtgtatcagttccttttcagctaagtatttccttcattacaggtattatgagcctcctggcaggtgagactttgcatgtcagactctaaaaatcagatgcaggacagatggtaaggctgcaacctaacaaaaatccctctagcgcatcacaaaaagatgtgatggtacagctaagaaagaagtatccgagcacaatttccaccatacttaggctctatatttctacgttatttcctggatccaggcttcaatcagaaaaagctaacattagtttgataagaagcattatcaagaaactaaaa

SEQ ID NO: 59792 - DNA, 1143 bp, Bovine  19866880450014
taagaggcagtgttttttaatttgttttgttttggtgttaagcatgcagtacgctgcagctgttagtacgtgttgagaataaattaaataaaaatagaacagttactcctaaggttggtctcaagtgattcatgtaaagcctttaaatgtctccagtacctagataagttttcctccagaatcagcactgctcagaggattgctgtcgtgggagataattttgtctctctttgtaaggcgttttagatagtaaaagccaagaagaagaaatttctgtcaaccaggatggattgtcctttcaaatgtactttctctaatgtaaaataaaccattggagatgagtttacgagtttatatagttctgagttcccacctcgcctgggtatgggaaggctttcttaaatacacagatagctccagaacagagagaagcaggaacacgtacaagaaaagggaaagctgtggttttaagggctggagtagaaatcttgaatttcctttccatgagacatgttcagttttcttttaaaatatttgcttttgactggaaaacttttctagccagatataatctactttggcctatatgtttagctactaccccttaggtcttttaactttcagttcctcatttagataaagcatacaggagcaaaatgtccaattgcaagtgtacagcttggtgatttctgcaaacagaacatgtgcattcatctagcactttgatcaagaaatattatattacctgcaagtcctcttgtggggccagcttcagtcaccacccccaatatgataagcagtttttgaactttgtatgcatgggatcatagtctgtgtgctttttgggacttgatttattttccataacattatgttttcaaaactcattcatgttgttgctcctcctcttcacttagtttttttttttttttcctttttcttcagatagacatgttgctttcatgtgtcacctccttgattcagtgtagggagccatgacgtgtataagtggagtgactcgaagtcaggtcctcttggtggccttcatcgctagggctgtccctgctttttttttcttctacatggttgttattctgggcagaactgagatctaagaagagagaagtgctaaaaacttagcac

SEQ ID NO: 59793 - DNA, 1362 bp, Bovine  19866880457884
cattattactagagataaagagcaatatttctcaattgataaaaggtcagttaatttataaacatgaagccgagaatgtacaatgagaaaggaccatgtcttcaataaatggtactggacaactggacagccacatacaaaagaatgaaatgggaccacttcttacacaaaaatcaactcaaaatggattaaagacttgaatgtaaaacctgaaaccacaaaactcctagagaaaaacaggtggtgatttccttaacatctgtcttggcaacgattttttggattagatgctaaagcaaaggtatggtaagtcgcttcggtcacgtccaactctttgcaactctatggactgtagcccaccaggcttctctgtccatgggattctccaggcaataatactggagtgggttgccatgcccttctccaggggatcctcctgacccatggatcaaacacatgtcacttatgtctcctgcactggtaggcaggttctttactacaagtaccatcctgacccagggattgaacctgggtcttctgcattgcagtcagattctttactgtcttagccaccagggaagagccaactacattttaccaaggagtaatttagaatgactagaccaaatcaaatcaaatcaaatttcacctattaaaaaactaatctgttagacatgaggataggacaatttagaaggtacctacaaagaaagcaaccgcctgcccaagcacaaaaaaacaaaaacatacagagagctgagcttacacatgagatacagcatagtagggggcggtgtaattttctcctctgaaactgattgatggtatcggctccaataacatcaaatcaacacatctctcctacttaactgtgccaatgatttatttgctctgactggcctggaaagtgaccctcttgttctacctgctgaagaatgtctgaccccccaagacctttgcccatggctgatttcagcaaaatggaacactcaggtggaatcctgatgaacacccacaacggtggtacacatgtggctcagggaaggaactgaactaatgtattatagtaatttatcggcagttctgtgtgacagcatatttacagaaatgaggcctgccaaaaagatcaggttatagcaggaacacatgatttcccagccagccataaaatacaaatcaaatgccttttctgcccgctgtcagccacctccacccactccttgtccccaaccctcagacaaattgaagcacatgccacaatttgcagagggaaaatcaaactcaatttcgcagtacaatgaagtgagttttggtcttgtcatgtccacgacatatgatccctagaagactaaaagaggatgt

SEQ ID NO: 59794 - DNA, 2288 bp, Bovine  19866880558647
aaacataaagcctctttatacaaaactgtaacaacggcatttttctttcatcactgccaagccccaaacacatctagattttccactatgaaaaggctgcatgttttatatgttatatttatgtctcactgtaaactattcattggtttatagacctcaggtcctctaggaagcatcacaaatccttattatactcgtggatattaaatttggtgttaggctctctgatttatcttgccagactaactcacatgtaaacagacatctctgttaaaactatctacttcaggagataaaaaattaatccatgctaaagctctaaccttgaagctcactgcaactgcaatactgacaaaggtaagagtaaggatgaagatagtaatgatgacgtcaaacacgatggcgataatgaagaaaatgctttcagttagttccttcctcattctgttaactttccctaacacaaaaattaaacaaagctagagaccaaagaagcgtgctttgggaagctttcgaagacccaagtaggatttctatgtgaatacagtaatcttgagatgaagggatgagtcaattaacaggaaatgactaagacgtgccacaaagcaataaataatggccatctaatgactgcaaatgaaagtcagcccaacgacattccttcttacaagctctcacctttccaagaagccaagctacaaagagttctccgtatgagtttatgtgataattttttttttctagacgctacataaaattcttccgatgggaatttgcacagaagaaatttttatcttcactcgggtatcttttgagaaagtatgatcgcacgagttattccaaaggtttctgaagatgtcatcctcccagatgttctcctttgaatcttagacacatgctgccaactgcagaatcacagaagaaacactttcctcctctgacattttcaaaacagtaaaaaacttatttttttagatagatgacgtttagtaagaatgatcatgaactactaaaatacactgctagatatatactgaattgaaattcatattatatgtgtggaaaaccaacgagagttaacttaattccccttcaacacaagtgaatgcagttttactgtgcacctatactgtgcgaaacactgcggtaggtaatgaggtcaaggtacctggcgtgtcccctgccttcaaggctcttccaaatcaacttgcctttcttttgcctttcacgtgaacgaaatggtcttaaattttcaaaacagaaagaaattttactttatatatgaaggccctgcttaataatatgatcagttctcacattcaagaatgagaaaatggtgaccattaaaaacaacccccaaaaaatgagaaaaacaaaccacaggacttccctggtggcacagtggattaagaatcgcctgcccacgcaggggacacgggttgggtctctgatctgggaagacccacatgatgcggagcaatgaagaccgtgaaccacaacgatggagcccgtgccccagggcccgcaggctgaaactgctgaagctcacgccaagagcctgtgccctgtgacaagagaagccatctccatgagtagcccgagcgcagcagcagagcgtagccccggctcgccacaaccagagaaaacccttgagcagcaacgaagacccagtgcagccaaaaatatttttttaaacaaaataaaacaaagaaatttaatttttaaaagcattccttttaggtaaatgtacactgtgtgtagagttgtctcgatcaaacaatacttttaaaaatcaagataggataatatatgtagaaaagattaagattctaacctttgctctttgttggatctgaaggtatttttatcccagaggtcataatgcaaggaaagaatctgatgcaatcttattcattaaaaatcttaagaaagcaatcaactctgcaggctcaagacataaaaaagcacagagaaatggcaaaatggttaaagcacagaatattactatcattgcatttctggttttttccctgcagaatcattttaagcacgataggcaacgttcttcctccagtagatcagggataaccttttagaaacttgaaattatgaggtcaactattaaaaatttttccacgaaattttaatgaattaaagacatattccaaagggatgcttataatttattccttatatgtgcagaatttccaaggcccttgaatcctataggttattagaattctctcacttgatatcttgggaaaagataactgaaaaacaacatagtt

SEQ ID NO: 59795 - DNA, 1529 bp, Bovine  19866880588224
gatcctcggttctgtaccccatagtggctggtagccgatttccattcccctgcagcggagggcggcctgccctttaggcatagtcctcatttctgacttccacaaagacactgcctatattttaataccaagcagtgagtggatttacttctgaactcctctccttttcaaatttgcagtaaggtgaaattgacctgtgggctctctttcttcctttctttggtatgtacatgtgtacaatctagggtctatttcatagcaagctaaattaaaataaattagagaatgagttaaaacggttgaattgacgacatcagcaatggatgactgagctatgagaggcttcctaagattcctaaaccagctcatggtgagttttctttcctaaagttggctaactaggtgagattttattttcccgttccattccagagacttctagctctgagttctatgggaaatacatgtctatcataccttatctgaaaccttagagcctgatgtttttcagaattcattttttacaaagaggtgatataacaaacaggtggggcccagagcacttttagggcagtgtaactactttgtacacgtgtgtataatgatgaatacacttgtcctaagccacaggatatacagacaccaagagtgagccccagtgtagactgtggacttgggacagtaatggtgtgcaggtttgttaattgtaacaaatcaccactctgatgctggatgttataatattgaagtctgcgtgtgtgggggcagggactacaccgaaaatctctataccttcttttcagtgttgttctgaatccagcactgttctcaaaaaagtagtcttttttttttttttttcttttaaaggtgataccatgtataatcactggcagggtctgaaccaatacccagtaaccaaaactatctttacagtgaaatttaggctcctttatgctaagcgggttcagcatagcttaaaaatagcctgaagtcagtttgggtcagattttgcctccaaatgagtttacatcaaaattacaaaaaatagagtaaaaattggatttcttctgacatctttggatttttgcattgtggttaagagagaaattctccatccactctaccctgtttacactggctgtttatgagccagtctgcagtagcagtggcacaggctttcttgtgtggtgagagggctgagaactgccatctcatccgagtgacctacaccagcacccccatgccagtgcattccacggacccttcctcggggtgggcagagctgctgacggtgccaggtaactgaccgtgtgatgaggttaatcccctttccctcggccccctctgtcataacccgtcataaagctgccactggttttcagagccagcagttcattgctctcatttctctctctctgctctcagaaaaggatagctttacccacacacttctgggcaaataaatgtctctttgcttttttgggtaatcctagacttatcaaaaagataaaagtcagagtggaggtttt

SEQ ID NO: 59796 - DNA, 2064 bp, Bovine  19866880637552
ttgccttctccctttgggatggattacttagtaatttaattaattacttcagattaattaatttaattaattatttatttaattaagaagtaattaagtaagtaattaagaagtaatctgtacttcagattaacttggaaaaattccttgagctaagaggtatttatcaataacctgctaattttacttatattttgtttcactgttgttgcttttttattgtaccattctctaggatatgtacaatttgcagaatatatttctgtaaagatgaccatttaatgtgtccagttgtggtgataattattcctatgtgtgcctagtcgctcagtcatgtccgacttcttttgagactccatggactgtagccttccaggctcctctgtctatgggattctctgggcaagaatactggagtgggttgccatgacctcctccagggtatctttccgaccaagggatcaaacccaggtctcccgcattgcaggcagattctttaccatctgagccacctgggaagccccataattcctttattatgttttaaatataatgcgtgtgtgcatgctaagttgcttcagtcatgtccgactctttgcgactccatggactgtagccctccaggctcctctgtccatgggattctccaggcaagaagactggagtgggttgccatgccctcctgcaggggaccttcctgacttagggattgaacggcatgtggcttctatactggcagacagattctttactgctgagccactggggaagcccttcaaatatactgtgtggatataaaaaatcgtgttatatataacatacatatgtaagttaccaagtatcaataaataaaagccatgatttcaccacaggctcgcacacacaaagagggcatcaagagctcctctgggcaggggtcagcgtgggatgtttttcctgacgccagtgaggtcagttacctgaatgggaggtgcttttgctccccagctgcgtctctgactgactgtggctgacgggcgtgaggtcttggcagctctggatgggggagtctctcgccgtcgggtcggtgcctggtggcttctcgatatttttcatctccatttcttcatgatggatccacaggtccgggggccggaggtccttctggctgccctttcttttgccaacgctgtgggtggcccgtttcctatggaacaaaatcaggaggcagatgtgagtacctttattcgatggcttttcctctctctctctcttttttgtttcttagtcaattcaagttagaagcgagagagaggagacaaaagcgctcccaggaggaaccccgtgaaatccaggcgctggcagcctcggcctggctgcctttcctctccttccctggagcttcgctgccttccggagacgcggcgcggcctccccagggcccggcggcctgccagggagcgcttcacgccagcatccccgctgcgggcttcagcgtgaggtgacggtgggttagatggagccatatgccgttctttggagccaggcataaggtaccccacggcaacatctgtctagcagataaatgacagcgttgcttccaaagggcaaatggaaatgaaaaggccaggatttgtgccaacagccaagattggggcttagaagaaagtgtgtacctcagctgtccaatttcctgtgcaactggggaggtggccctttgaagacaaaaaggctgcagaaacacattctcgggagaataaaatgctttcttcttggagtcactaagtatctggattcgaacacaataagacccatcttttttttttttttaagaccgatcctttgacaaaagaagaagccatttggaagtgtgctgtaaacatctcttattttcttcagtaagcatttagcaatccttaatttgtttttcagcagcagtctcctcttggggccattgagattgcaatgttccctgcagactgagtcaagagcccgatgcttatgttagccaatctctagagcagggggtccggagaaggcaatggtaccccactccagtactcttgcctggaaatatcccatggg

SEQ ID NO: 59797 - DNA, 1519 bp, Bovine  19866880703283
tgtgttatcaaataccaaactgacagatgggatggtagagaaaaattggagtttggaaacaagcggacatcaacctgaaaatacagcttcaatagaaggaagctgtttgatcttaacctgggcattcagcttccctaagcctactatcctcatctccaaagtagaaatcatgatacagaagtatttataaaggatgagaagagatgattatagagttcctagcagcagcatgatgagtggcaaataataggtattcagtaaatgggggccaattctactctcaatttgttggtcttatggtgatatattttgcaatgagaagaaaacaaaaacggaaatctgatgcccttttcagacatgcagtggtactgagcatttctaacattctaatatttgctctaaactaggaaagaaattatgtaactgtacaaatatttcaaggcatttacatgattaagagtgaaaatgttatgctttcaaatcattagaaaaataatacatgaaatggctgagaaaccagacctgaacaaactctaacgtggcaatcagtcggatttcagaagatagcaaggactagcttgctgtcatctttatctgctgacctgatttactcaaagaaactcatgtcatttggctacatgaatgtctgaaatgaataacatttatttgcactagaaagaaatgccatctttttgtatctatagtacacaaaaatatatacaagcagatacatagtatatctgctcttggccaatgaaacattaacctatgataaacctattagaaaaccagcatattaaattcagactaaagcgatagcatgtgttacttatcatgagtagtttactctcccatcataactctctgtgtttaaatgtgatgtaatagaaaatgcttttattaatcccctctgacatacttcaataaaacttccaaggtctctaaaactcagaaaagtggtagttagaatgcattctgggatctagcctcagatcatcatgtcaatgaaatagaacatttgtgtaggataatggtggcctgatgttagatcactgttgagataaagaattttttcaaatcaaaaaagacaaagcaggatttttttttttttttgaagcggagatcaaggttctcttaaaatgtcttctctaccacctacatgtcatttcttttttacaaactccgtaaagagccgaattgataaggcctctcaacttgatctcttggaattgccaagtgtttgattcatgaaggagtaaatcagattttgtacatcactgaggatgtgtgtaagattgtaagattacacctgagatttaccttatgggttgggttaggccaagatggcagagcagaaagagcctcagctcacctcctcttatgaacccagcaaaaccacaactgccaaaagaacagtcatctatgaaaatgacaaaaacctcccagaaaagattgtctacaactaaagacataaagaaggaaccacagtgagacaggtacaagaggtgggaaagtggaa

SEQ ID NO: 59798 - DNA, 691 bp, Bovine  19866880793768
aaattcatgtgcatacccccgccatgtgagccttctccaaagagttctctgcttcaaaatctgcaatctctctaactgcctttaaaataaaacctaaacttcctaagctgataattaagatcctccacaatcagtctcctatttctattcccaatctcatcccccagtaaaaccctctcacctcactgccacccaagcatgtctcaaaatagtccactttcattatcacatgctgttttcttctgcaggaccctggcccttttgtctgcttacccaaagccccctctccttgaactataacgtctagtataaatcctttctcatttatgaaatattcacagaccacaaaggccttttcttttctaaactcacattgcttgctgcctttctggactagtaaacatgtattgaattatcacagcttctgcagtgcagcctgaattgctagttaactttctagacctttttttttttttaaacaaagaaagaaaataaaaattatttgctttaatgatctgggaatttaaggtaaataaatctgaataatgacttcgttactattactgcatctgagataaatacatcatctaagttttagttcatcttatcacatattagttaccaggcaagtactgcctatgcagattcatttatggaacataatacagacagagtcactctctattcacct

SEQ ID NO: 59799 - DNA, 1818 bp, Bovine  19866881069705
ggtgcccatacaaacttactgattatgaatattttatctcacaggagttagaattgtaagaaccttacagtgattcttaacattgaggggttagagtcaagaagggtagaatcctccttgatggatgtggccatcaagagcatcacaggccttcagaattggtatgcaacctctttggtgactttggatttttttcatgattatgggaaagagtgcatcactttcatcatattctaaaaggagaaagtgactttaaaatgttaatcagcacttgagggagacttggagatcttatttttgttcgttttatcattctttaagattgagctactcacacgaccttttgcttctttggtaacatggcatgatatttatgaaggcccagaaggactgtgcttagtgataacattaagcacattcagaaacactaggagttgcaatgaatttgaatgagaattcaaattgaatttgttgggttttttcctttaaagagcagagacctggccaccggcaggtgaaaattaaattgcagagagaggacgataggtacagacttattgctaaaattcagtgagtggtccagtgggaatccatgactgttggaaattaatgcagagtgacagattgatgctttgagcagaattttttttctctcacacaaacaagtctgtaattaaagcattttatgtttatatagttgtcacatccaataatttaaaattatcctaatttaaaacagcatttaagaaactctaattagactgttaatattatgaattttcaagtactcatgttctctttccctgattaaaattaagagggaaaaaaatgccccacatcagccagccagtacctgattctagacgtgatagttaacttaaggtgagcatatggtttatatactctgaaaacagggagaaaaatcctacattccttgctcaatttctcattcaagtcagggagcagattattaattttctcaagtagttttgatcatgtcataaaataagagtttagctttaaggaattaataaaagtcagtagctcccgagaagtcactgatttaaaaatcttgtccatctcagaaaaagtggggggaagagtaaacacaatgtaaaaaagattagaatgtatttgtttcaatactgtgctttaaaatgaaggtggaaatagatttgatgtctatgtatatggagagaagggtcatttttttcttgattacaacccccaagagaaatgcggatggctatcagtcaaatctccatcactttgactgcaaaagttgtgccaattaaagacggttggagctctccaagttcagaatgatgttgccagactttttcttcaattattctgaagcgctaaatgtgaaaacaaatctcttagattaccacagggctggaaaaagaagagctggaagagccagcaacaaatcacaacaaagcatagaagtgtcaccttcctgatataagcatgggcagggtttctgcagaaggatttttcagatggaaaggaaggggagccatttccatttcctatcacccagcagttttattcttcagaatattctcaagagaaactctgaagcttgtacaactggagatgtgtacccgatagtttgccaccatcttgataacagtggaagtccaaaaacaatccaaatgcccattagttgcagactggttgactcaatagagagtcttcatacagtgccattgtgtgatagattaaataaactacagggtgacaccacaatatgggattgagtttggtgatgtatgaattaagtgaaaagaagtaggttccaacatactatac

SEQ ID NO: 59800 - DNA, 2419 bp, Bovine  19866881183496
tctgactctttgcaccccatggactgtagcccttcaggctcctctgtccgttgaagtttccaggcagtgatactggagtgggttgccatttcccactccagggctacaccatgtatccaggtgctgcttttcaatcaccatagttgaggctaagcagactggagtcaggtggacagagagcaggaaaaaaggatactgtgaacacagaaccaagaggatcctgtccccttaaaagtaaatgttaaatgagcatggcaacagcagagatcctaaaaatcaacgcagtcaccgaacgttccgtgaatactgctcgagtactgcttcccagatttccgacatgatttctcctggttctgttcttcacttacttcgtgtcctgtgtttgctgggagtatgtgacgtgctgccccgacattattccgttaacgtctgtctttataccggtgcccttgcttactgcatctgtggccggcagccgcagtttaaggggctctgtgaggctggtgaaaccatgccttcaggaggcctgtgtgcagttgataacagagcggctacgtgcgttaggaaggtagtcaggagacggatcggtaggtttacttctccagtcgctgatactgtgagctaatgggaacaaggtttagggggtcttagtgtgctaatgggctttccagaggctcagtggataaagaaactgcctacaatgcaaaagacgccagagatatgggttcgatttcctgggttgggaagatcccctggaggagggcatggcaacccactccattatgcttgcctggagaatcccatggacagaggaccctggcgggctacagtccataggtcccagagttggacacggctgaagagaccgagcacagcactgcttccagaactgtggtgctcagcggtcaccacttgggggcacccttttgctatgaaacagcaaagccccatccagtggccttgcacagagttgagggaatgtgtgattcttagctgtctggcctgtcccaaagaccatggaccagtaagcctcacggcctctctcacctcccaatctagaatgctgctatgccatgaccatccaccttcaccgaaaatgtcctctctaagtgctgtttaaaactaatttttcaaagcttttcatcgatttctcaaagtgaaccacaaagcggcagcagcaagcacatccttcatcacgggtgaagcatgtagagaatgtagcatctaatttgcgtggaagccacactttaatgctgtctggcttgagtgccaacaaaatggaattgagtttgagagctggaggggacgccctcgttttctgggtgagaaacccatgttccaggggtaacgaggctcagccaaatgagcgtgtcgaagacacagagctggagctttgctgtatcccattgcctcctctgtccctgcctccgtttgaggctggttccacctgttctcagggaggactaacatgtgttcgttgagaggttgctctacttttaggcaagaccaccctgccctgcaggatatgctgggagttactttacagggtcactctctccctttatgacccctgatgtttccttaagtctgcagatcaacacctataggagatgcagggtcatccttgatctcagccttcactcctcacctggccccactggctttttcacagtgatgtgatttagcaataccttcacatattattctttcattacacctcattttgactcttggattcatttaatgaatacagctttcctaatcaggttctgattccacgtgatggtacgcttccaagggttgcctcaaattaacactcttcccagactgcctctacctgcggctcatggatctgaccttcccggcctggtattttttactggcaccccacccagatcacctgtgctggctgacgggcccatcctggctactgggagttctagaagctaatggctcccagatgcccccttctctggattgtcgtcgttgttgctccgttgctaagtcacatccaaccgtttgtgaccccctggactgcagcacgctaggctcctcggttctccactatctcccagagtttgctcaaattcatgcccattgagtcagtggtgccatccagccatctcatcctctgtcatccccttctccttttgccttcagtctttcctagagagcccccccaacctagaaggtgggggaaaaatggaggaggagccaaaggcagagactgacagattcgatgggcacatagaccagcccggtttacctttgggagggacaacgctgatgcatgacttgatttttttgttgaccatctttccccaccatggaccacgccaagaggagacttcccctgagaccgcatccccactgggcgcccttcttcctccaatctccccttctccctttcttatgggtt

SEQ ID NO: 59801 - DNA, 1051 bp, Bovine  19866881215623
caatgaatcatattcttttaactgatacatagtattcagaatttcagtattacttttcaacatatatttttattcagttttcaaatctgcatatatcatttttatttttatgactctaacatgacattttatggaagtataataaatttgtatatagagacctaaccatatttttgcagaatgtagtttgtttcccgtgttttcatagtaagatttaatgtctttggggcttaagtataaattgcaaagattgtggttaattcatacagttgcatattatggagctgttaaaaattacactgctgacttatttattgacagagaaagatttttctgtaacttttttaagactacaaaacagtatgtatggtataatgccatttttgaaaaataagtatattagtatatattctcttgctttcacacacacatatatatgcatgtgtggaaattataaataaataataatagttctttttggataatgaggttctggtaaattttattaacatttctacaatgagagcatattgataaacaaaaaagtagatattattatttaaagcatcaatgaaatgaaaaaggcattggggttcctggctagaaatgaagtattgcatcattaatactcaagagtattgctttccttttaggtcaagacacagaagaagcagggagctccatgtccactctggagaggtcactggcggcacgccgagccacccgggccaagctcatgattcctatggatgcccagtccagcaatcctggtgagtgacagttggtgccacagtggagacgggaacaacatcacgttaatatgaggcatgcgtgcttagccgctcagtcgtgtccaactctttgcaacccttttgcctgtagcccgccaggctcctctgtccatgggatttttaaggcaagaatactccagtgagtgggcattttcctccttgatttgcagtattatattagtttcagtttgtatattatattatacagttttctttgtgtatcttttctctatcagctatcaaaacctgattagagtttt

SEQ ID NO: 59802 - DNA, 1816 bp, Bovine  19866881233359
ttcccatctgtgaaatgggaaaaataacagaagctatctcataaagtataaggttcaataaagctgttgtaagggttaaccaaaattctatcaagtgaagttcttggaacacagtcaatactacaaatattagctgtaatataacaactgattgatgcttttgaactgtggtgttggagaagactcttgaaagtcctttggactgcaaggagatccaaccagtccatcctaaaggaaatcagtcctgggtgttcattggaagaactgatgttgaagctgaaactccaatattttggccatcggacgcgaagagcatccgaaaagaccctgatgctgggaaagactgagggcaggaggagaaggggacgacagaggatgagatgcttggatggcatcactgactcaatggacatgagtttgagtaaactccaggagttggtgatgaacaggaaggcctggcgtgctgtggttcatggggtctcaaagagttggacacgactgagtgactgaacggaactgaacaactaattaacatctttccaccccattagactgagagttcttgaagggcagtgcaaggtcatctgattcgctcagtttcatcatcaggtcccggcccagtgcccagcagagtaagacattggcacatactatctaaatgaaagagtttaggtggtcaagaagagaggctctgtgactgtaagaaacaggaagaacaggaagaactttacagagaagatggaatgagggacttcctggggcacaggttaaattcctggtcagggaactaagatcctgcatgctgcctgccacagccaattttttttttttaatttttaaaaataaagaagaagaagatggaatgagagccagcctttggatgattgagtgcttttaaagaattggagaggaaagagaagtgcatttggggaaagcaaaattacatttggaaagctaatgaggtgaaaatagaaaacttacatttgaaggaccatgagtagcttaacacagctaatgcagagaattcatgtaggaagacaataagagggaaaggctgtaaaggacaccagaactggaatataaaactttagataccaggcaaaacaagcaatcctcttggtctccttccagccttggcattcagaaagggcttatatttgcttcctcttcgttcccttgggaataagactccaattattttgacacataaaagccacccagtgccactagtactaagacatggagagtcttataacacaggtttgggcatccaggctgaaaggctctgctaagatctcgtctgtgagatccccacagacccactacagtgttcagcaatacaacaatcatttctgcctccttcctaaagatacaaggcttaggcagctctgcagagttcaagtaaatctctctcccgtgacactgaaaatgaatgacagattggtgccaagattcttaatggtcccattatacaatgttgctaatagtcaactctgtctcaaaattgtacaaggaaggggctgtctgtaagcttttagcatctggatatcagtttagacatgcaaatttgaataacttgaacaagatcctccccgagacaattaggacacttagaacataatccatgtcaaggctatcaattaagaatggggattgtcatcgctaccccgcatttggtgaggtttcacttgaaaacaaaggagcgtggagcatgggaaattctcaacaccaggaatgtcattctcaaagcacactggcctttattctatgggtgggctgggtactggttttcttcaaagataatgctccactgaaa

SEQ ID NO: 59803 - DNA, 1587 bp, Bovine  19866881282774
acctctctgtaccaggtctcctggactggatcccattctccacccaggagtctccgactgcagagctcagggttcagctaaccaagctcttgggatgcagttggcatgaggattcagagaggggcctggaaactactcgtgggcttttctaaagagaaaactctacttgtggctttttctggagcagaaactctacctggggctttctctagagagaaaagtggtatctgagtggcttgaagaggacagtgcatgtggaaactgacgatcctggagaagaggtaatgaaccagagaagggggcacccgtgaaaggcccagtcttaaagagggttcccttttatcaaacaataaagaatccagattagctgaaatttcagccaccaaatgtgttgaattaaaagttgttgcactgtaacaagttgtaaattatagtattcttataaacagtgttatttttatagacagtatatatacatatgtattatttctatatatagtattcttataaatctcttctgaggctgcttcaatccagtgagctggttcagagaaagctaactacataaggaaaaggtctgtccacttgatctcagttttctcctggacccttataggaaaaggaagtgttgatttgggggaattagaacgcataattcctggcgtctcctcctaactgcgtctaagggacacccacgaccttggagctatgagggagctgggatgagtatgaggaagaacaagaacaagtgatcactctgcagattagtacagtcaacccttcagcctgcaaaacctaggatgcttttattcacacccatactattataatgccaatgtgacatttccagtgatccttggttttccctgatccttgatcagttgtgtccagctcatttgcaaccccatggactgtagcccaccatgctccatgggattttccatgcaagaatactggaactggttgctatttcatactccaggagatcttccggacccagggattgaaccgcatctcctgcattgcaggcagatgctttacctctaagccaccagggacacccatgtattttcccataaattaacataaattcttccattatattcatgcacttacaactcctcgtggccatctctcttccaacattttcgaggagcccaacacccttgatccctcttgtaaactggagaaattgggccatataacatcaaaacacacatagtctcactaatggcagaaaagagtgccagtaaaatagagggctgggtgatttgtaggcaactgtgatgactcaatacattaaactgggctgctggttaaaattatttgggaatcccagagagttctcttgtgttttccacatcgggaatccataaaatcgattccttagccccttttcccaatgacaattttagcactctgctcttattcaaataaccacatgccacagttcagtagcagccttcctccaaggaaacactattttatctttgagggtgacatgctctgagcttgggagcgatgaccagtagcacagcacagatggacaggaaatggtgtgcctttcacagcatgctgctcctatat

SEQ ID NO: 59804 - DNA, 1618 bp, Bovine  19866881298770
agtactggagtggggtgccactgccttctccgacctaccttgaatgactgttaaataaaagtctaaagaagtggagaaaaaagaagtgtagttaaagaagcattgatttgcattctgctgtccccccaggacacaaatgttaaattaagaaaaggataatcacatcaataggataaaataataagtagacttgtcaagtggcaagagactcagataattcttcataaaattgtcagtcctttattaccaacttccctgaagaattcaaagcaatgacttcaaagtccccttacgattctggaggtctgtttttgcctgggtatactgagcaacctcactgatctctgcaaaactatcttcacaaagaaacagcttggttattccctggagaagctcaggaaaagaaataccttccacttcctttccaccttcttcacatcattctgagagagtaatttccagcccccttgatgtcaagtgaggcaattaaatgatgatcctagaaaaactgatcaattccagctacttcttaaagggttaactctaaagaattaaggaaacacccgtccatgatgcaagacatataccataaaatattgctactgttattgttgttgttagtcactcaatcacatccgactctttgtgaccccatggacggtagcctgccaggttcctctgtccatgggattctccaggcaagaagactggagtgggttgccgtttccttctccaaaatattgctaggttcagacaaatagtgttgatggtgctaggcaagtacctcttgtttgtgaatattcattggaaggactaatgctgaagctccaattctttggccacctgaactgaagaacattagaaaataccctgatgctgggaaaggttgaaggcaagaggagaagcaggtgacagaggaagagatggttagaaagcttcactgattcaatggacatgaacttgagcaaactctgggagacagtagaggatagaggagcctggcgtgctgcaatccatggggtcacaaagagttggacttgacttaggaactgtacaacagtaacaatactctggaaactagaagaggcaaaagcctgctctcagcactgttcagaacatcctgttaattgagaccatccctgtctcatgcatattcaatctacctgcagaggggatccacggtgagcatgcggaaggtgcgcttgtcactttctgcaactaacagccttgggcaggcatcctgtcccatgaaggcatctagaaaagtctggattctactttgtgtttgctaggactggttccagtagaaactgcccctataaatccatttctgcctctttttaaccactttggaaaccctgcttatgtgtctcatatcaaccccacactcattctcctacacttcctaaaaatatgctctctgaccgagcaaactttgagaatatcttgctttgcaggatcctacctccggacacttgagacaacagttgaagtgaaatttcctctggcagtcagcaggtgccgaaggtatgggggagctgctcacagaaagcgaactaaaccagggcgctcctggggcagctgtgaagtcacactggggcacacaatgcctgacccg

SEQ ID NO: 59805 - DNA, 787 bp, Bovine  19866881345115
aatagtggaattaagaatgacagaaagccgttaattgatgtaatttttttaaaaaaagaaaatcagtatactaaatttttttgatgttttatggacttgaaacaaaatgtttttcacttatagacaggtgattggagttcatttttttagatagttctatagctgagaagtttctagtcggtgtacacactcatctatcttctctagggctcatgacaggtattttccctgagctaatcttcccttgacacatttctgaaacataagaggaagccaaccttaactctcatgtcaaaaacaaatgcacgatatggatacttaatagatgctgagagcaaattagcagtaacaagttcagtgttatttacctatgaaatgaagttgagatactcagtgacaactgcagttaccaaaaagcatagaagctatagtgcaagagagcaatttctcttccatctaattgtagtgcaattcaaagcaggatattattaccaactaaatgtcctatagagtacacgagtccaatgaacaccgaggaacttctggagatacttatatagaaatactggtttaagagggaacaggaagtagtatattttattagaggaaaaaaaagtagatttaaatagctattctgacccgctgtgcccacaacgcattaaatatcctatagttaaaatttctttccgcagtcttctgacaaggcactggtttctgtttcccaacacttacatcaagcagtagaataacccttcgggggtttcctacctgttaaactgggctactg

SEQ ID NO: 59806 - DNA, 1024 bp, Bovine  19866881398775
aaccaaggccagaacccctttcttgaaagtccttctggctccttcctggctccagcactccttacaagactttgtactttgtgactcttagggttttcttcctccaattcccctagcctgttggtaggtagaccagaggagagtaacacaaacctaagtgatgcaatccgagttcggagctataagacacagtgggatggaaaggaaaccgaaagatactattacttagggtgagttactatttcttaactgtatgggaattttctcgatcaaagcgtgtactcaatcttgctgctgcgactatttcagaggccagctttgcctgtacttctcagtgatttaatactgttggtaataaatgtgctgcagtaatgaacaaaacgtaatggactgtgttggcaagtggcatggcttgtgactgtcccacttaaggttttttaaattcaatgcagtgctgctctggttccttgagaagctctaatcttgtgtatatagataaattgtaatatctttttgaatttgtacatgtaaaaccttctcagcaccttttctcaggctgtttttaatcatttgccaagaatataaaactcaaggtagtcctcagtttccaggccaaaaaagaagaactggtatttatggtaggtttaccattgttttcacacattctcattaagggttttgcaaataggatgatgcatttacatcagcagtaatgttcaatggtttggtctattgaacaaatattattaaagaatagctgtcaaacgccttttttctaaatatagagcttatgattggacttcacacaaaatttcattgtttctcaaactttattttaaatcagactcttacctttcttttaaatgaaaatgaaagtcactcagtcatgtccgactctttgcaaccccatggattgtacagtccatgaaattctccaggccagaataatggagtgagtagcctttcccttctccaggggatcttctcaacccagggaaagagcccaggtctcccacatttcagg

SEQ ID NO: 59807 - DNA, 1580 bp, Bovine  19866881647070
tgaacccatgttccctgcattggtgggcagattcttaatcactggtccaccaggaacgccccaccaaggcatttacttatgtgtggaccaagagtgagtgtgttcttcagtgccatttgccttcagcatacacgaagtcatatctggaatcaagtagaacagcaccatgtctccagcccattatagtgaggtgtgagcctgcctgtatagattaatgctctagccagcttcccagttaacacactcattaatttgtctccatcgagagtagatctttgtctctacttacttacctagtctcttacctcttctgagaggtataagaaatctttttctttctgtttggttggagaatgttgctatatgagtttttctttttcctttttggactgttctgtaccctacttttagtattattcattgggtactaaaaatatttatatcagtccactgtgtataaaagctactatcaaggttccaacaactttaaggggagagtctagtgatcaaagaagcaaagtcttattccaaaatggcatttgtttgggaagtcacagccctcgagagaattgtcttggtcttccccctgagcctgttaccctgccgcccactggaccctgcttccctccacgactccctccactcctatcctgggcttgggacgatattactctgctttcttcataatttttatcacttgttgaactctcaaatttgttggtgtacctattaattatctgtctcgcctccgaaatacaaacactctgaggggctttgtcagtcttatactccattgcattctgggtgcctagattaacttagcacttaataaatgaatacagggccaggggtgagggtctggaggcccaggatcagctgtcccccaagaggcctcctgtggcagcagggtcccggagatctctcaccaggcaaggcaggtcatggcctccccaagacttgcatggtgatgatggcgtgggctttcccagcagggttgggggatgctatgtgttcagaattgtaagagttttcctaattcctttaaagagggaaagaaggagaatgacaccagccaaggaatccttgaaaaaagccgcctgcctattgtctgttcccatttctctcctcattcactgtgctaagcttttcagatgtggacgtgtggctttctgagagcaggaagagctctcggtgtaatcagaggcccggtgatgacagagaacattccgtacctgtctttgattacttgggtaagcttaacctcaattaaggagacagagtgttcacctgatgggtttgcggtgggcagatggcgctcacacagctgttccaggatgccaggtggagggagggcgttgagatggaagtgagggcaccctcttctcagggagtcaccgtgccatctgctccaaggtgactgtgtttcaaaggaggcacgttaacttgttcagggaatggctttgcaggacagacgttgctgtgtaagtcacctgttggggtgtgaacgtgtttaaagggaggggagcagtttactccctcccactgacgaaagcaggaaaagaacaggcgcagtgtgtgcg

SEQ ID NO: 59808 - DNA, 2575 bp, Bovine  19866881673114
tttcaaatgagtcagttcttcgcatcaggtggccaaagtataggagtttcatctctcattgcccgggtgttattttttcctctgtaaggtgaagctttgacttagctgatctctgaagcctatcacaccttaaagcaacctgcatctctgcacaacctgaccaatttttctgggcccaaggaatcttcattctttgccgctggcataccacgtgggtcgtcaggcggtgtatcttctccctggtgttgtcctgtgtttagtacagctcagatcctgtatttttttccccacagtgagtcaaatcacttgcctgtgtctggggaaacggccctgatgtccccaggtggctcagttgcaaccagcctgggatgataatttatttgctgtcattccgtgtatacatgagtcccctaaatacatataacaccactttttatgtcctcaggtgatggggtgcttatctagcttcagggactttccagcgaagaatttcttgaccccaggcccagacctcaaagggccttaaattccactgagtgatcttcctcctttgtgtaattggcccaattagtaacgtagattttctgcaaaagctacaacctccatccgactgactttggaggagagtgaataccttttttacagaataactctgggaccagtttcatcctaggagaggagctgagtccactacggcctttctctagctcatccggcatcacagctcctttctggagaaacgcctcctatcacgtttcgccagactctctcgcttgcggtctggtaaagtagctcagaagtcatttaaactaatgggccaaaatgtctcttgtgggctgtgacagtccctcctgctgatgccagtaccagaggtgtctgagaagttttcttcacccagctgttcagttcttgcaggtctttagatgaagaggatgctttcaaacaagacaaagaaactgagtccctgcaggcttttcttctatctgttcattcaaactggtgttgatcacaacaattcagacacgtaggagatcgaggatctgatttatggcagagacaggtttgcaaatagttttaacagagggctaaaggagatcaaatatgtatgagtgagtggctttgcttattatactttaatcagggaacactgaaccggatgctgtggtttgaaatgtgtgttaagatgcatggggatatgttgccaatgtatccaactctaatgaatatattttgcacatgtcataatattgtatgtttatgacattttttcagtacagctttttaaaaaaaattggagtatagttgctttacagtgtcgtgtttctgctgtacagcgaagtggatcagctgtgtagcgaagtggatcagctgtgtggtgtacacatgccctctctttaatggacttgcttctcgctcaggtcaccacaaagcatttagtactgttccctgcgcgattcggtcagttctcattcttatctgttttctacacagtatcagcagtgtatacacgtcagtcccagtctcccaggtcatcccacctgggccccattttgctcttggcatccttacgtttgttttctacatctgtgtgtctgtttcagctttgcaaatgagattgtctataccatttttctagattccacatacatgcattaatatacaatatttgtttttctgacttacttcatcgtgcattacagtctttaggtccatccacatttctgcaaatggcacaatttcgttgaatacaacttttatttgctttcattatttttacttctgggcattcctaaaactgtctgaatttagtataaattcaaactactgagttaacttttctcttaaattctggagttaggacatttatgattcccactgatcaatctgcaacttcagttttgtgggtgactaattccaaatgggtgaaatattaaaaccaatatggacacgtggggctgggtatcgataacactgcaggaaggcaaagacaaggcccacctacttagtattaaggctggttggtggctgtggaatagctaagctgaagttaagtgccctgtcttgcttgttagcttgttaccgattactgtaaggagttagtcagacctgcctttgcgtttggatattcagttacagggctcttgtgtctcacatgaaaggttttagctggataaacaatctctttatggctgcactgtggaaatagaaaaagtttaagtgtttcttctgtttatactctctctctgcaaagtgataatatctgtaaagtctccagttggtatttgaatggtaatggggcgtgcattcttattcttatctaggacatgcataaaatagcaaactgtgtgtaaatatatgccagaaagaagccgctcttttaaacctatgtgggaagttcatgtggctgaacacttgtgatttctctgacttccaaattctttgatttttcacattttgccctggttttctgtcatagaactgtactggatgccatgactggttccatttaggagaagttattagagtttctatgggagaacaattcctctggctcctaaggagccatctttttaca

SEQ ID NO: 59809 - DNA, 1358 bp, Bovine  19866881866721
caatcagttttgattacttcctttgaaatgtctaccagtaacaagatggatcaatgctcttactatgcaaatgtttcttatctatttctcagctttcagatatccagacactggagacagttaccagcgtcatagaagatatagaccctcgcctcaaagacaacagagtaatgattcacaccagctaacaaatgcaccaggaaaattaaacaacaagaaaatgatgttgtatagtatcctgataacaagatgagcttcccaggtagcacagtggtaaagaatccacctgccagtgtgggagatacaagagacacaggttccccgaatcagaaagatcccctgggggaggacatggctacctgctccaatatccttgcctgggaaataccatggacagaggagcctagagggtcacaaagagttggacacaacttagtgactgagcacgcacacacgcacacacaataacaagacagggacatcacctcactagccccacagataaaacattttaaatattttgtcacctcaaaatcaataccatacatgtaaatttcagatatttgtggggaaaggctcaatacatgttcccattgctcccactgctacctattccagaatattctcaagaactcaaacactacaggtgtttggtgggtacgggcccctaaaataagtgtcagcaaagggaaggagcagggcaggagctctgaacttgtacagaaaacgaaaacattctattcatgcagctctacatgatgatctgatcttggcctagctccttagccttgctaagtcagttttcctcatatgcataaaattaaggctggattaaataacccttaataccgtctagctctacctacttgaattggaggtaaaattatcttgagaaataatattcctagattcccaacactcccattttttcaagattctattgacataattcaagatattctacagttcagcttttgtttgtttgttccccccaaataagtgctttatctgaaatttttagtgtcaatccaacattaaaagagaaggccactgggtgttgatatgaacaacaaaatcagctgagtccaactctagaacctattacagctcacatgaattcatgcaacgaatactgactgaatgctcacaatgcccaggcagtgttttaagtgcctgagatagatcagcacaccagacagtaattccctgcccgatgtgcagcttacattttattagaggagtcaggacaaataaaccaataaacaaaaagaggtgacatacatactgtattagaaagtgataaggactacgagaacagactaaacaggagtaggcaggagggtgggggtaagagggag

SEQ ID NO: 59810 - DNA, 2577 bp, Bovine  19866880245079
ccttttctcctttgcttttcgcttctctttttttcacagctatttgtaaggcctcctcagacagccattttgcttttttgcatttctttttcttgtggatggtcttgatccctgtctcctgtacaatgtcacgaacctctgtccacagttcatcaggcactctgtttatcagatctagtcccttaaatctatttgtcagcattaaaaggaataaaaagataggagtgagtaatgaaaatatggccaatcagggtggtgacatgttggaaattcccagaagctaggaagttgtgcttcctaacacaagtttaagggctagttctgacagcttgggtttagatacacaatttgcaaaagaacagggcttattttcaaggtggcaaacttaacttccaatctttctacatctggtctctccagactgaaaattcactatgataagaaaggccaaaccacaagtttcaaggctacattttgaaccacttacctcaacttccacccttgtgaagggctggcaccaagtaagcacacaaagttgaatgctgaggagaaaagagagaaggccatttttatgtggtactacctaaagttgctcaaccatcctttcctgacaaacaagcaacgtttgtcactctttgtacgtattctgcatttataaatgccctctgctgctttaccctttttgggcttagagacctattctttttaaaatatttaaaattttttattatacattctttttaatattcttttcctttatggtttatcatgtgctcagttgctctgtcatgtctgactctttgcaatcccacggattgtagcccaacagactcctctgtcttgggatttcctaaaaatactggagtggattgtcatttccttctccaggggatattcctgacccagggattgaacctgtgtcttgcatcttctacattggcaggcaaattctttatcactgtgccacctgggaagcccccatggtttatcataggattttttttttttaattggaggatagagaactattcttgatattcaaaagttaaattgccaaacacaataccaaatatgtatttgtgggtcagagccacaggtcagcagaaggaaccccaaatttgaagtctctttgacaactaagactcctagacctagagaaaactactcacagtcacattttaagatatagtaatttgtctacagaaaaactcctgagtagaatattatgttactaaattatttttaatagtgaaaaaaaaatgtgggcccataaaaataaaagccaatccacattatctctcattaagtaagtttttctttaatgattaacagagagctttggaattcaatgatgtaaatattgatttgaaaattctgaacactattaaaagaaaatgaaaccacacacaacatctctcgaaactcaacttgtccacactacagacaaaccaaacagcattttcttatggaattctcaaggacaactgggggaaactgatttggacataacagaccccagtgctaaatataagatgatgggagatgagaagataaggtaaaaacgggagggttaccacacaagtgcgacgtgacttaagatgaaagttgtttctttagaagatcttgtgtttgtttacaaatcctaagatatctttaactctgaaaatatttttttcctttcttagctgtattctctctcccatttttcctcctgttacatacttctcaggttagaagcctagattaaatacttaaccacgctatttacccccaatctcctatttgaccttcatttccactggtccagctgcaaaaccaaaaaaagtcacaatgaacccaaagtcactatctctaagcagacttgtaaaggccctgaggatgacatacctcaggaaatagaaatatgttatccctcaattttcaggtatttttttcctaaaatgttctcatactatttgtttctgaaaaccaggaattccaaattagtaatgacaggaaagatattctagccaagggaataaatagatatcctttacagtttatgtgccctatttttagtgttatttacttaactctgacgaccaaggactaaagcataacaggaatataaacgtctcacaagtatcagtgtttattaacacatgtaatcagcccatctattctgatttaaatgtgttatttcaaagcaatttacatacacaaaaaatggagaaaataagtttgtagtgaaaaaaatctaattttcataagttgtttggattgtctacaatgtatttgaaggcaaagtatgatttcttttaaatatttccaagtgatggtcacctatccatcaataatttgagctctgtgtgtaacagtatcaaaaggcattactgcataagctctgggaaagccctcaaatccaaaatgttgtcttttttttttttttaaatttgggggaaggtttgtcattttatttttctcttctgcagcccaaggccagccaggttccttgaggtgaacactgagggatgtcaatgttgtctgagcaagtaccaaaggaggcacctgaatagggaggggaactaaacaaaagaa

SEQ ID NO: 59811 - DNA, 1816 bp, Bovine  19866880424343
ccctggagaaggaaatggcaacccactccagtattcttgcctggaaaatgccatggacggaggagcctggttggctactgtccatggggtcgcaaagagtcggacacaacctgagtgacttccacttcactttgcccttcaggctttccctaaagccccaacacaaagaagtctttccttttcatcctctaaaaataattgtacttgtcttttgcagacatcatcaccagtttatgaagatatgtttatttttaagagacaagttatttatcatctatcttctttatcagatctgactggctaagtcaaattctatctccatcagtttctaaatgagtagccttggaatgttccctaacatttctgtgccccagtttctgtaagaaggggctaataaaagcccctgcctctggggcttgttgcaaaggcacagtgaaataatcaatgaaggagcaaagaatgggatggattcttaatagaatttaaatattttactcatcattatgaccttatcaccatctcgttcatcatcaccactcctaccatctccatcagcagcaacagcatcatcatcttcatctttagaactggactgtgtctttcttgttcaccattgtatcctaactgtcttagcatataataggactcagaaaatgcttagtaaatgaacaaatgcttctctgtaaacacaactgttctcctaaggaggcatttcctttgagccagtaagttgatcctccttatttttcaagtggaaaaaacaaaacttttccccaggtgaaaacacttaaagggagcctgtgatggaatcccaacatgtcacgtgtgcctggagatattttgccggtatattttatgggaaacatttcgaggctgtgaggaagtgtaattttccttgtgaaatgtctaggtttcttttctcggtcatttttcatgtgcttgtcactttcccagactaattggtgggctcctttcccccagctgtctatgcaggctctcgctcacccagcctgtccagcgctcagtgcagcccacttggggtgtcaggagaaagcacccaggaaaggagtcaggacatgtgagctctgtggggcttcaggaaggtctctgtctttccctgggcctcagttttcgtatccagaatatgaaaagttttgactagctgtttgctaatagcgttgcaatttctaaaggaagccagtgtctcaaagttgggccatttccaattctgggaaggtctttgcctttgtgctgttgaaccttatgtactcccatcatcgctggggctcaggggcccccaatatttcaaatcctcagagtgcagtaactggtaagacagctctgcttttagagtgaatgcaaagcccactgctataaatctgtgcacagacagttttaattgtggatcttggtcacagcactgcaagggggaacagaggcctgtaattcagttcttctgcactgaagggttgacagtcaaccactcagcactgggaggaaaggcagccttcaataggggacccaggctcccacttttccagataacctctggaggactaccatgcaagggatttgtgggttccaaggacctcctggaggaacccaggctgactgttggaagggctggcagcccacgaacgatgaccttgaggtcattaggagaggacagggagatttcctagtagtccagctcaacctgcaaaggtgggccattttttctggcagagagggactttaggtatgacatcaaggatgccactcataacagcctcttacccagtcttcatgggattttcctctaagggaatagaaaaat

SEQ ID NO: 59812 - DNA, 1774 bp, Bovine  19866880439261
atttaattgttgactttttccaattaaaaaaaaatgcgacataccatggaatattctaaaagttcagcaaaaacaaatacacccagaaaacaaatactgtgcccacaattccagcttctgagcaagttgggtagtctttgaacatggtgactgtggatgcagttttaagggttcaactacctacagccaaacctcagtcctagcatatacagccatgtgattttggacagagtcacttgacttcttgtgacctgcctccattcactcaaatttaaatggagatataatagtacctgcctcataggataaatatgaggaataagtctacaggacttagaatagtatctggcacatagtaaacatgacaaagtgtttttacctaacattatatttaatgtctgttttgacataagtaaaggtttttcataaatgtttttttgagcttccacaaagttctataaagggatggatcagtaatcaccaggggcgagttcaggaaaccagggaggcaaaggacagggcttcttgttggtgccacaggctggcagaggctactccccaaaacctttatttcaggatcccttttttttttggcagcatcctgccacttgcaggatcttggttcctggaccagtgactgaactccagtcccagcagtggaagcacagagtcctaaccactggaccaccagaggattcctggggatccatttttcttcaccacctcctgcaaaacccacccctccctctgctatggatgccatcacctctctgcccgcacccaggggtctcccctccagctccggagcgccttctcctccctctgcctgctttgccgctgacagctagaagattccaagccaaccattttgtagaaggtccctcgtctgggtttgtttgatgtttccctttgattaaattcaggttatacatttttgagaggaaatcacagtttcatttcttcacatgaaaatattgaatccatttggaattaatttgggtataaatgatatatttttcctcacttatatgaaacacctcctttatcatatagcaaatatttaattgcatatcttttatctttctgctcttcaaagccagtgtcacactgttttaattaccctggcttcgtaatatgcaccccccaaacacggtaataagcagagtccccctaatcgtgcttcttttctcagaaacttcctggctcttctcgctcattaaatcttccagatgcaccttagaatcgtgttatcaagttccttaaaaagtacctttgtgatttaggttgtcgaactttgaaatcactgtgggcaaaacgggcagctttaatactaaaccttccatagaggagcagtgtctgtgtatcatccacactttctgtgactcggtaaagctttgtactctttttcatgaagttcctgcccttttctctgggagctggtgactacttttgagtctcttgtgaacagactcatatctgtttttcattgccttctctgactgatgagtcgctgacaggataacacagaggctaaggtcagagtctcttcagatgactacttgggtttgaatcctgggtcgctcactcatataccttgttgtatgaggcaacccatgtgcctcagtttccacgtctgtgaaatggggagactgacgtcatctgcctcccagggctgttctgagaagggaccacagaaggatacctagcccatgtttaggataaccactgcaatttcctcacaggctccttacgacccctagggcttcctaggaga

SEQ ID NO: 59813 - DNA, 924 bp, Bovine  19866880712099
ggtctttgttctttgacccccctcctccagagcctgtgggtgatctttccacacgacacgttccctatttggactttgagaagtaaaaacccagccgccactgctgtgcacccatacttgagcctggaggaatgttaaaattcagctggagaggtgcctagtgctacagaagcctagatttttttaaaaaagggatttcaggcaagaggagaaaataaagaagcaagacttaaaatgtcctgtgaaatggagagcattgggccccccagcgcagacatccgtgggagatgactcctttagaaagcagtgagttttgtgtgagcacagatgcattttgttttcctaggaggaatcgatgattaaattatcagaaaccaagctcaaaaccaggctgcctgcatcttccccagccgtccccagtgtctcctgcttatgaggtgccagctttatctcggaagctttagtttaaatgcccaacatatcttattaatgaaagtaataagctgttgtttatatatgtcataatggggaatatgactatttaatataaatctgacatttaaattccgcttagttctgagatgtggacgatatcaaggcataactctttaccctggagtaaaaactccctgggtctgcattttccagcattgaagttttcaaagtaatcaggttccctttttttttttttctttccagaggaaccaaattgtgaagacatctgttctgttattaatttcacataaatcttaagctcctcaaggccagaaatgaggcttcattcacgtcgaattaatgaaacatgattgtaagtcccttgcatggaaatgctgtcacacaattctgagctgcttagtgcactgagtaatctcagaaactgccaggggacagccacgtgaaatccaccctcccctcccgccgcca

SEQ ID NO: 59814 - DNA, 622 bp, Bovine  19866880714809
atgggtttcatatccggagggagagcttttctcatcattggggggtaacagagccatctggtacccccagaaggcagcacgcagacaggcgtctgggtgtggtttcttttcggtgcctgaatcatttgcaagaggtcgaaggactagaaaacacagacaattatctctcggctgctaggacatgagggctggaaggccttggagatcagttggcagagtggttttcattttctttctagcctcagaattctttcttctttcaaaatatcatgcagaactctaattataaaagagataaaagcagaacactctggttaaggtggggatgggggcctcaaaatcccacccactgagccccagaccctcctccttcagcagcttctgtgaagcgcctcagggctcagcagaacatacatttagaaccaccacttcataagcttccttcattcccaatcctgacactcagagagggtaagtgacttgtccaaagtcacacagctcacacgaagggcagagaagaaacaagcaatgccagttataagatttgtctgctttaatgactaagcttcagaagcagataatttgctccgtggccacacctggcctgccacgtgctttgaca

SEQ ID NO: 59815 - DNA, 2195 bp, Bovine  19866880898909
tgtgggaagacctacaccccatcctctaggactcaaacatgagagatccaagtgacaaaaatatcccctactcctgctcctcgggctcctcctcagcttgaattttatgcgaggactctgatcagtttggctcaagctggcaggagcctttgagcgtgaaacgtgccctccttccctcttttctctccctgtctgtggcaacagacagaactgaaataaagaaggaaacagacaacgcttttctttgcagcggctctgcctcttcagacggggcgtctgcagcacacccataatccttgtgtcagtctgctccctagcgtcgccggccgcgtccagcatctgacaaactccaatctgcagctgccggcagctcctttctgagaagcagctcacagctccagccgccctcctgcagaagaggaacaaagcccagcggactatcttgctatcttctgggtggcaaggaaatctcaattatacacccaagggatgtggtttatgaaaaactagaaagaatgtttaaattgtatacgtaaattgttttgttttacaagctggggtaaatcagcacatttgcagcccatatttatctgatccactccataagactctttctgaatgtatgccattgatgtggggggagatgcctatgcaagacataaccgaccccctaaattcaattagggcattagcaaggggagaatggaaattttgctctggggttagtccacactgctgagaacttctcggaatagttccttggctgtaaccgaagattgaaatcgaaggataaaatttccaacggatgccgagtagtcagaagattggctcgggctcgcccttttaagaaaaagatggcaaaggaaatgccctcttcttgcttgatttctagctcattttaaaaactctcttctttgtgtctcccccaacatagcagagtcaacatttattgaactagatataaagcttcattcacattctctattccaaggatcataaatggtggaaaatgggaatacaaaattccacaggacaaaccataaattgggggaaaaaaataccccaaggaaggaaatatttgaaaacaatgttttatttttatacaactcttagcagcagagcacaccccagggatgtggttgatgaaaaagtaggagtgtttaaaccgtgtatgtaaacttattttgttttgcaacctggggtaaatcccagatagaggtcacagtgatgagaaaagtttgaggtggcaagggaagctaggcaggaataatctcaaggctttgaccgtgggctgctgagccctaatcactgataacaaccgtcaagctaccgaggggctccacttcatatcgatgtggcatttacttctccagaaagtcccccattcggaccaacacttagggtaagataattaatagtcccttgagttatagattctgagttaaaggtaacagtacataatagaagtcaaggtcatgcataatacagtagcttctataacaaaggggattattaccgcaattaccgtcctattagaaagaaagattttagaagttttcatcgttttaattcttaaaccttcctcttgccactgaagtttaagctcaccaatttatgatagaggagtaaaaacaaaagctttcttccccgagcgtccaagtggctactggggaggtggagaggcagagaatggtgatcctatttagcaggaaggcttttgagaagtttccacagactggacctgtctactttgctttgctccttcctgtgttgtatcaagtacacactcaaatcctaccttagatgtaacttttttcttttctttttttgctatacaaaatgggaaagaagtttctagttttgtgtataacattatttattcattttcaacagataggattgattctattttcctttggcagccactgattccgccccccgccccaccaggtcacaaagatttttgaaggcccttgagaagtctgaggctctggccccttgcctgttgtgtccagtgaaggcaacagctctgtgtgccaagacctaaattggacttgaacccaagagcatgtttcccacccaaactatttagtaactaaatttgctcctggctggaagaaagctagttcctgtcctttaaaccaaagcaaagcctaaaaaaaaacctgttttaaaaacttctttaaaaaaagagt

SEQ ID NO: 59816 - DNA, 1635 bp, Bovine  19866880899411
aatagtaatgaaaaagacgaaaaagagaaacaggacaggtatttgaaatataatagccagagttggaaaagtgtattcataagctttgactttatttccaaaaatatacactgaggaaaaaattacagagtataaatatgtgtatttacaaagcaatatatcccagtattattcataggaaaaaatagaagtaacttaaatgtttaactagaggaaattggataaatatgttacatctgaagcataggatattatacagtgcttaaacttacatttttgaaagcttacgacatacaaaatctttcatgttttattaagcaaaatggggagctcgcctgacaaatagatataaagtttatagactgaaatgtttaaagaaacttgaaatgcatgttacttttattttttattttgctttccggtttctcaaatcaatgttctaaaattaacacatatttgtctttgaaatcaagtttaaaagtagcgactatcttttacaagtgtaaatattaagtaaatttccctgaaaattttcaatgaaataaatggtttctaggaaaatataattgatcaaaattgattcaagacatttcaaaactatcaaaaaaattgcctgtgaaaaaaatctccagggctagcctgtcttattatgaatactttcacatttccaggaggggtcaaattaattccactagtatcattccaaagttagaaaaagaaagtttcctgatagtaatgcaaaatataatgaaaatagaatagatatctatagcccagttgcacttataaatatagatacaaatattttctaaattttaaaaaatgaacaaatttagaccaataggatgttaaaatataacaaacaaaataagattccaaattttagttatctcagaaattaaacaaagggtttaacatgctgaagttgaagctccaatactttggccacctgatgtgaagaggtaactcattggaaaaggctctgatcatgggaaaggttgagggcaagaggaggagggggcaacagaggatgaggtggttgaatggcatcactgactcaatggacatgagtctgagtgaactcagggagatggtgaaggacagggaggcctggcatgctgcagttcatagagtcacaaagagtcagacacaacttggcaactgaatgacaacaacaataacaagatgaaattttatatcaataaatcaaaggacacaattgtctaatcaattcaatagataacaaaaaggaatttgatcaaattcagtatccagttcttaataacctggaaggagtaacatatttctttactgtaggaaagtctggggtagtagataaaagcaaatgtcagtaccaaatttcatggatatgaatcctggcttcctctactcactagaaacaaagaacataatcctgactgtgctggaagttctagcctcagacatttttttttttttttttttttgcaattggcatgatgtctatctggaatattcaaaagaaaactttatagttttataagacacttttgaggaaaaggtacttgggacatgagaaaaaacaaaaattcactttgcattgcaaatccctttctactgctgagaactttaaaaaaatgtttatcataagcaggt

SEQ ID NO: 59817 - DNA, 1875 bp, Bovine  19866880954937
tgatgttaactcccttagctgttttgttctttggagtagaatgtggagccatttcttaattgctctatatttagctttgtttaaaaatctataatttaaaaaccaccaagggctgggctggtaattcagcttccatggtccatttactcgttggcttttgcttctgagccagcccaccaaggtgacagcgtgtgccaatcacgatggaagtatttgttagcagaacatctgctccctgagagctggtccagatctagttgccaaaccccagaactaatctcaggaccccttagtttagtttcctgaaaaggagggctggagagggacagcagaacagctggggcctagtgcaaggggtgggaatcatcattacatgtccaggatcaattcatgtctgggttgtgttacttattttttatttttttggccttgccagtgacatgtggaatcttaattccctgttgtttagttgctcagtcgtgtccgactctttgcgaccccgtggattgtaacctgccaggctcctctctccataggattgtccaggcaagaatactggaaggggtagccgttcccttcttcaggagatcttctggatccaggggtcgaacccagatctcctgcattgcaagcggattcttttactgtctgagccaccaaggaagcctcatagttttattgtctacatttatataatggcgagtaaataagagcctactttagtgtgactgaagttctgagctccacaagaaagatgttagcattgaacaggtgatacataatgtattaaaaagcaattatttttttctttccttctgatggctggtagcttgcctgtttccccttaaatgtatctatttcctacacgatagctctcaaaaaataataataaagctggcctttttaaataagaacactgattatggaggatgctttgtcaggttcgcaggggctgcaaagtgtgtagaaaggttatgctggtcaacatgatgcaaggtgggtggttatttattcacataagactctcccagaacaatccagaaagagaagcctcaaagacacacttgaaaggtgacggtaagagtggaatgcatcagccaacctgcgagggacaccatcaccctgtctccctaattatgggcctgttgcaagtctgaagagagagttctctgtataaaacactcgaatacagatcaacgctggagcctgtgacaccccccttctcttcccccacactgcctgatcgagatgcttctgtacttcagcagaacctggaggcgggaatgacacttcacatcactaatgaacctgtagccgggcatctcagactctcatctcctctgcctgctttgccccagtccctgtccagccagcttggggacagtggagtagtcgctgctgtgctgagtgacaggcttttggcctccaatcagccaaccagtgatttgaaacagaaaaaggtagtcttgagatttgaatccaggacttgctacctccaaagcccatgttcttcccactaagaaaatcccatgggcttccaatggtttaggaaaaacaagatatgtcagtagcctggcattcaaggtctcagtttccctgacccttcttctatcggccagcatctcaaatctggcatggacagcctctgcacttatcatttccagaatgctctttgaactaccttgcaaacactctgtatctggaatccttgcccttcatctctcctcccttatgctgctcatagcttaacataagctctgggaagcctgttctctcctcttcattgggaggtatacaacctggtcctgtgcttgaccgtctgcttatctgaatcactccatccccaaacatcacagagcaagcacatttatagca

SEQ ID NO: 59818 - DNA, 2559 bp, Bovine  19866881038089
tacccaagctcaccaggctctctggtggtgcaatggtctggcacagaaaatctatttatggggatggctgccatagataaccctggggaaagaggctgacaaaaggaaggaaattgcagtgtcttcaaaaggccaggtggtttaggacaaagttgaaaatcatacacaatgatgtaaatcaaagatctttgcaaactggtagttcttgggctgaacttgacctccaggattttgtttaatccacacttggcccaactcaagggtttcatcttaaaggtgagtgtgttgccactaaataaaaataaggaaagttcacagaaaaatctctgaattgccccatctcaaaatcagaagatccagctacattgtgtccactcctcctcacggcagcagtctctcggtctcaattcctgccagctgcccctttgtatgtgactcacctgacctcagcagtaatttaagttagtaagccctaatttcagcaaaccctgagcttataccatttagtatcacagacctaaaccggttttataatagttccaggctacagtagaattgtctcttgggtggctattttccagtgagtaatcagcaatgaaacactgatataaaatcaggatgagtctttagaagtctagaatcaatgacccagtaaatgttcacattctctgccaataaaatcaaatgaaaaatgtaataatctataaaaatgacagtaagagaagctaactaatgacttaaaaatcttatattcattgattttttttctcttttttttgcctgccattgtgactagaagcccggtgaaggcagggactttgttctgatgaccgccatatgcccagtgcctaaaacaatgtctagtaccctgtaggcatttaccaaatatttgttgtgcaaataaacaacagtagtagttgagccattgctctgagcagtttataagtaagatttcagagatgctctttaacagatgaggaacccgatataaaaagcaggtaaccaacatgcccaacgtcacctggctggtcagtggtgcagcagaccacggaccgttcctggctcctccccaacctcttactgcagctcaatttctcagactgaaactgactaacgaaggctccctgagccagtccaaacctttgaatgtctttctggtgcaaagtacacactcactaaaagctttccaagtttgtgttattaaaagtgttatttccctgagaataagaacaggagggctcttaaagaaacctgtgatctaacaaaaaggccagaagtcaagaagttaaagaccctctcagggatcagtttcaatttctgcttcctcttccttaagccttcgtaggttcctgttttcccatctataaaaattgggaaaatactttctctgacctccttttcacaggaacgtttgctgggcaaaatgtgatggaggaaaatgcaaaacgtgtaatatttataataatacacttacttgacaagtttaaaatgtggtttccaatttcttatcttattgtccccacttctaagaactctgttgatagaccatggattgttaattccataaaaataagaaaagtgaggctgaaaagtaattatcacttgccaaacatcaccgagttttattgtttagtcactcagttgcatccaactctttgcgaccccatggactgcaacacactaggcctccctgtccttcaccatctccctgagtttgctcacacctcacgttcattcagtcagtgatgccatccaaccatcccatgctttgttgtccccttctcctcctggcctcaatcttttccagcaccaaggtcttttccagtaagctggctcttcacatcaggtggtcaaagtattggaacttcagcttcaccatcagtccttccaatgaacacccaggactgatatcatttaggatggacaggttggatctcctcacagtacaagggactctcaagagtcttctccaaaaccacagttcaaaagcatcaattcttcagcactcagccttctttatcatccaactctcacattcatacatgactactggaaaaactatagccttgattagatggacctttgttggcaaagtaatgtctctgctttttaatatgttgtttagggttggtcataactttacttccaaggagtaagcatcttttaatttcatggctgcaatcaccatctgcagtgattttggagcccagaaaaataaagtcagctgctgtttccactgtttccccatctatttgccatgaatgatgggaccggatgccatgatctttcgttttctgaacgttgagaattaagccaactttttcactctcctctttcactttcatcaagaggctctttattcttcactttctgccataagggggggggtcgtctgcatagctgaggaattgatatttctctcctggaatcaattgatattgattccaggggtgtgcttcttccagccccagtgtttctcatgatgtactctgcattataagttaaataagccaggggtgacaatatacagcccttgatgtactccttttcctatttgga

SEQ ID NO: 59819 - DNA, 1443 bp, Bovine  19866881099864
ccccttgtctagatctgttcctccagtgcagcctaagtacaacctccaggattgggtcctgctagtctataatctctctcccttcctgcttcagttcttggatttggcacaagctgccatcttcctagatacagtctaggtttagccttaagcattctggtacccattccccacatcccacaggaagtgtcctttcctggattatcatggcaagatgccatgtacagttgggcaggaagtacactgcacaaagacttccagctggagctatgagcaaggctaaaaccagcttgggcttcccatgtggtgctagtggtaaagaacccagctgccaatgcaggagatgcaagagacaagggttcgatccctgggtcaggaagatcccatggagaagggtgtggcaactcactccagtatttttgcctggagaattccatggacagtggagcctggtccattgggtcgcaaagagtcggacacgactgaagcaacttagcaaccacgcatgcacaaaaccagcctacactgcaagccggaccgtgtgttcttgcaaggggtttcatctgcccagaggaggggggaaccttctcttcacacaaggcaccatcagccttccaaaccatatccgagttacaagttaggagtgatgggtcaggttttcacactactcacaaaggtactacataggctatagtcacagcagggttttagaagagttggattcaagtcctggttggtataggacttgaggcatcacttttctgagttgcctcagtttccctgaaagtcattcttatcatcacaaggaaagtggggctacagagtaggaactctgacccttaccaagcacagaaaacagcacagcctctctgatttcaaaggtaaaagccgacactgtggcctaattattttcctgacctgagaatggcatttgatatagccccactttcagagaattcagactctaaagcaaagagagagaatgaaacttatttccaaggaaggcttggaagtttctgcagcttccccgatgctattgctgattgagatcattcaagagcattatttattcattctctggggttttttggactctgaattcaaaggtttcatttccctccttcactctctcactcttttttcttctctcttatcctctcccgaatatttgttacagttgcatttttcaaaccatttactgtctagagggtaagtggagtgacacagcttataatgtgcaaataaatgggaactaagctcgtcagctcgagtggaatgaattactgtcgccagtgaaatgcagtgatggggagcagccgcccgggagacgggggagggcgtgggcaggtactgctctggagtggccggaataacacttactatgatttatcaaagagcacttgaaagccccttagaggctttaaataggcataaaagaggctt

SEQ ID NO: 59820 - DNA, 2287 bp, Bovine  19866881130376
agaaagaacttaggctcaggactcctgtaccaactctcagcccacagatatcactgaggaagttcatcctcatctataaaacagggcctatattcgttatgaaagtgctttcctaccttgtcaaatactgcacaactccggtggattatttgtgtttaaaagattatttgtttaaacagatctatccatctatctgtctctaatttacttaagtacatcaatatcaatatagtaaatttgaaaaggcagaaaagcacaaaaaggaaatgatcttctacctgaagattgtcaccaggaatatttatccttctggacctttttctgtcttttcctaacaaaactgagatcatattgggcttattgctgtgtaatctgcctttgtcacttactgtgttctgaccatttccccatgtgatgaaacattttttttaatattccagtaatatacactggaatattactcgttcattaaaaaggaacaatattgggtcgcttatagagatatggatggacttaaaagtctttcatacagaatgaaataagtcagaaagagaaaaacaaatattgtgtatttgtggaatctagaaaagtagtacaaatgaacctattcgcagggcaggaatagagacacagcagcagcaaacagacttgtggatagggcagcggggcaggcaaagacagggtgggactaactgaggaagcaggattgacatgcacacagtgccatatgtgaaatagctggcgggaagctgctgaatagcacagggagctctgctcggtgctctgcgatgacctagatgggtgggaggggaggatcacgagggaagggggggctatatgcacacacatagctgattcacctcattgtacagcagaagcgaacacagcattgtaaagcaactatactccaattaaagaaaacccacatataacccaataaagcagagtgttcatagatgtaaatgccacctatggatgctaaggatcgtaatcaagcttttacagattgctccagctgatgtataacagtgttggcagactgcagccctagtggccgcaggcatgtttcactgggctgttgcatcacatgcaaatccaaattcctgcctggacccaccacattcctgcctggcagcagctgacggggctgagtgatggtggttctctgatgtggagacagggcctccaggttaatcagtgtcccacctctcccaaaacgtgtgcgtgtgtgagaacctaacccacttcactcgcgttacttggctgtcctatggccattttcactcgggagccctgaaacatagcatgcccaaatgagtcacaggagaggatcgatgcctttctgctataatatctgtgcatgctaagtcgcttcagccgtgtccaactctgtgaatctgtggactgccaggctcctctctccgtggggattctccaaacaagaatactggagtgggttgtcatgccctcttccaggggatcttcctgacccagggatcaggaacccgcgtcttctgcatcagcaagcagatactttaccactggtgccacttgggaagcatactatagcatgtgctgtgctgtgctcagtcgctcagttgtgtccaactctttgcgagtccatggactgtagcccaccaagctcttctgtccatgggggttctccagcaagaatactggagtgggttgccatgccctcctccaagggatcttcccatgccctcctaccagagatcgaacccaggtctcccgcatggcaggcggattctttaccagctgagctaccagggaagccccaactatagtatacacatagctattttcagcatttgctctaatatctaatagtggatccattcggcccaacaacctaggatggttttggcaaagatggtgatgcagatccagagctaaaggagtacaacagaaaatgaggttggaaaatgctgacccacgccctgtgtcaggcagtctttgaaatctaggaaccatgcccagtcaaaccaggcccctagaaatccaccccctgccaagatcttcctgtgggtggtgtggggttcctacacaccgccgtgcaccttggccaactcaggcccccagcacgtgagagctgccagctctgtcgccgttctcaccacaaacctggaatgcatgtcttcatttattttgaaaagcttcaggactttttccctcccagatgttaaacattaaatggcagagctgatagagacggacccaatgtgactttgattttggcataggccataatgctctcgctgctggagga

SEQ ID NO: 59821 - DNA, 1060 bp, Bovine  19866881136035
tagggcttaggtctttactgcctagaacagtgtgcatggtaagcggtggatgaacacttgttgaatgaatgaatgaatgaatttctaggccccaggacaacctatagtcagtgctggaaactatctccttgtctctgtgtgtgtgttagtcactcagctgtgtctgactctctgtgaccttatggatggtagcccaccagtctcctctgtccctgggattatccaggcaagaatactggattgggtagtcctttcctcctccagggaatcttcccaacctagggattgaaaccaagtgtcctgcattgcaagcggatgctttaccttctgagctactagggaagcgctctcctcttcccaagtcataattcagggacaaagaaggactcatttcagtcatgctttcatctgacttagtctcccggcccagggaggggaaggacccgatgtagaattaaacatgtgcagagcccagaccagctctttaaaatgctttagacaaaagcccaaacagaacagaaaccgtctaatccttgagcttatcctctcccactggccttgtcctctttcgaggagagagtcatttataaaattcagttcaatgaggtttccagctaattgaggctttcctgaatatcctatttggtgcattgattaagcacctctctgtgctttgtgccatggagggctgggaggtaaaatagcgaacaagacgaggcctgtgccctccaggtgctgacaactccagcggggagggagacagacacacaggcactcataacccagggcagagagaaaggcgagttaagcagagctgacagctctgtgcttggggccaggagggtccattacatcaatgcttgttcggtccaatttattactgctgctcttactaatctaataataataataatttctagtaggcttgccatctttgatatcaaagggttatttttctaccaccaaaatgaatgataaaagaaaaacaactccctggaattaaaagcagttgtgcttgctgatgggagagagatgcgcgggctcttctggggagaatgag

SEQ ID NO: 59822 - DNA, 982 bp, Bovine  19866881203628
atctttgaaatttattttctccttttagcctgctgtatttttaatgtctgagtgaaagaacaaaggaaggtgaacaccagacaagatcgtttcattcctccaacgagctgttgtgtagcccagttcaagctcagccaacataaatgtttcaaaattctgcctttgcacagaacaagtgctggtctagtcatcaactccaaagtcaggccccttgtttctgcctttcattgggtgacataaaaggcccctgcatcaatcattaacaacctattaacacaagcagcccagagaaggttccctggtccagttggtcaaccacagtggaagaaattcctgttgcccagctggctggccatccgcgtgatgcgagctgtttttcagctttgaaaaaggcctgctgatttctctttcatctctctctgagtaacagatacctggtaggcttgctttccttccccccgccactgcaaatttatctacctgcctcctcggcttctggcgttaagagacgcttgcacaaacactgacaacattgattctgtgcaaccggcgtgccaggctgttaggacgtctgctcagcatgcgggccagaatcaggtctgtttcatccacacgtgttagggtgagcagggttttgaagcgtcttgagaaggcagtcgtctgcctaatgtttctgactcttgtatctaattggttttgatttgaagcaaaaccaaatcaacatgaacctggttttttaaaaaggctgtgtggcttagccagacacaccctggaatcttgcggacccagagaatcagattcagtcttaatttttatactggttcaccgtgtgacctgaaggaagccattggtctgtgccaggcttgtttctttcctttttttttttttaaattatgaaagtatgaaaacacatttacaagaggcttggaaaatatagcacaaagttgcatatagttccacatatatattacaattatttttt

SEQ ID NO: 59823 - DNA, 1799 bp, Bovine  19866881213313
tgagctccccagttgcaaacaggccacacagcttgggttcggtggattatttttaaggacacaaagagtgagaaaggggaagagacacgcgtggtccttaggagccaggtcagcattggagttacaaagtgagggtgatggggtgagtgaacaggagagggagtggcttgagacctgaatccagaggggagaggcagactagagtgctgagctaggtgccctgggcacactcgcccagccttcccacttgaccttccccaaggtgcccttccacctcctctggggatctgaaaagacggacctctgccagccactcccctcctctgagtgccaggagggccattcggagtatttctgtatgtctgtctcttaggcgaagtgagagccccagaccctggtgaggtctcttagcttcttagtgtggaggtgagttccaaaaagcagggcttatttccaggatgcttctgctaattgcagccattgcgctaacctgctgagagaggaaaggttgattaaaacccgaaggccactcaggggctattcctaggaaatccaaggtcggtggtgtctcatcacaagggaatccaaggtctacaggcaatttgcttgccaggggtaacatttggaccctgttaggtagaagttcaaataagactgtaacccaattttctaagctagtagttaatcctgagagaaatgacttcaaagagcagaatctgatggtaattgctggaggcttccaaatgctttgggaatgtccctttgtggggtgaaattcccttccaacccaacacagccagtgaaccagtgaaccagccaggtgcaggagacagctgattggcagtcctacccagcttggtaagacggccctactcagacagcactcatctgaactacacccctagggatttcagtgggctgcacagagagcttctggccttaagcactggccttgaacagactataggtatctggcctttcccctgagacttctgggaaagcccttgtgcctgcctggccctagcaaactcttggtacaagaccatcaggggagccagctggcctcctccaaagggcaggcaggggacaagaatgcttgggctggagggtcatgacggtgcccacctggcacatctggagagatctaaacattggagagaccttctcctcaatgactttctaagtgtttcctaggtaagttactgtctcattctagcataatctagtatttggttttaagacgattcaggagctagaactctgatctctaaacttctgtttcaaggaatgcggtgagacacacttgagctaggctatgtctgaacctgggcagagagcctgtgcagcggctgggtaccccagagctggggtacggggactggggtgagggaaggtggggaggggaggggtcttggtcagacacgcccagagccattgggggcccactaccttccgctcctgatgggtactggcaccgcaccgccggctccctccgccgcgggcagggcgcacagttcagcggcagaccctgtagggcaaacgtggggtttccaaaggctttggctactcggggagactcttggcacgcggagtctctggggaccgcgggtcgcgcgcccgggcctggaggctgtccgggaatcagatggtgctcaggacttcgtggctggggcaggtttggaggtgccccttcgacgacgctggcggccgccgtgtgcgccagagaccagatgcgcggtggtttctcgctgcaggggtagtgcaggtcaacgtggggcctccggctcggcccggaggaa

SEQ ID NO: 59824 - DNA, 1977 bp, Bovine  19866881233515
atctatctagaaaattagcaccatgagggtaagattttatcttgtttattacaatatccacagcgacatagtgggaggtcattaaatagttgcagaataataaatagatggagtgtaggtagagaagcagtggaatcaaaatgacctcagccttttaaaagttctctcaagattaaaatgaaaaagacagatgttgctagccaggaaaagaatatgccaactaatactccaggtatttacacaaattaaaggcagagccctggataatgacttgccctgggagctgccggtgggcctgagatgacaggaagttgctctgtgactcacagggcttgggctcatgcaccaccttgtactgtaacctcatgtctcagccgagatcattgccccagatgtggactgtcagctcacttgacagatgaagcagcagcattttttcaagccgagcagtgatgggcaggaccttgtctctgggcttccggtccagtgctctttgtactgcagcagagtttctaagggaactaacatttctcagatactgttaggcattttgcatgtgttattattccattcatatatatgataattaaatatcaatacattaaatatagcccatctaacagatggtaaaactgaggctcagagaggagtttgccaccctggagccagtcaggcctgagttggactcccacttagaaactgggtcccctttttaagcctctggtatattaaatgagtattatgtagtaactgtcataggattgccataaggattgactgagaaagtatatggaaagttggtaacacactgtttaaacgtcagtaataattataagattgtttttacgggactgtcccaagtcacctaatgagtgagtcgtgtaattaggatttacccaggtctgactccctgcccctcagctccagtcaggggcctccctgaagggttagagctggcctcccaggctcacccaggagccatcagccggatcctctggtcacgctggggcagggctggccttgagggagccccactcgttcaccatggccattctccttgcagatacaatgaggtgaagaagaaaatggatcctggcttccccaagctcatcgccgatgcctggaacgccatccctgataacctggatgctgtggtggacctgcagggcgggggtgagctgcccaggcctctggccgctttctaggactccctgcccccagccagggccctgttcctcacaagcacacactccctcattgtgtggggaggcaggcggcgcccggggaaaacaaaccagccccttcagcccagcgctgggaaggcatccagacccctgacctctgttcactcagctggctccaggcagtaagacccagaaaggcccctcacagctgcagagcttggagccagagagcggggaggaggggaggcctgccgggggcgagaaacctgggcttggtgccctggattcattctggggtttgatccaggcccttttgggttccacaggaggccttgtgaccgcctcccattagcagaaggatggctccatttgagacaggaccaactttgtcaggccctgatgctgaggtggcaaagatggcccatttgtctctgttcctttgctgcataaaacaaccaaaccagcaagggctagaatttggagtttggaaaccagattcctgaggagtcttctgggaggtctctagggccctggaaatgagtccagtttggctttttagaggagatttcaatgaaatttcacaaagatgctttttgagctcctatcacatgctaagcacatggccctgactaaacctctcacatgtccaagaaaaagcagggtacagccaggtgtcaggttaaggattttcttcagaaagaaacatctgttgagcacctcctgtatgccagggggtttgaaaaagaagtaaatgaggtcatatgtgtcaggagtaagaaattccaaaacccta

SEQ ID NO: 59825 - DNA, 852 bp, Bovine  19866881237298
tcccagcttccctaaagtagtgggccccaggtggcacaaaaaagaaggctcctggccagttctaatgctcagttttaaaagtaggagaaaccacagtgaaagagaaaactggcggaatgcagctaatcagacaaaatgtgtgtggcttgaagctgctcgtattttaattgaagccttaaagtctacgacagtgaaatactttagggagaagaatgacaaaatagcatccttaattatggcctattagcaatgatccagttagagagttgtatgcaaaaaggcacagtccctggctagaatcagagccagcgccaaatcagctccctttcctactggtcttggccatggaggtctgttccctaactgtacactcaaaaccactcttggtggtttcccctggtgcaaaggggagaaagtacacagcatcctatcctagcaagcctttatatgttgcctctttcaggtctttgttttttacacgcatttttttttcccccaaagactttggcttctggaactgttccctggctttcaaatccatacatctcttgttgacttcgaattttaattccttgagattccttgagctgtcatgagaaaaatgtcaaagataaaaataacgaagaatttctacacataaaagctgctttgtaactgagaagttaatgcaccaatccccccagtctactgatgcaaaaacaaagattaaaatatatatatacaaatgtaaataatttggttggtaaatagatatagatatatataccgatccaggaatcaaaccccgggtctcccaactatgtatataggagacccgagttcgatctctggctgggaaagagcccttggaga

SEQ ID NO: 59826 - DNA, 1025 bp, Bovine  19866881263683
actagctctgttacactgggcaagttaagctctcttaggatccaacttctgtaaaacaaaacgaatgatttttaatatcaggtagacattacaaccaaactgtaaactccatagggacagaaattttcatcgtctctttgaactaaattcacagcccctaagtcagtgctcttaaaaaacaagaactcagtgaatacttggcaaaggaatgaatgaaggtataaaaggttcttaactttatgccttgagtcttgtgagcattcagtaaatactaagccactttcccaaagtattacagtgctagataagtgatttcaggatgatgcaaataatatttaactcatttgaatgtaaccttcatgaggcagggaacggttttgtccagttctgaatcctcacctcctagaaccatgtgcagcattcagtagacactcagaaaatgtctactgaataaatgatttgggtctttcttcccagacaggccatgtgctacttgaagggaagaattttcttatattctcaccccgactgtgtgtacacaaaagatattcaaacattcaaagcagatgagttcagtggactatcaggggctcaaggtttcttagaaccaccacgatctgccaattacatgtaagtgtcatgagggttatacagtacttttgactccaaagtaatggaaacatcttctattgccctggaaactcttcctgcagacagaattttgaaagaaaattgcacaagaaaatactgtgaaatttcacaacctctgtcactatgaaaaatgtcatggaaaaggatttttcttataaaacagcaacttatgaaagtaatcagtgctggaaagctcaaagatagatgaagaaaacaagaggaaccgatccaacagctctggttttatgaataggcgattccaccaccccactcatttgtaagattctcatgagatcttttttttacagcaggttatgaatcatcttcatgatatctttaaatgggatgatcaatactatattttcccataaaat

SEQ ID NO: 59827 - DNA, 1800 bp, Bovine  19866881307288
cagttggtgatgccatccaaccatttcatcctctgtcatccccttctcctcctgcctttccatctttcccagcatcagggtcttttccaatgtgttagttctttgcatcaggtggccaaagtactggagtttcagcttcagcatcagtccttccagtgaatattcaggactgatttcctttaggattgactggtttgatctccttgcagtccaagggactctcaagagtcttctccaacaccacagttcaaaagtatccattcttcagcactcagccatctttaagatccaactctcacaccctttcatagctgtattttaagtaatgtcttgactgtggtatgacacaaaatttacgttgttaaataacctctctgattgttacattatgtggataatggatggcggtgggtcaagagagataagctgcaaaaaaaaaaaaaagaaaaaaaaattactccagaaacccaggtaagtgcagatggactcaggaaacagcagaggcactggagagacgggatggactagggagctgctttgaagggaaacagcccagaagggaggtctgttactgtgaaatgtgggtgaaatacaaggtatgatcatcaccattgtcatctgtactcctttttgctcatcagtggggctggctagcctggcaaccaccaggcccatgcaataagctttgcagaaactgccttttcagttcaaatcacttacaaaagctcaggctgcaattataaagcttcatagctgtgcagcatccataaaaagaggtaattttaatatttggttcaacttcaaacgcagtaacttagtaattatatataccccattaaaatataatgtttctcccccaaactaatcaaatggctaaatcaattgttggtggattgccagtggcctgaggatcaatgggaatagaaaatgtattctatattttccttgttacgtagaagttagagaacatattttattaatgttcatcctttagagaccagatttgtgtgttcgctaaaataaatactacaatctttaggacttggttagatggagagggcaggattctaagggcaaagaacgattcacaaggaagcagacattccagagcccttgtggggtgatgggacttggatccagggaacttgagtcttgcatctcccactcacaatgtgttgaatggctttagaatatgtcctttctcttcccagttgctccatttgtcaaatgaggagtttggacaaggtcagtgaaggtaaacaggttttggactaatttaactcaattagtcatcattgcatggagccttccatggggaaggattgtgaagctatgactgagttcagagggagggagtgcagcaattgattagtcatgtcttctatgggcattggcgaggcatcctgcagtccaggtgtttgtgatccttgtactaaatggattctaagatcccttctgttctaacaggttgaataaaggtctattagtctgaataggtaatctcctctatgacttgtaggatcttctcaggccctccgtggatggtctctctccctgccctatggccagctttggctagactgggaactcactaagaataatagattttaaactgtgtgcagtaagtcagttgatacatttcaatgatgcttactatgcaccaggcactgcagatctaaaggtccataagccatgactgcagcctattattaggctatagagaagggcatgcaatttaaagaagggctgacaagtaacataaagctgtaagatggcccaagtttccccgaattttccatc

SEQ ID NO: 59828 - DNA, 1044 bp, Bovine  19866881312137
tggctgatgggggagagcaggagggggctgaagttattgaaatgctattttaaactccaaagtcaatgttaagcaaaaccttgaggctgattaaacacgaccttcgggccacagggcaccagctcaaaaaggcaaacagcttccaccctctcagcagctccgggcttgtttattggtttgaaagcccttaaggggcttgccaagcagaggggcgagcagggggaaactttaatatctaaagggagagatcaaaagcagttgacatttctggcagagagcaagcgcgtatgtatctttatatgtataatgttatagctgagcagaagggaacaggcatttcttctctgggttaaatcacatcaggccacatgttcctgatcttgactgtgttgtcttataatccaaccaaatttaactgacattgagcatttctgatctgaacagttaacatggaaatttggcccaaataactgtatatacattctgaacatgaactcggttcaggcatcagaaatgatgggaaagacccctcccaactaccatccagggagccaggcagggggcccctggtgggtagggctcctggctcttcatcatcccttttgctgatgtagttgctagggagaccacctccacaggtgggcatactttttccatgcctaaacctggggctctgggatttgttcttgggaaccccaaagaagagaggtagccttgctttggcaaaagcatctaatgggccatgggagttgatccctggaggatatttctcatatttatctaccttgaggtacctggtaaccctgatgaggaaagtttcagtgaagtgctgggtaggaggcaggatggctttggactataaaaaatagtgcctggcacagagtaggtgcttggggatttgtggaatagatgttgaataaatgaatgtgtgatagactcagggagctgattgctcaagactcatccttcttttcttgggcttcccttggtgtttcagatggtaaagaatctgcctgcaatacaggacaccttgggtttaatccc

SEQ ID NO: 59829 - DNA, 1193 bp, Bovine  19866881354501
cctggtgggctgccgtctctggggtcgcacagactcagacacgactgaagcgactaagcagcagcagcagcaaagccattccaactttgacttttagttctgtaattcctttactagaacccaggtgacttggacatgtcctttcccacttgtagacctcagtttccccatctgtaaaataaggaagttggacctgatggtccttaaacattgttttgactagaatatgccatgatttcatttttccaactccgtcctttctgcctcaacttcgatggaagttgagcttgggctcacttgaatgcagaatatcacaccactaatcttttttttttttttaatgtggaccatttttaatgtctttactgaatttgtcacaatattgcttttgctttttttttttttttttggccacgaggcagatggaatcttagctctccaaccagggaccaaatctgcacccactgcattggaagtcctaaccactggaccaccagggaagtccctaccccactaatccttgattcaaggagcagctaacatagatgtgggactggtgaggcagcggggcacagagcaggggtcatctcacattctttccctctttgctttaatgaaattgcccacttcacagcagagggctgaggggtaacattaatcctataatccagttggctctagatttcttttggatggcccataggcacacactattggccagttaaggaacaaactagatgaaagcttaaaacagcatcacaagctctctctagtctttctttggaagatgctgggatttcatgctaaggagcagggaaggtggggatgttcatcttatctctcagccccaggttgccctcttcatctggactattatcctttgtagcccttgtcacatgatggccagacagttaactgcaaactcggcacaggatttaggtttgatattgcaaaaaaaaaaaaaaaaagcctgggcaatataagagaaaacattcttgttttgcccagtatgaatgtgggctgggccaagtgaaagacatttgtttatcatcaggagagaaatcaagagtggattgtggggagagttcctatccactgggctgggggaaaaagtcttgagattgttctgggcaaggcacatcccagccattttgaaaagaccccatgctgctcttcagcatattaagattgat

SEQ ID NO: 59830 - DNA, 1600 bp, Bovine  19866881568243
cccgcttgaggtttgtttgctaaattgttttgaaagcttatgacgaattttcaggattacttgcagtggtagggacctcggtggaggcggaaatataaatttagagatgccagttggaatctattaatttgcttgcagcccattaccctaggtctgctgcttcactggctgtgtgaccttgggccagtgaattaacctctctgaactttagtttatcctcatctgctccatgggaggcgataggcatagtagctaccttatgggattatgaattggaaggaagatgatacatgtaaaatgctgaacacagggactggcatgtgatgggtgctttgtaaatggaattgattagtctttttgctgaaatgaaaggaaaaacatccccatcagacagccctgggtgtgtgtcctggctaggtaacttgctatctcagtgaaattgggagatatatattttctctctgagcctcagtttttaagtctgtggggataggattaataacagatcatgaaaactgcttgaggcaccacacgtagttctatgtccaatggtcacgttggctgccactgttgttactgcacagtggccttggctgggctacttccatatgagtttgagccctttactgtctacgtctgggatggcacatcattctgtctcctgtgtctcttctgatcttggctggagcagcttcttcagaaggagctacgtagggaaaatggattggtgtctgctggaggcgaggatcgaggcgtgaggagtagggagacccaagggtatttgacgactttgttctagactctggcagggaagatattactattgcctgtgcatattcgctggtaagggaagaagatgcacagggtgaagtcgtcagatagagggaggccatagatcatgactgccaacctccaaatgttgcaaaccttcagctggaggtttgcttgccctatgctgctaagtatcttggggaacatgttgcagggaatcccaagggaaatctttcatttggggttgcttttctggggtaagacagaaaaagagacagagataggaaggagagagaaattacaagagcatgagactaagaaggacacagggagaagcaggcaagagacagagagataagtaacaacagataggaagatgaggagacatagaatccaagagacacggagaaggagacaaaatggaaagaaaaagggcttccctggtggctcaggggtaaagaatccacctgccaatgcaggagacacgggtttgatccctgatccaggaagatcccatgtgccacggtgcaactaagccacaactactgagcctgtgctctagagccccggaaccacaattactgagccctccagctgcaactaccaaagcccaagtgcttagagcccttgctcctcaacaagagaagccaccacagtgagaagcccatgcactgtgagtagtccctgctcgccccaactagggcaaagcctgcttggcaatgaagacccggcacagccataaataaataaataaaattattttaaaaagaaatggagagaagtagggatacacaaccccagactcagagaagctgagacagggaccaag

SEQ ID NO: 59831 - DNA, 1324 bp, Bovine  19866881648694
tgaggaaactgagacccagacaagttttgtatatgacctgcccaaggatttaaactcaaagcccaggtttctgagcccacaagagagtcagtgtcagaggcgagaccgtgtggccagcactgggggtgtggcagacacctccttcactcctgagggtaaccagccaccgtttagaggtgaggaaactgagtccagagaggtaaaggccggctccatcccttgaagctggtgagtggcagaggcgacgctcgaacccagagccactcactcactctactgcagttctttcccaagtcctgtgctccccacacctcttcgctccagaaccattttcatgatttcagccttgtctaagtgctgccagtactattacacgttgatttattttaaaaaatggagtcactttgtaaactctagcctcattgcaagcattaatatacataaatcagtggttccaggtactagctgtactgatcctactacacgttaaaataaaagaattgtttggagaactagaagttttgcactcctgtatcattaaggtcattccaggtgctgggaatttctaccctgtatttagctattaatacttctcctggattctaaacctcacttggatgcgtaaacctcattgaccttgaggccagaaagttacctttctcagctgactcacctagaaaatggagagcccatttctgccccacctgccttgcagcgtggctctggggagccaagtgaggctcagacactggtgttatttggaaaggaaagggctgtccaaaggccttagagtaatgctccaatatccccagaccaggttaatactgctgcccttgtctcctgcagtcccagatctggctggttccccccactggcaccctacccccagtgacacgacctcccccaatccctgccccagggaccccaagctgaggcttaccatagagttcttggatgccctggatgtcatcatgggacaggcggaagttcttagtataggtataaatgggcgccatcagggctccagggtcctgtgagtgctccagccccattgcatggccaaactcatgggctgccaccaggaacaggctgtaccctgagggccatagggaggggaggcaggcagaacgacagggagagagataagggacaaagtcagatcaggggatttccctggtggtccaatagttaagactctgggcttccaaatagggggcacgagtttgatccctgattggggaactaaaatactacatgtgactcggtgcagccaaaaaaaaagtagtagtagtcaggccggctctacaatggggacatatgagga

SEQ ID NO: 59832 - DNA, 1855 bp, Bovine  19866880203014
atggggaaacagtggaaatgtggctgactttatttttctgggctccgaatcactgctgatggtgatcgcagcaatgaaattaaaagacgcttgctccttggaaggaaagttgtgaccaacctagacagcatattaaaaagcagagacattactttgccaacaaaggtccgtctagtcaaggctatggtttttccagtggtcatgtgtgaatgtgagagttggattataaagaaagctgagtgctgaagaactgatgcttttgaactgtggtgctggagaagactcttgagagtcccttggactgcaaggagatccaaccagtccatcctaaaggagatcagttttgggtgttcattggagggactaatgttgaagctgaaactccaatactttggccacctgatacagagagctgactcatttgaaaagaccctgatgctgggaaagactgatggttggagaagaaggggacgacagaggatgagatggttggatggcgtcactgacacaacggacataggttggatgaactctgggagttggtaatggacagggaggcctggcatgctgtggttcattggggtcgcaaaaagtcggacacgactgagcgactgaactggaactggaagaatgctggattttctaaattaattaacttttcaagatgttgaattaaaaaagaacaatgtaacccaaaataaggggctttcccaggggctcagtggtggagtttacctgccaatgcaggagatgctggttcaagccctgggttgggaagatcctgtggaggaggaaatgacaacatattccagttttcttgcctagagaatcccatggacagaaaagcctagcaggctacagtccaaagggtctcaaagagtcagacgtgactgagcacgtatgcaatccaaaatgaacttcctggtttcacacatattatccatagctaatctcttctccagcattaagaaaacagagagtttctttccattcaaataatcttctctacatatttcttttaatactagcattttattttcagaatgaaccttccaaaacatgcttagaaaagtacatggtaacaatatattgaacacttgtttaagactattggattcttttacaaatataatattcccagcccattaatgatgaggcctgtcatcatttttgtccagcagggcggacaactagactgaactgtctttagaaattctttcccttaatgactctgtgaccacattttcaatataacatcatctctaaattaaggcaaggtcatagataagccctttaagtattttttttttaaacatggatatagatttagatatctaagaggttagttaatttagcccattgaagtgggttaactaatacatctaacactaccaagtacctatgctggatactgtctacattaggttatgtgactatggaactctttaaggctccgcaattgtctttttttttttttttttttccgcaattgtcttaacatataaagctgtagaagatcgcacttgtattaataaagtctttgattaaacctaaatacacaatctgctttgtggataatttgtaaaaatgggcataatttattaagctgtattgggtgagcctgtaccaagtattacaactatgtagaatgttttcaatttattctaagtcagtcatattctttggctcaattttttttttttttttggtattactttgaggtattagtcacaatgactaatactatatgacgcaaggtgagcaaggttacacaacttttgtgacaactcacatgcaatcaaattgctactgctgctgctaagtcgcctcagtcgtgtccgactactgtgcgacc

SEQ ID NO: 59833 - DNA, 1074 bp, Bovine  19866880367529
gcactgtgtcaagtgctaggggtaaaatatatattcttcaccttaaagagcttattctgcagagggaagaacagagaggctggagaggagttgatagtgactgttctctgcactggtcccttgcacatgctccataattcaactccactgaacaccagacagatcccaactgcactgctagtctttctccaacctcagccccatttcatgttcaacagcaggtataagccaacagactaacagaaattagctatgctgcatctaaaactgtgtttctaaaatttttttatcatttgtgaccaagtcacagtcacctacaaaacaaatgacaataatgtatagatgtatatacactcctaatatagatgtatatatgcacgcacataccgaattctgcacaaaacatccaggctttctacattcctcagtcttgttatgatctcaaggttaagaactgatattcagctgttaatccaagcccatatctttgacagaatcataagagattggtcccacagaaatgataatacatgttttcacagacacatctttaaacagtgtctgctatgtataagggacaataactgaatagggacagaggtggctgctacagataaaaaaccagagtggacgtagggggatatatcaccaaccacactgctcatcactttcctgagatcctctggggaggggagaggtgcagtacagacatcccttcaaaatctgtcagcaaatactgtgatcttttctgaaacctccttgacaagctaagtcagtcctacacatgaacttcctagtcacatcgtgctgtggcaaaattacaaattatcacatactctggacctttggcttacatgcagtatgtacgaaatttcaaatgttgaatgtgtgagtgctaaaggtctgatgttcctgatgagtactagttcatttgtcgtctattctgggactgacaagtttcagcctctcagcttaaatctcttccttcaacctctgatccagaaaattactacaagtatggggcaaggttacattctaattagatttcttaattcacattcttaaaactgctcg

SEQ ID NO: 59834 - DNA, 1660 bp, Bovine  19866880373731
ggctataaatcttctgtaagtttaattgcctgcttagaacaatgctttttcttttactacagtaataatgctaacttacatctgtacagctacttagctcctgtatagcatttagttctttaatgatagggaccaggtattcatttgccactttttcttgagagttcccaggatactttaatatataaggaagagatatttattgaaaaacaactactaaattgggagattagggttgacatagacacactgctatatataaaataggtaactaataaggacctactggctcaaaaggtaaagaatctgcctccaatatgggacacctggattcgatccctgggttaggaagaccccctggagaagggaatggctatgtactccagtattcttgcctgaagaattctatagacagagaagcctggtgggctatgatccatggggtcacaaagagtcagacacaagtgagcgacacacacacacaaagatgtactgtatagcacagggaactctactccatactctgtaatgatttatatgggaaaagaatctaaaaaagtaaagatagaagtatatgtgggcttcccaggcggctcagtggtaaagaatctgcttgcccagcaggagacatgggttcaatccctgggttgggaagatctcctgaagaaggaaatggctacccactccagcattcttgcctggcaaatcccatggacagaggagcctggcaggctacagtccatgagagtgcaaagagttggacacgacttagcaactaaacaacaacaatataagtatataactgtttcacattattgtatatcagaaactaacacaacactgtaaataaactatacttcaataaaaattagttttaaaaaaacaaaggaaattctgacacatgctacaatgtaggcaaaaccttaagactttacagtaaaagaagccagtcacaaatgagcgaatgctttatatttccacttatatgaggtacttaaaataggcaaattcacggagacagaatgtggagtggtggttgccagggccaggagaggggaatgggtaattatggttgaatgggtttgatgtttcagttaagaaaaatgaaaactgttcttgagatacatggtcctggcagctgcacatcactgtgactgtacttaattaatgccactgacatatttacttaataaatagttaaaatagtataatattcattgtgtacattttactacaatgaaaaagttaattgttctcattaaaaaaagacaactaataactattagttggagatgtcattaaaaaggaaatgcttcacactaaaagaaaaaaaaaaaaaaaacttctagatcatagttctgcctatgtcacagccatgtcttacagcttaagtggtttctcactgcccaaaccagggcacccttcaaaacttagaattcactgacctctcacgggatcagtctcactccaccttcctcatcagtcttctctggacctccccacatagagctactcccaagcacggcatgaaagcttctgttccacctgttctcttagtatggcatgtccactcttccctgtgaaattaagctactttcaacatgaatacagtacacactggcaagggggagtgccatgaaggggatttaatactccctca

SEQ ID NO: 59835 - DNA, 1141 bp, Bovine  19866880403071
aaaataaacttaaaacatagacttgtctatgatgtttcctttttcatatggctttccttaccatcttgaaataaataatggatagcaatttataaagatctggtaaacatagtctgtaaaacttgtaatggttgtctatagcactaatagatctaattctctaagtatctacatattacaatcaacaaaattgaaagtcttttatgctccttttttggggatagtaatatttttgtgatagtaatttaacatgtgtcaaatattatgccagccaaaataattgtgactgtcacatataaagagagcataaatgtttattctgaaatactgaaaaagagaatcttacaaagttgaaatgaaccttaatactgcatcccccaaaaaagttttagtgttttgaaataagattgattactttaacaaattatagaatttgcttttaagtgaatgtaaaaatgcaaggttgatgattactaaagagtaggtatctgtctgatacatagaatttattatgtcttactcattggaaaagactctgctgctgggagggattgggggcagaaggagaaggggacgacagaggatgagatggctggatggcatcactgactcgatggatgtgagtctgggtgaactctgggagttggtgacggacaggcaggcctggcgtgctgcgattcatggggtcttaagagtcggacacgactgagcgactgaactgaactgaacaggagaggttatgagtgggataaagaaatacttgcaaactagaaaaaaagaatccataaagccatcctaatttttttaagctgaaatcttattgtctagactaaacatttatattccaaaaccctctgtataaaacatatgaatgctatctatcagcatgtggatatttaatgcacttattaagaaacatttgtattatgttctaggtacaaaactgtaaaaatatattataaaaggtaaagataataaagtttcaatggttaaacaatgttgtagtctgtttttaaaagtctttgcaacattatagtaaccctagaatgtgaatgctttggttttagtgtttctcacatacctaaaaatgtactataaatctgttattatataaaaagttatttctttatggtccatttga

SEQ ID NO: 59836 - DNA, 1894 bp, Bovine  19866880429992
accctgatgctgggaaaaattgaaggcaggaggagaaggggatgacagagggtaagatggttggatggcatcaccgactcaatggacatgagtttgagcaaactctgagagatggtggacagggaagagtggcgtgctgcagtctatggggttccaaagagtcagacatgacttagcaaatgaacaatttaatacagttaagcaaatactattatagagccaatggagtaacagttttctttgatctcagcctcagtgactgaatattagtggttgtcaaatatacacaaaataatttttctccctttacattctcacagctttaacttcaaataaaaattccccagaatcctgttgagaatctaaacacaccagcacctctgtacacctcctgcctaaaccacccaggatttaaagatgtgatcagtcagccactttcactgagcattcatatctgaaggaagtaagagcaaagagcagaaacaatttgaatagttcccaatctttaaaaagggagttcatatctgccattttatgttccttgattctttggggagggataatttgttttatataagcatcataaaaatatatgtaaatacatgcaattcagtgtgaatatatgatgttacgtacaataaagctcagttgggattcagtggattctaatatgcaatttttttaattgcatattcccaaggaaaaaaatgtatcctaagaatactacttattaatcagtatatattaacgtccaatgtaaaaacattttacaatttataatattcataccacttaaagagaaatttctaacttttcaaaaagcaacatattttatgtttattgttaaaatagtccatggagctgtttttctctttcacttaacacagcagtcctaagtattaagagagtctatcttggtatgtaaagaagatcccagactacacatgaaggtgacgtgatcagcacagttgagactgtccagaaagaaactgtatgctggtaagtggagcggctgctctggagagtcaagtaaaggaatgaccatcctcatccttcaggaacttaggttcctatgtggagagatgtgtccccatggaaacactataatgcaacactggaaaaacaggtgtcctagatacatagtcagctgtaggggaagtataacttggggttttgaagggtaaagaaaggtcattgagcaaagagaactatcaaggcattgtagattggatgggctgtgtaaccaaaacagtagagaatgggacagcacccctcagaggacaaacaagtgaactggtgtcaccaaagcgaagaattctcacaagaggcaggagatggggcaagactccaagggcagttagtctactagtacccagacacaagacactgagctgctgacttcaccccctccccctcagtcagagttgttttgtctttaatgtatccttgtgctggctccaggaaaggctaataaaccaacctaaaattccatacgaagccctgcacatttgaacttttgttggggaagatgtccagaagaatttgcacttcataacctgaacaaataggtgattggtatcctccactatttaagtcacataaggagtccagtttgcaggaagatgatcaattctactttagacatgctttatttgagatggcaatgagatattcaagcaataatgttcctcaaagtgtttggagataagcaataaagcacgagatgaggactagactagaactttcattacagggagaaaagagctgaatcctggaagtgaatgcacagatacaatgaaatcctaccttactctagaagaataccaggatggctttttttgtcacagtaggcagactatatttctcagtcttgtagtaaggagaggcatgtttt

SEQ ID NO: 59837 - DNA, 943 bp, Bovine  19866880455455
atttatcttgttcaatttcatttcaattttatttgaaaactgaagctaccagggaactgcaggcaaaaaaaacaactactggcaatatacctccttgaaagcaatcacaggtctaaggcccgctactgcaaaagagatgatggttggaaaaatgtataagcggctgctggtcaatcatgaaaatagaaaataaccgagcagaatccatcaaaataggtgatgtgtgaaaatgagaatttcccaacttggttcacaaaggagcgatttgaaatgaaaacccatgaatgcatgaatgaatgaatgagtgattgaagaggtgcttagggagctaatgtcaaccaactcgatctcagtaaaggttaattgagacaaggcagctgtctcatctgctggggggtgcagcccatattgagaggcttggcagcggccatcatttgcacaattttaaagtgatcagaaccattttcagtgatctctggctttagaagagcctagctgtgggaccatccagtgtagaaaggtgcaaagggtcacactgaatatcaggatagaatcccagctctgccatttactagctgtgtgcccacagggaggttgtttagcccctccttaagcctctattaaagaatatgtaaaatgaacacaataatagatgctgtctcctaggattgttctgcagattaaatgaggcaacacacttaatgtgtttctcacagtccctggccatatggaagaaattgataaattattagctttctgctaaggccagagcttggtgctgaggataaaatagaatctttgcccttgcagagctcagagtctactgggagacacagatccataaacaggcaactacaatgtgtaagaagtaccataacaagagtatttatggggatactgtggggaaaagaaaagggaatgacaaactctactctactgagag

SEQ ID NO: 59838 - DNA, 2259 bp, Bovine  19866880491677
atactggagtaattgccttcccttctccggggatcttcccaacccagggatcgaacccaggtctcccacattgcagggagattctttaccatctgagccaccagggaagccttctaagatctagatctacacacacacacacacacacacacacatatatatgagggaaaactgcctgattttttaaaaatactgtaaatgtccaagtataaattatctaagctaatatatggataatgtaaaccaggaaccaatcctcaaaagcagtaaagtagccaaagtaacttcatacactcagatgggttgtgtgctctgtagcccttgggacaccactaacctgactcataggtagttgatatgaataaccccctcccactcccacagggagctgggcaacatggtagactatggagtaactaaaactaaacaacataggtaactcacaaaagtaatgcttttcaagctacacttacaaatagcatttaatatggctgcagaatactgagtgactataagcattgtgggctcagcatgatacacagcgcatggtcagaatacatgatggactgaatgaataaagtgagtgttttccaaaatgtaagctcacaacatttcaaacaagaaaggagatactcagtctaggaggaactggtaaactcttaggcaagtgtattttatacttttactgaatatttctctcctggattcatagtcaagatggagaagactggcctcaaagtagcagctttttagatcactgcttatgggtttacatctttgctgaaggaggagaaggtcatgggaaggaaagagcctctatggaagctgacccaagtgtagagagggaatttccatctgcttccactccagttgtgttttgctaccctcagaaggagcagagttcaccctaagattaacaaaggaatgaaagctttccactaggtaacagtgcaaagaagaaatggatagctcgatttttccaacattaatgggaattcacagtattcactctttagtaattgagagttgattgtatatataaatacttagttgtaactgttaaagtgaaaatttaggttaaagaaaatcactgaagcaatcaacacaatttattattcattacattcctgcaatgtatgtgttagttgctgttcagagaacactgaactagtttatatgtaatttttactgtctacattgtaagactcctttattttcaattatgttaggcattttaagttaaatttaggggaaaaactgatatataataaaagggacaatttttaattggttaactcatctgtcttaagtccaattacctgttttctatccagaatcctttctcatcatgaccagttcaaagcactcatctccccatgcattcttgcacttctaggttactatgtaatagttctgaataataagatgtaaacaaatcttctgaggttaaatttctggaaagctactgttttctggataaaagaagcaggaacagctattatgtcttttgcatcttcatctatcctccaccctgcctggaacagggaagggcagctgcctttttgcaaatatgaggttgaaagccacacagtatggatgaagcaacaggaggtcagaaggagcctggagatatggtgacttgtttgagcacctataccaatcctggccagattgcttttgcccttcttgatgcctaagaaaaataaactcttttttggtgaaaccattgtcattgactccactagttgaaacaaacacatcctagtaaaaacaactaattatgaaaatgcaatggtccttacatgtaatatgttaaactctacacatttcctgctactggtgctgtttgttcatgataagttcaggacagtttagttcagtcactcagttgtgtctgactctttgcgaccccatggactgcaggatgccaggcctccctgtccatcaccaactctcagagcttactcaaactcgtgtccattgagtcggtgatgccatccaaccatctcatcctctgtcatccctttctcctcctgccttcaatctttcccagaatcagggtcttttcaaaagagtcagttcttcccatcaggtggcctaagtattggagtttcagctgtggcatcagtccttccaatgaacacccaggactgatctcctttaggatggattgggttggatctccttgctatccaagggactcaagagtcttctccaacaccacagttcaaaagcatcaattcttcggcgctcagcttt

SEQ ID NO: 59839 - DNA, 1862 bp, Bovine  19866880538307
atgtacagaattaaccatgtcctgccccatggtgcactgatatcttcattgtaattctttctaccccatgttataatttcccacattttctatctcccttacaatactaaactccttgtgagtggatcaaattttctttcacatacccaaaatgaaatatctttcctaaagaacagggggcacttataaaaggtttatagaaagaaaagaatgaaatacattttcctaatagcctatttaaaccacaaagcactttaattgcagtcttaatagcattaatctgtatgctaggtctgccaacagatggccacgtaacactacccaggatgtcaaggaaggagggcctttctttgctcagttccaagttcatgtcagatgtggacacttcattatttatatttaaatatggtatttcatctcataaaaatctgtaagttccactttatttaccctctttcgtagatgaagaagctagtgctcaaagaagtcaattcatttgccccagattatataactaattaatagcagggctagaattttcaaatatgtttccatccaaagtataacctcttttcattctaccaaaggttagccttggaagtagcaccctagagtccatacctttgtcccattgatgctatctatcattgttcaaatgcttagggcaatcttcatttgaaaccgccttaaagccagtttatgagctgcttccttaaaaaaaaaacatttcactattttatactcatgggttatttttctcccataaatggtattctatttgatgacaaaatttatattgtaaagttcatctcaagtaacttgactgtttatacaatttaaatatctctatgcagcagaaagataccataaaaaaaaaagaaaagaaaagtaaaaagaaaaaatctgattcaggcatgaagaacatttaaaggacatttatagaagaatagattcaaatgtggtttagaagcagagtacagagttttatagccattctttgtttatccagttgtctcatggttaagacaaccagtttttatccctaaatcatccactggctctctgtcaatgtagacaagtataattttgttctctgtctggaaaagaagattatcttctctcatgctcacagtggaattgtgaagttaataccttttatcttgagtatagcatttaggagaatgtgggtgcttaatatatgttaataatagtgataataatgaatgttgataattagaggtcttttataattatcaaatttctaatgtgtgttaaatataattaaaggggaatgatttaaattaatatgcacacatgcaaaaactagagctagccacagattttatttttagcttcttaacatcatgaatatgaatcaagtattaagaaatccagttatgattcgtgtttcactctggtcatgatggagaacccaagcaggatctggaaactagaatggcctctgtttgagttgaaaaatatagtcatgaatggggatttacaaagagctgttgtgattggagcttgaccacatgaacttgtgaatcagacattattattataatccatcactataacactgagttccatgagagaaaggcacttttcctagaaactggacaccattccaggagtaggtaacaaacaaatgcctggaagggccctagaaaatgtaggtggaatagaggaaacaataatcataaataatttcccatgaaattcatcttggagattcattcttcaactcagttatttcataaggtacaagaaagggtaggtgagctgaggattgtgagaggcagcaagctgaaataattgagaacatggactttgtaagtttgaatgccctgggttcaaatctg

SEQ ID NO: 59840 - DNA, 1422 bp, Bovine  19866880579320
taaatattttttcttgatactggtgttgatatatgaaaacagtatccttttagaacaaccagggttatatatttcagtttcaaatactgcttgtggattcaagttttattaggtaaagtcttctgaattaattaattctggaaacacaatatctaacaagtggcataagagggagacttattagggagcaataggtggaaaagctacaaatgaaaaattgtagcagtcccaatgaaatcaaggaactaaatgccaatttgttacaggtagctttggaggcctcagaaaacaaatgcaatagatgtggcaatacctataaccccctaagtaattcagtgacaaaattacatacactttttgctgataaaactctgagtctatacatctatagcccaacctgaattcacaacacattacctaagcatgggaaacatggctgaagggtacttgacggtgacaaacaagatctttcctgatccctacaatgtacaaccaaaattttacactatgcgaagccagggaaatggagatagcaataaaaaccttatgaaaagacatcatacattacactgtttatgaataacgtcctgaagagatatcttttcagtaatataaacagaatgagtatgtcttaatattcattcagcatagttggtctagctgatcttttaagggctcttccatatgaaactgcattcaaaccacaccagagggaacacactttatgaaacttaataacaacaactctttgctttccttgcagttaacaattgaatatcttttgtcagtctccattctgccaaaacgttttctgtatacatgctggcaacatcgggcaagttgtcttcttctttctttccaactcttcgcatcggtagccaaaagtgtctttgttgctcaaatagtccacgccatctgccaacagtttctccatcctgctgtaccatctgccagcctctctgcttctgagtccaggctgtgttgcctgtatgcttatcaaatggctctttcaccagaagagaaagaaagagcaaaccagcaccttttacgtttaaccactcttggtaatcatcccaaccctgttctctaacccattgcttcttaacaggacaaaaagctcaacaatttgaatggaagcattttcctttgactttttttccctcccctgtcgcaataaagaattagacagttatagtacattaatagaatcagtcattagtataacaaatttttcatggccatgttccctttttgtttgtcctaaggtattcttaattatgaagaattatccttcagaaatgagaagcaaagagaggaaaacaatccttattcttacagttaatcctgattattttaaaagcaacttctggtaggaattaataattcagtgaattttattaacagtataatgttaactttatg

SEQ ID NO: 59841 - DNA, 1721 bp, Bovine  19866880581126
tttttttgattgaaattgcatctttagacccatgaacgctcccatgtgatcgttcactgaaactcaaggtccttaacatgtgctatctgtggctgggatcctgaagagcggtgtgtctgcaaaattactctgttagagttcagttccaaagcctaacagagaactaacgtcttacttaaatgaaaccctaaagtgggctggctttctagaatctattctctcctcaatgtaacatccaactgaattttgccaccgtcctggagtgcaggacctctctcaccctcttccttctttgtagtagaagactgtttaccattttagaagttaaatggttaattttagtttctctgcgctgaagagcatcctcagaatgaaagtcttaagacaagtgagaactccagatttcttatcctgcacttttcctgctacacttttgatagaagtgaccttcctaggcaactgtttttttcatggattttgctttttattttgtgccactgaggtgggtacaagcatgtacagtacattaaagctaatacatcacccctgtcagtggcaccttccctttggtaccccttttccttgctgatttaaaacactcagtccccagtgcttatggttgagtagcaggaagctaaatgatgtattccaaagctcttaacatactgcctggtgtaaatggtccatgtgagtatttcagaaacgaaacggaagagaaaagaacattgaaaacactgaaaagattaacacctttttccagccttcaaagaaatcggagtgcactgtatatatccagaataaaaccatttattctctcccattgagactttttattcagattttcaattctatgtgcatagcatccacatacttatggtttgtttcactacagaattccacggaggaattagaagatggagaagttatgaatggtatgcagacagaactactgacatcaccaaaaactatggatgtgttgaggtattctatttatgtgaataagaatattttatttcaattgaatgtttttttaacttatagttgttttattttatagaaaaaatcaagataagaatacttgagtgaaacctgattctaaaattaattgctaaattacttttctttttttacatgagaaattcctgacaaacacgtacaaatgagcctcaatccttccaaactttttctgcaacctagatttcttaattgttttttttcttctgtttgagctacagcttaaagtgaacatttcagaattcattgtggtgtggtgttctactttgacattagctctttgaatactactttgcactgcattttaacaatcttgcaatatttactctatgtatataaaatgaacctagcctatcaacccagatttttatgtttttaatgtaagtaatttgtatacaaaatcagttgttctcatggttatgggcacttgctttgctctgtgataatttttagctcgtccctagctactgcctgggttcaagttccagctctgcagcttattagttctaggagcttaggcaagttgctcgtcaatctgtgccttagtttctgttacgtaaaatggaaataaaaataaataaaaataaaataaaaaggaaataaaactccttcagagttaactgttaactaaactgttacctaaagacaaattagttaataaagtgctgtgaacagtgcctgaggcagagtaagccctgttgctgtcg

SEQ ID NO: 59842 - DNA, 1426 bp, Bovine  19866880587200
ttaggttggtttaacttataagactgaatataatatttctccagctgaaggtgatcatgcattttcttggtcttatacattagggcctgaaggacttggtttcactgtggttaccagagattcttccatacatggtccgggtcccatttttgtaaaaaacattttaccaaagggagcagcgataaaagatggccgcctgcaatcaggggacagaattttggaggtaagaattagaatgaatatcttcaataaaatatttctttgtgtttaagtaaatgaaatttattaaattttaaattaattatattgaaaagtgttcttgtagacaagataaggacttgaattagaaaactggttaatcaatagctaactttgtaagtcctcaataagggcagtgatatggagtcaaatattgaaaagtttttcctacctcctctttcttacttccacctcttagagttcctgggggatttgagtcatatccatcagttcatcatatattcagttagagctaagaattgcaaagttgcactcaagtgcttgtaatagtttctttaaacttctctaagaatgggccagtcggtgttagttcagtctatgcatatggagaagtatttgggatactcaaaggaagaggctttcttttttccatttatttttgtttaatagtattatcttcttgtctacatatattgtcaatttacctttcaagaaatcatcttcatggaaactggttcggtttaacttgcccatggcatggaagcaacaccagagctttgttatagttctagatcatgaaagaaaatggttcaaatgattaatgtagccccaaattagaatctccaataatgtatggtaacctagttaccataactttctaacatagagaacactgtagaattataacaaaaactcatgtctgcaagaattgaccatgtgataaaaatccatttctcctgtttatattcagtggagaacggtaccagttaagcatttgaaatcagcttactccctacttgaggaatgattctctggtatctgtcagtttgatttgtcttctctaagaatgtgatgtcttagggaaaaactgccgatgccaattactgaatgtctgagactgtccagtgccatagtaatgatggctggcatattgctagtatcataaacatgattggtttggactcgcatactcagttttcagcttcccagaatttccttgatcatgagagcccatttgctgcatgctttcaaaaaccgtctagggcggacaggctggcagtgttgtaacttggctgcttatatgcctgtctgcattaggtcaatggcagagatgtcactggacgaactcaggaagagcttgtggccatgctgaggagcactaagcagggagagactgcatcgcggtcatagcccgccaagaaggaac

SEQ ID NO: 59843 - DNA, 1069 bp, Bovine  19866880592341
tatagccctgaaatgttatgatagtgttacattattcagaatgcagttgttcttactgttaaacactgaaggtggtgtctatctaaagatagacttcaggttgctttcttcaggaacataatatcattgttttgtccagtaagagatttcacttacattgtttccacttgcaaagctttttctcagattttgtcttattgaatggaattctacactttgcagtagctgagaaacaacatggctttcagtaagttaactgtattttaaatttatttatcaatttcttggaatgataacttctttataatattttaaaggctgtattgaaattgtttagttttggtatatgtatccatagtagtagatgcccaccaaatactagttaagaagaagattgtcggctttgttactttaaggattttttgagagctggttctgtattagaaaggagcttggaaatagtatttttttttttttttgctattgctctgagttgagttttgtattatatttttgtagttaaatattgatctcttttttgaaattcttaattgcttatagatttttaaagttgatctttattttatggttctttgctttaaatgttccacttaatttcaaatggaaaggatttaaaacagctctaaactaggacagactgcatgtacatgttgtgaaaaatgttatcaagttttaaagttgtaatgccactatgatggcatttactggtaaggtttctcatcatgtgctcaggggaaggaagcaaagaatcttactgtattgctttcatgaccttgttacaaaatgcagggacttcactgggcttttgtgttttaaactagaaaactcatttgggtatctgacattatttttattgtttctccccatagcttcctgagtggcctttcaagttgtttttctcttatatcatgatactcttacataccacgccttcacaagaggggtctgtcactacttagacactacctgttaggtgctctcagacccttctgggttcctctcccctcttcttcacctggcatttcagaagagctagtgtgatgaggca

SEQ ID NO: 59844 - DNA, 1246 bp, Bovine  19866880606035
tgagtggttctgtgccaagtgctttacacacagcaatacactttctctccagaacaatcctgtgaggtttattgcgaggcccattttacagatgaggaaactgagggtatgcaacatataagtatcatgcttatagttcaaaagacctatccatgttggaacttgtggagtccaggcagtatggtgcctgtgatagactcttaactgctgtagtagttctcaacttctgcaggccaccgtgactagacctagccacatgaaatcccaagatatatttctacagtggcagtaagatgtcattcaatttcacactctccacttaactacacttacgtttcatctttcttatgttgtatgaagtgcaagtcataattagtagtctaataatagcaaacttctcaatggtgagggaagtcattacagtagttaacacagccatgtcctctgttagaaataaatgttccctttatctaatgtaccaaaaaaaaaaaaaaaatcaatatgctgaatgcctctgataacattggttcaactagtatctcttaaaattaaactcaaatcttgccatacaacactttgtggtggtggtggtttcgtcactaagtcgtgtccgactcttgcgacctcatgggccgtagcccgccaggctactctgttcatggggttctccaggcaaggatactggagtggtttgccattcccttctccaggggatcttcccaagccagggattgaacctgggtctcctgcactgaaggaagtttctttactgactgagctaccagggaagaccacaacactttatagcaggatagaaagaggaataaagtccttgtaagggccctgaatgaaggcccttactgagagcatgagcccaaaggcagcagcacattcctaccttggactctccctgtcttgaggacaagagctctttcctcactgtgctaggtgtgttcttcactattatgccccactctttgtgaccccatggactgtagcccaccaggctcctctgtccatgggatttcccaggcaagaatactagagggggttgccattcccttctgcaggggatcttcctgacccagggatcgaacctaggtctactgcattgcaggcagattccttatcatccgaacaaccagagacacccatggcaggtatatcccttgctttttctacctacaaatatccagaaagggaaacatccagaggctgacacaggaagagaaattgtgtaacttca

SEQ ID NO: 59845 - DNA, 941 bp, Bovine  19866880642287
cctatcccttctcctggggatcttcccacccacgaatcaaattggggtctcctacattgcaggaggattctttaccagctaagctactgtagcttggactatacagacctttgtcagcaaaggttggtttgtcccaataatggcttttatatttttaattagctgccatatttttttaattaaaatatttcacctaaaaattggaatccctatttctcctaaagcatcagatgatctggcaaccagactctggtgaaggacctgctggagtgggatggaggccactgtctagacaaggcatgtcttctccagtgagccccacacatccctgccacccctacattcagcatctcactcaatccagccacacctgcttttccaggcttttgaattgatgtccctgacttatagtacatttgagaagagggaaaagattcttagaggttactgcttttatttgtcatctgtctgtgtccttgaaatcacactatccagtgattctcaacctaaccttctaactctgtaagaaagggtttgttgcaatctttgtacaagaaatgacacaggccattatataaacgtgtatttaattttcattagacttatcctaggtagtgcttgaactttaaatcttatatagcagaagcaaatgtgtgtttgaaatagaaattgccagaagaaagaacaaggaagacatttagataatttcctctggacgtgtgaagtcagagcaagatccatctttgtattatctgtaagttgggagccacctgttcttcatgactgactgatgcttggaatttgaggccctgagtttaattaagttacacatgtgggaggaacaagctttgtagcagcagcagttagattattaatggactcctatattgaagtgttcacatgttgaaaggctaattataatataattttagttttaaaat

SEQ ID NO: 59846 - DNA, 2261 bp, Bovine  19866880720244
ccccggtatttagtgcatgtagatttgctgttttggtgtttagtttgcattttgtctccttgttgcattttattgaaaacagtattttttatgagattttgagatgtgatattcctgttttgatatttttctttcttccaaaggaagactatctaattattgaagtcattcttccagtagcaaagaagtaattgcagtttctggtctccttgatatgtgcagaaagttaacctttatggtactggtgagatttattatttattgggactggagcttataagctctcttagaagtgaaccccgataaagcaccttaatcaaactttgcacatgtgtatatgattaatggggtgaatgtgatgaaaacgtgagctgaggaagttgctgcatttggtgattctggcttagcaggaagttactgatatgtgtcatgcgttcattgcatttatttacttaattaggcagtgttgggagatctttccagagcccctgactccttttttggtgcttgactatctgtcttcatcatctaagtaaccgctgaccaaatgctgaaatatgtgactccacttatgagtttgcattaccttggaactagggcaggggctgagcttaatgtagctattaggttttgcatgatgtcttacagtgctccacacatggtctgtgctgtctttgtactggtagcttggtcattatgactggcaaattgcactgagtgctcttcaaagaatcatattgttaccatctggtgaagtagaagaaaggagtgcagaaattctctgggtctccatacctctatgctaaagagtttaattcagcttgcatttggttactaaattgtgcctattttttggataattctccttagagctgggaaaatgctcctaaaggtcagaatagcttgagtaatgtgaagtccccaaatgagacgtcagtcgtctaaaccattagaaaataaagcatagtgacttatgctaatttataccagtggacgcccttatttcccatctattcatcttggtgagacatacacttcccttccggcttatcctcttcagtcacctataaaggttagtgaacaacaagaagaaatgtttcaagtctgcttatctgtgcaattttgctatttgtacgttctgaaagagtatgttaaaaagtaactgttctccccagtgccccatgctaatccagatggtttttctcaaggctttggaaataatagaatatgtggagaatagaacaatgtaagaatataacttgaatagaatttaacttcttgtcatcatgagtggtaagtaagcattgtatcaacctggattctgaatttaaaaacttgttttgcagattttttgttctaaaattaagataagattccttgatagttatttctctatcaaactgtatttgaatttagcattcatattttatacagcttaattagatatgtttagcgctaagagtctgacacgactgagcaacttcactttcacttttcactttcatgcattggagaaggaaatggaaacccactccaatgttcttgcttggagaatcccagggacaagggagcctggtgggctgcagtctatggggtcacagagtccgacacgactgatgtgacttagcagcagctctatataattattcataaatggacacattgcaaaaaaaaattaaaaacgccaattgcctactggtcagcataaaaatctcaacaaaatcacatggaacaagtatttgaactcattttttacagatagttttgactatgaaaccgtttgagtatgaaatcattacgactcccacattgagatataaggaaaggaattaaaaaataaaataagaatagcattttacaagtggctgccctttaacccattcaggagacattttattttttagcttcttgtaacaagttttgcttggcaaaaactgcttgctgttttgggggctgttttcttcagtagtttgttaggtgattgctctgcttttaaattccagaggagtgcagtactctttaattttcataattgcaattatgcagaatattacatttatgtatgtatataggtatggttctagttaaggcttgttaaacttcttgtgataatacataaagacaaaatttaaagcatgtgatgattgtgtgttgcctttggttcagtatttacatgtccatagtgaaaaaaaagaataatgttttttccataaacaaattggagttgtgtgatggacattaagcacaaattttatcagagt

SEQ ID NO: 59847 - DNA, 1113 bp, Bovine  19866880740000
catttggtaaatgctttggtctcatatttaaaagtcactgttacttaacttaatatttttataatccagcaaggacatgccttctttattacatacttgctgtggacaattttactcctttggctaaccatttttagttttttgtgtctccttattttctactccaaatgaatatttgaaagatcaaattagtgattcgatggttctgactattgtgaccattgattactcattttgtttcttctttttatataaatcattattcttttcattttccagttacaggccatttaaaatatgtgcatgtatatatagttatacacacaaatacaaatacacacacactgacacccaggtatgtgtatatattaagatatatatatatgtatatatacacacacacacacacacacacatatctgtatctatataaatgatgttatgccttgggttttaaatggttaatttatatagcacagttacactgctttgtaagcaagttttcagtaccatagcatttcatcatatatagcaaaatgagtatgtagttttttacatactcaaatcggtgttaaaactgaagatgaaatcgtacttagctttctttcttaaacttatgcccatcctcctaaaagcagtcttgcaaacagatgtagggaaaaaatagtgagaaagctgttgtctttcagaaggaaaaattgcatggtgatattctgaaaggctctcattggagaataaaggatgtaatctctgtattaaacacagatggaatatttcagtctcagctgtcatcgaagaatctccacattagtttggattgtgcacctttggggcatggataaatgacagtgataaaactacctctttgctgagcaggagtacacaacatccctttatctatgccatctggtgatgcagaggatggcaaatactctctgccatgatttttttctttctttgggatttatacccttttttagcatagaatgtgtttgaccaaaatcagtctttgctccgatttcaggggcaacagattgaaaagagaaaaagaattctaagattaaaagtgtaggaggagcagagaagttagtttgatgtactgttgggatattt

SEQ ID NO: 59848 - DNA, 1223 bp, Bovine  19866880753968
ttgcctggggaatccccacggacagtagagactggtgggctacagtccatggggtcccaaagagttggacacaacggaagcaaattagcacacatgtacacaataaggcaatgatctcgtgttttgcacctgcttttgagaggtcaaactggagtgtatttctcaggtaaatacctaccttggaaaatgaactgacggaaaacacattaaaatagacccattaacgtggtatgcacattttaaaaaaaaaatatctacatctcaactgctaatgatgatgtgttcctaattcaaagactaggtttagtttggtaaccacaaagtatcccctgactactccttccccagtgggtatcaggaaggaacatctgaaattagaatttgcctagaagatatatcatgcataagctttattttaaaaacatagttcaatcttttttcatgtttaacttgtaaaggtcaaagtattataaaaatcaacaacaacaactacctcaaagatcaaaaagaaataaaagagctttgggtaatttgcaatatccatgacctggaataacagacatgatcaaaagagccacgtgctctgcacaatctcacatcatcgacatctcttcaaggactcagacctatttttatactcaaacaaggtaaagctgtgtgtgtgcgggcataggtatgttttgggagtgagtggggtggtgggtggaagtagaatatgaatgccctcgatgacatccctaacatgcctaaatgcttagcacagagcctggtacacaagggaaggttaaacgctgattccttttcctctcacagcgagccttccctgactcccagactgcgtcccacttgacttgtttattcctattctgcttttactttgttgcttctctttaatctcttcatcacaggattgacagaggaacagagaaagtatcgagatcaaacacatcaaataggtaatttttgtttttcttttttccttgctcttcatcacacaagaacacacaacctttagacatgcagtgcagttccccgcctagcagtacatggtttgcgctgtctgttctatttttagcataacttgaagcaatataccaatgcctttagtttttaccctgacgagtaaatattttaataataaatgtcaccaagtgcatttataacagagtccctcaatattcatgatgtggtttgctctgtagacagcctatagcattctgtca

SEQ ID NO: 59849 - DNA, 837 bp, Bovine  19866880896298
agtgggaattattccattttatagatgaggaaacttgagatgtcaatgcaaatagtaagggttctagatgtgaacctaagtcactttaaactttttaaaataaatcactcaaagtttagaattaattgcatttgacttcagatgaacaaggtagataaattcctaccagatagcaacttattttattatactttcctaatttcttgaattcaggttctcggtgattaaaggtctcgagtgtttttaaaatagcatttagacttttgtgctaaaaactttttgatacttattcttatgaaactaatgataccctaagtatactacttgcaagttattttccaatttctggtttttgtcattagcagtataattcagacataaaaaaggaagtctttctcaggtcatgtttcatgtgtaggagagagaaatcaatgttcacaccttgttagagtttctgagaacttttgtgttcaggaatttatatttaggaaattcattgattgtttttaagttcccccaggggcaattgagctcctgggctgctaattctcaataaccaaactcagacctgacaaacaaaaatgcattagtctgtgacaaggtataattagtaatttccctctgaacagtaataatcattttaactgtcagaaatatttttttcctagtaaaaatattccctttcaaaagccaaattaaaatatgaaagatatttgcctagttgagcaagcaacgtgaattggatcacctgaaaggaagctatatatatctccacttttggaatgcttcataggctaaatattttctagaattcctcctgatactttcaccaatctc

SEQ ID NO: 59850 - DNA, 987 bp, Bovine  19866880994101
actctgtaccctccaatggtttcctccaatgttgacatcttgcaaaaactatagtgacatacaaccaagatgttgacattgatacactcaagatataaaaccgtttcatcaccaccagtattcatttttaaaactccaatttttgatggctaagtcacctcaagttcagttcagttgctcagtcatatccgactctttgcgaccccatgaaccacagcacgccaggcctccctgtccatcaccaactcccagagtttactcaaacttatgtccattgagtcggtgatgccatccaaccatctcatcctctgtcgtccccttcttctcctgccttcaatctttcccaacatcagggtcttttcaaatgagtcagctctttgcatcaggtggccaaagcattggagtttcagcttcaacatcagtccttgcaatgatgcctccaggacgatttcctttaggatggactggttggatctccttgcagtccaagggactctcaagagtcttctccaacactacagttcaaaagcatcaattcttcagcactcagctttctttatagtccagctctcacatccatactcagctagtggaaaaaccataaccttgactagatggacttttgttggcaaagtaatgtctctgctttttaatatgctgtctaggttggtcataaccttccttccaaggagtaagcgtcttttaattttatggcacctcaaaggaatcaacttaacactgaatgaagttcaaagaagcaagccagaaattcatcaagagaacattgatcattagtttctggctcttaattggaatgttttggttgtcagtcaagcagcaacaccagtagagaacaaaagacatttccaatatccctttaaagtagtaagaggaaaaaaaacaaacaaaaaactaatatatctgatagaccttggttgagtgaataattaaagggtttttatagattataatggactaaatgaaaaa

SEQ ID NO: 59851 - DNA, 1201 bp, Bovine  19866881032028
atgaagggcctgtgggcaccagaaatccagtacactcacaggagtcaaagatgtttacaacgtgaatcagcaattaagagtaacatccccccaccccccaccccccacaaaaagtcatatctttcattcaagcaatactaattatgctgtttagttttgtttttccaaggcaaatgacaagaaaaatgtataaccaagggagtggttgacagaagtgaagaaatatgagacaactaaaactgagaacaaaaaataatgagaaaaatgattaaaagaactgaattgtgtgtcttgctttactggtaatgagcctgaactaactgaagaagttgcatgtacttatggaacctacaggagagctgggggaagcaggttcctcccaatctcttactggattttgttcccaagctgggtggataatataagaacaaggagtgagagggctgccctggggtcaccctcattgtggcccctcaagagaagctggccatgtagacaatttctgcttttccccacctctgcccttagattccaccctgtctgaacttatctggaatttcacacccattcatactcacatattcattacctcactccaccccctttcctcagacctgttgaacaagaatctatcttccacccaacgttagtttcctgcataacagattaccccaaattgggtggcttaaaaccaacagcaactcattctctcatggttctggaggccagaagtctgaaatctaaggtgttggcagaactgaactcccattcaagggtataagagagaatccctcatggcctcttatggcttctggtggctccaagtattccctgacttgtagccacacaactcaagcctctgccctgacttcgcatagccctttcctcttctctctttgcctttctcttatatgaacacttgtcttaggatttcgggcatgctcaaataatccaggatgatctcatctgggagatcatcttgacttactgacatctgcaaagattctttttcagcataaccccacccagaggtttggggtagacacatctactggtgggaagccatcattgaacctcttctaaattcaaagatttctgacaccataggtaagagaacaatcaaaaagaaatccattcacaacccaccaaggcgttttgtaggatactttttcttgcatctccagttttcttataggccaaa

SEQ ID NO: 59852 - DNA, 1568 bp, Bovine  19866881041616
tcagttcactttgtactctgtctagatctccgacttctaacaaaaactatttgtactagcacagaattcagctgcaacttcctaagaaactttaacggtgttctaagaacactgcgtatgaacaaaaactcaccttttccccttagcattctatgaggagaatctcctaagtcctcttaaagagaaacagatttgggaacttaaaaaaaaatatagaatggtcttttatttttttcactctctggtctatggtaattaatgtcgactcaataccatgctcaatcatctatctcccttgggacagtactttcaattaaaccttttatttcatccaagaatgtctgttctcattgaccactgcactttttatctgcggatttatgataatctaatgcacatctcctcacaggctgaatggccttatgaatccttattgttcttataccagaagagaagtgaaaaacaaaattagctcctgcagaagacaggaaggaaaccgcatttgtttaacacagcgagaggcctttcactacctgcccagtggccttgaccacttcactgccctggcctctcaatgtgctggctgcccttgccgggctgctcctgtctgataagaagtgcccattccctcgagagctattgagaactgagggtgagaggcaatgcgatctcagggttacgttttcaaaggtttgtgaaggaagtaagacatttacatattcttttccaaagaaaccctacaggttaaagaggaacctctgaactgttattgatggcaaagactgggcttaaaaaagaaaaaaaaaaataagcctctagcttgtttataggcattttgcctttactttccagctaggatatacatgatttggttcctatttcagaggtacacaaattatagtggcatgttattaacttaaccaacatgaaaaattgcatacatatattttacaatcgtactcagttatgcagctgcagacaaggctcgatctagcgcacttccatctccctacaatattggaaagaagtcactgttatgtatgttctcacacatgaacaattcagcagccttcatctttgtttaattttcttgtgtgccgagatagcacataaaattatcaagttaataatttcattaatatttatataatttatttaaaatctatctagtacccaagaggaactaaggtgccttgcattaataataacattgaaaatatctgccaagttttcaataagttgttattgttgacacagtcatatttttctaatagaagaatccagaaaccaggtttcttttttttaattgcattaaggatgaatattatcccaaacagtaatgaatagtgtttgtaactcattcatttttctctatgtataatggaaataagctttaaataaactgtgatggtgggtacagaaaaggcaatttctagttagaaaaaaggttttatgctataagcctgtttgtaaatttgattcttggaattcaatttttttttttcctcaaaagaaatgctggtagactggtgtgtaggcttcaattagccagcattatttgctcactc

SEQ ID NO: 59853 - DNA, 1144 bp, Bovine  19866881057982
tcctggattgagttattggtgtttcagaaatggccatttaaagtagacttcatgaaagtaaattcctcaatttattttttcagatttttcattattaaatatacttatagactacatagataagatgttgacaattgtgcttttcaaacaacaataaaagaatgcttttggttcataaaaggagagattatcaaaaagaatgaactttattaggagaaataaaatttattctaaaaaggaacatagattctatctgcttaagatagagactgacattaaaatgtttaggctaaatattcttttgaaaagtagaggattaatgagaaatacttttaaatgtataattcaggtgtacaaagggcagtatgatgggaaagacgtaaagtgtgcatttctttgggggaaagtcaagaagtgcctttagaaaccgaactaacttatggtaataaaaatctagaagattaggaggtgctacgatgtgttatgaaagtagtttattttcctttcctaaacatgtatgtttctagaatcagttttaagaggctagtttggaatgtcttttgcaattttaaattgaaagccttttctggaaatttcaaaagttaatgtttatcgtatttttataaccatatatatcttcattgctttgcattatgcagcactttgaaactcagaatataatttagatagttcacaaagatgttatagtccagccaaaaatagtccatctttttcactgtatcatgcatttaaatattatatatgaatatgattatttgaatttacatttgtttattctataaacattcatactacattgtggtagttttgcagtaagagctaagaagctctattattcttgcattaaattctttagtaaaaatttactgttttacgtaagtaagtgtattcagacttaatgaattccaaaagaaaagaactaatattagctttgcttcattgtgctttatctccaggatattttattctccttagtcagattctacgtagatacaatcttttatctgtttaaactcacttcttctgaaagcactttaactgtaagaactgaaagaatatatacatgagagcaagcagttagaagcactttaagagaaggattcttcttaagctatatagggat

SEQ ID NO: 59854 - DNA, 794 bp, Bovine  19866881059512
tgtaagagcttaataaatgttagcaattagcaaaaccaatattaatgatgattttattattacctatagtgtttgcaagagagactaatgacaatgcgacttgagagggagttattcaggcatgaataaaattcctattaattaggaagggagttgagaaatatctatttggctgtgtctaagacattaaataaaggttatctaaagctttaaccattgtcaacatccttgttattctgagtctgagaccaaggctgagactaattgtttgaatgtgataaaattagaaaggctttgaaatttctttgaaattgctgcctggtatgcatatgatctccaacacatcaaaataagtgtattagtagttaattgcctctgtggagaaggacagagttgaaaagattttaacaagtgaagaatgataaaaggaaattaatgtacattattcagtattaacatgttcagtgttgcagtgtcgtagacaatccttttttagtgtttttctttattattttcataaatatatttttaacaagtaaatttatgaggttttttttccacaagttttttagtacttcagttctccaaggcttgttttttttttttttttttttatatatataaaggcttaggtatacaagaatttgtagatttaagaaggacagctgtacacgtgtctttattaaaatatttcttgtttagatttcagtaaaattgccttcaatcagctttggagaacaaagagttaaatcattatataaatattataccttcatgcatttcagtctgtaggc

SEQ ID NO: 59855 - DNA, 4354 bp, Bovine  19866881097960
agttggactttttaacgtttgtgcaataaatataattatttgaagtgcccttcagcacttccccatagcctccatgaaggggccgtgatagggcttgcttcggggtcttccatggtttctagcttgggaactggcttgttgtagacacttggtatatgccaaagtgaattatcaaaacagaatcctagagggggaggtatgaaacccatttcattttatgaatctagactggatttcagaaatggagttaaggagagtttcaggcaatttcatagtcagtgtaattgaggaaatgggctaggttagcgaggtagtggaagagtggctgaattcttattaaaacttggggtatcactatattgcttcttaaaattaccccctctaggtcttcagccctgagggttcttttgttcttgtctcatggagggagctatggaagagaatatttaatcactcaatgcattgtcagtctggatgatgagaaatattctgtgtattccagcctgtgcttctgcttctgaaagaagttcctctccctctgagtgaatgaattgaggcttgaggatttgggagggcaggtttttttttttttatatataaacaaggttttgttataaaaataaatgcaatctatattttatcatttcaattcaggccctaagcatgcacggtagttacctttcatgaaatgttcttgcaataatgctatttcagtgggctttgtaatgaagctttgatttgcatcgctgtcctgagaactttctgacaatgctcaggtaatattatgaaggcagaaggaaatgaaatgaaatgatggtaatgcatgtccattgtgaaaaatgttaagttgccaaggcgatgtcatatcaataatattttcataaattaaattaagatacatatggcaactaaatattgcatttctctttactatcacttcaaatacatgaggataactattaggatgaaaaccagaaattagacataaagcgtctcagccaaaatgagagatgtgctattcatcggttcaacctgatgtgctctcaagattcccgtcacgttcacttcaggcttgcagcctctccccctccgtgttctccagcagcctctctgctgtgctcccctgcttcctgaagcagaattgctgttgagaattagtgagagtcagagtaattctattaagcctcacttccacgctgcaaaagcaaccctctggtttaagttcttctattccttttaaggatcaagctggttttactttctttccttccttcctttcttttacagggaggtatttattttcagattgttaatggcattactacttaaacttgcctgcttagggcaaggttactgttgttgtttagtcactaagtcatttccggctgttttgcagccccatggactgtagcccgctaggctcccctgtccatgggatttcccagttagaaatgctagagtgttgccattttcttctccaggggatcttcccaacccagggattgaacccatgtctcctgcattgcaagcagattctttagcactgagtcaccagggaagccccaaggttactgtactcactcacaaaaattaagttttccaaggtgagataatgcacttctgttgtctcagtgaaatgggaacagatgatatctaccttatcagtcattctgaagggcaagtgtggttctgcatgtgaacagcttaccacagtgcctggagtcagtgtaaacaatagtatttaacttgggcttaaggatctggattcaaattttatacctttaaatcacttgtttaaaaattaattggttatatagagcaatatatgctcattgtaagggaattttaagataatggtaaccaaaaggaataaagtagaagctactctgattcccaccacccaccaataagcatgcacacaccattttcttattttgatgtatatacttctaaactctacttttcaatagaaatgggatcataatgcatgtactttatatactctctcatccccagtaagtatattaagatttattcaatatcaatttattcttctgcaaaactttttggactagctggcatagaacattccattcaatagtcataacacagtgttaaatatttagacggtaccaattttatgtcattttaattaggatgaataccccaaatgcatctatttcattttaaacgttacatcaaagtatttagctctaatcctacaatataaaaacacgatgtcatataaatctatttaatctgctttatataaataaattcactcagtaaatgtatgtactcttgctgtatgtcaagaactatcttttacttttttcctgtttgtttgtttgttttatcccaatgaatcataatatagtttggatagtaatatttatttctgagacttcttttctgtacttctttactgtaacaatagctctgtgacctacttagaagctgtttcatcttggaaaaatcacttaacctcactgatacaaggaattgtcagctctaaaatagggactaatgttcagatatctcacagaaataatgtatgggggtgtactattacaacaagaaattctaactgctgacttaatttcatttctaccatgtctgaaattgatttgcttgagaaaataagttttgccctgttttatacttaaacgattgttagcttttatatttctcttttgtctctcagtttatttagtctaaggatgaataaagctgatttccatttattgttcagcactggaaaatacaatagtagagcaaccaagtggaaggcaaaggggaggaaatgggttcctcaaaaatgcatttctaaaaatattaatagtaacattgaacgtcagtagagggatgacaaagagaggcacgtttctttaaagacaaagggcaagtttattttgaaggtagggagggggaattcaccactttcatcaaagactatcaaatattaaagaaagctcagaaacattctcattggaagagctggttttcatgtgaatggtctttttccttcagtgaaacaaaaagactatgcctatatagttatggcattcctttactaagattattcaatgctcaatttatcagacaaacatacagcaggttgaaaaggaaatatgttacttaacactataatgtaccaccaagtttgaagctaaatctcattcttttaaaaaaatgcataagaatgcactacagcaccttctactttccttttaatttatttaaaaatataaatagaactctcatgtgcttaaaaagtgatatgttttggtacatataagattaagatcaacatgtctgttcttttagtgggttagtggggaaggggaaagagagggaagtagagcttttattatcacctaacatcctacttcatcatgtttagtacttctaatcttatattcaccttcatttatttgaatatcatcatttctgctttcagtttgtttgatttatatctcttaacccactgcttgttatctttgttcttgaaactttatggataataatgtacaaaagttaaaaatccagtattgtatcaaagtattttgttaatgaaaaagtataatcctggccctaattcctactctctagacaaccattcacaattttttgcttgttttttcctagtgctgatctatttctaactagaaaccgtgtactctttttgatactaatttttcaatttaggacattagctttttcatccttatttatgaaaaatgaggatttactctcttacactaaccatgcttcacttttttttcctcatttttccaaaatacttataataaaattttagttcaatctgtgctttgtacttatattattatttactctgtgtgtgtatctgtgtatatatatttaacatatatatgtaaaatatatgtgcatgtacacaaatatatatataacatatgtgtataaatatatatatatgtatatatataatagtgtgtgtctgtgtgtacatatactacagagagtatgatgtattgtaactttattatcctagttctctaaagttaagtgattaatacatttgtggttgtttagtcactaagttgtgtccaactcttctgagaccccatggactgtagcctgccaggcttcttctatgtatggaaatcttcaggcatgaagactggagtggtttgccatttcctcctccagagactcttcccaacacagtgatctaactcatattctgggaagctcagttaatacatttcaatcaaaagtttctgttaaaaacttccagcagaaatataaaacacccacaaaataaccaagtgtgtatgtcagtgtagaggtttatcttttccttaagtattcc

SEQ ID NO: 59856 - DNA, 1404 bp, Bovine  19866881104437
cttccctgtcctttgctatctcctagagtttgctcatactcatgtccattgagttgatgatgtcatccaaccatctcatcctctgtcacctccttctcctcctgctctcagtctttcccagcatcagggtcttttccaatgagtgttcctcacatcacgtggccaaagtatttctaggtaggaagagatgcaaagattgagatcatgagacctgttccaccagactgcctggagcacagagtgcctcccctccaccctgaactccctcagggggtgttgaaggtcaacagccacagcagcacatggttcagtctctgcaaaggcagatggcaaatgcccttggcaaacacagatttgtagttgacacaaatttatgagcagatagttagaaatttggcttctcgagcttgtgtcctcgggctcaacgtggtagtgggtaatggtggagaaaataggtggaaaatcaagacctattttcagatttcttttcctaagatcttttaaacagttgtaacaaacttatcaacatatcaccccttttaaaatgtaccacttttcaagattgctcaagaggacaagtcactgcttcttcctatgttttgtttagaatggaagggcccagagttttaaatatcacctcatgttctccttatgatcaccaagaaaatgtctttcatctctgtacaggtgatatcagggagctttgagcaaaacaatcagaataaaataatgcaccaaaggtctagttgccttgtctgtttcccagtggggggcatgtttgagaactgttcacatagaacatttcggctgatattagaaagaagagtaagaacatccaactttagaaaggagggagttttgaagatacataagaatgatcattaaagcacctcaaaactcagttaaacaaagcaaatcaaaggatgaggccagagacagtaagtacaagaccagagtctggaagagctggctaatgagctttcagattaagttccgatcaaaagattagagaatagctctcttcagagcctggcaattatcatgtttaaagctgtgacaaagacaatgatattaacatatctaagggaagaaagtgttaacagaaaattctcagtggggggcagcatgcggaaaatgaggaggggaccaagaacaaggcctgtaaatcccaaccagtgaccaagaaagaggtgccctcaccagattctagtcatctcctcggctggtgctctcctcacaagggggaagaatatatttcaagcactcttagctgaagaacccttcattaagaaaatctaattcccatttgtttgtacttaatattcaccaagcaatcttgacttgtaggttgcatttccatctgtttgcctgagggagaaaatgtgagattcaaacaccacttcg

SEQ ID NO: 59857 - DNA, 1810 bp, Bovine  19866881109494
ctttggcattacctttctttgggattggaatgaaaactgaccttttccgtcctgtggctactgctgagttttccaaacttgctagcatattgagtgcagcactttcacagcatcatcttttaggatttgaaataactcaactggaattccatcacctccactagctttgttcatagtgatggttcctaaggcctaattgatttcacattccaggatgtctggctctaggtggatgatcacaccatcgtgattatctgggtcatgaagatcttttttgtatagttcttctgtgtattcttgccacctcttcttaatatcttccgcttctgttaagtccatgccatttctatcctttattgttcccatctttgcatgaaatgttcccttggtatctctaattttcttgaagggatctctagtctttcccattctattgttttcccctatttctttgcattggtcgctgaggaaggctttcttatctctccttgctattactatggccgaaggttcatgacattgtacaggaggcagtgatctagactatccccaagaaaaagaaatgcaaaatggcaaaatcgttgtctgaggaggccttacaaatagctgtaaaaattagataagcgaaaggcaaaggagaaaaggaaagatttatggtaagtatgttctatccaatataaatataattttgaggaaaataatcagagggattaggggacatatgatctaaaacaggactgtctaagaaaatgtgtgacaaggtgataaatatatatttcagtgttacattttgagaaatctaattaagcaaaactttaccagaatcaaactccttgcctttcattcaaggaatcagacaaaataggcacatcttgttactaatcttaacagaggaagctaatacagtgttaaaataaaaccaatttaagataaaataatttatatgtccaatataatcttttttattgaaatatagttgatatataatattatattagtttcaggtgtgaaacataatgacctttttttttgtatacattaagagataatcaatgaatctagttaatactataaaacattttctttcaaaaccaatgtgaatgcattagtggaaaccaacctggggtttctggtcgatatttgggtcgctttaagaaaacaataggtaacattaacgaggatttgtgagttagttctaaatatcaatatgatgatgactagcaactgtacattttagtaagctcagaaacatcctaaaagagaaactactttttctttgggttaaaattatacacacatgttactggcatgtttacttatatttttctggcatgtttacttatatgtcaataattagagactgaatcatcaaccagtcaatcactattacttatcaatgttatttttttcatgaaggaaattcttccaacattgaggctatgagggtttccagctatcatcctcagtagcaaatgcttgacacttggagtttcatatattctcaagtgactctgaaggcccttgtctggcagcaatctgatattttgctgaggcatgaatctgaatcactgcagaaaatgcacatgacacaaaatccagcttctgaaacctttagagcatgatttttctccacttgtctttggatatacaggaatgcatctcaagtgattatttactagatccaggtaagctataatggagtaatgtaattttatgatcaaatttattttaatagcagcatttattatttttcacagtgtgaagggcttccctggtggctcagatagtaaagaatctgcctgcagtgtgg

SEQ ID NO: 59858 - DNA, 623 bp, Bovine  19866881156210
cgatgttacacagctcaaaaatggtgtggctagattcagttccagagagtttgattctggagcccaggagtgtcacagatctaggcagagaacagactcaactgaggaatacaatggagtgtttccataaaaggttaggaaatattgcccattgaatatttttaggaatttttcaactgccatatttctatgatgggtaagcatagaattgggggatttatgaactaaagtatttcttgtgaacacagtattaaatgcaataatataccctgagaaaacacttgtgaaaaaatttaaatatttggaaactttatcttataaacatatgatgctcattttatctgtaggctaaattaccatcagtgggctgaattcattcccatgattaatgataatagcttctttgaaagtcatcattctaatgcttccaaacatctatttgtcatggttagtattcagattagccaagagaacacaggaaaattctgatagatgtgaggtgaagggaacaaacaagagctcaagggaaacaggacctgtaacagagctggggacaaataaagaactcaacaaccattccttactcaccctcttagtttttcatatagttttatatagctaca

SEQ ID NO: 59859 - DNA, 895 bp, Bovine  19866881165180
ccttttttttttagtttgtaattggcaaattctaaaagtatcttaaaaatatatgttccaagaaagttaatggaatctaaaaattaaagcaacagcatatgtaatctaaactattgaaaagaatgcccaatattatatccattctgtaatagaaacaaaaaaaatcaataatgtttagactcacacaagcatgagaaagagagatttactaagcatacacaccatttgaatagtagaattcatagattttattcttctgatgagttttaaaaatcattaacttgtcccttagctattttctatatttattatggctgttaaaaattggatattttattccattgttgccccatggtaatcctgtgagatttttttcatttatcttgcagcaaggctggtgtcatcactattatgttttttattacaatctgctaaaaataaaacaagagtatagctacctctattagccaaaatcttacgctatctcctattcctacatttctgaagtcaaatatcttactcaaacacaatttcttcaactagactgataatcataataatgttctagatcaatatctctgggggtttattgagcaaaaatctggacatatttgattttgcttgtttatttccattgcctgcctttagtctgaatcaaaaatgacagtttggtagcattaaaaattcccctgttgaaaataatttcactcacctaccttactgtttatccagggtatatgcacaaaactgctagaacaatgcagatataaatatatctaatatatataaatatatataaatcagatataaacctgtcatgatgtatttataataaatatttatttggtcttaatcccatttctggcaccggcccctaaaaacctgaaatttccta

SEQ ID NO: 59860 - DNA, 1346 bp, Bovine  19866881174510
cctgaggggactactcacccaggagagcttgtgcatccattgaatcccactgactcccctctgggtctagagtctggagacctgtgaggtttataccataaatacctgggtgacattaacaatatctacctggtggctaaaaagagatcaatgctgagtgaagggtaatgttgcaaggattattctgtggataatgtaaccacccactagagatgaatgagcagtgactgtgttgaacacaactcttcactggtttagattaaaaataattttctgaccaaatttagtcatacataaaggtatatatttagcatttattatgaagcaggcacaaaacaccacatataaccaagtttataaatttaatgaaatttcagcagttggccttttaggttgcatgcagtgttcacgtgaagcagaaatgaccattttctagaggcagagttccattaacctcatagtagatatcaggccctggcatactaagactaagccaatggccaggcacaggacaatctaggaacaatagccctaagggcacaggtcacatggttttctagatttttactctgtttatacaatgagagagggagtctttagaatatgttatacaatccgtatatctttaaattcactatttgcaccagttaaaacccatttctaacatccctaatgcatattgacaagtcattaattttaccaatgaaaatccatttttaacagacattctactaattaagaatactctggtggtggtgttggaaggctaagacaactaaatccttgctaggtagcacccctggagaaggaaatttcttaatagaagactgatgacacatagggttgacattttgattatgggcaaatgatcatccttcaagtgtagcttaagctaactgacatatcctaactttatactccgtataaactaaagaggatgtttaagttatacacattctattaagcaactcatataactaataaaggacaaaatcagacttggctcctctgacccccgagtttgaaagttcttactactattgcatcccaacttgacattaattctacaaacagtccaaactcattaccctaagaagtagcctattctaagttagcctattatcaaaaatttttccacttaaagtaaaaatagcaaatttagttgctgctgtttatcttggagcatcattgtaaatggcattaaggcagaatttaaaaaaaaacagagcatcaggtaatgaaagcttagatttgtaagatgtggtcaaatgtaaaatagttcagttcagttcagtcactcagtcatgtctgactctttggaccccaagaattgcagcacgccaggc

SEQ ID NO: 59861 - DNA, 818 bp, Bovine  19866881175219
atgagattatctccagtcattgtcagatatcccctatggggttgggaacgggtattcctgctggtggagtggaacttaccttagcaaaagacttgaaatgagttgctcaatactagaggtggggagtggataggtggagaggattcaaagatctaatcttgctgcaaaacttagacatatataatggaactgagagagcaaaatgtgaaaaaaaattcccacctgctctttgagaggtgattgacggtgctgtgaattggcatccacaggaccatggttggcatcagaggttgaaaaccactttaagtgagcaactgctgaggtaccacaggcagccaggggcagcgtgacctgtactgtcttagtcacacttccaccatcgatggaaggaagcagtgtggcaatttagacagtttggggcccaaggcgtcaccctactgtgaaatccagagacagagagggcatttcacctatcattttatctttccatccttgtctgcgtgtgtataaaatcaccttgtcaacagcccagcctcagactcggctatctaaattgtcctgctacccagcctcactcctggaacttggagaattcttaggaaagacgtcccgtatttatgttggcatgctgctactttaaattaaatgaaaattagagttgaatcataccctaaataaaattaaaaatagcttcatttgcatgctgccactaatatcatcctgactccttgtgtccttttcaaataagtctgtgaaaaccaggaatttcctgacagctggacttcgagcacagctgttttaacctctctgcaggtgca

SEQ ID NO: 59862 - DNA, 1343 bp, Bovine  19866881267616
ttagtttggaagggcctaaaatgttccagatgtgaagatacacgcatgacatgcaatacagctgtcatggttaagtccaagttttgaacactggtccattaaagcatgtgtattcccatgattgaaagcaagactttggggattgagtgctaaatatttgttaacactaccaatggaagacacatttcttagggatctgggaatgtgagtgagggttgtggagtaaaagaagacaataagactttttggctaccagccagtctttcagaaccattctaagttcaatttcaacctagtaagccaaagcctaaaatgtttaataaaaagcttggctgttgtcttccaacatagttcctagtaaggaaatcagaattcaggtcttagctctttggatttgggaacaaaaaatgttattgattaccattaagaacactattagcaatgctggagatgttttaggaatttttgatgcaacgcttactcagcctatcatataatagaacctttggaaataattgtgcaggtagggattaaataataataaaaaaaatgcagaggagcctgaaggaagcagaaatagcttgtcgctaaaaataaacagacttaagatagtcccaccagaaaaataagtcttaaataataatagcaatgaaatctcacccctttcatgaagcttttcctttgaccttgaccaagtatcaccttccaattacaaagttctgtaacgcctacgttctagcacttttagagctgaaatgggaatcctagaaagcatcttagggaaataatctagccagctagctgaatacaaaatcaagttaataaaaatataatagttttgctacaaactagaaaaaaccaatttgaaaaggcaatagggaaaaaatcccactcacaatagaaaccaaataatacatagcaataagtttaacaagaatatgcagaacttatgtaagtaaaactaaaactattgaaataaatatgaaaaagctaaataaatatggaagatataaataaaggtagaactatactatgttcctaaatggaaatgctgaaaatttcaaagattttaattcttcccaaatgaatccataaattcaaagtaatctcactcaaaattctactgaattttcacagaacttgacaagctttttttttttttttaattcatatggaagcgaagatggacagaattaactaaggcctttaagaaaaaaacagaggcattactctaacagattgcaaaacatatcgtaaatctatagctgttaaaagagtgtgattttatcatagaaatgtattctaaaaatcagtggggtagcttaaaagtgtagaaagagaat

SEQ ID NO: 59863 - DNA, 720 bp, Bovine  19866881284323
gcaatcatgcaaacaagaaaagtcattttctgtagacatttgtgagtatctagatttaaaaattagaaaagttgtggttcttttaaatttactttatatagctataaaggcatttgggtaataagaaatgaaagagaagtttgagtttgaaaccagttagcaacaacttgaataaaatatgccattcttattacccaagtgtgatataggtataaatattactttgctgattataataagatcaatgaccaacatttggtatttgaataacaagcttctagatacattgtgttgtgtatatgaatttctacacccttgtgggtacttctgtcttgtcttacataaccacaagttgcataaaaccattacactgtgctaaacttatccatctctttgaaatctaacagtgtttatatctataacttcttgatgctgtgaatcccacaaaccatggatactgtaactttcacagaagctttcctaattggttcacaaatttttggctctttaatttcctggaaaaagttcctcattctcttgttattgatctgaaatgaaatgaataagtataattctgacaatcttcatctctctctctacctttttattaaagggcaggcaatcatggcaaggtccttttatatgtaaatcttattttgccactaactattgtaaagctttatagaagctaaaaatttaaaaactcgagtcagatagagg

SEQ ID NO: 59864 - DNA, 1929 bp, Bovine  19866881293951
tcatggtgcacctggactggcaaaaatggctaaataattccaagacaggtgctaataatgcaagctggtttctagtttacttgaggcagagtcaccaaatactctgggttgcctgggtctaaggggttgcccagaatagtattttcagcattaaaacccaaacaatcccagacagataggggtggttatcacctactaaggggtgaaaccagatgtcagctgtgaaccggattaacaagcggggcctcctggtttaagttccatgccagtgagtcaataatttgccacaggaatccttcagcttctggtgaaaataagaacaatgtcagataccacacctaatcagtacatagctgttaccccatagaaatacacagcgtggttctgttctattgctttctggctagctgagttaaagacaggcgatgggggattcactgaaagtgaagatcgtacacagggttggtcctttgtaactgaatatagcaaggctgcacctgtcccatcagggacccttctgtttcacccccttctcttccatccctgctcctgtcccctatatgaacagtgagagagaatttctcaaactttcctggccgtgaaaatcagttaaggcacttattaaaagtagatgcagtgaaagtcactcagtcctgtctgattctttgcgaccccatggactatacagtccatggaattctccaggtcagaatgctggagtgggtagcctttccgttttccaggggatcttcccaacccagggatcaaacccaggtctcccacattgcaggtggattctttaccagctgagccatcagtgaagcctaaaagtagattcagagacaaacgtatttagaatctccagggaggagctggaagctacatctatatctctatgtgtttactagataaagttttaagcaagttctccgggtgattgttgggtcatcagaactagcagccttgccagcaggaaactagacacccatttctcctctcagaagaaactaggagattcatccgccaccatttctgtcttcagaatacacagagaggggagaagggggagcatgctagtttctgctcaattcttctgtgtctatttcagagacacatttggaaagacagaactctctttctggatagaactttttttagatagaactttctttctggatagaacttttttagatagaacatttttcccctgttactcggctcagtttgattccctgatagccatgtttttggcaagcaaaaggagctggggaaggaaatggaggtagtttgaggagggggtgccaacggaacctcagtacagggcaggtagagaggcgtcagactcttggtgtcgagcttttatctgggtggaggatgaggagggttccagattgttaactcatggcggctggcagctttatttttttttaattaaataacccccagccagaggagcgcacaccaatcccccacctcctcctcatgaaacctcattaagcaagaggactataattaaacctggaatccacggctgacactcctatatctgtctgtggctcatgcgccagctttgggcacaaaggcagctcgctcctccgcattttatggggcagagggcgaggaccagggcaaggccatctttatttatcacttaatgggcaacttggcccttcctccagggtaaccagatgtgccttttgtccttagccacctccactgtgtatgggtgcccatcaaataatgcaagacatctactcggaagggccagtttacctcaagcaggtgaggactttgatttctgagagccagagaattttccagacattccattgcccagcgtttgggcccgttatgtcaggaatatttccacatgattggaggtggagagccatcagcatttttagcttaggcctattctgtcttactcag

SEQ ID NO: 59865 - DNA, 1107 bp, Bovine  19866881350281
atccttgaagaaagatgttgaatttctcaatgcaagtagataagtaattttcaattaattccacacttcctgcattgtatttgacagtgttgcacgcactgtgccagtttttcctcccacttttgtgccgaaacagcttaaccttttatttaagtgtctctggtccaaaaaacattaaaattgggcagctctaataaatactactacataatgactcgctccagttctctgcagtaattagtactctggtgaggaaatgtgcctctaggttcaaaattttataatgttttgacagttggaatcttaccaagcatgaaatgaaaccaataaaaaattctttttttatcattctctaagcattcggaaaaaatatattcttaaaatgtaacagtagtaatctaagaaaaaaatagtgacccactcagattcaaggggagggtttatgtagcattcaaatgaggagaagataaatgtaaaatctcataactaaaagccgagagcaacttctatttaacaggcaagtgcatctcaatcaccttgattagcaaagaaagataatatgcattaaaagcttcatgccagtcaaaaatctcacaaataccatattttactttctatgtttaactctctgatgatcatagtatctttaatcattttgaatggttcttcataagattgtttttatgtgaatgtaattttcccctcaatatccttgcctcccaaagaaagaaaataagcatgaccctgacaagatttcaaaaaatgggccaggatttcatttgtatcagtaaatgtcatgttattacctaaaataacaaaaactacaacctcaaagttaatttttacacaaattgaaaagtcaaaagctttaaaggtactaagcatcactacaagcccaaacatattctcagtgatacctgaattatattactgggttggctaaaggtgcattcgggttggaaaaaactcaaacaaaccctttggccaacccaatatttaaaattaaaaacttttattatgaaaagttctggagatggacagtagtgatgatggtacaaccatgtgaatacatttagtgccaggaactacagacttcagaacagttaa

SEQ ID NO: 59866 - DNA, 687 bp, Bovine  19866881357138
cttaagattttagttaaccaatgaattaatacttgctaacacttttaaagaattattacttaatttaatctgtgcaatcttgtggacaaatccaagtttcaatatctcctttaagcagatgacttctaaatctgtattgctaaccttgacctctctcttgagtttcaaatgcttatttcaaatgcctcttcctcataatttggattttcttcatggttcctttcttttgatcaaaggcaccaaccttcttcctgatcttcaagtttaaaagtctcagataagtgttgagtacctccctaactcttgtacacaaatacaggaaattctcaagtcctatataccctatgtctgcaacatcttttaataacacatttattgattatcctactctaacaattgtcttcaacctcccattactgcttacataaaataactcagtaatctagttggtccaaaaagaaatactgcttaatcaactaacactaacatttcttctattttttttctagaggctttatagttttagcttttacatttagatctataagtcattctgaatagatttcttatcaaatgtaaagcacaggtataggtccttctctggttatcaagctattcctcgtcgaaggcttcaaagaagaaaaatgacatgatctatctagggtttcagttttgggcttcccttgt

SEQ ID NO: 59867 - DNA, 724 bp, Bovine  19866881510417
aaaaaaagcctaaaaattaaaactgattagcaacaatacataagaaaaatgaataatcgcccattaaactttctttaatgaaagtagctataactaactgttcttttaagatgaacagaaacaaagcataaagaagagtgctttggaaaatccaaggtaatttatcaaggtttccagtacaagtagtacctaagggaatcctgaccaagaagagaacttagtgagccctgttttaagcaaaggcactgtcttgttcttgttttgtgccaaaaggactatatatgagaactcaaagtcagaaagcctattacttgcatatgaaaaaaagaatatcactatttcttgccagaagaaatttggaatttactctcagatcatataagtgattaggttagaccaacaagtcagtcacaataggttaagctccctccaaagtcctatctggtcaaccaatttacttccatcatgcccactttctcccacagattatcatgaacttgatcattctaccatcctgccccatcctgtattctaactcccttccagtaagtgacttacctcactgcccttttttgcccattgccaatttccagcccatcagcaattataagaaagacaatactacttttgatttcccctgaaagaagaaactagctttaaaccaacatggaacagaggacctcccttcagaatatgtagtaaagtgctaagaaaaaatcattta

SEQ ID NO: 59868 - DNA, 621 bp, Bovine  19866881533318
ctagaatagttccctctctttctcctccgatctctctctatatattcctgacaagagaagccaccaaggagtgaggggaacagaattaaatggtcaaatagtgctgtctaaactcagtctgtgacaatcacttgacccaggtcctcaagaagcagcagctctaatattactaataagactaaagcactcacttgtgtattcagagacgtcactctcttaccctggacagagcaggctgcacactcagaactgtgcctagaacacaatggcacacaccgcagagtgagacaacacagaagccacaaccgtctaaattgtttaatgcttatcggctctcagtaggagaggtggtagataacggttaggtattcgccctcactatgtgcacaagcttctctggtcagcctacaatgtgggactttacaaaataatactttgcatgttaagagggagggcacattgaaaaaccatacatgaaacgtaaaattggaaacacagacagtgcttttgaagagcagcccagaaggggaaattcgagtcaataattccacttgtgtcgagagtgatttgaggactacaacgtaaaggctcacttcacatttccaggtatttcctcattta

SEQ ID NO: 59869 - DNA, 938 bp, Bovine  19866881648725
tagcgacggaccaccaatataatgaggattaaaaatactaatatctgaacttgaaagggctacactaaaatgggaaaacagcaaaactctctcactcatgtcatcaagggaaaacaaggtgtactcttcttagtatcatacttgctctccagaaatcctatttactacgagggcatcaagtttgactagactggataaactcagcactgagctggggtggcctttcagaattgctattatacctcagtggccacaatgctgagactacgtcacttgtaatacagctgaagttacattgcttttaacagtgtctcaagacgtgacaatacttagggaacagattctctaacgtaggagagatggagaaaggctgggaagtctgtaagaaaggagagattagggcaaaacctgagatataatatcaggtacttttacaggtgaagaacagggcctaggcagaaatgaaacatctcctgggtgaatgggtccctcagccctagatgatgggcagcagcactcgggagatgagcagtgctcggaagtggtacgtagtaggaattcaaaatgcctccgctgttataaaaacaaaattctccttttaactttactgaaatgatgcaacagctataaagttacctgaacaaacaagaaacatgtgtgtgtttaggtgctctagactccgcagaaacagaacactagcagcctacgtgcccagagatctgagcagttctgagtcacaatcatttcacagtgcctggctggaaaatgtttttgagtcttattgctattttttgtctttattatattgagaatgggagcaaaatgcttgcaattttcacagtatttaatactcagagtatctatattatgatgaatataacctttcattgtattggtgggactgtcatgtaccatctctaaacaacttatttttagaa

SEQ ID NO: 59870 - DNA, 728 bp, Bovine  19866881662940
acgacaatgatctagtaatatctctaagaaaccagaagtattattttaatgtaatttaaaataagaaatgtttaatgaaaaaagtttgatatcaagtgaaaactgtgtgaaaaggcaaaacaaagtaaaccaaaggttacatgtggttaaaaatgtgcatattttcattaaaattataagttttaagtagaaacaccttatttcgcatagcattacagtgaattagattagcagttaatttacactttaaagatatctactattaaaatgatcaaagattttcatcactcatattttctgtctattaaaatctcagctttaatttcaaaactaaagaggcaagcatttgaaggcacttggccctaattcctcaactttctgattcactaggctttgaaaatatacctcagtctataaatatttcacattagacttttttgccatgaaagtaattactgcactaaactattataacaaaatacttcaactgagtaatccacaagatatgctttttgaaaagtttcattagagtcatgtatttacaaaactaggtcagataataagtatgaactgcaacagtataagacacaactataaatatactctattttcaaaactgttcaaaagcaaactgtttcagttattcagctgttttctctccactggtctataaattctcccaaggtatgttttattcaatgactgtaaatttcatcaaatgtgtcttg

SEQ ID NO: 59871 - DNA, 1573 bp, Bovine  19866881676104
attttgattttcccctgtccaggatttccatgccagagaatcttgaaaaattatttgaaagttgatcattctttcactttgctttcattgacaaagttgggacatgttacaaaagtgaatgtagttcttgttttcattccttaggagcctgcagaatgtggggcattttctaagccctgctttgagaactgtcaaaatgctgtaaccacctccaggagaaatgataatagtacattgcatccatttggcacatatagtccacaagacaaacagaaaggtaaggctctctactgaaaattatctactgcaagtggtgtgagaaaacacaagtgtttatttaaaaaaaaaaaaaaagaggaacaaaggggaattaattagactaagtgcagactttgttactctgagtcctgaacactgagagaagggtgggggagctgactcacaagttgtgaagcagattcctggcattgcctccagtttaagtgacagtttctgtgcttgctgccccaaacatggagggttatgtataaaacaaaccatgcctgcagaaacaaaatgacaaaccattatttttgtttaagaatattttaatatttggaagttaccaagtgtaaataacaattcaactcacgatatatatggactggtattaaaccatggagtgatcatagcacaatttgcagatttatgcttatttttgagtggtaaatgccatgaaccatgaccatgattatcttgtacacgtcacatttctagtggagttttacatgtaaaagccttagattttcctctttctgttttcaaaaattatgctttaggccaccaagaaatttatttccctgcttctcctttctgtttagtaactttaatttttttttgtactacaaaagcaatagatattcatgacagaatattaagagaaaggcaataaagagaagatttaatgtttctcatgtgtgtgtgcgctaagttgcttcaattgtgtctgactctttgtgactctgtgccatagcctgccagcctcctctgtccatgggactcttcaggcaagaataccagggttggttgccatgctctcctccaggggatcttcccaacccagggactggacccacatctcttatgagaaactgacttgactttctgtcagtatgtcttttcccatcttaatacaattaaatattttcttgacaaagcaggatttcctcctgagtccttctgtcacaaaggcaggaagaatctgggtaaggaacagcaggttcccctcacaccagaagtgccttctcttgaccatgtcccaataatgaccaagaacgtttccagcccttatataacttgactggcatttaattctcaagcatcacgtagtccagtgacaatccaaattcagggttttattccttgtttaatatgatgttcaaaggaacattggacacattccctcctatcttgtttcattttcagtgcttgtaaaatattttgctgaagtgataattacgtggtatatttttagaggacattgagacactcaaggaaatgggataatatctctaggaaggctggcagaggcaaa

SEQ ID NO: 59872 - DNA, 1559 bp, Bovine  19866881683696
aaattctaatatgtagcataaaattacaaactgttttactagtctaatgagtctaatgttattttactagtctaagttattttcccattagtcaattcaatactacacacatttaagtacaagttcatattagctctaagcctaccgtgcctcatataacacctcccttcctttcttccttacatatatgccaatctgataccagcctaatttccattttgtaccatggcaagagaggtccttttattgaaggctttcaaagtgtatacttgtccatgttcaaaacaacagtaacagaagtatatatcatcatgactaatgtaatggacatatccaggtttgcctgtgtttattacatatatatatatatatatatatatatacatgcacatatatgtgaatatatgttgcattcatatgtacatatttacaaagcagctttttatttctttgatcatctttgatggtatctctgcatctgtacaaaaaattcactttatttagactgatccttacttgatgttactatattgctgtcttgttttttcaatggagatggggttaattgtttcccaagagtttgggaaaatttgagttcttattcttaatttgacaaataatgcctagtttggtaaagcattctaaaacagtaaagtgaattaaccaaaacattacacagttgggtggattcccatagtctgccttgagcagagcacttgaaatgcagcgtgatttcttttaatgaggaatattcatgttgttctacattttctcccaaaaggttttcattataacatgtggcatatgttttgattaaccctttagttttcttttatttcacaacatgtaccactctgttgaaattaaaaaaaaaacaaaaaaaaactaacctaaaatgcaagctgcataagagcatgtgtgaaactgtactaagaggtaaaggatgcagttctatggatgcaggattagcaacaacctgcatcccaggctggccaccattttagacaaagatcttgcggctctgggaaaagttcaagtagccacaagctggtcccgacttcgccagtggccagctgttgtgaccttggaatatcagtctcctctttgggcctcagtgtcttacctacaagatgaagagttagatgaggtgactttaatgacttccaactcttcgattctctggttccatgaaggtcatgagtctctctgacactaaaaccatatcatcacaagagatcaaaggatgaaaactaagtgcaaataaaggtcggataacacatttaaaggcaagtgcttccaaaacatcaaggttcaaaggaaagctcacattcaccatggcatctcagaattcctctttaaagtgaactaaaacaattaaaatattctattatgccaggccagtcagtagcactagtggatcaggattttatgtttgcagttaacgtattttgccaccatcactagataccccatctaatatgtttgacatcagtagctttcttggctgagaatgtagccagacaccaagaaagaagccaaagcggggaggcgggggaagg

SEQ ID NO: 59873 - DNA, 1739 bp, Bovine  19866881882617
atgctctagggaaattgctgcattgggaattttcctacagagggattttactacacacaataatttaccttcaagggaaaaagtagaagatgtactaaacttaagcttttaaaagacaaggaccataaagacagccccatggattcagatcatctatcacaaatgtaagcaaagtcttccacagacattttctcagtggttaaaaaagcttaaatgccttttcacttttcaaaacaaaatatcataattgcttcaatttgtcccaatatacctagttctctaaagaaaagctaaaatttccaaagcatgttccttatctataaatattatacattttcctagatatcaccctaaggaccccaattcaaatgatttaggaatccatgtagattaaatgtgtgcatgctaagtcgctccagttgtgtgcgactctgtgcaacccttggactgcagtgccccccgccccaggctcctctgtccttgaggattctaggcaagaatactagagtgggttgccatgctctccttcagggggtcttcctgacccagagatcaaacccatgtctcttatgtctcctgcattggcaggtgggttctttactactaaagattaaataatcccatgtaaaacgtctaatataaatgtaatataaaagcaagcctgggaaaaatacaacttggtgaccacattacagagaaagtctcctcctgcatagttgaaagtcatgctgaatatgacaacaaattttgaactcactatcagttaggcagctaatacatctttcaagctatggttgttaggcataacaatagttgctaaattataagggaaacataaaaaaagttgctaaacataagggaaggcaatgaaattacagcctagatgccacaataagcaaaagaagtaattatcagtaacagtccaaacaccacgtgttctctagttaataatgatgtcttcttgccatgtacacaaatggcgtgcgagaattctctccccatgatattcattcattcattcacacacacacatacacaccctgcatgctcaccaaggagaggagaaaacaaaggatgaaaatgggctttggcattctagctgtaattttcacttttctgtgatatgagagttgttgtggccatcaaagccagaaaaatctgagcttaaatgagctgctttctcacagagatacctattctagaaccctttacagagaagagaggaatggcccttttcacctctttgactaaacagttacagtcaaaataatgcattgcaccctctaagtttagccacagaaaaagtatttaatcaattacccagttcaggcaaggaataaaaggtactgctacgtgacttacaaattgcaatcagaaattctttaaaccaaaatcagagtgatggccacaactgctcttacagactagtcccctttgcctgccatctgatttggaaagctacctgaattttcattttcttacattaacccttaaaatgtcttagtcttttacctgttgtccttgttcctctctattcccattgacttagtaaggttttcatttccaggaatgttttcaggtaccaaatactgtggaaggtagccactggccctcaagagtaattttttatttttttttaacttattaacctatttacattgtgtgctgagctcattcaccttgaaccctttaagtgggtgacagctgcccagtggaatctaattttaacattcgcactc

SEQ ID NO: 59874 - DNA, 1176 bp, Bovine  19866880465618
tgtttgacacagtatacttgctgagtcccagataagtttgtaggatagcagttgcaaagtgagtggtggttattactctaaagggaagtgtatttatatccatgtttaaaagcgttctgatagagaggtatcgctataaaatagaggttagagaatggcctggaaagaattggctataggatgattaaaggcagtgatgaaagaataaaagatgatggtaaagagaagccctaggttttgcaggatctgggagaagggaaagacagataaaaaagactattcatagggttttggcctctttgccaaaatgcaaattagaaatttgggatttaaaagttagggcagtcacagaatttggtttccacagaattcttacccctgaaaagaatctgtttttgtttagttgctaagttgtgtctgactcttttgcgacctcatgaactgtagcccaccatgcttctctgtctatgggatttttcaggcaagaacactggagcgggttcccatttccttctccaggggatattaccaacctggagatcaaacttacatctcctgtgctggcaggcagattctttaccactgagactccagggaagcaaaaggaagtgtaagaatcccagaagatatgcgatggggagcattaaatttcaaagtcatctcttaattattaaagttatattttaattttctaatataaattgcaaattaaaagaaatgggttccaaatttgtgacagataacataaggataaagcctattaaaatatgaattccatctttttagaaatcaagcacatgatttatcaatatccaaacaaaccttcaactagttgtactaatttcagaatgttacttattgatgccaattagcagtacaatatctctgaataccacatagtcctaaaattatttgtgcaatttgattgtcagtaaaattggtctacaagaaatattcatgctctaatttataggggcttcccacgtggctcagtggtaagaaatccgcctgccaatgcaggagactcaggagacacaatttcggcccctgggtctggaagatccctggaggaagaagtggcaacccactccagaattctttcctggagacacactacagaggaacctggtggtctacagtccatggggtcgcagagtcagacatgacttagtcaca

SEQ ID NO: 59875 - DNA, 1391 bp, Bovine  19866880492273
acctagatagtgccttgcacatgacaggctctttattatgaatactacgttgcataataaaatgcaataaggaggccaacatctaatatatatacatttttttcattttcaacttcactgacaacgtaaatcaacattctatagtataaaaatgcatcattaaataataaagttgctaattctctgatggtgtcaaaaaaatattaataagtatgactatttaatgactacaataatatagcccatcaagtaccttttaaaattccccattacttctacattccaatgattcaagaaagttaacaaccctcagagccagggcgctcagttcatgttttaatgtaatatataaaactacacatgctccagtgttaaaaatgtattttaaccaatacaaatctaatcaaatcaaataaatctttaactctgctttgtcttcaaaacaaacagaactactaaggaaagctactttcacactggaagaaaacatcaacagttggcatgttttgatcaaaaaaggagctccttaattaatactaaatgaaaaccactctgacagtaagttggtcagttctctttcttcctgaaattattgaactggttgttacaacatagaatttcaatgttttaaaaacattgtgcttgacagctgcttagagacatccaaattcaaaataatgacactatcctactatatcagttacaacctagtagatggttctatgaaaacacagatttttcatagaacaaacataaatttgctaaaacgcagttggtatacactattctaaggcacctctctaagcttcacgttacgtctggaatttttgtctgttataaagcaaacaggaaaagaaactgaaacaaactgtgttgtggactagactaaaagtattttaggtcttttcttaatagctaattttaattctaattagcaataatcaatacaaacgcacctagctgtctgcttctctttcttccccaaggcttttaataaaaccagttttatggtaaaatgtgtgcacattatgttaacagcctttcttaggggtataaatgtgttcgatatctgtgggaaggtattcaactgtaaagatattagaaatgaaagctgttgaaaccaagtagatgttttgtctgtaagtattattggtggcctgaagaggcaagagacgtgataagtacacacaaacataaaaggcaaaggatcagtaacttgtaaaaagcatgtttttttctacctgtaaaatggcaagtgattttctgacttccttcatctcatattcaaggtcccacgagaaagggggtggggatggaatagaaagcagaattgcttctaattctgagaaagaagaggggagagaggaattagatagaggaggagagggaga

SEQ ID NO: 59876 - DNA, 900 bp, Bovine  19866880603799
atatctgtcactagcatgatcaagtagggcaaaaacttaagaatgttcttatgtgcaccccctatatgcatcttttagaacattccaataaaactcatgttatcatccatgagaaatttaactaggctaattggctacatggaacaaattagtgtgacacctcatttatttaatatagtcatgaaaaattgaaaatgtctgttttgatgatctgacatagaaagacacaaaagtcctactagagaatttttaatgggacatataaccagttgatgttttaattaatatttagtctgtatattatatatatgcacttatgtatatatgtacattaaaataaaatgttggctaatagcaaatactataaaaaatatcagcttattaattaaaatccaatttaaataatttaattctaaactatatgtatatttgatctattgatttttatgaagcctatgtttaatataagtttctcaataatctaatcatagttattattgtctttaataatcccatgatataataaatacagaaataaaattatcattattattttgcccttaattagtagcaaaattacagtaaaattttactaatttgcactagtgaaagaggaataacagtaaactgatggaattttgaatcacaaaaaatattataaagaattatggttttattgtgctcacatagatataaaaataggttaacaaaatgatatctaatgtccagagaagcactaacaacagataaaagggaatgatttatacactttctcatttatcatgacttattaattattaataacatctttagaattttgttctgttaaacagtttagatgtgctccttggaaacactattaccaaggcttaacattcttttttaaagctagctgtattg

SEQ ID NO: 59877 - DNA, 1143 bp, Bovine  19866880636859
gttgggggaagggaagaatggggagttattgtttaatggctgaagtgtttctatctgggatgatgaaaaagttctgaaaatggatagtggtgatggttatacaacattggtaatgtacttagtgttactaaattgtactttttaaaatggataaaatggtaaattttatgttatgtatattttattacacatattttaatgggagaaatttgaaaaaagtaggctgagcagtactctcagctagtgttttcggctgcctgcctaagatagctttcattttagaaagtttgatgagctgattttagttcaaggaattcatcttccatgtaagtcacagtgcctgtgtgctttcccgatttttagtccctgtttggttttgaccctggactactgcacaggttcttgctcttgcaatttcacagctcttactgtaatgggaacaatctcttagctttggctttcatcttagatgtcaattctctcccataatcttgctgatcttgtgacatgctccctagtttttcacaatatatagcccaaaggtgataaatccagtgttaccaccacatgacatgattgcaatagttcagtgttaggattcatagaattcactttcatataaatgttggttaaaaagtatagaaagaaaactatggacataaagcttagcagtttttcttcagtggactcatgcgatctatattaaaatttgaaaccaacttaaatattcccatgagtttttaatgaatgatacttcattattcgataaacactcagaccatttccctgaaatgatgtttaattttttattcttatgttgagaccgaagatcagagactattcatctttgtatcttccaagtttagcaaagtgctcaataagtcttaattgacctatgccacctaataataatattgtatgctttatacattttcacatgcattacttgttataactgttaaaagaactttgaaagttagacattattattatttagatatgagaaaacttgatcttggggtagttttgacatcttgaaggtaaaacaacatctgaacagtagaaccaaactcttaccaatagcttttcatttaagagttgatgcatgtttggtgtggagaaggcaatggcagcccactccag

SEQ ID NO: 59878 - DNA, 1473 bp, Bovine  19866880759924
taaattaaatatatatatggagaaatattaactgttatttcataaaaatatttctacatgctgaggaatgaagcaccaaagatgagtatgcaagaaaactaaagacttcagtcaatatttctctgttaatctttatcctttttggtttatttctctttttcttcctgaagtgttagtcactcagtcatgtctgacaccttgtgaaccccatggactgtagcctctgtacatggaattctctaggcaaagataccaaagtgggtagccagtccctgctctagtggatcttccagacccagggatcaaacctgggtctcccacattgcaggcagattctttaccacctgagactttctgaaagctttatttaattctcttctcccattttcttattctaaaattttttcttatctttttatttctaatttgctgatttgctctagtatgtcacttactattctctcattggcaatgcaatagcatttttccagattgcatgaatgaaacttacttgaaattcttttgaccctaaggtgaatagaaaattacacttaaagtctttttgtatacctcctttctgttcttgaccctttacctcttacctaggtttgttttcacttcttgcacattcaggatctggcctggagtgagtggcaaagagacaaccataattggatgaagtactctgcctcaaataggacccaacacacatagaatacccttcacttcctcttgtgtgagtgtgtgtgtgtgtgtgtgtacgactctctttttgctggtactttccaaatcaggaacagtcaatgaaatagaatattacaatctccacattaaatatgcaagatttaatactttgtaaagagaagagacccaatttcattaaaatataatgcaatataaaataatgccttataatttgtaatgaaaacttttagcatcgtattttaaacccttgggaatgtactgtgtaaaatgctactgcaatttttattgcggttactccactttagtcaggatcatgattgcctcaatctgcctcttgattatggtgatgtggtggcaagggacagggtttatattaaaaaaattgacaactaatttggtatcaattaatatataaatcaatataaaaatcaaaaattaagaatattactttattttcttaagttactcctggaggaggaaatggcaacccactccagtgtatatgttatttatattataaaactatataccaaataatataaatcataacacaaatcagtcattgtatcattcaaataaattctaagcaatttattaatttctataaattttgatgtgctcttttttttttggcatggatgacaccagctaaatgatctccccatcagagatatgatttaatataggtaactgcctctgtctgttttaaagacttcttcatcagatttagagccatgagtgacagaaatctcagtaagtttataattt

SEQ ID NO: 59879 - DNA, 3072 bp, Bovine  19866880767926
tgaaagtgaaagaggagagtgaagaatttggcttaaaactcaacattcaaaaaatgaagatcacggcattcagtcccatcacttcatggcaaatagatggggaaacaatggaaacaatgagagattttatttttggggggctccaaaatcactgcagatagtgactgcaaccatgaaattaaatgacacttgctccttggaagaaaagctatgacaaacccagacagcgttttaaaaagcagagacattactttgctgacagaggtccataaagtcaaagctatggtttttccagtagtcatgtatggatgtgagagttggaccataaagacagctgagcaccaacgaattgatgcttttgaactgtgatgttgggagaagactcttgagagtcccttggactgcaagaagatcaaaccagtcaatcctaaagaaaatccctgaatattcattggaaggactgatgctgaagctgaaactccaatactttggctacctgatgcaaagaactgactcactggaacaaaccctgatgctgggaaatattgaaggcaggaggacgacaagaggatggaatgcttggaatggcatcacctactcaatggacatgagtttgagcaagctctgggagttggtgatgaatagggaagcctggtgtgctacagtccatggtgtcgcaaagagccggaaatgactgagggactaaactgactgagagccaccttgaagcccctttcttttacttagcctattttaaaagatgttcataatcactgagacatatggcaagaacaaagttactatatgttaaatttatagaatctattgcttttcttataaacttatattccttaaaggaatataaattcattagcacaagaatcgtctctgttgaaataccaccaaatatgtcctgtaaatcatgatatactattttcgtaatagcaacttagacaattatgcctgatagcagatcctaatttgccacactaaaatatttcttagtttatctgcatttctaagctacaagatcaagatacatatcttaggcatatttgggatatcaaagagttgagaattaaatgaacttatggccttcctgaaaatacaaatattaattccacattgcaattagaaatattttaatccactctatcatcttccaagtgtatgtagaacacagtgagaaagaacattttttttttgtaaaattgtaattttgactgtgcaacatagctttggatcacttcctcttaggaacttatgctctttctctgtcaaatggaaacaatcagtcctgctcttatttgttgctaagattaaagttctaaagaaaactgtacaatgttttgcaaatatcactcattattatttcaaggttaccaatcaagtatacattttacttctgttaaagccagcagacgtagattttctagaaatctgaaactatgaaattacaagcaatgtcataaatacctgaacatttttacaaaatgaacaagttatttaattaatggatgaatgaatgaatgcaaggtataatatattgatagtaaagaaataatagttaaatgttaagggaaattagagatgaatgaaaaaaatgtgccagaataaaagatagtgatattctttctattatttatcctatttttatgaaaaattagaattaaaaaacttcataaatagtttctatgcaaatttcccatccacagttaatatccataattgtctatttccagttacatgttgttaattcctgtaaaaatgttcatctcagttactgttgctctattaggaaatgttacattgagttacattagatttcctacacttttaaagacagtattcacatgttggttaatataagtttcattattaaaacttcagcaatttttacttcttatgcattttttagttatttggtttaattccatctctcagatgttattttttcaacaaatgaacagcttctgtgtggtactgataatttcctggagatcacagttcttttatatccatacagtgatgatataatccattttccattaaaatggtttaggattcagctactcaggttacaatttatctagcattcttacctatttataccagtgctgtacagtgttgactaatagcttggccatgtgttcagattttggatagcaaagcatcttacggagctaaatttcagaaaaaatgagattttacaacctagtaataaatattgctgggatatagttccgtctctgaaaattagcttccacaacattaatattattttataaccacaaacataatgtgcctataaagaaatgtgtgaagcatctaagattttatcctataggtaagctaatctttagcccaccacagtttcatatttgctagaagaagacacagactcttgggttagacacaaaaaaactttattcacatcaatagcaatagctggagtgtcaatatttgtgagtatgtgtgatgatttcctaagtgccaattcccacaagttaacacaaagagagcaaggtgatgatatatgcacatgcatagggttgtatttcaggagacaaacctcatttgggatgtgcaagtaaaatgcaaatctttgataatggggagtaaacatatctgccatttgttaaggaataagacactatctcccacttctgttcactattgaaagtaaattgaaagtgaaagcctctcagttgtgtccgactctttgcaaccccaggtactctacagtccatggaattatccaggccagaatactggagttggtagccattcccttctccagtagatcttcccaacccagggatagaactcaggtctctcgcactgcaggcagtttctttaccagctgaaccataagtgaagcccctgtccactattaagtatgagtaaaaaactattttggcacaaacgcagtgcctctccttgcaagcagtacagaagtatgagaaatctatgtgaatactgtgtcttaacaacatccaactattgtctatagggtcttaacttttggaaaatgtttccatcactacaacatcctgttgactgctttgatta

SEQ ID NO: 59880 - DNA, 1058 bp, Bovine  19866880785258
tcactgaagtccatcgtatttccttcatgtctttttgtccaaagaaacttaattctacagttctagtgtgtactacctgcaactgattttttccccctcagacttaccaattaagaagtgatcatcttgtaggaatgccagtaattttttaaaatttcataagcaaatgtagtcaagaaatatttttatttcatgtcattaatgtttagtcacaaacttttatctttttagagatataaaagtttacacagttaaaatctatgtcatttactgttgtttcttatttctttctccaggcctaaagtccaaaagcattaatgatctggtaaaagaaatagtaagagaacaatttaaaatttttcaaaatgacatagaagagaccgtagcgcagctcttcaagactgtatcaactgtctccaaggaacttgaaaatgtcagacaaataattcaacaagttaatgaatctgtaatttcagtagcagtccagcaaaagtctgttttaatgcaagaaaataggcctacttcaattgatatactggacctgaaagatcacattgtaaatataagacaagaaatgacccttatgtgtgagaagcctgttaaagaactagaagcaaagcagactcgtttagaagatgctctagaacaggagcgctccagtagaattctgtattatgaatccctcaacaagaccctttctaaaatgaaggaagtgcaagagcatcttttatcaactgaacaagtatcaaatcagaagactgttccaattcctgtatcagttagcaataacttcactgaatacgtatctactctacatcagaatataaagaaacaaggtttgatgttgttgcagatatctgatgatttgcatgcccaagacagcaagataaacaatcttacccttgctttggagatggagaaagaatctgtcagggaggaatgtgaagacatgttatccaagtacagagatggttttaaagttcaaattaaggacacagaagagaatttacaagttttaaaccaaacattgattgagtttctctttccaaggacaataa

SEQ ID NO: 59881 - DNA, 882 bp, Bovine  19866880789273
ttacttgtttgcaagacacttttatctgtaggaatcattgccatataacaaaaaagccagcagttcagtagtaggtatgtttacacaaagcttgaaaattttagtcagcatgactttgaggcagcaatatgtcattacctttgcaaattgttgggttataaaaaacccttcacctggctgagtgatgatgatgggggagggtgatcaaaggataagatttgtactttggtttctttgtggaaagggaaacacattcttcatttttgtcatactactaaatcacagctgtgcagaatttatgaatatattcttctgagacaagaaaatggccaccagaggaaatcagcaacttgttcttctcacacacggagaacagaacgagaaacctatccatcaatgactttagtgttgacctgtggagtaactcctgttaggaagacaaattaattcaatgactatcctgcttaatctttgacctttattttctaagagatttttccatatgacttactgagctgtctcaattatgtctgtatgtcccctgagaaaggtgagacaagaccacaaatatttcttagcacaaagtctttaattggggttatataccaacacatcaattaaatatgtagaatgtaagtcattctcactaatagcagagagcatggcagaaaatgctgaattagggcagttaaaaatattgaatagtaactagtattttgaactagcttgcagggttccatttaggatattaaattgatacctgctgattgtgtatttatatgtgtgtgtgtgttcatgtattcatgaatggggtgattttcctgaggtggggattcagttacccacagaggctactgctggcattatccttccaccttttca

SEQ ID NO: 59882 - DNA, 2249 bp, Bovine  19866880797613
ttaaagaaatagagctggctgaaggcagagaaagcattatggaggtccccagctacaggtgaactttctcctggccaacagaaggttgcaggttccttattattaggtctgttatttaaaaggtctgttatttaaaagatggaaagtataccttgaggctgatagaagggcatttttagcagtaatgatcagaggtgtgatgatagaatctaattaggtggttgctagaaggttggaaacaaaaggaagatcacttgcagaaactaaaatgtattaataccaaattagatgcttagtcaatataaccacgaccgcatgtggtaagtgcttatacctcacagaagcagttaattatctctcttcaatttactagtctccgcttgaaatccaacttcagccatatatttaatgccatagttgaggaagatgtaggttgcccccaccacatatgaaacagaatcaatctatttcttccccagagagtgacatttaatcacccctgtgttactaggcttatgattgggattatgattattattctcattagctttggaggctttgtgctttcaaagactttatagcaaatcacatacccacacagagatgtccactgatcaccagttctccagcatgctttatcaagtggcccctgaacaaacttcttaatatttcctagtgcatggttttaagttgtttttattctatatggaatagatgcaggccacacacaaacacatttaaattttaattgtacatctgaatcaacatcatacatttgatatctaaaaataacactttggtcaagattgttggtttttgaaatatcctcttaattttatatgctttaaaaatggatgaaaattacttgaaagggataaataatattgtctgatgtctaagaatttatgtatacttaaaggaaatccaagagctttatatgtaataaaaatatcaatattctaagattcctattgtgttccatcactaagttatgtccaactctttgcaaacacttggactgcagcatgacagcctcctctgtccttcaccatctcccggagtttgctcaaattcttatccattgagtcagtgatgctatctgatcatctcagcctccctatttaactgagtcactattgaaagactaatgtatcaaataaaacatagtagaaaatgcattatttaattctgtcagtaaaaagtttttctttcatgtcttttaggatttttttttgacaattcaattaatatttattttatcacctacaaagcactgtactagtgaatttaggcatctgggaataaaaatatctcagtagtaagcccttactctttggcaaacattgcactaagtgttttatatctcattttttcttaaataacctcagagtaagtattactattatctctattcatttgtgggaaaattgagacacagaggatttacccaaagtcacacagattataaatgatttatcctgtctttggacatcaagtagtataactccagaactttactgtttttacttttgaaaatgaatctactctcttccattctctatctaaatttagtttttcctatttctgctttttaaaagaagatctgaaattataataaaccaatccaaaataaacacaaacactgaaacattcactgctagcataatttaactatttgctatgttttctttggtaattaattttaaaagtcatttatttgttcaaaaaacaacatacacacacacatacacacatgttccattgttttgggataatataatatagggcaaacatacactgtcagctacattaatttgtagtgcccagtgagaaatgaaactatgaagttccttgttcaaaaactaagaattttaagatagagacagatatgtattaaacaaaaagagactgcataggtcatatgcccatgatgctggctctagcaaaacaccataggagtatatatatatatatatatatatacacacatacatatatatatatatttaatgccatagttgaggaagatgtaggttcccccccaccacatatgaaacagaatcaatctatttcttccccagagagtgacatttaatcacccctgtgttactaggcttatgattgggattacgattattactctcattagctttgggaggttgtgctttcaaagactttatagtgtatatatatatgtgggggggtgggtatatatatatgtacatatgtatgcatggtttgtatatttt

SEQ ID NO: 59883 - DNA, 1718 bp, Bovine  19866880807708
atacatatttgatatatacaggaaatttcttttgtatgtgaaattttaatactaaaactaaaaatttccaagagactatcttttgcaagaaggtagtctcaaagtatttagtcttcaagtgttttgaagaactctttctacaccttaaactactaagtagtcttttggaagaaatatttttctttttaacagtgttactcctaaaaagtgctgctgctaagtcacttcagtcgtgtccgactctgtgcgaccccatagacggcagcccacaaggctcccccatccctgggattctccaggcaagaacactggagtgggttgccatttccttctccaatgcatgaaagtgaaaagtgaaagtcaagtcgctcagtcgtatccggctcttagcgaccccatggactgcagcctaccaggcttctctgtccataggattttccaggcaaaagtactggagtggggtgccattgccttctccaactcctaaaaagtatctctgtgttaatagataaggacatttcctttatgatacagattttaaatgtggaccgccagagggttaaaatcattaatagtgaaatatttatctttaaaactacttcatagagtataatatacagcaagaactttacaaaaagagcaccagcattgtccatttttattttaaccaacaaacaacatatcattctaaacactaaaatataagtcaatggcaaagcaatgatgagttcctttgtaaatttaatccgtttcccaagacagtatctgattttccagcttatcatagatttcatgtttgatatgagaatcagctgtgatcactatatccttagattaaaaaacaggaactggaaacccagaaaccaagcctgatgacttccaaagactcaggaaagaaagacttaacttctctctggcctactcacctctgtgggcagtgagtgaaaacaaaatgagcaaacaatgatggacttcctaaaatagaccaaaaattttagtttttcgtttttaaaggaatgaataaggagaaatatgttggtagcaaggattggagtcaggctagccatctgttttcagggttttgtgcctttttaaggtttttttttttaatacctccttgataatgaaaacaagatgtgcattccttacaaatacctaatcctatcctgtgacctcgacctggtcaacagccaaactctctacctcaaccaaataaatgcaaaccccttcagaacaaatatgcctttgagtcaggaagacctttaacattactgtgcaggtttacttgatgcctgcaccacctacattagtcatcactgcagtaggttaacctttgtcctgctccttcagataatggcagtgttgaagtaatttgatccagcacttggataaaccccttagtttagctcagaccccttagatagtcagaatcacatataaagttggtgttgatgctgttttctaggcctggagataacacagatcaggaaaatgaaacaatatgtgtaggtgttgcactctactgctctgaactttttttagtgttgtacatgacaagatttttatatcatatataaatatacatcatggggaatattcatttcactccttaaataggactgaattatttaaattatcattttatttcctttgtatctatttgttataaagtctaaagctagtactctgtaatctatcgaatttcagaaatattatag

SEQ ID NO: 59884 - DNA, 2106 bp, Bovine  19866880851772
ctataggtaatatgaaataatcacctatgtccagaaacaggcatcatggtgtcaaattcagtgaaattaacttaatgtattaaatggcttggaattaggatctcagttaccagattaatagccagcaagataattgttggtcattacctagtttccatagagataatatttactttatacagtttgacattaaggcaactcatcatttctaaatatgaattaaccagggtaattatacttttacccttttgcatgttatttcttttaagaactgcctacattccaatctgaggtccaccatttgctaagagtatgatttcataaagttatttaacttaatcctaaactttgttactaaattccacataaatttttggttagtattaaataaaacaatgcatggaaactgcttatcacattttgaggcacatcagtatcagcatcattatcattcttataattatattatagttaaagaatgaagcaagtatcaccaaaaacacaaataaggctacccagatcaaaaattgaaaaaagcaggcagatgtgtaaaaatgatcttgtatctaatgtgaaaaaatattaaaacaattggaaaattaattcatgactttaaaactttagaattgctatattcatggacagactagttaaacaagtcagataagcttataattcttgatattatataatacataacttcactgatcacaaattttatttaacattttcaaaacattccatataatgttttcaaaggaggttaggtcatgttatgtactacaacctagtcactaagaggactgatctttgcatttaaatagtttaatctggctatgccactagccagttgtataatccctcagtctcagttttcttatgagtaaaatggggaacatactagttagtacctatctcataggaattatatcataaacaattactcatgaacttagtggctttggacacattacttaacctatctgtgctcccaattatcttgcctgtacaatgagttacaataacagtaatgatttcaatcacctccagagtcaataaattatgtctccaaagacacagaagagtaaatgggacatattgttgagagaacactaaatgggacttactgttgaaagaactattagtgtgaaagaaagtgaaaatgaagtcgctcagtcttgtctgactctttacgaccccacagattgtagcccacggaattttccaggcaagagtattggagtgggttgccatttccttctccaggggatcttcctgacccagggatcaaagccaggtctccggcattgcaggcagaggctttacctctgtgccaccagggaagccctattaatgtgaatagtagcaacaaaagcagcagcagtagtgggagtagtagtaatcacggtggagaaaaaagaataaaaaataatgaatacagcccatcaacaattttcttgaactgaattttatactgaaaaacaaagtttttctgttaaataacagactgcattaaatcaaccttccctttcatttttttgtgccaaaacatggatcctatttaataataaaaagctttgctaaaatacaaaataaaatttatacaaatttattttataatggttattatttaactaagacataccaatattctatcatgaactataaaagatactaattattttagataaagtaaatggaattaatttccttccactttcttctgaggctcagaatctgaatagcacaactaaggaaaatagtaatatggctgaattacatttcagcatgatacaaatgaagtaagtttaagtacagaaatgatttaaagcaaattataaataggaaagaatattagagagtgaaaactaaggaaaacatagttcccattcatgagatggaataagaaaactgactataaggaaaactataattcatatcatttattataaagagaaaatcagcatacctttggcaggatttgcatcatatccatatgaagttttgtttaaaacatgatgatcaccagaagagggtattatccttgaatctgaaataggatggatccctttcacacgttcagctattgctttatggtgctcataa

SEQ ID NO: 59885 - DNA, 1169 bp, Bovine  19866880878280
taattttaatactgggaaaaatgttaagtgctctttccaactgactaaccatgatacatatgcacgtgcgcatgcacacaccacacacacacacacacagacttaataataagtgatgataagtagtagactaacaatcaaacaattcatttttttttaccagaacaaaatttccctaaaataggaaaataagaagccaataattttgtcacatcttagaggaattaatgaaatatggtcattctgaagagacttgattgtaacacacagagacaaaatatgaaagtaattttcctaagaagtttacttttcttaagcagcaggaaaatggtttaatatcctaatttaaataagcttagcttaaatttagagcgatcccagctgctaacaaactctcattagtaataaatttaggaaatgaccagatgttgtaaacagtgttataatcagaacaaaaatagctcacaaaggactttgcattcatctgaaggattcttagcagttgtgatgcataacttattatactcaactccttcattagtagtatcattactgttatgttcccaaaagcaaaactgtaagttgaaaagaagacctgcagaaatgattcagtgtattactcacaaaaatacaatggattgaagaaggtatatagtatttgactggatagaaatataaatcaatgctagtagaaccattatcagggtagtgataacagtactgagtagaataagacatcttacattcaccatgggcagctctgagaaacataaaacagctttaacatttctgtctcaatctttcattttaaaaaggcatataactcattcatacacacataagcatttacacaaaatgaaaacactttcatttcatttctaacacttttatagttaaaagaaatcattttaagaaacaactgtatctaacagtaattctcaagttttgaagattttcatatgtgataactagaaaacagccacattaccttgggtcctttaatatcttagaataaacaattcctatatttaagaagtatgttgcaaatgcatttgcttcaacttcacaaatggaattttgaagtatatatttgccagattgtaatttaaaccttaaatagagaaggaaatggcaacccactccagtgttcttgccggagaatcccaggg

SEQ ID NO: 59886 - DNA, 2725 bp, Bovine  19866880997972
ggtctttgttgtatacagctttctctagctgcagcgagcaggggctactcttggtctccatgtactggtttctcattatggtggcttctcttgtggagcgcaggctctagggttgtggccctagggcttagttcctccgcagcgtgtgggatcttcccagacacaggcttcactgactgaagcttgcaggctcagcggttgtggcccaagggcttagttcctccgcagcgtgtgggatcttcccagacacaggcttcactgactgaagcttgcaggctctagggttgtggccctagggcttagtttctccgcagcgtgtggatcttcccagacacaggcttcactgactgaagcttgcaggctcagcggttgtggcccaagggcttagttcctccgcagcgtgtgggatcttcccagaccagggattgaaccggggtcccctgaattagcaggcagattcttatccagtgtaccaccagggaagtccttgctttgtgttttgatgctcactgacgttttggactctgaggacattggccatatactagagacggcagagctgtggattacatatagctttgtcaactttctggaatacagttgccatcccagcgcttgactgtctgtgaatttctccacaagggagaagttattcccatcttatataagccactgctattttgcatttttctactgtttgcaattgaagggaatcctaatgtgccacgtctgtatgaagaatggaaatcggaaagatggcactggatagctacatttttctagaaagactgatcttcctcattcgtgtatgagcttatctgtcacccgtgagcacctccgcttgctccccctgctactgctcttattctctgggtggactccgggtggtgaacaagatgtcagcagccatgttggtgctgttgccccctccttacctgagtccccctcagagattccaatacatcttagatactattgagttttgtcttggtgttttggttcatttgcttgtttctttttaagaacatcacaacattccactataataatatcctagaattcagcacaacggaggaatgaggttttttgttttgttttaaattctgggaaaatagattaaagcagttaaatgttactcttgatgtgattaaatcagtagagcaaatgtacattgcttatagcacagtcaaaataactgaaaaagccatttgtataaatcagtagagatgtgaaaatagtgaatgtaaaaactacagtggaggtctcttttaagctacccatgcagtgatattttcatacagaaaagagaaaatagaaaaaaaaaaatacattaaagggtattaaaatggtttagttatattcaaaatctatcttgtcaagcatagtaaggatttgaaaagaatgaggtaggaagcatggaaaaggataaattattaatacttagctaagtcacgagaacagagacatttgataactcaacttttgagtggtaaagaaaataggaaaaacgtttttaatggaaaagggtataaacaaggcaaatgggataactataatcattcaagagaatagcttaggctaaatttccaaaatgttgttctaagaaaagcatctggtacagcagcatggtgtgtcactgaggatatggaaagtagaacctaacagcacacttaaacagatacgcacctcagattgcaactctacctccggcactacctggcagccccgggatggaccagaagaggaaagccaacaggttggagctgctgactctaaactctcctgctgataactcatgttcgtggcaaaattctttataaatgaatctgttcttcctacaccagactggactgtctctctattgtgagaacaaacttttttttttttttttccccatctttcttccttctcctcatctcttttcccacatctctaccctagactatagttcttgaatggaaaacaaaaaggcaatttggcaaaattttatattttattttggctttgctggtggctcagtggtaaatagtccacctcccagtgcaggacacttggatttgaactttgggtcagaaagatcatctggagaaggaaatggcaacccacttcaatattcttgcctgggaaatcccatggacagaggagcctgacaggctacagtccatggggacacgacttagcaactgttgctgttactgttaggagaaggcaatggcaacccactccggtactcttgcctggaaaatcccattggcaggggagcctggtaggctgcagtccatggggttgcgaagggtcagacatgactgagtgactttgctttcacttttcactttcatgcattggagaaggaaatggcaacccactccagtgttcttgcctggagaatcccagggacgggggagcctggtgggctgccgtctctggggtcacacagagttggacacaattaaacagcaaatattttattttaccttttaaaatctctgtgtcttggcttcccagtggctacttagtgttactctatttcagtgcagcactttccctcatcagttcagttcagttgctcagtcgtgtccgactctttgcgacccatgaaccacatgccaggcctccctgtccatcaccaactcccagagttcacccaaactcatgtccatcgagtcggtgatgccatccagccatctcatcctctgtcgtccccttctcctcctgcccctaatcc

SEQ ID NO: 59887 - DNA, 749 bp, Bovine  19866881285645
tacccactcttgatttagagatctggagatgacactgaaagcctttcacttttaagtgtccaaggaacctttcaaataaaaagggaaatcggtaagtttgttgccactgctgctatagctgatgttttcacctagactgaaaagacctgaaaagaccagctgtcagagatcaacatctttatttccatcataaaccattttcccttctcttgccctaaaattacaggaaaatatggtttattttaaaatgaactgctctttgatagctgagcatatacctaacatgactcatattcagagatgatgttcatgatcttgtcattctccatgtgtcctggatgcacagtttatctgaaaatatcatggtaacttctaccagagagcacttttaatatgctgctggtaaagtctgtcacttcagctctgtatacttgattcatgtaacaatacaactctggaacctctctgttcttgttttgctcataatgtaatgctaactcatttctcaagagcatgttgtttcattatggcataagaatgtgacataatagcagcctaactaatttgtacctggagaacaatacagtagcctaacctacattttatttattatattcttcagaattgcagaggccccaacgaaacccaaaaggaggaaacgtgggtccctcctaattgtaaagtctctaagacagcccccattctgagatgccaaaataatttttggatcacaatattatcaatagttg

SEQ ID NO: 59888 - DNA, 759 bp, Bovine  19866881466738
cccatgagcatttaaattatgttgatacatggaaataattacatataaaatattaagtgaaaatattaaagaaaataaaatataaacattgaatatagctgagaaaattttatcatactagtcataaccatgttaataattcactgtgttccagttgatttctttgatccttaaaataaactttgtaaagtagatatgttattctaattttataaatgaggaaactaagttttaggaaaaaagacttattacaaataagtcttgctaggcaattcagtgcttcttagtcatccacaactgcctctatgctgtgtcacaaaatttataagtgattttaaagtgatataacagttaaatgttcactagtttcttatttttctcttttaaactgcttatattcacagcaatgatcattttaaaagttgtgtatcatatactaccaaaccttttacaaaatctttcttaaaaagagtaactaaagtgatcatgatgaataagaggtttattaaggagagttaaatatacctggtaaatacaggggaaatagttaaagtagaaagccagtggtctcacgagcggaggacacagcctcagccatgctgctgacattgttactacaggattcagcttctcttggaaggcaagcagccaaactctgtagggacaagtctgccaattgtacaaacaaatcttcaaagtgaaataaaatcctcttgatgtctattggactattgttagaaacaaatcaaatatgtaggg

SEQ ID NO: 59889 - DNA, 1015 bp, Bovine  19866881650546
atgcagaggggttttctaggaagaccttttgctggtgagtcgttacattttctcgtttgattactagattagtttctgtatttcccactcagctgaaaactccatgatagcaacaactacagcaattttgctcagaaattctatatcttagaagatcctctacaaatattttgaataaataagtaaacataaatatcacaattttaaactcaaacctgtttgaattcaaatctttgttctcaacttcaaattgggcacactattaaaacttctaaccttcaatttcttcatctcttagtggggaaaataacacctatttatcaaataaaatcttatacatatatcaatagtcaacttgtggttttaactgccacaaatccaaaggtgtggagccttcatgtggtattactcctcttaggtctgaatcaagaatatgattattaaaaatttactgaaaagttctggcatttacttttctcctttgttaattaaaataatgatacctatgtctcatggttcttttgagaaataaatgaggcattaacctaggaaagactttagttcagtttctggagtgttacattttcatttatattactataaaaacttttcagactacacaagaggaaagacaccatacaagtttatagaattgaattatgttcagacaagagttttttaaaaatgattttgctgtgaagagaagaaattgatttatattcttacagtgtatatatatatatatatatatgcatagataagtgtatgtgtagtatacatatacttaatacacatacatctgtatgtctgtgttcctgggcaatattatacataattaacatttacataaattactgttacaaaacacctctgtgaatattctcttgttaaactcagcaacaaacctgtgaggtaggtagtacaaggtataaagaaacctcacttggaaagagctaacagggggtggccaggttctcaggttacgcaccttatcctgttactaacagtgtgcggt

SEQ ID NO: 59890 - DNA, 1069 bp, Bovine  19866882229093
acattctggaaagaatttgaaataaaaggtctatttctacatggttatgatattttatcaataattattacaatgatattcattctcttcctccttcaagttttagtccatgagtaacctttaaaactactgaaaagataaaattaaatgaatcaaggtgcttagtaaatatgtatggaatcatatttgtgaaaaatttggagatattaacaatatgaatttttacattatacatgtgtttaatttcagcttaattgcctgtttggggaaaaaataacattcctcatactagatctttccatttttctatataacatattgatttatggttcatttgaagttcataatgggaatgtcattatatcaatcatatcttcctcacatctcttccaagtgaaattaattttaccttttagtagagattatataaaatcaatatcattattgctttatttgtatattaaaattctgaatttctgaatgaagcattgggttttacataaaataattttatcctcatcctttcatttgttaagtagtttaggcaaatattacattcaggaaaactgaggaaactgtatcccatttcaaattttaaacagggtcaggtctaaattaagccagagaccattccacaatcaggagtatgagcagttgctaagacttcaatctgaggctagtcaacttccagacccataaaacctttgttttaccataaaaatctcccagtttagaaactgaaatcaagtaaaagtgaagtaaatacactcatcatacgtatttttaatgtagccacttttgttgttcagttgctgaattgtgtctgattctgtatgtgtgtagccactgctcagtttttattcctatgccatatacagatttaagtaattcttacataataataaaaatacctaattcttactaagtgcttactgtttgacaagcatcacagctactaatttatatgcattgtttgattaaatcagagcatagacctataaactacaatgatgttatttccattttatagctaagaaaacaatttaaataacttactcaaggcctatag

SEQ ID NO: 59891 - DNA, 1665 bp, Bovine  19866880395220
gtctttttccctttttgattgtgttgttttcctggtattgacttgtatgagctacttgtatattttggaaattaatcctttgtcacttgtttcatttgctgttattttacccattctgaggcttgtcttttcaccttgtttatagtttcctttgctgtgcaaaagcttttaagtttaattaggtttcacgtgtttatttttgtttttatttccattactgtaagaggtgggtcatagaggatcttgctgtgatttatgcatagaatgctctggctatgcttaagaggtggtggttaagtggctaagtcatgtctaactcttgcaactccatggactgtagctcgccaggctcctctgtctatggtaatttccaggcaagaatactggagtgggttgccatttcattctccagggaatcttctgacccagggagtcaaactcgggtctcctgcattgcaagtagtcccctgcattgcaggctgattctttaccgactgagctagcaaggtggatggcatgtttaaaaggaagattcttaattgatacaatggttttcctggctgaaatgacaaaccaagcttcacccacccaagactgtggaagtaggggcacatagttgaaataatatagttcaggcccagccctttagtaggctttaattaaacatggtcattcctagagcaagggtgtggctgggtaagggcaccaagtgtgtcctctgcaaaataaaatgtttaatgtcgcagctatgattctgtcttgaatggctctgctaacatttccggcaagtggggtgaaaggccctttcttaagaggcaaactttctgagacaactctgtaatgaaaacatgatcatttctgagttacaaatgtgtgtactaaggttctttgaaaacttgtcctaccttgctgctctccagaacatacttaataggctgctgctaacttttggcctccaaaagagggaatggtgtacaaagatggaccaaggaaatgaaatgagggtttccatggctactgtcttgagtgcgcataagacaaaaaatttttgagctgaaagtcatcaattaatccaaaatgattttcttcctctatttcatttgtttacttggtacgcagagaaacagagcagggaatgttctggtacagatacatagcctgagggagtcaggacttttccagctgccaggaacatcttaaacagagccttgagtgttcaacaaactttggggacactcagaaccagcttgggtaaatttgaagataagtagtgtgggtctcattcctgatcatctctgagtgatgttaggtgaattatcagtactttacctctctgagtttaggtgacccatctgtaaaagaaataaatgctggttgaatctaaaccctaattgagtttagctaacaacctatatgtttccttttctcttttgctttttgcttctcttcttttcacagctatttgtaaggcctccccagacggccattttgcttttttgcgtttcttttccatggggatggtctcgatccctgtctcctgtacagtgtcatgaacctcagtccatagttcatcaggcattctgtctatcagatctagtcccttaaatctatttctcacttccactgtatagtcataagggatttgatttaggtcatacctgaatg

SEQ ID NO: 59892 - DNA, 2305 bp, Bovine  19866880435471
agtctatgggtgtatgctgctgaggcattcccattgtagagttctggagtcttctggctccctgccatacccccaccccattgctttaaagctgactccaactttgtgggttttgtgattaaacaacactggagactgtgatttctaatgccatccttggaatccatgtcggagatgaaaggccacttcccctgtggaaaaggctttcacattcttctggaactgaacaaaaatgaggaaagcatcccaattctgtgactttgcacaatttaccacgtgcatccaagggatgcaggagaaatgatcctcattgcagatggagagaggtcaagtgtcattgagcaatggcttcaaactcaagtcatctgactcaagtcccaggctctgcccgactgcagtggtctcattacgaagcccaccagccatggctgaggagggcctgtatgtcaccttctaaggtggttgtgtagtggttgtgcagcagtgaggctgagtatgcaacacccacattgtaaataagaaagcaaatatttttatatttcaccctctcatgtataatatttcctctataaataggttaaaactgaatcgagactcaagctagtctctgtagcaggcagggaaagaataaattaagggattttcccttctgcttactttcaagtcgggctaattgtttcatgaactgtttttccttggattaccagttttgcacgtttgtgctttgaactttcaacgatatctcatttccattagtgtaaaatgagagccactttgattacctccactgtcctctttcgtcaccactcctcaccttgccgtgtcccagcaagactcaattgctctcagttcttcagacccagtttcttacctctcttgacattccctgtgtccagacagtctccactgcctaggcgtgctgaactcctatgcatctttcaggtcacagcgtaactgtttcttcctccgatcccctggattaagtaggttcaggcccctgccagacgctctcatagcacactcggcttcaccatcatttaacttatcacactttcctgtaattgctggcttatcctccctgctaactccctaatggagggactatagcttgttactcatcattttaacagatactcctacatagtaggtactcagcaaacatttgttgaatgaatgaataaatgaaactacttctgtggcaagtttggttcacaaagtctgtatttcacatacattgccagactggccaacatttttatgttctacctgtggtcattctcttagcaaagactgagcttttgccttttgaaacataaatagaaagatctttcataacaatgctgttttgccctgtaaaacagagtttgacatttttaacaataatcatggttcagaaatgagaatttatagaccaggaatgcaaaactgaatttcaccatcatctcagagaatcatcagtttatggacatactaaagtgaaaattctgtagactcaaatttcattaattcttacctaggataggagaatcaacttctattttatctctgtagtcctttttctaacattgtacttgttacaggggagatgcccaaccagtgtatttttgtaaatgcccaggtagaatgataatgtttgctaaatttacttagtgctgttctaagcactttacatggattaactcatttaatcctcacaacaaccagaggaagtagattctgttattagtccaattttacagatgaaaaaactgaggctaggcctttggcatgaattaccagtgttggctgccaaggtggcgctagtggtaaagaacctgccaaccagtgctgaagacgtgagaaagccaggttcagtccctgggttaaggaagatgccctgggggagggcatggcaacccactccaatattcttgcctggagaatccccatggacagaggagcctggagggctacagtccataaggtagcaaagagtcgtacacgactgaagcgactgagcatgtaccagtgttggcaaggacttgagacaccagtttatccaatacacttactttaaaaaggcacatgcatattcattaaaactttcattaaatggaacccactatccacactcaaattagccaagtgctttttttcccccttaagcaatttacaatgaataggaggactttttatagttagatttagggaaaggggtacattttactttctttttcttttcttaaaacattttgattctttattttgtcgtcttagtgctttttatgttatttaaaaataatacacagattgggaaaagttagaa

SEQ ID NO: 59893 - DNA, 1427 bp, Bovine  19866880544946
tgggtcatttatgtttctggaattgagctgtaggagttgcttgtatatttttgagattagttgtttgtcagttgcttcatttgctattattttctcccattctaaagcctgtcttttcaccttgctaatagtttcctttgttgtttaagcttttaagtttaattaggtcccatttgtttatttttgcttttatttccaatattctgggaggtgggtcatagaggctcctgctataatttatgttggggagtgttttgcctatgttctcctctaggagttttataatttctggtcttacatttagatctttaatccattttgagtttatttttgtgtatggtgttagaaagtgttctagtttcattcttttacaagtggttgaccagttttcccagcaccacttgttaaagagattgtttttaatcgattgtatattcttgcctcctttgtcaaagataaggtgtatgacgtcacttttatgtggaatctaaaatataaaacaaatgagagagcatggagcacaagagaaacagactcagagatatggaaaacaaactattggttaccaggggcgagagggaaagagggaggggcacgataggggtatgggactaagagatgcatactattgtacataaaatagataggtatcaacaaggatatattgtacagcataggggattaagcaattatcttgtaataatgtgtaatggagtatattctataaaaatattgaattactatgctatatacctgaaactactataataggcaaatcaactatactttgatttttaacaacttctaaacgtagcaacacttattcaaacatttactgtttgaaacctgacatttaaatataaaatggattgcttctttaaagaacatgagaatctccctgctttagttttaactgcactgatttatcttgaagccgaaggtgatgctttatgagtaaatccttccgtgaaagtagaaaattgttcagttaacaacaaactgcctatcttctaggggccagacactgtgcagcatcctggcagagaaggaagaaacacaggataaaataataaatcccagtccctccttccacaccctgccaatctcagttgattacccttgcttcttagttcatgagaaaaatgaaagcccaagagagaacctccagtattcccaccaccaaatctatcacctttccaacagctggacccatatactccagtggcagtgggtgaaatcagaaacagccaaggcaagatctctacctcaatctcaccttccagatctcgtaagagtgcctctgataggtgaaagctgaattacatccagaactgtagctacaagggagtcagggatcatttttctcccattccatatataacccagcagcaagtttcgatgatcccaccttcaaactatattctgaa

SEQ ID NO: 59894 - DNA, 1522 bp, Bovine  19866880586232
taaaactgtagcttctgttagtgactcccagtccacaactctggcttctgctgagccatcagccctttctaattcacgtgcttcgtgtggtgatcccatatggccctttaacaaattcaaaacagaactcgccacccacctcttacagaccacacttccccatttcctctcagatactggcatctttattttcacaacctgagtttctggctacagtccaactaaactttctccttcaccttatacacccaaagcctatttatttcattctctaaactggtatttctcaaactagctagggcaaaagaggaaccaggcacgtatattccaaaactgtttctcataattccaaacaatgtactcctatcttcactgagaatcaaaacttccctgcattcttccccttttctagtcccacacccaccttcatctctcacctgggttcctgtaacaacctcctaccagatcaccctgtctccagtctcttccctctctaccgatcaaccgagcatcatcaaaacctttaatgactgatctcctataattcaatgtctaaattctctatcaaactgaatcaaaatctctcccttttatataattccacatccatatccggtcactaagcaatgcttaagtattcacagttgcctgaatcagtcaagatgtgtcaaaggcttctatgaaacatccctgccttggaaagaactgattcagttacttggaccactccccaaccctcaaccctcgtctacccaacaccagataagccagagctcagctcaagttggcctcctctgggaagtcttccctccccatgactcctttcttctcctcatgctaccctaatacttgcaatgttctgttattattgaactaacaggaccccttaagggaaaagcagttttagccagagtatcaaacacactgctgggttcacagtacctactcaaacattatttctgaaaaaaaaaaaaaatatatttttgaatgaaaaaatgagtagcaattttctaaatgatttcttatttggctgaacgagaagacaggaggtgagaactcagcaaaatttaaaataccatcgcccctaatcctctcttcaatcaagccagctacctggaccctcaagttggtcagagctgcttagactcaagaagcatctccactcttactctcttcaatacttccacagcctagtgcccatttcatctcagctagatcagtgcaagaaaacactctgatggttcccatgaccattcagaactaaccaatagaacagaagtcagctctttatcccacctctcttgtattttcccccaaactgtgtatcagaaatgctcttattccagccagtttagtccttttcatcaaaccccaagactaagcccatcagggtttgggcaataacaacccaatctataagcacagattattatttcccggttactgacaaagccgactctcagacctgaagagccaccagaggtatgccttttaagagctggaatgaactgaaggaactggg

SEQ ID NO: 59895 - DNA, 970 bp, Bovine  19866880590575
cactgggagggctttctcctcatactgcaggtgaggattgaagatgtaaacctcttctggaatgaggcaggagcatcaagtcactaatcaatcaaaacaaaactcccagtggtgagttgacagggccagggtcacaggcataataataagctttgagtgtaagtctattgaaagcgtcctggtgctataagagagtatgaattaaattcagctttgatcctaaactgggtttgtcagttactagttagttatgtggttacccggtccagtcaggtaacctcctggagctatctgcatttttgctgagctggtggggttgaggtattgctatttttggggaaggtgtgtaagaccctcagtgcagttcatgcccacaggcagtgcttagtaatggttattattagtgaattcctggctgaaagtttttttcccccacagatgtacaggagcctctcaggtgcgaaaaagtctcccagccttttagaccagctgtaactctgcccctcctctccctaccatccccttcacaggtataactgccctggggcatctgtcctccagggcataattccccatgaagctggcacatctaccatgggcaccagtaggtgccagcacaggctaagctttcagaagggctgcttcatttgattttatccttcttccatccccccagtgtgaatcatgaaagcccagacttctttcctttcttccacagcaatctgtcttctccagccttgcttgcttgctattcggagctgggagaaaatgctcagggttgcaatgtcaagtatcagtgaagaaagacctgtttgtggctccttgtaacaagactaatgaacactagcgctccacttgggtggcactctaccctttgcaatgtgctttcataattgttagctcatttaatagttgtaaacttctggcaaggtagtgtgattgttgagggtctgcaaattgcctttacatt

SEQ ID NO: 59896 - DNA, 1605 bp, Bovine  19866880601671
tagaatttgataaaagtaatactaaaatttatatgaaagaatatcagaataccaagaatatcagaagagaaacaaggtgggtggagttgctctaccagatttcaagtcttataaagctagagtaattaagacaatgtgggtttaacagaaatggacaaagagcctagtgaaacggaatagagaacttaggaacaatcacacatatatggaaacttgataattcacagaatgggcacttcttgtcagtaggaaaaggaagaatttttttaaaaatgaggataattggttatctaaatagaaacacatgatattgcatctctgtctcacagtatatacagaaacagttccaaatggattaaaaatatcaatatggaagtaaaaacttacttttaggcaaaaaaaattgggcaatattttccccacctcggtgggaaaggaattcttaatagaccgaaagtgaagattaatatatttgctccattaaaatgaagaatctttgttcgtcagaattgaaaggataagccataaagcaagagaatatgattgcaacagaaataaccaccaaatgattgtagcacccaaaataaataaaggactccaatgaatcaaaaataagattacccattaaaaattggtaaaataaatagtcatgttgtagaagaggaaacagatggctaacacatatgtgaaaagatgctcaactttattagaaaccagtgaagtacaagttaaaaccacagtgagcacaagcattggaatggggagctaatggaaatgtcagcagtacaaccattttggaaaacaatttgatgtaatatattaaagttgacagtgggtattacctacgcccaagtaatttcgctcttaaatccacaccccaggagaaaatcctgcacgtgtgttagagacatagtttggaatgttgatagtcagtttgcttctaatggctccaaactgaaaactacccaaacgtcttttagcagcaaagctgtttaaatgaagagtgctaggttcataaaatgagacactgctgcagcggtgaaatgaatgaaccacggctataattatcagtctggatgaatctcaaatgttaaggagagaaaattaaaaggttcaaagcaggcacaacaaaaccatgtatcatttaaagatataacataggtgcaattgttataataaggggagaatgagcacaaaattaggacagtggtttcttttggccggtgagggggtgatctggaaagtgagggacccatagggcacctggattttcagaggtgctggtagtgctttctgaaggttggtggtaggtgtgttttgccttcctgtcatttctttaaatgatacaaatatctgttatatacactcatttgttgtatgttttgtaattcagacagtttttttacatgccctgggctaagtcccaagcacagttcctgcagagcggcacccaccttctttaataatcactttattcttcctgtcaaaactcccactcccagtcttacaatgcttttatccaaggaagggaagagggaaatctgccacacagccccaccctagcctggaatgttattctaccacccaccagtcttttcctgtctt

SEQ ID NO: 59897 - DNA, 1648 bp, Bovine  19866880637826
catttttatcgctatgaatctacccaacacaatgtcatcttctcagggcccaactccaagcatccaacatccatgcacataggcaaataacaggacaactgccgaaagggtggaatcctcttgattttactggttagagttcagctgccagaggtactgggttttcatatacagaacagccaacttgtttgtgatcagacttcagtgacatcgaccttccgaaacatctgtgacgcaggggggcgtggaggaagaagcagcaggctcagagcctcctgagaacaatggcccaaaacccatgcaccacccctcctcagacgcaaagccaacctgacacgtacgcagcactgcctttcctggcttcctcagggaaacttcagttttgccccggaggtttccatcagagagcaggaagtgaagagcagaagactcagaaagcaggtcagaagaggagggaccggcaggacgtgacaactcgggacacaaacacttcccccatattgtacaggaacacattttgtatcgtgtgcacaacagaaagaatggcgaaagctgtttaaatacagccgggaatcaggtagtatggaaggcggtaaaagttcccagataccacagttgcccccaacagcttcaccaatagagcagacagcagtgcaaaccatcaatgagaagagtgttagtctgtgaaaggcaagccaagctctgcactgcaggtttggacaggctcttggtgacatcacgacaccacagcaaggtacaaacgggctgatgtttgtaatgatgaccatgactcatcaagaaaaggttaaatactctccagtgtactctgtttactaaggcagggaagtgcgtaatatattttagaaagatttccctcaaaaaatattaaaattttaaagattcatcacttaaaagggttaatcctctgttatctgaatatttgcgtacattacctcatttcacaacaatgctagttaatgaggcattgcttttttttttatgtatcattagtatcaaattattggcaccattcagatttaaggagagggagaggagagcaaagtatacaatacaacataaaaatacaattctgatacaaatgtatgagatcaatcccacttaagtggtcctaagaaatggatggatattttacacacaaggaaatacagctactaagtcatcacatggaaaagtgctcagctttgctagcaattaatgaaataaaacaaccttttgagaacaactatacgtacttattaaactagcaaaaataaataaaaatggcaaaacccaatactggcagaactatccggtaaatagaaatgcttatacattgctggtggcatcaaaaattgtagaggggattcaagcattcagagaagatgggaggttgaacttgatgacctttaaggtcctttcaaccaggagacgagatctttctagaaagcaatctgacaatatgaaacaagagctataaaatacttcatgctctttgaccttgtcatctctctttggagatactcccaagggaagaatccaaaggaagaaacattttattttttacaaagacattcatagcagcactatttatgagaatgaaaaataggctataactcaaatatctagtaatggcaacaagtgagggtaa

SEQ ID NO: 59898 - DNA, 1321 bp, Bovine  19866880774018
cagtgtttacagtctgggagtttgtaggagggtcacctcacagaccccagaaagcctactcctggttttggttgtatctttgttccttgccaggcacctttcctgcctaactgagcccaaattgctgaaaacaaactttccctgggttatcctcatcctgctgggtatcagctttccctaaaaccaaaattgctgttcagtctagacctgcacacttactgttctattttaagagaagcccccagtccatatcagaacagcagaggtgtctattccacattaaagtccttttcccttcggcgtcttcttggctccctgacagttgtgaacccttttttgtatagtgtctgtccctggtggcttctgggcagtcctcagctgctctgttactgcccagggcagcagcaagcacagaaatagcgttttcaaaggaagagaagaaaaaaataggataaatcgcaggtacagaaaagcaagcctgaatgctgagggctgttacaaaggtccacctgttgactaagccgtgtccagggaggcaggggttggggtgtcctccactttttcttttcctctgactccatggactccatttccccttttcactctgcttttctgtctgggttttcttagcgagttggtaaagtactttatttatttatttattttttggccacgcagcatgcagaatcttccggatcagggatcaaacctggtcttaaccactggaccactagggaaggtcctgggagagcactatagttcctataattctgtctcactgagccctcaggacagtggtgtgcagatagatgtttaacaacagactctccaggagaagcagccctggtttgcaatgtttgcccagttccatagtgtaaatactcctgtcatagccaattttaagctgccaatgtgatataactgcatatggagttgggaagagattctcagtagcacacgattatatataccatgtaagtgaaataaatgttagatgacctcaagagcatagatcagtggttggcaaattatggcttgtaggccaagtctgacacatggcctgtttttgtgcagcccgtgagctaagattggtttttacacttttaaagtttttttttttttttttttaataataatacacgacagagactgattgtggccccccaaacctaaaatatttcacatctgtccctttataggaaaagttacctgacccttgcatgaaagtgaaagtgaagtcgcttagtcgtgtccaaccctttgcgaccacatggactgtagcctaccgggctcctcggtccatgtgattttttcaggcaag

SEQ ID NO: 59899 - DNA, 2013 bp, Bovine  19866880921840
ccttgcttatattcattcagagataataggtgtaatcaatttttgcaatattgaaatattttataatagcatatgtcttattggccaaattttgtgtaaccaaccatcaggtttatcctagattgagggacttcgtggaatgcatgagtttgagtgctaacatgaggacagtcctgggcaaaccaagatgagttactctaaaattgaccaagaaaacatgtgctactatattaaaaagatgcatcactaatcatcacttttttttctaatagaattaacgagtataatcattttaaagtgaggataaaacaagatggagcaaagaattaacatcactttgacattgaatgaatgattccatctggtccagatttaactcctttataggaagcctttaggtgtatctttttgagtaatgaggggataccagtgacatatgtatctagtcttcacaattaactatctttatgaaccaaagaaagtaccacacagtggcagtaaatactgactcaagagccatagacgcattcatttcttctagatgtcaaaggaaaaccctgtgaagaccactgtatactacagcactctaaccggtaagcaaattggaaattttaaattattaaaaaaatttttttttctgatattgtagcctggtatggtcttatactgaatattcactaaattattatcttccactgtgtagagatggtattatatatataataggcgtttagttgacaagaatgagtttttcaatgcttacactaaacaagtaaacttgattactcagacatccaaatggaggaccatacccttagtcagccagctactacttcaagtaaccagcccgtgcctaatcgtggaattgcccgagcccatggagagggccagggtggaaacacagatgtacatatgatgcctcagtgctatctaacaccttggtactctccccttttaggggaaggaaattcaatcccattttctccatttttattattgtattcttcagttaagctccaatagtagctgggggaaaaaaatgcgggggaggggtgggtggggagggaatgacagggttgactaaacaaatgtcagctcagctcttcttgtgccagtaggaatactatgttataggaggaagaattataccatgcagtaatattggatcaatttttgcccctcatagaatatgtgtcatcacgttggcaggatctcatccagttcttcaaagtggaaaaacaattaaaagcatttcttatcaaatcagtaccaactgtagcagacttcagaacaaagtctctgggaaatttaagcgggtatgtacctgtatttctttacttaaatcctctattatcagaataatgatagagccagtcagtcttataaccagcaatatatactcagcgcacttccctggcagctagagatgattttaagaatcatcttgaacttttaactcaaagaaattttcagaccaaaaagataaggtatttcaaaaggtatattacctgtcatataggctctgcaccaccatccctaccatccccaggataaaggatggagaaagtgggcctttgaaagaataactctaataccaatataagaaaatattttgtcccttctaattttattaaaccagtatgtcaaattttataaactctagatcaatgcttttttgtcacatattttcacatgtgaatttaaaagagaaaaacacagttctggggtagtgaaaaaaaaatcagtcttaaaatacacagtatttgcttcatatcatttcctattcctaaatcattgccagtttagtacacatctagctatactttcttctccaaatagtgttcagttatataaaaaatgttacctctatcctctacaactctatgcaagaccaatattattaaaggagggtatcacaccaaggacaattcaataccatactaaaatatcctgacaaagcccccagataggaaagtttgagtagatgacttcagttcagttcagttcagtcgt

SEQ ID NO: 59900 - DNA, 1552 bp, Bovine  19866880971124
atatgggatcagggatcaaacccctgtcctctgcattggcaggtggattcttaaccaccgaagcaccagggaagtcctgtactgtgcattctttctcagagccgtagattcgactctgcttgctgtccttctaccctgcccctgcactctccttctccctggccacatggctgcccaactagaagactccactatcaagcctcccatgcagctaagtggtatgattaggttcttgccaaacgaatgtgaataacagggatttgtgcaaccagcctaaaaggtaactgcttgtcctgaatttcctctctttctcatttcctccagcttgaaagaatccatgcaagcaacatgacttccacgtggatgaggacaaagccttagggcatgcaggaacaacaaggaaggaacctaggtctctgaatgacattgtggaacagagctggcctaccagtctagatagtcagactcgtgagagaaaaataagctatcttatttaagccactatacgttgggggtccctgtttcaacaagtaagcatctacccaaccaatctatttccccaagtccatttctccatagaatacagtaagtccaatttttgaactagtcatattcctttccagctaaaaggcaacatttcccagtctcttttgcacctatgtgtgagcacatgactaggttgtggctaatgaagtgtaagtgaaattgtttcatgggatttctgagtaatctctttatagtcagtgaccttcttcttcccacttctttcccgctgtctggaaagtgaatgtaatggctggtgatcaagcagccattttgggccatgaagttacaaactaagagttgtgaagaagcagaagaccaggattagtgtctcagatgaccagttctagactgcctgcttctggatttctttacgtaacagaggaacttctatcttacttgtgttgttaatgtgtgtttgttgtaggtagctaaacttaatcccaaataacagatgcacccagcatcgtattggctgctgggacagacaacatttcaaaccccaacttgattcttagatattcctcttagcagaaaaaaggaaaatcactttccaaacagcagaaataagaagccagtttccattccttctgaagagaatcagcttagcttttgtgctcactgaaatattgcctgtgcagggaggtctgcatgacaaacccccaattgctggacccaggagaccccaacgatggtggctcacactaggggtccatgacatgtgggaaaacagtactgaagggggctggaagtggggaaggaggtgtgacccagctcttggggggctgggcagcgagcaggaacagaacgctgaagttgggacactagccacggcaaatttaggtcaatacagacatggaggaaacaaggcaatctctctttaagaggggacttgggcttcccaccagctactctgatttcacacactctaggccagatgacagtctcctcccttaccatccactaccccatccctgtcacagacagacgctgaaaactgcgggggggg

SEQ ID NO: 59901 - DNA, 1016 bp, Bovine  19866880991633
aatccgtgttacgttttataggctgaggttaaattaaaaagcatttatatgaatctcttccatgcctcatgtctggaaaagaaatggtctctgcaatacagaaacttttagaggtattagttcactagtctaacttgcttttcaatgttccatggacatcaagtgcttatgatcaaaccgcactgtcgtcctacaggatccgcaacagacggggtaagaaagatcaagaactaactgctctccttggccttgttctgaacggaggttttcccatcactccgttcaccatactttctcaaggagccaggctcgcaatctcactaagaaataactttatacaaactgaattcgccaactatgtttctgaaagagcttcacacacaaacacccattaagactgatctgaaattcaaatcttaaaaggaacgtttgcttttatgaagctggcattaaaaaaaaaaatcccaagcttaatcataaatacaacaaagcagatgccagtttatctgggaaggaccacagtcggttaggacacaggtgggcaaacacgaccctcagcctaaaccccactgtctgttttcataaataagctttccagaacacagacaggcccattcacttctgtatcctttgcggctgctttcaagctattcagtacaataacagggttgagtagttgtgatagagatcacaaagctgaaaatactgaccatctggacctttacagaaaagtttactgaccccaaggtttagaaaaaaaattcaccatcaaagaaagcaaccctctactccatccttggtggaaaaaaaaaaatcctttcaaaaaagtcccacaacaaaaatccctgagctttaatctgtcctgaattctcaggacagaaaaatgttacttaaactctaagcaacatttcaaacagaaaaccaaatcccaaatacctgaagttagactgactaaaacaaaacaaaaccaaaaaaaatcccctcccagttcatttttatttcatcaagcataagtt

SEQ ID NO: 59902 - DNA, 1564 bp, Bovine  19866881107535
tgaactgtacacttaaaaatggtaaattttatattgtgtattttaccacaataaaaagtactggaagacagcagatacccgggactccaagatggcatcactcacatcagtgaagaagaaactcatggatgttaaaacaggggagctgccaatctggatatgaggtaggattttgcccctaaaggcactgctggagtgtttcaaagaggttactagtggtatgacaagtatgtctacgtgaagaaaggaagcactgctggggtttctaccatgctggcagcttacaaacttttcaactactgcctttcttagaaggaactcaaacatgagcagctaagcgagtaccactggagagggcccagtgcaggggacacactctgcttccctgaccatgacctctgcccaacactcctccctgaggaacatgatcactgctgaatatcctaatttgcaacaatgaccaataaaagataaccagtacagaaatgaaaaaatacattggaaaactttttttaaaggacccctccacatatacacaaatatgagactattacttacagtatctgcataggaatgatgttctattaaataccacgcaaagaagaaaagaaaccaagtctagtatcaaaaagttttgagtcaggtaatcccaaggcttgggaggaaaatcttatgacttggtgggtagccaaaggcagaatcaacaaaataatgccaagtactaaaaaattaaaagtcaagctttcgaagcagtccagtccagctggcctaacagggcagatgcacacgatgggaaaggctgaccattttttcccctccctacttgaggacgttttccatgagagcacttctcagctggaatttgctttgctttcataaaagttacctgtcattgcctagcgtaaaatatgagtgaaagatgatgacaatgaccactttccatagctttgtctgaaggggagggtaagctaggaaagcacactctttaattaagagacaatgaatctcgaaaacacaccaaggaaaagaagagggctggctatttcctcagattgttttaagcctaaaattgtattttatgcagcaatattatagagcaatttatctaccaggtataggcaggcaaagtcttgattcaggaatttaaaaataaacagtcaaaaatatctctagaataatatacaaggaagagagagagtacagtagttcagggatggggtgacaacttacttttcactgtatactcttttgcgccttttggatcttgcttcatgatctcatatttcatactcaaaagttaatttcaaatattttaaaatgaaattgattttataaaaatgtgactcaaacagtaagtttaccttagaatcaaattaacaaaatatttcttgctttaaaaaaaaaaatcagcgagagtgcctttacgtttctgatttttaaactttcattgtattggatgtccataaagtgtttttaattttattgagttgcttttgaataaattattttaaacatttaacacttagaatttttaagcccgaaagcaagtcatacactacactaa

SEQ ID NO: 59903 - DNA, 988 bp, Bovine  19866881134885
aaacaagtaggcaaagagatcctacaggcgttggcagactttttttttctgtaaagggccaaggcgtaaatattttaggcttttcgggacatatgatctgtatcacaactactcaattctgtctgcttttttctgcagcctccaaatagccacagacaacatgacatgaacaggtgtaggctgttccaataaatctttatggaacaggtggttggatttggttctgagccgtagtctgccaactctgccacaaaaaatgatacagtatgggaaagctgctgactctgccatggcggggattttcttgaatcccttaacctctgatcctatttcctcatctgtaaaatggggataacgtcttcagcaaacaacataatataggggaaagcttagtaaatcaaagacatgttgtatactgtgagactcaattcaatattcggactttcccctctgctctcctccatcccattacgtgtcattctcatgcaaaaatgacaacattcaacaaagttttgcaaactcttctctcttctctcttccaaggtaactgtaccaatgaagatcatttcataaaaacagacatagaacctaggccattcatctctgtttgtcaaaattacatccaccatcccattacatgtcattctcatgcaaaaatgacaacattcacaaagttttggcaaactcttctctggccatccatctctatttttgtcaaaattacattcttactttgcccactcaggatgatttgctagagtttcattaatcaaattgcttgtgacttcaatcatgtgtacactctcttgatgtacctgtattacggacaggaaaagagtatcaataaaaattaaactcaatttaacatttatcttttatactactctaggaacaatgctttaagcgtcaagtaattagatatctgagttgtcagttaacttaagagaccgcactgaacagccactatccataacaaggcaactctaga

SEQ ID NO: 59904 - DNA, 1049 bp, Bovine  19866881197880
ccaccacgcaagtctcaatgccgctgctgtcccccaaagttcacaagatcagctcgcctcagaactcagaaggcaagggccagctgtccccaggggccaaggtacgcgagaagccttgaggagcagctctccttgctgcagtttctgcataaattcagtgtgtggcatctgtacacatttgagcttcgtgtcatcaactctgggtgctcctaaagcaacagtaacaaccacatgttttttttaatataatgtgtccctgaaagataaccatgtatgagagataaatagtatcatataaaagcatgtattctgtacttaaagggaaatttaagaggtttctgagggcagttctgattttagaatatcatccctacaaacgctattactccaccatgaagacagaaagtgagaaatggctttttacccgccaaagtggaaaatctggagaagtaaaagcctagaagtatccccatctcgttccttatgggagatagcctgtgttgattgaaattggtcaatattctatctgtcggcttgaaatttcaggaaattgccagtggtgtgaatgggctgtggcaaaggtcttacacaagacatttctcttggttttgtttgagtgatgcttggttgcagtcactcttcagtgattggtcttgctcgccaagcaaatgctgggtcaaatgttgcttggtccctggaccccactgaggaatgctgtgtgcatgaggaggggccccccaaggcaagaccagagccacacagtctattcccaattgcttctttcaaatacctatggctgctttaaatgagaagccactccatggaccttgtttctctgagcctcagttttttcttcccaaaaatgggagtaaaatctactaccctgcccaacccatgggtccagtggagattaaagtgcttgtgcaaacagaatgcctgaggcttctgtggctccagggagcacagttcccagtaaaatcggagtaacaacagcccaggccacatcccgcttgcccatgggcagtctttcagggggtctgttcctgggg

SEQ ID NO: 59905 - DNA, 1142 bp, Bovine  19866881222698
attcacccttcttcccttggggtttgtaagttgtctctagaatcatttataagatttacgtgacccttgaacaagtcactcagtctttagggacctgtttcatagtctgtaagataaagggttggcattagttattttctagggccctgatggttaaacaaaatcttttgaattcttaacgttgtttaatttccaaaggaaaatgcattttaatgtctttgtttcttactgtaattattctcacttgagttcatgagtgcggactaccctattgttaattttgtacagagtcctgtaaactgaattgacattggattacttccaggaaaaaaagaatcactttgtacaaataggcttaattaaaaatcagattaaaaatgatctctttctagtgagcccaaaataacctgtcataactttttttttttttttaaagacaagataaggagaagaaaagattttggagttgattgtacacagagatattcagtgagagtgaaccatgtttaaaatcccttccacctaatgttaaataaagccttgaggttttcattattattttatccctcatttctcctgtgacctaggagttagagcataaagttctggatggcaatatagatgaactataagctccctgaaggaagatgttgagtcttagttttcatgcatgtccagcctttaggctagtgcctttcctgacgtaggtatttaagaaaatttgttgaatacatgtttgactgtatctcacaatggtgctttcccaaatgtctgtttagaaacacattgatgatcatgaactgccgtttgattgtcctctcagtatacagaatgccagtctcttcatagtgttctgttttcgctaactttaagagcagcagaagcagttgaggtaagagagaagccatgtgggaaagagctggttgataataggatgaaaagaggtccaggctactctgccagggtgaccagttcatcttctgcaaacaggattactgccaacaccaggggactcaaagatgtcagttctccttcctgcccttgggagaagttgcaagctcccggggctttgcagttctactgttaccacaggaaactttaccctttccccctcagcagatcaggtgggcggatctgaggtt

SEQ ID NO: 59906 - DNA, 1429 bp, Bovine  19866881393425
tgtggtcagagggaagggcatttgctgtccagggggagcatccagccatgatatgcctgtcagttaacacagggccgtagccatctggctcataaaccctgaaattgctgaagattttacaaacctcagacagcagtcttcagaaggggtcgtggatgttttaggatccctggggtcattattagtacatattcttgggtaggagaggatgcagggaaacttcagcattaaatatttaatgagcacactggcagcctttggaaaacactaatgatctaggattctgtataatgatcttgggtggaacctgggtatctgtgactgaaatgtgcagccagggtttaaaaccacagctccggaaatgatacaggcggggcctggattaagattagagtttgacagtacagggagaagaacagtgggctgaaatttattctattccaaatatgataaggagacttgagaaaggaaagaaatgggacaagctcctttaagctctgagcctccggggctaataagattagaggttggttgtggggagaaccgttccttgcctgatatggataaattcatttgaaagtgaggcaaagaacaggtttagtcaacccattagcatgatacttactttggcaggaaagtaaatatgttgctttataagtccttgtatgtcctcttcccaggggctaagggtccaggacttcagcttggctaaggggcagcaatgagacttcactctaatgagacaaatgatcatcaaaaaccacctgataggcaagtggtaaataagtaataaaatttgacaacctggcaggcccaccccaccacaccctccactgtgaaaataatattctctttaaaaggaagaaactatgcagaaaagtgaaaaagaaaataagtagacgtcattcacagtcccacattcagaaataacctctataaatttttatggacatgtgttgctaggaaataataattttctataaagggatccaacctgctttttttttttttccatctcacattgtgctgtggatctcttgccacatcaataaatacaggcctaaatcagttttaaaggctgaatagtatttcactacatggaggagtcattttttaatccgtctttgttgatgggcatttaggtcatttctcattcagagctattaacaatgagatgaagcatcctgtgcacaagcctttgagataggcatccagctgtggggatctggggcttttatcactcagttgcctcgctgggaagcaggatgacaaagccgatgtctcccattgcactgctcacagcttattgggttataattcatctcttatttgcttttgggttgccttatccctctcctcccacagagtctcgtaacgggctctttggtgaggggtagagtacactgtactcactcagtccctcccattt

SEQ ID NO: 59907 - DNA, 1358 bp, Bovine  19866881651245
actcaaagaaaaggaggctttctcaaacaaagcagagctgtctagatggaaagtcactgtctagctgttttctagctccagtctatcacatccagatagaatactactaataatcaggcactagatctgaaataactagctggacactagaatcagtgcgtactgactagctaggatcatatagctatccacagtcatgactattgttttaaaaaggaattgggtcttagacatatctgttgggttgccccaaatgttcgtttgggtgtttttttccgtaagatgttatggaaaacccaaatgaatatttgggccaagccaatattattgcctgtcctgcccacacccgcactgaatgaacagagacaaattctgtcatgtaattcttcttcatacaaccaactggttagacccccaagtcaatggcatacagtcataaatgaagtcataaacgaaccagagaagtaagttctagggccaaggggcgtgagacagctcaaggcctttaaggctgcaacctgggctggcctctggaaataggttacattcgtgctgaagttatgaggggtgtgggcccctggtgagagtgaactgcatgcaatttaaatactaccttgagaagcaaatcaaagtcttagctttaaagttctccaactcacagatctaccaacctaaagcagcccttagtctttccacagtcatccactttgattttggcaaatggatccacaggaggagcagtagggaaagggtaacctggccagtgagaagaaataaagttagaaaatccaggaacagcgtttccaatgagaaaagctactttttagtaggttgactattctctatcgcatgagtctagaaatggtcaaagcctcagaaaagagctcagttgatgcctaatcaccctcttcatgagggcaggtgtggggcacacatctttgaacccagcctatgtgttaactgagaaagggctttctcctcacttacaggtagggtgcctggggtactgaaagaagacataatatcataagcactggctcaccagtgtccattgaaagcatgaaaagagagttttattccatacacctgctctaagagaaagaatgaacaattctctcttcgatagcagaggctttccatttacagctatatattacaataggatctctctgtttctgtgaacttgtttttcatcaagctgtagaggacattttcatatctcatagaaatttgttaatcccatcatttcatgcatctttcttgtaagatgacttaacgtcataatgctttcaaccacaagtcaaaggagagcctacactgcgtttccagtttgtgcccacaaatatttttattctagg

SEQ ID NO: 59908 - DNA, 1025 bp, Bovine  19866881809071
cttgctagttgaaggactttacatcacaatcaacccttttcagaatagtatgttcaattaacaaataaatatttgttgcttatgcagtgtttactatgcactgggtattattctagctactggggacacagcaataaacaaacattacaaatcacatttctgctgctaatctagactagatatcaaaatttagcatttcaagtttgacgaagataacgatacatgtaaaatggtttaatgttccttaaacagagcacagcagaagttatgggacagttgttacctgatggtatgaagacaatattgatgccaaatatagtatgagtcagccaggtatacaatccatagaagccggccattttgagggaagcatcaaacacccctctagaatgtccaaagacaaagtggaatcaaaataaacacagtatcatactgggactcagaaaaatcaattatttctaggcttctagattttattccaaatctgataacagcttccatttttccagtggcctgagaatgctgttttcattttatttcaataaaatatacaaatcttctatttaaaccttgcaatagatttactaaactgttctttaaatttcactaataaaaagataacagaaaaaccttaagataccctattcactgaaataactcatcagcttttcacttctgaagcagattactcaccaccaaaataaagagaaagaaaaaaaagtgtgattatcttatttctgaggaggtaattaaattctgagacatccaggctgtgaccagccctccccttgggaggagcaagtgagggataatataactggtacttcatcagtctttcttcttttgttaacaaaatgtttccacatttcttaaaccatgcaacccaacttacaaggtaacgtctaaaaatggtatcaaacaatgtaggtcacttggagagaatttacagaatataaatcttattaattccaaagtaacacctgagattaaaatataagaggtgtaaaaacaggcacacatattca

SEQ ID NO: 59909 - DNA, 1122 bp, Bovine  19866881866198
attgtgtggactgcagaagaaaagttgaaaacctggagactaagagaaagaagaccaatcccaggcacataatccattaggctgactccaaacagctagcacaagcctgctcaatgaagatgtgttgattgaatgaatttaagtgccattctgaaggaagaattatttttccagccaactatcattgagggtagtactgaagaaaaaagtaggtgaacaggatcttaaagttggggctcaagagtgatcagagggacccgaggcttccctactgcggtgggtgaaggggatggagggtcttctgagaaactctggaagtctagtgtaggctagagtgatgtctagggtggaggaacagcccagataggaggtataatgttcctatgttcatcaacttgggtaaggaatgggagctttccaggccagatcttccaaataattaattaatagtttgttgttgtttagttgctaagtcatgtcctactcttagtgaccccatggactgcagcacatcaggcttccctgtccttcactatctcctagagtttgctcaaactcatgtctgagtcagagatgccatccaaacatctcatcctgtcacctccttatcctcctgcttaaatcttttccagcattagggtctttcccaatgagttgactctctgcagcagtggccaaagcattggagcttcagcatcagtactttcagtgagtattcaggattgatttcctttaggattgactagtttgatctccacgtagtccaagggactctcaagagtcttctccagcaccatagtttgaaagcatcaattctttggtgactcagccttctttatggtccaactctcacatccatacatgactattggaaaaaccatagctttgactatatggacctttgtcagcaaagtgatgttggtaattaataatttaatgtataattaaattaatataactataaattataatttaaaaataatttaattaataattaaattgatattgttaattaattccaaattgttaactccctcttacaaagagcaaagctaggcactggggttagaaaaaatgatccatgagtaaagaagactattcctataaggatttttaaaagtg

SEQ ID NO: 59910 - DNA, 1373 bp, Bovine  19866881876658
gctggatggcatcctgattcgatggacatgagtttgagtgaactccaggagttagtgatagacagggaggcctggtgtgctgtgattcatggggtcacaaagagtcagacacgactgagcgactgaactgaactgaaccacaaggttttcacaggtgtatgaagagttaatttttaattagatttaattttttggagtgatatactggaatacaagaattgaactggttctaaagcccattcgaggtttttgacgattgcttaagggggtatagctatactgacactaatgaccaaagacccactttgaaaagaaaacagaatggtgctaaaataagaaatcagtgggaatttagcattgatttccccccttgaatttagcaattctgtactgctttttggatagaaaattcaagctggcttgctgcttctaagtcacttcagtcgtatccgactctgtgtgaccccatagacggcagcccaccaggctcccccgtccctgggattctccaggcaagaacactggagtgggttgccatttccttctccaatgcataaaagtgaaaagtgaaagtgaagtggctcagttgtgtctgactctttgtgaccccatggactgtagcctaccaggctcctccgcccatgggattttccaggcaagagtactggagtggggtgccatccaccttctccttgtgtgtgttactgaattcaatttgatagtatttggtagaattttgcacatatattcataaaagacattagtctgtagttttcttgaatgcctttttacattagagtgaaactggtatcatggaaggagttagaaaatgttatctttaatttttgaaatactttgtgaagaactggtgttcattcttctttaaatgtccagtaaaagtcaccatcaaatccatctgattctggacttctctttgtcagaagttttcagatttctgtttcaatctctagttatcctatggctattcagattttctgtttcttctagaaccatgttcagaagtttgtgtcttaggatttgtccacgtcatctaggttatctaattggttggcacgtgattatttattgttttattattctgtcatattcctttttattgatgtagagtggtagtgatatcctttcttttattcctgattttaagaagttgagtttttgctgttgttgattgtggcttggtgagtctagctcaaatttttttcaatatcgttaatcattacaaagacatagtttcaggtttgttgattttctccattgctttctagtctctatttcatggttattcctttccttttgtttgctttggttacttccttttgctcttcttttttctatttcctaaaatggaggtt

SEQ ID NO: 59911 - DNA, 1132 bp, Bovine  19866880934169
cagaatcaggcataactgaagcaactgagcacatatgtacatgcagcatacttgactgctgtaccatgtttgagtttgagcatagtcttgctgcaaaagagtcatgttcaacacatttcaaatttgaacagagtttgatgacaaagttttaaaatgaataagcatgtatcaaatcaagtattttggagaaattatgtcaattatttacactttgggtatgagaggaaaatgcacatttaaggtactctttttcctctataacatacatttttacttactttttacatgccatgccaagttgcttctgttatgtccgactctttgtgatcccatggactgagcccgccaggcttctctgtccatggaattctccaggcaagaatactggagtgtgtggccatgtcctcctccaacttcttacataattgtatgtgtttacttatttacttttcccttttaaaaagtaggaaaatctgtacttatttaatgtaacaaaatattgttaaaggaacaaaaaggatcaggcagatagaatattgtaaaaatccactgattttaagaattaaagactataaagagcttgcattatattcttcatagttagtgacattggcaaatttttactgctataacaataagcaaaggacactcacatccacataccctctgatcagggttctcaagtgaaaaatataacactgtatggcaatcaaaattgctgtctaataatattcatatctaatcatctaaacaagctccaagagatggacattctaacagggaaaatgatacacagagataaaatgcaggccaatgtaaagggcagctatttagaaggagagcataaacttattccttcactggcagctctgaagatcctgagtgcaaatccattcttccctgttaattgctttgtgggagatgttgtcaattatcactactttttaccccttggaaaatataaataaatttgtcaaaacatatcttcccatagttattcaaaaagttgctatccaacatagaattttgcataatttatctcatttaatatcctggtatggcatattggcttctttcagcttaaggagttcatagtcacaaatgaatccattgctattgaggtcaactactg

SEQ ID NO: 59912 - DNA, 2019 bp, Bovine  19866881652553
ataacatgtgtgcttcctgtatataagggagagacctaggaaaactgagtaactcccctaaatgactcaatccatttatataccatcagccttaaataccatctgcagtaaagaaaaaaaaaggagctgggtagagggcatgggtatgggaggggaatagttgtgaaaggtggtcaggaaaagcacagtaaagggtaaggttgtatgcaaatttaagtccttgccttctccactgataattttctaaaaatttagagttatcattttcctatacagagaaagacagccttacaaatggagatgtcccatataaatgtaaatttctcttacacaagagtaacttctactcagttttcagagcttctcctgtgtctgctgtttcttaaaaataaccagtttaaaataatccttgtcttccctcgtgtctcagatggtaaaaagtctgcccgcagtgtgggagacccaggttcaatccctgtgtgaggaaggtcccctggaagaggaaatggcaacccactccagtattcttgcctggaaaatcccatggacggaggagcctgggacagtccatggggtcccaaagagttggacatgactgagcgacttcacttatgcaaaagaaacatattttcaggtggcaaattctactccccttcaggccccaattcctatgttcacttcagtcgcaagccaatcttaatagttcatggtatggatattgatgtgctaatggcaaagtatttgcaaactatctatccttaaagttaccccccacccatgtacacatatacacacaaaatgatggttcatctaaaacacagctaaactgtcatcagttcctatttgcaaaaaagcaatttctaaagtgacattagtatgcattcaagttttcagatggattaaaaataacagatttttttttctctgtaattttaggtctttactggcactcatgtactgcaaatcactgatttaagtgggcacaaagatgataataaaggggaaaaaactcgagaaatctttcctaatctgtcactgattaaaacagaaagcaccatttttgaaaagtagataaagtatctaggtaaaattgcatttacttaccctcatcttgaccctatagttctttcaataattattattttgttttaaaaaaagttctgtggtgttatggatcaacagccatgagtaggagtccattttttttttcaaattaatagactgtaacttataatgagcaatgatagaccaacaagaaattcaattccagtataattattgcttatggaatttaaaaaatgtttcactgagtaagaatataaaatttcactttccaagccccaaatgaatcattataggatttacatggtggccaggaaagaaagtaacccaacaggaatttcaagaacctcaacctcttcttattaaatgtgattaactgtcaattttctgctctggatgaggcccataataaaatacatacaataaaagccacatggaacatctgatgtatagacaaaaatttttccttcctccatgtctatttagtaaggagatgaggtgtgatgtcaaatgactcactaaattccaaattttctaccaatttgaaacttgctaccttcaacttttgtcatttccagcaagatgcaggacaactggctatctggtaaaatggtgaatggctggtgtattaaggactccagaatatttggttatattaacatgggcttgatataatggaaaaggtctggaatgttaaagcttaaattgaaagtgtgttaaattaattaaacaaggaggctgttaagctgaggtggctctaatagaggccttggcggcctctacaagcaaaccaaaatataagcctgtaaaggtcccaagttcacaaaatcaaaatactaagaacaaccaatcacagccagccagctaagctgtaagctacagccaatcaacaatttcctttctttgctttctcaatctctccagataagtctttcccctggttcctgtcagtccaca

SEQ ID NO: 59913 - DNA, 1330 bp, Bovine  19866880695502
ttaaactgcttgatcatgttctgatggttttaatggcttccttcaagatcatttcaggttggtccattttccaccgccattcagtacccactggattggtgtggtgcctaggaaaaagagaggcaaaagttctttagaactctgttaactctcagctagtcatccactatgagggagtccatataattataaaatccaggttggttttctcctaaaagctcagctatctacagctatatttcacaacttattttgagtcatgacatctaggacagaaagacagatggacaagggaaatgcttggccaagactgaagcttaatcagaacaatacaacacgtacccctctctcccagccacacaccaccaggctaacaagcatccagcaatgaccaccagtacaatactgtttcaagactctctccgagaggcaatgggaagacctaaagcttaggatggatcagacacggagggaaaaacctccagcaaaccccaggcaacactcaaggtatctctaaaggacaccagaaaggaaagggatgccaatttccacacgcaaagaacattcatctcagtctctcacaatgttggacttcggaaaaaaaaaaaaaataagaggcatataaaaaagcaagaaaacaatacatttccaagagacaaagcaatcaataggaccaaactcttctgacacaagggggtgaaagtatctgacaggttatgtttttagaactctgattactgtacgttacaagtcctaatagaaagaggtaaacaacacgcaagaccaaatgggtaaattcagcacggggaggaaagctataatcaaacagaaaccactaaacacgaaaaaaataggacttctacaggctcaacagtaaactacaacagctacggaaagaggtaaaaaaaaaaaacttggagagaacaaattaagccaactaaaacacacataaaaatttaagtggggaaaaaaaaagacacagcatccaagagctgtgggacaattatcaaaaggtccaaaatacacataattggaatcccagagccaaaatacagtaattaaaatcccagaagggaaacacaaaataaagtagagaaagatgtcggaaaaatacggccaacaatttcccaaagttaatgagaaacaattaaccacagatccaagaagcttgcagaacaaccagaatatttaaagacagtgtaaaaatacagtatctaagctaatgaaaacaaaagaaaatcagaaaatcttcaagtaagagaaaaagggcacattacttaaggacacagattggtatttttcgacaactcatcggaaaacagcaagccag

SEQ ID NO: 59914 - DNA, 4215 bp, Bovine  19866881006136
ccaaagaaataggaatactctgtgttgtaccttatgtcctttttctgggttattcagcttattggtatgaccttaggataaaaattctggaatcttaagtttctgcgtcagcatctttcagtggcataaagtgcatgcatgcgtgctcagtcgcttcagtcatgtccaattctttatgaccccatggactgcagccagccaggctcctctgtccatggggattttccaggcaagaataccggagtgggttgccatgccctcctccaggggatctttcccgatccagggatcgaaccttcgtctcttatgtttcctgcattggccagcagttctttaccactagcatcacatggaagcccaaggtctttacctccagtctagaggctgaattagagacgttgtgtttgggggcaagtaaaccatttgggtgcctgtggtgttgaactcatggggtctggattggccgttgtccaatatggggcattgtccaatatcaaaagaactttaaaagactgtcccttaccagcaaggtacttcctgacttcctgacttcagggacagagcatccatggaaccaatccagaaaaagtcttcccattgtccacaccttctttttgtacaaccagaagactggcagctggtgtttattttatccgttcaaggctcaggggttaacaactttacagagaagagcagtcgtaatcataaatctgactgcatttgcctagcaccatggcattaacctgcccattcctgccttaaattctggtgctggcttctcttccttactaataaaatgtcctttgaagccttctttgcaccccagcatagggcacttttgactacattaaaaacctgttcaggcaggtatcctttcttcttaatgattttctttgctgagaattcctttgctgcctcttggttggcagaagctgctcctcctgttatcttgacattttaaaagtcagacctctttttaaaatcatcaaaccatcctttgctggcattccattctccaactttagatccttcaccttcctcttgctctaagttgtcatataatgacttcaccttttgaatcatattcgtctataggtatgtctttcttataacaatcctgccccacacataaaagctgcattttcaatacgagataaaaagacattttacaaaaagctcaaggttttcacacctgctgtagctgcagcgaccgcttcatgaatttcctttcctttttcttttttttacaatggtccttccactggactcatttgtcttgaagtggcgggcaaccgcagctgcagacttgactcttggtgcatatcaagccatttatcctttgtcacttttctctgcttcttgggagcatcacgtatcatatgggtccgtgctgttattcagggtttacggtattgcactaaacatgatgaaaactgtgagagaacttcaaacctgtactgcagtgaaactgactagagagatggctgctcacgtgatgatgaccctcacctggagtttcagacagatacttgcagcactcctgctcagtgccctagcaacaggaggtgctgggaaatgtgtacagtgttacagtctatactgatctttacctttgtttacatttctgtcaactgggagtggtgctatacaaggtctgtttgtgtgagtacattttgatacattttaacttaaaaaaaatacatgtatattttatgatagtaaatgatagaggagtatctacatgttttttatgcattcaggatacacctaagttttaaatttttttggatattactgtgttatggggtgcatctgtgagacttttcaaattgtcacaaatcttcaagaacttttatataaatagaaatttccaaaaattatatatatatgtatataaaagaactatatgtgtgtgtgtagaaaaaaccacatacacgtcgacctgcactcttccaaaccttgttgttcaaagatcaactgtatgttgaattgaatggaattaccgttttatttaaaatagaaaataattgaatttatagaacaattcatgaaataattatcataacgaaatatttgcagctaagattaaaaaaaatgcttatgtgctgggcttggtaccaaactagttatttcatgtggcttatttcactgaattctcacaactgtgtgcgcatgtgtgtgtgtgtgtgaattccccacgttatacatcagggcataggtgtagaggggatgggtggcttgactcaggacacagatcaccctagtggtagagccagagtttgaacctggggcatctgacttccagtgcatctgactgccttgccagtactcagtcattcttctttctgagttttaggttaattttaccacttcagattaaatctgcccttcagctcttctgctcatggggagattaatgatgtttcttttttttacaaaaagaaaattttatacttaatgctgagttgtcttggcaacacagagtgagttaagtatcaagttttatttaaaaccttgattcacttaagattttagatttcagtaacttaaaaaattatccatctccaatactgacatgaaatacattcttagaattgcagttagatagtcataaaagaagataaaacctgccacttttagattgttctgattttagcctgtattatgttgattttgatggcttgggtgtttacttgcacttgcttatttccaagtagattgtgtgtgagtgtatgtgtaaaataaagtcacctcgtggaaactaaagcacaagcaagcagtgaaaggtaactttattttctccagatttgtcttccttaaggcgatagttactgggatttaattattttaagaaaccaggataaaggtgatgataaaaacacgtccttaatgaatgttttgtgtgtgtactaggccgtctgctaaagcctttccaggcattatctcatttaattctaacaaacattctttggggtaaatactgcttatagtgaagaaaatacatttcatgagtgactaagaaatgactgagaaggtgtatgaatatgcttctcctcatttctaatcttggtgaagaggaatattatactctttagaaagaatgtatttttcaaaaagtacctagagaaagtagcatggatgcgtatacagtaacatatgtaaatagatagccaatgggaatttgctgtatgattcagggaactcaaattggggctctgtaataacctagaggtgtgggaatgggctggagctgggagggagattcaagagggaggggacacatgtatacctatagttaactcccttggactgcaaggagatcaaaccagtcaatcctaaaggaaatcagttctgaatatttattggaaggactgatgctgaggctgaagctccagtactttggccacctgatgcgaagaaccagttcattagaaaagactgtgactctgggaaagattgaaggcaggaggagagggggacagcagaggatgagatggttggatggcatcactgactcaacagacgtgagtctgagcaagttctgggagatggtgaaggacagggaagtgctgctgctgctgctaagtcacttcagtcgtgtccgactctgtgtgaccccatagacggcagccacaggctcccccgtccctgggattctccaggcaagatcactggagtgggttgccatttccttctccaatgcatgaaagtgaaaagtgaaagtgaagtcgctcagtcatgtccgactcttatcgaccccatggactgcagcctaccaggctcctccgtccataggattttccaggcaagagtactggagtggggtgccattgccttctctgagggaagtgctacagtccatgaggtctcagagagtcaaacgtgattgagtgattaattcatgatgtatgacagaaatcaaaccaatattgtaaaccaatcgtcaatcaattaaaaataaataaatattaaaaaaataaagacctggagagagcaccaaatcctgaccactagaccaccagggagacattaccatatgtaaaacagatatccagtgggaatttgctgtgtgatgcagggagctcaaatccagtgttctgtgacaacctagagggctggggtggagtgggaggtgagagggaagttcaagagggaggaggcatatttatacctgtggctgattcatgttgctgtaggcagaaaccaacacagtat

SEQ ID NO: 59915 - DNA, 1653 bp, Bovine  19866881149808
ttcccacgaactcctcagattctgttagtttgttagagtggctcgcagaacagagaagcatctacttatgtttaccagtttggtataaaggatattatagagaccacaggtgaacagccagatggagaagtatagggtcggtctggaagggtcctgaggccaggagcttctgtccccatggaactggggtgcaccaccctcctagcacatggatacatccaccaacccagaagcacatcaaatcttgttcaagggtttttatagagcttattttgtcagttccctttccctttctcaccggtccatgggtgtgattgaaaattctaatcctttgaacacttggtctttatggtgaccagccccatcctgaggccatttaggagtcctaccctatgccaccccatttgcataaatgtacttaggtgtacttaaaagggctccttatttattttttggctgtgctgcctggcatatgggatgttagttccctgagtccccagcagttgaagcatggagtcttaaccgctggaccaatagggaagtccggaaagggatctttatgaatgacaaaaggtactcccaccactcaggaaatcccaggggttataggagctttgtgccaggaaccagagcaaagaccaaatctatttcttattttttaccatggtgtttcttactactattctgacttcctaggagaaattgggaaagtaatgcaaataatgattcaagagcaataataatttataaaggtatttttataaaagtaatttataaatttatattatctttatgagttttctaaggaaaattgccctatacatatatatgtacatatgtatgtgccaacttgtacatctgcagagatgctaataaatattttaacatttcatcttggtttttagtctcaagaattttttttttttggaaacaagtcattttcttatttggaaaaagcagtgtctcttaccagccttttggaaaattaaatgaaactgtgtagtaaaaaactagtaagtctccacatcaggaatttactagcttttcttagactctttgttgatttcgttaatattattgatcatgaccctcaaataaaccatatgccttttaagtatatttcaaggcaaagtcttactttcttttggatacttagttactagtcagaattctccagagaaagagtcatcaggatgctgtgtgggtgtgtttagaggaagaaagagagagagagattgatagagtgagattggcttaaagaattggatcatggaattgtacaggcttggtcaatcaaaaagataaaaataatctgatggagtggaccagcatgctagagatttaaggaagaattgcagttcaaatccagaggctgtctgcttgcagaattccttcttgcttgagggctgtcagcctttgttctttgaggctttcagttgatttgatgaggctcatctgcactataaagggcagtctgctttacccaaagtccactgacctaaatgttaatttcatccggaagacatcttcaccatccaacatccagaataacatttgaccaaactgggcaccatggcccagccaagttgacacgtaaaattagccatcctagacagtcatatcagaagcaggcaaacaccagtaatttaacct

SEQ ID NO: 59916 - DNA, 2171 bp, Bovine  19866880283949
tgacttttaatttcgattttaacttgttttaatgactatgttgcctgcatctgtaactgtataactggatttgtttctagccgcatgaaagcttttaagttacaaatgattgttcaaactcctgctactgctgtagcttcctccaactactatttgggcccctggatcagatatcctcaatatgaggattaggagaatatgttgcctcaccaatttagggacaacacctcttgtcagctgggaagcagttatggaacgagaacgatgccccttttccctaggcaacataattctcctaaaagaaaaggggggaatgagagagtcatttcctaggcaggttgatagggagtctaggggttcccaaagagagaggggtctggaattctcaaggtggaagaaaatacaaactttttttctttctccacattccttaggataatataacaataatgtatcctgcctaaggacagtctttggattaaaccttctgttatcttaaaatgttaattatgggagtagacctggtctttacaaggatgtatcttgcctgaggacagtgttatcttaaaatgtaaattatgggaagtaggtctgatgacattctgatgtctgatgacattacaacctcatttgtaatgtcatttttttggattatataacctcattgttaacactagcaagcgggtactctttctgcccccttctggtgcctatgtcagaagctttctctatctcctttatactttaataaaactttattacacaaaagctctgagtgatcaagcctcatctctggccctggattgaattcttctcctccgggggccaagaatcccggtgtattcgcgtgattcaacaacaaacctttcagttccctggattctcttccctttctacttcatacattcttctcagctccaatgctcaggcctgaaggctcaccactgatgctcactatgacttacatcttggcatctccttctcttggcttgtttctaaatcttgactcttcctgagctgtgacattgcatttctgccattgacctacctatgctttcccaaatgtctgacttggatctcacccagttttcaatgtcagtcttctcacaattcagtggtaacccattctgtattgtgatattatcacccagaccactgctccatttgctagtatggactaccatggcctacatctaaatataatgtaccgatgatttcaatattttgcaattaacattgtaaattatatgagggtgggctgtgggctcatgactttaatggaaaagactttctgcatgtcttttccagaatttaggaatcagacttttttttttttttctccaagtgctggatattggcttcacattcctgtagaaattcattctaaatcatgaaaatcactgataaaggggagaggcctttattgcttgtaccaggccagactgtcctcatctttccttgattactatctagcattgtagattcaataatattaggcctataaagtgttctgcaaattttggatcagtacatcagtgggtgctttattgttatagctgacataccatagagtccagtatgatgactctcttttctcaggagcttccacttatttttttaagtcatcacaaatgcatttgatccccttcttactgtcatgtacaaaatagagtaacttcatcttgtaaacctttttgtttcatctgatactttaaaatacacaagccaagtaccatttttcatttttaaaaataggaaatcactagaaattgccaatgatatgtacagttaattgaattgctggaatgaactgaaacaatattactaataagcaactaaatgacacatggttaaaatgaactcatcacatgcagactataattataaggtatgaaaaatcatatgcagaggttatcctcactggaaagcaaataactgtctcattcagagctgatttgctaaaatattatctggaaaaccaataaatattcattattcatattaaaaaattctgtcagccgcagattacttctttcaaggtcacctatactgaaaagcacaaagaggaagcaagggaaacacttatccatgttcctgttaaaccacacaatttttgacctctagcaaatttcggattctgctctgttgcatttggaaaatggaatttgggg

SEQ ID NO: 59917 - DNA, 822 bp, Bovine  19866880589027
cacactaagaggtagagagtttatcacctgtctattcctgagattctaacaagaagcttttcagaagatcaaaatggaaggaacacaggattgtgatggcagggcaatgctcaggtatgcatccacagagagtactttctgggtttgtttaaagaaaatgaaactgtgtgcttccagtgctcctgagactgtggtggggattgtggcttcaaagaacagtgatcacagctccatggttaccacgatgcaggaaccagtgagcctgagaagaaagcaactacctttgtgtgaagaaaaacaaacaatcctggcaacaaatattgttaaccttgggattggattttttaattatatggtataatctgttccagtggaaccctttataaatagaacagcatttaatatgttaatttatattttaaattaaatttttataaatatgtatgtaaatctattataaattactttatatttttaaattaaaatatattaacatgctaatacactctataggagagtagaggtatgactccgcatgaggaacattacaaattagttgactaccatagatttttccatagacaatttagatttaattgttgataattattaataacaaataattattgataacctaatgtatatgataagccattttttattattgcatttgccttgttcatggttctcagtttcctacaatgtacatttcctcaccatgacctcatttcctaacccattttttctgagcctctaaaacccccagctacttcaatgattaacttagtatagtgtattcatatttgttcattttacaggtca

SEQ ID NO: 59918 - DNA, 929 bp, Bovine  19866880635706
aaaagttgttagtgtgtatgtgtatttgtgtgtatgcgtgtgtgtctctgcgtgtatacatgacatatccaaccaaaagaatagagagagaaacctgtactatgctgaaaaaggttttgaacattttgaaatgaagcagcagagctaattatctgtctgggaaaggtacgtatttaggttttgagctatttaggtcaaaagtaacagagaaattgctgatacaattattcctagtaacactctcataaatgcctgtgtgcattcacacatgcataaatcccctcacatggatatgttcctgggaatggctgtctaaataaatcctcaaagtaccttttgttcagtgatatggcagtggaggtaaggaaaggatgcatagaatgattgaggcaaagttagatgagatcaaatgtttcgtcttccatgagaaagattaaggtcacaatcatcacaaatcaatgataaaccttcccattccatcacaccctggtccaccctctaccacttctgccttaaattcttactgattttgcacaaactgttccatttgaatttattctcacttattttttgactgacattctagaagaaagcctagaatatgaaatgcatgaggacactgaatggatttaggagactgaccactatgatgtgaaaactgccacctaatcatttgcttgatttcattcatgtttctagatatcaactgctccagacagtacactaaagttcctttattttgttttgcaaagacagtatgtctagagtttatcaactcaaaatactcagaaaaatgtgaaataaatataaaaaacatttttgattaaatagcaaactgatcagaattaaatgccagaatcagagtcacatgtactagttggatcctttcggctctattctcaagggtcatataactgtcataactgctt

SEQ ID NO: 59919 - DNA, 1353 bp, Bovine  19866880740892
aaccaaagaaggaggaaagagaaagcctaaaaccagaagtgagaccccagaaataagaaatgcacatgaaaatagggtagactcttgcctcagactgagcatttaaatgctggttagggaagtaagaaccaactccaatacaggaatacttggcttgaagtgaaagttatgtgggctgaagaaggcagagtctttttgcagtgagactctagcgctcaagatagactaggcctgacacatctaatgttataaaaatacaaataagtttcataacactgaatttaaacaagtacacttttctcacacaatgaaggtgatgttgccagatctaattgttggttagtttttctattataaaataattaaataaataaagcactacttaaatcaatggaggttattttcctggaagtgtgtataaaatatgtgtaaacttctccaaacaagttattggcttatgaacaggctggacatgtgctctggaatcactgagttgtggtttctgtcctcagctccatcatttagcacctctccttaggctactgatcccaaagactatttccttaagagataaatagtagtactggccccatggaattattatcaggttaacttaaaatgctatactgaagcatttaccacagagtctgacatataataagcttccctgggagctcagctggtaaaacatctgcctgcaatgcaggagactccagttcgatttctgggccaggaagttcccctggagaagggacaggctatccactccaatattcttgggcttccctcatggttcagagagtaaagaatcctcctgcaatgtgggagacacgggttcaatccttgtgttggaagatcccctggaggagggcatggcaacccattccaatactcttgcctggagaatccccatggacagacagcctgacaggatatctctatggggttgtaaagagtcagacacagatgagcgactaagcacagcactgacatataatatgcagtcaataattttaactttgcaattccttgttttaagtccagtcctccagaattttgtttatgggatcatcatttgcagtgttagcctacatctctaaaaagtgtatggtaccacatatcctcaacaaaacttcacacaaagtcaaaacagaatcttacatttaactcaaaataatctagcctttttcttcaatactttgctttgattttttaaagtacctgttgatcaagactgacaaagaaaggtacaaaacaggaactttaaaactgctttgacaacactgttcaacagagattgttacttgtcttgctgttttcttgaaaatccatcagcattaagttttctatctc

SEQ ID NO: 59920 - DNA, 1953 bp, Bovine  19866880860047
tcagatatgcagatgaccccccccccttatggcagaaagtgaagaagaactaaagagccttttgatgaaagtgaaagaggacagtgaaaaagttggcttaaagatcaacattcagaaaactaagatcatggcatccggtcccatcacttcatggcaaatagatagggaaacagtggaaacagtgtcagactttatttttgggggctccaagatcactgcagatggtgatttcagccatgaaattagagatgcatattccttggaaggaaagttatgaccaatctagataacacattaaaaagcagagacatttcctgctgataaatgtccgtctagtcaaggctatggtttttccagtagtcatatatggatgtgagagttggattataaagaaagctgagtgctggagaattgatgcttttgaactgtggtgttggagaagactcttgagagtctcttggactgcaaggagatccaatcagtccatccgaaaggaaatcagtcctgtgtgttcattggaaggactgatgttgaagctgagactccaatactttggccacctcatgagaagagctgactcatttgaaaagaccctgatgctggggaagattaagggcaggaggaaaaggggaggacagaggatgagatggttagatggcatcatcgactcgatggacatgagtttgggtaaactctgggcgttggtgatggacagggaggcctggcgtgctgtggtttatagggtcgcacagagtcagacacaactgagcgactgaactgaactgaacagtgcagccctatgttcatcgcagcattatttacaatagctgatatgaaagcaacctaaatgcccatcaacggatgaatggataaagataatatggtatataatacaatgaaatactattcagccataaaaagatgaaatttttccttttgtgacaacatgaatggactttgaaagtattatgctaagtgaaacgaagtcaggtgaagaaggatgaatactatatttcactcatatgctgaatattaaaaaagtaaacaaattgaactgagagaaaacaaatacacagatatagagaatagagtagtgattacaagaggagaaacgggtaggggagggtgattgggtaaacagcctcaatgatatagtggtggatggaacccagacgtttggtgatgcacacgctgtagtgtctaatgaagttgaaatataatgccatatacctgaaacttctgttatcaatgtaatcttcatgataaaacacacacagcagttaggggtactacactaggtctcgttgcttgggcctcttcatcagatcatcagttatgtgttattttcattttaccgaagagtcaaggcccacagctcctcagagaatcaattgctcatatttttccttctagatttgtattttttcaatttgaaaagtctgcaactgtggttcaggatgatttctttcctcaaactattttctttggatagcaaatggatgaaccaaaatgcctttggatactttgctgaatctgtaattcctaaatgccactcctgtccacaacagagcctgttcaacagtagaccagctcatctggctgtttttctattagctaattcttatctttaatgagctaatacattgagaacaacatttctccgggtttgtagtgtagctgagaatcatgttcctgcaattttgtattttgactggctggcttcagggtgaagttgaattaaaagactatggaaaactgggtggtttctgtctaatgcaatcttgggagaaaaatattcaatttctccccagactgtaacatgtttctttttatgtggtgacttcttccttgttataaattctgagtttgctttgaatgcctctgcacattgtttttctgttgcttaaaatctttgcactttgaaatacatgtatttagaagagagagaataaa

SEQ ID NO: 59921 - DNA, 2766 bp, Bovine  19866881061765
atgcaaaagtcgttacagcaacacatgacagacagaggtggaaagcgtttggcatgtcgcatcacaggaagtcaatcacgattggctaacgatgatggtacctggctctggtgcaggtcactggcttgcctgagaggagtaacagatggagggggcacacctgatgtggacgccgaccgccctagtttgcagcttactttcggttctgtgaacaaggaggaaagacaaagcattagctgagcaaagtctgcagtgatgaaccggctctcagactttctttttggttttgcagcaggttctttcaatgcactgaattcttctgatgtatgctaatcattggcaagtgatgaaacaatttcataacaacagattaaaacgaaatttgttcatgaggatcagctcctgggaataaagaacaaatcacttaaggtcaaggctttgttccctgtccactttatcctatttacaatgagtttctacagagtgattaggctgggaagatcccctggagaagggaacagaacccactccagttttcttgcatggagaattccatggacagagaaccctggggggctacagtccatggggctgcaaagaattgaacacgactaagcgaccgacacaacatcccattggttaaaaagccaatttttggtgcttcattttcagctttggtccatggttctcccatgtcctaaaatgtctttctaccttctccaaatttttcttctatcgtgccctcttttcattttatcttttcttctttctcttattctttccttctttttctattttctagctttctgattttcaagttgtcttgtgctggctattttcacgatatactgttttcaacgtatcatttccctaatttaaattcatttgcttttaagtttatagatacttctgagacctttgcaatctttcataataatattatttttcaaaattaaaaagccttctcctaactcttcctttatttaaggaacctagattggccacccaggtcattgtcaggatactctggagattagaatttgggggatggaaagagttcccttcatccaagaagtgcagaatgtatggtctactgaggacactaattttcagacatatttgagggtattgtgcaggtgattctagtacctacatacacactctaaaaatatgagtgttcaaatctaagtgtaccacacgttgacataatctaacttataaatgaacataacttcccaggaggcataagtccttgcatgtcttaaagaatcatcttttatcttataaaataaaggtaaaggtaagcatctattggaatcctggttgacatgtttttataatgagccaatatttccatatatccctttatggcattaacacatttaggtacatgaagaaaattagacattttttttttccttgaaaaggatagcaaataatattttttactatgaggtccctttaaagtgtatgtggaagagattatccgatgagtgacacaatcccatgcctttcatattacccggcgtacctacggattaacttcccctgctaggtttcccgtcagactccgacttaatcagcatctttcaagcatagacgctgatatctctaatacacagactgagacttaccaaaatccaagcaaactcccaatttcatcatgacccagaaaggccttgcctgaccctcattggacagtggtccgcatcatgtcttggttcatccaccacccctttagggactgcagtttagccataaaccagtcatacagggtggctttaaagtccattcccaacatggctcacatgggttatgacatcacctgcagtggcagtgacaggctgagatgactacttacagattcattatgtacacatgcatatgcagacaataaacacatttctgtgttcacacacacacacacacacacacacacatacatactccattgttgcttaatggtatcatgtcatagggacaattttgtttattgtgagtttttggtttatttttagcatactcatttcactcttgttttccatttcacctggtccttcacttaaatgcatttgcaatcttttatgttgtttgtgagaccaggttggtgaaacaaaccattatgatcttggacccaaaggttttttgtgttttttttggccaaaaggatgttctgaaaaagtcttgaaaatcctagaaaagatactgtttttataactgagtctgttagagattcttgcctggaaaatcccatggatggaggagcctggtaggctacagtccatgaggtttcgaagagtcgaacacaactgagcgacttcactttcacttttcactttcacgcattggagaaggaaatggcaacccactccagtgttcttgcctggagaatcccagggacggcggagcctggtgggctgctgtctatggggtcacacagagtcggacacgactgaagagccttagcagcagcagtagagctgatatcgaagttaaattgtccagttcactcacctttggaaatacactgtgtttaagtcttaaacagtggggcttaggatctatagtactgaaaacaatgttttcatcctgaactttgttaatataaaaaattgccaaggctttagaggaccacaaacaatggagatatgcctcaaaacagatctaaagtgtggctttcctccccttaaaaaaaaactcatttcattaagacagtcattataagctagaaattacttattcttgtacacctaaggaaaaacctgt

SEQ ID NO: 59922 - DNA, 1854 bp, Bovine  19866881069528
agatagagagatgcatttttctgaagaaataacagagactaacatcttaaaggaggaattcgaatctgcttaacattatgcattattgaactcaaatagtaaagagaataagaacacattcagctaagtcattttacctccttggtgaaaaagcattgcgtaaaccaagggagttattattatgggaccactggtcttaaatgagtgtgtttccaggtaagaatttgtttaaattataaaatatttgaaaagcttttttttttttaattttcagaaagatcaattttcagaattcaataaatggatggcaattctgaatttaatgaagtgtctgtagtggtgcatggtgtttctcagctgaagcaaactcattattgttgttagttgatgggagctgggttaattaaatgttccactcctggtagaataaccaatcaactgaagaatctgggctattgctattcccaaatgaaaggagtaaaaatgccataaagaatctaagaggggaggagggaggattagtaacatggatttggaagcagaatatcctgtctagccagatacaccccgaacatatgaactgaaaggaaaaaattcaaatacagaagtctggaatagtcttgtaacaattgaaggcagaaagaatactttccccagattttcttctggtcaaatttcagttacattcaaaaatatatcattttttaaaatgttttgcatctgtgcccttgttacagatggaactgatataattaaattgagaaagaaaaaggatagtaaaactatagaatcataaagtaaagattgtgggtatccgtgtattgtccaatcctagatccacccatgtcgctgctgctgctgctaagtcacttcagtcatgtccgactctgtgtgaccccatagacagcagcccaccaggctgcccagtccctgggattctccaggcaagaacactggagtgtgttgccattgccttctccaatgcaggaaagtgaaaagtgaaagtgaagttgctcagtcgtgtccgattcttagcgaccccacggactgcagcccaccaggctcctctgtccatgggattctccaggcaagagtactggagtggggtgccattgccttctccttttctggattagtcaagtttatttttctctattctgttaacaaactccagataagtgaatgctaaaacaaacttgcatccctggaacaaatccaattttattatgatatattttcctctttatgtatatagaacttggttcataaatactttgtttaggagttttgcatctatgaaccttgtcaggttttaatatcaaggttatgctgactctgtgaaaggagttgggaaacattttctctctctctttctccttgtcctttgaaagagatctttaaaccaaaacatgttttataactctttgtctctccctattcagttgcccaggccccaaatcttggagtctttccatcagttttgttaggtttttttggctgtgccgcacagcttgcaggatctcagttccccaaccagagattgaatcctggcccctggcagtgaatgcactgagtcctaactactggattgccaggtaattctcctgtcttgttagttctttcttcaaaatatatccccaattcaactcaccatgtccactgccagcacaaaattcaagctaccattatttcatggctagatgaactttaatagatttataactggctcctgatttctgtctgtcctccccataatcagttctatacaaagtgatcatatcaatatatgtatgatgtcttcactctcttgctaaaaatttcaaagacttcctagaataaaatctaaacttttta

SEQ ID NO: 59923 - DNA, 787 bp, Bovine  19866881132120
cttaaaagaatattaaaggagaatgtagctcctaacgatggataaataagtcatttcagtggacagctagagattgctgagcagttggggaaattcatatacacaccccttcttcacttcctctttattcagaggcaacagaaaaccaggcctcccagaacgtaattttatgtacttgctgcttcatctacaccatgcctatttggtctactgccaaccctggccgccctcccctttcccttctagggtcatcagttctttaaaattcaagttccctcctccagctctcttagctggaatccctaaggtagtttcttttccccagctggccctacccaagcaaatggcttaggtaaacaaatgtgcagtcttgctgcaaatgggaaaaacaacagggtgagagaaatggatgaaatggtgtttagaggaaggtggaagcctgtggactcattatttcagggattccatggactgttcaggacttcttcagacagctggtaaatatttcatctcttttattgagaagagattggcttatgtttacattaaagaatatgttgctatggtccacctgtgtgactcttccatgttggtaatatgtaggtatgagtactgtgaaattctttcatttatttttaattgtttatacattaagttaatccaccattatgcaactttcctgccctggtgggagtagagactttaaaaaggaaaagtgttagtttcatgtttacttatatttttttctattttctaaaactgggaaatgctggataaaacactggtt

SEQ ID NO: 59924 - DNA, 3045 bp, Bovine  19866881304259
ttcttggttagataaaggaccttgtgagttttgttactgaaaaagggttacttacttttaggaataaaaactgttaaatatgatcaacttattaatatttaatgatgcttacacctaagtttaatgaaaagaatgtgaataacatagagctagacatatatgtgtgatgttttagatttttctagtaagaagaagagcttgtacttgaagtgaaaatcgctcagttgtgtccaactctttgcctccccatggactatacagtccatggaattctctaggccagaatactggactggatagcctttcccttctccagggaatcttcccaacccagagatcgaacccaggtctcctgcatgcagattctttactagctgaaccacaggggaagttcaagaatactggagtggatagcctatcccttctccagcagatcttcctgacccaggaatcaaaccagggtctcctgcattgcaggctgattctttaccaactgggctatcagaaagcccaagattgtatttggctagacaaaaaattgaaataggaaaaattaaaataatattcagtctattttccttaagttgatcccaactttttcagatgcttctaagtcaaaggcaaatgggatggggtgggaaaagctttttaggctaattttatcaattcattcaactagcacttttaaaaaatagttgactttctttaattctttgcagtgaatgaaacaaagaagtctgtgttctcatggaacttacattctgtagatgaatatccaagcattcaaatccaaacttttttgttatgcactcacttaaaagaaaaatgacctcagtgacttggtatgagaaacatggtgccaataacttgaaacataagatattagacttctgctttctttcctctacttcttttaactacctgacataaaaaaaaaacagctcaagacataaaccaattctctaatgagcaacattaaatcttctcttctccacccctaaatttgtggttgttaactttcaccccaggttcatgtcaagttgtgaaaaaagccacttgattttttgatctatgccttatcactgagtaaactagtcattctggcactaaccagttggaatccttcttctttaaatgtcccacctgtgatagcaaagaacaacacataactttggcaaacttgggaaatttagcagagttgaagttgagaatctcataagggctctctatggttgtgagcatgtgtgctaagttgcttcagctgtgttcaactctttgtgactctgtagactatagcgcgccagactcctatgtctgtggaattttcctagcaagaatactggagtgagctgctatgcattcctccagggaatcttctctacccagggatgggacctgtgtctcctgcattttgggcagattctttaccactgagccactggggaagccccgactctggtattaggaaggacaaacagaggtgtaagtggcatgcttgggcatgaagagagtaaagagcactctccagtttctggagagattctcgtgttccccatgggcttggaggttagaacatctgtgtcattagaaagagttttatattttgtcattgccccaaagaggctgatgaagggatttccaatagtgagagggagttagaaggaaccaggtctccatagtctgatccatccatgaatgctgtgaaagaacctatttggacaccaaaagctatctcacttctcaaaatagagcattagacaatatcagatatgaccagagagccactaccaaaacctgagtagctaggccagacaacatccgagaccaaagcttagcaatggacctaatgagaactctactaatggacccagacaatgaagagcaatatggagccaaataagaaccctctccaccctgagatacagacaatctcatgggcagcctagttccttctttacctcttgggtaagggtcatatttgggttacatgcaactagaagctggatcagaagaatgggaagagaaaatctttgccagtgaataggaacactgaaatgggaattgtattctggccagagacagagagataacttaatctgaccctcaaactccttgatttgatagagttcatctaaaataaattgtcattagacattcttggaggtgaatcaaggtagagtgttatgctacagtaattttgtctaataagccatacccaatacaacaacatgcatctatttttctcactcatggtcctgttggtcagctagaagggttctgatgcatgtctgctgggattttttggatggttctgccccgtgtgagaataggcaatgggtccctcaggtacggttttctcacagccatcctaagattgcagaagacaagccaaaacacatgtgcacatttcaagtttctgcctgcatcatacctggtcactgtccaaagttcagagtagatgacatggccaaacccaaagcttttgagataaggaagtaccctacttcaaggaagagtgaagagtgagtacttgctgaacaataacccaatctatgacaagtggagatcattcaaaaccaataaaggcctgtttaattatcaaatacaactgtatttgtttgtaactggcttataaacctgctttatttttaaagttttgatatttacactcatttgctgtgctctgctttacttggtaggttggtgcttctctactttcaactttttgggaaagaattttttgtgtactacagattcactggagtgttgttttatcttaattaggaggaatgtagctgtcaatggtgctgggaaaaaggctaatgaaaacactgacagaccattcaccattgccctgctcatgaggggcataatacaggcttttcttctaattttctttttaattttaacagtacatctgtacttcaaatctttttcattgttgtgatggttacacaaataatatctgaagtgttaaaaacctctttttttcctaatgcttttccccaaatagtagccaaaactctaagatacattcttcctttg

SEQ ID NO: 59925 - DNA, 869 bp, Bovine  19866881505414
cttggctggctcttttatcatcgaattttgatcccattaggactcagagaggatatgatacaagagatgaggtgaaagttttgcccatataaaatagtaataaaaaataaaggtggaattattacttcttatctgctaagcttcattatccatctgtcttatgtcatttcccaaccacattatcagttcgtctttccttgggtgcttctgatacttaacaatggtttaattacggttacccagaataatatggagaacaaaatgattatacactataaagaatgtttaatttcctaatgttggccacaaaatgaatttcatctaaatgcctttattaattatgattagaagtctagtccgatatctatagtcatgggtgataatgtactccagtgtgttagcactttatttttctttcccttttttttttttttttgccacactggccagcatgtgagatcttagttccccgatgaggacgagggattgaacccatgccccctgcagtgggagtgtgcagtcttaaccattgaactgccagggaagtcctgttggcactttccactcatttaatctgttggataaaatatatgatcaagaagatacagtcatgtgtaatatataggttccctgcaacttcccccctttctcattacacaactctcttctatccctttcctattgtaatctatgactaatttatagcatctgaaagctgacctcaaagaaaaagcttcccttctgctatcctttgatcactgtggcagctacaaactaaaacactttgcaggtctctcagtctgggcatccagggatagactgtcagtcaggtggtaagctttattgagcatcagtgtgtgtgcagggca

SEQ ID NO: 59926 - DNA, 1602 bp, Bovine  19866881620989
tatcttatgagtattattcctttctctgtttagttttagcccagtgttataagcagtttcttcacagaaagtatgcatttccatgaaaaaagtaaaaatttagcagctcatatgccaagagggaaaactttcagggtagttccctgtaaagatctggaaattcattaatgatttacatttcaaatatcacatactatgctagcttatttactattcctataggaaacagatcatcagtgaatggactgagtttgatacaatcttatatgacaaacatttcaaaacttactacacacaagaggcaatttctctgctcttgaaaaccagtttaataattaagactaaaactactaattagtgtatccttttgaatcaatttaggtgctaaaatctttcagccctcatataattttaactattttaggagaagaagcaaaaatatgtgtacatagagaagatgaaacaaaaggaagaaattcacatttgaggctgggtgtacgtgtcatttgcaatcacttaaagcaaacagtccaattcctttccttgtgttgccttctacctaaatggatacaaatttttttttagttggtgcagtatgtcattattaatgtagctatattatatgatgaagatgaaggtcataatgttgactgtgaaagcaataatagtgatgataataataatgctaacaataatggcagctaccaattctaaacagttatgatacatcgattactccactggttgttccatgtgagttgtacctttatttctcttaatacaagaaagggcatattattatttctaattaacaagtgagttaatgtcactttaaggattaaggacccctttatgggtctcaccttagttagaaagtagaagaaaccaattctaccttctgtccgggcaccaggattttcccactacttagttatcctctcctgtagcccaacacacacaacgttacttcctgtccgccaacacacacacaactttactctgaatttacatcttacaacaggatgataaccctggtttattgaagtacctcaggacagggaaaaggtcccatgtaactgatggaaaaggtccatcagttaactacttatctatgtctccatcctcgcaaaaaggccgtaaataaacatagccgaagctacccattgttagagcatttttactttttaacaatgtcaagtattctgcctgtctacacctgcctttcatcttgcttctaagattacaggatgagggtggttcttcctgtcttaactggaaagcgtccgagagtgtggctcacgtagctcttagaatcgagatcacttactccactaaatctgcacaaaggcagaaaccttcaggcaattatttatttgttctggttaatctacacacttgccctttgctgaataaacactaaaaaaaaaaatctttcttcaaatctttcttaaatatgtgtgtgtacaactttgagttttataaaagtatttcaaatttctatgcaatttttcaatcccgtacccacaaaatatcaaaaaggaaagatgaaattctcatacataccaacaaacgattaaaaggcctagaaatctcaatatgccc

SEQ ID NO: 59927 - DNA, 992 bp, Bovine  19866881897969
agaataggacactgaaccaatctaccaaaaataaactgacagggaggaatccaaccaaacacatcgccaaaagtgtcagctaaaaatacagccagaaaagtgtgcagtcaatacagagcttgcaaagccagatgagagcattactgtagtgtaaagagatccatcatggaaaaacaggcataagacaaggaagataaaagggaagaggaaacacagtacctagagacttccatggatgtttttcaatgaatactttaattacagcatctagtctggtttctacccatgaacaattctatttactgatgaataccataactaacctacttccccatagctagctgtcagagcattcattattataaacagatacttttaaaacatctttttaaattttatatggggatatagttcatttacagtgttgtattaatttcaagtagcaaagtgattcagttatatagatacatatatctatcctttttcaccttctttccccatataggttattatagaatattgaatagagttccctgtgctatacagtaggactttgctaattatctgttttacacatggtagtgtgtctatcaaacagatactttttaaagacatggtataatatgtctttgtgagactctggtttgaattgataacatgtaatttttctgaagaagtccatcggttttacatacaacctgcaaacaaaagcatcctctttcccacctatagtggaagggaaagtcttctatcactccttacaagattaaaaaatctctaaggagacattgtgcatgtaagagagcattttgaaatgaggtgggaacactaagcctgtgctgtcccatgattgcattaaagtggaagaatgaaagattaggctggtattgggtttaagaagaatgctgcttgtggatttgtcattaatgccgtgactctatctgtccaagcctttccatttcaatgtacttagaattctaaaaggaagtcag

SEQ ID NO: 59928 - DNA, 1380 bp, Bovine  19866881971597
ttaccaattatcttagacagaaagatccaaccttaaattgtattcagaagatagagtggcccagtacagccactgctcacaaatacaacggcttcatctggccatatctgcaaccagtgggcttcttgcttcttgcctatgactctgatttctagaactcaaactcaaaactatattaaaattaaaacttacaggcaaaattgtcatagaccttaaattttatgctgagagattttatatgaagcagattggttttcttacaccttagtttgggaatttcattagcaagctgggcatatataaaacaaatcactgagctgtttgacagtataatgactcaccattaaaaaaaaagaaaagaaaaatactgaaatgtttctaaaatgaagagtcaaactacagaaggaagctgatatgcttttacaaaatgggcctgaggacaaaaaccaaagataaatgtgtatgtttaaaattacttgtgggcaaggctcccatcttaaatatttgaagtattcaggcctccaggcacctgttcaagtttgtgctgattctctccaggcagctgcttacttgcctctgcttcaagctggacctgaacatggtccaggatgtagcattgatgagcaagttcagctggtgctaaatgacaggtgttggctcctgattgccttcagtggcatggtgggggatatttcttaacagagggaaagagacgagacatcaaacacttgctcttccaattcaatgttttactgtttgtccaaatcaatgtttaatgtttaatgaaaggcatagactagcaaaagaaataagttagtaccaggcttacagaaaactttttcttaatgaatgcacactggtagcacaacaaagaggtgacatggctcgtaagatctaggatactttacaaagtccattatccacagggcatgctcttatgatcactaaagccttgaatccaggtggatgggttgacccaatggtcaagacaactgcaagatctcactgtgtcagcctctagaccacggtctgtgggccgctaactgagaaggcatggaatgcactttccataagtatatgaagctaacagaggtacttctacaaccagatgggcacagaaatgctcccaagtccatcctagaatccagtgagacttttctgggtgacaatagagcatatcaacgaattatgccctgaatggtaaatccagcctactgcttatttgattaaataagcattgaatcaaaataagcagaaggctggattttatgtttgcattttatattgaaaggaatctagaaggctatttaatgacctgtaaaaaatttatgaatttcaaatgcagtagcgaaaataagttttatggaacacagccacaca

SEQ ID NO: 59929 - DNA, 4583 bp, Bovine  19866880779964
tagcagagagttttaatcagggggtgacatgacccgcattgcattttagaaagattactgtgctacacggaggcaggaggcctggttaggaagacagtataacatcccccagagacaggatggcagcttgaacccagggtaaatgaagggataacctgggggtgttctggagagctgattgttatattttcagcaattttggcagctggttattaaacacagtcacttatacaaattagattataagcatttataattaaatgaactataataaaaacaaagagaataaatacttaggttcgtcacctcctaattattttcctattctcgagcgtcttgaaggtatctgcgtcccttgcatttgcaggtggacataacagggccctacccaccaggtgtgaattcccaactcggagttcagtgatgccacacccctgactcaaaatttgctttattcattgggagtattcccatcaaggactctggaaaatattagaaatcaagttttccatttttgacacactctggctgggttgccatcttttagagttgaagaacctcaaagagctgtgtttatccttgcgggctccacctggaccctttccagtcgcctctcctctggggtacccaacctgttctgctgaccttcctcatagggttcatctcttgtaactgttactcgtctcttcctctcccttcattctgcaagcatcttgattcttctgtagaccagaacttggcccagacatgggactggttctgcgctcatgaaataatggacttgtgaaccagtgagagtggctccccatttccttgtgtctgatccacctttggaatgagcacccgcccctcccacccccagccaatgagcaaaactccaagacagataaccccaccttctttcagcctcagaagcagtctgatggctgaagtgacgttttataaacatgtgtacagcttgatgctgaaatgtctgctgaggaactcctcgaaagggccactttcgaaagcaaaaatctacttctaaaactactggatagttgactgagcagagaaggacatggtcagggtgcttggatgaaaggccttctgcaggacgatttgaaaggaaagccgaaagcccagatcaccttggggaagttttctttgcaactgatctccagcgaaggctatagggcacaaggacatcagatctgttggaaggaaacagcattctgtttctcttgggaaataattacactgagccaccggagcaccgcttcctctcctcccgccgcctgcctgccaagtaagctttcgtcagcacatcaaagattctttgagcccaacgtctaccttgcatgtcacctcagtttactacttgaggtcgaatgctcagaatgtcgatatgggggcttaggaaagagcccttgcccctctgctaagtcatgggacctcagctccaccacatccccttctctggggcttacctatccctcagctagctttggtcatttttctagatcttgactccagagagctaagctccaggactaatgctaccagcttccaggagggtctgggcagatcacaccgaagccattgccccacgtgcacagtgacttcttgccctcaacttgcctaccccaggagctgctgggaggaatccaggcaccacagagttgtaagctgctggtcttggactccctgctgccggtactggtgtctcagtttctctcagaggcaagaaggacctgaccagggctgctcgggtctcactggtgaatccagggtgggatccagaggccttccgcttagaacacaatctgactctggcctgcctttcttaccaactctcactcatccgccctgtggtggcaagtgatctaacaacaggaaatgactgccacccatttttgctataaattctcatcctgggaatgcagacagacctccatgccccccacccatatcccctgcttcttagatttaggacgtgtagaagtgcaccccgggaacccagccaggagagctggagcccagggtcagcagcaggtgtctccgagggtgcacggcagagagtttttggtgacagatggtgctagttttccccgcaaaacttcttgctttggcttctgagtggcactcagaccctggggaacaccagagctcctgaattcaacacctgaccctcttcccttcattctcttctttctacctttctttcctttgtcagcaagtaggctcaagaaagtaagcccacaaatctctgcccttgtgccctggaatccaccatccaagaactgcaatttgctagaacctgctctgtgtagaagtaatttcactacccccgtggagttccacacttgcctgttcttcccaaggcaaaatgccctttaggtgcagctttcagacacagtgccttcagagagcagttttccaggggctttagaaggcagtaggtctcctgaattggtcttggttccacataaatcagaagccactgagaaaacagtgaagccctcagctgatacacagagccaaggccaaacacaccctgaagaactgcccatttctttactccccctttcgatgaaaagaaatactcagaaagggtggtctcaggctgagttccttctgaggctgtattcttggtaacaagttcacagagaagcagagagcaaaatgagtcttgcatttcacattttattcaaactcttgattttacagataaggaaattgaggtcagggaaagtcaaggaagttgctaagtagctggtgagtggcaggagtcgagcccagtgttctgcgccttggccaggattcttgccatcacagttcattcttggccaaagagcaacaatttaattcaattgatcaaacagttatgatcacctgtgtgactaattttggaccagtgtcctgagaagacaccaataaagactgcagaaccttgatccttacatgtattatagtctagtggagcacagactcctgtgtgttaacctcaccttcaatgctgatgacagtgttgctaaatagagaggagcaaagatatctaaaccccaacattttcctttgaaaaataatatttgaacaggacaaacacaccaaactgagagatggttgaagagatggcaggaaatttctggtaaactgtgtctctggaaacatacttggaaataactcaaaatcactagttcaactacaattttgacaattattcttgcatttatttacaaatgaattagaagctttgggtccctttctctttttctgttttcctggaatgggtggtgttttaagctatgaacatgcacacacacacacacacacactcacacacacactcacatacacacattcttacacatatacttacacacatacacatgcccactcacactgtcacacaaattcatactcacacacatatacacacatttactcacacactcatatacatacacattctcatgcacactcactgttacacaagttcacacacacacatatacacacacactcacacaatactcacaccctcacagaaatgcacacacacatatacacgttcacacactctcatgcacattcacacacacacacacacacacacacacacagctgtccttgcaggaagcagtggcagcactcagcgtggagaattctgccctataaactcttctgcagctagattacatgcaggacaagcgttgactgtcaatttgcacctctgacatgagtcaatgagtgctctaattctcagtttatttgttctgcctgcagtaaaatggattgcatgtagggctatcctaccatgatgtggcgctttgacgcctccaatatggggctgatgaactcagagcgcctggcactatcttacaggaatataaaaatttgatttggtccttagccaatttccctcctgctttggaacctgggccgaacatctggggaaaaccgtggacatttgcataatacctgatccatcagagtctgactccgcactttgtgttggcctcagatccagctttcatagcggatcacagtgatgaatcttgctttaatatcttgcatcttttaaatttttatgtattatacagaagtatggctcactgtttgaaagctcagaatgagataactatatttatttctaaactaaaatttcagatttccatacttccccagctgctgtatcttttgcttctttttcagagagatagtctttagagatctcttcctaaagccaaaagttttaagcccattccccacagcgggtccaggggttctctgaatctcctttcatactctttccatgaactgtgtgtttatgaagcatgaacaaagacaagatccatgttttcatcagatgcttgtagagacccatggtcccaaggggttaaaaatctattttagagagattccccatgattttgaaactaggaaggacctgagatgtcatttaatggaaactctaatttcacagatgtggaaactgaggtgcagagagatctccttatttttcacaggccaacgcaaaaagatagtaacgaaatagcatgagagcccaggacaaaaacttgattttcttttagctcatt

SEQ ID NO: 59930 - DNA, 1210 bp, Bovine  19866881255063
cctgcaaagagtggacatttcagaacaagcagtcatcaaagctctcatgcctgcaggctaagtcactttagtcatgtccaactctctgcaattctatggactgtagcctgccaggctccacggtccatgtgattctctaggcaagaatactggagtgggttgctgtgtcctcctctaagggatcttcctgacccaaggatcaaatctgagtcttttatatctcctgcattgacaggcagtttcttaccaccagctccacctgggaagcccgtagctctcctgaaactgtaaaatgcttcctagttttaccacattctcaggtattttgaattgagaaaataattggaaaagactattgttaaatgatagcctaagaggggaggtcattgatcatggctcactgtgacttgctctgtagacattcctggctcccatcagggagagaaagaatgataaatgctcccagctgtggctggacgggcggtaggtccctatgtttcctgatgacactggttatttgcagaatggtttgtctttttttgaaaaaaagtaatttgttgttatttatgtgtgtaacgctagcattctctgaccatgtattccctggaaatctaatttgtaaataattgcttgacagaacggaactggctggaaaattctgaacatgcagaggcataggcaggcccccaagaggggattttagccaaaaggctgggtacctgaatggtcaaatcacaatttcccatctctcagcagttcatggctaacaaagtccccagttaaaaaaacccaaattctcaggctccagatgtagtggatgcaggtaggcaccatcagctgaggtgtggagagcagcagtcctgctgggagagctgataaagagcttctgccccttcacctccccacacagaggatggcacctgggacagcagcatccatccttcctatgtgtacagtgggatgagaagtggggagggtgggaatgagagtggggatggaggagtggggtgccagagcagcagggaaggtggaactacagactgaacgttttcatccccttcaaattcatatatcaaagctctaacccccaagtaggactatatttgggaaaggggcctgtgagtaagtagttaaggttaagtgaggtcataggatggggccctgaacaaatagggttagtgtccttattagaagaggcagagacaccaga

SEQ ID NO: 59931 - DNA, 928 bp, Bovine  19866881828742
gtgtgtgtgaatgtgtgtgtgttggaggaaggaagagagaaacagaaacaggagaaaagtgtgagactacaaagaaatacaactgaattcacgtctacgatcaaaagcaccatggttctaactaacattaacagttaagtgctaactcatctgcacttaagggctgttaaaactctaaccaccatagcaaaaaatttagtataacagctcaactccatataattttattattttcaataaaacaaaatgttaagtgtataactagaagtgattgagtttttatgtttatgtaagacttttcacataattagactcaccaatctataaacttccattttcaacacagcttcaagtttgggtgtaagaagagtaatcaccataatcttaagacatatctatacaattctaggaaacacacagaaaactatgaatgccccagtttaaaaaaaatttcactttcatattcctttgatgatgcctgttactaaactcacatatttcagtaagcatcatacaaaataatattgtaatagcaagtataagaccctctaacacacaagcgtaggtcagagtcagtcatcaactagaccacacacttaccctgaaattccacagtatttttcaggagcgtgttaatggcctctgcctgcaagagtgtgaggcacatgctcttttttccaaaaatcaaaatgacaataattaaaccaggcagctgctgcccccagtaatatgacaacctctccctgctccctggaacttgctggaatccctctgcttgagctcatctcattcgaattcgctgtgctcttcctgtgccccagcaatctgggtgagtttccatctttcagctgaattattcagatgttttcccacaacggcactagcagtgttcgtataactagtttctaaatcaacagtgaattacatt

SEQ ID NO: 59932 - DNA, 1909 bp, Bovine  19866880390323
ttgggtcatttatttttctggaattgagctgtaggagttgattgtatatttttgagattgaatttttttttttttttaaataaagcagaccccctactaaactaataagagtagcatgtccccaacatccattcccccaacaaactgatcacctctgcctcggccacgacctcttctgcctctttctgtgcctcttccagaaggccctccactcttggtgccatctaatccattttcctgacctcgaactgaaatttaaaaacagaacactacaaatggccagagtaaaatgaacaggaaaaatatatataaactgtatgcatacatgattagggggagacaaaaacaaagaagagaaaatgagctagaaggacagaacatgatggttactaggggaatggttcccagtcaaaaaatcttacaaacagctaacaaggtaatttcatgctaaactggtggctgttgctaaaaaaatctgtatgtaagaaatgccaagatctcagaacagatgatcgtaaaaaaaatcaaaaagataatggttaccaggtttagcctcacaaggccctgacatccctcaagtctagacattactaacccacagctggttttgttaaagccccatgcatacactctcgtccacggctggcacctcttccccgtcttggtggcccaccacgtcgccgactatagtctctgtcccggtctcgattttctttgccttcctcgttggattccgtttggccaccatccttttgtcctgagactcccttcttcttcccgaccatctcccaggaatgctaaagaagaaaagaacattcgtgtcaaatcagtataggttgctaccaggaaatgagagataaaactgttgggacaactgttaaccattctctcagtatccatatctaagatacttctataagtttacttctgtttaagctgaggtatagacaggacctcaagacaaattctgcacctatcactgcaaaattgaagccctttctgtggaggaggtgcttatgagcaaacggatgcaggaatcattcccaaaagggtcacccgagatctccattcagttcagtcacttcggtgtccccttagtcaaagggcctagttacttactgggttcgtcctttcaagtgtgtttcccgggctgaaaacactaattccctatgcattcagtaatttccaattttttatagccttatctatgtcaaacaaagctgaaaactcaaagtttctaaaagttaactttgaattcagagtgaatgaatagcatttgactcgagtacagtctcaaattaagcaacctagaatttaggaggaaaacaactacacctgttccctaacccaccccttccacacacaccaatttcctttatttaaaagaagaccaaatagcagtcaggaaagcacagccctggccctgagacatgctatgtcttattttactcactgtgttccccttatgcatctgaaattgctataatacaattcaaccttcctcaaaggagttcaggaacaaatatttatagcaaggaaaataagctaaacagtcgtgcaaaaactcattccttaggaaaattaattttataaacttaaagttcttttttttttgccttgccttgtggcttgcaggttctcagttccctgaccagggactgaacccaggtgctcagcagagtcaaagagcagagccttaaccactggactgccagagaattccttatagatttcaagttttaaatatatacatatactgatttataatttttgcagaaaatacatacaaataagttcaaacgtgtataaataggtttcagttcaaatgccaagactatcatgtttaccatcctggacaccaatattccaaataccaaattacgtaataccaaattacgatggccctgtt

SEQ ID NO: 59933 - DNA, 2271 bp, Bovine  19866880596033
cattctcattaagtggaaaggaaaaggtgaaatcactctaaattccagggcaagagttcctccaatatcctctaccatctccaggaatggtcaacaagctgtaaagtttgtttctcaggcttccctggtcatccagtggttaggaacccatatgtcaatgcaggggacatgagttggatccctggtctggaaagatcccaaatgcatcggagcaattaagccctcgagccacaactactgagccctaacgctgcaactactaaagcctgtgtgcctagagcccgtgctctgcaacaagagaagccaccacagtgagaagcctgcacagctcaatgaaaaacagcccctctccacaactagagaaagcctgagaacagtaacaaagacccagagcagccaaaaattcatgaaaaaaataaattattttttaaaaagatttctttctctgctacttcaacaaaaacaagttcacatgataaaaaggtattgtgggaaaaaaaaaaaggtactgtgaaatgtaaagctaatattggtgggactgttctgaaatcagaatccaggaagggctgtggctttgttcaacagcaataaatctattagtaactaaggctatttagcagcaactctttactcaagactaaccaagtcttgaaagtagtcattagcctagaatcaacaattatgccaggccaactaaaagaaactgattttatctgttctatttattgcccaaaattttaagtgtttgcaacctccagcaaatataaagatacttccttgctttatttggagaataagagagtatgctttaagttgaccccacttgctatttttggaatttactagcctctcaaccagggacccactttctagaacactttattagcactctaccgtatctgggtttccttccagcagtacattgatggctctgttgacatctccattgcagtcatgcaaagcaatgacacattcatcctggttcttgcctgtgatatcaatcagctgaaagagaaagatcaacaaccattatgaacaagcttgcactccccacaaaaggaaaacagatgaaggaaagggagaagacacagctgagtttgaaagaattaggtttaaaaaagcaaaacatgcagaattttgacattctagctccaaaagcaaaatactaacacctgtgattaaggatggggcaaaagtatttataaaacaatcgaacaataaagtatctaatagagaatcaaatgcagaaacacacaggcttcagtataccatgactctccatatttcctagataccacaaatgctcaatgttactgtacaacagtactaataaagtcattcaaaaaagagtttaaaattaagataaaatctctttgaacacggtatctgtccaaaggggcacagtaaatcacacaataaaagcactcatgtattggcttaacctattatatttcaggttaaaattcttataatacctaaagtggaaagtatcccggtaggcatcaatcctattaactgcgctttaatctttatgttttttcccacaaattaagacaaatcaaaaatacactcacttgtttcaccttttcctcaaagtcagcatcattatggtccgaaatcatctgtgcaagtcgaatttgttctgcagtggcctaaaaagcaagatcaagagacaacagtttagagaaatgagagggaccaacacagtccactgggcttcccaggtggctcagcggcaaagaatccacctgccaagtaggagactcgggttcaattcctgggttgggaagatcccctggaaaaggaaatggcaacccactccagtattcttgcctgggaaatcccatggacagaggagcctggtgggctacagtccatggggttgcaaacgagtctgacacaacttagcaactgaacaacaacaatcaatatgcaccatctcccaccccaatttccttctccctgttacacatgaccaagtaataaaacatttccaccacttcacttcagttgctcagtcctgtccgactctttgtgacctcatggactatatagccattaggctctttccaccacataagatgcttaaatgaacaaaacaacaacatagagttaagctgtcactatttcacactactttctccaaaaaagcacggagcttttatgtccacagttaaagagactcattttgggatcaaacaccactttgaaacatctgtgccttaattcaatttcatgtatttgcaaagtcatgtgaaaaccctgttcctg

SEQ ID NO: 59934 - DNA, 1941 bp, Bovine  19866880661501
tcatgaagcactccaccacaactcctaatactttacctggaacttttaattatttatggtgtgtatgtgggagcaacacagtactaatctgtgcataatttggatacctcactttaattactgggctgtgttgtatcctttcccactctgttacagacttacaaagaatgggaagaaccactttcctttcattccattctattctctgagaaacttatgaaaaggttgggagtaaggggccaggaaaacgtgcagtaaacaacatgacatcacaacagtttaccacactccaccttcctgtaacatttttccttttttttccaagagggctcagtttaaacttcaagaactcactcactttctagtaggatgggtttcctgatacctctcctaagaggactgttcttgttcagtcttttcccgccctttggccatatggcttgtgggatcctagttcccctaccagggattgaacccaggcccatggcaatgaaagtgccaagtcctaaccactggacagccagggaattcccatgttcagtgtttttctatcactgcaactccacctcctcgatgtccatctctctttccagttctatccagagccaggcacctacctgggttttggagtacacagaacccgagatatctggcacgcctgtattactggaggtgactgacacacctgggggaggaggaaacagacaggaggattagctctgctaactgcctggccccatccctgggaaatgatgatgcgtgtggcttttctagctagagcactgcaagggaattttggtctgtttttccaacttcatgtcagtcctgaggaataagagctcacgatacaaaaaggttctctaaggggttctcttgccctttcccgatgtatactgtttatgtgagagtgaggggtgttgtttttgggagcaccagggaatatagccaaacttcactagcctatggctttcaaaactctctgtgccaaagcccaacaggattgtattaaacttttcatgtccttttcaaatcagtcagcccaaactccactcagttctgcaatcttgctgctgagtgggctcaaaattcatgggctccacagcataaggaaagtgctaacggagcagttcagttcaacccccaagagcactttcattctcagagcctcagtttacttggtccagcttccctattgtcttggtactactaggctacatacttacgatttacaaagcaaatttccatttactcaatttaagcctaagtgtggagaggagagagggtagacagggttaggctcttatagcctaggtggaacacaaaatccaactgttcattctagtttacaatttcagcttttctatgaggtaaaagctctaatccatactccagcaacttatgtgtttcctattgaaaaactccctaccaccatgatgattttatggaaaccacaacagtacaattccccattttaatctgtactccttaaactgaaatacacatactgtacctcccagggtatggggcagtaagaataggaaaaaaaagccatcaggtaaaataacccagcatcttactagtgaaaactgtatacaaatactgaagaaaaagtaactgaaattttactaggaatttaaagcttgttttctaaagatctgttacatctcagaaggtgagataaaacgagacttcaaaaaaacattgcatttcaggctgggtctttggattttcctctgctgttaggagaactttgatgagttttttagaactaaactgacggagtcacacaacacacacacacacacacacacacactgatggagtcacaaaagaggaatcctccatttacccacagttcaatagcgatctccattcaaactccaaaatccaaatcctccctagaccaaggcagccttcaaaagctaagcccaccttggacag

SEQ ID NO: 59935 - DNA, 1855 bp, Bovine  19866880732481
tggggtaccgccgagtctgtgtggatctctgttcatatagagggccctgagcattattttgggaggtataggttgtcgactgaattgggccactctgataaccggactcctgactctggttagatgaaattgtggatgaagattcactgtggggaatggagaaggaaaatctcaagagaaacgaatagaacagatccactgatactaaaacagtggagtaagttactctagtaacttactagagttgattacaatcaacttataatcaaattgattataatcaaaaagacaaacttcaagaacaaataaaagatactgcaacaattttctcctgacaacagtaggaatttccacatcctataaagccaggtatctaagctaagaatcgagcttaaaaacattttcaactcttaaaggaagagagaattttcttgtgtccctacattctgctgttattagaaaaagaggctaaaagtcagtagaaaggatacactattcttggtccctttcatataatcgtaacaagaaccctaagcacaggaaaaatcaccttttgctcactttaaggaattctgagttcctggctctctcaaaaaacccaagagtaaaattctcttgagaagaactttaaaaatactcacatgcattaacaacaattatgattcaatagagctaggctggggcaagacatctctacttttaaattctaaggacttaaaaaaaaaaaaaaactaaacccacctattactcccgaattccaggattttctattgcctaagatagacttccctgatatctattcataggaaataggaaaggttctacaggaaaggtttcttttaattctgtagtactaattttacctccttcctaggagttcaaagttacaaccttcataggctttaaatccacagaaaaggtctcaaagtgtcaaaagcactgccaatgtactttaaagggggggtacacatctctaggaactgtgcctggacattctgtaagtacccaaaggatatattctatctgtttggttatggaaaaacctagtaacaaaagtgctcaacaaactgctacaagtggctgcttttccttcaatcagagccttggctgtccagagttctaggaatcaacaagagacttacaaaaagttggaaaagtctaaaagaagtctatgacagctgtttcctctacctggccgtgctggtatagaggctacttggagcctggcttgaagaggcgctcgtggtgggggtggactcataatcagaaaggacaggctctgacccaaactgcaatgccccaaactgcaggtttagccctgagatatctgctgagccaggcatctccacagccagagcaggaatctgtagagaagataaagaaatggtttactataaccttattgtaagactgatagcaaacttccacatcagacttctaaactacatccttacaatctcaattctcaaatcccacacctctttgccctaaaataatatctttcgaaaagttcaaataccttagaagtcaaggaggcttttttcttctgctgtttcagtttttgctgagccggctgagggctggaggattggttgtctgaagacccaggagacatttgtggagccgaggtggatttgcttggcagaggagaagatgggggtggaggtgcggctgtggaggtagccacagcaggtggcttctcctgaaggaacacctccatcatggttgaagatggggtgaaagcctggcgctttgtaaaggggctgtgcactgttgaatcatttggggtcttcaaatctgcatgaggagatccaatatgtatgaggccagaggtcctcattgacctcaagaaaat

SEQ ID NO: 59936 - DNA, 1920 bp, Bovine  19866880866493
aaaaataaagatatccctcttactaaggaaatttttccagtatataatatatacttggatatacttggatatataaagtatatactagtatatactttattataccacaggtgacttttggaattttttaaaaactgggggaaaaattgcctaaatccttctgttctaaagccacttgaggatgccagcattctatttgtggtcttagatattgatcatgacaggtattcagtattaaaatcatgggtaaaagttaggaatttgggggccagttatggagctgctgtattaaaactaacatttgacatttcattaagttaaaaaatttcactaaaattaaaattgtaaacaacattaaggatgtcagctccattggaatacatctggatactattgtgactcttatacatctgttgtttttgatgagttcagcattttagggctttgtgtttctggggagtgacttccttttgatctatccttaatctaagtcgggtattggagataagaatgttctgtcattattcatcaaactttctctctccactagaattgaccttgctgttctgttgggaaagacaccatcttccatggagaatgattcatctaatctggatccctctcaggctccttctcttgcccagcctctggtgttcagtaactcgaagcagagtgccatatcacagcctgcttcagggaacacgttttctcatcacagtatggtaagtaggaaacaaggtatatcttaaagttttctgcaaccccagcacatacgtacaaatacagtaattcctttcagtgacacctgaaaggtttggggcaaggtaaaaagcatcttttgtcttcctaagcagacttgagtgtagaaatgttgatttgggtaataggggatagctctaggagaggatttaggtctggacagaccaaatcatcttataaaaatgaataaacattttatttgtggtccgttgctcactgtgtctgactctttgtaaccccatggatcccaccaatctcctctgtccagggaattttctaaataagaatactgaagtgggttgccatttcctactccaggggatcttcctgacccagagatgaaacccatatcgcctgcactggcaggtggattctttaccactgtgccacctgggaagccctgacaccatttactgagtacttatggtgcagaacaatgtattttttttgtagggcggggggaatgtaattttttggggaaaaaattatttggccgtcctgggtcttagttgtggcacgtgggatcttagatctttgttgtggcctgcaggatctttaattgtggcatccagggcctagtttcctgaccagaggttgaacccagtcctctctccctgcccccacattagaaatgtggggtcttagccactgggccaccagggaagtccttattttctattattcttgaagagagaaaatcaatgacaattttaacgctaatactaattagtaatagtaattaaatgttgagaggtagtagcacttccctgttttttgatagagcacaattaccatatgtatgtatttaaatcgtacatttctgagctaggcttctaaaaacttgaggtcttcctgaatctgcccatataataactgtttctccctttctccgtaagtggggataagggtgcttgctgtgcctatcttacagggcttcaggaagatagataagattatgagtaaaagtgatacaaatgtggtggctgtggtggtattaagttgttaacctggagcacttaacaacaaatgacttgttgattcagaattattttttaaaaattcaaggtcatcaattacgggaaaggctaaataaacaaagacgatacaaggactaacttatgggtcagtaaatcctaaaagtactgctttttctttctttta

SEQ ID NO: 59937 - DNA, 1509 bp, Bovine  19866881256221
ggtgaaaaggagctttggtttagggttagagttgctgctctggtgtaatggcagagaccaggagcttgggaatcccagtgggaaaaggaatagtgcagtagaggatgaaacttcaggccactagaactcaccatcagcaactgcttgttggccagtgccaactcctgtaccatggtgtcctgcatccttaggatagcatatgggtttctcctctggcttaatgttatctgccacagacagtgagtgtgtgaatttcgccacctgtcccaggcacaaaggtaggggttgaataggttagagttaagaggagagacagaaccttgtcaaaggaggctcttcatcagaacttctgtaccattgtcagagaagactgcaaactccttgaaaaggtgactagtactggcttagcttctccaggaaagaacgctggagtgggttgccattcccttctccaggggatcttcccaacccagggatccaacctgggtctcctgtattgtaggcggattctttaccgtctgagccaccagggaaaccttgatatagaacctagcgtatatcaataggaagtctgtcattcaatcaccataataaccatgtgtcataggtatcagtttttgcattatacaaataaggaaacgtagttcaggtgagttgcccaaggtcacctgatggcagacctgggtatcaaatccaatctaaagactgattccttccatcataccagtgatactctgtcttggctagacactctggaatcatttgttaaggttttctaatacacaacaggattatacacatgtgatacacacccatatcctctgttcagataatcttgttgacatttctttaaaaaaatcaagtattttttacagatgactgaaaaatacatacaggaatatatattaaatgaaagctggaagcatcattcttctgccccagttcatctcaacaaagttatcagtttcttgtgcatctttatagaaaaatttttatcatgtatcagcaagtataacttttatttttaacatgaaattttacatttacataagcagtattacgtaacaatttggacttttcacatcagcacttagagatttgcttcattctgtttaaaggctgccaagtacttttataacataatttcaccagctacatgttatttctagcttttttacttgtataaacaatattttgtcacgaatactcatatgtgtgcattctattgcttttgtaggtatgtgtataaggtattcctagaagtcgagttgccagttcaaaggatctatgaatttaaaattttgatagattttacaaaaaaggctgcatcaatcttgactcccatgaaaactatatgcattctttttatgtcacatccttgctacctctgggtataacctatgaaaccttaaaaaacaggcttatcctatctaatcttaggccattttagtcagaatcttcttctgggttaaggctttaaaaaaaaatcttttgccacatcatgcagca

SEQ ID NO: 59938 - DNA, 1275 bp, Bovine  19866881313092
ttggtgtcctgtcttctgtacacagttgaatgggagccatttggtttgagacatctaagagttgattggtggaaatggtatacagaatgctgcggaaattggtggaggccatgagtgctgcctagaacaacttaccctggtgctccacttaaaccaggatgttactgggaacattaacacaacttctctaacatgcaaggatctgccttccactttcattgtatactgtcatgaataaaaaaaggaatgttttaacatctgatataatcccatcactccttatttgtgggatagtgtgaagaaatagaccaatatcttgatctgactttataaaccatttaatgaacaattaaaaaataaagcatatgattcattcctctatagttgtcttttaataaaacagacatgtgagggcttctctggtggtccagtggctaagacttcatgctcccaatgcagtgagtattggttccacccctagttggggaactagagtttgatcaaaagttttagcaaagatcccacattctgcaaactaagacccgatgcagcctggttttaaaaaaatgtttctttttatttgtatttggctgcaccaggtcttagttgcagaatgtgggatctttgatcaaactcttgagttgtggtatacaaactcttagttgggtcatgtgggatctcaaaagaagaaatcctaaagttgcaactggggtccttgttcataaaagtgcctgtgtcactaatagaaggctggagaaccaggattcccttcaggtctctggggcaacaggccaggcgaccaatcaactcttgtaggcctaggctcattgttggaggtgtaaatgttgctatgactactgaatccttggtgactaaacagaaatgagagcttgttcagtctcctaagactacatcaaggaagtctgtagacatgtccatggaaaagatgggaaaagtagaagaggtacgcagagttggagaaggctgctttggatgagtttcccctggataaggtttccagatgaatttatcagaaattgacagttcttgagagaggcccttggtgtaactgaagggtagcagcaggggtgggagactggcacgtagtaggtattccaatatttgttgcatactaacccctgcataataggactttctccacacctgccctaggaagttggctactcccctctctccgaaaagaaaggtctttgtctcccactatgttagggcactgagggtgaggtactagagatcaaggcagataacagaact

SEQ ID NO: 59939 - DNA, 943 bp, Bovine  19866881405579
tggctgaaactgatgaagaagaaagtgtgttgtctctctgaggatggtaacatagagggtgagctcaggcgtctgtcaggctcaagagcctagggtctgagtctgcactgttgtgtatgtgtgtcttgtgtgtgactcttggggcttccatagctggaagatgagctggcagccatgcagaagaagctgaaagggacagaggacgagctggacaagtattctgaagctttgaaggatgcccaggagaagctggagctggcagagaagaaagcagctgatgtgagtatagggaaactggggggtgggtttaacctatgcaaatagatcttcatgttaataactgaattctaaacacacttggacatatacacacttgtggattctcagaacataggcgtagatacccacatgcatttttcccacatgctggtatacccttattggcacatactttcattctttaaaacttgcagaagtctcatttttcttacccccaatccaggaatttaattatctttcccaggacctggacaaagggagggaactccaagtccagagtgctatcatttaccccacctcctcccccatgccacattcttagcttttgtgtccaaggactggcatgtagatatgtgtattaatagggaacctctcatctctcaactgcccagcagagctagctcagatttcacaatgggacaaaggaggtcacactgaccctggccctatatgggtttatttatcatgggcaatgtgggcatctgaccttatgccacagagatgccatagaaagcactgcttatagcacagctgagagaatcttaatatcagaaataagaaggaccaaggagtaaagttgttaccaccagacctcactctgtgacctgactaaattattcagcttctctagggctaagttttcccacttaaaataaataattct

SEQ ID NO: 59940 - DNA, 1224 bp, Bovine  19866880927168
accctcatgatgttctctacccacaattctcagtgactgtagaccccctcagagtgctctatgtacataattttcatagtgaggcttagacttgttatagcatatgtgaggcatatacacacaagcttggtaacgttaaactaggatttgaatatcagctctgctgttgactagcagaaaaaaaaaaagttttcttgacattttattgatgaagaaattaagcctcaatgtgattaagtaactcaagatcacacaggggagtaagcagcagagctggtacctgaatggtagacttatgatcccaagcctgtgtgtataccccttccatctgctgtaaccatcccaggctcagttttcaagttgtaaaataggggtaaaacaacttcctcagaaggtcattgccagggagaccctgtaaagtgtgagcatagtaccaggctccatagtgattcgttcccttcccgtccctgccccagtcatctttccagatcaaaatgaggggaaaaagtgtggtctgcagccctacattcttgggatgctttcctccctggtgaaagtggagtgccttaaaacgtctttgcctctctttccttcaaggattttgatcaaggcatcagtttatagtgatgtgttgagggaagtgactcaatagaaattcagtgcaggagcaaagttacttaataagtgtcagtgaaaattgatagctttacacactgtttattcaacattgcaatgttcatttctgaggaaaggtgaaactgcaataaattctttttttttttgtaattttgataattatatttattaactataggaaagtagtaagtttcaccgtgaaaataaaaacaagattatataaatgatattatttataattaaatattgaattaatgctcattttgtaaaagaaagttgattttgggggtacataagactcattaacaatttagagatagtcctgcctttaccatatgtgaccatagaaggactattacctctactagctttgtattcctaaagtgaaaacatgtaaagtcagaaatgttcttctgttgcagttttctgtttcttaccataaaaggctgacaataaaggtttcactggtgtctggtttttatctatgaaagattatggatgtattaactcatattaagcatcattaaccactgatgcttctggagcaataatttaatttcatatttctatctatataggactctactt

SEQ ID NO: 59941 - DNA, 1614 bp, Bovine  19866881085515
ccattaaaaatagaagttttaaaatttatatgattttccccagtcttacatttcatttcattaacagccaagtcagttcactcctataatggtgacataaaaaagttttatgcaaccaaatatttggcatttcaagcataaggataacatttcagttttccgtttgtgcttctactgtggacattagataacttgtgactcaggcacaaatacaacctcttcctgtaagcccagcatcacccaactctgtcattcaaaagtatctatgtggtccttgaaaacagctgcagacaacagaacctgggtaagccacctcttgtatggacagaacaaactcattgacgaactgggtaccaagcaagaggatggcagggactgatgcagcctctggaagctgtgctgtcgtgggcatgttgagatcagtcctctgtaaggtgtgtgtgtgctagaacaggagaattcttccctctgccattaaagcactgttgctttttcttttcaaaaaaaatgagaatcattgcccacataagttttcatgcagcattacctgcaccggtgtccccttcctgagtagtgaagcaaacatgttttctcagcagttcacatcccaggtgtagctctggttaccagtggcagtggtgggggctgaagacagggcaagtaggaaacatcatctcttatcaaatcactgcccagaaacaaggacctgaagtgctttataattttttaacaagtctccattcctaagataaatgactgaaaatcaactgagtttcatgaaaagcactgtttctagccactgctcttcagtttgccctacacgagatgctggataaaccagtgagtttgctttctactcacagagaagttctaaaccttggatatactgcagtgatgaaataagaagcctcttctgatttacaaactggtttaaatctaatgttgtacaatgttgtcttatgcaaacatctgcagagtaaattaccttgcatccatgctactgccacgctatgtgacacagataagaaaggtttgatctcagtttccccattcaggctcatgcattttttcaggtctcatcaatttatcctaatatgcctccaaaggacatcaataattgcttcctttaaaaattataatcataaatagacatgtttcagcttttgtaaacacttgctcaggcatagaggtgcatttaatataaatggtcaaatattcgtaaggaacagtctgtaaactgattttttaataaattaggcactttaaacacgcaacagagagtatgaattatttatagaaagcctatgactaattcttttgcaaacttcccttttgcaatctgaacatccaaaacctgatgtatcagttttgtaacttccagacatcatcagttcagttcagttcagttcagtcgctcagccatcacacgtcaagcataagattgcctaccacggcacctggcacacagtggcattcaataaatgttatgttttaaggcattttaaggagatccataaactaatctatatatcatagtgcatccagacacagttcataaaatccaagaacaagtttagattcgaaacaattcaggcatattagttcccttcagat

SEQ ID NO: 59942 - DNA, 2272 bp, Bovine  19866880463634
tgacttcactttcatttttcactttcatgcactggagaaggaaatggcaacccactccagtgatcttgcctggagaatcccagggacagcagagcctgttgggctaccgtctatggggtcgcagagtcggacacgactgaagtgacttagcagcagcagcagcagcagtatctgagaaacacgatggtttcattaagcacctcctgttcgaaagagcatttttggcaatatactctaccttcatgaatttccaactttgaaacctggaggattatgttctgaaacatgctctttagtgacataaaaacaatcagttatatgtgcttatcctgcctcaagatgatgacctttccaggggtatttgaaacatggctagttctttactaaggctaggcattttgaaattggcaaggacactaaagtgttttgttccccccgccccatcactgcccatgaacaataaagttggcacaacattttattctcaagaaaatgatacaacaatgtttccttagtcccaatttcgctattgccttaataacattgctaaaatcatttcctagttgttttagaaatatagaagagtaaatcctcttctcaaataatgaaattctgaattatttagaaaatctgtctgctgttgagtgctttattttttttccacgaaaaataactgatttgaacctcagtttatacattttaaaaatgagcatgtgcactctctaccccaaatattctttgacatgttaatagtcacattttggaacctataaggattccacagagaaggtcaaaagatacatctcttcatatttatatctgctaagaggagagttctgtttataagatctcatcatggaaactcggagtaaatccagcttcaaacagaagataaggtttgcttcactacaggaattcagaagctgctacttccacatttacacaaaacaagcctcagacaagtcagaactgcaatccaagcagtgacctctatctgagcccccataaaccagataattcacctctgccccaagcaagctactgactggagatacgtgatgctgactgcatgcagatcttctcagcaatctactcgcagatatgactcttctctctggaaagaaaaatgctcagtggaaatagaaacaaacccaatttggatttcctgaaaggtcagtttgctttagagaactatctgctcacatggcagtttttaaacactggtgctcacatcaaggtttcctgggtagagattgaaagttaatattcaaatctaggtccataggtgttatggtagacttcttaatttttttttaaccttctaatgagttgaaaacatatttactgtgtcaaaatatttctagtcaatagatactattttaattgtatgatgtactagcagagatatacttccaagcattagttgtataagtcagtaatggaattataaacaagatgatgttttatgaatctgtataaaacgtaggcatatggcttctttacatatgcacaccccagccacaaagaaatagttgtatttcagcattgtaccaattcttctctttcataaaaatgttttcatgtttactcaacagtctaatttaccagaatctttgtgcttcctttgcttataaatttagtgatagttggctttttaaagtaaaatggctataaaataatgttgatttataattcatagacagaactgaatgccacacaaattgaatgtaaagggaggattcactagactaaatcttctgcggggagtagccatgtcttcataacacttatgaaatgtcttcccctctgttcttctgcctactgggcagagtacaagaaaagaactctgtcctcagtgaatttttcagggataaatggaaggttatggtttattgtgatctgcatctgaaatttgatcagccttgtaagtttggattccatgtaatggtgctagaaatattttgccaatttgaagtcaaaaaaaaatgaatgagcatcaatttacaaagtggacacatcctttgcaaattaagtgggattgttgctaaagccagatgaatgaacctcgcatgcatgtatttatagtagaagccaactggagcttgaagttaaatgtctgacaagcagcttggccaatgtggtcaaaacagacaatcaatccaagatgatcaatgccagagccatttagctgtaagtgaatcataccactcaataatgtgaaaaatacctcactggtaaatctattctacctgaattctatctactgcttcag

SEQ ID NO: 59943 - DNA, 1751 bp, Bovine  19866880467292
aatttaaggctataatgtcttcaatgatagaacagagtacgtgaacacttaacagacatcacctgtatttatttatgaccttgttactaaagcaggtccttgaatgctgtaatgaatagaaattgatgagagggtagatgagaatttcaggcaaggctttactgggactcctgctgtagcacatggtagtgaaaacaagtaacagatttccttgttcattcccagagggttatcagttcccaaaatggggtgtgggtagggctaatccgtggggtgggccagagtgcggtctcaggtggtctgtccacccccttggtggctctgggcacgggtggagtgtgcagtatcctgcttctcctcctgccacctgagaagaggctattgggcttttggtctcttcagtcctcaatattaccaatgcaacattgcataaagtcagttcctttcttcttgtcatctacgctcctcagcctgcttgtcttcatcacaaactgggtaagtaccctgaggtcagagatgaagttttaaatgtttttggtcagaattatccacagagcatagggtctaaatgtatctgtcaatttactgattaattgaaacttggcttccagaagctgtgatactactactactaataatgatactgctgctgctgctgctaagtcgcttcagtcgtgttcgactctgtgcaaccccagtaatgatactgagatgaatataaaaacatggagtgagtgattgcatacctagagaaaatagatgccagcgaagcacacacccaaccatccccagacaagtctcgttttcattggaaaggaaaattcttcctaataattttactttttggttgttttcaagggtacatttaaaggaagagtgtcagtctaacccagtatttctcagtcatggctgcaccatagcgtcctctgggaagacactaacacatactgatgcttgctctaggttgtgggacaattaaagtggattctccacagcagcaactccaggagtgctaagttttagaagctccgcaagtgattctaaggtgcagctagacttgagaaactgcactagctgtacatgtgtgaacagatagattgagtgacagaggaaacaaggttttcttgataattgtgtagaattgaaagtaaccagttctctccccacattcctttaactgaggctatccatattcttaacattgtatttaagaattgtggcaaatattttaatcactacaattaagactattttgtttgacttgttatatgacctctgctcacagaaactaaattagaaaacagtcctatggtagaagtttaaaaactgtttgggaaagtgcaaagcatttttacccttcatttcaaccttctggagagccctagatttggtgaggggagagagtagattaatcaggttataggatcatttattttttatcctttctctggaggatatcagcaagagctcctacgtaggagacttatttttgtaatgtgagcaattgttctttaggaatgaaattctgttccacttacaaaagacgtgagaaagctcagggtgcccccttgaactgtctgacactttgcacaaaaggtaaatctgctaaaaatatttttttaaaaatacttgaaattctctcccaacattttctaaagtgcagaagaatgagaaatcaacttctagaaaaaggaagaaagaacagaaaggctaacaaggcccacaagaaagcaattttctgaataggaaaa

SEQ ID NO: 59944 - DNA, 773 bp, Bovine  19866880714608
taagataagatctcaaattcttaagttctcaagataatagttctaaagagatatttttatccacaccaccaatactgagtagattgcaggaaaaataacttttccttcccatatttgagagtcactgtttttatagatattctgatgttttttgttgttgaatttgtcctaaagagagatatatgctcctgagagtcatggttgccagaaagtaggaggctaggaaaacacatattttttttttttcttttttagccatctcttactagtgcccaagagatataataatgtatattgtataatatgtatacattataacaggaattgagagaagaatttagatttgtttaaaatgcattgagttgcacttggaaagatgtaattgcaaaggtaaaaaacaaacaacaaaaaagcaataaactcttcaaatgccagaaatgagtagtaaaccagagttgtagttgcatagagagaatcagtcactgatttaaaaactgggctcttagtatccacttggaaacctgagcagagaaaatagacagcgtgcatagcagaacgctggaatgaggcttcctgcaaacggctgatgccctatagaagttgccctttctgtgaaacaagaactaaaaatattgaagcactagcagtggaactggctaaaaaagtaagtcacccagcctgagtctctggacattctgaaatggcctatgaagtttcactaagcttcaagcttgttagtgtgaacattacaaatgaaagctgaccatgcagta

SEQ ID NO: 59945 - DNA, 3581 bp, Bovine  19866880769865
aactggtctgggacagacttcaaaaagaaaaaaaatcaggtgacaattccttctgtctggcacataaactttcacactcatcacagagttacagcttatcatgcaaacgaaaggcatccatttatcctgagtagtgtataatttcattactctaaattgttgctaattgtcttagcctgtggcagacaggagacagtttaggattcagtttgtcttaagttgcaagactttggaacaaatcaccacaatgtatgaatgtgaattttctttagcaagagtctttttttaagaataaaaactctttcagaaacacagttttgaccccaaacttaatgatttttatacagtcagtactggaaattgtgttatacataagctgcattatgacattaaaaaattctccagaattattattctccagaactattattttaaaagagacttctagccaacttttttcaattaagaatattgcttccacattgaatggacataattttggcaaaattcaatcaccaattcactcattttttcattcatatttttatatgcaagtcacaatcttattttatttctgctattgactatttttctttacctaatttaatacactgtttatatttgagcctccctttcattgaatctcaagaaactactaaaactataatactgatcgcttttcctaactcaccatgcatgcagtaagaaaagaatttaaaatttatgtagtggtggtagttttgttgctaagtcgggatcaactcttgcaaccccatggacggtagcccaccaggctcttttttccatgggaatctccaggcaagaatactggagtgggttggttgacatttccttctgcaggggatcttcctgatctaggaatcaaactagcgtctcctgctttgtagatggtcttatgcattgtaggcagattatttactgttgagacactgtggatttcctcaaaatttatacatgggggcaagtagctaaaaaagtgctatccttcacaggagtaatgtcatttaaaaaataaaagagtggattttcaaacataaagatggatccagatatctgttgtgctcattctttgtgaaggtgagagtaacagtgtagagggcatccctttattgaatcatcaaaaccagtaataattaaatgactatgtgtacaaacacacaaaaaacaggataaaccctataattatttccccagtcaactataatcaaatgtaaatattattcagttacaaactatcaggcagagagccaagcctgctaacaaatatacattcagactttggcaagcatacttggaatgtagaacccacatagtttaaatggtttattttacataaacagttacagaccagaaaaagtactctcaagggcaggttatgaactgaattgtattcttccaaattcatacactgaagcctcgactcccagtgtaacagtattttggaaatagggcccaccaaagctaagtatgaaatgaggtcataagggtagggtcttaatccaatatgactggtgcccttaaagaagagaaagaaatatcagtgaaatggccacatgaggtcacagtagaaatgtggccatctgcaaaccaaggatagaggcctcagggaaaaccagacctgctaacactttgatcttggacttccagcatccagaacaatgggaaaaataaatttacattgcctcagccacctactaatagcattttgttatggcagatctagcaaaccaatagagggtgtcatctcttctcatatctcttgggcaccttctgtacctttctcagagtatacacatagtttagcagaaagaatttctgaaagatacactcatggacatgcaaagagagaagaagtcttttgttaaatatagagtttatagttgtgttcaaattagtaacttaggaatcaaaagatggagaattgagaacaattaggaaaaattttattcatctaaaaagcagagacattgttttgccaacaaaggtccatctagttaaggctatggtttttccagtagtcatgtatggatgtgagagttggactataaagaaagctgagtgccgaagaattgaagcttttgaactgcagtgttggagaagactcttgagagtcccttggactgcaagaagatccaacctgtccatcctaaaggagattagtcttgggtgttcattggaaggactcatgttgaagctgaagctccaatactttggccacctgatgtgaagagctgactcatttgaaaagaccctgatgctgggaaagattgagggcaggagaaggaggggacaacagaggatgagatggttggatggcatcaccgactcaatggacatgggtttaggtagattccagcagttggtgatggttagggaggcctggtgtgctgtggttcatggggtagcaaagagttggacacgactgagcaactgaactgaactgatttgaggtaagagtctaaaataaatctccaaaagcagttgtgctataattcctaggttgaatgtggattagcagtaaaagaatctgcctacactgcaggagacacacaggagatatgggttcaatcgctgtgtcaagaagataccgtggaaaaggaaatggcagcccagtattcttgcttggaaagcctatggacagaggattctggggggtacagtttatggggtctcaaagagttgggcatgacttagagactaaacaacaacaacaatattacatttgtttcttggttctcagacacgactgagcaacttcacttcttctgaacaacagatatggagtaagctaagactaaccccacttagggagaaggctaagaatagggaatgaaagaacatgcaacacatccttctttgtcaaccaatagtagaacatcattgtaatgtaaccaacctacagcaaaagcaagagcagtgttcttctaatctaatgaagccagaggaataagatggtctccaacagggatcactaggataactctcctctatggtaatttatgggtaccgatattcaatctcactgcaagccactgacaatcagctagtatctgaatattaatatcaacccagctgttaaaacactcagatcctttccctcttattttctctccaatagaggatatttagatgaaagtaaaaggaaagatgctaccacagtgtttcctgggggctagcaattttcaaagtataagtaaatatagataaagctgatggacaggtactgatttattttgaggagcacagtcgtttagaattaaattctttctagatgcatttctgtgttacatatacacctgagatgcctattcattgggaatggagacagacaattttcaaagacttttagaagggaggatgagaataagtcctagaagaaaactctcaaaaagcattgaatgacagatggtcatagtgaaaaaggaaggaatgatcaaaggcaaactgcccactgtgaatttgctttgtttgcctgtgatttcaaataaaacactctcagggttgtaagaaaataaaatggtttttggtaattggaggataccccgaactgctgtgccaca

SEQ ID NO: 59946 - DNA, 1759 bp, Bovine  19866880817339
tgcatagcttaggtcagttccacatctattcttttcagctatttgcactaaaaacatttcactgttctgtataaaattgtctgtgttgtgtttctgcttatatgctataaacaaatgaatcctaaatgatctctcaatggaaacctctaacaatagctaaattagggttatgggtgaataagcctttccatttttgtaactgtactacgtaaaacgtgccacattctaaaaatgttaagttcttgaaatcatcaaagactgactttaaataaagttaccaatttttagattacaaaagtcttgacatcaattatcacaagcttttaattaatgtctcaaggaaagaataaccatcagcatattaattaactgacatttaaatatattagaatatcatcaattttaacatttgttttaattgaagccacctatttccattgtattaatcagcatctgtcataattacgctttactgactttcacttttgtgttttttcaaagtaatatactcatcaatattttcactttcaatagtatatacagccaatttcaattgtatattatatacagccatatttgtatataacatacaatttgtatttacatatacatacatgtacatgtgcatatgcatatataatatacatatatatgtatatgtaaattaagtactttatgcaataaatgcaaagtatcatttacttaataataaagcattggtcatcacaatataaaattacgaaacaggactcagtttaattgcttttgtaaaaaataaatatatatgaaatcatttcttgtttgtaagaaaattacttaatctttttggattctcaatctttatctacataaagagtaaggtggaccatattttctttagtttctctccaaatttcaaactgcatgaagtaaggaataaaaaatcattattgttcgaaaactttgtcaccagaatgaattcctcaggtcaaggtaaataatcaaaatacttaaaaatatgatagttaaacatttttactggtactagtagtatcttaagactgttaaattacaatatgtttattttattagaaattggtgacaataaaatgtgttaaggctatagatattttttcagtaagcatgtgtattttgccaacagaattttaagctaaagaaagagagttgaaaaactatttaaaaaagagttatactctaaataataaaagcttactttgctattggcccatatgcaaaagctgtagtaaagatgattaaaaaggagaaaaaggaaacagtatttgcattcattctggtaatagaatatgaaattaaagcatgaagggattaatgttttaaagcttgacttgcagtgataaagctaaggtattagaacagacaacataaccgttacaggatagacaagcaaagaaaaagcagcaaatgccttaaagatgagcaagtcaacctagaatggaattacaaaatgattaatcaatacaaatgagaaactgtacaaggaaagagagcttggtgagacttcttatgggactcaacactgcggccgcttaaagataatgaaaggagccgggcaaagccaaagaaatgctttcattccgtggcaaagtcatttgtgaacagtttaaattaccctaatcacctcccctccagccgtcagtaggctctgactctttagttatttaaaaaaaggagtttggggaaatgagttttgcgaatctaagctgcaaaataattatacacacaccattttagcatttta

SEQ ID NO: 59947 - DNA, 3651 bp, Bovine  19866880825220
tatctttattattgttaagttcttaagattctcttcatcgatttttgtttgaccttctgttggtggtttctgtactgaccttaaattccatctgctactacaactgtaggtactgagtttctcttacaaacaataataataaattatgtatatacatgtatatatagcacacacatatgtatgattgaataattactaacacatttcaaaaatgctttctgttgttcaaattaaaagtgatatttaaaaagcaagctcacattcctgaagcctgcaggataaggaataaatgatccaaagaataataaccaaagtgtgaactatggatctcatggtatctgatctaatagtttgaaatatatatagattccctttcatgaaagtaaataagtcagttgaaggattgaactggagtgactaatgcagtatagcaatagaactgtgtccttctttcccccccacttaaaaataatgataggttcttctggaacctgcttaagtaagtgacactcgtagagatagattgctatgctgtgacatatggtgtgctggtattgcggttgtattgtagagattattactagcagcaagattttatagttattgcctgtcaaagctggtgttttaatcactatcatcaacaccgccttcaggttttacctcatcttctatccagcaagccaggccagtgtgtcatccaaagagaaactcattggtttgggcctgttatttcattaagatatatatttgagggggacaagtgaaagatgatttttacaaggagggaaaaaatgctctcctggaaagaagaatttaaggactgcaattattgatctgaggaggtgtaataccagttagtttgtgaagaatccataagcctgccttggagatgagggagggctaaggggatgcaggtgtttcctcttgttcctgagagcaattaagagatccaaattatttccactgttacctaataaggcaacaagtgtcacctgatgaggttaattcccagcactattaatgtaaacattgctcagcttcttcagttcactggcattttgtgtatttcgcagcctcagagaggagaggtgaaagatgcaaaccatcggtaactaaaagtcacaagtgaaggagtaaatggaaatgagttagggatcctttggcatttgacctttagttatctgggagcgtccctggtgactcaagcggtaaagaacacacctgccagtgcaggagatgcaggagacgtgggcttgatccctgggtcaggaagatctagagaaggaaatgcaacccactccagtacttttgcctggaaaatcccgtggacagaggagcctggtgtgctatagtccatgggctggcaaagagtcaaacatgactaagcacatcagagcaacagtattttattatagttaaaaaagaaagtgaattcaagtaaccctttatgtgaaccaaatcccaccctgacatcacccccaaggttttcaaagctaactattcctagtgtcaattactcagttttacaaggtagaatacactccgatattttcattttgttttgtttagagggaaactagactatgtcctcaaatccttttcttccttctattgaaatataaatctggtggaaaagctttgacagtgaaaggtacagctgtggggctcttttcccctttgttacaattgacctcttttccggcacattagattcagcctcagacttaaattgcaaggtgttatgaataacgtgtgactcacttcaggctgggctggtagagttcttctttctcagcttctcagcacatagcacctcctaaaaagccaagagagacaaatttctcatttatggagcacagcaggtcagccccttccatatgctcaagatttgtggctttgtgtcacaggcagcccattctcatccttcaagtcctaatagttcaagagcctcaaatccctttgaacccagattaaatggattctggaaaacatgctaccatggtgggcggtgtaatgttctcttgaagtacagtgcatcttgagccttcctagactaccctttgcctatctatctagttggtctatttatcatcgaaaaatggtgtgtgtggatgactatgtatatatgcatatttatgtataattcagcatgcatatttgtatcattttactctcttggcaagcatacttcaagactcggctttctcagccaaaatgagtttcacaatttaaatataatgccacatcactttcttgccaagtacgggggacacattgagatgttttctcctgactgagctcagcctgcaagtattataggacattcccactgcagtgtgatcctaaaggaagaaacacctaatctctggaaccattcttgatgcagtatcaagagacaagaagtcctcttaatctcctttccattgggatcagcatttcaagaaagtatccccaatatcctagcttatctttatgctattttttcttttacataaagagtaaacattttagataaacattttaagctgttcccaatttggtggtaacttaaatggactctttgtttaaggtaacattttaaaaatcattgttaaatatgcttattaaaagcatcttctagcctcagaggtcagtgaacaaatctgttctggatattattgtttctatagaaccagcatcccttcttcacttaggaataaaactaccatatgacccagcaatcccactgctgggcatataccctgagaaaagcagaattcaaaaatacacatgtagcccattgttcactctagtactatttataataaccaggacatggaagccacctagatgttcattgacagatgaatcgataaagaagtagtggcaaatatatacaatggagtataactcagccataaaaaagaacacatttaagtcagttctaatgaagtggatgaacctagagcctgttatacagagtgaagtaattcagaaggagaaaaacaaatatcatatattgacgcatataaatggaatctagaaaaatcatactgatgaacccatttgcagggcaggaatagaggtgcaggcagaatggacagatttgtggacacagtggggtaaggagagggtgtgatgaattgagagagtagcattgaaacatatatatatatatatattaccatgcataaaacaactagtgggaagttgctatataacagagggagctcaacctggtgccttgtgacaacctagaggtatgggatggggggtagggagtgggagggaggtttccaaagggagtggattatatctatacttatagctgtttcacattgttgtacggcagaaagcaacacaacattgtaaagcagttatcctccaattaaaaataaattttaaaaaagaacccatcttccttccatcttcccactagttggagaaactttcctttgattaatattgctgtttatgatgtcatcatagtagggaagacaatttttcattattattgattttgaaaatgttcttggcattccttatatactcattcttccatgtaaaatttagtatacattttataatttgtatttccctatgaagtgttagtcattcagttgtgtctgactctttttgacctccggactgcagcctgccagggtcttctgt

SEQ ID NO: 59948 - DNA, 1399 bp, Bovine  19866880830854
tgggttgaagtgacctatgttttctacatcgtacgtgtagcattctctcaggaggtagaaggtaataggagccgtgtttctccagaaaataagacagaagcagaatggtatctaattaaaatgtttacaacatttcccatgagatataagccactgacattttccagactgcaagccaagaaatgcttaggattatacagatgtactttgcaaactacaattgccatgcaatgaaaacatagcttagacacagttcaggaaatatggatcggataacctttctttagagctcagaaattaaaagttaggtcctatgagaatttatggttaagttgagcagttcatctcttctaaaagtaaatcagaaatccatttcctctgcttcataggtcttcttcctctagaatggtttccaacatctgtatctgagactgccgaaaccagagctgctttgttgtacttccttttcctacaaactgctctcatctctaccagaacacactactctttgctttagttgtcatgctctggtcctccagcattatatatctaatatgtaaatgatgatactgaactcgtgtgtgcttagtcactcaattgtgtctgacaggctcctctgtccatgtggattgcccaggcaagaatagtggagtgagttgccatgccttcctccaggggatcttcccaaaccaaggatcaaacccagatgattctttaccatctgagccaccaaggaagcccaagaatgctggagtggatagcctatcccttctctagggcatcttcccaacccaggaattgaactgggttctcctgcattgcaggaagattcattaccctctgagccaccagggaaactcaaaagttacctccactcgtcttaattgctgtgttccttaattccttatagtattagccatacatatatcaaatgatatatgctttttgatcaaatatcttgttccaaacatctttagagagaaggggatgtatcaacaatcaatgtagacagactgccagttctcataaaacacattttagttcaaggagacgacagataataaacaagagataagctgtcaatagttttttggacactaataaagaatacaatgaagaaaatgaaacaaaagaaaagataatgataacgggagggtcacttgggcatttgcattcagtccctcagaatgcagatcttcacttctttccttcaagtactggtactgccctagagttatttatatatttattttttcacacacatatgttaccaaatctttattttatttcccacagttcattttcattagtctaaaataactgtttttaggagaatagtgtgagagtgtactttatcacttcaagcttaatttcctaaggcaatagatacaggtctttg

SEQ ID NO: 59949 - DNA, 3025 bp, Bovine  19866880841079
gaattattgtgtggttccagctacagatgtttaaggagagaggtgagtttggtgcctggcctttctacatgattctattttattacttctcactgtacgataaaagaccaattttaactcacttaaatccataaaatgggaaattcatctcacctcagctgattcatttccttcaaaggaaacatttttaccataatgctttttgttgttgttgttgggataaaactgaattcttaagggaatcatttaattctacagagaattttgatattgggataaggtctcagactatgcaatcaaaactaacaataacatgattaaaataaaataaccaacatgttgtttgaaattacatactcataggaggattccaggatgtgaatcatcagtgcttcagaattttatctaagaatagattactaggaattaggataaaattgcaccttctaaagtaaattataaagagcgtttagcttgacaggcacatcccccaagtttagcttacaatatatgattttgtgaagaaagtacaacatactccagttgttaccctagaaacaaacattttaaaatagaaattagtttttattcatgttggttttgattgctttaggcaacataattttagttagataaataagaaatatctgaggatatctatgactattctaaagaaaaactgagtggccttttctaagttccttagtcagatcggttgctcagctatgtccaactctttacgaccccatgggctgcaacacgccaggctttcctgaccatcaccaactcctgaagcttgctcaaactcatgtccatcgagttggtgatgccatccaaccatctcatcctctgtcctccccttcttctcctgccttcaatcttccccagcatcaaggtattttccagtgagtcagttctttgcattaggtggcccgaagtttggagtttcagcttcagcatcagtccttccaatgaatattcaggactgatttcctttaggattgactgattggatctccttgcagtccaaggaactctcaacagtcttctccaacaccacagtttaaaagcatcaattctgcactcagctttcttgatagttcaactctcacttccatacatgactactggaaaaaccatatctttgactagatggacctttgttggcaaagtaatgtctctgctttgtaatatgctctctaggttggtcaaagtttttcttccaaggagcctcttttaatttcatggctgcagtcaccatctgcagtgattttggagcccaagaaatagtctctcactgtttccattgttttgctatttaatgccacgaagtaatgggatgggatgccatgatcttagttttctgaatgttgagttttaagccaactgcttcacttttctcttccactttcatcaagaggctctttagttcttctttgctttcttgcataagggcagtgtcatctgtgtatctgagattattgatgtttcttcctgcaatcttgattctagcttgtgtttcatccagcttgtgtgaaataccaacctggcatttcacatgatgtattctgcatttaagttaaataagcagggtgacaatgtacagccttgatttactccttcccctatttggaaccagtctgttgttcagtgtccagttctaactgttgcttcttgaccagcgtacagatttctcaggaggcaggtcaggtggtctggtattcctatctgttgaagaatttccacagtttgtggtgatccacacagtcaaaggctttggcataatcaataaagcagaagtacgttttttggaactctcttgctttttcgatgatccaatggatgttggcaatttgatatctggttcctctgccttttctaaatccaacttgaaatctggaggctcatggttcacatactgttgaagcctggcttggagaattttgagaattactttgctaagatgtaagatgagtacagttgtgcggtagtttgaacattcgttggcattgcctttctttgggattgaaatgaaaactgaccttttccaatcctgtggccactgctgtattttccaaatttgttggcatattgagtatagcactttaacagcatcaacttttaggacttgaaataactcagctggaattccatcacctccactagctttgttagtgatacttccttaagtccttttgactttgcattccaggatatctggctctagatgagtgatcacaccatcgtggttatctgtatcatgaaggtcttttttgtatagttcttctatgtattcttcccactgcttcttaagttcttctgcttctgctaggtctataccatttctgttctttattgtgcccatctttgtatgaaatgttcccttggtatcactaattctcttgaagagattgctagtctttcccattctattgttttcctctatttctttgcattaatcactggagaaggttttcttatctctctgtgttattctttggaactctgcattcagttggttatatcttgcctattctcctttgtctttagcttctcttttctcccctatttgtaaggcctcctcagacaactttatgcagttctttttcttagggatgatcctgatcactgcctcctgtacaatgtcacaaacctctgtcatggttcttcaggcattctgtcagacctaatcccttgaatctgtttgtcactactactgtataatcataaaggatttgatttagatcatacctgatcccaccaaaaaaagacagcccacgctcaagcgcaaagaagaagccccagcaagacggtaggaggggcaaaattgcatttagaatcaaacctcatacccaccagagatgctcagagggctcaaacaaaactttatgcacaccaggagaccccacagagactgaagtagatctctctttgagtgtttgagtgtctcctgcagaggtatgattcagcagtggcctgccacaggggcaggggctcacaaatctaaatatcagtcaatataaat

SEQ ID NO: 59950 - DNA, 776 bp, Bovine  19866881096373
cattcctaccttctaccatttggaacaggtacacgtatcatttttatttcaatatatgattattattgggggttttcctagtggctcagaaggtaaagaaactgcctgcaatgcaagagaatggggttcaatctctggattgggaagatcccctgaagaaggaaatagctacccactccagtgttcttgactggagaattccatggtcagaggagcctggcgggccacagtccatggggtcacaaagaatcagacacaactgagcgactaacacacacacacatgattattattatacctaatgtcatgagtgagagagtaataagagttactcttcttcatccccaaatgatagtgaatgtgcactaaagctaagatggtttccttcttttattattttttgcattattctagttatgttgactgcataatatcaatgtcccagtattatactctttcagatttatttgttaagtgtcagattgatctcttttgttaacttttaagataatctcaccagatggcattaagaatatattaattaaattaggagttataataaagatatacaatattttttatccccaggaaggcttaacatttcattccctttcttgtatttgtgttcaataatcccaaatgtcatgaataattacatgcagttatttaaaaaaatactctgttgagatagaaaatctaccagatgctattataatcactgtttcttgcagtttaaattttaggcaattgtttggagacaagttaaaacaaaatgg

SEQ ID NO: 59951 - DNA, 790 bp, Bovine  19866881392713
tgggaatgatagttttctaagccattctgaaatatcaacatcatcccgtaatactgcatttttataatcaatagtttttcaatttttggtttttgcatttgtttataatctctgtaatttaagagtttttcttatgcctccataaatgcctagctatattttccaccttccaatttcatttgcattcctagttttggccatcactccttagttcagtctttggatgatattatctaggtgcaaattggtcatagcttgggtttctttttgttttctcacaaatttttaaatatatagataaaaagagaaactaacaagattcatagtctttgacttttctttgataatagaacaatatggtactccagactatggcattagggtcctaaagccaaactagcagtcaataaatatcatgaaccacgaccaatgtgaatttgattactcagtggttatggagctgaaactgaaagcctctgaaaagaatcctaagcttgtgacatttacaaagctgtttctaaagacaaaacaggtatgaaaggtcatggcagactaaggctttgggggccaggaggagggggcaattcatccacaggaagattaaaggattcaagttttgagaacaaagtttgtaattttcctgtgtacaagacaagatgttgtttgtgatgcatatatctgccatgcatcttaagtctgaaaataagatgaagtgaatatagaataacttgcctttacttcagttcattctatcaggtactgtttccttcatgcattctatcaatcacat

SEQ ID NO: 59952 - DNA, 802 bp, Bovine  19866881414014
cctaaagcttctaataaatataaaagaccttggaaatatacaaatataatattttgtaaacgtcatatggcttcacaatgtgggaccaatttacacattttacattctttttcttatatgtgttacaaaatactatttttatttttaactttttactcttcttttgttatacattgtttccaccacataagctttttcttttttttaaaggaacaactatccaaacgtcatgggacactgctgctgagtcgcttcagtcgaatccgactctgtgcagccccatagatggcagcccaccaggctcccccgtccccaggattctccaggcaagaacactgggtaagtgtaatttaaaagttataagagccttctctggtggtccagtggttaagactccgagcttccaatgcagtgggtcggggagtgtgggtttgatccctggttgggaaactaggattccatatgctgggtggtgagaccaataagtaaataaataataaaggtaacaagattttcttcttctctgagtaaaacactactactcagaaatttggtcaggaaagaaaggcatcacaagatgtgaaggcattaatttagaagctgaagattaattgtaaagggaaattgttctaagcaagaccacaaaactaaagccctgaaacattctggaactttctgaaaaccagctacacttcctacaaacagaccaaattgtggttctatctcaaatattggagttctttattcttaactctgatttgatagcttacaataaagtcagcaatcgattgtgctagtagca

SEQ ID NO: 59953 - DNA, 692 bp, Bovine  19866881578111
gctcctaaaaatctgatgatgattagcttattatgtctattacctcattttctagtagttatatagaaagagaatctcaacaaaggacattttgaaatcatgttctgtaagccaacacaagtttgactataattgtattgtctttgaataccttctccagtaataaatggattttccattattgcaaacagctcacataatgaaagtgaaagtgaagttgatcagtcctgtccaactctttgtgaccccatggactgtagcctaccaggctcctccgtccatgggattttccaggcaagagtactggagtggggtgtggggtgccattgccttctcccaagagtactggagtgggttgctatttccttcaccaggggatcttcccaacctgggcatcgaacccaggtctcccacattggaggcagatgctttaccgtctgagccaccagggaaatccacttaatagcaacagggtaacaatggtggttctaaagagaaagttaaataatcagtgactcagtgtccccatttaagacataaaacaattaagtttccctgcctccctcctgaggccagtaaattatctatttgctatatttggaattacttataggcaaagactctgatgctgggagggattgggggcaggaggaaaaggggacgacagaggatgagatggctggatggcatca

SEQ ID NO: 59954 - DNA, 825 bp, Bovine  19866881814403
ggctttacgaaagaagacagaatcttctagtaactggtgacagctctgcttttaaattttttttttaaaaaaacctctactgtgtttttaaacagtgctgactcaacccattaacatcccttaagtgcttggtaattttagattatctcaaatgcaaaggaatacatagctttgtgctttcaaaaaccagtattacttgtggaggggcttattttcaggctcatattttcaatggtcataaatgtatcagtgacttgctgtaaaaaatttggaggcaaaagaataattttcaaatgtggaacttcatttcagaacttaagtgtcttcagaaagatttctgaaccctgcctaggaattggatatggccatgtcactttaaggacaattccctgtttttggctttttgccctccattgaaaaggacaaaccctgcattgccttctcattaagcaaaaactaactgcaaagacagcatatttctagagtaaacaaatctcccagaggttgtatttttgataagtatttttgcagtgctagtttgaaggtttaacggtgtgtagtgtttcactttaatagtcagaccagcaagctataacaaatgcactttacaaactttacacaccatgagccctgctttgacaagacatccttggaatcaggaggtaatacggcttctcagtgagccatacttacatttcgagctgaagaggaaattattcttgaaccaccagatctgctggtaattcatggctcagtttatggtggccttttaaattcaccctgtctcacctggttcgcctggatagagctctgagtggagagatt

SEQ ID NO: 59955 - DNA, 1403 bp, Bovine  19866881242623
aatacatctaaaaataggagattcatgatatatggctataagtaatcataaatataatactatacatttacatgcaatgccaatatatctgattagctatagttttttcagatgaaattcactggtggaataagctagtttgaaggagtatacattttataaaattgcacatgtcagacttcactggtgggctgtagttaagaatctgcttttccctgcagggtcgtggattccatttctggtccaggaagatcccacatgccgcagaggaacaaagaccatgcatggcaactattgagccagtgaggcacgaggaacaaacccacgtgcggcaactgagaaccaatgcagccaaataagtacatgagtattttaaaaagtgcacatgctagttattcaaacaatgctactgtatttacatgaatgcttcttatttaaatatgaaacgtaaatactcacagtgttgattagactaaaaacatagataattttctcagatgcaagtgccacttcagaacccatataatgatactgaaaggcaaattttattttttagtcatcagtgaaaatgactaaactaccacatttcaatggatataaaaatggtaaaataatgcagcatgcaaacaaaaagacaaaattataattaagacttaacaagtacttaataagttctagacttaaacctagggacattttatagtaaccaataatacaaaatagggcttcccaacttgctcagtactaaagaatctacctgccaatgcaggagatgtgggtttgatccctgggtcaggaagatcccctgcagagggaaatggcaactcactccagcattcttgcctggaaatcccatggacagaggagcctggaggggctacagtccacggggttgcaaaacagttggatatgacttagtgactgactaaacaatgacaatattaaaatgagatggtgatgattatattcctctttacacatgtagttatttaggatcaaaagttaagattccaagattgcataattaataagggttcctttttattcacatccttggcaacaattgttatttgtggcttatttgattatagccattccggataagtgtgaagcgatatcttttagtagttctgatttgcatttcagagatgttgaacatcttttctgtgcttattaaccatctgtaggtcttccttaaaaactgtctattcggttctcttgcacacttttatttattttctttgtatatacttccttttatttttttttaatttatttattttaattggaggctaattactttacaatattgcacacttttaaattgggttgtttttgatattgagttgtatgaactgtttatatagtttggatattaactctttatcagtcataattgacaa

SEQ ID NO: 59956 - DNA, 1297 bp, Bovine  19866880408464
tggatgtgacagttggactatgaagaaggctgagcaccgaagaattgatgcttttgaagtgtggtgttggagaagactcttgagagtcccttggactgcaaggagatccgaccagtccattctgaaggagatcagccctggggtttctttggaaggaatgatgctaaagctgaaactccagtactttagccacctcatgcgaagagttgactcattggaaaagactctgatgctgggagggattgggggcaagaggagaaggggacgacagaggatgagatggctggatggcatcactgactcgatggacgtgactctgagtgaactccgggagttggtgatggacagggaggcctggcgtgctgcgattcatggggtcgcaaagagtcggacacgactgagtgactgatctgatctgatctgatctgaattccaaagggcagggttaagcaggagggaaggactttcaccaaaattgtaagtagtctcctaccatggtaaaaactcaatttcaagccaatctgaccaataacctccctacagtcagaacagcgccctgcagtgcggggtacatcctagacgggagaagagctaactgaggcctccagagactcagctacactcaaccacagagatactccccaagttcctcccaaggcacagctcctttccgttctttcatttccccacctcaccccctctttaataatgaatgtgtgactcagaggtttaatgagttaccaggagaagttcaccagaagggaaacccgttgagtaaacgcataattaaaattacgaatggacagaggaatacaatcattgcaggagatgaggagtacacaggaatgactcaggggttaggctggttagaaaagggcctctgggacttaaattatttctgatgacgatctggaaatgaaaggaaaattctggaacccttccacactcaaaagagacagaggagccacccgggatcccttccttccctcctcaaatgatctagattggtagccaggagtcacttccagcagaagttgaaaatagcaaaggctgaattcaccaagggagtcattatccctttggtgctaacagcacaaggctctagcatcaattacttccctggtgtaaatatcctgcaggaaattataagttaggagaacatgaaaagctaaggcagcatcacactggattttctctcttgagctcaaacctagaaatattctgtatctgtggacgcctggctggggagagaaaccaggcaagatgaccatgttctgcctttaggagaaggaggctg

SEQ ID NO: 59957 - DNA, 1888 bp, Bovine  19866880446471
accctggctggcttttcaccagctcacattctagcttcctaaccatcccgtaagctccccgagggtgcccatctgtctcacagatatttgtgttcaaacacaagtgcttattgagcctctacaaagaccgaagcttcactgcagtgtcataggaaggagaaaggcagagtccctgcctggggatgccctctctaacagtgaaaacagagtagacgtgaagacaggggaccacagactcccagagtaaagattcctaatgccatgggggagggtcacactggaggcagaggaggaaagtccagaaagaatgtgcaaggggtcaagcatgaggagttccaccagagccggggaggaggagtaagagggatggagaagacaggaaccgctgggctgggaatgctgagctaaggagttagactcgtcctgtaggtcaggggttggcaaatccagcctgctgcctgtttttgtccgtgaagttttactggaattcaggcacgcccattcttctacacactgttcatggctgcttacatgttacaatggtgaagatgagtagctgcaaaaggctgtacgggtggccaagcttaaaagatttacatctggccattttaagaaagttctgcggatccaggccatagtggttgaaaactgtgggtggattttaagcaagagacagcatggtcagattggtgcttcatctttttattactctgggccagcacagggatgggctggagcagacaagccaacaggaagtgaagacagctgggagactgctgtaacgaactgtccaggtgaggagatggctatcacaattgctgttgttgattaggagggttattaagagttgctgtgtgcccgcctcaggttaagccttttacatgtactccctcacttaatctgcacagccactgcaggtatccccatctcacggatggggcacagagaggtgaagcagcttgcccaaagtcacacagctgggaagaagcagagttgggatgcaaaatgccaagctcaaggtctctgggctcaagcctgtttgcttgttgacggatcccttcaagcttagctgagaattcacggaacacaagtcctcggcaggagaaaatcgatctgagtcgagtcaggcaggaagtgggaggcaggcgtgtggctattttggaagagcgacacgaaaaaccacgaaacttcctacctgtcccgttttgctcccatctgtcctcggaaacaaggctgcccctctcttagatgaaaaggtgtttctccccacacagtggctctgccgctggtggtgggagagagcactaagcttagcacacgctggctatttttaaagggctatataaacaaacagggctatgtaaataagaaaaaaaatgaggtcatccttttaaaatctaaaaatgttctttttctatggggtgagcagcaaaacctcagaaagaactcatgcttttttatctgtgagaggccttctccagcccacagcctcccaaagccaccagcctgcccctcccttctctgcacccacccagggaaagcagggggcctgggagctgggactcctgggttttattcctggctgtgtgggctttgcctcgaatgctcaaagtcactgtccagccccagtcaccccctccttggggccttgacatctgtccccattcaggtcactggcaagtatcgcccatgctcacgtgtctgcctcctgcataaactgatttagtgagctgacccagaggacccctctgccacccctcttcatctcccttgctcccttcccgtgtcttgatctgctgactggcctcaaaggtcctcagcatgatgattagaagcgatttgtatgtgccttccacatcctcccctaccatttcttggagcatatttt

SEQ ID NO: 59958 - DNA, 1140 bp, Bovine  19866880502595
cattgtcctctcatatccttttctttgcttcttgctggtttacacgctcaaggtagatgccattatgtgtgggcatctgagtagaagccgcttaaaatagccacccgactatttcagggagcagttgaatatgcatgaagctattttagaaaagatgtgcccagcccagccaatccaaaccccatcctttcccttggaaatgccaagaggagctgaatgggacctttcttagtcttccccactggggtgggggtttttcagaagccacagaaacaacacctgggctaatgttggtctagcagccctgtcagctctgcctcccgatcctgcggtcacagaggctccaggccagacagctcagccctccagagtcctccagagccttggcagccttcaaccacaactgtgctccaatccagttggcctatatttgttcatttattcctttaacacacttttatggatagatgaaatgagacaagttcatttgagggggtagatcgacaggtgagtggggacgacggccttgtggttcctaaatagaggggtgacctgaagaaggagcccttggttcttcctgatggcttgagagagggggggatggatggatatggctcggggtgggatgccctgttgggagggagagtgtgcctgtaagaagatgagaaagaaaggggagccagactgtgggggcatggagtgctaagctaaagcatgccactttctctgagccccaggctgggccaggaaggcgcccttctgagcctacggcactgttacacccctgttgctgccatcaatccagactggaagtcccttagtcagattctcctgggcatctatgcaacccagagccaggctaggcactgagcagatgctcagaattttggttgaaagcgtggattctggaaccagactgcctgggttctgatctgaactctgcttctcactagctctgaccttgggcatgttacccgcctctctttgcctcagttttctcaccttaaaatgaggataataatagtacctatctcttttggtgagaagtacatgaattaatatatgtaaagggcttagaagtctgcggggtgcctggtaagaaacatctaaaactattagctgtttttatcattctaccga

SEQ ID NO: 59959 - DNA, 2809 bp, Bovine  19866880509918
caagtgctcagtaaaatgaaagtcctatccaagggggccagcccgggcctgcggggctggacacagggctctgtgcagagtgttctgggtccaccagacccaaccttcctctggggcctaatcactcagagaagtgaacagaaaaccaagccaagaaggacccaccctacggatcagatagttctgggttgtgtctgggctgtgtgctttctagctagtcaggcagtgtctacatcccctctctgaacctcagttttctcttctgtaaagtgggacaacagcagtggcttcctctaggagttgctccaaggctgtgacattaatttgctcctggtaggtgctttaggagcgggaggggctagaggcacaattgccctgactggaacaccatcccccatcccccacccttgtcctgcacagagtcaaggactaagggtgggagcctccgggttgccctaggcctttaggacctactccccatggagcagagggaacacccagctcactaatgtcctcagggcccagactagtgacagtcaacacacctgcacacagaagcgcccatgcaggtgccacacctgaccgcactcttgctgtcacgtttgtgcatgcatctcaaacgctcacacgcacacatacacccttcctgatgcggccagaatgtccccatatgaaccaagggggaagctcctggccacacccacggggggatgagcccgggagaggcagctgcaagccagctgtggggtctggagtgggcgaggggagctgcttggatacccagctgggagtcgggcaggagggcttctcagctgtctcttggctccaggcccccttcctacctctgggggccagctggcccagctgggcagggttggaggtcacctgcctggaggtggccaaagcctctacctgtttctctctgcccctccccgcggcctttcattcagcaacaatacctgggaccccgcccaccttctgtgccatctcccccctcccttcccactctctgtctctctgtctctctgactccttctgtctctccctgggtccctggatcttgtctctctgggcctgggtctccccgccccagtgctgggctatgtaaatgtggtatttcccgtgtctcatcagcaggactgcctgcttggctcacatttaatttgatccgtggcggcgcctctgcggagccactcatcaaagcgggaagacaattaggtgaatgtcagggtggcctaggccccacggggtgaccagggcctggggctggggccatgaagtgtgaggggcaggggcctggctgccaccctcatctccctcggggcctgtccagacttggcccaacgtctgcgggctggccagccgcctggatggcccctgtgaagaccaagctcctctctgcccaggacctgcagcactgaggaactgaggggcatggctggagctcctggacttggcagaaccccctcctcacccccaaaaggaggcagctgtgtggctacagtcaggtggactcctgggctgggccctcgacaggcctggtagagggtctgagctctgagctagctcagggtcccctgagaagggaatgcattctttccaccagccccgcccggcgcgcccttgctggcgccaagccagcggtcctctcctgagcctcagcttggccttttctcctccctcctctgtgttgcttcctctccttctgtctttctttctctggctgttattgtgtctcttccccctctctacttctttcctcagtctcattcctttattcccaacctctccttttctgtatcttataccacccccacccacccccatcatgtccttggcctcctgggaccctttagcctcagctgctcatctgtaattccccatccctgtccctggctgatccttccccacctgaggctgacctgctaggtaaatctgaactccctgccccagcctgacttcctcctcactgcccccgaccctcagggatccctgaatctctgacacctcccctccctactggcttcttcatgttagctgtcaacacattcaagtctctcctgttttaaaaacgataataataataaaatgccttttaaagagatactctccttgatggccccactgcttcctccacagcccctttctctcctctccctctagggaagcttctgggagagcaatctactcttgcttctgacccccttccaagctggcttcgggaccacccctcaggccctagaaacagtcctcaggaaggtcaccagcaaccttctcatcactcagcccccttgatcacacctcacttggatgcccagacagcatctgaacaactgacttctctcttcttgactctcccttattcacacaatgcctctgggttttgcctccacccctttggcctgccccttcctggaccccacctctgccctggcctcacagttgccctccagagccatcccagctcctcttctccattcaccctctgtacagctccttaagtaatttaacccatgccctgctcccccgacccaggcttcagtcacacttgtgtctacacctttggccttctgctctagcccagctctttcttctgcgcttaggacgcaactattcactgcctcctggcccctccctgcgtgttccatggccctcccaaacccagagcagcccaaaccctgacctttcaagcctgtttctccttttgggttccccagttggatgactggcactttcatctcccagtttcccaaatcagaaacctggagggaaaccagagctcctttcccccaccacttccacacagtgg

SEQ ID NO: 59960 - DNA, 2422 bp, Bovine  19866880592799
ctacaaaaattcacaggactagagcaaagaagcagttcctaatgggcaagcatcaaagtaggtatctccttaagggatcaatgcaaaaggaaagggaaaaaaaaagctatctctaggggcattctagtctttccctgaaaatggtttgactgtatactttacaagctgctgcctgagggtctgacttctaattagcatgattctggaagctggctgttatttcatggagccaggggattcagtggacacttccactgccttctcccaacaagaaaaccaggtcactatcatctctagaagaaacttgttcaagcctggtgccccagcgtttgcaccagaaaaacaggaccctggattccctagctctaataggggcttgtattcatgagtcccacaggaatgtagcaaactaacatgcagtttttggaagcccaatgggcatgccaacactcaccaaagctatcccccaggcctcagcacaaaagaggcagcaaaaatgcccagttcccagtctttaactgtaaggggtttgactgcatcttttacaagttacaacttgagagtccagcttctgattaacacacactttggtgctaattatgatcctctctggagtccaaaagagccagtgggcactttccccaccttctccttcctgctcacttcaacaagaaaagcaagccactgatatctccctataaggagtttgtacacatttctagcaccccgatttttacagcttgcagtgtagggactggctctcaaattacctcgctctgatagccaacaggccttgcattcatgagttccacaggattatagcaaacaaaggcagtctttaaacacaagcacccccaacaataatacactcaaactcactgcagatggaacatgcagaaatgcccatttcccagtttcccagctgctgcctgagaatttggtttctaatcagcttacattgaggtgttaactgttaaccctcttctgtgggtctctaatgggtcttagtacaccctctaccactcagaggagcttctcagtggtaaagaatctgcttgccagtcgaggagatacaagagactcgggtttgattcctgagttgggaagatcccctggaataggaaatggcaacccactccagtattcttgcctggaaaattccatagacagaggagcttggcaggctacagtccatggggttgcaggacgacttcagatgactgaagcgactgagcacacatacaataatttaccaactgaattcgaatctaaagttgcctggtcacgtcttactctgctttaaaataattcccatctctccagagtacaatccagaaaatgttcccggatcatttctaacagggaacacagcacccagagtcgctctattttaaaggcaattggaggagacagtggcaatgcccagagcagaccatccctgtggtttggggtgtggcaactgagcagagcatcccctgagggcagggcccgggtggccggtgctggctgcgcttctgtaaggccatagggttctgggttccagccctggcttccctactaccaccacctaagagggcatagccagagagcttttggtgggagggtcgcaaggcgggtctaactcattgcttgtgcccttggtcctaccagatctcttctctgtcgctgtccttcctaccctcttgtctcctaatctttgtttagctccagatgctgttatggctctggactaaaagctggtgtccaggagggtatgagccagggctttaatttccctggttaccaaggaaaaagtggattaaaaaaaaatagacccaagtgtttaaatggaaaagatacttgacctcacctctcgtggagtcaagtccagagatgagaaagtttgtgcacctatgacacatcctttcccttctgctgtttaactgccccagcctccagagctggcaggaggcacgctgctttcattaatctctgcaagacttctctgggaacccagattaagtagctctgtgaagggaatctacttatcaaaatactgatgaatggtctgggtcaagggtgagagtcagaggcagccagcactgaagcataaaccccttggattagtgtgagttgctctatctttatgcctgttttagctgctaaagcaatttgcaatctggatctgatgctcctttgatagtttttcttatacggagtttttccagggatcagctgccactcagctatgtctgagggtagctgctatcaagacatcttctgggaattcttttccatcctgacagaagccattgctccatcctgtatatctgaactctctccccatgtctcaaagtccttctgagaagagaatcaggtgagctgcgtagtcacccggatatgcttcagtgcctattcatggtgatccagtcccttgtccaga

SEQ ID NO: 59961 - DNA, 1587 bp, Bovine  19866880644406
ctcctgaccccgctctctgacctcatctcacccccctttcctcctcctggactccctccttatccagcctatatcccaagggacctttctgcacccagagtctcgagcacaccgaccctcaaaaatctcccaccccattctgcaaatgcccagcctggggcagacccacagtgctcctcctagaggatcccatctgtccccaggccccagggtccccctcccttgtctctccccacttcttccttccatcaagaaacacactcacctcttgataatgatctttcaagctgctctcttagccctgcacatggctccaactgggccccattccttctccccagcctggtggagctcttcaagcgttacttgtgtgcccatctctgcctcctcagccccctgccctctggacccgcagtccaccaaaactcttctcatccgtcactcctgctacatcccgagagagttgggttcccatcccaggctggggccagagagctgtgccctgctctccccctcttccctgccccctgctcgtctccatggccccacgccctagtgaaggtcccctggctgctccttactcccccagtaggtccttctgccatcctgtcccacagacgacggagctctcttctagccccacatgatcatcccataccactgccccctcttacccggtaccaatgttcccaaactcgccaaggcctgtctccacgcccagggatccaactgcgtcttcagtgtgggtcaactccatccaagtaacttaatcgtgacacagtaacttcatgaaggaagtactattattatccccaatttgcagatgggggcaccaaggcacagagagagttgcccagggtaaacagctgatcagcctctgaaccaaggtctccttcctggagatccctcaagagcctcagattcaccataaacagaacaagctcacgggctctgcactgaatgtcttcttcctggccaagctggcctttggactggacagtgacaagcgtctggaccgtgggcaattttactttctgtgggaagtacttaacccagagctcaacagcagtaagtggccagtacaggccagctgctgttgtcaccatggccctccaaacctcagctgcttctagaagatggggctattgggggaatgtctgagctcagggcctggccacacgggggagactatagccctggccactccgcacaagagcctttttgcagtaagtcaaagcagcatcaatttataatgctgcaagtttggcacaaatgcactatttttcttaagccaaaataaagctccaataagctgtaaaagccctggagttgggaggattctctgtggggtcatttagggtgagttagaacctgcagctgtgaactcctcagccacacatggcaacctgggtgggtacaccccagaatgctaatgaaggcagctgctcagggtcggggagccagctttgctctggcttcaggccccagggagagggaaagccatgtggggtgagacaggacaggacctcagccaccctgggctgcgtgatctgggccaagcccgggccccactccaagctgcagctt

SEQ ID NO: 59962 - DNA, 1530 bp, Bovine  19866880690285
cttgggcctgatttgtcatgatttggcactgagaccacgccttgtctctgagatgattgggaatgtgacgttttctgggactcagtagaagcttttcgaatgagcaggcctctctgccctctgcagcaggaaaacaggatgtctcaggttctgctgttccttcagcttgggtcccaggataggaagataggccccgaagggcctcgggggcccagaggtgccacagtcttcatgtaaagggaacaagaaatgaatgtttatttttgtgtgtcaatatattgggatgtttgtcactgcagtataagctgacggatacactaggagaaaagaatgctttgaaaaattgtaagaataaaagtgaattgagtcttagattttaaaggtctgttacttccagttaaacaccatttctgagagagaattcaggcacataacggacacttacttagcagctatttggattgtccagaaatatttttacataaagttttcaaaaagtcttataatcgataaaccatgaactgtatattttatggaactccagagtttctgggtagattattcagaaataggggggaaaaaacacttcttgcctaataaaaggaatgcttcaattcagagaatgataaaagaatacattttagagatgggatcttaggagcactgcatccaactcagatcatgtgtattttcccatagttaagtttcacaattacttatttttggtaaatagaataaataaagcacattctgtttccaggtgtggaagcatgaagactttgaaacaaactcactcactgcttttctctctatccatccacccaccccgtcagctagacagccagacaaccatcgtgttcttgatataagacaaacatcaaaaaccctctcttagttgtcattgtgggagaagaaatttctgtggagcatataaatctgagttaggacagattcccatatgaggagctttagacattatattgttctttcaggcagagttgttggcttcagaatctaagttaccagaaactggcattctttcagatcatctgaggactccaggggaatggagggagcaattttgatacctgagcttccaacatggacatttcaggatttcatggatccgctgtgtggcacaataagccacattgctcctgatgtcaaaccaccagaaggaccagcaggttactctgcaaataacctgacatccccagactctgcctgcctggttttggagagctcctggaacgtcccaggagttacatggggacacagttacatgcgtcccatgcgtcctgaagccgatgccaagtgttcattgtcagcgatgaatagatcacagaggatgtggttcaaggggagatctacacgtttaggcttcttgcagttgcagtaaaaacaatgataaagggatgagccccttggcatttaaacaacgtcttcagtcagaatgtggacaaaagacaagaggctgcccaatcaggctctgcccacctggttcacaaaagaaaaagctaatggactcca

SEQ ID NO: 59963 - DNA, 2797 bp, Bovine  19866880856295
ttgtatattgttttagaccccttacataagtgatgtcatacatttgttttcctctggcttatttcacttaatgtgataatctctaggtccatccatgttgccgcaagtggcattattttattcttttttaggcttagtcatatgacatatatagttttggcaacatagtgtctcattaaaagcacggattctattagtgtactaaatgccactgaattgtacactttgaaatggctagaatggtgaattttgtgttctgtgtattttcacacacacacacacacacacacacacacacacacagcagttggattctggagccagaacctttgagtttgaatcctggctctgtcaccgactagctgtgtggaccctgggcaaattacctaacctctctgtgcctctgctacttcatctataaaacagcacttgctccatggggttatcatagggattaactgagagctccacgtgagaactctcactagtatgattactgcagatggtctaccccacagggagatgagacttttgttaatttctactgcttgtctgctagactgtgcctcatttaatagatgaagtcaagattgacaactgaggttgtcttcactgtatgacactgactcagacagaacctctttgtgagaaagaatgctttgttttcccaggcacattgctaatataaatgatttcctttgcgtttcctgaatcacagaatctcaagcactggagaagggctcacaaatcacgtcagcccgcataaagaagaagctgacttgcccgaggatgcgttactggtgtggcctggtcttctaattgctggagcaatgctctttctgcccatcaccatagttacagtgcctggaaatgcattttgttttcacatctgtaatgtttaaagtgaaatacacacactcttagacacacacacaacaatcaaggtgcagagagcacttcggctttgcaaggagccgtctgcatttaattgggacacaccatattttctgtttggaagggaggcagtaaggctatacccatgttccagggttcttagttacaagtaacagaaacaagtcctggctaactgcagcagtcaaggatttattggaagggtgtcaggtagcttgagaattgaagggaggctggcaaacaagtctgggaagataaccatgacaagagggcgggccgtggctaccacagtcgaggtcaccctcaaggtcagtgtggtggagatgctgctaggtgcagatgtccctggacttcaatctcaaagccccacgctcagtccagtgctgcctccagtgaattctcatccttgagcttggtgttgtgagtctcctacttttgtgtctttgcatcactctccgtgatttgaagttccagaaggaatagcccatcagctgagctggatgggatgtctgaggttcagcatggttagcaggggtatggggcttagaggaaaagtctctggccttctcagactgaggactgggaggaaggtccctgcctctggccaagatttacaaaggaggagtccacccacccacctcctgcttgcttgctttgaattcttcccagataaggaggtgacagaatgctgaggaatcagaaacaaacaaaggaacaaaaactacagaaaattcatgacattaggagaatccaggaaaggtgcctggcccagatgtctgctcttctcccctttctggagtcagcatcctttactcatcccgctctctccctaactcttattcatcccgattggtccctatgttcgagggaacagatgctccaagaaggattctgaggtcaaataattctcttacagctctgtttactttggtctccatcagagtcaccctgaaactcctgagtgtcttctctgtccaattaaagtccaacagcctattatttttattgtgataaaatccacataacatgaaatgcaccattttagccatttttaaagtatacaattcagtggcatttagtacgctcacagtgttgtgcaactatcaccgctgtctagttctggaacattttcaccaccctcccacccatgaagcagtcactccccatccctgcctccctggagcccctggaaaccattcgtcggcaggcattctttctctttccaaaattgatctattttggaaattgcatataaatgaaatcatatgctatgcaaacatcttcctatttatcttcacctccttctgctacaggttcttcatgacctgtctccccactacctctgaaacctcatctcagcacaggacagggaaccagcactggttactcagcttttccccaacaaagccacagaaggaagaaagaggatgatgtatctgagaaaccatcagaaagatggtgaggctcccctagggagacagaacatagttgggtgtctctgtaaggattaacaaccacacagaactggggagggctaggtaggaggctgggatagatgaggagaaagccttttagctgagttgaattctttctctctctctctgggcagatcactgcccaccccttcatctgttcaagacagagaaagagcaggaccccaggagtgctggctgagagtggagagtcagtggaccagatggggcaggagtgagtcagagcaggttcaagcagtcgtaccatcatctgagtgtcccagtctttcctccaacattgagggaaaacacttgagcaacagcagtgcctgaaactgaagcccacgggaggtttgctgaggcatagcattgccctgtgggggagtgtacagcaaacaggtgatttgagcacg

SEQ ID NO: 59964 - DNA, 1220 bp, Bovine  19866880956849
tctgatcatttcccttctccagtgactctccttgccagtagcttctggccccatgagcttgtcccctgctctcagaccctcctccttgcctttgttcaagtcatccctctgcccagaatgtctttccttctccttctcctccttgttctatgagaccatccccttcctccagaattccctgaccctccaggcacatccagccaccctgagggcctccgtgaccatctctgtgtgatggcacctccccagctgtgcctcattcctcattcattcgcacagatgcctccatggtcttcagaattggcttgaagagagaagtgctaaagtaagagtttctcctggtgggaggtgtgatccactgaagatattctgtgagccaggcctggtgctgtataaactccagtttacttaggcccacctgctgtcctgaaaaaaaaaatcactgtctttttacctatggcaggactgaggtccagagatgctgagggcctggctcgaggtcacgcagcagatgtggcacagggatcctggttgactgatttcacagttccctccaaagtgcatgatcgtgacagaggtaaaaataacagatctctttccaaaacgtaactgttaatgaactacctggggatttgggctgtctggttcctccatgtctcccatgggtgcgtccatctcagccctgacaagcatctggctgatgtacaaggggccacagtccccatccaccttcctgtcgacttggtcaggcttgctctgggatcctccaggttacctaggcccaggctccagaccaaggttagacctaaggtgtctctgcaggactcctgagagagccagggccaccctgtgcccatgtctgcccaagcctgatatccatgttgcagatcaataaatctgtctcttgctcttctctcccgaccatctgttctccctggtggtccccagggagtctgccaggctggctgctatctcccaggttggagggaagaagctattttggggccatctgtttgagaggtgcctccggctggggttccacagctgagggaagctgcccaggcagtggggggctgtcaggaggggacagcaatctgagaatgagaaccacctttatctttaggcttggggccaggccatgccagctctcccttgactcgggcagaccctgtgagatcccaggccctggctgaatcttggacatgtcacgggggcagctg

SEQ ID NO: 59965 - DNA, 475 bp, Bovine  19866880966377
ccgccccaccctccctgttcgcagcccgcacaggcactgtctgtaggatggggccggagctttgggtctagtcttgccagggaggctactcttgaggagccgcctgcagcaggggagcaagacccctctccccaactcagccaagctctgcccggggctagccaggctgctagggccccccaacagattatgtaagggctcatgccgctgcggctcatttgtccgcccccccgcccaagcctggcgtggcgccaggagcccgaaaacccagggctccagaaatcaatctcgcggtgactgattaagccctgtttagaactaattgctctttcgtgtgtggggagaataaattacctgctttaatttcgtgtctttaaaatgcaactgcaggtagagaagactgttaaccctttgctggaagggtctggccaggataagcagaatcggctgggtgtccccaaggtgggcagaggcc

SEQ ID NO: 59966 - DNA, 1248 bp, Bovine  19866881161513
catagttctaatatagccctcaaaatacagtaaatattatccttcttaaaattaagtctggaaagtcaagattaaatcttgttaaatttgttccttgttcaaaaagaaatcagcatgggggaaaactcacatgctattagtccacaaaaatttaagtgacacagtgactgaaatcatttctacaaagagaaatgacctcataatgacctcatagatcaaacgcattgtaatacctaccgtgccaaagaataaaaaaccttaacagcctctagcagtaattatctaagtaaaatgggctgcaaatctgttggagaattgtttttgccatgataatatttcgagtaaattgctgcttctatactaaaagtactggtgtcacagaactggcatactaatagaaagattattaaagaaacactattaaaatgaattaggtattattaaagattcaacactacaacagtgcctgattacaagagatttcaagctctattgcttaatgggcagataaaagtgttaattaagcccactcttagaggatgtccctaggcaggtctacaaaccacaggcagcaagaggtctaaggactaaatgagaaactagtaacaccagcccagttggatacagtcctaccagtaagatggggagagatcaggaagagccaaggttttctgcacagaagaggtaacctggtaaagcacacaaccatccaacttttttgaatctcatgatttttgtttttttaactgctttgtcagcaacacttctaattgctcctttgcttaagtgaagagatccaaataatccaccatagattggcgacccttaataaacagtataagcagggagaggcagagaaagccttgccgtgatcaccaaagccttctcaggcaaccagaagacactgaatagctctcaaggcagcatctcggccaaaagcatctctcaccgcaaacagcctaaagctctcagtggttcttaaaagagttgctagactaaaggcattagccatgagtttcaggatctattttgctttcccaccttgttaattaactaatcaggggtggcaaagcgcctcacaaatatcaagtgtcagggaaatgctaagtaaattcacctacatgttctatcaacgctcaattaggaaaggcggaagagctagaggctcagctgtccccagaatgctgcaagccaagggccagctaacgtgaaggcggagagacccgtgtgccctgcagcagcctccag

SEQ ID NO: 59967 - DNA, 1255 bp, Bovine  19866881171993
aaaccagttcatcagcaccttcctgggaaatttgtctctctctgaactgggcaaaggctgggccttatttacctttgtatttcagtgctgggcactggactcagccttaataaaatatttaaaatactttaaaaatacttaagtgagtatctgctgatgcctaagctatactaaacatgaacatattgattctcatacaggtccccttttgcagaggagaggcccgaggctcatagagatgaagctatttgcttcagatgatacaagaaagggcagaggtaagatctgaaccttgagtttagaccacggcctcgaaaagccccaggagtgctgaccttggtcagaagggcccaggtgggttctgccttccttcccagcaccccagttcctccaggaagtcttcccagttaaccacagccatctccacttgcgccaaagtctcctccctatgtgcaatcactctgcatgaccctgttcacctcagggctgcgtttcttgatacatgcttttatcagctatgagtggtagattattcactgtctgggcagctcctaaatcatttcccttggatgattgtctgttgttcctactttcccttctcctcctccctcccaactccaagacccagacaaggtttgaaatttatgcactctggttgagaagcaaattctatttatagcaaagagaaacctaggtaactccaggtgagttatatctggctaatatttgtcttcctgttagaaagcccagggattgagggggaattaacatcatgggggaagcactggtctcgagaaacatccccaggaggggagaaacaggttttacagtcaagaccaagcaacagtgcagtcagaactccactctctccgacctgaggaagcccagactcagcactgtttatttgtggctgtgataagtaacgcaaagatggtcctaacaaatgccttgtatctaaaccaaacaaccgaacttttaatatgtgtcagggccattcttagtgttttacacaataactcttatcaggcagggatcatgatcatctgcattttacagataaggaaactgaggcacagaatcacaaagttggtaatggcagaactggaacctaagcctaggccatcagtgacctctgccatggagaacttcaaggcagctggggccatgccagccttgtggacaggacttaagattgaatcgctcctaacacttcaggtcaccagacactgttcctagtgagtccctcccatcctgt

SEQ ID NO: 59968 - DNA, 920 bp, Bovine  19866881350040
tttgagaaagctcaggtgatggatagggaagtctagcatgctgaagtccatagggttgcaaagagttagacatgactgagtgaatgaactgaaccaaggggatttgcctagtggtccagtggttaagactttaccttccaatgtagggggtgcaggtttgatccctggtcagggagcaaagatcctgcatgccttgtgacaaaaacaaaaacaaaagcaaaaaaatcccaaacataaaacagaagcattgttgtagcatattcaataaagacttcaaaaatggtccaaaagttaaaaaaaaaattttaaataaacgcatggtgaaaagtgaaagtcactcagttgtgtccgactctttgtgattccatggactatacagtccatggaattccctaggccagaatactgaaatgggtagcctttcctttctccaggggaccttcccaatccagggatcgaacccaggtctcccacattgcaggtggattgtttaccagctgagccacaaatgcatggtaggtatttatgaaaacttaaagagcatcatttcctccttcagggaatcactcatgttgatcttttgttttgttggcatttatttaattcaaccaacatctattggacacctgctttgtaccaagcagagccctgggagtacccaatggtccctctttgtctcccaatttattaacacctatttttattttaactattttttttctaaattgacatgtttaatgatatacctccaatcctatcacctgttctgtcagcaagtaattaatgaaaatgttaaatagtactgggcaagaactgacccttgtggaactacatttgttaaattccctcaagctgacatttacactgacctgttaatcaattttgtgttcacaggatacataaattaagtttcccagttt

SEQ ID NO: 59969 - DNA, 1610 bp, Bovine  19866881462095
cagatccccgttctgaacacagaaggcaggcaccacccccagcctgcgggcgggcacgagcgcttactgcgtgaagagcagacactgcaaaccaaacataattcttaccctccttcgaagattttgatcctcgccggctcccctctcttggaggcgggagcgtcctcctccggcttccctctcttctcctcttctttctccactctagctatctctttctgtccttccggggaaaccagcgaagggaggcgaacctggcccaccgcaggaacaacaaaatcactgctggttaacacgccgtcatggaatgatgcccacgcttcaccatggctcacttcattcattctccctctacccggagacaagatgctacctgccccactttacagaagaagggaaacgaatccccagaggtgaagtcagaaccaggactctgcccaggcctttctctagggaagaccaggccttcccacgagagctgtgtttcttctcttttttcacactagtctaggggcttctggggacaggtcctcatcttggtctcctgggtcatgccaacctcagagaaggtgtgtgagaggaatgctgcatacagaaatgaagacttcacctttgaagattaactggcccaattctcctttatacatcagtaagtcaaagccacacagcaagtcaagggcatttctaggagcataaagcaggtctcctgaaggccctgacccccaccccccgactgctgccagagctggacacagagaggctgtgctgcccactgatgggcatgtgtctgggggggtgggcattttagggaacccattctcttcatgagctataggccttggtgttaagagctgggtggataacctgtcccctagatcctctgatggtggcagggatgggtgcacctttaatagagagcagtgatgctgggctgggggctgaggctggcagtgatattctcatcctgcttcatgccatttcattaaggtcaggaggaactgccctgtttatagccagtaggagcagcaactgtgtcccctggtgctgcgacaatctaaggacagaaatccctgcttcagccaccacacctgctcctacaaggggctgaacagaaaagtagctgattggaaatcaaggaatctgagttcttgcatcacataggccactgcaaactgagccaaccttgggtggattaattcacctctctgaggctcagagtcaagattagaccatcttaaagattcattccaggatcagctttagtgattcagtgactcactgacaatctcttctgaattggagatggggagtggaaaccaagagaaggtatggtgtgccgcttcagcaaaagatcgatgattttatgcaatactcaaaggttttcagagcatgctgttttcacttccatgtcagcctaccatctgggccatccatggaatgaccaagaggcctccctcaggctgatagctgtgatgtcagagccaagctggaggaggctggtgttggtggcagcagacactctaccaggaaacatggttggactcgagcaggggaccagggatacacttttaagttttaaagataataatgtgagtaactgaagatagtga

SEQ ID NO: 59970 - DNA, 1461 bp, Bovine  19866881626550
cagccacagtgacaggtctgaggtcccatgggctctgccaactgggatgcttacagggctgatggtgcactgcactcatcagctgtacatactggtctctgggtctcttcctggactggcctgatccaggacttgttgatttgtaaacatttagaggaacgccccccggtttttcaccttcggtgctttgtgtttgtcaacctaatgactgaaacagctcagaattctcagctgtggggctctcggggctcccagaaggctgcctgcttccaggcctgctctgtggaagtgtcatgcgagctgtgttctgtgtgaccacgtgcgtgctccctgggatgtgggtgtctgtacgcaggtcccgtggtgtctgtctcagggtcctgtgtctgtgtccccagtgtaatcaatgcagccctcttcctacccagtcctgagggataatggcatggaggaaaacctgcctcccagggaggagggtccctagaaacccatgttcccaggaacatggaatgtcactggagcctacaatcctccagcacttgcaagtgcccagctcacaagatcaaagtgggaggtgccaggttcctctggagcactgggagaggagacagtgcccagctcccgaggccactggtgggcatccttcggcactgaccaacagggtctcccaggagaaggggtgtttgaaaactgaacttggggacttgtgttgtcacagcaatagggaggggagtcagggatggcaagcatccttcagtggcaaggacacgtccccaaaggggagaaatatcttgcccagagttcccgtaacttctccattgagaaacactagaccagcgggttttcgaaacactgtctttccacctggggactggcgggtttcctcttctgctacttggttagagcgcccccgtgtgtctctgtgttcgcacatcatcggatcctccaaaggccatgtaacatttcaccccaggattggtggatcaggcacagccttctccccgcagcttcaaggaccatctgtggggtcccaggggtggctgaatgtcagctggtgtgaacaaaggggtctgcctctgccttgagaggcaacagtccccagactggagatctggttccctgaggcagttcccttgttctgagccccgaaagggcagctggaaggagcctttccccagcccagttagttaacagctccagcccctcctagagtgagaggtgaaggccacgtctgggtcctcttctcctctttctgcagtctggccaggggtccccactctaacccacccccaccattccatccaggtcatcacttagtcccacccactctgttcagaatctccctgtcttgccaggtccagcatccctgccccagagtggctctcccactaacctgttccactgggacagtctcctcacctctccagctctgcctcccatcggtaaaaggggtaattacat

SEQ ID NO: 59971 - DNA, 1325 bp, Bovine  19866881838167
gcaaaaatgatctcctcattgtaattgtaattggtggaactcttaaatctatttaaaattctatgagcttctccgcaaatcactccacaaacattcttgtaagaatccctccaatgagaagcagcaaagtccaacctccagagtacattctgctctggctcttttatttaatataatcataagcatagtgagttttgttgtttttaatctagaatcttctcagatattgaaatctttcaaatgagagcacggtgcaaatgactacattctgtctctcttgcttagatttcaaatggtgatgttctcattttgtcttttaccatacgcgcttcagccgtgtgatgcccccgttctcctcatgaaatacgctgacagtcaggggaagtttctaagagtgtattaaatctatatcgagggctgaagagtatgtttgggagggtgcagacatgtgtgattttttagcaactccaacagctgcttggcatctgtagactcaccattcgctattttcagttatttgtgagccactcctaagagcacaccacatggcaactctgtctttcctaaagcacagacgtgaactgtgtagcaaaactacacagcacaagagcaagacactgagtcagagaggagtcttgtcaaagctccccttcccaacacaccaccagggaaacggaaactccctggatgggaaattacttccctgagtgcaagttgaggaggcaaatcattggagggccgtgaataattatgggaacctctcctctctggacagaaacctgattcagaaggaagtcaagagcctatgcaaatttttctgcatttgcaaatttgggaatttgaaaagggtctgaggtgcatccatcaagaatgtcaagagtctactgtatagaatcttgaatgaggaggttttcagaattcttcttctaataaaattgttggttcatttttatcagggctcctctgatttaaagagagcttcagcatctaacactgagcctgcaagtcctgaacagaccaagtttggtaacagaggctcagcagagcatcccatgtatttataacactgtttttctttttttccatctctattttttgtttacaagtttttctttggatcccagtcatgtatagtactcatttttttttaaatgttggccctgacctccaattcaaggacccatggacatccagagagctccaagattcttgagattgacttctgtatgcttttccctggcttcgctacttgaatctaagatacattctcagttcacctctactgaacatctagatgtaaagctccactcttctttttttttcag

SEQ ID NO: 59972 - DNA, 1070 bp, Bovine  19866881900811
tcacccccaacaccaggtacgcacctgacttcttcagggccccaggctccttatctctggcactttctggtcttgggagacaacagctggggccccaaggcccctcccagcattgccctgcctggctcctcctggggccctgagaggaggggagccagacccccagggagtggtgctccctggagtagaaacccccctttcctgctcccgcccctgcacctggctccccagcccctccccaacacctgtgttcagggacctctgaggcctcagttctcaacccctgtgggactaactgcctagccagaggctccacctcgcagcccctccagctggaggtcagtcaggccacacctctttatccatgtcactatgtgccagcccggttctgagtgctggagggtgggaggagaaggaaggatgtcaccaagtagggcatctcctgagtacctgccgggtcagccctggtattgggagtattttatcccattctcagtactttatgatcattctgtcagtgttcatataactcagggactgtgacccctatctcaagatgttctagggaaatagcaacccactccagtattcctgcctggagaatcccacacacagaggagcctggcaggctacagtccatggggttgcagagttggacatgacttgatgactaaaccaccaaccatctcaaggtgaggtgactgagagagattacgtaagttgtcaagatcatacagttttaagtggcagagccaggcactgatttcaggttagactcactctgagtctaaaggacctcacattccaccatgggagagagaacaagtcagagaatttccaaagaatcttaggaaaccagtcctccatttcttctcaaactttccatgatgtaatcaaccctagaagctggtagcatgggaagctgggggcatgttaaaaggtcaaaattctctaagagtcttgcgtttcctttttagaattcaagggaatcttggcttgtattccacgagacttccaaattttctgaatatcaatacaaatgttttagatcaccgtcaagaacacacatt

SEQ ID NO: 59973 - DNA, 928 bp, Bovine  19866880152124
gactgggggcaggaggagaaggggacgacagaggatgagatggctggatggcatcaccaaccttgatggacaagagtttgggtgaactccaggagttggtgatggacagggagccctggcatgctgcgattcatggggtcgcaaagagtcagacacgactgagtgactgaactgaactgaactggaaagcagcactgacactaaagctaacaatggtagcacaaaatgataaaagaaactcacttttaataaagttaaaattctttaataaagttgtagaaaataagatcctctcttttaatgaaaataatgtactatggtctaagatgatttaggaaaagaaaggaaaatgtttcaatattgggagctgatttaaaaaatttatctcaccaactgaataaaggagaaatatttatatgttgatcactggttaagaggcatttgataaaagttatgctttattcataataaactctcaacctagagacaatatcaaatgcaatgtaaatattaaaaccaagacaaaaatgactgttgtcttatctagtgtagaggaacaatgcaacaaggccaaaagaaaagaaggtcataaatactgtagaaaaagagataaattttctattgcctattaataatagggttgtctctctgtaaggtcaacgagagtcaattgagttggttctcataaagagatcaatacctttatgaactaccattatattcagtgcaaagatttaaaagattcattctgaatggaaccaaatatatagaatatttaagaataaacttatcaagtaatgtgctagaggggtttccctggtggctcaacggcaaagaatctgcctgccaggagacgaagattcaatccctaggtcaggaagattccctgggaaaagggaaatggcaacccactcagtattcttgcctg

SEQ ID NO: 59974 - DNA, 1256 bp, Bovine  19866880441537
ggcacatcattgttaatgcagtccttttatctctggaaaatggaactcatattaagctttgaacctcaggggaaaatactattgggggaagggtatggaactcattttgttctttgtgtttatcagaaaactatcttagtttccaagtattgaataatgttgaataatagtatggtaagaacagttatgatccgtgatttttgcaaaacttcgtgaagtggtgttgctaatggttgttctcagtatcttaattttattatattggtacctgttatatatgaccttttttaaaattatacttaattgtaagaaacatatttcattgtttaataataatctaagctttagatgttctaagtgtccataaatgtaccagtgttatgcaccgtaaacagtacagatttaacaactgtatttatagtaaattaccaccttgtaatgttttaattagaaacctctttcaactggaagttttctatatctgcagcttaaggatagttcatgttgataaacagaagtcattgcagatttcataagcatgttttcaattatcaaaggaagtctgtagattatgcagctttttaagaaagtgcattctgtttttacttaattgtttgaaaatggatctaaattgtatgtccattaacatgctaatatcaaaagtatttttcctgaccattgtacaatgacacgagttcctcaaatatcatccaatttacctcttgtgagtaatgtctttaactttcataactagagcaggaatatgtattatttagatttttaaattgctttggcatttaaatatggatttattatagaaagtataaaccatattacatagtctcaagggagtttagaatatattaactgtaaattacatgaattcattactaagaaacaaagacctttattcatctttttcagaatctaatttattaaaatgaaaaaaagaatcactatcctttgtcttccatttagttttggactttcatcatagtaagtagcagtgctagttaaaactgattaatcactattcagtaactgttcttgaaaaccatctgtgtgcaaactgcattgttaggagatgagaataaaaagatggataagccctatcctgaaggtatgagtagcttggctggagggggagatacagataagtattagtgtgacaaaagctgtactatcagtatgaggaaagcactacagaagaccaatcttatattatatataaaaatattttaattgtaacagcatgg

SEQ ID NO: 59975 - DNA, 1672 bp, Bovine  19866880605604
cagaaaaaagatgataaattgtataatgccatttatataaatcatccagcaacagcaaatttatagagacaaacagaagctgggtggttcctggggctggggagggagcagaaatccactgcaaatgggcttgaaggaatttggggagagtcatgatataagtataactcactaaaacttgttaacagtatcatggaactgtacattcacaatgagtctttttatggtgtgcaaataatactttaatgaaattatttttagaaggaagcagaaaaatcatggggtccctcccagtgataatcaaggcaaaactctttagagtaaatttaaagtgacagtggaagacaacattaaagttacttttgcaaatacattccagtagtccagcatttttcacacctaagctacagaggtccgtatggctattgttagataatgtggccatctctgagaatccataacataaaatatattttctttcaataccgtgaaaatatataaaattgattgagccatagtttccttactttgcattataattttacaatcttcagcttaatgagccataaaccactttctacaggatttcaattgtaattaaaaaaaaaaaaagcgatgaaaagaatcacaagtcaaaagacaactgtagaaatccacaggctcagagtcttcatttagggccaacaccagctcattgacttttcttggaagaaaaactgctaggtcaaattcagaccccctgacttcagctaatcacctcaaaaatatgcctttattcccagtggactcagcaaagtaatgtggatgagtcagagcacttgtctgcaagggaggtaaaggaattgcataatttgctatccatatcaacaataaaagtcaaggataaaaaggatagaaaatccaaggcattatgtcacattatttaccaatgacactggtttagcaatggcaaattatatatttattatgtaaatgggagagagcttgctaagaggtaagaaaactagacaggaaactaagattttatttggttttgtatttgagcagccctagcttccctgatagctcaattggtaaagaatctgcctgcaatgcaggagaccctggttcaattcctgggttgggaagattcgctagagaagggataggcttcccactccagtattcttgggcttcccttgtggctcagctggtaaagaatcctcctgcaacgcaggagacctgggttcagttcctgggttggaaagatcccatggagaagggaaaggctactcattccagtattctggcctggagaactccatggactctatagtccacagggtcgcaaagagtcagacaatattctggcctggagaactccatggactctacagtccacagggtcgcaaagagtcagacatgactgagcatctctcactttcactttcaggtaataaacaaggtttgaaagggtagaatcttggttaaatgttgggacagcaaactaggtgtttctgcaacacccctccccctgccaccaactctgtcttcccaatgaaggggcaccgatttccattctcagtatttggaggcactttgtaaactgtagattcataatcactgtacttatcatctgtctttgttaaataaccagagatatttcaccacgatattatttggtttctagcat

SEQ ID NO: 59976 - DNA, 1837 bp, Bovine  19866880686782
tggaacaaaatagaaagcccagagataaatcctgtacctatggacaccttatctttgacagggtaggcaaaaatatacaatggagaaaagacaacctctttaataagtggtgctagggaaactggtcaaccacatgtaaaaaaatgaaactagaaccctttctaacaccatacacaaaagtaaactcagatggattaaatatctaaatgtaagactagaaactataaaactctcagaggaaaacataggcagaacactctctgacataaatcacagcaagatcctctatgacccacctgccagagtaatggaaataaacaagtgggacctaattaaaggtaaaaacttttgcacaatgaaggaaactgtaagcaaggtaaaaaggcagccttcagaatggaagaaaataataacaaatgaaacaactgacaaagaattaatctctaagatatacaaatagctcatgaggctcaataccagaaaaatgaacaaccccatcaacaagtggaccaaagaactaaataggcacaattatttttaaatgaccaaacttcctttaagttgtagcgaatagtagggaataataggtttcattattttttgaaactttcacaaacaaatatctatgtgtcattatttttcaaaactttcacgaacatgtatctatgtgttttggcagggaagagagaaaggttatccataacatgttggatatctaatgaatagcgtgtgtgcacgctaagttgctttactctttgtgaccctatggactttagcctgccaggctcctctgtccatggaattctccaggcaagaatactggagtggattgccatgcccttctccaagggatcttcccatctaactcatgagtgctgatacctaacttcactcatcagttgacgataacaaagattatagtaaaagaagacttgattttgcttaataaaaagtaattgttattatatttagtatatcagatgcataatttttatcttcttattaactattatcctcattgtcatcactttagaaatacaaacctggtcgatgtgatgatattttgaaatggaagcctcccagtcttaattctgtggattttcgcctaaaaataacaagaatgggaggagaagggtaagtatgcgcatttgattccccatcatttttatatgtaataatacttttactattcctaggtacttacccaaaagttatgaaaacagatgtgcatataaaagtttgtattatggaaagcttcactgtttatctgatattttacatataccttcaaaataaagtaaaatacttttccagtatactttatatatgtatactataaatctatctcattttcccagattatttctttgatatattacagctcacattttgtagcatcctttaaaattgaccaattttagtcttaaaaaaagttatttctaatattaacacaatgaacttcattaaaatgtaaaagtgaaaatagattttacttgaaaataatccagtcaagtgaattataaatgtaagatattattattattattcagcattttaaaacaagccatttttcctttgaaggaaactgcttcatgtttgcatttgcatggcaaaaacttatttatactttattggggtagagttttaattgtagaatttcattaaaatttttcataatgtctattaagtgttaatgtcatgtattggttaatcttcatatgtgacttcattggttagttgttgttgttagttgttaagtcatgtctgactcttgcaaccccaggctcctccgtctatggggtttcccaggcaggaatactggagtgggttgccattt

SEQ ID NO: 59977 - DNA, 1534 bp, Bovine  19866880706207
gtttctatattgcatatctatatttgaggggccgcaaactctgctgaggtttttttttttttccatggatgaaggctggtggaaaagttaatgaggaaatgaaaaccactggatatattttacattggtaaaattttagcctcctgttttccctctgagtctccagctctttcctaatcctgttctcatgataatgttaactttacagtataaccacatgaatcctgtttttgagggattggaaggttcagcattttgtaactaaattgctctttaatgtttttataaccatttatccagtaatctatattcttaggttagattgggttaacctcataacatattgcagatcaacttagttttctcccaaatattttctggactaaaagaaacaataaatattatccagagtatatgtaatgtcaaattatagattgcagaatttaagatgacagcatgtataaatatacctctatatgtgtatatgaacaaaattttttcctggatgtataatcacaactaaattaaaaattgagacatgttgccttgatatatttgaacatatgattcagattttaaataaattctatgaatttggggaaatgtccaaattcaagggaactgtgcagatggacatggacaactcaaggccaaaggaagtacccaccttgaatcaaaacaacactgttcttattttccaggagagtagaaatctattccagtcttctatgttctaagaatcttatgaagatgccaggatgggcagaaccacattcaattatagttttctcgtaaacactgactgttgtgtttaacacagttttcactggttgtttattaatcttggaaagaaagttcggagaagatacacaaggttattatgggcttcttaggtgacactatggtaaagaacctgcctgccagtgcaggagacataagagacatgggctccatccctgggttgggaagattccctggaggagggcatggcaacccactgcagtattcttgcctggagaatcccatggacagaggagcctggtgggctacagtccacaggatcacaaagagttggacacagttgagcacgcacatacacatacaaaattatcactgtgtcacaagatgcatattaatatagttatatttcttggataaaacacattataatgctattacaagtaagttaaaactttgggaaatttgtgaggagaaaaggggaagcctcttttagtggttttccagtgcttctcttggtactcctcaaatgatttgaggttagatgaacttctatctcaaacaggcctgcatggataatagggtatgtctatgacataccagtgatcagaggtcaaaagttgttgcctcaagcaatcagtgtgattacctccagttcttaccataaaatatttactaaaaagctcgggactgaacaggggtgcgtcatggaaaatgaagtacatttcattggaacagtttttctaagggcagttgagatgacaaatatattccttgatctaattttcatgggctg

SEQ ID NO: 59978 - DNA, 806 bp, Bovine  19866880721841
tttcttgttaaggagaaattctatttttttaaattactgcctagtattacggactttttattatgctgcatatgaaaaaggggatatgataatgatgaaacattcctgatgcatcagactgaaaaattagacactcacagaccatgtctgaagctaaagttctaattggataaccccttctctccccttgctcttattttgaaagatatataaatttaatttagttagtggcatggtctattggactgagcacaagatggtggttaaaaaaaatattgagaattccaatcttggtctgttgttcgagttttaatctcagttcactgaatgctcttggataagtcataaaaaattggcatttttcaattttcccatctgtaaaatggagatatctctcctaactcataaagacattatttaattttctggataaaatactgtgaaaattaaacaatgaaaatgttcagtccaattaaaatttaaacttaagtccttattcaaactgagagtcttaaaatgtatttttttacaatctaaactgaataatagcacttgttgaaaatcaccagactcatctgcactttcatctttcaaaggcagtggagtagcagcaaagtgaatgacagcttataatttagaatggataccttgaccagctcactagctccagaggtaatcctgggggttctgtaataaaagcccaggcttgtttaacaatccacagcacaattaaatgatcatccaagataaactgagtgtaacagaaccagctagcaatggaaatgataggaaagaactgaagttat

SEQ ID NO: 59979 - DNA, 1687 bp, Bovine  19866880802008
ttcttgtatgaaggaatcagactttgtagcctttctttccagacccagactactcctctggtgttttggttaatagctgaaactcttgatcaagtgaaataatctaaatttgacctactgtcacaaacagcattgaaaggggttgattcttaaatcttacccagggctgggcccattgtgttgttttcttaaaaatgaataatttaaaactggggtacattttagacaatagtgcttttgtcttcccagaaaggatgttgttctaaacaactaaaagaggtgataccagtcacatgagaaatgttttctctaagtactttccctaaatgaggggtttgattttttcctcaggccttagaatctattcatctttcttttctctttccttctcttcagtataaatattaaaaacaaaacaacaaataaaacaaatgtcaaacaatgaaacattttatagacaaaatttttgaaactaataatattataaaagataaaattattaatgttcagataacttaaaaatacaagtcctttccactttaacattatcattgatattattgatatttcctagtctgtatcacataggtatagaggtttggatacagaattgtttttgcatttgtagaattatgtttctgaaaatttttctcattggcaaaacttcttctggcaaaatctcagtctcataggagactctcagggattaggagaaatcaataaattctcctaaacacatatccttaagaataatgttgaataaaagttctagaagatttctagaagttgctgtgctatctattgcagaataacaaattactccaaaacttactggtttaaaacaacaaatatttatcatctcacagttattatctcataggtccctctgtgggtcatggattcaggagcagcttagctgggtggctccagctaaggatcttcagacataagaaggctttattgggtcttggaggtttgcttttaagctcactcacatggcttgtagcagggggcctcagcttctcctcacacaagcctctcaataggactgttttacctcacaaaatggtagttgtgtttcccagatcaaaggatctgacaaagagcaaggagaaagtgagatgtctttgacgtccctatcttggaggtcatataccttcacttctgtctccttttaggttttggaggcaagttactaagtacagcccacacttaataggaatggggattggggtttcacctttccagtgaaggaatattaaagaatttgtggacatcttttaaaaccatcagagtttccaatacaaatgagatttgttgactttaagaacgtaatctggtgggttcttattcaccaataagaaccaataagtatttgtgaacactatcacactctaaggcagatttttcccttgagttataaataaagtaaatgaaactataaataaatgatatatctttagcatttaaaaaaattagccttttatcagtttaaaatttaattaatgtcttttgcatttgctttccttttaatttttttaagctttaataaaatgcttgtgtaactgccaggaatttcaacacattgttcagatgcttaagggtgtatatttggggggtggggactgcctgtgctgcggccatctgccctcacactgaggggagccaagagacctttttacctgtc

SEQ ID NO: 59980 - DNA, 774 bp, Bovine  19866880828744
caatactgatgtatacatgatccccctaatccttactaaattcttaataatcccaaactaatatttttgaatgtattagatgcacaatgcattgggtactgcatcacaaaataagcctgtgttaaagctggtcctctgctgccatctagtgtaatcataaaatgccaaaattaaaccaaaagtgactggaaaaaaagtacttcggtggcgcatctaaataataaatcattaaaataaactagttcaaaatatggtccttaaatcactggagataatgctataaaacatttaataatttatttttaaaaatgtaaatctcttaccacaaatgcattctggaggatataaatagttcattataatgaggatatcttaaattataaaaagattgctacttctatcttaaatatcttggaatttcttgggtcacttgatctgggggaagctggctgccatgtagtaaggatgttcaggcaactatttaaggacacacagaactccagagttagtatgaagattactttaaactgaagacatttgagattcaagagatgctgaaagaagccttcccacaaaagcagaaacttctggaaatgaggtttccataaatcacctctttggagtatattcagttccagcaaggggattgagaatgaaattatcttaaatcccctctctgggggagttttacagccatgaggaagatggaaaagaccaatcacgctagcataacgaagattatcatcagctttcttatctcctgttgctatccta

SEQ ID NO: 59981 - DNA, 2423 bp, Bovine  19866880836830
ttgtcacatatctatccatctagccattcctctcaccatccatcaatccacctaattttttgatgcatattaaagcaggtagagacatcagtcaagttcatccctggacacttcagtatgcataccattttctagagtttaatatttgttcatggttctttatatacaaacatcttaagtattccatttgatgggtgttgataaacatgtatatgaaaatttgaagtttcaaaaaaggtacaacttttaccaaaattatcatatactgttcaaggcttttatagtatatatgaagtggcataatatcaattcaagatagattttgataaattaaggatgtatattgtaatctctagtcatcactttaaaaatattacctaaaggggaattcctgggcagtccagtagttaggacttggtactttcactgtcaagggtacaggtttgatccctggttggggagctaagatcatgcaagctatgcggccaaaaaaacaaaaagctaaaaagccaatagaggggataagctagtacacaaaaataaacaacaataacacacacacatacatacaaaacccaaaccaaaaaacctcaacccaaaagaagaccaaattcaaaacaaatagcaaaacaggagactgaaatctgcctataaagtgtgcatgcatatgtgctaagatgcttcagtcatgtctggctctgtgtgaccctatggactgtagcccaccaggctcctctgtccatggcattctccaggcaagaatactggagtgggttgccatgccctcctccagaggatcttcccaacccagggatcaaacccatgtctcttatgtctcatgcattggaagatgggttctttaccagtactgccacctgggaagccccacctataacataaatacatcaactttgaaggactgaactttccaattaaaagataaagattgtcagcctggataaaaagcagggcccaactatattctgtttataggagatacacttaaatacagagacatacatagatttgtatttttaaccttctttaatttctaacctctttaatttttaagctgtttctctatagcatgcaaacactaagcatcagaaagctagtatttctgtatttccacatatcaggcgaactaaatttaaagacaaagagtattttcaggaaccaagaatgatactgtaacaataaaaggtcaatcaatcaagaaaacataacagatcaaactgtgtgatcacttaccagcagagcatcaaagtatacaaaagcaaaaattgacaagacaaattgatctgccgtcatacttggaggttctaatacttctctttcagtatgtgatagaattaatagacaaaaatatcagtgaggatatacgaaatttgaacagcattcttaccaacttgacctaactgacatatttagatgatccaaaaattgcagagtatacattctttacaagtgcatatcagatattcaccaagatactttttatgctaccgggccatatgtgaaatttaaaaagaaatactatttatgaaagcagcacaacaaaatacttaagaatgaacaaatttaacaaaaaatgtgcaaacatctatactgaaaaatacaagtattatagagagaaattaaaatctaaatagagtagaaattgggaactgctcatgattagaagccttcatattatcaagatgtcaatcattcataaactgatctagagtaaaaaccatccaaatcagaatcatggcagggtcatttaaaaagaaatttacaagctgatttgtaaattttttgtgaaatttcaaaggacagagaaaatgagctttaaagaggataaagtatgagaactttgtcaaacttgtcaaattgtcagaatttcctgatttcaagaattactaaaaagttacagtcatcaagacagattgatgttggtgtaaatagatcaatggaacagaatagaatccagaagtagactgacatttttacagttgattggttttcaaaaaaggtgtcaaaggaatccagtgggaaaaatgacaatcgtgttaataacacatgtgactggaagaactagataatgtatgaaaaaaactgtcattgtatataatcacattcgtagtatgtatgtgtgacaaattacaattttgagccctgtgttatccatgtcctgggaaataaattatgcatctgtactgctatattagctttctcaagccacatgagtattatttattatgaaaaacttgttaaggggctgcaataacattgaagacacaagggcatagtttagaaaatagtttctaattcattaaataatgctttacttcctggatgatatcataaaaatggccttctgtttttacagcaaatttaatccctccctgttattcgtagtagcaggagaaatttccaat

SEQ ID NO: 59982 - DNA, 1344 bp, Bovine  19866880921450
cttccgtgtatatttcttaagggcaagatattcttttatataaccacaatgcaactgtcaaattcgggagacttaaaaacataaaactattatctaatacgcagtttaaatttttaagacttaaaaaccagtgctaaagttacaaaaaattctccaccatgtttctgcacttaatcaggttggcaaaaatttttataacccttcttggcctcttctatggaaacctgacaacttttgaatgcccagtacacttatcccaacttgtagcacacaacacgtatggaacaaatagagaaacactgtacactggactctttactgaccttatagaaagaagttcttcctttgtcttacggagcatctattgcatttgggcacaagtcagtttcttatttctttttctcttatttcttattttctctttcttttttggccccacttgtctagtgcaaaattgtagctaaaataagactcctaagtgtttcatttatttatttacttttgccttcacctctggtttctcttcccagcccttattcaaggaagcagtcttgtctttaaaatggtctcttctcactgagaaattcacccactctttcagtgatcaagctctttcccataggataagattttagatgaacaacatgtactctttagactccctaggacagcatcattgattttctggacgtcttcaaaaagaaatgcatagggataagcattatttataaaggtatctttttcataatcaacaactattcatctcttctattagcaagtttatcatcacaaggagggaaaccggcatctgaaagcagtggcaatcaagagtcctgaaggaagattgctttggggggtacataaattcttacctagttccaatttccttatgaattttcttggtttactgcatataactttataatttgctttctgtttccaccatttatttattcccatcctttctaatttatccaaataaaggtcttaaaactgcaagacataaagatgattcattccaaatattttctctattttttttgcactgacaatagctcctctcatatttcaaaaggactgttttcctgtaaataccttttctttttaaaaaaatggtgagacatggagataaaagaccccaatttggcagagtaattagttggtcaaccgcttttttatcacataaattacttttctgtcaagtgacaacaaatgtaatttgaactgagattaattacataataattatgcttaaataattggttaaatagaggaatttcttgtgaaatggtagattcttgaatttatacaaataagaccagatggtgaacagctagttttaat

SEQ ID NO: 59983 - DNA, 699 bp, Bovine  19866880963305
ttcttgagccctaaaattctttatgttttaataagacttcaaaagttaaataagtaggcatatgtaaaggttaaatttgaactgaaatatagccttataaatatcctaatgctatttagttcatattagttgatatttttatgaaaaatctaacactcatattgttagtaagaatagaccagagaaaagggtgcatttaataacttctgctgtatattacaaagtacaagaaaagctaaagctatcagaaccaaccgagcattaccagcataatggaattatcttttatattaatatatgagaaagagaacattaacacaaggaagaggaatttggtatttttgcctgaatcatcaggataattaagtcagtctttgactttgctgtggaagatgatgcaataagtaacaaaactactttaataattccaaagctcaacctggttgggcaagagtgagaaaagactcagttgcccattcgactgtaacagaaacatcattcatctagttgtgatgttggcacatgagatctgccgtgtatatgaaggacatgccttagacataatgcagttaaaattttccctactaactttagagaaatacatgagcagggttatttttcttgatcaaattaagacaaaccagacttgttcccagaaatgaatgtaacataacaaatatatccactggcaccttcctt

SEQ ID NO: 59984 - DNA, 1260 bp, Bovine  19866880969035
ccacccatccaccaaggcctggaccagctcccacctctggcatcaccctaattgtatgtgatgcgtccgggtgtatagtttctacccacaggcagaatttttaaggattcattatgggaaagttttggctgtatgtgcagttggagtctcggcagccctcagctttagtgtgtgtctgagcacactgtgtgtttatgctgcagattcaaactgcacaacactcccctgacagccttcagaggggaagcacaaacagggaattcttattcccttagatcctggaagacagcattcgatagtagcaaggagaagagtatcttccacttgcctttctcactctaaaagacatggctagaagcacggttcacactaagggatcatggactggtatttatttttgaaactaactgaaaagcctcagctgttacccaatgacttctctttgaaaacatcaaaagttgggcgggagtaggtgggtggggagaaggagccttctagtttcagatgtggcaagctccatgaaactgcactgaaaaatgagacgtgatgaaaaacactgctttgctcacacctccctcagagtgtatcacagtgaggagaccagggcaccagttcttaagattcttcctgctgggaagattccctcagaagtattcattttcagtgtaaaaggcaagaacagacaagacacttctaatcaggattaaatacaagatgcatcagagatggactgtgaagaaattcttaagaaacaagagatgttatcaatgtttctgtgatgatgagaaggctaaggggacaatgtttttgttcctatacagctaactgagggcaagaagaataaacacaactttttttttttttttaactggattgtaagttgattttcaatgttgtgttagtttcaactgaatcactgtactatatacctgaaactaacacaacatatatatatattcttctacaaattcttatcccttatggattattactaaatactgagtattgactgagtattagtagcatgaacagaaaggcatgtgtaccttcggcccctaattactgccagtgctcactgttgccaagccctgtgtcatgtatgtgttatatatgaccaagtccctccactctcgaagtccggggagaccatcacaacacagggtgacagccaagaggccacctgtggtggaaaggcctccctgatccggaagtaagggagcttggggctttctgacagaaagcaccatagcagaggttcct

SEQ ID NO: 59985 - DNA, 2513 bp, Bovine  19866881063041
acagaagcattgactatttaacaactggtacagccctaccagcatctgtcagctgaatatgcaccctgcttaaggccacatttacagtttgatacaaaccgatctggattcccctctgagggcctgattttcaatttaccaccactgggctcctgcagcaatgattatcaggagaaggtaactttgtctcatttgtcagtgagtcaattactctcagcagcacaattctcatagaagggtcaggagttttcttcctagaatcatctttcgcggttggagaacgatgggtgcgtgaatgaaattcatcctctctaagttgttcagagatggtttccccgggtgcgccaccacccaccagccactccgtgttggatccaacattcagatcacgttcacagtcactggagcaatagtacacaggcttccacagagatcagacaaccagcatcatttctgaaacacgcagaagcttctttgtgaccacaggtggaacccaagtgaaagacaagagacctcctccaagttcatccgccttcatgtttctcattaaatccgaaaccacagtcactccctgaaaaactccttagtccaggcgattctctgaaatgttcagcatcacataagattgtgcttttggtcagcttccagcacaaggcatggtgagagtggcaaaaagagagagggggtgggggggaaatgaaaggcgtggaactggatgggtgctcctcctcctgctgctcaaaagtcctgcccccctggaacatttcacataggagaaattgttcaactgggagctctaaggcaaaggaagtcactgtgcctgtatctgggtttttcatttgtttggtgtactacttggcaagttaaaaaatgttggcaggggtttctgttccatgattgcatactggacaaaggtatttgcctgccagccttcctaggagactcccacatcaccaaatataaacatgtcaataatgctgtaagaaagttacttacagttttgttagtgaaagactctaagtagaaattagaaagcatagtcggggcagggggctggggtggttagaatttggaaattaggcagtagctcttaggaaatcaagagtccagaggggtttccagtaaaaggttattggtgttcagacagtttgagcttagctagtctcatctgccatgggtttggtacagttcatccgatttgcaagtcatattatgactgcttgctacaaactttggttctgtttttgaaatacaaaaacttttttttaaaaaagaaatccataacagggaacaaaacagaaaaggggagtcatcagaaaatgagaaattgcagcaaatttctagaaaataagagcaaatgaaagtagtttgatggatgcaacaggtagagaagaggcagcctagaacaccccagggagaattgtaagagggcccacctttgcgtgtgaccagacatctggtagtaacagctgctgtgtggtggcatgcttactgggccacctgctttccatttattatgtcatttaatcttttcagtgacctgatactgtaagaatgactacccatagcttacagattgagaatctgagactgcgactcagagaaatgaaataattacctaatttctcacagtcaacaagtgttagagcttgaattcaaactaacaggacttgaacacaactttcataaagcaaagattgcctctctggttcattaccaaccacaactccaatacatagctggcacgtggcatccattggtgggggtaggggggtgaggcaggaggagaaagtgtgtatgtactggagtattggatggaagggtggacagatggatagctgaaccaacccaaatccaaatgactcctaaatccaccataccacaccatattgcctctccagggctctgaatgttagtagctaagtcatgttcaactctttgcaacactgtggactgtgtccagtcctcctctggctcctctgtccatgggatttcccatgcaagaatactggagtgggtagccattaccttctccaggagatcttcccaacccaaggattgaaactgtggtctcctgcattgcaagtggattctttaccatctgagccaccagggaagcccccagaactctgaagtaccatgtaagtcagtctagaggctgtatatagagagaagatgttcattaaagccagagggactcagaggctatggaaccttataaagccacattcagacacagggtgaggaggaggtagaagcagagaagcaaaacccaagagactgtggtcagacagtaagggacgaagaatcccaaccaaagtgttcaagcaagaggaagccaagaattgagagaagtcctgagtggcaggcctggggcaccagcccagcccaggaacggagcccattagcttgtgcttggattgagccgaaaggccgagaagcagtgaagcgtgctatggagccagaggctcaggaagacaggtgcttgctatatttattcatgtatttatacc

SEQ ID NO: 59986 - DNA, 1145 bp, Bovine  19866881102260
caacctagatagcatattgaaaagcagagacattactttgccaacaaaggtccgtctagtcaaggctatggtttttcctgtggtcatgtatggatgtgagagttggactgtgaagaaggctgagcgccgaagaattgatgcttttgaactgtggtgttggagaagactcttgagagtcttttctagtgtagcatctcattatcctaaccacactattcctgtctgaacattcagttccactcactggaataaacatctgctacaaaccttattaacaagatacatatcaaaggatccaagcaagttactaatttcctggggtaattacactgttctgtataaaaaccattagagcagtaactatgttcagaagctccctgaacatattatagacagtttatctacataacagctatttctacaagtcaccaagtattcgtcaggacaagtatagcatgactacatgtctagcactcaattaaaacaaaggcataggacatttttatgaggaaaaaaaatttacaatttacatttcaaatgtatacatttagtgaattgcttatataaaaactcaaaaccagaagctaagcaataactacaatgaattgtgtattcaatttttcttaaagcaagaatgcttgtatatatatgtgtattacatatacatatatatatacacacatacacatataatacacatacatcagaagtatatgtaagaatatctgtagctatcttttactcagtgtccactgtatgctaattgtttggaattactttatttaataaaaatttatttttatttattttaatatttaaattaagtaaaatttatatttttaatatattttaaatatttttaataattttaataatcaaagggtatcaatatttttaaacttaggaatatgaaatgtgaagctaagctctgttgtaagaatagaaccttaagagtggataaaattacaaaaagtattagtaaggattaacagaaaaagaaaaactatagaaggaataaaatacagaatgaatcggggacttggtaatttttagattataaactcataatacatttgttaattttagaagtgcccaacaaccattaaagacaaggtggtgggcagcagtcataccaaaaagtacaa

SEQ ID NO: 59987 - DNA, 812 bp, Bovine  19866881109182
tcctctagaaaatttctctttttaggacaatagaacatgcacacatgaaaagggaaaaatccacacagaagttaaaataatgcaagacaataaaagaaatatcacaaagctgtatgttttcaaatgccaaatatttggtatagacaaaaaataaaagaataaaagaagcaatgatctttctgtgctgagtgatcagaaaaggatttcttttggagcagagaagatttgaaccattttaaaagaagcagttgagcatggacaagagcatggatggacacatggagaagagggaggcatggaataaaggcagaaaatggactatgccttagatgggaggcatggagtagaggaaggaaatagaccactgcttaacaggagtgcaggagaacaatcaggtgagcaattacagggtagtctgcagagcatcttgaccagcagtctgggattcatcttaaaggttaatggatatccatagcaggtgtaactattaaatcaaatttatcaaggtgtacttcatatacaatcaactgcacacattttgactgtaccattagatgagtttttgcaaatggacaatgtcttgagatcaccactgcaagcaaggtacagtccatctccatcactccagaaagttctcttgcaacaccttctagtcaatccctccaaaccctctcttgctcattaacacaccatagtccactaattacccatgacattttgaatagttccagttctaagctgtaatatttttaagctgttcaaatatttttcatacaactttggcatgcttagtcactcagtcatgtctgact

SEQ ID NO: 59988 - DNA, 2142 bp, Bovine  19866881157465
caagagcaagctagccaagaagtgttgcaaggaaggaattttctggagcctcacaccaaactttggttattatcctgggcgatgttacagtttcactgctggtttgtattaactagtactagaaacacatagtaagtgacctaattcttttccagtggattttcctttttttagggctataccctggttggctgctttatttaataataaatcaacagtcagtatgactttgagctcaaccctgaattaaattttcaaatatgttgttataatatttaataaatatgaattcagatttttaaggttttttaggtgtaattttatatttcatgaaatttacccattttaagtatacaattcaataacttttaatatttttacagagttgtgtgatcatcaccacattaagaattctttgggttttttggccaccagatggcttgtgggtaagatccctgaccagggcagtggaaacgctatgtcctaaccactggacctcccaggtaacgcccaagaattcgtttttgagcttatttttatttgaatctttcaatagatgataattttcaagagtaaatgataagccacagaaaggtctgccacctaagttactgactaaacttttatcaagttttctttgagtggccagaggtctcctgcccatcctctcagatgcctgtgtttgaagacagtgtgtccagataacgtggtttattgttccgactcatcctgtggtttcactgttacttgatcttccctgaagtaaatgaccactgagaagggaggggactaatgaggccttccagttggcctcattatcacgcatggcaaccagtgaccaaacagctcttgacgtcatcagtaagtgctttgaaatcaagcatctcaacaattcttgacaacaactgtgcgaagtgccctcgtggatcaacagtgtcacatatttctatttttgctttaacattgatttcaattcccttcacctgcctacatcaatcactatgaccttgaagtgtgggacaaatctctttccagttttcccctttcccgcatggacctctgtgaccttgattctggctttatttcctttatgcttaaaatgataatccatttccttctgtcaaaggcatcttcattactgtctccttttcccctctcttcacaaactattcctacagcacataccaaaattttagttatgaacaccttgtactctgaaactgaacacttggtctgtggagcttctgaattctaaggttctatagtcagctcttccaggagctgccttcaaaatcatcttaagcaaaccactctctgaccactgcctccagtctttgcagctctgacttcagtaattctttttttgtctgggatccataatccattaatcctcaaactattccactgtccataacactatcatgtctgttctgaactatcttccatccatgattcattactccctacacctctcccttcagcaaacttgcctggtaaaagtctaacccatggcaaaaccaactgtccatcagctcaacctttgcaccaatgcagctgaatgtggctggaggagaacaaccaaccgtgtggagtggttcacgttaaattatgaccactaacctcaggtgtccccttagtgctacctggcagccctatcccattgtcccccatcgttcactcttccactctccaaggcagctgtttcacaccttcctttctctcctaaacctcacatggatgaccttacctcccatttccttaagaaaagagaagcaaccagaaaaaagccttctaggagctccgattatcacatctgccttatcctctactctatcacatgtagtcatagataaactatccaagctccctgttcaatatcattgcctccacttgggtgctagacccactattctctaacctactcaaagatatggcttcagaaattattcctctctcccttgcatactcaaattttcctctgtactagatcattctcctcagtctatgaatatgtcttaaaatatcctcatcttagcacacaacagtatttacctctcagtttcactttaatcccccttctggttgctcagatggtaaagaatccacctgcagtgcagggagaccagggtttgatccctgaat

SEQ ID NO: 59989 - DNA, 1081 bp, Bovine  19866881165044
ggctcttgttgctatagccttttttatggcaactgaaatcattaaattgtttaaggggcatgaattaaaactttgctacagaaatacaacatcacattattctaatactatgcctggctaaattgcagttgaagaatggcgttttgttttttctgtctaagattattttgtaaagaaacttttcatgtatctttagtttaacgttcatcactttaatggctccataatggtcccgtgagatgatatgccatagattatataaccattccctaaccgttagctatttgtatttctcatttttccttccactttcataaataatgatgctataaacatctctgtacaaagagttgtttttccatcatttcaatcttttcctcagggcaaagttccccaaactggattacttagtcaaaatgcatgcactgtttttaaaaaaacttattatggaaaattccaaacaaagacaaaagtggaaaagataatataataaacttgatgagcttatcttcctgcttcaacaattgtcacctgatggccattcttgttcatctatatgcatactcactttttaaaattatttcaaagcaaattccatacagctatcatttcagatatggtaattctttggactcagtactgatggtcttattgtcttccagaaattcaagtgaattttcaatcctaaagctcaaatatgacatgacagcaaaagaacaaaacataaaagaaaaaatgacaaattagacttcattaaaattaattaaattaaaagtaaaaattttgctctgggaaagattttgttaagaggatgaaaagacaaaagtacatactgtgagaaaatatttgcaaattataactgtgacaaaggttaggtagataactctatatctatctctctatctatcctcaaaagtcaacagtttaaaaagccctaacagttcaattaaagaatgagcaaaaggcataaagtgacatttcactgaagaagatatacagatgtcaaataagtacatgataagatgtttaacatcactagttatcagtacagctcagttcagttgctcagttgtgtccgact

SEQ ID NO: 59990 - DNA, 1370 bp, Bovine  19866881217157
cacaaaaattccacaggcctgaactagagcaaagtcaacagcaaaagagagaagatggcagcacggtctttgtcatgagatctgtggaggctgatggagcacttgagcgagaggatgggttaggggaatcctggacatgacagaagcgacttagcagcagcagcagcagcagcagcatataccttcagtcaccatggctgaaactttgtaattccaggagagtcagttctaagctgcttaacgtttaggccttcttatgccctttccccacaaacacagcaacccagatgtccaatctggcagaggtttatgatctataacacttttttaaatatgaaaataacagagtaaatttactgcaagttctggtcctttggaagtatattccatgataaatctcctgtctcaactttcttttctttttttctattttagaagctcagtcgagtcctactctttataaccatggactatacagtccatggaattttccaggccagaacactggagcaggtagcctttgccttctccaggggatcttcccaacccagggattgaacccaggtctcaactttaaacaataaaaatagaaacaacttctcagaaagcattattctatattctaacagaactctatcttttggataatgttagttgaagtagccacctagaaacaatcaattttcaaaagaacatagagtacttctccagagatttattactgatatgaatttctttttttaacttaatgactcaccagcaaaatcctttagaattggaaggctctgtacttggtgagtgtgccgatgttagtccctgatttatacccctgagtataatttggaagaaactgctgtgtaaatctgaatactgtaaacctgtaaaccatgagtcttttttaatctagtttcccaattaatagtgggtaacgcttgagagtagaatcatgaatggagtggaggagaggaatatggaatctttgctgtgctaaacttatatgtaaaaacttctactgaacctacattcagaggatcagtggcagattcagcacaaataaaagcagagaaccaggccctgggatggggcagactgaggtggttgtccatgattacaatgactgatgtcttgaagttgggtaaataatcctttgttgttggttagtcactcagtcatgtccaactctttgagaccccatggactgtagcccaccaggctcctctgtccatggaatttccaaggcaagaaaactgcagcagattgcttgttccttccccagggtcggggatggggtggtcaataatcctgaaattatcaaagggaaggaacaccaaaaaaaagtcattcttgtaaatgcatcactacaaaatatg

SEQ ID NO: 59991 - DNA, 732 bp, Bovine  19866881261204
ctgggccctttctgaagcataattggtttaagatggcttgggcttcccaggtggcactactggtaaagaatttgcctgccaatgcaggagacataagagatacaggctcagtccctgggtcaggaagatcccctggaggaaggcatggcaaccctctccagtattctctcttgcctagagaatcccatggacagaggaacgtggctggctacggtccatagcgtcacaaagagtcagacacgactgaagcgacttagcatgcagcatgcacaactggtttaagaggaatgaggctatcgctttattaaagcacaggcaaatagcccaagatgatactcaaagttatgtaaattacagaacactttaaggaggtagagttactttcaatggatcaaagggaaaaaattaacataaatgcttgcttagaaaagctacatgggaaaattttcattaaatgatgaagatactgggtaactgaactcttcattgtcttgcatttctatggagcttgctctattcaatgcacagttgtgtgagttgactcccttggaatacatgatcaacatctccaatggaaaatttaaattagcaatattttcacaaaaacagtgctgtaaagaacaaagagactgggcttagggagtcaggagaaccctgagttctgatcccaattacaatatatcatttactggttgcatgaccagggggttaagttatttaacctctctgggt

SEQ ID NO: 59992 - DNA, 4252 bp, Bovine  19866881275597
gagcttggggaaaagaaacgagtgttgcagggagatctgaaagcaaagactggcagttctaacagaaccatagaatctgtttccccgtgcacttagaaattactgcttctggagctatcagcaccgtcgtcatgcctccagagagttttctgtgtggttgagccgaatgggtgtaaacccatttccccaggatatgctggtcaagttcactttttgaactgccacctcccccaccccacccccatccccaccatgtcggtgacaaatgacagaccaggctctgtctcagccttcccacccccagcatccaggaagatggcacctcccagggacaagagcttttgtcagagactgcctgccctggagaacacattgcaccaacgcatgatgcctacgccggaaaacctttcctcattaacacttcctccccaaggaagtcactgggatcattgtgtcatgtaagccatttgcagcccaggtgagtaaggcattttggctcctgtttatgtggaagtctttgtcataaagctggcttgacaacagtgagatttcccagtgaggttgttcccagttccattatgtcactcatctttgtagcaaaaacatgttgtgtgcctatttcatgcatacgtgctgggtgctgagactaaaaagagatgaacaccaccagtttccactcctcagcggctcagggtctagacacaaatgcagattattgcaataggggtccagaccactgggtctaatggcagctctttcaggactgtggatgagaatggagggcaaaccctccaggcagaaggatgctctttctctttcccccagtcagctggtcttcttcttagttaatcttgtcactcttagccttattttcccattttgtatttttgctctcaactctctccttgccctttcccctttctaatactcaacgcatttcttggtttaatctcagacttgctcccatgtgcttccagtccctgcccgggcccggcccccatggccctgagagccgattttggtcatgtgcccactggactccttgcccccaggttccctcttcagtcctgccatcctgcctgcatggtcaggttcctaacatatcagatcatatcactctttgtttagagacaacgcctgtctctctttagcttttggtgtgactaggcgttcacaccatctgtagacgcttggtggagcaggggtagtgatggcgatcgctgacccaggaagaaatggaatggaaggaggggactcaaccaccagctcggatgggcaaaggcagggctctggtggtgatggcacatgggaaccacagactcccggttcgcataaccgcctccagccactgggtctggaactctgggtgaggcctgagcgacagtagatttacaaagctcccctgggtgattctgatgaacagtgaacatcgcaaacttctgtgctgctgggaaacccagcaggctctgtgctgcgggttggattacgtgctttgaaaaaggacattcctatcagctccacctcacagggaacacagtcttcgtgttcctgttggtcttttggttcaaggtcccaaacaaaacagtgactgcttggctctggaagccatcgtagctctaatcttggctctgctgctctgtaagctctacccactgagctaatttgcccaaagcctgtctgtttcagagaaaatacaggttgtaaaattcaaccaattcctcatcctagatgcatatattctggtttctattgggatttaatcaacaaaattttagttgtctgctcacaatagcataggagtatggtatattttatgaagcatgtctcaaaccaaatgcaatctttgtttgcttcaggcctgctttgaaaaacattttcatattctgagtttattatagttcagtagttttggaaagtatttagatttgcttttaattcactacacattcctttttgttttggaggggggaagtctattgatcttacaagatcataaaaatatcggtttgtttcaggattcagtgtgtgtctgtgtgtgtttggaggtgggggatgactttgttttgttttttattggcattttaattcatttcttgctagaaaacacacatttcttttggtggtaaccacaacacagaaagtgaaaatgttagtcattcagtcatgtccaactctctgtgaccccacagactatagctcaccaggctcctctgtccatggaattctccaggcaagaatactggagggggttgccattcccttcatcaggggatcttcccgactcaggattgaacctgggtcttgtgcattgttggcagattctttactcaatcaccagggaaaccccagtctcaacgcagcacctgcacaaaattactccatggccacaaaaatttaaaatgtgtaggaagcctcctcttttctgtagggaagtagataagctgagacttttttgttttgttacctaagtctctgctactggcctccggctagcccaaacagccgcatcattcaaatcagggctggccaggccttgggcgaagctgcctgtgtggaagcgtttttttgctttttaccctgatatccttcatggtttattgtgtgctgtcctccacatgacacaagcctaaaaagaccatttgtctgcactgtctcatctctgcttgccttgctccttaatgcaagtctttaattttgtttcagtcatcctgtcctttcctccaatttcttcaccaattttccccacttaataattataaagaaaaacattagcaatgacacttcccccctcccctttgctcttttctcttcataaatatccttgactgcaagacatccaggtacagcacattcatccatttttaatctgtctcttcttgtggttactgtgttccagggactgaaggaccctgaacaatggtctccaaaaccttggactgagcctttcttctcatagcagagaaggtgctgagggcataatggagtgtgatcaaataaagatctgttgtctgaaacactccctttcaaggtgaatatggattttcatcacatgaaaccccgagctaggaagccagagtttttcatgcctgaatattattagcaaatgggaaaataatttggagagacagcagactgaaaaactggttcctcgtaggagcactgtccctgaggcagcccagaggccctggggacagacactcacagaacgatgacagggcagctccagtgccagttcagagcaagagcatgcagaaaacaccttacagaggggctctggctcgctgtggtgtcttcaggggtctgttgacagccaactttggctttgcggtgtacactctctttggaggacctcatccaccctttctgcctttccctagctgtacctcttgacacctcccactgttgtattgggttggccaaaaagttcgttctagtttttctgtactggattacagagaaacccaaaggaactttttgaccacccccaatatccccacccagctctctccttcagctccagaatcacttatacaacatccttctggaaatctccaggcatgtccaaaacagaattcactttctggacgcccttagtctgtcacccaaacatgctgttcttctgagtgatcccctcagatcagataaatatcccctcagataaataacactatcacctactatattcatagaccagaaaccacagagttctctggggtttcttttgtccattattttgcccaacaatttgccataaagactcctgattggatctcagacacacctccagagttagtctggaccagctccatcctagttcattcacttgccgcctctcacctggacacaagtacctcccagctgagcctgtggatgcctccactgctgtaggatctgtctgtcttctccactactgtgggatccattgttccacagcacatgtcttttaaggccacagataagaaacttccacaggctcttcgaagtctgccagagaaggtccaaacttctcttcttggcatctcagacccttcccaatctggctcaaacctaccttgctaggcttagcttccctcaaaaaatggcactctgggctttctatcatttgaatttttatggtgtctctactttgtgcccagcaccctgctaggcaccccagattcagagaggaggagggcacaggtcctggaagcactcaagactcaaaggagtaaatagacaagaatagagatgggcaaagcacaccaggagagaa

SEQ ID NO: 59993 - DNA, 1293 bp, Bovine  19866881313538
gcctgctggggatgatcggcatccccaaggaaggaaaccttttcttgtaataatatgaatcaagataccagatgatctggattcttatttccaatgtttcaagtggaaaacatagctctttattgtctgtaaatcaaacatgattacttttcctcttagagaaatactgtattgttagatgtttgttgagctggtaacatccttgcaaccgctgcaatatctttgttagtaataaaactttgtacacaagtactagtaagattgttattcaatgtagcttcagtcattaaattactatagtgaagtagtacttctgtaatatttacaatgtattaagcccacactatattttatttcagtggtgtaattaaattgttatttattcaaagagaaaacatcccatcatgtctgttgtccaaagttacctggaatcaaataaaaatcctagattatcacaaagaacacacagtgtctttggattctgccttatttcactgtctaatgtcaaaacacttgaagtttaagttctgaaaggttgatttgttcctcaaaagcaaggaagactctatttgagaaatgagaacagattagattaatatattcatttttaacatagaaaaaaatgcaaaaagcatcatttacataataaagggaaaagcctgccataccttttaaaaatcattatttaattaaagagtttaatgattttgcactaagctagagcaaatgtactactcataatgtataaattaaatttgaacttcagagatttagtaaaatatataaatctaaagaatttatagcatcacatatcctgaatgatgtgaaaagataattacttttcagcttatttataaaagcatatttttatttgaacagtaggagaaaatagaaaattttataatgaagtaaaaaagcattacagtgaagtttatacattattactgtctgaaatacagtatgtttgcagtcaattttgaaagaagtttttaaatttttcaaatgatgaattgacaaatgtttgaaaatagatcatctttattttttaaataactgtaattaaaactcttcattcttctcttagtaagcattgtagttaactgcatgagctaaatgcttctagcaaagagcaaatgacatgtgttcttaattcttaaattttatactggggtttgaagggaataagatattaggttggtgcaaaagtaactggtttttacattgttgaaatttgccatttgatattggaatacattcttaataaatgtgggttatgttacacagcattttaat

SEQ ID NO: 59994 - DNA, 1132 bp, Bovine  19866881336501
tttcaaaaatgaatcccgaaatttttctcccaataccaagaatttcatcttcaccaggtcttcagagctgtgaaaagagcattgacattgcctggtgagctcatagatatgtggattcatcttcagggtaatttgggactaaagagtggcaaactcttcaatggaaactaggaaccctggtgagttttttcataaataatcttttgtccttctaaagagatcttcttaatcctctagcaccctgagccctcatctgcatatgacggagaggtaaagtgaagaaaccagcaggcagattcgagctgtacagacaattaaaagcatctcagcttggtccacaagccatattcagccttatactgcaagaaacgacattgccccatcaggctgcttgggtaccacatagctagcaatcaccagattagctagctgtccactttacttcaggctatgcaggcctatgcaggctatgcaaaagctacattttatccatttagggaaaaggtagtctgcaagcaaaatttgtcagagtcgaatggcttcttcagcactatcaatgcttactgcgaaagggcctaatttggagcacccatggcaccactgaggatgaagtggagggtaagaagaaagcaagccatgttcatcattatgccttagcacctctagctaaccaggagcagaggacagcctcttccttagcccgaacctatacaggcaaagctgctgggttgtcaccaagggcatctgcttgaagtacagaagcaaccacatgacgtccaggcctccatcccaagggtgtcagctcctcactgcccttttctctcccacttgctgtctgattggccttcttaccacatgagccagatctggtagtctcactccagtgagcaaggtatagagctacttaaactgggatctcgctgcctacacatacaactaaactgtgttactacctggcttttcttctttcttttaaaaccacttcccttataatgacttacatttccatggacttgatcgacattaggcaatcagaaaccaaaacacttctatttcctgacatgaacactatacagaccgtgacttgagtgttcatggtcaatgattccttgctaaacactggtcttatgaa

SEQ ID NO: 59995 - DNA, 1844 bp, Bovine  19866881365098
tcacatgactggctaagcctgctgctgatagaaaaacagagttttgttgcagaggaaatcttcaagtttgaaacatcgctactgtgtgtcttgatgtgactttcttcttagaacttgaatatttattccacggcagtaaatgattcagttcaggcagtggccctttaatcctttatgcactggaggctctggtgtgtgtaaatctgaactagaggtccacttggccctgaggagcttacaaaaatgaatgtgtatagtgaggatgtggagaaaaggagccctcgtgcactgttggtgggaatgtaaattggtgtcgccggcatggtagaaaacagtatggagtttcctcaaaaaaactaaaaatagaaaaaccctatcatccagtaatttcactcctgggcatatatcctaaaataacaaaaaataagtaaaaagatatatgcatcccaatcccaatgtgcacagaaacactatttacagtagccaagacatggaagccacctaagtgtctattaacagatgaatggataaagaagatgtggtgtctatatacaatggaacactactcagccattaaaaagatgagatgttgtcatctgcaacaccatggatggatttggagggtattatgctgtgtgatggcaacccactccagtactcttgcctggacaatcccatggacggaggagcctggtaggctgcagtcgatggggtcgctgagtcggacacaactgagtgacttcactttcacttttcactctcatgtattggagaaggaaatgtcaacccactccagtattcttgcctggaaaatcccagggacggaggagcctatggggtcccacagagtcggacacgactgaagtgacttagcagcagcagcatgctgtgtgaaataagctagcagagaaagacaaatactgtgtgtcatcacttatatgtgacatcttaaagcaaaatagtgaacattacaaaaaagtaacaaactcccagatatagagaactcttggttaccagtggagagagaggaaggtagggaattcagaggtacccactactatgtataaaataaatcaattataaagatacaatatggggaatatagccaatattttataataactataaatggaatacctgccttaagaattgtgtaccactgtgtagtacatttgaaactcatatactattataaatcagctctaccttaataaggaaaataacaaattttatttaaaaagtgaatgtgtcttagggttgagggttggggtaggggtagacagctactatatattgcacagttgagtgatgacacaggcagaagcagcgtgagccatgagggtacacattgctgtggaggtttaagagaggctgagggtctctgggttggctctgggaagctgcttcccggtggaaaggccgtaatctagagtgaacgctgatgagaagtttctagtgagttttgggcttcccaggtagagaatcctcctgccaatgcaggagacacggattcgatccctgggttgggaagatcccctggaggaggaaatggcaacccactccagtcttcttgcctggagaatcccatggacagaggatctggcgggctacagtccatggggtacaaaagagtcggacacaatttggtgactaaacaacaacaacaaaacccacatctaacccacgattgaaccctgacagcagctgtgggaaactgttatcatcactcccattgctcaggggagcagactcagagaaattgagtgacttgaccaagctcatgtgatccaggggaggtctagctgggacttgactcctcattctttttttgcacatggccttgt

SEQ ID NO: 59996 - DNA, 1783 bp, Bovine  19866881402315
aattaatagatctatattatgtgtcccctacagataatatttcatctttttaactgtgtatggatcatttacaaaaattgactacaaacacaatttttgaattcaaaaagtaggcattctatgacccacatttcaaggaagtcagaccaggcaatatgtctacagccagtaagtaacaaatgcttaagccaaaaatctcaaacaacctgaacagtaaaaaaaaaaaaaaaaaactctgtcctaaataaataatgggtcaacaaggacatcaaaagtaaaatcagagactctttttaaaatagtaaagtcgaaaacattatcttccagaattttggaaatggggcaagagctatacttatttctttaaattaaagactttttctctctttccaataaaggggtaaacatttatttttaatcttcatatttctgattatgttttcttagttgagatttaaactcagtcatctaattgtcccttttaaaagctgaaaactgagaccactttctcttaggatatttgaacccacaactgatcggaagaactaactggacttttgcaggtactggagatgaccctgtacagagtttgtgtccaatgatttgaagagtcattcctaataacaccatcctgtgtcccttgcatgggtttctttgctggctacaaaatgtgagagtgatactcgcctttctagaaatgatgctcttggatgatatcatcagggtgatggcagagaggccaggagaaagggagaattctctagctgagacaaatttaacgctgctgctaccagattaacgtaagcatcagggctacagtggcccatggggtcccactctggccaggcagtgataacacacatggggcagagagggaagactgcacattcagctggacggctctgataacgggaagtcagctgtggcgtgtggtcgcccactgacagacagcacggtcctgtaatgaaattcactaagtacaatgataaacaagtttcacctgctccatttcaaaagaggagttaagaaatctgaatctgagagactcatttacactccattgaaggcaataatctcagtatcagactgggccaaattttctccatacaatttggaatgagcaaaacacttctgcttccagagtatctaatatccctatgcttgcttagaatctgtaaaacgcacgtccctcactaccatttccatagtgatcacagcaagtgggtccctgactccaaaaagctcccagcagatacccgtggttctctccaagcaacagttcaacattatttcctgatgtgtaagactgagagatttgcagagtagaaaagagtctgatcatattccttaaatgtaacctgccttatcatatgacattacttacatgtgaaatttaattttaaaaaaatcacgaatttatttacaaaacagaaacagacttagagatatcagaaataaacatatggttatcaaagggggaacatggggaggactaaccaggagcttatgatgaacatacacacaccactatatataaaacagataaccaacagagacctactgtacagcacagggaactccactcactccataataatcaatatggaaaaagaatccaaaaaaaaaagtgaatgcatgtatatgtataactgaacccattgtgctgtgtacctgaaactaacacaacattgtaaatcacctatacttcaataaaattaaaatattttttttaactatgacttgccttggaaagatgctagaaaccaaaataatatcgtggtga

SEQ ID NO: 59997 - DNA, 1550 bp, Bovine  19866881470702
tcctgcattcccttgcttccttgaagatcaccaattactgagacctgttcaagggcaagatcatggccagacttagatcacagaatggctttggcaaaaaaaaaaaaaaggtttctttcatgtcaagaaagctatgcctggttctctttctccaagaaccctcttccccccacccatcagcttataggttttcagatgccttttagcccagcatttagtgtgcagtcagttgaaccctgtgtgccttcccccatacatctgtgatgttcaaaaatgattgctaggagtctaaattactattaccttgaacaagaagcaaaagaaaggaaagtttcacattccatgaccaaagtgcttagcacttcgcaataaagcttgctttttgttctcctattagtgtatgaagtttccctatttactctactgtctctggtgagtttaaagatagaaaaaatggaatgtttaaaattcaggctaagtcaagaagtataacatatataacccagatttctgatccagctttcaaatcccagagacactgctaagctttgaaagcttggatatacatgcgacctaagcctttgaaatgtctgatgtttgccatctctgatggaacggtctgcctcaagaacgttgcctttattacactgagaatgaaaaccatccattacagaaagtggtctgatgtcttcatgagggacttgaaaatacatgaagggactcttgcccagtgaaccacagtgctgaggtgcaaaaagtcagaaacacagacggcttagtcaggcttccttagtctaaaaaaaaaaaaaaaatttttcctggaaaaaaaaccagtgcaacatgttgtgcctggaggagagaacaaaagttgttatttttccttaatgacagcactggattctgaaattgagcacagcaggtaggaagagcatgtgtaaatttcaaaagatatccaaatgttacacaggcacctcccatacggatgagcaacacaaaacgtattagcaattttctttatttttcccaaaacaaaacgttctgagaaaaagaaccccctctttttgcctctctctgccttgatttactgtcagaaaggagagatttggctctgatgaagttaggggctgggaaaggccaacctgcctgtctggtaacttctcaccttcaattaattcccagcctccggggatgcatctcctgatcctctctttgtttctataattgtcacttttgtttgttaaacatatccctgtgtgctctttattgcaatacactgtttcaggatcctaaatctacaccaggatgtttcacaaataaatcacggaaagggagaagtttaacctcccaatcctgatgctatttgatgcatttacaagagactctaagaaaggagatttttttttaaagcattgatcaaatatgcaaagtataacaaaaagtaggcaactggatcatattctaaaaagatgtttgtgacaagaaaatttggattagaaattagatggaagagaatagaatttgtaaaagtatgtacaggaggagttctaaga

SEQ ID NO: 59998 - DNA, 1900 bp, Bovine  19866881629086
atagctcaacttcattttaagatgttttgccttctatggcaatcaaaatcaaacttttgtaagtagacgtgtgtgtgtgggttacgcaactcctgtcagcagtgcctgcggtctttgcttgaccttggatgaacagctaagccttggaggtgggtgtgtgcatcaaagctgcctacaagcacacgggtatcccaggttgctcaagctccaggatgagaagagggtcaaggacagtcacctctgggctctgtataggctttgtgaaaggtcacatcgtctgcctaattggaatcaactttctttcatgcctgtttttatctccacggggagaaatgccaagtgagctgggaattaagaagtcagggagccagctgtgtaaccttgttaaagtcacgttagacgttgggtctcactttgcttatttctaaaacgggaccagatatgtttgaaggcaacttccagctcacattcaggttcttgtttttttcctgggaagatcccaggaagtgttcagagttcaggtagtcacttccccctagtcagatgtcatccagccagcctcctgcatgtcattgctttgttcctgccatgtgaacagcatctgggtcctcaccccaggacagtgtcttcctttctgcccacacctcagtgggctccctccagccctgcccaccccaccaccagccccctccactggctcccatcaacaatatatctggggtaatatatttgaaaccaggacaagctttgggaaaacctctgttactgttcctaggaaagttgagtgttgctattatcataaactcttaagtttcctcaaattttccacttacttgttctccttatatgaaacgttatctttccccagatgtaatacttcctatgcaacccctttaaaggagaccactgcattcattcaaatgaaattattcaggacctactatttgttgggctcaagaaaagcttgttgagtgaataaatgaatgggtaaatgtaccttgctgggtgctacaggagattcagaaacaagttctctccccagcctttaggaggatggtctatctatggcagtggaaaggattaaacacatacagaaatagttggaatacaagcagtgccaatattcatggtatggtaccaccacctgtaaatactgaaagctatattacttgaatactagttgggaaatagccacttccctacctaccccctgcaagtctttcccctcccagctatcctacctcttgcttggagtccccaagtgttagtcattcagtagtgtccgactctttgtgactccatgcactgtaggccccccaggctcctctgtccatggaattctccagacaaaaaatactggagtgggttggaatccccaaacctcacccaaacctagcaaccagggaggtttaacatctgaggcttggcagggagcctcagggtatgctgctgcagagctgatctgattggtcagcacccttgcctaactaaccagttagttaacatttgaactatctctactgaatgagtaaagctcaggtaactgccgaataataacaataaaaataaaagtgaggaaacaaaaatattgggaaagttggttccattctcaactacagtgatgggcaccagccaaaagagggcattacattccctggccacagagaccagctcaggaatgagcaaatgaccaaccagattaaataggatgtaacaaaactttggctggcactgttggtagagagatacttgttctttatgatggatgtaaactaagatgtgattcttgagaaaccatgggctaccatatgaagcccaatgatgctaggagttgagtgatgggaagttcctagatcaagccactcctaagtcaagcatgcctggagacttcagtatctag

SEQ ID NO: 59999 - DNA, 1309 bp, Bovine  19866881776324
tctttattgatttcttctacttacaaaagtaatgtagaatgactgcaaaaaatctcaagcaaaagaagaatgttgtgaaagtcttttctttttttcctttctgaaccctcatcagagcaccactgttcgcatttgggtgtacattctgacagtttttttcccaggtatatgccaaagaatatgtattttagtttttaaaaagtcagatgacaggctgacaggctaattgactggtagttttgacgcaatggattactggagattgctgtcttttcccttggcagttcaaggctttgctgctatgttgggtgaagcaataagctggaaagcaaaaaggagctgcaacagctttcttaaagagggagtgtgtgcaggaaggcagaactaagataacgaaatggacatgaaagtgactcagggaactacgtgccacacttccatttaatggtgtgactgctttcgtggcaaatcctctcagtagagggtaagatccagggccagcctggagtcagcagagagagccacagtcccctttgcttccccaggtcctttcctcactgcccttgttctgctccatctctgcacagcacaggccatcaaatcacatgtggagaactgcaactctttgcagctgcctcattgctgaaaggtcattttgctcgtgttttcttctcagtggtcctggcccccctgacagtaggagcgctgacctccgctttgatctctaaacaccgagggctcctcagggaagactcatgtcacagcaaatgtgtctttatgtcatgtctgtctggacaaggagggtgcttgtcagattgtcaaatgtcaacgctctaaattcggtgtttctgtcctcaacaggaagttacagggcaggagcaggctcctaatcctgtgttcttgcaaaagtattccttcattattgacagccttgtgtgtgtgctatgtcacttcagttgtgtctgactctttgccaccctatggactgtagcccacctggctcctctggccatggaattctccaggcaagaatactgggggcagttgtcatgcccttctctaggggatcttcctgacccagggatcgaaccctcctcttctgcagttcctgcattggcaggcgggttctttatcactagcgccacctgggaagccatttatggccttactatgtatcaaaggtgatgagaattcacactaatatgaagtttgaaatttgatacgaggagagatatgtcttacctccaagctattgtttgggtctataacactaacattataccgagaatcagccgacggaaatgcagat

SEQ ID NO: 60000 - DNA, 681 bp, Bovine  19866882042279
actatgttgcatctttaaaaaaagaaaaaaatacagagaagaacagctgtggttctgtcttcttctgtcttgggccctttgttccattgacctgctaatctcaaatcttcagaggtactagatctggtttcgtctgactatctcttaacaccagattattggtagatttaaatggtatcaaaagcgtggtactcaataagatggacaagaagaaagcaaaaaaaatattttcttcagtataaaatacactgtattttctccccccaccaaaaaacccccaataaatctcattaatccaatgtaattatgggtacagatgtaaaatcttgatttataaatattttattcttattacttgcagcctctcattaactcaaaacagggtagcagagctgattataaaaggcctaaccagatcctgttttagtaaataataatgtatgattggctgaggatgattattgtcatagtaaccaattagaatttagatactaaaattaaactccttccctgtatgccagtcattcttctgatctgaccattagtgaaaactgtctttgtacacatatgggatgtattgtgtttatcagttagatatattttattacctgaccaaatgagtacagtgtgtctgttttgggaatattattgggggtggtgaatgaacagcaatgtacttgt

SEQ ID NO: 60001 - DNA, 2648 bp, Bovine  19866880181634
catcccagtgcaccagccccgagcaccctgtatcgtgcatcgaacctggactggtgattcatttcacatatgataatatacatgtttcaatgccattctcccaaatcatcctaccctcgccctctcccacagagtccaaaagactgttctatacatctgtgtctcttttgctgtctcgcatacagggttatcgttaccatctttctaaattccatatatatgcgtttgtatactgtattggtgtttttctttctggcttacttcactctgtatactaggctccagtttcatccacctcattagaactgattcaaatgtatgctttttaattgtaagcaagttggagtctctacttatgaatgatcctccgagagtcaagcatgatagagaagccctatattacttaagggcacacaaaacattaactgttcagagaaacaattggtcaaatgtaagaggaaaaaggtggtttgttacgttgcagttaacaaataccttctggagcattttttttaaattaaaaaattctattcatttattttggctgccctgggtctttgttgcacacaggctatctcttggatctcttggttgctacaagtaggggctgctgtctactgggggtacacaggcttctcattgcagtggcttctcttgtggagtaagactccaatgcacaggctcagtagttgtggcaaacagacttagttgttcttcagcatatggaatcttccagaaccagggatcaaaccccttgtcatcctccgctttgtcaactagattctttaccactgagccaccagggaagtcggctggactattcctcatgagagcagtagaaatgaatattgaaaatcttgcatttccttccacatcactggtctattgctgtgtaataagccagtcccaaacttaatggtgtctattaacaataatcattttataattaatcactgtttctgagggtcaggaagacttctcagggttgacatgccatagtgtctactgaatggttttgttagccagtaactggagctggagcggtgtggggctggaagatggggctctgcaggcatgtatgcacaccctccctttctctctctgtccttgttgtctcagggcctctcatgtggtcttcccatgcaggctaacttgggcttcctcacagaatggcagcctctcggtggtaggacctctcttcctatgcagagactacgcagagacttggagcttcactttgactgtttcatctattgttgtttagttgctaagtcgtgtctgactcttgggaccccatgggctatagcccgcaaggctcctctgtccaccggatgtcctaggcaagaatactggagcgggttgtcattcccttctccaggggattttcccaacccagggatgaatccacgtctcctgcattacaggtggtttctttaccactgagccacctggggggtcctgactgttccagagaaccaggtaaaaaccaccctgcttttttgacacaatctcagaagtcttgtagcaccatttctgctgaattcagtgggtcagctagtcactgaggttgggccaagttcaaaggcaaggtatacacactgctacctctccatggaaggacttaacaatttgcagacatattttcaaagcaccacacctctctaacacaatgttaacatatcctttggtttgaatctaaatacatgctttttcctttttaaatgatccttactgagcagttgatttaaagagttaaaaagcacatatgtattgcaaagttccactgtagaacaggtatattccataaaatatcaggaacaacgtggggcctttgtgtgcatcagatcgccccaattcatgacgagcattctgtggacagtgaataaagactaccagagtgaatggatgaatagataatgaattagttcacatatctgtcatcaatcaaaaaagctcttaagccaaatagattagaagccaacagaatgaataataatttagcatcttgggcgaggaaataagtttctaaaatataattaatatagcactggttctgctttgttttgtctgtacctgtaattttgttaaaagacagttacgtatattcacaggactgtctgatgggctgaaggaaggcaaagaagagaacagtttctgaaaaactgtttttcatattttattttatttaaaattggcctgcatcaggtcttagttgcagcatgtgggatctagttcccccaccagggattgaacccaggcccgctgcattaggaacatggagtcttagccactgggccaccagggaagtccctgaagagcttcaagaggctctaggtcaagtgtttgaaatgtccagaccacaggctcccccacactcatcactgctgttggaggaatcattggaattctctcagaattctggaaggtggttaccatggggctccttggtggtcacccttggcctcttcctttgtctgcaaattgctgccagggcaggggtctaaagcatatccaaaattccagatgaatcaaatcataataattgcactattcatcaggttagaaggagttttggctcagggcccatttcaagcctgaatgtcctaagcaaacccttttacttccagattatcagggagcattcccag

SEQ ID NO: 60002 - DNA, 1897 bp, Bovine  19866880452573
aagcttaaaagactgtcaggaaatctcatctcagagctataaatgttccagttctcgccactgtgggattccaggtggcactagcggtaacgactctgacggcaatgcaggaaccacaagagacacacgttcgatccctgggtcaggaagacccccgggaggagggcatggcaacccacaccagtattcttgtctggagagtcccatggagagagaagcctggcgggctacagtccatggggtcacaaagagttggacacgactaagcaagcacgcatgcctctgctcttgtctctggaaagtactctaggaagaaaaaaagaagaattgactgtagcttacaagctgaatctgattagcaggacagcggttaaaggcactgattctggaaccagaaatcctgggttcaaagtcccactccgctacttcccaggggggcagtgttgggcaagttggttgttttccatgtctccccatctccatcaccacaataggggcagccagagcatccacccctagagggggttgtggggattaagtcagttcacatatgaagagcaagagtgatggtgccctctcgatggggctctaaagccgatgggtggtctcaaacagctttgcttggctccggaatctctgtgtgctagacccacacctaaacatacaagagagcccactggggcttagagtgaagcccgctgccatggagacaatctcctggtctgatctacccaggctgtcgccctcccagggtccatcccagcccattaggagcaaaccaaccaccacgcagatgctcactttgccctgacttcacacacagtcctccagatgggctgacatcctacaccacccatttgtgtgcacttaacctgaccaaaaggccaccaatggtgctgcctgcccgcgttcccaagccttctatctgctcagctctctactcgcccttttccttgtttccatctgtcaacatctctgatagccttcttctctcaggagtttctgtctccccattcctttctctgtctcagttttgcttttcctttctctttttctccctctacttactactctttctctctcttacacatacacgcattctctctctctctttcgctctctctctctctctctctctcacacacacacacacacacgccatgacatgctaattgggctcccaggagagtctgcctcctccacacaggcagaagtgaagggagctggtgagcaaggacgcacgtcacacctgccaatcaagctctgtcgcttgttgtgtgacaccagccctggtcccaggaacaggctgacctggccatctctgggcacagcctcagctgtccttccagagtgggcccagggaacagatgctctttgtgctgtgtatgacagcgtctcctggaatgtcctgggagcaggtgtgggcccctcagtggctggacagaggggcttactcccagtgagtttatggaactagatgtactgcagttggtcagctatttttacaaaattccaatcacacagctaaaggacaaacatcacagaaggaggaaatgggtgacatcctcgcgctcatgtcacgggagtatgtcagccgcaaggaaacgtcttgaagctggactggccataacaggaaagaaatatgacccgaaacaaaggcgcctctgttaatatatgactttcgatttaaaatggtctgccaactggaacagagcacatcaagagagaaggctggatggatggatgaaggtgggaatatttttaagtgtaggctgaggtccaagtcttcatctatcatctgatgcacttgacaactatttgaggactcatggtgttgaaagcaacctcacacagcttacagttcagagaagaagaaggaaaagggaatgagaaatgc

SEQ ID NO: 60003 - DNA, 955 bp, Bovine  19866880677859
agactcttgttattgctctttgaggtttcccttttggctttcttttctttgtggagaaggaaaatattcatttctgatttgtagattgctttttccagttccccagatagtcattcttaaaaatcttgggatctagcttaaaatggcttataaagcatcttgaaaggactagttgctttttgtgtgtattttgtttctgtacgtttgaactccatctaactccatctgtgcagttttacctggaaattccatcacgactctaggttcagaagcccaccaggtagcagaaattcatcctttccctcagaatcctggagacaactggaaacccaggacaagcactgacccccagtgatgcaggacagctgcatgcagacatgaggcagcggtctcactggcagccctagccccttccctcaaccccgagaccaccaccttcctcctggggagactcggagcctgaatcagggaccagttcgggtccctgccgctcctccccctcccccaggctccccatcagaggcaccagccgactctcctgtttctttattctcactactggaggactctatttttctgtctgccttgacagctgccgaaagcaaaccacaacagcacttccaatggtctcctcaccttctgccgctggagcaaccccctcctgcagctgccagctgggagcacccgcctttcatccacatgtaaacgtttccaacagcttcggaagcagccacttggctcggccttgcgactgctttccgccaacactgcgatttttggattttaattacatccccttgattaggcctcaaaaatccatatgtgagcatttgaaatggcatttctaaaaggcaaatctgcccatttcaagtgcttcctcgggggtggtccgagtactgattacacttttgctgatttggaaaacactctggtgggtagcactagttactctttg

SEQ ID NO: 60004 - DNA, 655 bp, Bovine  19866880726214
caccacctcacagtcagagccacaggtgagcgaccaggtgtgcggggttcccgcgtacatttcaaagaataggctggagattttatagctggtatctgagaagttcatttgaagtgttggacatccgtctcgtgttggtgaacatactttgggaaatcagtggtttagaagtaggttttttaaaaaaccctgttcactgaaatttattttagtgtgagcctgtgatacacaatttgacaccgctttggagaattgatggtccctgttgaggatgagtcagagctgggctgcagggagactgaatttcccttcaagagttcagtgctgtatagcttctgggactttaataagccactcaggcttgtctcctgctgctcagcatcataagaacccctttatgaaattactgccatgtagtacccagcagggcatactttattctccatgcaatgtaaatgatggataaaagagcttgtaaaatatgggtagtgatggaggattgattattgtgaaaaatctcctgccccgcccccccccccccaaagtcctcttcctaccatcactgtgctttagttaacaaactggtaacccactgaaaaatatattaaatgcagttttgtaattcatttggtaatttgcactctgtcaggttgtt

SEQ ID NO: 60005 - DNA, 1222 bp, Bovine  19866880812119
aaaaattttaaaaagggaaaagccgggggatgtgctttccaaagggaactttaaagaacaccaacactataaagggagtacagatggccatgtgcacgagctacaagcgtattaaggaaagactggaaaaatatttaaactttcacctctggctgatcttgagactgcacaagaaggatgtgaaggctaaaaaagtactgtaaactgtttcctgaatactgatagtatgtcccaaacacatacacagagccccttggtgaagactaggagacttacagactccaagcttgtaaataagtatccatccaatccttagctgaatgagtgaagaatccagtggacataaatagaagaaaacagcctgcacacagttcaggaaagtcattaaagaatcacacagcaaccataacaaacagaagaaacaacaagtcatgggagagagggagaaactggtttccagggttgctgtgctatttaaaatgttaacttatcaacaaaaattacaggatacaaagatacaagaaagtacactccgtgtgaaagagaagtcaatagaaactgtccctgaaaaagcacaaacattagatacactagacaagtgtgatagtatcaaacactatcacaagttttaaatatgttccaaaagataaagaaaaccatgtctaaagaactaaaggcaagtgtgagaatggtatctcaccaagtgctgctgctgctgctgctaagtcgcttcagtcatgtccgactctgtgggaccccatagacggcagctcaccaggctcccccgtccctgggattctccaggcaagaacactggagtgggttgccatttccttcttcaatgcatgaaagtgaaaagtgaaagtgaagttgctcagtcgtgtccaaccctcagcgaccccatggactgcagtctaccaggctcctccatccatgggattttccaggcaggagtactggagtggggtgccattgccttctccgctcaccaagtgagagaatgttaatagtaaggtggcttccctaatgactcagttggtaaagaacctgcctgcaatgcaggagacatgggttcgatccccagtgtgggaagatgccttggagaagggaacagcaacccactccagtattctggcctggagaattacatggacagagaagcctagcaggctacagtccatgaggtcccaaagagtccgacacgactaggcaactttcactt

SEQ ID NO: 60006 - DNA, 652 bp, Bovine  19866880862418
ggaggtcaggctgcagcgtgcacaaagacttctgttgaaggaaagaagatgccttcaaaacgggaatgctatacttacagctgattcatgttgttgtacagcagaaaccagtgtaacattgtaaagcaattatcctccaattaaaaataaaatggaaccaagatcattttcctatgcatcttcacctgattatgaaacatatagagggaattccttggcgttccagtggttatactcagagctttcactgctgtggcctggcttcaacccctgcttggagaactaagatcccatgagccacatagcccagccaaaaaataatagtaataattaaaaaataattaaaagtgaagtatacagaaagttaaacatacatgtgcatacatattttatttattttatacagtactagtatatttaagaagcagttgaaagcccagagctaaaactgatatgtgtcttcttgcttattactactgacttgctgttatgagccatctgtgacattgaacacattgtgctgggaccatctgtaatgttcctaatctaatggtttaaatgacagctcgtgctctcattagaagatcttagcaccttgaaaacatttgctggaaacagcaaggcattgatccctttggatcctatcagatag

SEQ ID NO: 60007 - DNA, 613 bp, Bovine  19866881057192
ttcatcattaatcactataaggaatgggctcagtgattcataattctaagccagcccatttcctcaaggatcccgtttgccttttgttgttccagaagtggcacagttcactgccctgtgctacccacattcggacgtgcacactttctgattaattctcttacgaaaagtcacgtactccaagcgttttacttataaccccaaagcctctgaaaaatcatacttctttcagacaccaatctttttctggatccagctgccctcagattacccaagttcaaacaagtcaataattagattgaatgaattaatcacaagtcaataatcctcaggctatctttggtcctcagcaaaaagctgcatttggggtggggcatttggatggaaacgcactccccacagttacttcttcattgctactgttcacctgcaaccagatagatggtctttagtggccaaggaagagcagcaacacaaaccaggcttccccttctggtcctggcccaaagtcactgacaaggaccgcatcactgctttctacacggaaacctgcattgcactgtttaccatcctgatactattttctctaaagctgcccgtccgcataaggact

SEQ ID NO: 60008 - DNA, 903 bp, Bovine  19866881071048
aaatataccagagtctgatttcagtgatgactcttgcacaactttggaccctttgcacaactttggaaatgtaagcggcagcttgtggttgtactagtgatatgtcaggttgaataagtaacactagaggcatgttgattgctgcctaaaagaaagattttctgctgtaaatagtgtttcagcaatgttttttggcgtgcgcgtcgaaacttggtggttctctatgcagaatcctagataaagcaatgttttgcacatgttcagtagcaaatttatatactttttaaaatgctgaaggaagtggcctactggtacattttaatttaggttgtaacagtgagattggaagaggaaattcacaataactataataggaatgggtttgggaagtagcagggtgattatggacatcagcagtagtgacagttgaaattagcctttgcaggtttctctctttgagcataccgactgaacatctactgtgggtgaagagttctgctgggagtagcggggctgcaaatactagcaagttggtgctgggttcttcggaatttgccctcatgccaaaacagtgtccaggcagttcagagggaagacattcatccttgcccttgctgctgttgccacctggtccaggtacacttggcagtagactgtccaccgcgccgccttctcccccctccagtaactgtcgggtcagctgtctgcacactgggctcttaggggccattcctccatttccattcattcgtttgaccttcagggacctccacgtctatgcatgacttcccacgctggtcttctttcccactgtcactagtccctgccttcctcctgccgctgaggccctgtgcttttacctggtcagagtgctcctgcactctgtttggagtgtctctctgt

SEQ ID NO: 60009 - DNA, 1147 bp, Bovine  19866881073164
ctttgtgaccacatgctagagaaacctgtacacacttgaggcacagcatctaaaacacctaattccgtctgtacaactattcagtgtcttaggtcaaaaccaagtcacagtatgtgagtagaagaacaaataaatagaagaagaagagctgctggcttaattcagtttatctgatggggagatacctattgaggaaatctgtacttattagtaaaatgagtttaattgcttgtttttgtgtgcgagtaattttacatgtttaagagcacattataaaatatgtattagttggttgaaacacaccaccactgggcttgctgactgaatgactgaataaaagtatttctcaggtaaatgctgctactctctaggatcataattgagaagacagtatcttaaaaactacagttgttagaagaaagtcacaacataaattttaatcaaagtgtggtatgcaaaaaaatacactttacctgtttacttaatatatctttctaaaacaagaacagtatggttgctttccactttaaaatatcttcactcttaattgagaagtagcatttttagcttcctactaactttaatacttggtggtggagtgagggggagcgggggcaaggagtcagatgaattcctagaaactgcaccagaagtgaatctccatggcttctttgaactgaagcttcaacagtcaagtcacactctttggccaagttcccttctttatgtacattcaaagaatctttatataactaaatgcaccactaaatccttcaaagtcattcaaaggaagcacttcctccaaattctctcattgcacaaggccaggcacacacaacagaaaacacattgaagggaaggccacagatcctccaatttcagcgtcgtgaccccttccgtatgcaaaaaagtatcctttccaagccacaaatgtcttagcccttattttcaatattaactgacaacattagaaggctataaagacacctggagagctcacaggaaaaacatgtggaaaaatatatatttaaggtaaaatggaaagggggaaaaaagatatagctctaattagaaaagaggaatatggcccgtactttttttttcctatcattaagatattaagtgactctttctgaaatgctgacac

SEQ ID NO: 60010 - DNA, 1400 bp, Bovine  19866881089995
ccatcactctccatggatccctctgagtgatgcctccgtggctctctgtcactcagaatgtccctctggccagggttcatggctgtgggtaagacctgctagttggaaagcagtcaatcctaagggaaatcaaccccaattcaattcattggaagaactaacgctcaagctgaagctccaatactttggccacctgatgcgaagagccaactcattggaaaaggccctgatgctgggaaagattgaaggcaaaaggagaacaggcgacagacagacagatagcatcccaatgcaatggacatgaatctgagcacactccagggaggtagtgaaggctagggaagcctgctgtgctgcaatccatgggatcgcagagaggaacacgacttagtgactaaacaacaaaccagagcaccctccttccagagagaagcaggcagaggctttcaagccgtttgcctgcaacctttgaccccctctgtgctctcttggttaatggcaattatcattgttcaagagacacaccacagaggtaagtgtcctcagctaaacgggctaaatgatgaaatggaggtgcagatgtttctctcgcacacagctctgtctattccaacagcataaatgtgaatttgagccccctcagaatgagccctgaaacctcaatggaggtgagaaagaaagaaaattttaattctagattttgggaaaacaaaacttctggttgtaattttggatccccttgatggatggatttgcttcaggtgggggatgtcaaaggctcaggtgtgagtggcagggggagggcggccacagctgcagtgcagagaggccagatggcttgccaggaaggagcgaaaactcggggaattctaatgatgagcagccctcaaagagctttcagagagcggacagacgtgctggggagcctgggagccattgcaattaacatctagaaacaattgtgggacatgcttgcctaaaatatagacctgggcacactccgtgtttggagcatgcacccagggcaaacaatcaaagtagtacattggatgtatgcaaatatgtacacatttcacacacacacacacatatatatgtatatacacacatatatagtacatgtttgttaactgtatgttgattagaaaaaaatcaaatggggaggagactggcagattccaggttttccaagtctccatcttcggtccacttccccacattgccactgggaacatgccctggctgccaatctggggacagaccaacttcttgctgcacccagcccggcccaggcgtgctctctaccttttgtgtgagctgtgccaccgagggaaaggggaggctgtcacctttctcaagctgctgctagtctctctcttcctgagctgaaaagagcctaa

SEQ ID NO: 60011 - DNA, 1569 bp, Bovine  19866881112214
ctagtacagtctatggcttattgcttcagaagactcacccattgacgaaatgtgtggattttttgaaaaaaattttattgtggtaaaaaacacaccatgaaatttacagtcttcaccattctttaagtgtgcagttggatagtgttaaatacattcatatattcacatcatatatatatacatatatattttttttttcacactgtaaaaggatctccaggacttttgtatcttataggattgagactctatacccattatccaactcccctccctctctgcccctggataaccaccatactactctccgtttctgtgaacttgacataatcacataggtagaatcatacagtacttgttcttttgtgactggcctatttcacttagtataatgtcttcaaggtccatctttgggaaagcatgtaacagaatttccttcctctttaaggctgaataatagtccattgtgtgtctgtaccatattttccttatgcatctgtccatcgttgggacatttggcctccttccttctcttagcttatcatggtgctgctataaatgggaattactgatatctcattgagacctggcttgctttttttttttttttttttggtatatacatacaagtagtattgctggatcatagggtagttctgtttttaatttttgaggaacctctgtactgtttttcacagcagatgtaccattttgcaatcccagcaacagtgcacaagggaatatgtgtggacttttaaaactgtgttttgttttgtttttaatatcctgaagcagaactttcagatctaagacagcttgctatatatttggaaccctgtaatcttctgaactggggagaggatgggctgctgacccatttgctcaaatacattatgagataatcacaaatgtagttatctgtaaccaaaagcaaagtggaaattactcttttggctaactagtataattttataataaatctctgtgtaatttgggtctgtttttcagggtggggaaataatcttcctaatcaccataacagggctgtctggtttaagacaaacaacacaaaaaaaggtctctatggactcatccccaggctggtctcacatggtgtccgttggaaagaaacaatgtgaaatttttaactgaagactgtattatcagagacgttgccccctgtcccctggccccactccccttatctccctggttttgctcatctcccttactgagtttagaagagagcttcccagatcagccagaaggcccctagtagcaggcccttttaatctgtggaaactgggtctaagagctgtaattagaaaattttaacgtccatgcttcaatgaaacttgaagtgataataggtagaggatgcaaatcgacactcattaggtgttcctaggttggtgcccattcgtaatgctgaactttattaatagtgacgctaatgatgtcccacttcctgggagaggctgcggtccagcccgaggactgcagcaccagcacatggtgaagtctgagtgcaggcttccatccctggtcacctcccaacacacaccaaca

SEQ ID NO: 60012 - DNA, 1135 bp, Bovine  19866881137064
ttccgggtttgtaggtttttgcctccagggcttgtaggtgcagtttttctcctaagttaagtggatatctggaattggcccaatttgtgcagacatttagaagtttagtgcatgataaggccttgaatttgatctggagttttagaccaggtctattacatactcttcccaagagatggtcaggacttcgtgattttttttagattttttttttcccccagtaggagtatcttgggataacatactgtagcagtggttgcagtttggttggctttcctctccacagtgctgtatggtttcctagcagacatgacgtgactctgtcaccctcgggcctctgttcactctgtagtttacaagatgggttttgatcacttgtttttatttttaatgtacatttaagaagcaaagatattgttattcagcatgtcttgggtgtttagatgagtttttcaaaggtacaaaaagattttttaaatcctttaatgttgacttctatagattaatttgatctcttattaattgagagtttgagatggaaaagaatattctgtacattcatggctgtaaatttttttactgaagactggtaccaacaaaaagagcacttaaaagctttctgttgcagctggttctttgaattagcttcttttattcctaaattaatgggattggattagccagctattcttttaattaaaaacaaacaaaatctagttctgtttaaaggaaaaagtctgactgaattatcctatttagggtggagttttccatccctaagacccttctcagagcagtttgtactattttggtgttcaatccacaaaacaaattggaacacttagaataatctttaaaacatgaggaagagaaacactatggctgtaactagtctctccagatggtagttttagtcttaaattaaagaaatggctcagacgataaaggctctgcctgcaatgcagtagacctgggttcagtccctgggtcagaaagatcctggagaaagagaatggcaacccactccagtattcttgcctggagaattccatgtatagaggagcctgctgggctacagtccatgaggtcacagagtgggactgactgcagactaacacactttcagaaacccatt

SEQ ID NO: 60013 - DNA, 956 bp, Bovine  19866881631903
cccatcatttcccactgcctgacaggtaatcaatgccattaacatctgatatcaccatatagggcattcctaaaacctctcatttattagggcaaatgcagagaatgttagataccaaaggtattttgaaatacaccctttaggacttcctgcttgacgcattttctatcatagttccatgtgcctgttggagaattatggaacttgtgaggactgtgccatgcgctttcggaactgaaacagagtgactgatatttgaacaataaataaaaatcatccaaggtgtatgctatccaaaaaaattaccataaactaaagatgatcatttttatcaactctatgtttcataaacatataaattaggcaaatacattaacaagtttcctcatgtaaaacagctgaacagactgtaaatttaaccaaagaagagatgggtgagggaggcaaggccaacccctctgttacctttaagcaaaggtggccccaaaggctcaggaaccttcaatagaatgttaaaaaaatgcacaagggacttccctgtcggtaccgtggttaagattctgaacttccctgcagggagcctgggttctgggttcaatccctggtcgggaaaccaagatcccacatgccactcagtgtaggcaaaaaaaaaaagcccaagaagacactttacatccatctccgccgtgttttccctccaacatgaaccaccattttttgacttcaaagcctatcttatttaaccatgttttttcttaattatagtcttgaagcctcaacttgctctcaagggccaatgaccatgagtcagtaaatagcatgcaatgtttccaacacagacgatccctgcaaacccaacaccattagtaatatcggacgtctgtgggcaaacattctactcagcgagtgacaccatacatataaaatcaaaatgctactttataataaacagaaga

SEQ ID NO: 60014 - DNA, 994 bp, Bovine  19866881643873
gctcactctgcctgccaaatggggagaattaattctcctgtttcaacttctgggaagcaggactgaaaagcctgctgaaatatagtgactcccctggcttctataatccttcttacccggtttggcattgccgctgaaaatgaggttggtggtctaagcttacaaacaattatgctggtaacctggttctatttgttaaacgccaggttttcacaaaaatataagacagtgattttaaataagaaactattcttcacccagcaacatttctaaaaatctaccacccaaatcaacaactcataataatgggagtcctaaattttacaatgcgttaacaccttcgcttgctagtttgggtgtgagagaaagaagcttaacagtgaggacaaaaatcagagtgacccccacccctgagctgcccctctccccccattccataggttgtaactgtttggtgcttgtgtctctactatttggtggcgggtgtttctgcccgcagcctaccttgactttttgctggatttgggttttggcgtggcagtttttactttcttttcctttggctctttgggaatcttaggggctttcggggtcttgggttccttgggctcttttttctccttgggttctttcggttccttgggatctttttttgccttcggccttttctttttctttttctcttcttgggacccgtctagtgagttcctgtttagttcttggttatcaaccccaccagggaagtcatctttaccaaagtttttactgggatcctctgcaacaatgtggttgttcttctttttcttcttcttttgctgtggctgctgttctatcgacggcaggtaatcatcactcttcactagctgagcgttcggtccactaacctgagtcatatccggcactggtttctctagaaagggctccgatggagaatgctaagagacacaaataggaattgaaattagtttatcattcttcgtagtttagaaaggaa

SEQ ID NO: 60015 - DNA, 1488 bp, Bovine  19866881818085
cagacactatcccagcaacagcaagacggagctgggagatgttttaaaacagtgaccgctgaatgaggagcccttggttagtgtctaaaggaactaaaaatacaggtaagtccccacatatgaacgagctctattccaagagtgcattcataagtccaacaaagttagcccaagtacccaacttgtgtgtgtgtgtgtgtgtgtgcgtgtgtgtgtgtgtgcatctactccactggcaggtggattctttaccactgcgccacctgggaagtagactaatacaataagctgtatatacctctgcttttacacttgcttccaaacatcctgggtttgaaataaagatactgtactctataacagtactgtacaaaaggtcaaccatttgtcgaggatgcacacacatgacaacatatgccagacacatgaactaacctatgtgactggacatgcaaacacacgtccacacctttgaaaatttgcaacttgaaggttcgtatgtaggggacttactgtaatattattaaatatggtcagaacaaattcatttttatctaagccactggttaagtcatgttcaaaagccaaaaagtatatagaaatagctagtaaataacaaagctgaatctgaaccttattattatctgtgtgatcattaggcaactgattcagactcacagggtaactcatcttggtgtgtttacatatttacctaaccggctactttcttaaacaatgagaaacaggcttgaacttattagaatttcttcctttttcttaaagggatactgtctgcatgcaattgctttaaagtgatgtgtttgagctctagaaaactggagagcaaaataccttgggtaatgcagaccaagaagatctcctttgcctttcttctagaaaacatttgggtttttggatcttcattttaggacagaggtactgattattaagccctaaaactaatagtaaattgataaatctcagctaaatttagaccaaggctgtgacctggctgtgatgttacaaacatttgctgtactatataaatataatatggggaaaaaaaattttttttaagtacagctaagcaaaacagaaaggtaaacatcgtattacagatatggtctttgaaacatcatggaccctgtgatacagaatttggagtaaaaatgggacttcactgcggactctcactagacaagcaagattcaaacatccaaacactttatgcagtttaatttacaagaagaagctaagtgacagacctcatggtgggtaggcatatccttactaagacacaatgctcagaagtcactagacgcgtgtttattcttacgcaatgagtagggtgccctaccaactgccctttacaacctctttgggttcttcaaagaaaaacgggcatgctgagactcagatctcacaaaaagaaggattctatagcatcctccatgaaccatgttaaatgaggcccatcaacttcattag

SEQ ID NO: 60016 - DNA, 752 bp, Bovine  19866881937148
cttctattaacacctcagaaaaagaaaataaacctgattgaaaagtaagcccaggctggcttctatatttgagtttttgctgtttgtttttcctttgcactggaatgcccttcttacctggcttcctcctcccttctgtgggcaaaagaacacttatttatcttgtaaaacccagctcgcatgtcatttcctttatgaagcccttattgacacacctgccaccaagtaaacttggtcactcccttcttgcggctccactgcaccctgaaagcttcccctgtagcaagcataactttattgcactaacatattgataagggttcatcagagggagcatgggggctaatgtctgagtcctgccatgaggggatacagagagaaatgagacgaacctcttgccattggggagctcattgtctgttggggcagttatacaatattaatttcaaacatgatcttcatttcagggctagagatctacacagggttgttagggacacactttaaccactcgagtaggggatatcaggtggcacagtggtaaagaacctgcctgccaatgcaggagacccaagagacacgggtttgatccctgggtcaggcagaccccctggagaaggaaatggcgacctgctccagtattcttgcctggaaaatcccatggacagaggagcttaggaggctacagtgcttgggatcactcagacacaacagagcacacacacaccatgacacagtagaggctatcattt

SEQ ID NO: 60017 - DNA, 1142 bp, Bovine  19866882088066
cctccctaggacttccaggcggcgccagtagctagaatctgcctgccatacaagagacacaagtgacatgggttcagtccctgggtgcggaagatctcctggagaaggaaatgacaacccactccagtgttcttgcctggcgaatcccatggacagagaagcttggtgggctacagtccatggggcctcgaagagtcggacacagagcgcacgcacacacgcctccctaaatctttcacgctgctattaaaaacccattgccacttgtttagtccttaactcaggaccccacgggattccagttcaaatgcttctagaccctttcttaagtaccagggacttgggggtgggggcgacacggaattgtccctagtatttctcactgctgaggtttcccaccgactccaacaagtgactcaattgtgcaccatctaatttatctagacctttaaaattattaccaaatttgatgtttattgccccagttagtacagaaaaccaagagaggaaaagaccccattatcttcattccaaaagcattttctatttgtggctccgtcaacatttcggcatctcattagacatatttaatttcattccctcaacaataacccacgtatcacaccagtgaccaccactttgctgctccagcccctaaattctattagtgttcagagagtctcctggttgcaacataatgttcaatcagcgcagagaaattaattaaattaaaattatttttattgtgatttaattagcttaatttaattactttgttcactgactgggcattctgtggttacggccagatcctcgctctcattcgtggcacgaatgttcccacagaattgcacattttctctgctcagccattggagcgggctgggggagtatgccagaaactcacgatttatcacagtcagcatcatcacaaattataggaagcatccagcagtatgataacttctaaatgaagtgtctgaaagcaggtcacaccaccagcctcggctgttaatccatcatatttcatagtcaacttgacaccttgtccaatttgctgggcctgctttatcaccagctcccatgagctgctgcctctctgggccggcaagctggggattcagctccgactcaagctgcct

SEQ ID NO: 60018 - DNA, 1113 bp, Bovine  19866881164612
tctgctttctatctataatctctattattagtatttctttttacagatagaacgctcttggaaaagctagttttatcattgctgtataatattctatcctatggcatttatttaaccattgttctatttggaatttttttgaatttcccttttgttataaatattactatcagaacttttctacataaattactcacctatttagatgcataagttttacaattctttgaaatgttatcattgttactatgaaagattatcatcataactgttgagtttctgtttttaaaccaatacttcagacagaaaattgaatactaataattaatttcatatttatgtactgacacagtgtctaagaaacagcaattttggtagttacattatcttacccaaacattcgttgttggtagttttcatgaacttgtgtcctgttttgtgttaatacatttgttaaacatactaaagctaaaataagtaaactatgtgtcatatgtgttcttagactcaataagtagtaaacagctctaaattctgtattgtatttgaaccatattttttataatcatcatgagaaataatattactgaaaattttatttcaaatagtggataatgctgtccccagaccaatatttggacatggggagttacttgaaaattgttttatttaagcttaagtggaatcttttttttttttttacatcaaaatattccctgatagtattagaccagatattataataagtttttcagaatatacattataaatgaaatacagttatgtgaaagattgctttttccctgggtagaaatatcctgccctgttgcatttcaagagctatttctttttgttgttcttgttccaggaacataagtgctcctgagtaaatggataatgttggttgagagaagagaatagaggaggacaaatttcacatgtttctatttggaattcatcaatggtctctgctgatgttcacggcagacaaagttgcttaaaatgcagacttcttgctgttcccactacaatcgatagtgcacatctttcatactttaaaggctgattttactgtaaatctttctaacattcctttaggtgataaatggtaag

SEQ ID NO: 60019 - DNA, 1232 bp, Bovine  19866880440241
tttctttgagcaaaaagatttttgttaaatagcagtttctaaagcctcttccaaacagagagacccccttaggaggaaaagttgctagaatagaattttcatctctctacattgggttataaaagtgaaaaagaagatcctatagcttgtgttgcataacaaatgaggcttatgtaacccgagtgttctctggcttgaccaacttatgactatcccacatcatcaacagtaactctaaatatccaagtttccaaggcatcatcctatgtgcttgaatgacagaaattagcatctctcaacttgtcctctagctattttgaagagttccacagatagcagtcacatgggtgcccagaaataagtcttcacatgattctacttcagcccccagacatgctgccacgatgccgctctgcccatgatggctgttgtggtgtcaccattctctgggcacagcggtccttcactggtgaatgctcctgtcaacaccattataatcttaagggatccagctctccctttgtggtgactaatcgcaaacctaggagagatggatttgcaattctacccagaaacacaaaatccaagcactaacttttaacttgactctacatagtgttcagaaccatagaaataatgtgaaatttacagtgtatacgtactaccgtatgtggaaacactgacagaaatcagcactgctcctttcatcaggaaacctcgatctgctgatctttggttttgttctttggcactcccatacattttagactaaacagagtattattcttaacatctaggtgatgcattctctctcaatagagcatgagaggaccactggaaattcagactccatcaaactgtgccaagttcaggtccatggtcagcacagtctctcctgcagtgaacgtgaaggaaagacatacacttacttccccatggcaccttccttatctctttgctctttctacttcaagcaactctttaaacagacaacacctaattctgcaggaatgtgcacttataggcatgaatagagaactcaaccatatgtgataaagaagcatttgttacataagggaaatgatcaacagacaatcagatctggctacccatcacagagtgtgacagtgttggaatgaaattgtcccaaagagttccctttctggaaagaagactttgcttgggtgtttaactaaatagactgattaaatttttttccagcaaaaaacaat

SEQ ID NO: 60020 - DNA, 4282 bp, Bovine  19866880462641
aattcctgacttagtgaatttctttgggagatcaaatatacagacatgtgaaggaatataagatactgtttttttattaagtatctaaacgtgtggaacagaccatggatgacttcggaagccagagacaaatgtctgtttctacaaaagaataatagctgtgcccctattacaaaatgatattgattctagctggcagtaaagctcacagattgagagccagccagcagctgaactcatgcagagaaccatatgtcaaaactaggcctttgtgaataatgcagtctgtccacagtaaagcctttgtcgtggacaaatattttaaagataattccagggttcaaaaggcatcttaactcttactggacatgaacaaaaggtagacaagaataaattttgagagtccaaaaatattgtttcatccaactgtcatgcaaactataattggaaacttcaggtttccacaaaataacatgacaaattttcctacatgacaggattgctttactgttcttcctactccactccactccaagtgatatgtattttgatattaagaaagattcttaggataataaagggaccttacttttctctggagtccttgctaaatgttagcttatgcctagggtagaaaaaaataaacaagttgaaaaatttgttccaatgagatggaaacatttattgtaagagacttgaggctttaaaaatgtacttgaaagatgtttgaaaagctctagcaaccattaagacttttgtctgatttcaggggaaatattgtagattttcattcctgttttaaaataaacatacttcatttaactgatgttgcttaaagttaactttggtttcaggacttcacttgaatgaggttagttgtgcaaatgttaaatttcctaaattctccaaagtgggcttcagagtatatttgttgcaagcttgggcatctcaccagtggcagataggttatagtagattttggtgctctggttgggctgcgtcgtgattcttcttgcctactgtctttagtctgcttttccctaagctagggataaacataagagaaaaatgtcgaatatcaggaaatgctcagcaaataccaacttgcataaatgtagcaagttctaattttcctttggtttctttatgcagagatttcttgaaacatttcctaaagtagaagtaaaatcttctttcttacactatttttgtgagacctaaatatgagccataagaattttgcttttttaaagtaaaatttcatcccagcctacgaggtaacttaaatatggcttaaatgtcatccaccctaggcatgcagaccatttggtacaaaatcagatgacctcaggggtcttcttggaggggacataataatccatttggaagagtcttcaaaaattgtttaagacagaggcatcttatcttcacttttaattcacatctctgatttccatatgcttgaaatcaatctgatttaaaaaatccttgtgtgtgtgtgttcagttgtgtctgactctttgtgaccccatggactatagcctaccaggctcttctgatatatgagattctccaggcaagaatactggaatgggttcctactttcttctccagggaatcttcccaacccagggatcaaactcacgtctcttgtgtctcctgcattggcgggtggattctttaccaccgagccacatgggaagccctaatgatatatttaattatttaaaggaataggaaggtgtaaggtattaacacagaggtagacactggaaaataattattttaaacttctttggattataatgaagaccacagtttaatacctccatgggaatagtttctggtgcaatcagcaaaagggtgtaacttaagttaaaaatacatggcctggggacctgtatgatttttctttatctgcactatcagtgcaacagcatcagccaactccagagcatttccttctgtgcatgagcttgtgggaggtactctcaaagcatatggtcaagaggtagagagtccagagaggagcagtgacccagatagctacaggcttctgagggctcaaaacaaatctaccactagataccaggctcatggaaatggtttaataaacatttataaaaaaatcacaagctgtttcctgaaagagccctaagcagtttggtttctgccagcatttatggaaagtgacaaatgtgagtctgaaatggaagtgtctgaatacatgctgttcatttagaaatgaaaatttcttcattatataaaattgttaaataaaattttttcactcatctcattgtataatttcataaatcttgctttccttggaaaaaagctgtctttcataatgataataaatgggggagaagtaatgttatccacctcacattctatgctgtttagcctgtttaagaaagaagaacttgcttttcaggatgtaactaacaataactcctgctgctgctgctaagtcgcttcagccatgtccaactctgtgcaaccccaaagatggcagcccaccaggctcccccatccctgggattctccaggcaagaacactggagtgggttgccatttccttctccaatgcatcaaagtgaatagtatatcaattaaatgtttagggcatgacaggtcaatgttgggatgcttgcatctgagacttaccatactccctactgagtctatataatatcagtccatataattttccatttagtcaaatctgtcatataatttattgctatttctgaaaaaaatatctttctaggaaccctccaacttcatgttcattctgaagtggtttacttctatagaacactttgctaggggattccctctaactctctgctttaaagagtctttcctattttagttccttaactcatttttgctggaaaatatcctctcggaactgcttaagaaaatttgtatgggaagtatcttttaagagactttgaaaatttgaagatgtcacagttctacccacaattttgactagtgatatatgtttgtgtaaaacttcagaaggaagaaaaaaggtttaaaagtgaaagtcttggttgctcagtcatgtcagctctttgcagccccatgcactgtaaccctccaggctcctttgtccatggagttctccagcaggaggatatttgctgaaataatttcctttttgttttcttgcttgaagagttgcctttgagaaatctcttgcaattccgatatcccattcttttacatgctctgtttatttgctctgaaaattttttataatgttttctttgtccttgatgttttgaaatttcatgataatgtgtctcagggagaaacttttggttccttggattatattctagagagtcatgttcatctagagcacagaaatagtctttatctcttctctgcaagtagtttctgttttttctttctgcaactgggctgttcgggcttatagattgctcctccatttatcccctcttctattttatatagaaatattaaaaaataaattattagcttttcccaacatcttttgttcattctattgaaatttctatttttgatatgattttatctctattttttgttctttgaatattctttctttaatgtgaccttgatcctttttaaaaggaatgcaatgtctttgaaaaatatctttctaatattatgtatgttatacatgaataatattatatgaaaattatatatatgcacatatatggttagtatttatattttaacccatgttgtctctgttctgagttaaatgttgctttagtttctatttgtttttctttatctttcatctctaaagtttactgatcgtaattgtaactgaggcaataaaaaattaattgcataaaagtagcctggcaggctacagtccatgaagtcataaagagttggacacgactgagaaactacgcacacacacaagcttgtagatcagtgatttcattgtgatgttatgaactgaattttttttccccttgtcagtatctatggaattcttttctggagtggttcagttttccaggaaagggtccttcagtcttctgcttaatgaacaaatgccgggttagggatgtcctgagccagttagggcaaaagagactctgccccagaccctgtactcactaaggcacccttatctcctatttcttcctcagtcacatcctctattctcaaggcaagggttctctgtctcagtttctccatatagttcctactgcttcaggtacagggaggacaagtcaccaatcccactcaccatgagggg

SEQ ID NO: 60021 - DNA, 1424 bp, Bovine  19866880574994
tcctgtggtcctgctgagttttccaacttgctggcatattgagtgcagcactttcacagcatcatctttcaggattgaaatagctcaactggaattccatcacctccactagctttgttcatagtgatgcttcctaaggcccacttgacttcacattccaggatgtctggctctaggtgagtgatcacaccgactttaggcgtattaaaaacttatcacttttccttacaaataatactcaggataagttgttaaattcatccattatcattcatcttttagttatgcattggctattttctggtgaattagaaagcttattaaaaatagaaacaaagaaatccatagccccaaattctctgattatttgtttattgaacagagcttgggtcatctgtcaccctgttgtaactaagcaaagaccaacttgactgtgacttgcttatggagtgctgaaacatggctttagggagttctaagcttggtcttactgttgatacatggagtatctcttggttgaaatggagaccttaaattgattctatttaggccaaacttcttactactatctaaacagatgcttttggaccaaactttgttcttaactcacaagaactttaagagccatctcttctgagcttttgattcttctgagccaattaagtaaggatttggtgtgtgatgacaccagagtgggttgctatagggtagaaattaaaggggtttgtgtgtgtgtgtgtgtttagaatctgtatctataatatctattaatgcataattttaagactaaaataaatcggattctgtctataataaatcactttgggcatgtgtgctaagtcgcctcagtcatgtctgatgctatgcaactgcatggactgtaacctgctaggctcctctgtccatgggattctccaggcaaaagtactggagtggactgccatgccctcctgcaagggatcttcccaacacagggactgaactcatatctcttagatgtctcctgcactagcaggagggttctttaacactagtgccacttgggaagtcccaaattactctgtaaatgaagccaaagttgattcaaaatggaaaattgtccttttgaactagtgtaaaaacatgactatatttatacagaaagtagaatgtgcatatggccacggttaccattttcttacagacagagacctaagtattgtgaaaattccccatttgaaatcatgtttctaggggggtattaagctacatctttaatattttgacaggactgttaacagttgataaaataaatcttacagattagcatcctgatttgcaactccctggacccttggagctttcaaggagtgtatcttgtgctaaatgacataaaataagtagagcacagggtaagagaaaatttcttctcatccagaagcaag

SEQ ID NO: 60022 - DNA, 960 bp, Bovine  19866881118149
tggtaatactgataaatagatatatcattgaaaagcataatcttaaaaccgactcaaggatattgactgtaattgatcaaaaagcatcttgcccatggagataagagtaaaaagataaattttcctatgaacttagaattttccaagtctgtttccccaaaagagaccattgaataccatgataatacacatatatatatgaggtcatccaagaagaagatagggatggcttggtttgatattgccaacactccttctgcttactccaaccaaaatgccaggaatctagccttggtgcttccatattttttaattaaaagcattgacatatacattgaaaccatatcacagtcctagagaatgaagtctggctctgctgactttcacttatggatatgggaccatctcttttgaacaagtactcctaggaaaactcttcactcaaaactgggtcaaggagagttgctttcattggagactgtttggaaaatcactctccaaggagacataatttgaaacagccaaccaaattaggtactaacctatcatgatacaaattcattacaaaacctacaactctaaggccaatccaacaactgcagattaaaaatgcactacatacacccagaaaatttcaatactgaggggcatcccttgcctgaatagattctaatgactatcaactagaataaaggtatcggcatcgacttagggcagagtgctacactctgtaaatgaaaaacttcaggtaaaatatttttcagaagctataaagtcaaaatatcagggaaatgttcaaaaccacaatctcactgtaaaaaaaaaaaaaaaagaaaaaggaatagaattaaacagaggcaattaccgatgatactatttgtatagatttaaatacttcactgagggacacaaaagacctcctaatgtttttcctctacagaacaagtacataaagcaaag

SEQ ID NO: 60023 - DNA, 675 bp, Bovine  19866881356529
tgggggagcctggtgggctgccatctatggggtcgcacagagtcggacacgactgaagcaacttagcagtagcacagtctctcattgtctttcagttctgctttattatctgaacatcctagctttctggtactttcaatttattttggcttttcttgagagatgtataaaggtattatccacaaatttcttctagatgtcaccaagagaagctattccaagctgattctccattttgaaaatctgcaaatctgatttagttagttaattcagagggcagattcatatcaacaaaattttagaatactaatttctaaatcagatgccaacttattaatttatgggaagaatatttattacctagggacataaatattcatgtttgtaagtggactgtgattggaaattttcagtgattttaatttatgattatatatttatcaatatctctattttcccagtaatatgagtggtcagaacatttgactctccctactttattagaaaaaagacataacacaaaacatgcctaccaaagacatttaagtcacatataatacaaaggtgccaataactatttgatgcctggtctttggatgccagtttttcagatgtttccatttcattgaaaggatggacatgaactagaaaaaaattcagtagaaagacataaat

SEQ ID NO: 60024 - DNA, 819 bp, Bovine  19866881486922
aacctaggcaacacaactagggtgctcacatcttaacactctagtattctggctctacctgtgtgtataacatgacatctcatactcacaaagatcagaaaaacaggcagatttatccctattttacagatgaaacacctgagggaaaaagaagttaacttaccagacacatcacaattcagtgacagagttgaatttggactcaagactttctggtttcaaagccatgggcagctgtcctttgtcatttatctgctagcacctgctagaacctgtacacaatataaaggtggaaacaaataacttgctcatgatgagaagctggtaattttacctctctggtgcaatacaagaagaaataagttcctgttgttgcaatgtattttctcagacacacgtgcagagggctgcataatactgatacagagttgaaagatttttcaccttataaaaaatcagaaagatgttgcttaagttaatttctgcagactggcctgatgatctggatatcatttacaacattatttctatgggaaaataacaaacccacaaatgaacttctgggtgacaactacaaggtggaggattgcctgcattatataaacaacagatgttcatattataactgctaatttgtgtgtacacagacagatgtaaaatgtaaatacaaacctaattcatctttttagaaatatcagatgacttcatctatttttttatcttcagaggcagacaaaatgactttaaagtcagtactatatagcactaaaaattatttcttttagttatgtttccctacaccaagcagctagcatctgt

SEQ ID NO: 60025 - DNA, 900 bp, Bovine  19866881632857
atgaggaactgtggaaaactgaattattaatctagtaataggtcatcagttctctttgctgcccagagttttctatcactgatcatttatcactatccctacttttaacaaacaaacatttttctcttgcatgagaaaaatgagctctaaataatatatctgttcaaatgtgaatatgcaactgactgctaaatcacagattattttatggtatttaattcctcaattgtcattcatgccaaggagtgactcaattttccaaccattttatctattcaaacctgttaaagttttctttatatagtatgttatgacttcatttgcatgtgacatcaatgtttgattcatttattaaattctgtctctattcctctctcattagcttgagataaagtaatgcaatactgttatttaccatattcttctttgtgatgtcaaatcacactttcaatttattaaataactttggaagtaaaagtctaggtctatgaaaatgtctttcaattacaaattaacccaggatattatctgagttctgtcagaaacagaaatgactcttggtattgcaaatagaggaaatttgatactggtaactggatatatgcgtgatggaagacctgaggatttgtgcagaggaacatgaaacattagaagtacacaaagagcctaccatccccagaacagagaaggtagtgttagctcagtccaaaagccttgagttgtagttgaaactaaaatgatatccctgccctgccctgttttgccttaccctgtaagatttgggacaatgatgaaaaggactctccagtggtaactgaattaccaaggatatacagatactttggagataatgtctaaggtaatgagagatgggaaagaggaagacttatttccttcagt

SEQ ID NO: 60026 - DNA, 3971 bp, Bovine  19866880359943
ggcagtttttctctgtgtgttgtcctcattcccattcatgatgataagagcagtccttgcatattattaaacatggtttatatctgctcttctttgttttgtaggaaaacctgggtcttttttcagcagattcaacttctgatatctggaaaacgtatgttaactacattgatgatatgttgctggatggattctttcttgccattgagtgttccctcaagtacctcctggaaaatactggtatttagtggcttatggatgtgggttattactgggaagataacagccatagcatctgttgagttacagtgaagtgccattgagtgctcggtgacttttcccaaaaggtgtgaacactttgtgaagtgtacacagtaaaatagaaaaggcattgtgtctctgtaattgtttaaaggtaaaacacttctccctctccaaaacccagatgacaaaccaggctctaacacagtgaaacccgtagccagggtgaaaacacaaaagccgatttactctagggaactccctggaagtcagtagctaacactttgcacttccagcgttggggggcatgggcttgatccctggttggggaactgagacccacacaccttatggcatggccaaaataaataaataaatttcatggtttaagccaaatgtactctatctccgtggccttttgagaacacagggagtttgtagcagctggcttatgtagaagaaacagatgtttttctgtgtaaaaaaaaagagagacaagaagctggggatgagatagctttcagaagggaaaggtatattaaggaggcagcgggcattctttgaagctgttaaaagatagctaagggcttcaaatttatggttgatacacagggccaaagattttatagtaaaggctaaccttggttagtaaatgatgggatggaaaggggagaagagttcaaaaataaagttgaattaaacctttcacattctggtagattctgacatgctcagcaagactgaaggaagaggtgaggatgaggctagatgagagcttaaggcactgagtagaacccaagttaaatgcagagttagaataggtgggctgagaccagatctgggtatccagcccctgtaagaagctgatgatgcagagaggagcaaggccagcgctggggtaactccaccctatggtcctggtaggcgaagtgactgaggtcagaggcaaggtctctgctttcacagtataaggagacacagaagcaggaaatgggctcaggcctagtcaacaaggtgggagatcaccttctagaacctcgggcagtgaacacaggtgccgagactggggagctggttcctagggaccagtgccaatggtgctcatcttagtgaactgacccaacctcgtctgatagtggagctcggagactcgccactcagctctcctctagaagttctaggaagatgctgcagccacacttgagtgcaggcactgcacgggggacttgccccggctcagtgtctgtccagccttccggatctgggctgtctgatgtgtcacgtgtcctcctctcatgggaaggagagccagggagcaagagggtgaggacaggggatggtagccaaagtcatcttccctccgtggaagtaggaggaagggaacccacgccctccacaatgtatcggcagttaaggggcaggagctggccttaggagccacctgaggtatggttgaaatgaaaaggcactggttatcaaggggaggtgaaggagcctgaagagaacggcctctaagaggaaagccaccgtgacccttcaccatagcccagctggacaacttcagtcacctggtccaccttactgtctccacctctcacacttggccaaaccagtaccatttccatggcttggtctggcttcccagccacctctcagaatccagaccttgcctgagttaactgctacccactccgtctggaaacattcttcctcttctcaactcttaaagagattcacttgtgccaaggatgtggaaccaccaggccatccagtttgcacggtaattgtgttggtattgcatctgacatagggattatggtttcctgtggagtttcccaggtggtgctagtggtcaagaacccgcttgccaagcaggagacgtaacagatgcgagttcaatccctggatcaggaagatcccctggaggagggcgtggcaacccactccggtattcttgcctggagaatcccgtagacagagcagcctggtgggctacagttcatagggtgacaaagagatacagctgaagcgactcagcacacacaggcctcgccttctgcaaaggtccaaactctgtggactgtatttctctctaaatagatctacttcttgagaagagggaggctcatgagggaggggagatataattatatataatttatatatatatatataattatgactgatttgtgttgttgtacggcagaagccaacacagcattgtaaaatgattatcctccaattaaaaaattaaagaaataaatccacttcttacctaaaatatatatgtataagaaaataagtggttattaataagagtctaagcatttatcttgtaattggaacatcttattccatattatattttgatttaaatttagcaaggcagtttagtctagcaagtaatcaggaatttgttaattatttatactgtttttaaaaattttatcactacaggactacagaattaaaacaagtcctatttttacagaaaaggagcagatggggagggattgtgactgccctttttttccaagcctacacgaccttggacaagcacacccttgttcccctagtggctgccgatggagttgcctggtttgtgctcaggatgatgtccgccgcttccaagaaactggctttgcaaaaccaacaccttctcaaccagaggccgtattgccccacgggaagctttgagaatgtggaagcgttctgacttgggttgatcagtcacaggacgtgctctctaaggacaaggagagtaaatgccctgccatgctctgatgccggagctccagtattttagccacctgatgtgaagagccaactcattggaaaagaccttgatgtgggaaagatcgagagcaggaggagaaggggacgacagaggatgagatggttggatggcatcgtcgactcagtgaacatgaatttgagcaaacttcaggagacagtagaggacaggggagcctggggtgctgcagtccatggggtcacagagtgggacatgactgagcaacttaacaacagcagcagttccaggacagccacgcacagggaactggccttcagaatgccagcggtcagtccccgtgttgatcaacgctgcaggactgcccaccttcaccttttctggggttttagcaaagtttatatttctatttgctcagaccggaacagcagctctaaaggaaagaaacgctcggagtgctttcaaatcagtgttgcatttttgccacttacccactgtctcctgtttgttttctttgtatttcagaaggtaaggcaggactcaccccgatatttgaagcccagctgagcttagccatcccagaactggttttccgtccgtcactggagcctggtgtgaagggcggcttctacgacctgttggagggtctcgtcaccagcatcttcagcatggcgtccttggtgccccggctttctcctgagagtggctctccccactatcaggtactggctctgcgagcatctcccccgccctcccaccagcctggaggcccctgtgaaatgctaatgttacccatccactgccatcttgctcccccagggggacttggaggccagggctgacctggcgggcctgcgggccgaactgatggggcgggtgcaggccatgatggccctctgtggcgactaccgcagcaccctcagccagtactcctgcctctacacggaggaccggaagg

SEQ ID NO: 60027 - DNA, 1566 bp, Bovine  19866880455250
gaggcagagccttcctgcatggtgtgggggacgtttttcttgcaactcaagaaagatgggtggaccaacagggcgtgcaaaatatttttatcttttttccgtgccactctcttttcctaggctgaaatcattacataacattatctttgaaatgctgagccacattcagcttgaaggaaccaacttcaaaaaatgcatccggcttactgagaagtaactcaatcgactaacagaattctatattttaaaatttttttggctgtgctgggtgttggtcactacaagggctttttctttagttgcagagagtagaggttactctctagtagaggtgcttgggctttggagtacaggctgtagggcactcagccttcagtagctgtggcacctgggctcaacagttgtggtgcatgggcttagctgctctgaggcatgtgggatcttcccagaccagggatcgatgtgtctcctgcattggtaggtggcttctttaccaatgagtcaccagggaagccccggaactctgttctcttgaatagacccacacagatcccacggtactctgtttacttatatgttcatcaccccataagaaccctgccttcatcaaagagtttggccaaggatggagggaacagggtcattgtcaagcctccaaaggtgtctcggagaggtcggactcacctggaaaatgttggcgaagtccctgaggttgaagatgtagtggaatttgatcgctgtgggaaggaacgtggtggcgattttctggtggaaggtgagggccagatggagcagctgggggacactcttgtgcagcgctgccgggaagctccccagcttgaggtgctgagtcaggatggcgctgtagatggaggacagggcgtctgctcccgggaaggagagggtgagcacactgaagtgacgctgctcgggaaaacagagccacagggaggaggccacgagttacactctgtggtcacagaacagaaatcacctcttctggatttggatacggtggtcaagaattcttagaagggctttgaattctacattctggccacacttctcacattaaacccaaacttagttgagcctagaatgaatgaagggctttggacctctggtcaaagatgtcagtgtggcatagcagaaagagaagggaacctggactccgggtccaaatctgatcgtgatactgagaatgcatgtgaccttggcagggtcattcacccctctgacgttctctcattctgaaggccaagttgaattagactaaccctatgattccatctggctcgaaaagcttctttaaaaagtggtacaaacgaacttatttacaaaacagaaataagagtcacagatgcagaaaacaaactcatggttaccgagggggaaatgggaagggaggtataaattggaagattgggactgacatacacacactccaatatataaagcagataataagaacctactgtatagcacagggaactctactcaatactctgtaatgacctatatgggaaaagaattttaaaaaggatgggtgtgtgtgtgtgtgtgtgt

SEQ ID NO: 60028 - DNA, 965 bp, Bovine  19866880535652
tgcacactctactcttcttgtgacttggaccatccagcccccggggtgaggctgggaactgctggggtgcccacctgctggaccagaaggttgcagatctcttgcagcagcactgtgagccgccctgggcagcagtaagactcacacgtggcccagatcaggcagaccacgtgcagcaggggccgcagccggggcttcacgtcaggaaactccaggctctcgaggtcctccaggtgacgacgcagtggcgccaggtgggtgtagatgtcccgcgcctccgtcagagctggaaggaacgggagacaacccatcacagtaccagcttgaggctcacacccgcccagcagagccctggggcctgggcatgaaggataagaaaacaagggttgtgatctctttctgggctgagggagcagagagggctggccagctcttgcaaggaaacactgaaatcagaagagccctgggcagctgggagaggggtctgaggagcctctcttacagaattcttgtatctggacggcctcctggccctcccaagcccaggccctctggtgctgtgcgtgtagaaaatgcttggtgactgtttgctggtattacctctgaggtaatatgggatggatgacagaggacgggttttaagagtcagaaagatctgccttcaaatgccgatacatcaaatgtgtgacctcaggcatgactatcctgtctgaatctcaacaacaggctgaacagtcactcatgtaaagggttcttgtgaaggcagcaaagacggctagctcagtgcttgtaccaaaggaggtgttgcgtgcacgatcacatctctaataaatatttgccaataaagaatctcattgagctcttacggaggacaagtcacagggaatagagaaatagctcaggctgattatggcaaggctctgccggtcttcaaagccaggaaaacctcctgccatttccactga

SEQ ID NO: 60029 - DNA, 1494 bp, Bovine  19866880553703
tgaagaggcaacctaggagaacagcttttgttcagcatgaaaaaggatctccatttagcccttcaacttagcattgtgttcaagtcctgggacagtggctgagccattgtacctacttatacattctggtcccatccaggcagtgggacgttccgaagaaacaggcataatcagtcggacatacagtaatgtggttgtgcctttaatgaatgtgcagaggctgtgcagatcaattgtccatttgattaattcctctggcaggagagaattaaatgtacttaagcagtacaccagcaaaaactcaatgctctttaaaatgtgattttctgggtggaagccaatttttttttttttttctggccaagacatttcttgagataataatggaagtcaatgagaaaatagaatttgccgtataagtatgcactccacagtagaagagcatctcatgtgcagaacaaggtcaagctctgtacagtattcactgatctttgcagcaaatcaagttcctatttgcattcttccataggagaggtaataatgcctattttggtaataattcattgtccaaactttaccccgtccctctaggaggtattcagcattagagtactgctactgctgctgtgctaagtcgcttcagtcgtgtccgacgctgtgcgaccccatagacagcaacccaccaggctcccctgtccctgggattctccaggcaagaacactggagtgggttgccatttccttcagcattagagtactagagatctctaactccaaaagaggcaatcatcgccttcaacccatgggcaggtgtgaagacccaggaaaaaggaaagtcgtgtactttttattacttggaataacgtctgatgtgccaggggagaggaaggaaatactctggtatgggaagctgaatgcgtcaacccaggtctcagaaatcatttcactgcttttacacaaggaatatttctcaaatgcctgttatttgctggacatgatgttgagtcctggggcactatggagtagtgagccaatcaaagtcaatgcttttgtggaacatagagtccaaagctagagacagacattaatcaagttgctcaaacatataatagcttcatttctctgctctgagtgatataaattcccaaactattagctcatagtccaaggcaggcaaaaaaaccctcactgtcagagagaacacccttccggatgcccttcctgtttagaacaggtgtcttgctgagaatcaccacaaaggcaaagacatgtgagagggtcccctgtgaatgaaactccaggtgggaaagcttttccctgtacccacagcgaatgagcccctccaactgattgtgatccagtgaagccctagtaaaacccctgagacacctgaaccctcagagttgctgctgcctttactgttctagctacagagaaatctgcctctccccctgaactggacgctgtctgccttctgtcttcagctggggcagg

SEQ ID NO: 60030 - DNA, 1029 bp, Bovine  19866880845980
ccacttttctgctgcaggtggatgagctgaaagccaagctggccacccaggaagtggagctgaggcagaagaatgaagatgccgacaagctgattcaggtggtgggcgtggagtcggacaaggtgagcagagagaaagccattgccgatgaggaggagcggaaggtggccctcatcatgctggaggtgcagcagaagcaaaaggactgtgaagaagacctggccaaggcagagccagcgctcacagcagcccaggcggccctcaacaccctcaacaaggtaggaggaacgtgtgtgtgctggcttatccctctggggaggagcagcctctcctccgacccaaaggcagcccaccacgctggcgttccgagggacacaagggcacagtccagagggctgggctgggaccagctgccactggcttattcattgagcaggcagacatttacctacgctgaatatatgtcaggatgcacaggctgccagcaaaatcccagaggtgtgagtcctgaacttatcgggacaggaggggccaactgtccagcctcctcacttcactgatgagaaagccagagcccagagtcacagacctcaatgttgaactcacatcttcaaaatgcaagcccagagaccttatggctatgcagtccatggtcattttacttcttctgtgctataggacacataggcctcttacgggcttccctggtggctcaggtggtaaagaatctgcctctaatgcaggagagctgggttcaaaccttgagtcaaagcttcccagttggcgctagtggtaaagaacccaccccaatgcaggacatgtaagagacttcagtttgatccctggattgggaagatctcctggggcatggcaacccactccagtattcttacctggagaatcccatggacagaggagcctggcaggctacagtccatggggtagaacagagttggacataactaaagcgacttagcacgcacatgcatgcaggccttgtaaggccctatgaaaatgtttaagatatga

SEQ ID NO: 60031 - DNA, 1682 bp, Bovine  19866880907471
tatactgctcttctgaatgtgtttatcaatagatatcctcaaagggaactcaaaattctatcatgctaattatttccctgtaggaactccattttccacgtgcctccataccagagaattgggcatagggtgagggtctacttataggacctacccccatcactcaggctgcctgaccctctgctcagattgactttgactttgggaaacaccatcaggactgaagtagaggagagataggctggagtactttcctctggtttcctcccagctatgatgccatgtgcttcccaggggctgcatatgtctccaaggacctgatctccaaggaccattcagtttgcagactccttaaaaaactaaaaacagaactacatattatccagcaatcccattcctggtcataaacccataaccagaaaaccataattcaaaaacacacatgcaccctaatgtccattgcagctgtatttacaatagctaagacatggaaatactgaaatgtccatcaacagaggaatgggtaaagaagatgtggtacatgtatacaatggaatattagccataaaaaggaacaaaaccatgccatttgcagaaatgtggatggacctagagactgttatacagagtgaagtaagtcagaaagaaaaaaatatcctataatattgcttatatgtggaatctagaaaaatggtgcagatgaaaggtgttagtcagtcatgtctgactctttgtgatgccatggactgtagtctgccaggctcctctgtccatgcaattctctaggcaagaatactggagtggattgccatttccttctccaagggattttcccaacccagggatccaacctgggtctcttgcattgtgggcagaccatctgagccaccagggaagccctcaatgaacggtaggcactgtaattaattagcatcacctcaatgtcattagatcagattggtggctacgagatgtgcacagtagctgatactcaggtgctcctttccaggtggaagccacaaagagcgaggggtcccaggcagctggctggattgattgggccctattcttctgaaaactgtgcaacctttaatggggtgatgtggccccacaaacagcaagcctgttctcaggagaggccgcgcatcttaaaagaaatgtcttcagaattcattatgggcaaacacaaagcagacattcacagacgagaatctcaaaaggtcattgggaaaaagactgttttctttaccttctgaaggcagtcgaccttatgcagctaatggtctcctacgcgaccgagcgctcaggcctggctgaaagggaagcggcccaattagaccgaatgaaaggagctggcggaggggctggagacgtggaaagagcaagggaaatatggtagattgggtcagcttattacctaactgcctgctaatcactgcgcatggagcctcagcaggaaagcatcccatctttaagagaatcacagctttacagcaatttcatagtgaaagagatgggggttctccccaagctgcttacttactgcactgttggaggggagaggctgggggtggaaacacaaacagggcagctgcagaatctgcaatgttatggcacaacaacaaactgtatgtgtgtgtgcgtgcacgtattgcccgcagcgttgtgtacacagtgtatgt

SEQ ID NO: 60032 - DNA, 1871 bp, Bovine  19866881022911
gccgagcatgcacttgaaggtacagagtgacctactgtgatagcagttcagctcaggagacaacattggccacctccaaagtggcacagtgagtttctatggttaaatgtggggaatcccacattctgcagagatctggaaggctgtctgtaggaagcctcactcctcaactgtggggtaaggcaggttcatcctgggtgagttcaagggtgagcttcaggatccagggaaaggcgcagcatctgaacaaggtacacatatggggttgccctggcctgctcgtgctgcaggtacaggcgaagcatgtgtagacttgaacctgtgccatgtgttggcttcccaggcataggctgttactccagagaaggtgttggtatgttcctaagtaaccaggaagcattttcacaagtgcttcctggatggagcatcctgctttattgtagtaggaggctggttctcaaccctgtttccttggacagaggttctgaacctcatcagaaagctgccagctgctacctgggagtttcagcaagatcccgggagctattcttttttgggaccatggtgtgacagaagcagtcctggagcaggagttcagggtcatgggcttgccgtggagttggccctgaactccacggggaccttgagggagtcccttaaccccagagtgggtccaagaagtaggggcatcagcatcgcctgggagcttgttggagaagtaggctgacttgcagacccacccccagagccaggtctgaatctgactctgcatttaacaagaccccggagggcttccctggtgcctccatcagtaaagaatctgcctgcaatgcaggagacctggctcaatccctgggtcaggaagatctcctggagaaggagatggcaatccattccagtattcttgcctggagaatcccatgaacagacgggcctggtgggctagttcataggactgcaaagagttggacccaaccgagcgactcaaccaagccagcccgaagactaacttgcaggggcagtggagaagcacagcgtcgacccctctgggctgcatcactccagcgcgttcctggctgcagcattgcagtgtccccctcggctcactgctttctctcttgctctcaccctgtctctcccctgcagccgacaaggaggctgacgagtactacatgaggcggcggcacctgcctgacctggcggcccgcggcaccctccccctcaacgtcatccagatgtcccaacagaagccgctgcctcgcgagcgaccccgccggcccctccgggccatgtcgcaggaccgggtcctttccctggagcgaggcctgcctgacgaacttcggcctgccctacgaccgcctcctctcggacgaagcagctgctctccacggagcgcctgcactcccaggacccgctgctgtccccggagcggacggccttcccggagcagtccctggcgcgggccatctcgcacacggatgtcttcgtgtccacgcctgtgctggaccgctaccgcatgaccaagatgcactcgcatcccagtgcctcggataactcgtacgccaccctgggccagagccgcaccgcggccaagcgccaggccttcgcctcgcgcagacacaacaccgtggaacagctgcactacatcccgggccaccacacctgctacacagccagcaagacagaagtgaccgtgtgaccggcgggggccaggggtcggcaggggcctgggctgcagcttccaggcctggatgggtcccctcccctcgtcctctcttgttggggccggggggtgggcccgcctgtcccagaaagccatactcctgggactcggccggtggcctgccacagcgcgtgcgcagacctgggat

SEQ ID NO: 60033 - DNA, 1162 bp, Bovine  19866881041391
cctgggtgagggacatacaacaaaaatatcaataagaggctaataatgatatatttatggccagggaccacccccaccccaaaccacaacacgctagtctgctcttacagacttctataaggcagtgcaggcggcataacacgtcccacagacccacatgtccacagcaatcagagcgagggggcggacagtgggcagaatggaagatcctgatgcacgaggtggggaaaggtggggaaaaactatgtctcagagaggaaaaggggtctcccattttttaacttatctacaaaacaggctcacaaacaggagagcagacttgtggttgccaagggggaagaggtgggggagggatggacttgggagttttgggattagcagatgcaaactatcatctataggatggataagcaataaggtcctactgcacagcacagggaactatagtcaataacctgtgacaaaccataatggaaagaatatatatgtgtgtgtgtgtaattgaatctctttacacagcagaaaataacaacattgtaaatcaactatacttcaataacataagttaaagaatctcccttttctgaccttatgttcttaactatcagatgtgcaaaaatattagattcacctgtggctaataagatagcagctggttccatggataataccattcatttattatacgtatccgtctgtcatcttttctttctttggaggaaatggaaaaaaaaccttttaggaccaaagcttaaacccatggcccggtgggtctatcttgtttggactacacggtatttgagaaagaaaacttaaaagtttcctctattgaaaaattaagattttacataacaatttggttttctttaaaagtcaggtccgaggtgctggggcctgggggagagggctgtttgcttcaggtgggggtcacttacagcaatcttggctttaacggccgccagcttctcctgggcagcagcgaggtctgaggtggccctgctcagtgcttggcgcttgggttccacatcacagaacacctcgtgaaacttcacgatgtttatgacccaagaacagaggcctgcggctgcgtaagacttggtggccacgaactccggattgacctcggggtcctgcagatatggccctgatggccttggaggca

SEQ ID NO: 60034 - DNA, 1738 bp, Bovine  19866881056916
tttctctcttgaaaccagggaaatgttttgaaaaatattattcctgggtggggtcaaagaccttaagccagtgcaaagttgactggttcacagagaataaccctcagctttgccctttttttatcaccaagctccagacaagatccatcttaaactatcaggatctcctcccccccagagcagctgtgggatctctagaccacacaaaaatgatgatgagtctgacttgcaaaatatcaggacatgttaatgaccgcatggagcctttctgcacttggcggcagaaataaggcttcccaactttaggtctcaggaggaaacttttcaaatatttaaatagcctctgcctctgttgacatcacaaaatcccctctggcagttcagtctcctgctttcagcatgactacctacatcgcacagtaaatgacaggaatgttgtcaggagaaattggaggaacaagcctgaaaacgcaaactttgctcccaattcagaggtgctcgattccatctggtgctcttcttaagggattttgggaatcacgtgacaatggcctgagtgttttcaatattttggcacttaaaggtatcacagaatacaaatgaacttaatctccgaaacaaaaccagacccacagacatagagaacagactggctgtcaggggggaggcaaggggagggatggactaggaatttggaattagcagatggaaactattatacacagaatcgataacaagatcctactgtacagcgcagagaaccatattcaatatcctgaaataagccataattgaagagaatatgaaagaaagtatgtatatgtatagctgaacactttgctatacaacaggaactaacacagcattgtgaatcaactacacgtcaataaaataaatttttaaaaaaacatatcacataaacctgggtgagccttagagaaacacattttctataaagggtcagaaggttaacattttcagctttgcagaccatatggcctctgtcacaaatactcggctctgtcattgtagtgggaaaatagccatagacaatatataaatgaaggagtatggctgtgaccaataaaactttatttatggacagtaaaatttgaacatcatgtaattttcatgtcattaaacattattattttaattttatcaaccattaaaaattgtaaaaaccatgcccagcttgagggcagagacagagggtcagatttggcctataaatcatagtttaccccctcaatacccaacgtgaagggctttcctaatggctcagtggctaagaatccaccttgcaatgcaggggacacaggtttgatccctgctcagggaagatcccacatgctgaatggtagctaagcccatgcaccacagctactgcagcccatgcacctagagctccacagcaagagaagccacctgcagtgagaagcccggcactgaaactggagaggagcccctgctccctgtacctagagaaagcccgtgcgctgcagtgaagacccagcgtagccaaaaataaataactttttaaaatacgcagcatgttatccacaaaacaccaaaggacataaattttacctatgttaaataatagaaaggtgaagaatgcacaccaaagggaatccaagtttctcactggaggactatataacacatttacagataagaaaatgcagactctcagaggaacaaaggagaaagaaatccagaccactgcaggcagtca

SEQ ID NO: 60035 - DNA, 1794 bp, Bovine  19866881061795
ggtctcacatatactctcaagttgctctgtctttgacatcatctttgtctacagtctgccttaaaaatgtcctctgcccaggaaggtgctttcgggatcttattattgctgtcctgatgacccccaccatgacagcatttctgtttatgccaagggcatgtttctctgggttcccaaaactccagtccttgcccatcgtgatggagcaagattctgggcagaaacagagaaaagcctttccgactttgcataccctttactaccaggtcctgaagcagcattgctcacaccctgagtctcaaaggactctcacagaagcagaccctttttctttgggctctgactcctcttctcaacaaactccccgcccagcctatggaccttgtaggagaactgtagccattcagtcccttctgcctgcttggtttttctctttggagtcatctcaccaacaagaaaccaaagcccttccttcctcctttagtccagacaagagctcctgtgttcatagcttcatgcaaagaagtgtgttttcgggttgtgtagggactgagagatcccctgagtccagataccccgttactgctgtaagaccatctgaccactaggtgtgcctcagtggatgtgacctgaagcagtatgtcagggtcagagaacccgagctggacggtataggctggctgcagtggtccctcagcccacccctcccaacaggatgtttgagccagaactcggtgaaaactgcttgcttatgcctccatggagggagagctcttttctgctgtctcctgggatttgggtgatttggggttggaaaacagggtggtcctagaagtcatgtattgttgtatcctaaacacaactgaactcatccactttgccctgaccttgtctcagggcagcatcacaatcagagaaacagtctagcaaccaggagaagacgaaaaacacttcagcattttgatcccgctgttcccaccaagggggcagggcagtcataatgcacagaaaacatcttcagagtgtcctcgaaaccactgccttctgggggcaactgctctctgaaactcttttcttgcccctactctcaaattttagccctcctaattctccccaacagccagcacacttagcttcttgtttcttctccatcatcaccctccatctctgcatcgggtctttatgatgtatgtcagcttactctttctgacacctttaattttctcttcatgttaccctctacccagcttctcacaacacaagaggagggtccagtaggtcattcagcacacagggatccctccttcagaaacaaaggtgagatggacaggctatgagtatctgccaattcttttttttttttcttctgctgattcttaattgtccatccatgaccctcttaccttggaggacagacgtatgaaggaaaaaactgggctagaggattaatgtaacgatggaaaggtggggtctgtgacatttccccatcttcctctgcctcttttgcagctgctggacatagcaggaagcctcctggagagaccagtggtagcacaggatgcctctgaaagatacctggtgctcatccgcatgtttagcgaggatctggatgctgtgaggctgatccacagtcagcgtgtccaggaggaggcagagcatggtaagcttgctgccaggagacttggatgggggcgtctattagcagaaagggcacaggtcctctggttacacgtctgctgggctctaggacattctccaaaagcacaatcttcttgcataagatccagaccatct

SEQ ID NO: 60036 - DNA, 2127 bp, Bovine  19866881088262
ccgccacactgattaatcttcagcatacctcaattccacggtatatttgcacatgtttgagaaacggttctcatccctttcagtgccgtaccaaccatgctttcggagggaggagccatcaggagtctgacagcgggcaattacacacctaggtgtggcatctctgctgttattgcaattcttagatgccctgccttgtctgtttgaaagtcaaccagttcagttcagctttgcaaacatttcttaaggccatgctgtatgcaaggtccatttgtgggcactgcatgcagaggccgaccaggataagggagagaacaattaatcctaaaaggtggttcttcagggaacacaattggcatatatggagttataaagaactgtagcaagggacttgcctggcaatgcagtggttaaaactgtgtccttccactgcaggggacatgagttcaatctcaggtgtgggaactaagatcccacgtgccaaggggcacagccaaaaaaaagaaaaagaaaaacaacaagaaaaaaagataaggtagcaaaacaggatgaattgggctgggaggtgggaggagagttaatggagatggtggccttgtgctggaccctgaaagatggggagatggacagccagagagaagaggccatgccttggaagcaaaggcatgacaggatgtggaaggtgactagtcggacctgcctgtagccaatcgaggtgtatacagggagatcaggtcagccattgagtttgggaccaggtcatgaagttctctgaacaccctattagggaatccagaattccgttattcaggcaattggaaattttcagaagttttaaatgctggagtaacaggaccactctttctataaacaggtttcacagtaaggtcattaaggatggagttccctgaggaagtcatccagaaattctgttggcctcagctttacatggggctatccccagaacgtttgggaccatccctatggtgtatgggaccaccttcatgatacaggggttgttcgtgggcagagcagggctcagggagagagccacgcttcagtctgctgtgccctgtccccagggttctcctccgtgcacaagaacatgcccactgtggccgggggcctccgctgggcacaggagctgaggcagcgcatccagggtcccttcgacaactttagatgcatgacacacccgtgagtaccctgttcctgaaacgcaggttcatttcacacttccgctatctctctgaatttcgagcatcatagcagctcgactcacttccttgaggcacaaagatcatcttcttttcttcccaacaatcagccagtgtcttagtccattcagaaataccatagatgggggggaggggtggagcttataaacatcagcaatctcactttctcagttctgaaggctggggagtccatggtccaggtcccagcagatttggtgtctgttcaggaggacctgcttcctgactcacagatggccgtcttcccactgtgtcctcagacttggcgggagggactcaagagctgtctgaattctcctcatacaggcactcatcccatttgtgagggatttgccctgtaacctaatctcctcccaaaggcctcccttaggcttcaacatttgaatgtggggaggacacaaacattcagttcatagcagccaggtagctactggccaagggcttccctggtgggtcagtgataaagaatccacctgcaccacgggagatgtgggttcagtcctgggtcaggaggatcccctggagaaggaaatggcagcccactccagtattcttgactgggaaatcccatggacagaggagcctggcaggctacagtccatggggtcacaaagagtcagacaggacttagcaactaaatgacaataaacaaaccaggctggggtctgaagggagcctccacaacaccatctaatgccaaggagaaacaatgcaatgtgagaaatctcccaactgttggaaagaagccgaaagccttggaggtccctgtagattctacttcacttcatgggtgaggagtccaaaccactttcagtagccagttcataaatatattacagagtatacacacaaatgtgagttcatgatcaaa

SEQ ID NO: 60037 - DNA, 1966 bp, Bovine  19866881304660
ttgctgcctgaaaacacgggttgtcatgccacacaggaaaacaatgtgtcttctgccaaagtcacttaaaaagacaaatgtggggctccgcgggagagctgcctgacacctgctgggatctgtttttccaggagaactccggttcatccaggcctggagacacctgagtggtgtgctctgctagcagttatggtcacatcaccgtgagaaggagtccgactccagcggactgatggtccacctggtaataaagactggagcgcatcccccagagctatttgaatcatacccacgggaagtcaaccctggatgccatggggttacctggagcgggatagggtatgagctccaggtatgtgatgcggtggctctaggggagagtgggacagtcttagcctctgatactgggccaagctggcccatcaggtgggcttcctaagggggcgctacgattgctgggagactgaatggcaaattccagattctcctcacccccagctgtaggcaccccgtcctaaaatttcctgagcttgttctaggcacccagcatgtctcctgggtgatacaaagcagctcagtattgcaaaaggtgactccagttgaaataactagaacagagggatgactgatatttacagggcctgtagtctgtggggacaccccaaaatatcccgaagaaaaagtaggtcactggaggatctgcatcctgtaactactgtgagccatgagtgtacctgacatggagctgtatttccctttatgaagtgccgtttttgtgtgtgtgatctgggtctgtattttaattttttttaattaaaaaaaagggtataattgctttacaatgctgtgttagtttctgccatatgacaatgtgaatcagctacaaatatacatatatcccctcgctctggagcctccgtccgctcccttatcccagccccctaggtcattgcagagcacagagctgagccccccgtgctgtgcagcagctccccactagcggcctgttccacacatggtagtggctacatgtcagtcccgtctcccattcatcccagcctcccccctccacctccatgtccacatgtccatcccccacatctttgactctattcctgccctgaaaatagggtcacctgcaccgtttttctagacgctacatatatgcgttaatatacaatgtttgtgtttctctttctggcttactttactctgtatgacagaccccgagttcatccacaccactacacatgactcaacttcattcttctttatggctgagtaatattccattgtccatttttaatcgacacatttgctctctaagttacaataccgactggaggacattttaagcctcatgcctggcccaagaaaccacactggcattgttaaaattcccagtataaatggagtcttactggattgggcaaagacaatcaccttttccctatcatttaccatttgttgcgtcaggcacttacagtgctaactgacaagtatcatgtcactgaaacctcgcattattctatgaggtcattcacatttcattggtggcacggagttgcccaggatggcacagaatatatgtggctgaccccagatttaagctcacatctacagaatcgaaacacagtgtcctttaactctaccctgtgctgctgtcttgctagaacaagcaagcagagattcatctgcagcatcagttgcagagctggatggagtttctaggggggtctaggttctcttgtttttattttaatcactgtgttgtgtctgactctttaggaccccgtggactatagactgccaggttcctctgtccacgaaatttcccaggccagaatactggagtgggttgacatttccttctctaggggatcttcttgatgccaggggctggaataaaatgaaaaacaaacaaaaaaaagcatttataggatggggaagatcatgggagccgttg

SEQ ID NO: 60038 - DNA, 561 bp, Bovine  19866881323427
acagcatgagttaccgggagggtctctgtgggtaacgggggccctcctgcctgcagtagtgagccccccaaccccagtgcgattccctctcctgaaatgccccagggtgctctgacagcatgtgagtctcccactagcccacagttcgctcctcctgtctcccgccacacccgccccgtctcccccgaccccaggcctgcctggtgcacaccagcgagaccatatgcctctgctacttcctggagcggctcctggcgcggcggcggcctgtcatgctggtgggaactgcgggcactggcaagtcggtgctggtgggggcgaagctggccagcctggaccccgaggcgtacctggtgaaaaacgtgcccttcaactactacaccacatcagccatgctgcagggtgagtgtcaacacctcaataaccaagtgaatcggcctgcttctcactgcttataaagacaggtactcactcaccaacgagggaagagacatgggcctttaatcaaagtgccagcaatctggggagacggtggattcagtgtctcccaaaaactacttc

SEQ ID NO: 60039 - DNA, 1607 bp, Bovine  19866881324276
tcttatcctggcatcagaaatgtatttcaatagaatcgttttcctttgtaatcgtattcattccattttacatactacaaaacattactgtgagaaggaatgcatcggttttatcagactgccaaaagggtccatggcacaaaaatacttgagtccccaaagcagagccagaaaacacctcattaacctgctattgcgctccttgccttcatttgttcagctaatggctgtcctttcaacgatttcctttccacaagtgttcaaagtgaataaataacagcttaattttttgtttatttcccagtactgtaacggtttttttttttaattaaaaaaaaatttaaacaattttttggctgtgccatgtggcatgtgggattttagttccccaacaagggatcaaacctgtgccccctgccttggaagcgcagagtcttaacgactggaccaccagggaaatgcactataagagtttttaaactactgttcagcaaattatcaggtgggtgggattttatgagctgatctgagaagccaaccatcactagacggtctgggctttgtgttccaaggagacacctataaatgcattctggaacacaaccctaactgtacgtggtgattcttctgtgctaactctcaggcagctgcttcttatgactctcgtcttgactgcgggactaagactgtcccgccgacaccctggtacggactgtcttctgtgcctcccgccagtggcatgtaggacaggatgaagactcggcaagtgcttgtgggttgaggaccatgagcgctgtgagagtgtcgaggggcaacacaccctgagtcctcttcggttggaaactggcatttccccatcaggtcatgtcagcgtgagccacctactcacactgagagctgaggacgtttgaccaaagccgatgaactgccttcataggggtgtctgtaggtcacagacacagacgtggtgctcggggcacagtaaccaggggggcagcatttggggaaggaggtgtgccctccactgctgctattaagtttggcacaagagcaggaaggttggagggaaatacaggatgtgtttggtgcctcgtgggtttaacagttttgagaacagtcaggagacagcatggaggtggtgggccagagttcccacgcagaccccagaaggaggacaggtgctgtccccaggtgacctggagggcagtgcatggcggtacatggaagtgtggaaggacatgggtgcccaggtctccgtcctggatcccggaggtcactaggggatgctctggaggtgacgggaggaagaacgcaggaagggactagaagatttgcattgctactgtcacgtgagctcacgagtgacgtgggccagacacacctgcagctggctcaggtagggcctccacgccgcgtctaggaggctctggcggtaccgctttgtaaagaagcccaggtacgagatggaagctgcagtgagtaaaatgtctccacataatttcctttcctgttgcttgaggttctgcacagcttctgcccatctcacgttttcagaggccaggcctcccacctgccattggaagagcagagagggggagaaggcacgt

SEQ ID NO: 60040 - DNA, 1963 bp, Bovine  19866880514973
tgatgggaccagatgccatgatcttcattttctgaatgttgagctttaagctaactttttcactctcctctttcactttcatcaagaaacaccagagatcccgataaagtcagagaatacatataagggagatcattctgaggactcagtcatttccagctagccagtcaaatgtctgatcatatctatacgtaaactgggctacagtgagacctaactccattagaactcttattgttaagcgcgtcacatccgggagactcgccgttaagcagacatttttccaaacagggattacaggtgcttcccctccagtaaattaagtccccaagagcagaagtgaaggaagcacatttgctcacacacagactgagtataatactggcccccaatcaaaaaccatcaggaagtcagaattcaaggcaagcccctgtcctaaaatgactctttcatgatcagattccacaggttctcagagagaaacgcccacgtggagcttctgtaggttcctgagcccagaagccacagggtccccagggacaaatccgggacaagccacaagtacgccaaagctgcgtgacacacgtggtgtgtacactgtcagtgctgccttctcagttcctcccactctctccttcccctgctgtgtctgcaagtccgatctctaggtctgcattggctcaagagggaggggatatgcatgtagttacgactgattcatgccagtgttgttgtacagcagaagacactgtaaagcaatcatcctccaattaaatatatatatatatatataacatattaaaaaaaataaagtaaaagaatacagacaaaaaaaaaaaagtctgacagaacagtgggtacatctgctacatgggagcaggtcagggccaagacagagtcacatctccattcaaagccaggcactcggtaccacttggcaatgtctccatgtgtccctttcctccgtcattccctatggtggctattcaagacctctcttagaaggcggccttggggcttcccaggtgggtccagtggttaagaattcaccttgcaatgcaggggacatgggtttgatccctgttctggaaactaagatcccatgtgccacggagctactaagcctgcacacccaactagaagttcatgtgccacaacaaaagatccacatgaggacataaagatcctgggtgctgcaactaagacccaacagagccaaatgaatacacatttaaaaaaatagacgaatacagccttgctggctgtaaatagacaccaagactatcagtcatgaactttctccatctcctctctctctctgcacctacaaattattgcatttatacttactgaacacttctctccttccccagtcacaggaagacatgtcctgtccaaggcaattcctcacactgctctcatactcaattcccttctccctctcggaaacatttgccgccattctcacccacaaaccctttcagactctttcccaaaagcgttgaacaagcaaaccttgtgagcacatgaaacctcagtttcagctttcctccttctcttatcctgttttcgtagtctcagacttccttgtcctctggtccttagtcctctgtcggggtctttactagtgttttctcagcactgactgtgccctggaatcatttgcagtatgtgcctagagattgtgattcacactgagctttggcatcagtattttgcagatgttacatgtcctccactcagtcactttccctcctttgttgctccttttgggaatggcacacctctccatctgttcattcaatctagaaaccttgccttctcctcctcttccaatcaatcactacatcctatcaatctacctcctttggtgtgcatgcatgtatgatcagtcatatctgactctttgtgaccctgtgggactgttgcccaccagcctcctctgcccacagaattttccagg

SEQ ID NO: 60041 - DNA, 1564 bp, Bovine  19866880550918
agcttcttttttttcttttttttctataggtaagaagtagatttattcaaagagaaacacactccatagatacagtgtgggccactacagagggcgagtgctgtggtcttgaaatgcggccatggttagtttttctgggccggacaatttcataggctaatgaatgggaggattagtctatctatttgcggggaggggaggagatttccaggaattgggccactgcccactttttggtctttaaaaaaaaaaaaaattatatttatttttaattgaaagataattgctttacaatactggtttgatgtctgccatacattaacatgaattagccatagtctatatcccctccttcttgaacctccctccctcaggtgaggttcttaaagctgttgtgtttactaatacagctccaagtttaagtgcctaacacaatgcaggtgattagtaaatatttattaaatgaattaatgactattatatgaatgattattgtcctgtgttactaactacatcctaaacaaacggacttcagtcggctttaaaagagcatccatttattcctagagagatcagaaataaataccttactgccatgcttgctcaaaatgcttagaacaaagtgcaacagtcataaccatataacaggttatcagttcagttcagatcagtcgctcagttgtgtccgactccttgcgaccccataaactgcagcatgccaggcttccctgtacattaccaactgctggagcttactcaaattcatgtcccttgagctggtgatgccatccaaccatctcatcttctgccatccccttttcctcctgccttcaatctttcccagcatcaggggcttttccaataagccagttctttgcattgggtggccaaagtattggagcttcagcttcagcatcagtctttcaggactgatttcctttaggatagactggttgaatctccttgcagtccacaggattcttaagaatcttctccaacatcacagttcaaaagcatcaattctttggcgctcagctttctttatagtccaactctcacatccatacgtgattactggaaaaagcatagcctgactagacagaccgttgttggcaaagtaatgtctctgctttttaatatgctgtctaggtttgtcatagcttttcttcaaaggagcaagtgtcttttaattccatggttgcagtcaccatcttcagttattttggagcccaagaaaataaagtctttctttccattgtttccccatctatttgctatgaagtgatgggaacagatgccgtgatcttagttttttgaatgttgagttttaagccagttttttcattctcttctttcactttcatcaagaggctttttagttcctcttcactttctgccataagggtggtgtcatctgcacatctgaggttattgatatttctttcagttgagctatctcaaatcctaaaagattttgccgttaaagtgctgcactcaatatgtcagcaaatttggaaaactcaactgtggccacagaactggaaaatatcagttttcatttcaa

SEQ ID NO: 60042 - DNA, 2056 bp, Bovine  19866880596646
ttaatagtgatttcaaagggaacgtcaactgtcgtgtaatctaattacccaggatgtctgtgattctatcaattatatctcattcatttcacaataagtttgaatagcataatgatatcattacatttcttaagtgaaaatacttaggcacagaatcataaaatagtttgttccatcagctttccgatatttttttttatttttgaaaagcaagctatgactatgattgtgttattatgattgcatgtaaaaagcaacctttcttctccacattgattctgttttgtggatcagtataacagctttagcagcaatgtttttaaggaatttgtgatggtttaattgttgtttttattttctttttgagatgtgcactatcctgatcaattctagtctatgacttatggtgagatttattaatatatgtgtatgtgtgtgtgttggagaaggcaatggcaccccactccagtactcttgcctgggaaatcccagggacggaggagcctggtaggaggccgtctatggggtcgcacagagatggacacgactgaagcgatttagcagcagcagcagcatgtgtgtgtgtagtaggtgataatctttggctttggtttttaataagaattttttaaaaatcagttataactaggaaacttttcttccagtttttacccagttgtctttgattccctttggaaatagtggacctgacccagttcttttttgagaattcatttcacagaacagtatgttaaaatatttttgttattctaatcaagtacaatgtaagaactggctgtcatccatagtttctgttctttaacatgagaataattctgttccttggttaagatactcttccattattatacttaactggtttggatagcaggctatgatttgaggaacacagctatttcatacataaaataaatgatttttctctgcaagcattttttaatcttgattttgtctaacttgaagtacataatgatatggtaaaagtactggtaaaagaagaatcccatagatactagaagtgaaatttattgttgaataaaattcagcttattataaaatatagcatgactttattgctacatcaggataatttttaaaaaattgatccagctaccttcccttgtttgatttagtattcatgtaagtcttagtataataaattgacatttagttttaaaagtaattttagctaagttgtggcagagaaagaaaatatatattgggttaactcttaatgattatacccttaacctatttgtaggaacgaacattgaggaccatttataatatataatattaggtttctatataatcttctgggtgtttaaagtacagtgttgttgttcttttcttatagttggttagaaaaaaactattatttgaagggaatagaatggaaaagcaaaatgaggaaagttgaggagggtgggatatattagttttagagggcttccataaccaagtgccacaaactgggggacaaaacaacaggaatttattatctcatagttcagggttagaagtctgaaactaaagtgttggcagggatgtcctgtctgacggctccagtgggaaggatccttccttgcctcttgctcacttttgatggttgtctgcagtccttggcttatggacgcatcactccagtttctgtctccgtcgtcacatgacattctccttgtgtatctctgtccaaatttccctcattttataaggacaccagtcatattggatataggtttagagcccaccctaatcaactctaacctcatcttaacttgattacatctacaaagcccctgtttccaaataaggtcacattcatagattttggattgatgtaaatttgaagggacactatttaagccaaaacaaagagttctaaattcaatttatattttgagatttgaaaccaacacactggatttatctattttatatctaacaaatggtaagatgcattttatgtagaaagcttatttttattttgcagttatatttacacgtaggctttcctgtgtcacaggcctaagta

SEQ ID NO: 60043 - DNA, 1607 bp, Bovine  19866880614152
ctaagggatgcagaattgtttgataggaggtaggtgcccaccacaaacttgctgaatcttccatgtattagctggtgttcagaagtgtctgtaatctggctcagctcatgactctttgttttgtttgtttgtttaagggaatatagttggtttacaatgttgcattagtttcaggtatacagcaaagtgaattggttacacatatacaacatacatacatatccactctttaagattctttttttaacacatatatgggagaaggcaatggcaccccactccagtactcttgcctggaaagtcccatggacagaggagcctggtaggctgcagtccatggggtcgctaagagtcggacacgactgagcaacttcactttgacttttcactttcatgcactgggagggagggaaatggcaacccactccagtgttcttgcctggagaatcccatggacggaggagctgccgtctatggggtcgcatagagtcggacacgactgaaagcgacttagcagcagcagtagcatacattctttttttttttttttaattcctttccattatggtttatcctaaggagattggatattgttccccctctatacagcaggaccttgtttcagctcactgctcttaaattcaatagtgtagggatagtagaggtgggggaagtacttctctgacagtccagtggttagaacttagctctttcactgcccaggtttgaaccccggtcagggaactgagatcccacaagctgcatggtgaggtacccctcaaatagtgtgtgtgtatgtgtgaaagcagttgcaaaccataagatcctctttagttgttaaacattatttttattattctctaccatgaaattcctcctgcaagtatttgttcgctaagcttggctttatttcaaatctccccagttccacctttttaccatctagtctggaggtttgcttttctgtggagccttcagtatggactccagctccaacatgatctctctgtctcttctaaattccttaaacacctcctacccattacgtatgttgttgttgtcatccctaagtcgtgtccaactccttggtgaccccatggactgtagcccaccaggctcctctgttcatgggattttccaggcaaggatactggaatgggttgccatttccttgacatttaaccatatattacttcatattgttttaaagtaatcatgtagggtgaatgttttataaattgtgaattttccaacagtacatgataattgctcaaaaaatatttggtccacaagtggggaacatttgaaaacattagagggaaggtctttttttgagtttggactcgggagaatcaagtatcctctacaaagaacaaagagcatcactggaaagaggaagtttttagcagaagtttgagataagcatgaacaggcagaacagagctgatgtgggaagtgagaggggcagaggtggtggcgaaggacagaacagaggtcaggaagcaaagtggacacccaccctgcgggacattcctagaactcaaggcaaagctccttctttcccaagtccctccaatagctattttcagccacgtccaattttagaa

SEQ ID NO: 60044 - DNA, 2582 bp, Bovine  19866880731515
aagagtcattgaaatactttgagttctctactaagaaacacctgcccttgccttccaaatccctatctaaaagataaggcaaatctcttctgcatttaataaggacttttttgcataccattatatcacttaatatttacaacaatcttgccagctcagtagtattttactcattttgcagagaaaaaaaaaacaagattaggtttggttaagtgacatgtccatgatcataaaactagccaaattagaattcaactcaagtctccccaaagcttctactactacaccaagcctgtcccgtcccttcactgccctaaggaaatagaactcatctgcagagaatgtgtgtgaaagtcgctccatcatatccgactctgcaaccccaaggactatacactccagggaattctccaggccagaatagtggaactggtagcctttcccttcacaggatcttcccaacccagggatcgagtccaagtatcccgcattgtaggtggattctttaccagctgagccacaaagggagcccaattaaataataactaagactttattttaccggtttttaagatgactctcagtttcagagatgttaatatgtgaaaaaatatgtatcttaatggatgaaataggatatatgtcgtctcacttactgtgtttttaggacttaattgtagtttctaagtaaaactacttcatctctatcgataggcttcaaatatcccctttaaaactaccaaatatgggaaatacagttagaaaatcatcaatcacacacaagctcccaagtaagtccggattctctaatctttccattgatctgaccctgcccttaaagtacactgctttaattacactaagcttgagccacaagcgaagcccaagaatactagcgtgggtagcctatcccttctccagcggatcttccggacccaggaatcgaaccctgcatttcaggcagattctttaaccggctgagctatgagggaagcagagaatgagtaggggctatgcttttcggatgtcttggccctatttgtgacctgcctagtaaccggcaggtaagaattacagaaatcaaatgaatcgctgtaaagtcggtgcaagatgccgcagtcttggtgaagacctggtctcaactgcacatactgaaaaataatttcataatttcaatacagcactttaagaaactgcgtggaaaatcgcggggctgtgccctcaagtggtccaaacgagcctttcgcgggagctctctactttttcagctgtacaaggccaatatagcaacgctgccgttttctgccagcctcccaaagccccgaaaagccctgggctcaccaaaagcaagggcgcccgaccccgcccatgcccaggaagcaccgcgcatgcgccttcccagcttctcgcgcggctaccaccacctggtggcgccacttccccccacatccgtttcacccgcgcagcccgctctctcgaaatacctttgtctaactccataagggcagagttagcatccagctcctgttcgccatagccggcatctgccagaaaagacttagttgagtttgacgccatgacccatacagttactcgattagcctattcatagagattgcaaactcggccccaccaccgccatcttcttccaccaccttctcgcggatttttcctccgcgctctgtcaagccgtgttacgcatgcgccctgggctcccagcagttcgccagcgcccctgcggccccccgcgcaggcgctcagggagctctggaacgctaggttcccgcggctgggcgagaaggaggcggggcttcgaagggggaagtgactcgtacgcgcccggacgccgcggcgagagccaatcagagggcgtgacgtcagtttggcggggagtttggtgaccggggcttacagtggcgggagttggaggcattagctagtcgtggtctaaggggcgcagggtacagtttccgctgaatctggaggcatttccacggctttttcctcagttgagcgttttcctccgtcccagatgctcttcaattcggtgctccgccagccccagtttggcgtcccgagaaatggtgagtaacggccctaaccgctgtctcttgccggcgggattcacctcccccagaacaactcttcggaccaatgccgatttcagttcagtttcccagccgccgagttctcccccagccagaatgagttcgtactagctaggaatactgaagaaagccgcacttgcgtgccctcgagatacttttcgtcgtaatcgaggctttttttagtcgtgtaggctgagggagggagggacgttgagttaactgacctccattacggtttatgtctgttttgcacgttaactggaaaacgcgtgcattttcgtgtgtgtggctttctgaacgaacagctgtgtgagatcgtcaaggctcgtactcattgattaattcattcatttgtagtggaaacagtgagccctaccgtttgctatatacaccagagaataggatcggctcttaaaaagagctcagtcaggcagagagaacagaacatctgcttctagcaggtcagaatttttt

SEQ ID NO: 60045 - DNA, 1493 bp, Bovine  19866880789377
tcttcctgcttcatgaaaatcgggaccatcttcgtcttgttctcagtgtgtccctgatctagagcagtatctggtacaaaggctctcaacaagtatctgttgaatgggtaaaagcctaaataaagctgagcagagtaaggggagatgcagaggtattgaataatactttcttctacttcagaatgaatattgatattatcacggttatttaaaatttcctgaggttagccagcttcattgcttaattcatgccaaatttttcccttttttgcaggtgatcagaggattgctgaaattttggccaaaaacatgcagtcagaaagaggtgagttttaacaaaaacagtgcattttattagaacttttcaatctcagggctataaaccgtgcttccttgggttgcgggtatcaccaccactacctaccaaggggacactgttctgtggggtttagagaaacttggtggaagagctgtccattatggtaagtggcatgtactgtcaaggtatttttcgtccactgttaaccttctcatttgtgttttctgtattaacatcatataatttgtcatattatgtttcttaaaagaaaatttttttaacctaggtgatgtttttaggagaaattgaagaaatcttagatgtcattgaacctacacaattcaaaaaaattgaagagcctctttttaagcagatatccaagtgtgtatccagttctcattttcaggtatggtgttttcagtgaagccatttttattttacactattacttttcttagttttgatgtttctgaatgtcttttttaggttgcagaaagggcactgtacttctggaacaatgaatatattcttagtttgattgaggagaatattgataaaattctgccaattatgtttggcagtttgtacaaaatctccaaagaacactggaatccgtaagtgtctttaatgttgattgtgtcatttttgtttttctaacatctttgtcatttgatctcataactcatacataggaaacctatacagatttggaactcccaaggttaacatcacatggttctattctgcagtgagttttatgaagttgtacatatatgtgggtctgtatgtttgtttgtttgtagcagagaaaggtttattgcagggccaaatgaaaagaatggggtggcttatccttaaaaactctgaactcctgcatgttcttaatttcagtttagaattgcaaatctagggactgtttggtatgacattctgccagtatccaggctcacatctcagctggcttagcccagggagaagcgtcagtgctcagggtcacgtcagtgatgtttagattgcttatgttctaaattctgtaacatccttatcctgttgtctacttttctttcttctaacaagtcatagtaattgcatctttttcagctgcttttaatactattattcaggagttgtgatagtagactctagagtagtccctgtgttccctcaagctcag

SEQ ID NO: 60046 - DNA, 1351 bp, Bovine  19866881115258
agttaagtggtctcgaggggtggagaaagggaaggaaccgaatgagtctgacaggaattctgtcaaaaagttgttcaaggaaacaccgaaaaacctccaccctctcagtctcttcaactggttgctttggggcctccttttccttgaaagtgaagttccagggagataaacatccatggaaaccaacaggtcttgaggcaaatgtgaccccaccagctgaaaaacagtccttcccaccctgctctcaggcggatccgtaataaggactgaggaagtgaccttttctcaggaagtgggtggatgaatgacctagaattcaacccttcccttcgtggaagaaacctatcgtctaaaggagggaagttgtcaaatgtgctcctctcagggcagaaggaaaagggagtggcaggaacaagttactgtccagcagtaggttttagaatatattaacagaagagaaacattttctacaaaggggcacctgtttcctctgaggcaagaactggctcctttaaagaggaggctgaaaattttctctggaaaatgtagcctctacttttataattgtcccagttggacaccaagaggaattttttcatatgtgatattgatgtgttatttattgactatgtttggtttcccatcaccttctattgaaactgctgggattcaaactcagtagtgtgtgaagaccctggaccagactgagagtggggagacggatgagggagctgacctaaggactggaggtagattgggagcaaacagctaactcaattgtgtttgactttctatgactttatttgaatttgaagttttattatgaaaggaatatatgtacctagtcaacttggtgtttttattataaaagtaatttaaatatccagtatatatattacacaatgaatataagaacctcgtgtggaggcattccagcattctccccagatctgtggtgatcagctccttacatagtcttatgaaaaagcatttatgcatagctaactaggacagtgtatcatttgtttaaaaaactcgcacagagcttccctggtggctcagtggtaaagaatccgcctgccaaagcaggagacgcaggttgcatccctaatccagaaagatcccacatgccgaggaacagctaagcctgtgcaccacaattattgagcctgtgctctagagcccgggagccacaactatcaaagcttacacgccctagaacctgtgctctgcaacaagagaagccaccacagtgagaagcccaagaaccacgagtagagagtagcccaggcagcaatggagacccagcgcagtccagaataaataaacaaatattattaaaacagaaaca

SEQ ID NO: 60047 - DNA, 1737 bp, Bovine  19866881344598
actttcttgcctcctgagaaacctatatacaagtcaagaagcaagagttagatctggacatggaacaatgaactggttccaatctgagaaaggagtacatcaaggctatatcttgtcacccagcttgtttaacttatatggagagtacatcatgcaaaatgctgggctcgaagaagcacaagctgacatcaagatttctggaagaattatcagtaaccttagatatacaaatgacaccacccttatggcagaaagtgaagaggaactaaagagcctcttgataaaggtcaaagtggagaatgaaaaacctggcttaaaactcaacattcagaaaactaagatcatggcatcccatcccatcacttcatggcaaatagattgggaaacaatggaaacagtgagagactttattttggggggctccaaaatcactgcagatggtggttgcagccatgaaattaaaagacacttgctccttggaagaaaagctatcaccaacctagacaacatattaaaaagcagagacattattttgccaacaaaggtccgtctagtcaaaactatggtttttccagtagtcatgtatggatgtgagagttggactataaagaaagctgagtgcagaagaattgatacttttgaactgtggtattggagaagacttttgagagtctcttggactgcaaggagatccaaaccaatccatcctaaaggaaatcagtcctgaatattcattggaaggactgatgttgaagctgaaactccaatactttggccacctgatgtgaagaactgactcattggaaaagaccctgatgctgggaaggattgaaggcgggaggagaaagggacaacagaggatgagatgattggatggcatcaccgactcaatggacatgagtttgagtaaactccgggagttggtgatggacagggaggcctggcgtgctgcagtccatggggtcacaaagagtcggatatgactaagcgactgaactgaactgaactgaactgtatatgtctacgtcccccaaagtggcagaatcatgtttatttatgaagaaaataaaactaattgaatgaatgaatacatcagtaagtgctttaggggatagtaagcaagagctgttgtaaattaattatccttatcatttgcatgttttttcttgcaactaattcagtcagtcaaggggtagccatagagttctgcttcttgtatttgaaaaagtatctgtgaagtaaggaacttgattcaaatacctctatgttcctttcaagctgtaaacttcattaaaatcagacctcctcccatatgtaatggcctgattctaaagctatttagaactctactagcaaagcagagaagcatctacattgcctacttatttcctaccagtttggtttaatcctctacctttaggagaagttagaatttcccttcttctaattactcattttagtaacccaaggcaggcactacttaatcccattgcttatactttcccaagggaatcaaattaaagtacctttgatttaaatccgaatctttgaatttagtgtagtgttctgtttgtcatcttacaagtaaatgaaagaagctatataaaaggttgagaaaacaaaactttgaacaagttgaggattttgtgtagagtgaagtacttttattggaacattctgtaaaaagcaacaataaaagtcttagctacttcaattctcaggattaacaaaatacat

SEQ ID NO: 60048 - DNA, 1022 bp, Bovine  19866881355968
attatctgcatggtgggttggctaatttccattccaggctcacctcatggatatggttctccatcacctctccttgctgagaagttggcttccagtcaaagtacataggccatttaattattaatctgagcaaaacattgttaggaaagttaaactgttgagtgtgtgtgtctgtgtgtacacacgcggatgctttctgggttatctggctgttttgttttttctgtttacttttctgggcccctgctcctcaccattggtggagacgcctataaggtgatcatgaccaacagtgaatccctatgagctgttcggtccccggctccttggatgtgtgtggaaatgtttgtcagctgtagagggctcagtacaccaaaagtggctgaccttgaccttcgattggacagtgtatctgtgaccaggaaaaagttcagtgttcatgtttgatgatggttttatgccctcctgtcagtagaaagtattttatagagcttgctgatggcccagggctccaggaactatcatcattatttagccaatgattttaatgagtctatataaactcattctatttttacattactaacagggaggggagaagttggaagattaaacagaggggaggatgggttttagcttcactgctcagggctactgggaagacttttacagaattgctgctgctgctgctgctaagtcgcttcagttgtgtccaactctgtgcgaccccatagacggcagcccactaggctcctctgtccctgggattctccaggcaagaatgctggagtgggttgcccatttccttctccaatgcacgaaagtgaaaagtgaaagtgaagtcactcagttgtgcctgactcttagcgaccccatggactgcagcctaccaggctcctccgtccatgggattttccaggcaagagtactggagtgggttgccaaggctatggtttttcctgtggtcatatatggatgtgagagttggactgtgaagaaggctgagggccaaagaattgatg

SEQ ID NO: 60049 - DNA, 771 bp, Bovine  19866881636836
acccttactgctgtcctggattgcctgtcttctcttttggcccttttaaacttactagctggcaggctttgaatcgcaacacacagccccattcccttctgtcctacttttcccagtcagcacctgctccattacttgctattcttttactgtttcagccagcgatctcagcactgtcaggccaaggggttctctatcctgtctgtgcatcagaagcacttgtggagcttttaaacaatttgtatgcctccagaaattgttaagtaggcctagagtagagaccaagtacatgtattaccataaagctccaaatgagtccgatatgcagccagactgagaacctctgctaggtatcactgagtgaaaagatgattatcttaaaaagaaggaaatgttagctgttctgtctcaagtgcttgctgtagacttaaagtcaaacacagtacttacacaatctgttctttgatggctggaacttgaccctcatccctgtcagcagtaatgaaatttaacaaacattgtttaataattccttgctaggaactacagcagcactagacctaaaaatgagtaaatcattatcacttgccctctggatgctcatagtctaatccaggaggcagctacaaaaactatagtatattgtaaacatttcacctagctatgtaaacaaaagggtttgagaacttgcttcctgtgggagaggaagaaagaagtttgtgaaatctgcacaaaggagttaataacactgtcatcagagccggaaaagaa

SEQ ID NO: 60050 - DNA, 1443 bp, Bovine  19866881848069
aaattattaaaaaaatttttttctggtttagaaattggaactgacaacgtctgcaaggcaccagctgagtggatcacgtgctcagaggagggccaggcagggagcaccagaggctggtgaaaagcgcagtgtcacagctcacagctccccttcccctgctgagtgatggttctgctcccccacgttcatcattagccctttccatctgctgactcattctcacaccgctccagccccggaaagctgagcgtgtggaaggaggcctattaatagccttttcctgggaaactcatcccagctatttctaagaccgtgtgaaggcaagccctgaagccctgcccctcatcctcaccccctacctcaccagcccgctcctcggagttgacccgtgatagttgtaggcacgggtggagggtgggtgcccagcaggctctggaaggtctgttctgtcccgtctacatttgtcaagatttcaaaatggtggcctgtccgttttggccagagagccaggcgtgggaacggtcctctgcaggggctgacagagggctcctcgaggtaccccacacatggagcaggtgagcgagaggatgcaggacaaaccctggtggagggcagggagacacgggggcagaaagccacagtgccagcaagcagggctgggtttgcctgcagaggggctctgtggcacacagactgcagagcccagagggcacccggcctgcgcgtggctctcgggcagtggtgcccaaggctgcctccccgactgaaggaaagttatctggctcaaaatagcctggagttaaaactcccctcagagtcctccccaccattctatgcaaaacaaagaagtctctcacctgaagaaaaaaatgtgacattaaggttgactgtgcccagctcccagcaggtcccagcctctggcggatctccagaattccttcccccagccttttagagactactaatccgaacaaccttggagaagaatgggccgccttaagacagtagatttccacatacatgcctatatatactgcttcttttcttgggttagtgcagcagctcactaatctgactgctgccccttctcatctcattaaaggtgatctgttcctataaagtgacagttttattctttttccaaaccttgccttctctgactcccttaccctacacagttaataacatcctaattcatgtatgagtataattaagcccattttacaaataactaagctgaggttaggagacattcaacaatttatctaaaatcacacagcaatagaaaactaacacactatattggatatttttcttaatgaaattctttataaattgaaattcaatacatacttcagtgtttggtgcacttgtaaagatctgaattagtagtcaatatggaaggcaatgacaccccactccagtactcttgcctggaaaatc

SEQ ID NO: 60051 - DNA, 1277 bp, Bovine  19866880388879
cactgtttatttccagattatgacttttgtttttaattttatagcttgatagaggaaggaggagattgggaccggaggaaccgcctaaaagtatatcaaggtctttattgtgtagctattcgtgatttcaaacaggcagctgaactcttcccttgacacagtttcaacatttacatcctatgaactcatggattataaaacctttgtgacttacaccgtctatgtcagcatgattgccttagaaagaccggatctcagggaaaaggtaacgactgagtctttgatactcatgtttagagaatacaccatgcttttccagaataaataaaccataatcattgaagcatacatttgttctttgaaaaacccctaggtgattaaaggggcagagatcctcgaggtgctgcacagcctgccggccgtccgccagtacctgttttcactctacgaatgccgttactctgttttcttccagtcattaggtaaggatagagttgttcgttcgggctgtctttatcttattcctcactctgtctgtggacaaccttagatgatttttcacatatatgaaaaatacagtgtgcagagatagctgttgttctttggtcagcgtgcctaatctttgtccattcttgttagacgctgatcaaatatctttttgtgtggtccacaaggtaagactgatcgttacattttttaaaggattatttaacaaaacagaacacagaaaaatgcatgacagttctgcggcctcaccagctagagagatcagctgtctggttctctgccgaggaagtatgcctgacccctgagcacgagtgagcaagtggttctaagcattgagtgttttggcgactgatgtatgggaatttgactctcctttcaattgagttagctgtgcattagctgagtctttgtgctgatttgcaaatcattttcaagggatgttggttgagaaaatgtgttgaatgtgtttgtggtgttcaacccagggttccttcccagattttcctaaaacttaaaacaacttggcattgataattctcttgtctgctgcaagtttcggaaggtatttggttaatataaataggcagcatttacaaaacttgggaaaggaggactccaaatgatgatcttttactttcgaagtgggtgttggcccagtgcttatggcgtgctttctccatgcctagaaagttcggctgccttgtgggaattcacgtgtctgtgctcagtcacatcgactctgcacctccatggactgagcctgccaggct

SEQ ID NO: 60052 - DNA, 2937 bp, Bovine  19866880484302
tgaatgatagttgaagatgtccgtgatcatggtcatggtcacggtgggagtgtttctataggtttttattagtacctcagaagttaaacatataccattaaccttaaggaagtctgggctctagaaagggtaatggctggagtgatgtaagaaaggtttggtaacagtggctcctcttcactgaggtctccctctgaggcaggtgccacactcagcacactgttcactgttccttacccaccccaccactcaggggagacccggataatgcctcacatacagtagcttggtgtttcatccacacctgtgcatctgcatcttcagacatctctgaggaggtaacattggtccctaatcacatgaagcatgctcttatgcttgtttccatagaccgtatgttacagagcagctttatatttacagatacattgagtagatagaatattggaaccttctgtactagatggcaagttggcagactcttcacatcttacattagtatggtatgcttgcgatgattaatgaaccaatgttgagacgctattactaaaagtgtgtcaaagtccatactttattcaaagtgccttagtttttactagatgcccccttttttgataaaccttgtttctatgcttcattcagatggcctacgtttttaacctcatgcccccagatcactgcattacattagtggccatgtctccataggcttctcttggctgtgagaatttcttagtcatgtttcttatgacctggacagttcagaagagtctaatcaggcattttttaggatggctgacagctggaatttttctaccactcttctcatcctgagactggggtggtaggttattgggaggaacaccacagagggaaagtgtcatttcatcaccgcttaggaaggggacatgatgttaacatgcttgtgacctctggtgttgatcgtgagccccaggctggggtggctgggcaggtttgcacactgtaaaatttctctgctccccactctccataccattccatagcagaggcaagccactgtgtacagtctacctctaagaggtggggagttctcttccccttcttgcaagcagagtagctacagagatcatttggaattcttcttcatgggagatttgtagagtcatttctcaagtgagactatgcagaagaaaattggccagagagaaaattatggttgacagatgtgtagagatgaagtattaaaagcaacaaagggaaagcaatctgagaagtagcatttttcatgtattttttaaaattacctaaatagacaaaaaatgtacaaacatatttattgctgtattgcttataatacttaaggacagaaagcaagtagaatatacaaacaactcatggtacattcatataaccattaagtcagacacattctgtatatttgaatatataaaattattggcatagaactataataatagtatgctgatgaatgaactatacacaatatgagtatacataatgtaagtatgcacatatataaatatacttgaaatataagtatatacacatgtgtgtttaagcatatacaatacctgaaagattagctaatatagggaaaaattactgtcattatctctagctggtaagactatatgtcatttagaattttcctttgtaatacctatactttctattttcttcaatagcttttcatttatctaataaaacattaaaaattaaaagaaaattgcttgaagcaaaagctttactgacaaatgcaacactagccctagtgttagtgttctgagtcatgaaaaccccgttacatgctagcttttaaaatgcctctaatagaacttggaatagagaagaaggcaagagcttcattatgtttttatgccatttcctctcacaccagtaattctgtgaataactgtagaacatcctttctccattctgggcctctgatcctggaaatcagaaaacaaagagaaaacagagggccgtgtcgctccagtctttgcccatcttctctgttgccccaggagcctccattcagtgaacgcatggtcctctcttcaggaccactccccacctcccactcgagcagtctcctctcttggtggcctcctctcctcttgctgctcacaggtcttcctccgtgtgctaggttccttagcatcgccacctaagacccttcctcatcttgcaccagcctcttcagtttcagtctaatccctcactcgagtcaaaaacggatcactgcagctgagcgccaggctcagcctgtgcagtcggctactgccttcctgacctcacctccacacctcacctcagctctccatcctctgacccctctctttccttaaaggtctagattaattgccccgcccccactggtgctccgcctcttacacaagcacacacacacacttttcccagctatcccaaatcctgtgattcttctcctgttttatcttcaagagcacctcttgtctacaagctgttctcagcagaagaacttaagagactggtatagtttcactgaatcccgtaagagcagagcttactttctcctagtcaggtcctcctggtgcctaggagagcaatgcatgccgttggccctcactaaatgtttactgatgcttatgcctctatgacagtctcaatgagagagaaagctaatgtgtgtttgaggtacgaataagcataatatagcattcaaagcccagcaatgagagcaagactgcctccgagctctgttgctcacctcctgagtcatcacaagttccttaccatttctgagtctgtttcttcatgtgtgaaatgggcatgatgatgggacctgcctcacaaagctggggtgaggatgaaatgaatcatgtgaagctctcactggttgcaagttgtcaaacaagggtaactcttgtcatcattagctgacatgtgacctaa

SEQ ID NO: 60053 - DNA, 803 bp, Bovine  19866880504046
ttcttgcctggagaatcccagggacgggggagcctggtgggctgccgtctatgtggtcgcacagagtcggacatgactgacgcgacttagcagcagcagcagcagctgtgcaaataataggatgatatgagcaagtgtgggagagcagagaagccttcccgaggaagtgattttgaagctgagatcagaagagtagaaacaagcagtgggtgggacacagcagaagaacatgccaggagatgtaaacagcatgtgccagagacaggctgaacatggtctgtctgaagcactctaaagctgatgagattgaagggaacaggaaaggtgataacggagtgagataaagctgtagtaacatagcagagtcagggagggcactatagagtttggaagctcaattaaagattttgatcttttccctgaaatcagtaggaggctgttgaagagttttaggttgtgggctgacactgtcagatttgcattctgaaatgccatgctgattatagtggggacagtatatgtggtcccagagtggtttgaatatgagcaagtgaattaggagcctattgcaatcatctaggcatgagcgggttactcgatcaggctggggcattggcaggagacagggaaaaggtagagtaatgagagaggtaaagaagaggagaatcaatgagctacacagtgaactaacataatgtaatttgtggatctcagcttttctgacttggacaatttatgaagaaccattggaatgacataagttttggccacaaaagagcagggacagtacatgctgagatagg

SEQ ID NO: 60054 - DNA, 1034 bp, Bovine  19866880534007
tggggttgcaaagagttgcacatgactgagtgagtaacactttcacaaaggagactacctaaactgaagatatacagccaagagcattggaaacaaagcaaaaaagcaaaaaaaaaaaaaaaggcatcgatgtatattctttctgaagagcaggcaaaaaggcttcaaggaagaaggaaccctgaccaggtctgtcactggcctcacaggcaagggaggaggcttgttttcagcagcaggagcaagtccatgagtgccctctctgatcttcagggactttctatcaaggccagacacccaataaaaactgatcctacacatgagtatccacaggtaccactcaccaaacctttgtcagagctcagttagactattccttccttttgcagaggttgctcataaggaagatcaacagttgaaacaagaagttagaacttccaccatgcattccattgattcccgagctctctagacccctgcttcactttaacgcctcacagttctttgcaacagcaccactgtactgtctgagcctcataagacactcaacagccagactgaacaaaatctacaagcaagcctttactatatctccacagaagcagccttagaagttggtacaaaggttttaaagcaacaggggcatgttcgaaccacccctaattttaaattgtgggtttgataaagattcagcggctattcttctaccctggctcctttcttcatttgacagtgcccacaaacagacgtaactacggccaaggacttccagggaaagctgtagaggggctgcgcgcacagggatcttattagaagacattttcatcaggcaaataagaacctgagtgatgatgccaaaccaactgcttgcaagacatattccccactcactccttaattaccttttcataaagctgacagcatttaaacatttcttggggatttgagagtaaaaagaaaaacttgttatctttttaaacggaaggaaaagctgtctcgaacaggggactgctgaattttaccaaaatgaggca

SEQ ID NO: 60055 - DNA, 1239 bp, Bovine  19866880555610
aagagtagctactgttgggttactgtgataataaaaattgtaatgtaggataagtggctagtggctaaaacatagtaagttttaaattattattagctattatttttaacatttaaataaccctcgactgtgaattgagagcccttgagtcaatttgctgcacaggtcaagtctttcatttatttgcttgaacaggcagtgtatttttctgtttttcaacaggctcactaataataatcattacttttgcactaaggacctgaggactggccctactttccagaactgggatagctatgatcatctgcaggttggatttgacttgtattcaaattatacaaataagaaatataatgtgcagttattatagtacatcttatttgataaatgtccaacatatggcagtaagtttggaaatacaggtcctggcctctcatggacattctagtaagtaaaaggtaggaaaaaatgtaaagccatctggttctcgtgtgtcgcaagccactaactcacatcacaggtttatttagtcatggtggattcagactccagctctcgggaattcagttcttcagaggtcacctcagtcctgcggtcatatgctggctcgcatgatcacagtacacaagtccccacagctttcctgctcagccctggagcacggtattcttcccaggatcgctggctactattcttagtcaccagcaattttgcttttatgctcattctcttgtccatttaaaaaacacatgattgtgagtcaaagctagagacaacagacatgttaggggaactggggctgggagctctcaacccagtgattaagtttttagatcatgctgatacattatgaattccgccttttaaatatagaccagtttcatttgatatgaattgggctgactcaggctaggaatgctaaacaggtcacctaattgtggtgaaatgtgcagcctgaataagagattctggatggacccaaagacggagagggttgctctgagcttctagacactgggcataatgggaaaagtgaaaaggaactccccttccacttctgtctcagtttttctgaggttatgttttttttttttttttatggcttagttttgagaacatcttgaatgatatggtcttatgacagatatgagacttgtagactttcataaaagtaatgctaacacctagtgttgggcccaataaaaccgattttagattcagcacacagacactttacat

SEQ ID NO: 60056 - DNA, 1613 bp, Bovine  19866880568204
tggcccccaagatagtggggatgcttcactctgtctttggtcttgagagtattctctgcatggctgattttctggttctgagctaaattatagcaaaagcaatcttaaactgagtgtacatcttccattcttaccaattttattagtaaaagtagcagtctgtaataagatccagtttgctcatctgccaggaaagcacatcatgctttcttttcttcagcaagacattaacctgcatccaagtaaacatcttaatgttccccttttctacctcttctgtttgagaaggactcattcattcattaatttgttcatttcatattcatcaagcacctctttggtgctgttccaggtgttgaggatacaatataagacaggcagggctcttgcttttaaagatgttactgacaagccagtaaatggccacgtgaattgtgtgacttacgcagcactttcaaaactgatataaaccatagctacagatttttaaatctacaaagcactgagaaaccatcagtgtttcttttttctttttttcttactctctaggatacctcctgcttattggcatttagccctctgtgtattggtcttataccacagcctgccaaggttaaagttagaaaagagaagtagaagagataggattttaagtgattaaactttgttcatatactcactggcacttgttatggttttctttaagtcttggttaatacaaaagattatttcagaatgggaagggatttgaggaacatctagtcacagagccctttcactaagtaaggaagaatctgagacatggaaggaggcgagcaggagcagacctgggaggaaaactcagggttctaccctccacatcagcgtccccattcctctacctacacgtgcatgttgggaacagcccctttcccttccacggcctccctcctgtcgtttatactttcttcaagcaaaaccatgagctaaaggtcacacagattttaaaatcccactgccttcccccagaggaaaaattcccttcttgaatgacatagaaaggcaaggaaaagcacgttatattgttgctgcttcccgctaatgcttcttgattccctgtggattccggaaatgtgagccactgctgcttctcttcctctacctcctcttcctcctcattttggagaataacgtactatgaccacgtgtaagccttaagtcacggcgatgctctcctttgggtagttttctatccactcgccattacagaagggagccagactgctgcacaagagggatgtgggttggaaacctcgggtttatctgccacttactgctgtgtggccctggtaagtcactcgacctctctaaagttcatcttctttggtgaaatggagataataataccaatctcgtaaagttatttatgagtgtagtagatgctgtattcggagaaggcaatggcaagccattccagtgttcttgcctggagaatcccagggacgggggagcctgatgggctgccgtctatggggtcacacagagtcagacacgactgaagtgacttagcagcagcagcagcagatgctgtattaggggcagccatggtcaagaataatgataatgaccatctg

SEQ ID NO: 60057 - DNA, 2722 bp, Bovine  19866880570954
ccttggaagaaaagttatgacaaacccagacagtgtattaaaaagcagagatatcactttgccaaaaaaggtctacataggcaaagctgtggtttttccagtagccatgtatggatgtgagagttgggccataaggaaggctgagcactgatgcttttgagcacattggaatgtattctcatcttcaattgtcactaaaaaagaataaattaagaaatgtctttatttgatgatactgcagctccttgcttttaaaagatcatttcctttgttaatgttcaagtcgcctgtaacttccatagcactagagccattagcatcagagcagagtggaaaacacacttggttttgatcttccctcccagtccctcatatccttagctctttcccaagcagaaatttctgtgagcagaaactgccagcaatttaacatgtaacaacatacataagagctcatagtgatttgaacagcgtaagccagaaacatccatagtattgctcttgtaaattctagtttaacagagctgttttctgttgaagtggtacttgggctctatttgttccaagtatcttgtcttaatttttgtcctcatcacctgtgttagtgaaggactagaaaacggctttagtgtaactaacaaaacttaattttctatcttactttattggtgggcccaataagacattacataagctttcagggactccttcttagaatttgttctcaattatttactcattatttaaattaagatcaaacaaatctaaacttttacctccaaaagctaccctctgagcctttggcaaattgtggcacaaagataaagggcctttatagttgtcacctgcagtcaagacatcatgaatcatggaatatgatagaaggtaatacacatcaattaaagagagattaaagacacgctgtaccttgttccaaatttcctttgtgatgagaaaatggttgtttaatgaggaaggttattttatggcttctaacaagtgagcaagccaatgtcattttgccatcattatctaatttaaccacgaaaaggatgaagtataatagtacactgatttgcagcattttctcattgccttgattcaaatgagataagatgatgatataggcacttggaaccctaaaggcactaataaatacaaaattctctatcaaaatgaggcagagagcaagtctgcatattccagatccatctcttgctaaagccgtccaccaagactttggctgagtaatctatgtaagacacaaatcggattccattctcccatacttgaaatgattctgtgacacctggcaatctttaggttacacttatacatttttatagggtggctgatatcaggattctgcctacatctctagcctcatcttctactaccgcccagtccccaatcccactacttcagccttacttagtaatgctggtgatttcttaagaacaatgtactgtcagatgtctgtaagcatttgcagcactgtccccaagtcccagaatgctactcatacctattcctcaaccctaaaatacacctccaaatgtgtcttttgaaagacttctatccatacctccattgcttacattttattatgcttgcgtcttgacccttttaattctcaactacactatcagatcagatcagatcagttgctcagtcatgtccgactcttcgagaccccatgaatcgcagcacaccaggcctccctgtccatcaccaactcccagagttcactcagactcacgtccatcgagtcagtgatgccatccagccatctcatcctctgttgtccccttctcctcctgcccccaatccctcccagcatcagtcttttccaatgagtcaactcttcgcatgaggtggccaaagtactggagtttcagctttagcatcagtccttccaaagaaatcgggctcctctaagtcagcgtgtaccctttctttctctgtatgcccacagttggtactaggtctatgctcgataagacagcatggaatagggacttcccttggtggttcagtggctaggactccatgctcccaatgcagggggctgggtttgattcctggtcgggaactagatcctgcatgccactactagaacctggtgcagccaaataaataaataaaaccctgcatcaaataaatgggtttttcagtctggatgtagtcagatagtagcttcagaagattctgtttttcctctccccagttgtgtgtggttttaaaaattttatttatttacctttaattgaagtataatttatttatgatattatgctagtttcaggtatacagtatagtgattcagtatttttgcaaattatattccattacagattattacaagataacaggtataattccctgtgctacacagtatatgcttattccttatctattttacatatataggataaggaaatgtgttataaatatatacgatggaatatttttaaaattactcagctataaaaggaatgaaacgctgacatctgcagcaatttggatgaacctagagagtattttgctaagtgaaataaggcagacagagaaagacagacactataaggtatcacatatttgtagaatctaaaaactaatacatatgaatgtatatgcaaaccagaaatagactcacagacgcaaaaaaagaaaacttgtggttagcaaaagggagagggaaggggagacaaattagggatat

SEQ ID NO: 60058 - DNA, 766 bp, Bovine  19866880585181
aaaattgaaagctagcttgacctggagaagtaaggtcaagcacatacgatgccactgttattctgtctgcgtctccagcctaccttgagggaataaccattggggaggtggctagtggctgcttctgtcctgggaatttgtaggttcccttggagtgatttggcatagctgtaaaatttggcatagctgtttaggatgcaaagaaatgaattttggctcaggacacacatgttaaacaggatagtggcttttattggaaataaggcagaaaagaaacactaaaatagaaatcagagaaaaaatttttaaaaggtatgagactgggatgcaattagaaatctgagaaacagctggcttataaagattgtaggaatgattacattgctgaataatattctgtgagtgaataaaaccaacagtttaaaaagggagaggggagggatatgatccaggagcaacttaaaagccaataaaggtaattacgaataaatgttcaaacatggcatagaatttcagccactgagttttgcagaagctttgttagcacctcaaaccttagaaatatttggcttgccatcttcgaatgtatgataataaatatgagttgaggaaagcagtattcctgcctcccgaccttgatgaatagccagtgaggattataggaagagaagtgtatttgctcgtgaatttttcatatgaaagcagcctgccttgtgctttatacttgagcagcacctgtgccgtagttgtgtcgttgcccatattt

SEQ ID NO: 60059 - DNA, 1157 bp, Bovine  19866880592671
cccaggcgaccactttgtgcctgtgaatttaaccactttaggtagcttgtaaaggcagaattacacacatctttttgtgactgacttatttcacccagcttagggtcctcaagtttatccatgttgcagcatatgtcataatttcctccctttcaaaggatgaagaacaattcattgtacgtttggatcacatttagcttatccactcatcatcagtggacatttgggttgcctcttttagctattgtgaatgatgctatcaacatgggtgtactaattatctctttgaagcccagttttcaattattttgggtatatacccaggagcagaattgctggatcatatggtagttctttttttaatttttttgaggaactaccatactgtttccacagaagatgcactgctttatatttttaccaatagtgcaaaagtgttccagcttctccccatccatgcccatacttgttactttctttttccttcttcgttttttaaaaaataccctaatgggtgtggtgggagcaaacatttttagttgtcacaacttggggcatctaataagtagaggtcagcaatattgttaaacatcctactatacacaggatggttctatgccacaaagaatggactggaccaaaatgcagatagtgcccaggttgagaaatcctgatctgaacaatcaggttcatctttcatagcaaatctcacctctcctgacatgtgcaccttctctattcctttgctgagatgctcaaaggcaaagacttccaaaaacctagaaagtaatggaagactgagaagaacggcaacatttcgtttattcaaattttattggaagtttacaaatgtattacagacatcagtaaaacatcatatccatttcacagggcacggatctcaagcaaagtgttcacaacagtctctggcagagcccacaccaaaggtccactgcagaccttctaaacaaatagcttgacacccgacacacaacacagactctggtgtgccttaccttctcaggccctttgaggttttgtttacgcgcttggaattaaagcagaagatggacaaaatgatcctgtataggaaagaatgcgtttcggagcaggagaactgccgaggtcctcatctgctagggaaaaaggaggaccca

SEQ ID NO: 60060 - DNA, 2175 bp, Bovine  19866880609486
ctttttggagccttggtttctctcttactaaatggaattaataatatctagctgtgtaactgctgcaaggattaacaaggtatggaaagcatccttcacatcaactagaatatggtaagtgttcaacctatgatacctaccatctttgccatacattcacacaagcacaaaactatttcagacacgtagacacccataacatacattgacatatatactaacagctaccctgaaaaatatctgacctggtgaccacagaaaatacagctgtttctcagttgagtcctggaactttcacgaacaagaatctctgaggactcaaaactgatgaatggatgccaagaaaagagctggaaaaatggcatcctgcccagttgaaatgaaatgctaagaattcttgtcccagttaattttaaccctggatggggctggatcctatttgtaaggtttgatatttaaaaaccaagaaggggtgggggagctgaagtcaatggtgctcccagtgcaagacaaatggagacaactcaaatccccatctaccgtgagacaggcacagagctgactgtaaaaggtgccccaccttggttccatctctgcctcccatcccaggttccctccagtgccccaagatggtttatacacgaatgccagaaccaggaagaacaggggttctcagaaatcaccactatcccttcttcctagaggtcatcccactgtcctgagtgaccgactctggttacgctttctccaacaaggccagcagtcctgactcccctgaggtctccacttccaaccagtgatgcttctggattctgtgctccaggcagtgttttgcattctcttccatgtcagctctcatgaaacttgagtcttcagttcaactgacttgatcctgatggactttacaaccaaatatgtgctgaagtacaggccacacacccaccaaggaggcaggctggctcgtactgtactaaaaactgtgctctcttgaataaatgcacttttaaaaataggccatggtgctctggtggaaaacacttgctgtgctgagccccgtatagggttttagaatctaacatggcaaatggttgcattacggattctgtgggtttcccccatggctcagtggtaaagaatccagctgcaaggcaggaaatgcagcagattcggcttcaagccctgggtgggggaagatcccctggaggaggacatggcaaccctcttcagttttcttgcctaaaaaatcccatggacagaggagcctggtgagctacggtccatgggattgcagcgaattggacacgactgagcaactgagcacatcatagacctaaagaaaatttaagtagacaaatatttcttagataggatacccacaccccttattaaaaaacaaaaaaaaacccaacaactgccctttactgtaagaaaaaaaaactgttgtgaaaacaaaaaggcaagctgtatactgggacaaaatattcacataatatattatatctgacaaaagagttgtatccaaaatatataaagaacccattcaacttaataataagaagaccagtgggctgaagatttggataggcatttcaccacagaatacataagaatagccaagaagcatatgcaaagatgctcaacattaatggtcatgaaacgcaaattaaaacgacaagacacaaatacacccatcagagtggccaatatgaataagactgataatacccagtgttggtaaggatggagagtaagtggaactcttatactcagttgctgggaacatgaaatgcaaaattttgaaaacaccttggcagttctttataaagttaaacatgttctttataaagttagacactcccctcttatttaagaaaatgaaaagcatatttataatagttttactcacaaaactcaatagaaataacacaggtggaagaacatgttatattttcgtatcagtgaacactactcttagaatgtaatacaagtcatcagtaaaaaaaccccacaatactactgatatattcaataacatgaatgcatctcaaaattattatctaagtagaagaagccaattagaaaagggtacatatactgcatgatttcattcacaacattccagaaaatgacagcaaatctacagtgacagagcagatcaatgactgttaggctaga

SEQ ID NO: 60061 - DNA, 1767 bp, Bovine  19866880631694
gacagttctttaaatttgaagaaaatttaggtttaggaaaaactcattgcattttctttctttttcacgtttccttgtggactttttgaagatcgctgtgtattttgatatttgataatcactgctttaaattagcttcccaaaatgtctctcttgtagccctgcttctgtgtgctgttattagaaggtgttatggagaaaataggattccatgcgggaaacttgcaaatggtagctttaagtagaggctatactgagaactccagtcgagagttaaaccaacctgggttcaaatctcagctccactagaggagtcacttgagaaaaactttcatagctttgctcagcctcagttgacctacctgtgaagtgggaatcgtagcagcactttatagtgactgggaagatgaaatgatgtaatagcgtttcagccttttgtatgttatctggcagagtaactgttcaataagcattacttgctagtgttgttaattttatcaatcatgaaagcgcagtgttgggagcatgcctcaaatcaagtggttagccaggactctcaggagagcagcaggaagcaaaatgccaggttttcatttgcaggcagtctgtaggcatgagaagaaacctcagagtgctcaggacaacagcgtgagcgtagcaagtgaaccccagctcccagctttcatgaatgtgagtgaaaatgagaagtggacactgacattgcttatttctgctgttagtcgtctctttttggacttgtggagagaagcccggtgtggggtttgactttgttctgttgtataaaaccgtgcttgcttctttcctggaagcccgtagttgctgtctcttcttggaatgctttgcagagttctttctgcaagaaaggtaggcaagaaaggtgagttacagccaccagaataaagccctcctaggttgggaaatgggtcagagataactgaggctgctacttttaagattttgtgtttgcttagtggtagtcatggggttttctgtctgatgaaggaattttaaaattgccttttcaatgcttggaaatttccatttaaatttgaagcagttctccatataaatcaccttattctctttggaaactgtatctgcagatacattttaatggaggaggggagtattattgaagttaatacatattcattgtacagattttactaataattttactaatttttttccatactaatgatagtatgaaatgtgaaagccatcattctctgtaatctcattctaggccaatttttaaatcttcagttacaggatttggacttgggacaattcatacctgatcaaggacatccatgtaactgcttagggctcttggtaacaggcagggctcctctttgccagcctagtcgtcccaattcctgtcagagtgggcaggcctcaggatatcttgtccagcagtgattcctgccttgagactcctctggctgttttgccttcgttcatttgctttatccctcagacatttgacaggcacgttctctgtgcttcttaatggggttagagtccgagggtgtagctcggtggagtgaaggcacagtcctgactggcaggcggttgcttagcaagtggtgatagaattaacctgctaagtggtaggttctctcctgggtattggggtagagtgacacacatcagaaacagcccctaaccttgagtgaagtgagacccagtcaatacacagatgtttcacaagaagattgagtgctgttacatcaataaagtagg

SEQ ID NO: 60062 - DNA, 1890 bp, Bovine  19866880637953
cattctatagatgaggaaaaatgactgcatcaaggtaaaataacttgttccaatcataaatatagccagagagcagccggagagctggatcaggtaccatatgcatctgatagcacagccacggattttaatcactctgcttgggaaggaccacccactgaccatatttcagcagagctatttctcatgtcatattcaccatccggatgaattactgatttccacacagcagtggggtccaggcaaggatggatgcttcaaaaccacgcaagtccaacttcaaaatggacttacacagtttcagtcgactgtctgcctcaaatgacatgaacagagttgccaagtggttgacaaaattagtcagttgacatttcagctcttctctctgcttgcctctccatccaaggctatgatacttgcaatgatttacaaaatgatggaaaaggaggcagggaacaaaaaagaggctgaagtgttcaacatcttaaccatcaaaacttgagaaatcataacttacttcctttcctctaccaaatactcaatgccaatgaggatgaagacaccatttcttattcctgacaccctttggcaagaatcagaaaggaggtttcctagaaacccaggatttcatggaagaaatgaaaagtcatcattgagcttggctagttaatatttacagtccatcttaagttgctgctagacttttttggtagctttatggaaattagaaaaagacaccctcctgtcaaccccaactacaagttagaaaaagcaagctcccaatctcagaaggggagtgttgtatcacaaccaggtaaactgcaaggtgctctaggttaaataaaatttcctactctggttagtgggcttctcaggtggctctagtggtaaagaacctgcctgctgatgcagatccgggttcgatccctgagtggggaagatcccctggagtggggcatggcaacccattccagtattcttgtttggaggatcccatgcacagagaagcctggcaggctacagcccacagggttgaaaaagagtcggacacgagagaagtgacttagcacacatgcacacataccctctggtctgtagtcatagagcccagctgaattagccttcaccaccgccttggccaggcacctttgtgtggcacacaaactagacaactgcacgtggcagccctcatcctctaccaagcggaaaggttacagatttatctttttggcgcaggaaatataggttcagacatcacctgaataattagcttcccttagcaagataggatcactgagttttaatcagtctttctaattgtcagagcaataaccaccacactatttatcgagggccaactgtatgtcaggcactgtctcagagcatttagagacgaagcaaagagccagtctgtggaactgattttttagtgccatccatctggatgttgatgagtttctgtcccaaatctctgtttttattgtgcataattaatattgagcaattctttctgacagtacttggccaaagggctcagttacttgctaaggcaaccaagcaacattaggaagactccaacactggcattcaaggatgcttgccttcctgcttgctaaagagcaacttcattcattcactttattaaagtatttgatatagaataacttcacatatttaaagtatacaacttgataggttttgacatagacacagatccacaaaaccatcagcatgatcaagatcctgaaatatctattaccttcaaaagtttcctctgctcatttgtttcttcctcccactctctccattcacctcttcagccccaagtaaccactggtctgctttctgtcactacagactagtttaaaattttgagagttttatataaat

SEQ ID NO: 60063 - DNA, 1783 bp, Bovine  19866880654007
cgtaataaggagcctgtctgagagagagcaagagggtgtgacttaggcgtgggcccccctctcctgccctacagtgcttacccccatcttcttcctcccacacaagctgtgaggtcgtccgccggacccctgcccattagcaggaaagggctgggcaccacgaggtgcttgctactgggaggccaacatcaggaccaggcctgtcaccgccgccctctcctagggccggggatagggcaacccttggtctgcctctcggtggctgctgtactgagagaaagggcgagcttgtttacagccacaaacacctcagacccgtgcacttaaggctatagcgtccgctgccatcactactgggaagggcaaaaggaaccgatgccaagtttaccctccaccggcaatgctaacgtccccgagaccagtcgctaatgacaataagccctgtctctggctcggtgctcaacaactcgggatacccccaacctggtcccaaggcgggaggcgcacagagccgcacaccactctgaaagcctggaggtgctgagaaaatgaaagccccgaggtgcggataagccaggtctgatctcggggtccccgtcggggtaaacccctcaggctggggagcgcggggccgcccgggcctaggccgctgactcggcgctcccgcgggcctcactgttatcgcggacggctgccatcagctcgtcgcggaccgccgcgtccccgcggtgctcgggcaggctgagcaggaagcgcagctgcgcgatgcgcaggtccgggttcttgggcagaccctcctcttccaggttctccagcggcatcgcggcggcgacagcagcggttccgaacagacggcaactcacagccgacaactcagccgagaccggcgacggcggcggcgacggcggaagtaggaggagaccccgactgcaccgggacgcctccagcccggcttccggtcccagctccgcctccgcccgcagcgccccctgctggacactcccgtatatgcccaccccggccccgcggttttccccgcctctcagttaggagagtcccagggagggtggtccccacctccaaagttggatttcctgaacctctttctccctccattttttagctatttcactttccaatccgtttgtgattaatagaggctggcaatcttgaggattttgaaaatataataataacaacaaccagtaaccaccacaacaaaaaacgactgcagttgtctaggccctactcttccccttttacctttcttcttatacccatttcttaaaagatatggaagcatagttgctgtacaatattatataagctttaaaggttatactccatttacagtgggcttcccgggtggctcaacgataaagaatccacctgcaatgcaggagatgtgggtttgatccctgggttggaaagatcccctgaaggaggaaatggcaacccactccagtattcttgcctgggaaatcccactgacagaggagcctggcggctgcagtccattggatggcaagagagtcaaacgtgacttagcaattaaacaacaactccatttatagttattatttttaaaaaataggctgtattccccatgttgtacaacagatccttgtagcttattttatatctagtggtctgtccctctcactcccctctcctgaaacgcccttcaattctcttccccactggtaaccactagtttgttctctttatatctgtgaagactttcacttttatgaggaactcattttaattctcttaacactag

SEQ ID NO: 60064 - DNA, 2990 bp, Bovine  19866880724906
cttccttttccttttctttctccttcttatccccctgtttctccaggatcatagttaattaaccaatacctaccctataatgaatccagtcctatagtccctggagatatggagtatttgctatggtcttcagctgtaagaaggttgtctcttgttatgatgatatagtgaatacatataaagcaaaaaaaaaaaaaaaagataatttaatattaagttatatgtgtggtgctttccttgttaaaagaagaatatgcaggactagagcattcgggggagcttcctgaaggggtgagatatacctgagtctgtgaagaatgactaggattttagagggtgaaggcttaacagtgagcatctggggcagatggttcccagtgaagacatgggaaactttacagagatggaattaagtccagtgtaactactgggtaaaggttgtctctcttgaccacatcatgtagatgctctagactcggacaatcttcaagaattatctgattccaactcatgcgttctccactgaggtgatgtccttgatagccgtccaaacaagtacctatctgggtggagaatagaaatactcccagaaaatgagcagtcagactacattcatagcaccttttgggaaatgactcccagatgatgctccaaagcagaaccgtctgtcctaggataagtagagctgtcacacgtgtacattatctgaactagtggatgtttatgaggaaagtattacctttaagactatccatctaaagcattttcttccccctccttaaaagataaaacagatacacaggccaagagatgattgcaaaagacacagtagttgcaaaactccagtgtcatgaccttgatgaacctcctgatacaatacattatgctctgagcttgcggccaattggttctggaaaactctttgagcaagtgccaactgctggaaatttcatccaggtgagcaccaggtgctgcttctccagggattttcccgaggagatggagtcatttcatggccacagtgtggttggtgtgggtgcattcagcagtgggagctgggacacagcagagaagggtctggaaggcattcgggcaagtccttcagtattttgataccggacaccatcatcttaccattagcacaaaataattgacttcctgtttagctgcggaaatgaatcagaggctaaaatagatgctgattttctcaaagtctgtttgactacatgggtgatgatggctcatccttctggcattgggagtgagagatcagcttctttctccacccttaagaggtcataaagtttccactgacagaggggggacatagtaagtttttttttccccctttgcaagatcgagttgtgctttgggagaatcctccttctaacttctaatttccacagctctattattttttctattccctcaaagttccaacccctaaaaaaaaaatactgatcccggttaggttggcataattgttgcttaaccaaagcatcaccaaacactccttctcagccaaaagacatggctgagaaagccactgatgatctttctcatttttgggtccaaacccaccctaaattttctggaaaactccacaagttacaagtttagcgtttgcatatgttatgaatttttaagattagccactgagccaagaggtttcctgagttgatgttcattttgaaatgcaatgcaaaactatcattttaaaaagagaatttggagaaagatggcagttttgtaaacacaatgctaacatttgagcctttccatatgcttgctctgcttctcaacaactccttccacctgttgcccacctctcattaatttctatattttcataattatcctttgggtcttaaatgtcattcattcctgaaagctttcttttactatttgaacctgctaagttctctaacatatgtttttgagtcgtttatttctgtgtttcaatacctttcatagtgcttggtgcatactgggtactcagtataacttaatgaatgaatgaatgatttattgaatgagatactcagtttaaaaatgtagttaaaacatttttaacctgggtcccaaacacctaggtacttgatgtcatgttggccaattccaattaatgccagctgagattcatgccaatactattacatgaggactgtcttcaagtctctgttgtgggatcatattgtttattgctatatccctaatacctacaattgtacttggcacttaattaatactcagtaaatattttttaaatggtgagtgacttgtcataataggagtagctatatttattagtatgctttatcacttccaaagtgctttcaaaacattttctcttttaaaatatttcgctcaagatcatacaattagcatgcgataaagacaggccatgacccatgcttcccttctactatgctaggatgctttctccaaaaataagctactttggaagatcaaagatgtccctttgttccaccaaaatgcctacttctgtgtgtcagttttgaccagtctcaagaatattctaatgctatcattattaaatgaaaatggctgtgccctttcattttccagaatgatctattacttaaaatatgtacattaaacaaaaagtcaataattttctctgaaataatgttgttctgcaaggttgtaaaagaattggattatgaggacccagacatagttccagctggccatatctatgaaatgacaatttcagtatttgatgacttacatcccttccgtacaggtaagcttgataaatttcatggaacattaagtgtcttttctttagactgtgcactttagattttaaaatgtaaaacttcattatattggggacagtttcgttaaactagacaaaggagaaaggggagacttagattcatgttggaagttatcattaggtctgcgagtgttgttcatctcttagcacaccttatgcaaaacacaattcttaaatgcaagtcggc

SEQ ID NO: 60065 - DNA, 1692 bp, Bovine  19866880728422
gaactgtgcagctccgccgagaaatactaataactgtcggcggagctgctggtggtgccgaagtcgctgttgcagtgctcgcatcctccgcatgctaatgaagccgtgacgtcagcaagtcagtcacggcatctggatgtcccgtcccctctgcccagcgctgagatttatttacatgtaaattagcctcgccttccaaatcaataatccccaagccaggaaggacgaagaaagcctttgctggatgcaaacgccccagcaacacaacctccaaaggggtacaaaaatatcacataggagaagagaggctttaaagatgcacacctttttttgttgttgttttttaaagactgtgctcttatgtgccagggaccagatctgggcacagttatgaacctgagcgcctgtttcagattatgtgctgcatcaacgcagggtgcaatcagagctctcccccaaccccaattgtctctactttctttttctttcttttctctctccaactttcatttcagagaattttctggcttggggctatgtcatccttgaatgtttgtgcaccttgagataaaacacaaatgactgctttcctcaagtgcctggctgttggactggccactctgtcaagcctgaccccagcgccaagtaagtatgggagatgacaaaccagaaagcttcccagacgcttctgagggccgctggaacctcagaaagcacaactttcatctctccacttttcacactaggaaagtgaggttctggatggagaagcagcttttccagggccacagagggattccagcaaggatgggccagaatacacatttcctggactttagtctacagctctgttaaagacctttgggtcttcaatctccatctttttgtaccaacaaagaggcctatctaaacagtcaggaagaaagaattttatagtattggatagccctgggtttaaatcctgactttgcttcctgctagactttgcttccacacttagggtctacagtttcttcatctgtaccatccttttattcaataaatattttctgagtacctacgctgtgccatgaatatgttttttaaaactttatagtatgtatgtgaatagtgtatgtatgggtataggtacatgtttgctctaattcaataaagtaaaaatactgagtggaaatgtggcaaggactaacacaattaccagcaacggtaaatatggagaagtaaagtgaaagtctctcagttgtgtccgactctttgtgaccccatggactgtagcctgccaggctcctttgtgcatggaattctccaggcaagactacatgagtgggtagctgttcccttctccaggggatttcccaacccaggaatctaaccagggtctcctgcattgcaggtggattctttaacagctgagtgaccagggaagtctaaatatggagaaggaaatggcaactcacttcagtattcttgcctgaaaaaccccatggacagagaagcctggcaggttctagttcatggggttgcaaggagatggacatgactgagtgaccaagcacaacagtaagtaacagttatttctgatattttgggtaaagtaaaaaaaaaacaaaaaaaaacaagcactaagcttttccttccactgggctggccattgtatctcttctctgagtatccctagtcctcttttattgt

SEQ ID NO: 60066 - DNA, 1418 bp, Bovine  19866880766343
ctggaagaggcaagaaaataatgttcctctggagcctccagagggaagagggcactgccagcacttcaattttaaaattgtagcttccagaactgtgagagaatcaagttctgttgttttaagccaccatttattggcaatttgctatggaagccttcagcaaactaatacaatcattattaaacctcaggagaaaagaacatctccaagtttggaagcaagttgatcttgacccaatagagatctggaaccctctggttccagagtcattcccccctgaaagcagccctttttagcttcctcccaaacaaccctcatcttatggtcaccacctcggacattctttcttggccatgtctgagtggtaaacagtttgcctacagtgcaggagacctgggtttgatccctgggtcgggaagatccccaggagaaggaaatggcaacccactccagtattcttgcctggaaaatcctatggacaaaggagcctggcaggctacagtccatggggttgtcgaagagtcagacacaacttagtgaccaaacaacagctaccagtctgaaactgaaacccaaaacagctcaacagaagaaagtaaagactcatcttgccatgttccaatatttcttggtttgggcagagacagcttaagtactaattgatccattccagactttgaaaaggaagtttataaatgcgtcttctttttctcttcaaaaatgcaggtgatggcagatagagactcacatatctacttccatctgagcataattgatccagtgagagccttgctggagaggggacggcattttcccaggcaatctttggtctctcccctggtgaagaattatcatgccatctggaacaaggcaatatattcctttcacagaagttgtggagctaattatcaaccaattccaacatagactggcttagaaacatgcaatgaccatctctgtattccaagtcactcctctcagagcagccaattttgacttaatgaaacgattgctattttatacttaaatagtgcttacagttcaaaaagagctgccaaatgtagaatctcaactgttttatgttgtttctcacaacagaactatgagattgaaatgggccaggaatgacagtttacattttctaaaagaagaaaagcaaatttgtaagaggagatgtgacttgtccaagctccagacttcatatccactggagtcttccataccagcacctcctgaggatcaacccatttgagctacgtaagtaatttatgagcctgtttatcttcagggactctctcttgttgggaagtgaggtattcttgtactgaaaagaaatcttatgtgtgcacacgtgcaaaggggcataaatacatatgaaggctgatatttctgatcattcaagcatccattatcctctg

SEQ ID NO: 60067 - DNA, 1474 bp, Bovine  19866880805065
cttgaaatggtcgcatgaggggtggaagtgcctccctgtggaaacctgagtgtgtgcctgagcctgtccccacgtgagccccttggttcagcacagtggaggagtgttccgagcaggtgccccagaatgcgcccagggccaggccgctgatccttagcaagtcctttctttggccaccttttcattaaagtgccaccatcttaaacaaagtaggcttaactctagaaacatgaggcctttctgtgttggaaaagcacactactgtccatgagtcccaccttccagatcacccacatgagcccaccttcttttatcacctcctgtccctgttattgtagagcacgttacctgtaatttcactgatcgccttagtaacccagttccaagtgacatttgaagaggaatgaaagaattcgcttaagttccacatacatcttgccttttttggggagaataggaggaccaggtgggaaggagaaaggttgtaagtgactttgattagacctggcagaaagctccatttgacatcgtgcggttcaggagagagaccccttcgctccaggcaccctggatctgcatctgtgtacccaagggctagtggtggcgcccagagctcccctggtggttttggatacatggttgtatctgagtcgaggcggctgattcccagacatatggtgtgatctgatcagtgctgcactttctgctcaccaaggcctccaggctgccctgctcagcaaggtgggagtgcccccattgaccctcctccagtctatgagtctccacaccctcccctgcctgccactgagccagcttctcggttatccagtgaggagggagaaggcgatgacaaagaagagtctgttgaaaaactggactgtcattattcaggtcatcatcctcagccagcatctgtaagttccacacccgcccccgtgccgaccctccccacgcagcagggacagggcagtgccgggggggcgtgccggggaccgcagcatgccctcatccatgcgggtcgccccgaggcggcatgctctctggcgggcgcatctgctgctgctcgcagtctcttccatgacgctcagggctaggcattgccacattcatgctttacagcccgcggtcctcagtcagtgctgtctgtcccggccgctccttcccgggccgtgcaccctcagagtccgagagcccaagcgtttgctttctttttttgcagttttgcacatttgggagccggcagattggaagaggctattacgtgtttgactccaggtggaaccggcttcgctgcgccctcaacctcatggtggagaagcatctgaacgcgcagctgtggaagtgagtgcctgtccgccacctccggggcgggtggggccttggggctgcatcctcttcattgcttatggggctgatttaaggaaggtcatcatctctctgataacataagggcttgcccagcccggaggaaggg

SEQ ID NO: 60068 - DNA, 727 bp, Bovine  19866880834996
tctctgcccttcagttcagtgattcatcatatcacaagactcctcaagatctttctttcaagaaaagctattagcctaaaaatgaaacttcgagagcttcctttctgactaaacaggtttttatagaaatccaaggaagaaaataataaaaccaactctgtgggcaagtcaacatcccccgtctagagggagggggtgtgggagaagttttcaatcaccttttcccgagacatcctaaatcatcttctctttcagaaacaatattagttcaggtatcgcctcttttcaaccaacatcttcagctcccaggctgacagcatccttttttcttaacccgccgagaacactcctggttaaatctccaggctgtcaggtcttaagtttgaaaagatacgtgatgggtgggaattctccctccagctcagggaccaccaacactcaaaatctgacaaaaaggcgaacagtaacatttaaatgtttcatacctgttttttttttaaattttattttctgtaagtactctctgcttatgattctctaataatagaataagggaacagtctgaagccttcaggacttgaacatgaaaatgtggtggggtgggttagctctaagaagctttaacaaaggaagagaagcgaaggtgtttcgttgggtgacaaggtatctgggagtagtcttgccactgctgtttgctgaggcttggagccggggcttcccaggggct

SEQ ID NO: 60069 - DNA, 948 bp, Bovine  19866880855448
attctccaggcaagaacactggagtgggttgccatttccttctccaatgcatgaaagtgagaagtgaaagtgaagtcgctcagttgtgtccgactcttagagaccccatggactgcagcccaccaaggctcctccatccatgggattttccagagtctgagcctctacctaatccaccactatctccccaaatgatgtaaaatggtgtaaaatatctttaggggatgtggggttattttcattttaatgatggaccattaacttataaggtaacctttactttaatgctagagatactatttttgcatttattgaaatgacagaaataaaatgagtcaacttaaaaagtatggaggaagcaatggcgtaggtggtacacagacaagcacatgcatggcagtgtacacagaagttgtgcttctttgaatagttgtatattctgtgcctctcacagtcagaagtgaaggcccaaataatactctgaagtccaggtttcagagaagtatgaaatgttttctcaataactgaatgtgagacttgcctatggaaactcctctcactctccagaagcatgtccctggtgagccagaggactgggtgtcacttccctgggtcctaagtgttttatggaaactgagctgtttgctactgtaagaggcccaaagagaacagttgttttgcagcctcttccaaagtggatcagttgactgtgaattaagcacagccagttttagcagccccctcttagagacagacaatgagagtatgtgacacaaagctgtgatgacattaaagtatattaagtaatcattccagcaggatgctgaccaaccagaatgaacttgggcagcagtcacagctctggagtgggcttccagaagttctttgctatatcaaagtaatttatcccttaattgctggatggtgggacgccacagaatgacctgg

SEQ ID NO: 60070 - DNA, 855 bp, Bovine  19866880885887
acccaccctaggcaaccccaggtgcacgatcaattgaccaaaaataaaatgaaaacattttaaatcatttaacattgtattttgccattaatttgcctaactatttatttaaagctgattattgtgtaatttttacactccatatattttggagcaaatctgacattatagtgacgcttaacagtaagaccatgaaatcctcaaaatccagcttattttctgtgtgttcgtcaagttcagaaaggaggtctttgtaccttgctttggtttcttgtccctgtaagaatgaaaagtaaaaagcctaattcattgtgctgccttggttttatagataataagcaatagtaaacatgttattaacaacatgtcaagttgctaccagccctactagtcaagcaatgtgttacatcttttcatgggttatctgagtgctcacagtgaccttattgaatacgcattattttcccactctacagtggaaggccagagactcagtgagaataaagtaatttgccccaaacttccctggtggctcagatggtaatagaatctgcctgcaacacaggagacctaggttcaatccctgtgtcaggaagatcccctgggagaagtgaatggctatccactacagtattcttgcctggagaaattcatggatgaacagcctggcaggctgcagtccatgcggtcatgaagactcagacatgactgagcaactaacaccacatcatcacagatagctatgagcgtggaaccaggattcattgcattggctacctgattctggagtcctcactcaaccgctaagctatattgctgctactgctaagttgcttcagtcgtgtccgactctgt

SEQ ID NO: 60071 - DNA, 1475 bp, Bovine  19866880950906
tagtattctttaaaatcccctgtgacattaaactagagtgatttagaggtaaaagacccaaagataaatcctttaaattcagggtttaatggctgtaaagaaactacttttggcttttcatcttatattaagatgaaaatatttaccttacatacagtaaaatattattaatattaccatgcaatgaacttaagatggaaagataattatgtattaaaattacatatttagctcaaaatatttgatatgtagaggaaggcatcagagtactgaaaccacacacaccactactttttcttttaatgtctatcgagctctgaaaacataagacattgaacttgagttaaatatgatacctacgggctttctggttaccttgcattccccacagtcctcactgattaaagagaaatcatactgtgtgactgatatgaaactcacatgggtttggtgaagattaaacagataatgtctgtacaacaccggaagagtcgggtcctgatgagtgaataatattatagggatagttttgaaagtgaaatatctgggagaatgaaattaactcacatatcatccaggaacctggtcctataattaggatacatcaggacagagtgaggagagggaaatggaagtcctttagggatctgaaattctcttagtgttgcagagaaatgtaaagtcagatggaactttggaaatcttggaagtccacccaacaactccaccctaggtggtagacaggagcagttccagagttaggcaggcctgagcctgagtccaatttctagctgcctgacaccaagcaagatatttaacttctcccaacctcattcttacatccactaaatcaggactaattcactggctcattcagcagctgtttaatggtgtatttaccaggtgccagatgatgggaaacagaaaggtaaaaagttagagaaaagacaaagaaaaagtaggtccctgccacctctgaagtttaatgctggaagggggttgggacagaattaaaagaacatacaaataacataattacaaattgtgttctgggggacaccttccagaccagggtgttatatctgaggatgtcacatttatgctaagaccttgaagatgaaagcgagaaagccacaggcgatggagggtggtgtggagagaagccccagggactgagggcacagcttaagtgaaagcgctaaggaaggaaaggcttgacaagttcagggacccaatggaaggtcaatgtggcagctggatggtgaattgaggttgacagtaatctacctcacgtggatttgggtatgtcaactgagagaatacatgcaaagcatcaggctcagagttctcaataaaccattagagtgtgtctctcctcttccttctccttcccttaccctcccctatcaccacactgttgaagaaattgagaactacagaagaaaatccatttgccttaactcagcaagagcaga

SEQ ID NO: 60072 - DNA, 1605 bp, Bovine  19866880954642
ttgtttattgatttacctggtctaattgtgtaaagtctgtattctttgttatgtgtgagcttagttagctaagtattgcacagggagttccttaaatattttgaaccagtgagtctcccaggctttgccaagtggctctgggcatatgctgggacatcttcaatgctctagcaataatgtagacctctaccttaggcttcatttcctgcttgtatagaaactcaaaatcagccagaggtgagagattaaggttttctcaggtcattcctggacatgcagataaccctatacatgcatgctgttttcttctcttttttaaattgaagcatagttgatttaatacacatggttttctagattctcaggaatcttgaaaatgttggggcccttcaaaaccctcagttgacatctcatttagttttttggtcagactcaacttatatcactgccttagacaactgcaatgtacaatgattgctactttaaaaaaacaacaacaacaacaacaagtgccctagggatagggtacagaatgagctctgatacagacaaattgtgagaatggagctttttagggacccactagaaagttcaaacagtgacaattttctgggcacaaagctttagggaagctccaaacctattttttccagtctaataggttctaaactactggttttcacagctaccacagttgtgaggtttacaggttttccaagttactgtggagctcggcatggtatggtgtgtggcagcattaaaatagagttaggtaaaatacctcagagtttgcctgtatttacagagatttagttctttgttttgtataaatgctcaatagatcctacaagccattaatttttagaattctgaaaaagttaattttgtcaattcttgccagtgttaccactatttttatagaagaaaagattttgggaagtcctggaaatattctctggaatggaggataacattatcagacttattattttcaaccctactcaaagactgcagaacagaagggaagttcaggcttcaaaagtgagagggccagtcatttgcatttgcaatagtacaggtaagagatctgggcaccttggacttggagatcacagtaagatggcacagaaatgattcacagatatttagaaggaactgctgacatgacttggtaatgacctggatacaagggtggtgcagtgaatgatgccaagcttcctgtcttgtagaacaggatggatgggtgggaccagtctctgagactggaagagggccaggtttgagaatgaggaacatacactggcaacatttgaaatccaggtgcctctgagatttccaagaagataacaaggaagccatcatcttaaagactctcccccagttttagagaaatgttttataaaccaactcctaaaacattatttcctctatatgaagtgtgggggggaaggcaaggcttgtatactaaatgccaataattcaacgtcaccgaggaattaaaaatatggctccaagaatggtaagagccatgcacaaatgtctgaaactattcattgcttatgtgcaaagaaattaaagcttccccaaaggcagctttatttaaag

SEQ ID NO: 60073 - DNA, 2068 bp, Bovine  19866880970613
gtgtatatgtctaccgctgctacagccttggtctgtttataggactgtttactctgctgtgtgcaggcaaaagtaccgttgccctggcaacagctgcctgatgcagggtccgtgctgcacggctgtataaatagggaatatttggataatatggtcagagcagagcacccagacactgtggtatgcatgatacacagagcacaccctttctctgctgcaggaaaagtatgttttacagaaaagtggatttaagggaaaaaaataaatcagggacaacattttaactacagcagtgataatactgcaggccacagtggtccccctttctgataaagcatggatgtctttttatggatttcagagggaaggagaagggaatggcaatcaaagctaaagaggacagaaagaggagaaaacagaggtgtgcatgccatggtgacagatgtattttctctcttccaagctgctgggcaaaaattttaagtggcagtttctggagaggcttttcagtctcactgaaaagggacagaagaaacagaaatactaacaagcagggggatggctgctgtatgcaaggtgtctgcgcgttctgcccctctcatccaggcaggcaccttcctgtagacccagagccacggtgagcgtgctgggtcagcacctcacaccacctctcctgatcgagtcccacccccagccccttgtccagatcaagacccgcctttcctcgttgttcagtcgctcagtcatgtctgattctctgcaatctcgtggactgcagcacaccaggcttgcctgtctttcaccatctctcagagtttgctcaaactcaagtccattgagtcgatgatgctatccaaccatctcatcctctgttgcccccctccctcctgttgcccatccaatctttcccagcatctgccttcagtctttcccagcatcagggtcttttccattgagtcagctctttgcatcaggtggccaaagtattatattccataagccctgatatatatctctatattacttttcttggcaaagcatcaagagatcttccactaagtaaggtatgctgattttaaattttcatgctattttggaagatgagtattaaaaaaattgaaatttggggcttgcctggcagtccagcagttgagactgtacttctgtcacagggagcatggattcattctctggtcaggtaactaagatcctgcatgctatgtggcatggctcccctcccctgaaaaattgaaatttgagggaatttctgtaaaagagttcctttattttgtctatggtttcagctacttgcccattaaagcttttagttgcattttccataaaactttttattcaaatgcattcttttaactcattcattcaaaaacattttgttacagtcttaggagtgttccaaaccttaatgctaagccatagggatgatacaagacaatagatctcagtgtgaagtaactcacagtgtggaatgggaaacggccacataatacatgatagaatgtgttacggaatgtactgcatgggatatgcaccgaggtttctagggaataacaaagccaccagagggtacctaacccagcatgtgggtgggagtgggagtgccaaagccgccttcttggaagagattacccctacactgaatcttaagggtaggcaggtgggtggcagaagaagggtggggcaggctccaaaagaaaagcttgcatgtgtgtactggagaaccaggaagctggtggttagcaatgttggagcatagggagtcagcagaaagcagctgaaacggacgccggaggagaagacaagggctgattcaaggagcgctttgaatgacctgtgaaggaactcggctctttatctcaacaatgaccaggagccacagagacaaatgggccttgccttttaactgtctcacttaggtagctgggaggaggatgggttgcaggatgaagcaatggcattccgttttcctccctgctcgctggtgaagatgctgaagaacagtgaattagccaaaagaaaagaaagcaaagtactcagacaacctacaaat

SEQ ID NO: 60074 - DNA, 1588 bp, Bovine  19866880991428
tagtaaaaaaaaaaaaaaaaataagttgatgatgatctttaattacatgttctgtatcccaaattcagtgactttttaacagacctgatcttctggcctgtcctcaggaaaagctgaaaacctagagggtttttagtgtaggtggaggctgagggaccgaagagtcctccaagtgccaaagactccagcgccgagacaggcactgacacatccttttggctgggagggcaggttacatgccggagacacacagagaaaatggtaaagtcagctctcaggggagcctgctgagaaagccctggcccctggggtcatcagcatgtttgcctaaatctctttttctaggaaagtttgacgggtttgtttctcccttacaaagagaggaaaagccccaagacatgggagatccgcgggactctttcttcaagaataaatgtctctgcttgcaacgagaaactcctaggctgtggagtttcacgaagggtggagacagtgggaagcagattgagtcttgctgtgggaaccatctccccaggatgtgggaatgggcagatggtttgaggaatgggtgagttacccatgtgctttcccacccttcaggttcaccagtactacagctgtctgccagaagagaaagtcccctatgtcaacagtcctggagagaaacttcgaatcaagcaactattacaccagctgccaccgcatgacaatgaggtaaggggctagaggggccttcagaagcctttgcttagaactttcagcgaattattaactttttcgtcatcagaatgctgtggtcagtgagatccccgaggaaaaactcgggcaattaattttagattttagtttccttaattagaggtaaaagaagctgtcagacatcttctggagagggttactgaaaagcagaatcttactgtgggggttgatttgcctctgtgcctggtactatactaactactgggggcagagagcactgaaccttaaaaagttcaagtccaggttttcttagttgaaagagtaggcgatgccagtttcctgagcatgttagatgaaatgagattccctgggcagttcaagcccagcacaaacctttgtgactctcctttgattttcagcatcttttcttagtaaatgaagtgtggaggttttccatgttacactgctgtagaagttacgtgcccagatttgcagctgtgaacatctgtgtttttgttatttccaatccaggcttgccaaggttatcctttttactcctgaaagtatgacttgcagattgtctttttttctgaacccagacaagggcactctaagcaggcatttatcatctttgaagtcaaatttgatcctaaaaggaaatttgtgtatgtgtttttaaaaagtcatcatgcttgggaggtttaggtttgcaaactagaaattaatgttcaagtatctggtttttaaaagtagtgatcctatagaatccagttgtctacttaactctaattgtgttttaaagaaagccataatttcaaggtaaaaggagaaatttaaaactcctttagagagctggacccagctttttaccagctgcccccacccacga

SEQ ID NO: 60075 - DNA, 1950 bp, Bovine  19866880993757
ttgtaatcatttctacctgtattgttcagtggtatgaattacattcacagtgtgggataacctttacttctatttccaaattgttttcattctccccaaagagaaagtttgtaaccattaaacactgactccccactccccctgtctctggtgacctctattctactttctgtcttcctgaatctacctatggggcgaagtacctttatgaaccagaaagcagtagaaactagtcttaggtgaaaggacttaattttgtagacaagtgaagccatacaatgtttcggagcaagaaatacgatctgatctatatgtagcttccggagcttcatctggcagaagtttgtgggatgaatcggggtctggagaccagttgagaggctgttataaagctggggtaaggagcattaggagctgctactgaaatggaaaagaagatttaggagacgttttggggaatatttgggaggaagccgctacatgacctggcaaaattaccttggggagaaaggggggatggaggggaacagatgttttgagtctaagtaacttgtgtgattgctttgtaagctatacttaaattcagcttctgtgaaaaagtcacaaaaacagttatgtaaattatcaacgcagaatataagaaaaaggtcagtatgaggtgtgatgttcttttaggataaagccaaactaaggaacaaagaattctatcttctcttaaacttcacggttcgtataatgcggcccttcatgggaaggggaagaggtaaggatgggtgatcagtcactctagagtgatggaaggtgacagcccagggcgtgagagggaattaattctgtacagaagatcagtcctcctggaggagtatgctgtggtcagtgctggacaatagtaaggtgagatcatagctaggggcctggagtctcgagttcaaatcccactctgtcacatcctggctgtgtggccttggtcaagctacttaacctctatgagcctctgacatagggagtcataagagtatctatttcattaggttggtgtatagatgaaatgacttagcatttcttgggtgcttttagaagtaccgagcctcatgtaaatgctttgtaagaatttgctgccattactattattgttattaggctaatttaaaatataaaccaagataaatgtttccctgtaagcttgaacaatatagtttaccaagaaaatcagaaatgaagaaattacagagtttcagaagcagcctatggctcaaatatctgttttctgtggtttgagttaaccaagaatactgacttccatgtcaatgctaattatccatttttgggttaaaagttattttttcagcacataatcagcatcattgtaactcacttttgaagatttgttgacttggactttttgtaataagatatttagattgtctccgtggctgggtctcccttttcttttcccctcctgacatgtgatattgagttgagcgcatagtaagggttgaaccgtcatgtggttgactaaatgaaggaaataataaattacctttatgctttccagtcatccacatctgtaattgggaatgcgaatttaaatagatcttttgcttcacttgtaactgaaatcagggactgtgttttgaaggtcatatttagctttcaggggcttgtggtaaagaaccgacctgccagggcaggagacataagggatgcgggttctgtcccggcgtgtggaagatcctccggagaaggaaatggcaaccggctccagtattcctgcctggagaattccatggacagagcagcctggcgggctatagcccatcaggtagcaaggagtctaactaagcacagcacagcacagcacagcacagcacagcacagcacattcagcttctaaatagtgggttttcctatgattttcattccggaaaattcagaagactcccagatttg

SEQ ID NO: 60076 - DNA, 2159 bp, Bovine  19866881090092
gagaaaattccaaagaccaagaaatgcaaagcgaaggttgtatatgactgagagaaatgcagtgacacagaaagaaaccaagttcatctaactaagccagcagtatttatcgcctgtgggcagtgccaaaatgtttcaggaagtgccagtgtctttctctgtcaagctgggccaaacttttcagcgcagcatcagatcactatgtaaatcctcatttccttactctcctttacaaagaatcttaacagtaagattgatggccaatgcaggacacccccttccctctccaaaaatgcagtttcattacctaatgtttctagacctttctagaaaatcttttggtaacagcttcaatggaaatggagaatgaattagcgcagtttcatttctcttcctggtttctcactggggacccagatgtcttcatccgtacagcaacatccttctcagactcagcaaagtcagctcttccttctgaaccggaatgagcaacgacggccgagatcaagggaaaagccaaccccatgactgcccttccgtcaagagtggtatctctgggacttccttggtaggcctgaggctaagactctgcactcccggtgcaggcagccaggggtcaattcttgctcagagaactaggttccacgtgctgcaactaagagttcatgccacaactgagacccagtgcagccaaatacataaatatttaaaagaagaagaagaagagaaagaatggtacctgttcaggcttcagtcctgggggaacccaggcgtactcctccagggcacagcctgagtcatcgtctgaggtcgagttcctctggaagtcaaacatgagtttgctgacggtcttctccatcgccaggggcatcgccgtcaccatgtgctcctcctgagggcacttgcagtgcaggcagatcttcctgcaagcagcgaaggcaggaggtgagaagaaaggcaaaagaaaccatttttccacttggcctgccacactccagcccttggatcccaaaccataaacacattccttggcaactggcttttggcaaaagcatctaaaggagtgttccacaccccgcctgtctttgtagaaggcgtggccctgagtacctgcaaagcccctgaacagtcagaggccaccaggtaagcatgctaaggacatttaaacatggatgccgacctcttctaaatcagtatcccaagaggcaagtcaaaataccttttattttactaggtagaacactggatatgcaccatgaccacaatttccttgactggaatagtaattaaatatataccatacatagtcagaccagaaatattaccaggagatttaacaaatactgacaacattccatttttataaaaagtttccagaccttaggaaaagaaagtgattttaaaaataactgcaggtgagattttctttaagaagagtaaaaatagttttttttccccacaaaacaaatctgaccctaagatcgcctgggaaagacattttcatctccactgaagatccttgtgggtttgaaattctaatcagaaaccccaaattaccccacattggtagctgtttttttaatgtacaagagcaatatgcatgtgaattatttcaaaagatagcagccaaagacacaattctctcccctaaattgaacatttctcttttaagattaccatctgttcccttttccatggctacaaaaatgatgaagcaataaaaacgttgatgtcagcaacacaaaagcacttttagcttccaccagtgaaataaaaagtaaaaagagaggaaaaaagtaaaggaggaaaaagatttaaagaaaataagctgttctacctgcactctgacctttagaattagtttcaggagcaccttataaaagtgatgagacggcccagaattctaatccccatgtgcctgaatttttcgacaaaagctttgtgaagatgtaattcacataccataaaattcggcattttagagtgtacaattcactggtttttaatatatttatagagatgtgaaagcaccaccattatctaattttaaaccattttcttcaccctccaaagaaactccaagtgcattattagcagtaacttctcagcctcccctccccctgggccctgacaaccactaatctatttcctgtctttaa

SEQ ID NO: 60077 - DNA, 1127 bp, Bovine  19866881122967
tggctgcattatattctagccctgtgaccttgggccagttaccagatctccggtctgtgcttcaccttacttatctgtgaaatacacactaggtactgccccaaagggttgttgtaggatgtaaacgagtttatttacatcaagcactttgaagcacttattatgtaaagcactttatttacgtaaaacactgtatctgttagcttgtgctgcgtaacaaagtgcccccaaatttagtagattcgatcaatatttctttctgatttctcttaattcaggcaggcagagcatgccttctggtctcctcgtctggggctgggttgggctgttggctgcttcacttagatgtttagggtgatcacaattgtgacagcaggagctggacttgtttacatggttgtcataggtttctgaacagcagcaagagggcaaagcccaaatgcacagttgcttttaaagcctctactttagttatagttgctcatatttcctctggaggagagcatggtttccctctccagtattcttgcctgggaaatcccatggacagaggagcctagcgggcaatggtccctagggttgcaaagagtggaatgcaactgagcacgcatgcacactaatatttcattggcccgagcacatcctataatcatgcccaagcacattctctaagcaagcccatagccattctgggaggagatacctcaagagtactggatgggaaatcactcagaccatgtttgcagacagtatgcttcaagcaccctataagcattagctgctactattactattattatttttattaatattaactctccaacataaagctcctaaaagtaaagacatattcaggtaaagctcttgatgtatcttcagttagtcattagcacttgccgtttccaaatattgtgggagcctcgaaaattaatacttgcaacaagagagtttttaagaggagcttattctgcagggttgaaattattgttttggttacaaactgtagctgtccctactggtctccctgggagcattttgcaggttataaaatacaacgattactatggtaatcatattgcaagtataaaatggctttgacctacttgttaaaatgcagtgtgtattaa

SEQ ID NO: 60078 - DNA, 790 bp, Bovine  19866881209809
agcagtatgagagaaaacaagcagatgtccttttcccaactttacagctgaaacatagaaggaagcatggtaaaggacttacagcaataaagctgggacttaaatccaagcctctagggtctaaatccacagtttcctccccctcccacactctctagacatattctagagaatacctattctacataaatgcattcttagggctgttatcaaccctgaggaccaggcttagcattttcaaacagcatttgaaatcaattctgccaggaagttgtcgtgtttgtcaacagtatgtgtagccaaaatccccaagaatgaactaaaatgcttggcatcttttttcaaaagttacgtaaggattaggctggacctgcatgcacagagtggaatgtcccagaaaggaagtaattgcccagacaacccagttttgaatcatcttcacctgcagtgtccttataattgacgcaataggtatatccagaacctgaattgtggatataattgacctgattatctccatggctttatttgtgaatgtagttgcacataaaactaccaggtactgacagtctctgccctaaccataaattacctccaaaacagcatcctctggatccttagccaccgctctgtaaatgactgtgtcaggggcagtgtcttctaggatataaatctcagtaactgccaaaaaaatgtaaaatagatgtgcttgaatgagtgtcaccattataaggccagaaactcctcattcaatcctagatcttagacaaaactgaatgcattatgctta

SEQ ID NO: 60079 - DNA, 1944 bp, Bovine  19866881210607
atggtaaatctgcatgtaaacccagtgttatgctctgcgtgtttcggtctggatgataaagctggacagtggcatttcctcataaagtgtgaaacaacaggtgggagattaatgaagcagttggcacttccaaaagattctagagcgactgttccagcaccatgtcctagggttcataattacctagagaaatgcagttggaacaacagattcatcaccaatctgttgagtgcctgacagagtacttgaagaggtaggaaaatcaccgttaataacagagtcatgcgagaacaatctaaaacttgttgaatattattagtgtgacaagatatataaggaacaacgacaagcaaactgggacaggttttgttgaaagctgtttttagttcaaacacttatttggtttagaatacacatatatagcaagagaaagcatggaatataaatacatacatcatatacatataccacacatacacacatatgtaacatataaatataccaacaattataaatacataaaaatatatcctcctatcctcatgttttagttttttggtttaagttggcatccttggttgactagctcatctggggacttgtgtgggtcctttgggcattttgtggtcttatttctcctgggcttagatttctgtatgagctccttcacattttactgaggttaaaaatttcctacttgggaacaacgcaagtcctcccatcaccttcccctcaagaggtgtatcccttaattatgtgctttgcagagttacaaaatggcacttgttgcttcaacaggtacaaacgccgagtgcaatggaagactatgaggaacacagtggggtgagcacaaggacaaacacaccacaaacataacatccctaaagcaaatatctagtgcatgtatccgcagcagactttgtgagctgtctcccagaatccatccattccttggacctgagtaacagaatccactgtgatacagtaaagcacagtaaaatgagatctgtctgtaatcacaagagcaaaaaccgaaataaaaaaaaagtgagtggaaaaacaaacaaaacgtcagatcatgggaatgatgcagtagaatgtttagataattccagttttccaaatgctgtcacttatgttttctcctttgagcctttggaccacctggctgggagagtcaactccaattttctcacctgtatgttgtggacagtctgctctagaagcggtaccagcagctcctactatcactcggtccggggtgctatatcacccgttgttggtttctcttaccctgtccacacttctgtaaatggttcctttggtaatgcctcctcagctagcctgcttgtgtgtgttagctgtgccgtgtggggagccttgattggtacaacagcatgtccagttgtggggagtgtgcagtagagttggttccccaaaccaggtgtttctctgggcagagccgtgtctcatctcctcccagcatgtagaaagggggttgtcaaataacagttgcatgaatcttgcagtgtgttggccaaaagtcagcaggagaaagaaatgaattgcaagctatttatcaccagtaggcgatgcaatcaagccccttcatgatttgtgatacaaagtaggcttccacaggaaacatttattttagcttcatcattctcttcctcctaacgatgtttactctgaaaaatgcctctcataatttcctttttttttcttttttggcaactgcatcctcttgtcagtatcctcttttctgccaagagcacacacagcctcagagattccaactttttcagaagaaatatgactctattaattactctgtgaaatgagacttctgacactcagctgtaggacaaaataagaacctgagaaacgtcataggaggagaagaaagattttacccaaacagatgctagaaagtcaaagtta

SEQ ID NO: 60080 - DNA, 938 bp, Bovine  19866881212366
tgcaagtaattcatgtcaaaggaaagactccccaaaggcttgctcatagagattaaatgtttctggtcctggccctatacttttctcagaagagaactggtttcctgggccatatttggaagtctcatgaaatgttctttgtgaattttaccaaacatggaatgacatttcagtattgataccggctgtggaaacttacatttagatccacctcctacacacatccttctaacacaggagatcagaccagatgtgttattcaagtattcatgattgggcaacaactttcttttgtatttgacttcacgttgatgcagagaaaaactggttgccatctgggaaagagctcaccactgctttggagtctgatgtaggatgatgataatgaagacatggataactgttaagggacttccctggtggtccagtggctaagaatccacctgccaatgcagggtatatgggttcagttcctagtccaggaaaaccccacatgccatggagcaactaaatgtgtgccccaactgctgagcaactggagagtagccccggctcgccacaactagagcaagcctgtggacagcaatgaaaaccaacacagccaaaaataaaagaagtaaatccattttaaaaattatgcttggaaaaacaactgtttttactggatgataggcacacacctatcattgaatccctatattaatcactgaagtagaagctattgcctacaatgatattaagtaatggatcaataaactaatgtattatgcctttaatttacagatgaagcccattagggtaataggattaagcaatttgcctgaagaacaattagtgtacttgaaattcaaactcatgttccttttgctctaaagcccagggtgtttcttctcatacaaccaaaacctgaccaaagtgtattccataaaacacaagtc

SEQ ID NO: 60081 - DNA, 828 bp, Bovine  19866881292235
aactttatggaaattgcatggagaatttcccaaaaagttgtgttgtttttttttctcaaggtctaaatgacaaaggattctttcccagtatacttagcatttgattgccatgcagttttgatttttttgtgggggggtgggggaggacactgcagagggtgatgttgtctttttataccctgctgctctgtgtgacaagcagaggaagactcgttttttgcaaagatttctatctggatgtcttccagaagatacaaaagatggagggtcagtggaggggacagacagatgcaggtactgtggaattcagtgtcagggaaaactcacgtatgatttccctgcaagtgtagcccaaaggcctttgagaattgcctcacaattgacttttagtagtcagcttgcatacagcaatcatacccatcacaagggtctccctcttcacggaacacctttccaggcaagataccagacatcagggagtgtgtaggtgacattgcttatcacatctctgaaagtttgccttgtgctgctttttctttaaaaaagaaaaaaaaaaaaagtgaccgcttgatttcttagtcccatttacaaaagatccctttgtattcacctatgctataatgtttccagggattgaggctttatttaggtttttgaggatgaatgattatctgttgagttagctttcagataaagtctgattttgaacctcagtttgtctagcctagagaaaatgtctcatattaacatgttataattgatgatggcaaccattagctattaacttcctgagtctttgccaagcacagaatgccatgtcttaccaag

SEQ ID NO: 60082 - DNA, 847 bp, Bovine  19866881309547
taaagtaaattaaatagcattgaattttcttatgctttttgatgtgaaagatgttttaatgatttctctaagacaatttggagtatcacaatgtgcatgtattattattttttagttgcaggccctgtaggattgtgaagtctctaagtattggtttcagacaattactctgtattttttttaatttgatgaatcaatgctcatatgatttagtgcatgaaagcattttcttacaaaatgaacatttgaactgtatgaaaattttccagtttgcatcacgaatttgttaaatggacgtttaaagaaatatattcactacattgtatatttgcaggtttgtctctctgggtttatctaaccctgaattcattgtgagtaaggtttggagtttttttcctctctgattagcagatattcagtgttgtagatggtgactgcctgatatttattctatttagttagctaaatatttacattcttgtaactttctatggtgttttgtggcttttatcctatgggccatgaacaatgggcccactagctgtgagtgttggtggagtgttgtttctttagaatgatggagatgtgggtgtcagacaccacagtcaagatattgtgctgacatattcgtttatcaaggatattctggagaacctagaacatgagctaaatgtttaaatcctacttatttgtaaagttaattaagtcctagatccaattactaagaattctgaagtctcagctcaacttacagtctgatttgtatgttacccataaattaaaaatgacttccacgaagcagtctgtcatctcattaaatattcttcaggatgtatgcattatcaac

SEQ ID NO: 60083 - DNA, 1939 bp, Bovine  19866881358889
cttccgccatttgataattaaccatctgacacttacattctgttatttataaccacatttttagatatcttttttattagaaaaaggaacacattatttttcctattctaaaaatcccatagtacagaaattaatgaagtagaatatcagaattctcgttaatgtaacttctcagagataatcacttttaagagtttcctttcatgtgtatcatttgagactttttctttgcatgtactcattttcatgcaaactgattttggtgtaaatattatttgaaaatttttattttaaaaaagaaacaattgtaatatcctcccacatcagcttttatggatctaccacattatttggcctcatagccataccataatttattaagtcaagcacttattgttggatatttagattgctctagtttttcactgatacagtgtacaattaacagagttttataacttcattagtaaaataagttcttgagacataaaggtagaaaagtcttagatttttagaaattttgccaaactcctctccagaaagcagtttagatgttcaccaggaggatatggttcttcgcattctcaccaacaatggaatcctataaaagtacgtatttaattattagtgaagatgaacacattgttatgtaattattaggcatttatattcccggcaaaaatttttgaagagccgtacactcacctttctttatatctgatatctccctaacatgtgtacctgatcccacccctgaccccttttgccccatgaaatcagcgtgcctcactgcacattgatgaggtttgctaatccatgcaacactcactatggcccaggcatggtgctggacaatgatggaaatttaaaaatgaaaagagaagagattctttttctgtggagcttaggcttttaaaagggtacttgacatggatgaaatcaagacacagattacatggcttgtcagcacccttgcaagtccctgattttacaggaatctgcactaacgtccctgaaatccttccccaatatcactgtcacacagagtcacagtgcagatagttagaattaaggccctattaatctttactagtgacaatggggtcccaaacaaattgcctaaattgacaaattaatatttgcacagtgtgattgagttttttttaataatccgtatatcaagttaatttatggcattgtgctcatcttaaccaaccctcattaaatgttggcattgaaaacagtctgcccaaaagtgattgcaaagagaactcgtttgccaagccctggtccctcacagatacaaaaataccataaaagattttgtcttcagggttaatttttaagaatttagtcttatttatctgtgtgtttagtttgttgcttgtcaaaatgagaaaggactggtttctctgatctttttaccagtcatcataagcgattattaagagagagtgaatgctgtcagttgtaccccattaaatatgattttttgttacttaagtcatcgttttagactgactttaactttaccattttgaaacctgaaattactactctgattacaatggtcttcagaaatggaatttagtctctctgaagagtgagtattctctgaaaaaaaaaagaagttgaaattttagcatttcctttatgcagattttaaaaagtaaagcataaatactccatattggaacaaacagtgccatagaagaaaatgaatgtaaatgccttatgttgcacaagactaaatgaaaatgcaatgtgaattactttctagctcaggctcatcactagtacccagatgattgtatttctatagttttaaaaaatcacttcaattttcaaccaaatactactagtcaaataaacagtgtgtctctatcactttttacagtgcttttggaagagatacagacaatataggaaaacagtaaag

SEQ ID NO: 60084 - DNA, 3323 bp, Bovine  19866881418377
tgctgtagggtagggattgtatggtaggtatgcaaatgtggaggaagaggagcttattaaggcagtgtttgcattggtcaagggaagagaaaattgtggcctagaccaagatggtcacaggagaaatggagggaagctcattaaacaagaaattacttaggaggtaaaagagtgggattctttggctatcctgagatgctggagggaggtagagggtcagtgatacagaggaaaattcatggaaacctaggagaatggtgaggacactcagagcaataaagggcagagtagaaggatctttggagttaaggcagatgctttatggaagacagagattcagtgtgtcctgcccagcacgtgtgggggctgttgggaaggagggagggagcaaggaagtaggagatattagatcaattcaacaaatattgagctgctgctgtgtcttaggctctgggctatctgctgggaacaaacccaaatcagagacgattctcaaaaaattctacaactgagtgagtaatgaaggtgggcatatagatagtttcaacgtcaagagtcaatgtgttgctggatctatgtgcaaaattggacaaattctgaacagcacctgtcctatgccgggatggtgcttgtactgtagtcatggtggtaagtgagtccagtgacagcctttccttggaggaaatggtattttattagagaaggtcgataaagaaagaaaggaagatgggaaagaaaaaaggaaggcagggagggaggaagaaagaaaaagggaagaaaggttggttgtataagaaaagtctcaggctgccactgagtataagaaactttcagcaaactgatgggagtcccctagccaaagtcactggtcagaggagccccacgtttcccagaaacagactgccttcaagtccctgccactggctgggagcggcccacacagcccatgggaagtgtggcttcagagcatgccgatggggagatttcagaaagcagcagcagaggcccttagacaactgtactctgcaaggcgattgttacagctgccacagctaggaaggaagtaattcaggtgaggagagagaacgaccttggtcaatgagcatttggatgctctgggatggatggtctctctgttgaaatgacatttaacttaaaatgaggaagatccagccatgtgaaaagctttggggaaagcatttaagtagaggaatcagcagcagtgcaaagaccccgtggtgctacccaagggtcccttgaaggccagtgtggctggaatgtaatcaggaaaagagcagagcagcagaagctgtacacaggataataatccagggtttggcaaatcgctttaagtagtttagattttattgcaacttcaaaggaaagccagtggagaattaagctgggcagggatacgatctgacttatacttgaagaagattctctggccactgtgtggagcatggcgtataggttttcaagagtggaagtgaattagatggtgacaggtgatgatgactgatgcagtcgaggtgtactgaccccatctggaggttgcagggtgctactggtgtggtgagaaaaggctttgtgagggagaaggcctctgggctgagaatgaaaggggtgggatttcagggcaagttgcaaaaaaggtggcatttagggtgaacttcactggctttctgaagggaggagcaatctcacagcacttttcaaaaaatcacttcactgaaacagagccaaagcagtctttaatttagtgccttttataggactgaatatagttcagaagtaaccaaggacattcacaggtgaaaagtacttaaatcagagagacagagtagttagggaaaggagaccaaccatttctttttttatggcccagaacattaactgaatacctcaggggccaaaacaaagaaaatgagagaatacttgtcttccttctcgacttggctctgaatccagactggaactgccatgcgccattttgaacttggagggctgaggtgaagttgaggtgaccttcagttgggctgatattggaggtctggttttcagaacccattctttgctactcctatgttaacaataacaacaaaaaggtaaaacctgtatccacagtcacaatgacaccaagggaaaacaacagaaagtgcaagtcgctcagtcatgtcaggctctttgcaaccccacggactgtagcccgccaggcttccgctgtccatggaattctccaggccggaatactggagtgggtagccattcccttttccaggggatcttctggacctagggatcgaacccagacctcctgcactgcaggtggattctttaccagttgagctaccagggaagtgagagagagactaaaccccaagatgtgtgaacttggtcatctttcactgttctaaatctatcaccagctcgtaaatgaatcacgtggtacctggagcctgactctgcccctacaaagtcctaactgaacagacaaggctcatgttaaaatacagtatggtcctggcaccacctgggtcatatttacctggggggctcatcccagatctactgcatcagaatttctaggagggaggctcaagaatgtgcatttctaacaagctcttcaattaattttgatgcctttaaaattacaaaacaccaaaaaaaccccaaaaaccccactgctttgaagtcatatgactgtgaacatgtaaacagatcccggcaccagctccactaacttgccagcaaccttggacttcagagtctgaaaagctgcctgttatgtaatttggttgtgccagcgccaaggaaggtgcgaggattctgtgacctgccaagagccgggtcactgtcagatacaccatttccaggacagtttgtgttacctttcccgccagatcttggctgctgaagactgatgacttaattccccaacccagacagggtagatggcaacccagctcccctggaaactgttcagatggctggtacccgagaaacccatcaggatgctggaggctggtagagagggagggattttacttggtctgtctccaactcttgggccatcagagcaggtccctccctgctctctgagcatgaaaaacacctgaatatcagagcaagtaggtgaccgctctgagcctgatgtacagcgcctgtcctcaagcaggatttggtcctaccaagggaccatctcagggcccctagtcttctaagggcaaagttacacaacccaagagggcaatgtggtagcatctacataactttcttgatcctgaaatccccaaggaattcatgctactgggaaaacgtga

SEQ ID NO: 60085 - DNA, 732 bp, Bovine  19866881642077
gagaaagaaaagaaaagctatttattctaatggaaatttctaatgaatttcagagactacattttcatattcaattttcaagaccaatttaaaagaatacatttatttccttaccttcaggtaagaatggggtccttattgttgacattgatgaggaaaatctttagatttccagcagtaaacagtcctccaggatcaaccacattaataattagtgagaaactgaaagggtagccacaggaaaaacagctaagattttatagtaactgacaggctttcacagaaatagaatttgtttcgctttaactgaccagtgaaaacaattgattcatttagttaaaatgtcagtcaaaccagttattttaacagttggcagtggttaagaatgaaattagtcaaatccgttgaaaagacaggcaggaatttagataagtctgttaatccccatcaataataaaaaactgaagggaattccttagtgtgatagagcaaacagagctatgggtgtgggctctcaccttgaaacactgacgtttcaattgggaaactgaccgacaaatacaaagaagatgctaaaaacacttcaaagcaacataatgactatgagaaaagagtaggctggttacaggattaaaaggtttttatctcagcagaaatgtttatggatttgaagaatgaaagtatgaaatgtatcctaatgaaagagaatgttcacattcatagtctgttcta

SEQ ID NO: 60086 - DNA, 824 bp, Bovine  19866881756126
ctgtgaaaaaagagaaatgcctggtactagtcaatggtcattactattatccgtgagatctagttaacatcctgcctcatgtcacccaagaattgagtcgtaactgcagtggctagtctgtcatgctatacatagtttctactaatactgtacaggcagagaattattcagcttctaatctgctgtggctactggtatataaatgcagacaacctaccagatggcctcattaaaaaaaaaaaattctgatttgtataaacgtcttcactgctatcaacctgagttcatatcacagagataacatgggggaaaaaaataccttgagagacccagaaaagcacaatgcaagttttctgagtccatgggaagccatgtgcctctcacttgtgatatctgttgtgttctctcgaggtccatggagaacagccagttacccatcaccatctggccaggctaattctgggtggctgcagctgcaacccagagtcttagtaatcacaactccaggttctctccatactaaatagttcccagcatattctctagaggcagcctccctcttgagcaagagatccagatttcaaggcaccgaacagcaccctaatcatttataaacccaatacgatatgcttcctgtctctcctttcaggagtctcctctgagctttcaggaccaattgccttgtccacacatctcacctggataggacctcttaaatggagttgtgcagtaggtcctataacagctccctctgttctgattttccaatctataatatatcaaagccagttccacgttatcattcaaaagcccagatcaaggca

SEQ ID NO: 60087 - DNA, 862 bp, Bovine  19866881933636
aataagcttcccattatactttgccaggtgttaaatgtgaaaatggcaccctctttgcccagcaatgtaggctggagatggcaaggtcatctgtaacctattttacatggtcctgtatcagttacaacacccttctctaacagtgatgctttcacacaaacagtaggttggactttttatattctggacttgtcataatgaaacattaagttccttttcacaaatgtgttttctctgttcttggtattctgagtcatgttcattgcctgcttaatgacacattttcagagactgatgaatcttggtaaacaaagttgcaaacagagaaaaaacccatgaggttgaagggggtggggacccagcacatgaaatgatttcttcatcctaattttcattcttggttatcagcaacccaaatgtcctagataatatatgttgttaagcccagtcattgtgtggctagcctagtcattgtatctgactcctttgcaaccccatggactgtaccgcttcaggctcctttgtccatgggattctccagaccagaatactggagtgggttgccattttctccaccaggagaccacccagaccaggtatcaaacccatatctccagcactgtgggggattctttaccactgagccaccaggggagacctcattgtatcagttatctattgctaaaagtgtgccgaataatgaaaactacagaaaaggagaataaagcaacagtgaacatttattttctgtgattgtggttttcagtctgtctaccctgtgatggagaaggataagaggcttatggaagcttcctgatgggagagactgcctgaggaggaaactggggtcttgttctgatgg

SEQ ID NO: 60088 - DNA, 882 bp, Bovine  19866882129215
attgtccccttgaagtgaaaatgagaatatgaatatctttagaagaaacataattgttaatgacacaatagcaagaaaatcagaccaaaagaaccagccagctactgtatgtcactacacgtcagtgcctttgccttcttgtacagatgaataaataccattctcggaaagcagaagtggccacctgaatggggcatgattgtggaattgaattgtcacctctggttatatcattttgtcatgtttcctacagtacaggtttaaagccaatcttctgcctatatttctgagacaggatgttctgaaccattttcagatctcacatcaaatagtgacaatgtgaggctttagggtttctttgtttttgtttttaatattaatataaaatcggttaaaaaaacaacttaaccttatagggctgacaaagtgctctcggaatgagcacctaataaacaccaccccacattttggtgaatccttgtcacgagagattcggtttaatgttaaggaaaatcaatattcacctgaagactgtgaaaagggaagaagctgtgttgttcaaggtctccttttcccatgaaggagaccaggttgaccggaggtggtttacggaactagaaatgtttgctggcatgcaaaccgtgactcacttttgttttatgcctgatgcatttctaatgttttcatatttcccatcaggccctcaaagaatcctgagagagaagtggcatgattacaatcagcctcattctacagattccatttaactcctctttatgtagcaccaggcatgagaaaatgagtctctgggagattagggaccttgcctgtggtcaggcaagttcatggcagaacaaggactcaaattcttaagccagcgat

SEQ ID NO: 60089 - DNA, 1388 bp, Bovine  19866880255754
taatgattgcagcctgaaattaaaagacgcttgctccttggaaggaaagttatgaccaacctagatagcatattcaaaagcagagacattactttgccaacaaaggtccgtctagtcaaggctatggtttttccagtggtcatgtatggatgtgagagttggactgtgaagaaagctgagtgccgaagaattgatacttttgaactgtggtgttggaaaagactcttgagagtccctgggactgcaaggagacccaaccagtccattctgaaggagatcagccctggcatttctttggaaggaatgatgctaaagctgctttggccacctcatgtgaagagttgactcattggaaaagaccctgatgctgggagggattgggggcaggaggagaaggggatgacagaggatgagatggctagatggcatcactgactcgatggacgtgagtctgaatgaagtctgggagttggtgatggacagggaggcctggcgtgctgcgattcatggagttgcaaagagtcggacacgactgagcgactgaactgaactgaactgacactggaatcggcccacactcccgtttcccagaggtgtgaccttaaactttcttaaccttaatttccacctgttcgatgagtactgataataacctccaaggatcattgtgaagctttaatgaaataattcaagtgaatgaaagacacttaaaaaaaaaaaaaaaaacagctgactcagtatttaggggatcaagcaggctacccaggaaaggtgccccattctctgaaataacttcttcatcttgagacatttttacagaagtctagggtaagaaatccttcttataagaggaaggtcttagactgacattctggtggaatagagaagagatgtgggtgataaaatggggaaaccaggaatatttacttcataatatgttatgggccaggctggggtggttattctgtgtcctttctccacccagcatcacaagacactgtgtttcttagaatcagaggacccatgggtcatgcaggacaggtgtacagtgtgctctgattgttacagtccactgataggaagggaaattgggaaataaatcacagtgtgacagctccaagtgaagtcaagttcatttcattccaaatgaacgtggtagtttaaaaagccttggtgtgtgtctgcttatgcaaaccattattcaaaatagacttgtttctttggctcttggaaatgtagcaagatgagcgggacttcctgagaaaactgctgcaacatattctatatttaagtggaaataaattttaaagagagttttaaaaaattctggtaacagcaaaacaggcctcctacttcttttgtgctggctaaattccaaggacactgac

SEQ ID NO: 60090 - DNA, 952 bp, Bovine  19866880597738
attagtctgcccccacccacccctgcaaaccaaaaggcacaagacaacggcttactgacaacagctgcaacattaactttgaaagtgattcagagagtgatcaaagaaagtagattcaaacgatatgattatctaggctctcattaacatttaaatactgtgtatccctacaaattgtggggaagtaatgcaatctgttactattacattaaattaggtcactgatttttaaagacttatcttgacccaaagtaactgaagtaataactctgcccagctgggagtcctgaatggtcagaatggcctgctgtgtatttctgcattgtatacatatgtgtgtgtgtgcgcgtgtatgtatatctgttttcaaactatgacttaatatttaagtatttcgactgccattttcaggctttcctggtggctcagacattaaagaatctgcctgcaacgcagaaaaccttgttttgatccctgggtcaggaagatctcccgaagaagggaatggcaacctactccagtattcttgtctggagaatcccacggacagaggagcctggtgggctacaatccatggggtcacaaagagtcagacacaactgaatgactaacacacacacacacacacacacacacacacactgccatttttgtaagtgactgaaaaatacatatgaagaaatgtcttagaatttccccatagagggaaaacagcacttgggcaatctgtcatgtttttcagcattcctcatttttctcatgatttgtgtcgcacggaacatgtttatccaatatgaagaggaagagttttcattgctcaaattccctgtttgtagctttttgccttgaagcaataaatcatcagcaaagtgacttagtggactgggtgagttttcctgtattttcagttattatgaggcaatgatggaacattgaacactcccagtaaatg

SEQ ID NO: 60091 - DNA, 1180 bp, Bovine  19866880707480
gatccctcgggccgtgtgacggcacctcacatcatcccagactgcagtgactggaacccacgtgtgaacatcaaggacgctgtgttcccagggaagaatctcttctctagaagggatgctggacttccggcctcgggaaatcctctgacttcttacttccttggaaataccgccctatttctactgctctcctgaccaaagaagacctcctctatcacagaaggggacttgatctcttttgattaattattttacaactccaaacacgactcagatttcaaatagtagtagccacggctgcctcatgttgacaccatttcagagtatcatgaaaagatgcacaacgaggcaagatatgggtccctgcgagggaaaacccaaccctccccaggtgactgttaagtaaacaggccgagtgaaatcacatgacatacgggaaggccaccgtatgcacagacccgacagatccatgggcccagaaagggaatatgagctacacggtggtggtgaccgtaggtggaaaacatcttccacgtctaaatctgataacactgacttacaaaaattggaagtttcagaatcagacaataccaagatcaaaggccagttatgtcacttttggggcaactttcacactaggtgagcgacttcagctaagtctcgtcagatgagtcttggctttcgtacatgtaaaagttgagctcataatgtttatctaaaaggagaattgggaggattgactgcgacaacactagtaaaatgtctggcctgggttttaacagagcagagacattcaaaggtggtgcccctttgattatgctatggacccagtggtgctcaagggtgggcaattttgcccccccatttaagagatacttggcattgtttggagacagttcggttgtcacaatttggtgtgcatgaaggaggtgcttccaggatctgacaggtaaggaccagtgctgttgctgaataaacaccctctcacacaagggacagcccccccaaatgaagaactgtctgtctccagattccaggagtgccgaggctgaggtgtcctgctggatcgcatggcactgtagggtttctctttcgggcaggacccgtgaggacttacagtgagtctggctgaaagctccagcataaacggtagttctgccctcaggacacgggacacagg

SEQ ID NO: 60092 - DNA, 2720 bp, Bovine  19866880723744
gtcccctggtggctcgtggtaaagaatccgccggtcaatgcaggagacagaggtttgatcccagatctgggaagatcccacatgcctcggagcaagtaagcccgtgctcggcaactactgagcctttgttctagagccggtgctccgaaacgagaagccaccacaatgagaagcccccacaccacacctagagagtggcccccaactagagaaaagcctgagcagcatccaagacccagcacagctaaaagtcaatcaatcaataattttttttaattttctcttaaagttattttgaaattaagaaaataaaaaacagctagaaaccttctcagtatatcaacaggaaaattgttcaataaattatgatatatccatactacaatttaatagcctagtgtgaaaaagattatgctagagttctgtgtgccctggcctggaaacttgaccttaatataattgttaagcaattactatgtacggcgtgcatagtattttctaagcatacatctttgccatgatagtgaacttgtaggaagatgtgattgctagtaccactcatgtcaagaggtggaaaggtaagacaaattattagttataattagatctaggtactcttgcctggaaaatcccatggacagaggaggctggtaggctccagtccatggggtcgctaagagtcgggaacaactgagcgacttcactctcacttttcactttcatgcattggagaaaggaaatggcaacccactccagtgttcttgcctggagaatcccagggacagaggagcctggtgggctgccatctatggggtcacacagagtcggacgcgactgaagcgacttagcagcagcagcagcagccatacaatagaaaactgaaaaaaaaaaaggaaaacaatcaaaaacccatctcacacagagtcggacgcgactgaagcgacttagcagcagcagcagcagcagcagccatacaatagaaaactgaaaaaaaaaaaaaggaaaacaatcaaaaacccatcagcttaagtaaataggtttcaatgctcttacaaaaagttcagaaatacatggtccagaactaacgtggcagtaggtgcgtggtcatcaattcaggcatcacctttcgtttcatcatccttgactctacccccaagaccagctgtggtcccagatggcagctgatgctccagccatcacatctgggcaggaacacgggagaagctgtttatgcctcttttaggaatctatctcagaagtgccgccaaccatacctaattgcaaaggaggctgggaaatgaagttttttagctggcaataataactgtatggtattttatttcattgagccccaataatataaagctttattactaagaaatggagaatggatattggacaagccaactcatggtccctgccaaaagaggattattcactttttttctgaaatagacttttgtattctctggctaaatataatgagaattcactgctttacaatttaaaagaatccaagtgggaaagatttttaaaggagaaaagaggaactgacttatcttagcatataccatgagcccaccaggcatttcgtgtcatcccaaaggggacaggaggactcctcctcctcttttgcaagaggaggagtccaggatggagagaggtgacacaaatttccaaaagtgtcactgtcaccgagtagcagagccaaggtgggagtacaggagtgtgtggttcccagttctgtgctgcataatctaagaccactttcaggagggggaaaaaaaccccaacacaactcatgtatgattctagaaccctagatttgagagggtctgtattccctaatcaaatcattaggtgaagaacaagacagtgagttctgacctttctttaacttccagacctctgatgggcgttatctaatgacctgggcttacttcaccagcctctagaacatattcaattcctggcaacataaatctttcttttcttcttttttgttccttttattcatttttcacatgaacatctagacaaacacacagaggtaaaaaataaagagcaccttttcatttttttcctgttttcctaacacatctaatttcttaagagtgagaaggacaagactagagccttacataaacactgggctcctctcggatttttattgacatgaatttatgagggaatcatagaggtgaatctacagaataatattattccagccaagatgctgtctgctgcctgctgggtgggaaaacacgagcaccggggggtattttccttgaagcactttcaattttagacaggacagaaacaagcacaaaagaagacattgtattcctccatcctgccctaacaggggtgcaaatcttggactcttgatcccatcagaggtagagttttgtccctgaaataaaagcttttcccagagaaaaatgaactgtccgccacggagaatctttttcatggtgggttctggttttctccctataaattccaggaagggactagccctgccctctggaagcacagagaatgagctggagctttctcttctggaaggtctgttgaatactggtacatgcctggtgtttctgccaaatgcgtctacacttgcctggggatgtggtagagagtcagccggacctggggaggaaccccagcttcactcctcactcgcgctggaactcaggcgatccctcagctcttcgact

SEQ ID NO: 60093 - DNA, 1834 bp, Bovine  19866880769236
gtccagcggcttctcttacccatcttctccactctcatgatgaatgtcaagacatgtaggttaactgcccgagggaccacagcacccatgtggtgaaatcaagcattcttcccaagtactctctctcagccccaagttcccatgaatccaagacagagcctgggaatggatgatgcctctggtccttctagtgagaacagtctatgaaaaaaaaggtgtccatgctgctaactagaaatttccagggacattagtcctgaaaatccgatctgatttggtgatggatctgcatcacgtgtgcattcactaagcaaatctaattctgttgctgaccagcgagaaagagaaataatttaaacggttcaacacagttgcacccacgtttggctcagagcttctgctgtctcagctgacctgggctgggggaccagcggtgcaggaagctctcagtgccctggggccacttcacagggggagcaccttctaccccggtgcccatccagggttgcccccgagtccttccttcctacaagtggatgcaggaaaacggcttcatctgggcactcagagcattgcagaaacagcaaagtattgcagcactgaaggaaaaacaggctgtattggacccatgagacggagtctgtgatccaaacgacacctccttcagaacttttccgagctgctttggactctgcaatgatctcctttcaccctggttggagaatgccacagaaaaatgctacccacccacccctaccccatcccccactccggaataattcttcttttctcctctctttgtctctggtatcttgtctccctgatccactcacttgttctctgctcattgttttccagaaggcttgagttcctaagcagaagactcgtctgccattggacagagcctgctgcaggtctggaccgccctgagtgctccaccccccaagtcgtcctcaaaggggtggaagtggcttcttctggcaaagtgccctctccagtccacacgccagggctcccattttttattgaggaagtagtggcctactccacttttgaacttgagcctctatatcttttgccaggtaataaacagagcagctcagtaaatgttgagaatcgaaataggggaggtaaggggaaatggatgtgtgtaagtggagtaaaagaaagctggcctaattttgttcattaccatgcccccagtgtatacaacagaggctgagcaggtgctcaatccagttacccaagaaatgagcccagcttaaccttctctttgggtgaatggggaaactgaatcttggcgctcctcagcttttcagtccttttccccagcagctgaatgcagaacttggctcaaagcagtggctcaataaatatttgtggaatgacgtaataggtaaataccaggactcctggaggccagtgggctgcacagaggagaaccagggccctctcttgagcaaaacctgggctggtggagggaagaggtttaccgccatcaggcagagggctggaggaggagcgcagatgcaagcaaacacaagtctgggcaaggggcctggggacaacggtagggtcttccttcacccataaaataatattctcccggtgcaggtgcagtgagtctcacccgggttgcacattagaaccatctgggaagctcttaaaagacgcttgggctgcactccctgagattctgatcaaaccgacctgggatggagccctggcccgtaccttcttaaaaaaaagttccgcgggggatattgataagcagagcgcgttgggaacacggagtcacaaaccagacagtagacaaggcggctaacgcggaaag

SEQ ID NO: 60094 - DNA, 1743 bp, Bovine  19866880780745
ctttcttgctagtaattttcgcatccttatacagcagcttgggaaagctaccctacgctgggacagactgtattctaaaattttgataacctgtaagttctaagatgtcttttctacctcgatacaggtaactcattaagaatatatgtagtttggatttgaatgacttgaatatactttagttccactttttgattcgaccaaaagaagcccaacaggtctcaaggacggcctgttttagaagcttgaagatgaaactcaatatcaagaatttgaagctaatcaacttgtgtagaaggaatgtaaagaaaacaatgggtagcttgaccagagcataattagaatagcacatatgaaccacattctctggttttcaaatatctgaactgtaataaattttttgatgtgctatttcaattttcagttgggcttccctcatagctcagtcagtaaaaaatctgcctgcaatgcaggaaacctgggtttgattcctgggtcggaaaggtcccctggagaaggaaatggcaacccactccagtattcttgcctggagaatcctatggacagagaagcctggcaggctacagtccacagggtcgcaagagtcagatacaacttagtggctaaaccacgaccatatttcaattttcagtagcaaagaaatttgtgtatagagaatctaaagtttaagacatatctaaatatcttttaaaaagaaagaaaaaatacttgcatgccctctttatcacccatattctagtcaacttatggaagaaaatatgttaagaaaaaaatatctgcccttggcctggaggaaccctctcttgctggactaatccacacttggaaaatgagtaatcactggtcgtcaagctgcatgttcatttcctggaggaatgaaaggtatgttcccaggttcctctatgtctgttccagttgtgataacaaccatgcttcacatttgtatagagcttctgctttataaacttgactcacatactgtaccgatcttcgaaaatcacccttggagattggttcatatatcagtacttatgaggaacctgctctgtgtcaggccctcggaaagaaatagcaaacaggacaaatgatctttgcctcccacccgaagttgaaactacagtgggaaggaaatacaaccaaaaaaaaaaaaaaacagagtgaacaaagaccttatggtaagtacagaggaccatataaagaggaaaaaaacaagaatactatcagttcagttcagttcagttcagttgctcagtcatgtctgactctttgcgaccccatgaattgcagcacaccaggcctccctgtccatcaccaactcccggagttcacccaaactcatgtccatcgagtcggtaagaatactataaagcaaagcaaataagtagacatacacagggagccctactctagagaggggatgagtcaaggcccctctgaggaggtgctgtttgatgagaaacagacaacccagcggaggctggagtagcacctcccattcagagaaatcagcaagagtaaaggtgatgtgtgcaagggggctgtacggggtggacaaacagcttggcatactctggaaactttcagaaggtaaattcctctgaaaaaactaggaaggaagcagatagaggtctgaaatgaggtcacagaggaaagcaggggagagatggtgtttaaagctgggactaacaggcaatgtatgaagggttttagttcaataaaggg

SEQ ID NO: 60095 - DNA, 972 bp, Bovine  19866880854183
cttttaaagtgtttctattcttagcctcctctgatttcatgtggaatttgaaacatattttctcccagaaataagtgtaggttgacaaactgcaaagatccctagacttgaatactgaaggaagactgggtttaaactcaagttctgtaaagacatgcgttgtgattgtggacaaggtggtcattgcttcattccatcagtagccattcacttagcatcaattttggcttggctcaagtgtaaactccttcaggaagtcttggatgtcttcacctcccccttggcccttagctgctctgtctttgaaatcccattatacctcatgcatgtctccatcaacaacctttccacactgaattaaaattattgttttatttctctatgtttccccgtcagactattgacaatagctggcatctatttgctgttcttcagcagcagtgcccatattttccttgagaagtcccctctcccttcctcctagtgtgtggttccagtgaacagactgatttccctcccagcctttgatgcgctccaatccacttggagcttcacatgcatgcatgtgtgctatgtcactccagtcatgtccgactctttgcagccctatggaccatagataggcctgccaggctcctctgtctacgggattctccaggcaagaatactggagtgggttgccatgccctcctccaggggatcttcccaacccacggatctaatccacatctcttacatctcctgcactggcaggcaggttttttaccactagcatcacctggcaatcccctggatcttcatatacttagtgacaaagggataggttttgttgtgtaattgggacccttccagaaccaaggtagccagccctcttgtcctaagtctagagtttgtttctgctgactttgactggggggaagttgcaggcacagagccagcagaactaccatggagtaataaagagcatttcaa

SEQ ID NO: 60096 - DNA, 1415 bp, Bovine  19866880884116
tccaggctgccatataatgttgagcagagttccatatgctgtgcagtaggtcccttgttggttaaaaagaaaccattttttaaaaatacgttttaaatcaaattaattcaagattaaggcagaaaattggaaaaaccacaaataaaaaaatcacaaaagggaaaaagaaatgaaccataattgcatttcccaagggagaaccacagttcacatggggctgtgtggtccagagttctgtatgcccggggcacgtgagggctgtgcccccaggcacacagcagtggccctttccccttcattgaaatgccgcactagacagatgcttttatcgtcgtcctgatcatgaccagggcctcacatcactgagtgttctgttgtggcccttctttgtgatagctgcacagtttttgtagtcaggaaagtcttggaccctgactgattgatgcttaactaatcagagatgcgcgtgttagcatgatgaatgtcactgacattactcggggtccatttcaggggctctcaggtcctttgtatcctgaccagacattgtattcaaccatatgtaatctgacggccaattatttgccggacattctagaggttaggaatgctagcatgaatacaaaatggtttggctgtctaggctctgagcccacaaaatatagtctcaactctatcttagatttctgtctctgagaagtaagaggattcttactgattcctggagagccgattaccttgtctgatttatgatgtccgtggtatgatgtacccatttcacagctggggaagctgaggggcagcggggtgaagtgacttgtcccaggcaggtctgccaagtgtgtgtgcttctactcttcctatggtctcctctttgtactctctcagaagtcccacgtagtgtctactatgctggaacctcagttttggaagttggggggcatatccagagcatcagcctgctctgggggtccacacggaccctctcggacttttctctgtcttcagtttgactttaaagttcacagtctctcctgtggccaggttgtctctctcacctcgtgccttgaattgcagctcaacaaccccgagatggtggagggccttgtgctcatcaacgtgaacccgtgtgcggaaggctggatggactgggctgcctccaaggtgagcctgggggcctgggtcagccgggggtatcccaatctgcagaggggcaggcgtgcccgactctgcctggagggcagactgcaaggaacctctccttgcacccccttccactatccccagcaaagaaggctgctttcctctgcttggctttgaatagtgaacatgatctcagccatgcaccattcggatttcaacaaatcagctactgtccaagtcagtataccagtaggatgtgggtctccagccag

SEQ ID NO: 60097 - DNA, 3158 bp, Bovine  19866881077420
gtgtgggcgtgagctggaagactagcagggctgggtcctctgaacattcaggccggtgtcctgcaggggctgagctaagagctgctcaagacagaggctcccctgcagggcatccccacacaggccccgggtacagatgccgaggggtacactcagaggaggaggagctcagaaaatgtgtccaccaacccatgtggtagctgcctgttacttacatcaaagatataagagcgtcaggaagggcagaccacagcgtgcccccagctctgggcccaggcctgtgtccacgtcctcccactgcccccagacctctcttatcagtgaaggaatgagcagaaactgcttccaaatagggaaccctttccttaaagcccccagggcccagctggggccggctcaggccattcctatctcaaccctgccccctggtggagtatctgggtgtggctgcccacaagtgggcaagctaagctctggactattctgttcatggagtgcttgcccggggtgtgccaggagcagtgctgggcactcaggcattaagaaacggcatcctgtccctgaaaactccacaagagtctcccatatattttttaggggatccctggcaacctgggctcaagtgcattgcagctctcaccaccctatgttgcaatcttataaatgtgtctgtactgtgattgccgtggggtaaggaccaccatgcgtccatctgaataccagcccagccatgcaggaggtgcttagtgcatagcatgtgatgggaggatggaggaatgaatgactgaatacaaatgtgaatgaatgagggggtagggcagcctggtgacaagtcacctggagggatattttggggacactttcccagcttcaaaaccctgagcaagttacttcaacaccatgggcctcagtttcctcctctgtgaaataggggaaaggctataactgctcgttagggccactggaggatgttgttatcatcactgctttacacacgtgtacacagacgctcagagagggcgagcccagacccaggtcacacagcctcgggaaatgggttcgctcactgcagacgccccgcccttacctcctggtcccagggccccactcatcgatgaactgcacacaccttccaaggacggtggggttcagctccctcatctatcgggatgattaaggtctcctgggcggcaccccaccaccaccagcctcctactcgctgctaccattcccatcaccacccacttttgtaaaaatgaagtgaaactgttggtaaaagtcaaaggatagatttacatgttcctgaatctatttttagggagttggagaacatcagaaaattcagtcactgcccacttctaaacatcacccccaaattatacacacagggtttcctatggggtcttcgattgaacattcttctagtttttcccttcttaaatttaatctgcttaagtttgtccagtaactatgattgaatggattgctttgaacctgcccactgagtgccctccttgtccagagggtgcagtatcgggcacggtctcggtccacctgggctgctggaggaaaacaccacactcgctgggcggcttacagtcttgctgcccacagccctggaggctcgaaatccacggtcaaggccggcatggtcacattctaatgaggccccttttcatagttggcatctttttgctgtgtcctcacgtggtggaagggatgagggagctctctggggtccctttcaaaagggcactaatccatgagggggtccacccacatgatccaatcacccccagaggctccaccttgtggctcaaatggtaaagaacccagctgccaatgcagaagatgcagggtcagcccctgggtcaggaagattctctggaggaggaaatggcaacccactccagtattcttgcctggagaaacccatggactgaagaatctggttgcctacagtccatagggttgcaaagagctggacatgactgagcgcacgcatacacacaccaagaccacctttagagcggttagaatgccaacatatggatctgtggccaacataacattcagtccccagcagatatttagcttaccgtggggagctagtcatttttaaaattttatttttgttgttgttgttgcttttcagtccttctcacaaagcatgaaaagcaaagtaaaccattctcagttaactacatgaggcctgctcacggagcccggtgccaccccatgaaaccacagaacggcgtgtgttctgcgggccggcctggctgttttgtgtccaggctgatcaagcagccagcagggtaggcatgtaagtgcagttctagaaaagccacgcattaggaaaggaaaatggcctagaacctccccccgccttacactcccctggcccagttctctaagacacgcttcccgttcccacaagaatcaccagggacgcaggatgaattacggattccgggcccagcagagaagagttgaagctgaggattccaagtggactccaggcacctgtaccttacaaggtcctgaggtcagcggttctcaccctcaaccacattcaaggtccaggatcctgcccgggatcctgcctcagtctggctgcctggggacggtggccaggcaccagtgtttattaaagctcctggatgattctgacaggtggcaatgcttgggagccaccccaggaagtgactgttagaggcgctgccctgaggtcactgctgatggaggcggcggctgagcggacagaaccaggcaggggcctgagccctgggtgcctgtcttgggcagcatcagggcacagccccaccccgtcttccccataaacacagtggcatcctcagggagtctgcctccagaagcacgtcgtaaaagagactttcatgtgaacagctgcggtttggaagtagccaaggctgttcttgactctctccggcctccccagacgatagatactctcctcgctgtctggttgttatccttcccttttttcacccttagcttctgatgttagaaaaaaatgacgtaggccacacacagcagtgagcttacaacggtccctgtgccaaggccaagggcaggcggacgtgcaattacctcttgggcactcaagatggctgatgtgcgtgcgtgtgtgtgtgtgt

SEQ ID NO: 60098 - DNA, 1328 bp, Bovine  19866881098399
gggggtggggagtttgtagaggaggaagatagagagagactgattcgttagtgaaaggcctgtaataaagtcttaataaaagcttgcattcttggcagcgagaacagtgccttactcatctccatgatctccagcagcaaatagaggacttgaagcaaagtgagtcttcagaaaatgtgtgttttcatagaatcacagagagggaactagagaacccccagagatgacagtgatcagatataagggtccgcatgaaaggtgagaaaggaacatttggaaacatctggcatttgtgtatcaattttcatttggaaaacatataaggctgcttccttctaatttaatcctcattacaactccgtgaagtagacttaagattctcacgcacctgtgaggaaaggaaaatcagagaagtgtctagaccccagccactctggtaacagcgtcaggtctaacatacaatttctggtattcttaatctctgcttttcatatgctttcttattttaagttgccgttaaaagacaacagcaagaaatacattaatggattgatttccttcaaatatatagtctcctatgatcttcatggtactcatagttctcaaaaatagatacataaaaaggaaagcgcataaaggaaatcaaaggatgtttacctttttcttggggacactgactctgttgaatgttttgcaaactgcaaaagaggaagtaatctaatacctgaccacaaggttggattgcctcagtgctttttctctaagacaaaactgtggactgtggcaacacatgtcctaacaagttctctgccctggtccagccctctcccatcccccacaggtagaactctctttcatctgagtgtctggacaattaccttggagatattgatattgttttctggtcctgaccaacaggacagatacttagtcaaattgcaagtgaccagttagagcacatattttgaccctgaatgtgccttcacgctgtatcaagatgacctgttagtgtgttggtctactggactacactgttaacgcctttgatcaagaattaagcttattcatcctcatgcttcttgggcctagcgctgaacttggcacattgccaatggtcaacaacagctgtggaagaactggaagtagcatgctgtttttgatttgtcagagtttgaatcaaaactagaaagagtatgcatcaacaaacgagtggataaagatgatgtggtatatggggaacggaatataatggaatacccactcagccataaagaaaggatgaaaattttgccatctgcagcaacacggatggacttggcatgatgcta

SEQ ID NO: 60099 - DNA, 731 bp, Bovine  19866881251906
ggcaagagtctggagtggggtgccatcgccttctctgtaagaaggccctgggaggtggcaaaaatcaggtgaactatccgtggatgtttaaagtttgggaatcgccactctaaaggcagagtttcacatatttggaaattcacatgttgtttttcccattgctgcctcttcaaaatatgtccaaacaatctgaaagcaattggaccacagcagtgctgcacgtgcatgaggtatcttgttaaaactctcatggtttcagaatgtcttctaaatataacaaaatcaagtacccccacccccaatcagtaattagtcaacccgggtacacatggggctttgaaagcgctcatctctgctgtcaactgtaatcaaatcttccccagacttcttgttttccggatttacccaaagccccctgacttttatcagcaaatcctttttctctggaaacatcgccgagttagaagactcgagagaagaattcaaaattaaattgttctgccgttttctctctgggaaatggatgcaatcaaaacttacttcctctgattttcttttccttaatttttcaggctaaaatgggcttttttttgtggtgttgggtgttgttgcctattttgtttatcctcagctcaccccttccacagctgcatccagacaccttttcctcattagctgcaattcatcttctagctctgatgtttcgggctgcccagatccaatgctgcaat

SEQ ID NO: 60100 - DNA, 1885 bp, Bovine  19866881319479
tttccggaatatcgaagattaaaggaaagctttgtttcaaggattacccttacatatcacctctccctgtagaaaagggatctttgagacaaaaggaaagcataacccatgttttgtgatgacgtttggaagatctgaaggtgttagttctagaagtgaaggaagagtaacttccctcttactcttcttttccccgatttccaatggttttctcaaataagggaactacaagtttgtaggttcaccacacaagtagtacttcatgaggttgttgcctcacacactgcttcagagttgcttttttctttttttaatttctctaataagcaatttttaagttttaagaatgtgggaaataggagacatagtttttgactgacttgtgattaaacccatttactaaagcacatgttaatgggtgcaacaagaggaagttcctgaaatagtctactttaagtaaagtaaagctcatggtaagtcatgactcacttttgtgacgtggattaagaagtgagcgggccgaagctgcaggaggactcagccagctagctgaagagaaggggcttgtctcggttcccggcaagtaaagcgcggttgtgttccggcagtgtgaagagtgcctgtgctggcagcacagcgtgtgcatggggctgctggaggagagcatcccggagcagtacctctgctacatctgccgggaccccccgggtaagcctccatccctcctgcgcttacaggtcccactgtatgtccaccgcctgacatccccaccttccgtgtcagctagacactgcttccttgttaaaacttaaaaaggtttttcgctgttaagttttattttccacatcaattacttaaaacattagcataaattcatcagcataatttaacaccttacaggaaggaccgggttgtggctttttcctggagaagaactatctctttaatgtactcctgtgtgttgatttctaaataggctaatacatggttatttgaatgcattcatagcctgaactcaggctcctcctgacgggattttgaatgctcttctgggagtgctgcatgacgttgcagtattagagcaggtgggatgcccagggaccatggccggcccctttgtttcactgatgaggcaagtaggaccctgggtatcacgtgccttgtgctcaagacagttagactggcggcgccgggaggaactcctgcacctgcctcccctgcacctgggccttcctcgccacaggggctctgagcagcagtgtcctgcatgtggtgtgtgcttccagctccccggcggaacccatggaggcatctcagataaaggctgctgccttttcttgtgtctatcagatgaataacacgaagaagcaggagagttatttaaaccttcatgaatgtaggcatttgttcattcattcatctagcagcacttatgggattcctcctgtttgccagtctctgtggttagaggtaagatgaggtaagaggtaactgtgccatccactcgctcactgtatagtaggggacacagacatagaagcagctagttgtaactggatatagtcactgttgatagtgaagatataggattatatcagattctatagatacagagctcttagacatgaaggaggggtccctatttacttaactagaattctgtttcatccagttcaactagtttctgtctacccctttcaaccttttttagagaacagaagacagatacataaaaaatagaaagtaacactcaaggttcctctgcaggtgtgacctgccactgaccacatccttaatggagtttgtcttccttagtggacaggaaatctgactgtgggaagaactctaaacagcgccaactgctcgaaacactagccttgctcgt

SEQ ID NO: 60101 - DNA, 962 bp, Bovine  19866881384408
cctttgccgatgtacatggtctcctgcctgtgcacacgtgtgcgtgtgctcaatcgctacagttgtgtctgactttttgcaaccccatggactgtagcccaccaggctcctctatccatgggattctccagacaagaatactggagtgggttgacacgccctcctccaggggatctttccaacccagggatccaacccatgtctcttacatctcctgcattagcaggcaggttctttaccactaacgtcacctgagaagccccctcatgcctgtagacagtaccaaactactaaagagacatcataaagcacagagttgggaagagaggtgcacactggctctggggagcacacacaggccggctccagcccaccacccaaaggttacagagcactgcttccgggaaaggcctggccttccagcccatctgatctgtctaatttgagagcttgtcgttgtcgtttgctttgttgtttccttagcagggctgatctttatcaggatgccggagttatttcgagctgttgacggcaaacatctggaggaggggcaggcagtggggagccttggaagaaagcatttgggattggaggaccaaggcctctgtgagtctgggcctgagaactcctgagcttctggaggaagaagagggatttggactcagttatcagcagagggagacacagaaggacactccagggactgtcgaggtaaaagaagaaactcgctagctgacaggctgcagtgctgaggctgcgggcagacagttcaggcatattgatctggcttctttgctttgtgctgggtttgatcgctgacaggtcatagacccagacctgtggcagctgtacaaggcacgccgctttgatttagcctttcgatgtcatttgctaacaatccgcccaccaagattccctaacacaacagtcactcgtcctatctcaggccaggtctacatctt

SEQ ID NO: 60102 - DNA, 900 bp, Bovine  19866881419063
ccttgctcgtctttggaatttgttcttagtcctagagcttgcctcgtttactgagtgatattggtctggtagtagttgaagggaagtctcgagtgaatggactccttcgtcactgtaatctcaatttcatctacaggtcagagatggagtgcaaagtatcgctacgataaggattggttgaataatgggagaatgtgtgggttatcatttttaaaagaaaattactctcacctcaatgccaaaaagatagtttccacacaccacctgcttgctgacgtctgtggtgttacagaagtcctgcacgggttacagctgaagatcggaatactcaagtaagtgaagggtggccaagggaggggttcagttaggtgtaagttttaattcaagctaagtcagttgttttttgtttctaactaatttttactggagtgtagttgctttactggccaactggaactgatcatgtccttggtagactccatgcatcctggtatcaggcactttggtgtaccttgtttatgtctgtcttcccttactaagccttgagttcctagaaggttgggattgtgtcttactcatcattttattcctagagcttagtggagggatgagttctcagtaacaaatgaaattcgcttctgttggatgtcataaacctgaagatgaatttcttcataaaaaagtcacacaaatgctaaaactcaagagagaaactaatttataaagttaggctttaaaaaaaaaatgtggttgtccttgatatcaatatgaatttctgaacatttgtaatttcagtaaagatttcaactggacaaattttgcctcatgcctataggttctgtttatgttaatgtttctactaatagtagttattatcacagctagaaggcaaggcactcc

SEQ ID NO: 60103 - DNA, 610 bp, Bovine  19866881653437
acacttaaggtacttggaacggcttcagacacgtggtgagtttcatcagtggcacctgtgacctacgggcatcagcatggctggagtgtctcatgaaggtactggctgtactcagtgggctggaggagggccaggggccgggaagggatgaggttttaggaagaaaggactaaacgcacacaaagaacacactcggctcagggagtcagcggtccccaccaaccccagcaactcaccggaactcaggaagccgaagatgcccgtgcgatagctggccgtgaccacaatgaggttaccaacagcagccaggaaggagccatccactgccggccggtccccactgcccttgccctccgcggcattgtggaagaacaccagcacggacgcgttggggggctgcagggggtgcagaaatgtgggggctacaggcggccacctccccctccagagcttgggcagggcacctttgccatgtaggtgccagaccgagccaacacacaactctgggtgtgtcaacacacctaccccaaggccaggcaggggcaacagagcagcccaagagagaagtggcaaagctacttttgactggaaactccctgatggggaaagg

SEQ ID NO: 60104 - DNA, 1260 bp, Bovine  19866880584431
atgctcaaggaattcctgcagaagagacacctccatcttccctcctgatatggagacctgcaaaccggactgagaattggaggccgcaggctcgacgggaggtagggagccacaaactagaacatctgcaacgcattctcatttcccttctctgtcttccgcatctccccaacgggcatctgaacttggacttcccttccacgagctctgaggaaagcaccatatgtcagtttcgtcaggcccacaagctggtttccatccagcccactgtgatttcctcccagctgcagttctgtggaatgacccatcccccctggggcacatggaggaagagagagacagcagcagctgtggacacgtactgagcgcccgccaccagctgggagtcattctgatgacgtgtgtgttgctgatgtacagccctaagagtcccactgccatcatccctattttacagatggagaaactgaggtgcagaggtgttcagggacattcccaaggtcacctggccactggaggcagagcagggatctgagccacgctgatcatcagacttggccaatttgctgtgacagaaaaccccatcttggctaaaagatgttggccagaagaggtgagggtttagaggaaggggatcccacccagctggtcaggagtggggacaccagaggaaggattaacgaatccacgagaagggccaaggccgggccgatccgtctccagcagagcagtgttgagcccagtgactgaagccatcacaagccagggagtcctgggagggctggaaagcaaggaggactccctggaggcagccccctttggagagctggtcagggagcagcaagagccctcaagagaccctggaggctggtttgggccccttgccctgcataggtccttatcacaggcccttccactgctatttcctctgctccccagtgacaagcgcaccctccctgaagcctgcggaggagtgaggctacactgggcatagaggaagagagcagccctttggggcagagggacctgggctcacatctctggtccgagttggccagtagttaagtccccctacccccgaagctgtgagcctcacctgcaggatggcatggctgagaggtgtgaatgagctaagtgtcaagaacccagtgaggcttctggcacaccagaggtgtgtgacccgtgtgccctgcccctgttcttccttctagaacaaggaagaaggaaggcaaaatccctccacctgctgagccatggagg

SEQ ID NO: 60105 - DNA, 1265 bp, Bovine  19866880700307
cggtcatggtgtggaccggaaagcggcagtagaatgtgcttacatttccatagtagacactcactgaagtatggctatcagttttcctatttctctgctccttgggagaagacgtaggattctgctggcctcggaaaggccaggatcctgctggaccagtggctgtttccaccagcactgcccaggtcccaaagtcactgagcctgctgtcctggctcagcacagacttctttggcagcaaggatgctccagccagccctatcttttaatcagcagactgcgtcagccctgtcgggattgtttaaggtcttcttcctcccgggactttcttgctcttttcatcctcaaatgccaaccttaccctccctgccaacagatcacacacacacacacacacacatacaccctgccatgttcaccaccacgtcctcatagtaagttacagggaattattgatattaactcaagtttttccactccatatcaccccactatccacatctcccattgtcgcctgccccaactcagggggcctgacgttattccagcaacacatatcagagttggatgaaggtagaaggagtagaaatcacagccacaggcatcctatggggcgagctgaagaagcctcagtgatcaccacgtggcccctggagtaactagaggaagaagggaataagaaatcctttgcacacagaatgttctttctagtttcaccagcacgtggaaggaacctttgcttattcacttattcaagacatatttacggagcacctctatgggctgggtacagacagctgtctgccctgaaagggagacagccaagtagaagccggtgggtgctgagcagctcagcaggagtgctgagatggagatgagcacggtggggtgagggcggggggacgggctctgattggagccacaccgtgggacagagacgactttcctgagaaggtggctctcctgagcccagtctggagggaaaaggaagctgctccaggtggcactggggcggcatgtgctaggatctgaatgggtgtgagtttgaggagcagctggcaggtcactggggctgcggcttagagccagaagggaaggtgttctgggaggagccgatggcagggtggggtggcggggtaggggggtcctccagggcctctctgaggagtccagattatcccagagtagcccctagtcctgctatgtccccaccttccagcctgtcctctgccctccaccgggcttagcaagcgaggcctcaaaga

SEQ ID NO: 60106 - DNA, 640 bp, Bovine  19866880990257
ctgccagattctcagaggccaacacctggcaagctgttcttttgcttatacgtaagacccttgcagaacacgaaaaggtttcctggttgtctttttcattttgatgcctaccgttaaaatgcagagaaaatagtatctgatgcttcaaaaatataggctgagctgataagcatattgtcctcattttaagggcttattcttgttttaatcaaccagttgaggaagcaataaacaattactcgtttatgatgtttgccttcatccagaggagtgtaacagggtaagtgaaggtgatctctgacacctcaagaagccgaggtggtggtggtgcccatattctaaaaccctctctgctccctccaacctccatctgacacacactggccaactgtccccaccttcttggtgccgctcggtacctacctcagactagtggggtcagaaaaaagaaaggaattaggaagagtgagatggagccaagactccaggcagatgctcctggttcaagctgttcaagctctgtgtctggataaatgggttcagttatatccctttctcccaagtcagagctccctctgggtctcagggtgatgctgggctgtgtagaggctgagagcagctacattagttcaaatccagg

SEQ ID NO: 60107 - DNA, 3523 bp, Bovine  19866881109197
cttaaaggcagagaaggggacaggaggaaaacaaaggggaaaggcagaggtggaggaaagtagggtctggctgtccccaccacccagcagagaggccctcgccttgctcctctgtgcttctcggtgaggcctaaagccaccagaaacagactgggaggcacagagggtcggggctgggcaggggcacaggatgcaggaggatcaggatttttcgtgacaggggttgcattcagtgcttggcggtttaaaaaaaaacaaactgaatatccgagttgtacttttagtcatgaagccatcatatcgtaaggttccgatttgcccagaagtacccagtttgagccaaggctctgaaagcgatgctgtcattctataccacctcctcaccaaagccaagcaagcaagagcgcctctaggatactatcaagctttccttcactgtggtgtgcgagtgggagggggaccaagggtcagaaggcccagcaatggattgtgtccactctataaagtctcagagaaatcacctctaccacacccatgatgagaagttcctctaccctctgcttgaatgcctcctgtgatggggatctcatcttcttacagctatgtcctctccccagtcctgggttccaattttctctcgctaatatttgtgctattcttttcattaaaaaaaaaaaaaagccatgcttcttattcttttctccttacagagaagatcaaccacaaatagcatctgggtgtatctgtcatccatgaaagctaaactagccctcaccccaagcaggttttcctgattctagccaaacttttaaagctcccttctttccctctcccctctccaatcttctgaaacgctgtcttgcccttggccctttctgcaagcctcagccccaggcggggtgcagcgggacgggttctattcttgccagctcagacgcgcctttattcttgtccttggttctgtgcccttcctccagctttgaacgtgtccttctcagtctgagctcatccgccagctctgcgatgatgcacctcgtctcttaggctcctccccttctccttctcatcagaatctgtcacggttacacggtcagcatctcgtttccagaccggtgcaacattcttcttttaaggctcacctagagggtcatgcctggcttttccttctgtgctgagtgttaccggcccacgttagatacgttagcatcctcctctcggttcctttgaagtgggagagattatttgtttcctaaggcttccgtgataaattaccacaaactagatgacttagagcaacagacgtttatcctctcacggttttgggggctagacgtccgaaatcaaggtgttagcagggccgtgctctgaaggtttttcgaggcaagcagcttgtttcttcagcttttgatggttgccggcaatccttgtagactgattacaccagtttctccttccatcatcacatggctttccctgcaggtctctctgtacctgggcccatatttccttcttataaggatactagtctttggaactaggacccacactgttctagtatgacctcgttttaacttcactatatctgcaaagaccctatttctaaataaggtcacatttccaggttccgggtacgtatgacttttgggcgggggactcttatgtgactccctcaccctcatctttatttctctctcccgtgctcccacaaccctctaaagctttccagtcagcctggttcttctttcttgacatcctttcagtccgtcctagctcaccatcctgacagccgggcccattccgcccagcaccgactctgggaccagactaggtcctggctcccctgtttccatgtggtaacctgagaatgtcacttcaccccctgggcctcacttgcctggcctgtaaagtggggatgaaagaacctgcttcataggactgtcgcgatgatcaagtgaattcctctttgcagagaagagcaacgcctggcacagacaaggccataagtgtgaggtgtcatgtcaggccttggtcctcttgagcaggggtctctgcggccgctcccgagccagccgcttccagctccggtctgtcctcgagacacagatcttaccacgtcattccatgtcatctaaatatgttccaccttcaagtcaagatccagaaatttccaggggagaacacaggacctttggcgaggtggctctaacctactgtgcccccaactcaactctcaaagtcctgtgcatgtaggtgcacacgcatatacccgtgtacacacacacacacacacacgaacataaattgttcttaagccgtgctgcgacctaactgtggctcttgagaagcaccaaactcttccctgcctctcagccttcataccactgctcctctccccagacgtctgctacttctccttccaggtagattaagtcaggtccaccatctccaaggggcttcccaggtggaactcattgtaaagaatatgccttcaatgcaggacatacgagattcgtgttcaatccctgggttgggaagatgccctggagtaggaaatggcaccccactctagtcttcttgcctggaaaattccatgggcagagcagcctggcagactacagtccatgaggtcgcaaaaagtcagacacaatggagctactgagtgcgcgcgcacacacacacaccatctccaggacacacttacccccgccccgccagccttctagcctcatctgggccctgactcccagggccttgcccagtctttgcccctcacagctggggagctgctccaggactaggactgtgtcccatctctgcatctttggaacgttccttggaacacagcagggatgtagacatgaatgaagcacacgggaagaaacaataccgtatttcccagaccttgccagcacaccttgatctgttttccctgtttcccacttgacttgacacccacctgtcttcaccagcttgctgggaccctccgtctcctgccagccccagagcttcttcccctccagcaccctgctcttctgcggcctttcctggccttctgggcatccccaaacagcctgattaagatcccatccctccaattttcgctgatcttgttccattcttcccttgctcgggcgactcacgggctgtccctccctggaggctgttgctggtcccgtgattggattgcttgcacaccaatggggactgacgggaaaccccttcccagcgcagctgtgtgtgggcagacggggcgagaaggcccaggagcccttagagaaggagtgctgggaggcaactgagagcataaacactcacccctggagggggaggcttgcactcaacctccaccactgcagggcaacaccccagggcaccccttgccaggtgtttgccagggcaccagagcccctcggggcactttgctggcagagaaggaggtggtgagggaggaaggctttctcctggggtgtcgcccatggggaagagcctcatggggctgctccagggcccgacggctagcaga

SEQ ID NO: 60108 - DNA, 1428 bp, Bovine  19866881674704
ctcagctgggagctggaatgttctagagctggattcctggcctggacctgacgccccagggggctcctggcggtgggggagtggggagagctgcccagtggctctgttgccctggagagggggtaccgcagtgaggattcatggatgacaagtgctcggtctttctctgggctctgccgggccccagagtcttggctgggggggtccaagggctcggagcggggggatgtcagcgtgcagccgtggacacccagcctctggttgccagcgccgcgtatgagcttggtcaccttgggctcttgctgccttggtttccccacccgctgggctgaaattggactccttgaggagcctgccagggttttaccatgacagggcttggcagggtgcttgggcaccaggcaaggttgtttgtcacgggttctcgccggggtggaggggcaggcgggcccgtgccagcacggagcccacgcgcttcctctcgccagctctgctgggctcaggctcaagtgtggcttctttacagggacccaccccgggggcccagatcccatgagcaggcgctctcagccgtgatttagtggcggttgctaaggaaggcctggtacccagcctggagggttgagctgtggccaacctggattcggtaggcgaggcgaggctcccgccagccgcaggaaaaatcctcttttctgagctcagggtcctctggcctaagatgaagacaaggccgggttcacggctcctgctgattttgacatgagatgatgcagggcaggagtggaaatgaagagtaaagcaacgacaagatgtaaaacgggctttaggcatcagtctgttgcctaatgctcctggcagcgggacccgtctactccagggaccactgctgggaccccagagttcagcctctgggcttccaggtacatgagcttcctttttgactgttttactctgtaattcccaaacctgacaacccagatagaagctctagccccctcctggtgagagtaaggctagcaagccgggtgctggctttgtccagtgcggctgcagttgggggtgtgggccagctattttccagataaaggaaacagaggtgcagaaatgtaaagagaatgagattgttagtcgctcagtcatgtccgactctttgcgaccccagggcatgtagcctgccagactcctctgtccatggaggaagaggagtattttctccaaggagtatatatctccaagcaagaatactggagtgggttgccattcccttctccagagcatcttcctgacccagggattgaacccgggtctcctgcattgcaggcggattcttcaccgtctgagccaccagggaagcccagagttgtaaagaagcatctagtaagtaatagggccaggattccagccacagaagttgtctccagagcccag

SEQ ID NO: 60109 - DNA, 877 bp, Bovine  19866880431771
ctggttgagaacttgagcaatggcttgagcatcattctgtacgctctgtccagaaagaaggaaagtgcctttgatttagctgtatgcctatcaccatcattcttgccctcaaaaagcccacaaaatgtgaatgattcaagagagagttgacccttcctgtccttcatcagggaggccttaccagcctctgttgggtcaatcaaccctcttccttagaaagtacacctcagacattccaatgctgtgcccaggcctggctgagcagaaggaacgactgaggctgacgccgaagcacctgggctgcagtcccagctccacggctcttacacccactcccccaaccaaatctctccacgtccatttcctgtttgcaaagaatatcactctacctgtctaacccacatcatacgctgtctcgggcagaagccaaattcatgcttgtgaaaacttaggaaatctacaaagtactatattgcagaaaaggaggaacacacagcctgattcagcaacgcatcatctaacagcaaagacagtttaatccccaacctggtattgttcaacaaatgtggaagcatgggaaaggaaaaaggaagtcgggccagaagccttttattgaaaacgaaggttttcaagcctaaaaatgtttaaaccaggaggttttttccattagttctcagttaaatataaatatacctggaatcaagcaaaataataacgagcgcctaccttgagctcgtttattttcactgtgatgtggtggggaagacccctgatctgccagaaggatgttcttcagggccatcctgctctcacagagctccatctgccggcgtatcttctggagctctatcaacatccacgcttcttgcttgtcatt

SEQ ID NO: 60110 - DNA, 1157 bp, Bovine  19866880433075
ccatgcatgaaagtgaaaagtgaaagtgaagtcgtgtctgactcttctgcaaccccatggactgcagcccaccaggctcctcggtccatgggattttccaggcaagaatactggagtggggtaaggtggggtgccattgccttctctgacctaagtgcctatcaatggataaatggataaagaaggtattttgtatatttacaatagaatactactcagtcataaagatgaaattttgccatttgtggcaacatggatgggtggatcgtgagggtatcatgctaagtaaaataagtcaggtggggaaaaacaaatatgatttcattcatatatgggatacaaaaaaacccaaacaaaaaccaaaaaataaatgaacaaaataaatgaaatgagtaaaatggatcaactgtatggtgataaatggaaactaaatgtttggtggtgagtatgctgtagtgtaaacagaagtagaaatgtaatgtacacatgaggcttacataatgttaaaaaccaacattacctcaaaaataattttttaaaaatgtctttgcagatttagggtaatgaataactttgttttaattcatttgaagtcaaaggaaatatcttgtatgtatccagaaaagtttgtgtcatagaagatggtgagagtatcaatatttaattttttttttgtaaaagcataatacagataccatacctgctgtgctgctaagtgcagtacatgacattcagcaattaatacttaagtatttttgttaattagatattagtgttggacgtacacgtcttccctattatttcagagctgagaaaaccaaatttagggatccagtgttcaagggcagctctctttgacctcaaagctcatgatatttctactctttcagacttattttacttactgtaatttacagattgcaggttcttccaaaggagtacagaatgctatggatattcctgagatgtcagtcagacaccaaaaggaagtcccagaaaaaggcaggtggagtccacagatggtctcaacttgggctcctacaggcatttgttggagcgatggagcgtctcaggaggcctgcttgatacctgacgcagagcagagcttggaaagcttacaacctctggaagaggacatggctttaaatgaagtccta

SEQ ID NO: 60111 - DNA, 4400 bp, Bovine  19866880494807
caaggacaaggttcacacttcttcacgtggcatggaagactattgatgatcatggttatctcctgccgtatgaagaaggcaggttttagattttacctgtggttcagagagtatcacagggtacctcgggctgctgtgctatgtgaaaggagcttcctcttctgtctacctggggaacatctagtcagcgagaaggatcgggctcaggcatcatcacttctgcaaaacctgccctgaggttttctcatcatcatgtccagggccaattcatctatgcttctagagcatcccacatggtcagacccatgtgccaatcgagaaaagaatcaattatccatctctctgatacatcgtgtggtccttggccatctctgcctggcttttcatgatacctttggcatctctcagttggtaaagaatccacctgcaatgccggagaccccggttcaattcctgggttgggaagatcccctggagaagggaaaggctacccactccagtattctggcctggagaattccatggacagtccatggggtcgcaagagtcggacacgacagagtgactttcactttcactctggcatctaacatagaggctgttcacatggtttgttgaaagtcactaaatgtttatagggagaagccctggcttagatgctgcatccctgagccgtgtgccaaaggaggtacgttcactgtgagacagcctggaggtaaaggtcatgaacgtctagtagcccatgtggtgagtgcagcacttaggcacacagccctgcgtgtggacagcgtgtgttaacctgtcccttccaaagatctcaccacgtgtgtgtgcagagtccagatgctatgttagccatgacaatatttgtctttcttgtagcacaccttaactttccctagagaaccccatggaactaataataatgtctctttttaaaacttgatcacttccaaagctttcagagcttacatttttcaaacgaagcatgattatagctgcaacttcatttgcatttctcatggtttgtcttaaagtgtattgcaacttcttaaatttgagaaattaactttgtttcaacattcatataagatgtcttataaaattcctcaacaaaaataatatcaataataatactttttttttaattattcatcacttcctttggggccagattagattctccatatatttcccccttgtaacttgcctgcctaatttaagtgcaaagctaatttcagtgagataaaataatttcttcccctccattcaaggtatatcttcattcaataattaaacctccaccctggctctgggatttatcaaaaagataatatatttgttatgtacattcgtttttccaatacatattacaaaatcagcttctctggttcatttttttaaactcggaactaattcctcaaaatatgttaagggtggaagttacaagggtcagatctcctgtcatcggggttttaattccaaacgatttcagcattagtctttttaaatttgattgatagtagagagagatgcctggccagagaagaaaaaaaaagttggggtgagataagagaacaattttcataatgttattaaaggcctggcaataggctttcctggtaaagattcagtggtaaagaatccacctaccaatacaggaaacgtgggtttgatctctgggtcaggaaggtcccctggagaaggaaatggcaagccactccaggattcttgctgggagaatttcacggtcagaggagcctggcaggctgcagtccatggagttgcaaagagtcagatgtgacctaacgtctaaacaacaataatacaagactgttgtgctgtaggaatgaaacttggcaggtattcagaaaagaagacactgtatccacttgtttattttatattagaatatgtttgattgttcacaggaagaaactagaagaaaaataatcacatacttttggattgtaaagtttcactacttatacagattttaatgtatcatttgtgtggatcgatctgggtacagtactcagtaatgactctgctcctggagaggctgacaaaaatgattaactgttaatcttcagttctgtttaatctaaatcatttctatttccttctaaaataactggcatctaaaaatgaaaggaaaaaaataagtttgcaggacagacatttgggaacagaagagctaactcttgattacatgtgaattcttgatcacatacagaactcctattccataaacagtgtgttcttgattacatacaaaaaaacgggtgcaaggaaaacctacagataaactccacagataatactaatactatattttaatcaacatttttgtttcaaactgttgggacatcaaggggactaatacaattaagggaggggcttccaattgcgggaccagctataatcacagcccagaggcccttatgtggggcagaggggtaagctgtgctgaacattactgaaatataactttaggaactcttatttaatcttgtgtaatttgacaatgacatggaaacatcgcattctttataatgatcgtcaatcagcatgacctaccacggtcaggggcttcggatgacttctcggtctgcagtaaacagagagagcataacgtcaaagaaaacagaagcaagtggggtgggggtggaggagggttaagacagagaactggtgaacgtcgaatgagcatcttaggaactggaccagaaagagttccatttcaacgtcctacgatggttctaatcaaccccttagggtttgggcatacacctttgtagcgtcgaatactgagagctgagagtcttctattaataacataacagattataagatttcataccagtggaagaaaatctgatcataagatctgggtaagctgttttattgtaaactaaatcttagttcataatctgcatagtatttttcttagaaatgatcataagttccctgagggcagtgaaccttgctttgcaattcaggtcctacaaaaagacatgaagcaactatttcacgctaggcaagataccaagcacttttacatagtttatcttgtttgtctcaaattaagacaaggaaaaaggtgttttttaaaaatgtttaacattattatgcatatattctaaagttaaagacattatcatttagaaaaagaaacaacttaccttggttttctgactctctctctggaccttctaattaaatcttccaactgtttatttctctcttctaaactgaaagaagaaacaactgaagtttatgattaaaatggacttttctaagctaacctcactggaggatttgagtagataaatttaatgatggtctagctttctatacatcatccacccatcttgtgtctattcaggagttcagttgtgtccaactcttcgggaccatggactgtagcccgtcagactcctctgtccatgggattttacaggcaagaatactggaagtggttgccattctctcctccacattttcccaacccaggggtcaaaactgtgtctcctgcatctcctgtttggctggcagattctttaccactgagccacctgggaagacagctatatgggaacttggaattctttcctagcaactcaaattatttaattaatttttccctttaaaggttccagtggtgaagaaggagagtgatccctccttcccagccctctttgcccccacatcctggatgaccactcatctgctttctttcactatagttttgcaccatctagaattttgtgtaatgaaatcttacactcagcctaattattttgcaattcatccacactgttgcacctacccagaggtcattcttttttttattgttgtatagattccactgtgtggccatgtcacaatttgtctgtcatctcaccatgtgagggacatttaggttgttcctaggttggggctattacaaataagtaagtaagtaagtaactgttagagctcagtcatgcccgactgtttgcaaccccatggactgcaggcccacaaggctcctcagtccatgagattttccagacaagaatactgaagtgggtaccttgaaattctcttttgtgttaacacatgtgttctttcttcttggatccatacacaggagtgggttggctgaatcatacattgggtatatttaacttttaaagaaggcaccaaattgtttttaagaggttgctccattttacatttccaccaggaggctatgagcatttcagttgctccatgtcctgccaatacctggtatggtcagtcttttaggcacacttataggtgtgtagtggtcttcactggggtttaatttgcttattaatgatgttgactatcatttaatgtacttacttgtcatccatgtatccatcttcttg

SEQ ID NO: 60112 - DNA, 925 bp, Bovine  19866880558773
tacatgaaactcccggctgtgaaaacaagacgaaaacccggggctgtttttcccaccagcccccaggggaagccgtgtggcagtcggatgcccgtttgtttcagaaagtctcaccgttctttgcacgctctgttcctctctttcctccagaaggaagttgatcctggtgatttcagcccatgcattaaacaggaaacaataataaatgtgtagaattcatatttttctaaagggaacttaaaaaactgctgctacatgttgtgtacaaaactggtttatgccacaagaacagagaatcacagatccgggtttggtacttctcgtccctctttgtgtccagttgtatagacttccagattcaaaatgagaagaaacgctgttctgtatcaaaccatctacaagcaataaatgttatattttaaaaacggcaggttgctgatcctgcggccgtcctttgatttgctgtgatcctctgagctcgtccccaacccgggccgctgcctgttgggggtgggggtgggcgtggggggccatcattggacgtgggcatctgtggcggtgggtgggagaacctcaggcctgcttgctgcctgctaggcacctggggttcccacaacagccctcacccaggcagcatctctcagcctcgggcccgcgtccccgctcgccccgggggtctcttcggggccccgaatggtcggcggcggcagctcaggcctcgctcacgacaggtgaagcggggggctgtgtctccgggccacgaccccctggacacactgtgctggccctccccctacagtcaggctgtgtggggttgagttgtcccctgggcggagagctcccgactcagacctgctggtgtgcacaggccaggggcctggacagcacgatgactccagagttggggggacacagccagtcagaa

SEQ ID NO: 60113 - DNA, 657 bp, Bovine  19866880773053
aaagtgtgatttgattgaaaggtttttgttttcaatagtatttttttttttgtagctgcctccgtgggtcttaaccttcagatctgcattctgagtaactgcctaaagtagataagggtttttttttaacgtctgacagacgttacagtttgcaggtgaatctcaggtgtcccttccctgtcactctcctccccactgtctgcacagccggcagagcctgagtggcgccgctggtgagctctgcaccacgcgcagccgccctgggggccctgactgctgcagcacagcgcccgctgctcctggcgacttggcagctccattgagctcttcagttggagcgctggcatgtcaacaagggtttcagcttacactgaagctgctggagcacggctgcaatgttctcctgaaatgggttctgaaaccaattccatacacagcaggaacagatgtcagaatccatttgtaatgtctgtgtcttttgtaccttttaaatgttttctaaccttcctcttttttgtttcgtagattttccagcaaataacattgtgaagttcctggtaggctttacaaacaagggtacagaagattttatcgtcgagtctctggacgcctcattccgttaccctcaggactaccagttttatatccagaatttca

SEQ ID NO: 60114 - DNA, 1424 bp, Bovine  19866880784094
tcccttactgtgttccatctggggcaacccctagagcagcatttcctgaaaggaatataagtcctcagcagtgatgctcacaaagctagtgaccgcacacacacatttaggaaactgtgacgcgtaacctccgtgtggtgattcacaaacacctaagcacacacaagaactccaaaaggcctggctacgaggctgtttgttgcatttcttggttacaaataaacttgtttaactcagcatttctcaaacttcctaatttcatgtcctgctaaaaaaaaagaaaagaaaaccagtgccagttaaactaggctcaaggatgctctcaaataggacattaaagatggcaaagtttgaaaatatgtgtatcttgcagtagatgaaaggacttccctcatagtccagtggttaagactctgcaattccactgcaggaggaacaggttcaactcctggtcagggaactacaatcccacatgcctctccacacaggcaagaaatacaaaattaattaaaaagaactcaaagaactaaatatattgaatctaaaagaaaaggataattggccctgctgtaacctgtggactcaaccaacctcgaacagaaaacgtttgagaaaaaaaattccagaaagttcgaaaaagcaaaacttaagtttgctgaaggccaacaactatctacggaacgtttattgtatttatgaccatttatcttacattagggttattaagtaatctagaggcgctctgaagcacaggggaggatgtgcacagattatatgcaaattcgacaccatcttccatgagtcttgaacatccctggattttggtatctgcaggggttcctggaaccaacctccctgacaccaagggaccactgtaccggtcactcgggggggttttggtgcaaaacagactttgttcacttaaaaagtaacttccgggtccacctcagaatctaactgtccagctgtcctcagtgagcatgtgaagctctttaaattcagatggcgtgtaattaaatcattcagctggtcgacaggtagttgactttcacttgaagccacccctttgcctctcagagagccccacaccctgaaatgactcaagttcttaacaccaccattaaaagccttagcgctttccaagcaacaggcttgggcgtaaagcacagtaagtctgcagtgagtcagatgaactttgtgagtcttgcggggacgctggaggattcgtaaacctgctcctagcggaagggtgcggcggctggggctctccaggcccccctgcaggactggaagggcctggccccggtcagccgtcttcatccttccccatctcgccaatccgcccccagaggggctgcaggccgggcttccgcgtgtcccaccccagaccggcccaggcgttccatccaggtgcccaagttgag

SEQ ID NO: 60115 - DNA, 953 bp, Bovine  19866880910088
ctgactatctggagaccggggatgggcaggaaggtaaacctgttgggcttttgtgagttagttttcttttttattaataatcccaaaagtgactgtccttatgcagaattgtctgagcacagtccttccagcccagcgtgatggtcccctatacactggtagaagtccagcgtgagtcacggcccccggtacagggtgccctccagaaaaagtcccagcctcacatccctccagcgacggaggcggggtctgtttctccacctcgtcctcaaggctgaagactcggagttaaatgatgctgtcgggtgggggcattgatactttttctctctttttttccttttctccgcgtgcctctcttcctgtgggtacctgagaaaattctcagcctgtttgactgtggcctgagccaagaaggagcgctagctctgggaagaaaaggtttactttcagtctcacgtgactgtccgtccatccatctatccgtccgtccatccatccatccccccatttcacagtgtttgcccctcattccttccagccaggcactgtgtgctgggtgccagctctttctgagagagcccagcacgacccagcaggggcagagccggcccaagtccaggctcggtcccgtcccagggattcagagagtaggtagagccgtggagggacccgtggccttctgtctgcacgtggggcgtgcaggggacccacaggggtgtctgggccattcgtcacccgcctcctgtgtcctctgggctcctcagggcaccagcttaggcttttgaaaagaggtctgggcgagaggcaggatggggaagatagcacgttagaaaaacgcagcgtggtccctaccgggctggacgggagggctggagggcgccctgaggagcagagttccagggcagattagccaccgctggaagccagcaagggtgccagattgtttcatt

SEQ ID NO: 60116 - DNA, 1605 bp, Bovine  19866880935399
aggagctgaagagacaggccgagtctggacggcaagtcggccaagcaaaacctatacaagtgctacgggcagatcaaagaactcaacgagaagatcacccggctgacgtacgagatcgaggatgagaagcgcaggagaaaggccgtggaggacaggtttgaccagcagaagagcgactacgaccagctgcagaaagcacggcagaacgagaaggagagcctcggctggcagaagatggagtctgagaaggccatcaaggagaaggagttcgagatagagaggttgagagtgctgctgcaagaggagggtgcccggaagagagaatatgagaatgagctggcaaaggtaagaaaccactataatgaggagatgagtaatttaaggaacaagtatgaaacagagattaacatcaccaagactaccatcaaagagatatccatgcagaaagaggatgattccaaaaacctccgcaaccagctcgatagactctcgagggagaacccgagatctgaaggaggagatcgtccgtctcaacgacagcatcctgcagaccacggagcagcggaggcgggccgaggaggacgccctgcagcagaaggcctgtggctccgagatgctgcagaagaagcagcacctggagatagagctgaagcaggtcatccagcagcgctccgaggacaacgccaggcacaagcagtccctggaggaggcggccaagaccatccaggacaaaaacaaggagatcgaaagactcaaaactgagttccaggaggaggccaagcgccgctgggaatatgaaaacgaactggctaaggtcagggccaattatgacgaggaaatcatcagcttaaagaaccagttcgagacggagatcaacatcaccaagacgaccatccaccagcttaccctgcaaaaggaagaggacaccagcggctaccgggcccagatagacaccctcaccagggaaaaccggagcctctcggaagaagtcaagaggctgaagaacactctggcccagaacacggagaccctcaggagggtcgaagagaacgtccagcagcagaaggccaccggcttggagatgtcgcagcggaaacagcagctggaggttgagctgaggcaggtgacgcagatgcggacggaagagagtgccaggtacaagcagtctctggacgatgccgccaagacgatccaggacaaaaacaaggagatcgacaggttgaagcagctgatcgagacagaagccagccagaggaagtgcctggaggatgaaaacgccaggctgcagagggcgcagggcgagctgcagaaagctcacagcagcgccacggagaccatcagcaagctgaaggtgcaagaacaggagctgctgcgcctgaggctggactatgagcgggtgtcccaggagaggactgtccgggaccaggacatcgcccgcttccagacctccctgaaggagctgcagctgcagaaacagaaggcagaggaggagttggccaggctgaagagggcagcctccgaggactcctctaagaggaagaagctggaggaggagctggagggcatgcggaggaccctgaaggagcaggcgatcaaggtcaccag

SEQ ID NO: 60117 - DNA, 1246 bp, Bovine  19866881124481
catccttcaacccctacccacttctttttgtgcctttatcagactttattttaatggccttcttaaatgccagtctcccgtgctatcttatgagtgccttgaatacaggattgtatcctttattgtttatatttgtttttccaacacaggactgtcctttgttcatgtgagtgtgatcaacatttctggaattttacactgaaagacaaaaaaagttaataaggggaattcctgaacttattttactccaacaggttaatgatcttctcctggggttgtttccatcttagttattgcttagaatgaaaattacacccttttggggacactcccagaaaagctagtaaatgttctcgaagtctttgtttatctataggatggcataatgccataaatgaataattacacgtgtgaagtatataatatgctgtgtaattaaagacgagctgctaatagaatctacctacctacaagagctgcctcttagcaagtcatcttcagggccagttgtgcaacgtgtctgcggaggacattccaagtagaatggagaaaccataataaaggaaaaccgagacttccctggtggtccagtggttaagactctgcgcttccacttccgggggcatggttttgatccctggtccggaaactaagatcctgcatgctgtgcagagtggccagataaaccaaacaaaataaaggaaaatcaagcaaagtagccgccgtaagaaatctaaccaaacatcacttatgcagaagtatgtgtatctattctcctgcgcatacgaaaggctctcttttcatttttcgtttgtgcttttcaggaggaccattttcatttaggaggtttaaatattcaaggacctgtccgatttgctggcagctcactcttaaattcaatcatatagatccctgaaaattggcttcctgatccaatcggaggtttagcatcatccaaataaaaccacagagatctttcaagaggctggaagtacataaggaccatacatgctctcttttaaacatgtctctctttgaaagctgaatgtaaacttcttcggtatccgggatgtcgttttctttcctcctcaccatcccctcttcacacttctttgtccctctcacggggagctgggaattctctgtatttcacaaacacatttgagcagctacagtgtgccaagcaccaccttgtacactacctcaatactcatgcttttctagagacggatgggaaaacggcagc

SEQ ID NO: 60118 - DNA, 2891 bp, Bovine  19866881235539
ttttcccaggcagtttttttaaggctcttaattttatgatgatttaaataattctttttaaatttactgattatggaacgaatcccacatcattatcagaaatatggaaatgatgaagaatgaaagtccatgtaggctaggactgcagggcaacatagcctgcaaatctttcagtaaattcgagagccacaaaaagtcctttaaaaaagaaggcgtctctgaatgtctagaatatttcaagtgcatttttaaaaacctcttgggtaaaaaataaattaaaaaaaaaaaacctcttgggtaaatgtgattgatcctacccttcccttagggtactcccctaagtattgatgctttaatagttaactatgaaccaagggaagatgtgatgaactttaggcttgtatgtaaatctagagctttcatttctgaaactcatttcttccaggccaatagacagactcccagcttcaatgcagctaaaatgtctactccagcagacaaagttttacggaaatttgagaataaaattaatctaggtgagtttttaagatataattcctctcactaggcaatgagaaaactcttcaaagacaacaaaaagtgttataaaattttattagatcaatcaatggatatattgagtgttagagggtaaatattaaagcttagaggaaattaaaatttggtagttaaaaacatgactttaagaaaagattccagcttacacttttttagtcctgtgttctctcctgttatggaaatacaaaggtgcagtattcaagttatcatcggtttgtactagattttgtagtagggttatcttgtagtagaatggtgaaaacacttgaatataatcaagtgttgaatataataaactattgaatataatcacattttgtttgacttttggtgtggccttaatcatttcatgagccatcgaatgcagggaatcagtgtgaatttgaagcctcttgggaaacacggggttttctttctctcgtagacaaaagctgttaggagcatggtatgacagctctcacatctgatcatccctagcacagacctgtgattggaagtgaaactgacatttttagaattacaatatttatgatagttgtacaaaatattaaatgtctgaaagagcagataaaatattttttagggatttctgaatctagatttctctggctgagaaatgacacctgttatgatgaaagtgatcatctttgttagtaagtgcttgcccttaaaaacacaaaacacacttttcgttactaaaatacattgctacgtgtaataaaatatttaaaaagtagagaagggaaaggggaaaagtatcctattcagaaactttttcttatatgttgtttatgttatggatttttttttagataagctaaatgttactgattctgtaataaacaaagtcaccgaaaagtctcgacaaaaggaagcagatatgtaagtaatatatcaagtgtatacaataaagtaaataaaatgtgactgatatgaactaattgtagacagattagtagcatctctgtcataattcttttacaaaggatgttcttttttacacctaaatcaattcttaagtttaagttaggatatcctatgcctttgtaagttgaaaatatagatgagttttcttaagaaatctgtgctgaaactataattgtgtaaaattcatgaaagtgctctcagggtaacagtgcttgtagatttcagtttaaaatgttagagtataaaaaaatgtcccgtttttaaagcttattaaggattggtccctttcatgaagtaattttttaaaatggaaagtgaaagttaattgctcagtcgtgtccaactctttgcaatcccacggactggacatgcccagctcctctgtccatgggattctctgggcaagaatactgaagtgggttgccatttcctcctccaggggatcttccctacccagggattaaacccgggtctcctgcattgcaggcagattctttaccaactgagcccctggaggagccttaaaaatgtaagagcagatttaaaactaaatagtttaactgaaaacagtttccatttacatttctgttctcaaaaccaaatatttaagatttggctcacctcctattgctaataactctaaagcattaacaatatgttacagaaaacaatactaagatcataaaaatagcagtgttagaactgaacttaaaacccagttttcttctggtttattattacacgtaagggataccagctttttgagaaacagtgcatcttatttcactaaactgcctgtttggatatttattagtttaggttagtctgtgaattgagtcacatagtatgtgagccaaagtaatcagagtctgtttttatacagtagctgtgttgaaatgataaaagcttgtttctttgtagaaaaggactctgaagagaaagccttataaattactttaattctgtactaagaaaatcattaacggtctaagaaacagtacttacagacttgttctttttccagcgtagtttgttttaccgcactgctcttatttaatccttctgaaatatggacggaagtttttttttcttactgcagatacgctccctttgccctagggaactgaacggcttgtgaaaggcagtgaagtttcactcaagggtgaaactacaacgaggttatgaaatgtgttattaaagaactacctgcttaggaatatcatggaacgatgtacatttagaatctttagattttggctcctctgaattctgaatgtcacctttacttttttggttttgtcttaggtatcgcatcaaagataaggcggacagagcaactgtagaacaggtatggtgtaaagaatgtgttgcatgctgtttaaagt

SEQ ID NO: 60119 - DNA, 1350 bp, Bovine  19866881329834
cacacacacacacgcacaccttctcccacaaggtatgttctttgctgacccagcccccaggaacaccacactcctcgaggagccttagaggagagtcctttcggcccccaggggcccgcagccccagacttgggggccagggtgagggatggcggggacaaggatagccacagccatgggcacccatgtggcacctgcctccacgtggggcgagccgtgccaagcctcctctctcatttcaaggtcacaatactagattatgaaagagtggaaaagcactgccccagaaaatgggccacggggactttcctccgggtgaggaaggcgagaaacacgcggcagtgaggtcccgctgagagagtacacggggactcggggtgtgggtccctgcaagtgacaagacacgatgtggaggcaacaggggagatgggacgacctgagagctatctctgaggcgtttttatgtaggagagattctatcacagacactcgtgtgtctcataagaaccaaatacttttctatcatgtttcctagcagctatgattttattttttcccttgcaaattcaggtgggacaaatgttctcataaaataaacatctccctgtctttaaaaaccactgataaatagttcaggcaaatgaatccttgcctctcctcaaaaaatacgggaggactgtaattctggcaatagaatcagctcctcaggtgccctgagggaacagaggactcaactgtccagggtttttacacctaaatgatgacatgggtctcccaggatctgagactcaaaggaaacactttgtctacgacgtggtagtaactatacttcaagtcttaccttaaaagataaccacaaaagtaaaattactctgtaaaaggaacacttaaaaaaaatccaagccacactaacttgaaaaatattttggggggagtcttaactttttccaagactatagcaagtggtttaaagcaaatccagatccatgggaattctcagagggggccctggacacttggactttatttccaacacaattgattcccagagaggtcagcgaaaacgtcacggcataaggggatcacaaccgcgatgtaaaatgtccagggaaaacagaaataagcgtcgaagattccagaagcttttctagcgtcttcgagattggtggccgcatctctgccttccgcccactccgaaggtgaaggcgtctcctcacctaaccttcctgcgggcctctgctgtggctccagccttggaaaccagtcttgccggttccagagcctccagccaccttctctgaacgtctgaactgcgggccgcttgcccccagccgacccgcgaggcgcggg

SEQ ID NO: 60120 - DNA, 1754 bp, Bovine  19866881359259
aaggggaaccacaggcagtcatgtcctctccaggggggctcctgagcattcactttgctcctgagataatgcgcttgatcactgaggcagtgtggacgtgcagaacttaaggcacaccggaagggtaacagggtacgtggccagagaaaatcttcccagataaaataaaggaaacgggttacctggagacttaacttcctatagccaatagtacttgtgtggaagaagcatgctagaagaggcctggagaagtaaagctggattgtccgggggctgtagtgttccctgcagtcatccttccgtattaccaggtttttttaaggtctgacctgttccctcctagacgctgagtctttagcagattccttccctgcctcatctttggtcagttttaggaggcgggacacgggtcaagagggagtctgagactccttgtggggaacaagggtagagaaagttcgctgtatgtggaccatgtgagcttcagaaaataaaacaccacagaatcgttttggctgttgggagtgagggcgatgcgctgtagggaacatcagttaagagtgaaaaacaaccacagaatgtggttttggaagaaaaagaagactcagacatctcccgtacggttccctgtagtctggtgagtgcagcggtctgagattacagcaaacgtggtttctgtttttccttctgaacctttctgcccttgcttcccttccagtgtcgacgagagatacgaagagaagagaaaaaggagccccccagcctcgctgcctcgtccgtgcgcccaacccccgcagcagatgacgcgctcatagtgcatcagctggggcggagaatggaggtaatcgccagtgcgggctgggttttccttccttccattttctgggggaaggtacattacatcttcatatgttttaagaaacagccttttttatgctgatttgaaatttggttgtaacgttgggtggtggtgtggcttctcagttgtcttacagtttggactcccccattaaaatcgggtattgcggcctggagttaggtgagagccaaggtttctcaccttccgtttctgggtctagaacacgcttgcagtagtgagtaggctgctaggaggccgctggccagatgggccctcccggccttattaactgttggagcctttcccactctgcctcgtgaaagattagcaaaggaagaggacctgccttgggtcacctcgtcggtggcccatactcagaaaggaagcaaggcagtcagttcagtgtgacagcgcttggttgagatggaagcttcagtcacgtgagcacgtgtgtcggctgaactgaaggggagggcttaacctggctgcagcggtggtagccgtggcccctgccacctgcctgcccggtgcctcaacttcccagcgatcacatcagcagtttctcactttcagttctgtggccgaggctttctagaagcttaaatccttgtcccaatgacgtcaagctcgcccattggcctggagggttcagacttgtcttccatcaacaccatgatgtcagcagtcatgagtgtggggaaggtcaccgagaatggcgggagcccccagagcgtcaagtcccccacgaagcctccgggaccaaatcggatcggccgaaggaaccaggtaagcgtccgtgcgcgtgcagtggcttccgtgagagcactgagggagggatgtccccttgagccccagctccctgagccagaaccctggacgtggtctgaacggcaca

SEQ ID NO: 60121 - DNA, 1192 bp, Bovine  19866881686092
ctacagcttggatgaatcttgagaatattatcctgagtgaaataagccagacgcaaaaggacaaatactggatgattctactcacagtacatccctggagtgtcaaatctacagagacggaaagaagaatgggggctcccaggggcgatggagaagacagactttaaagtgggggaaatgagaaagttttgaaaatggatggtgatgatggttgcacaacagtgagcaagcacttaatcccagtggagcgtacgcttaaaaacgctgaggcagtaagttgtacgtaacgtctgttttatctgtaataggccactgccacatgaatgctaaaggcaccaggccattcggcggctcttttattggaaggtgcagatcgctcctggggacagccccgtgaaatagcacacacctgtgcacacgagacagacccaggcagggcaggtgaccgagggcaggttcacactcgaattttaggcctcgccaggggacagcacaggaaacagagcactcgcaccataaaactgcagagcaatttccttatcaccatctccacgactcagaattttttttttttttacaaaagtcgtttaccaaggggcaaagttctcagcccacggaactcccggggctaggctcccccgctgctggcagagtccttccatgtcccgcagagctttctgggggctgggagggggcccctgggtgaggcggcagacgatgccaccgcaccataaatgaggggctgaaatgaagctggtcaagaggtctggtctgggaacttgcttcaactgcccaggttcagggactattttgagaatttcatttagccagagtcaaacaaggcaattggtaacttgcctaatttaagtcacctgtccccaagccggggtcccattcagttcctcctgcattgttggctggacaaagatcttagcacatttttctttttaaaacccggtccagtggctctctgaggctgtcttcagtcttctaaagactctctggccacctactggattttttcagcacaagggctgggcagaaaaagagcagctcgttgcccttgttcaaaggaaagcgagaagagacgcagacgagaagctggtgagacttcaccatcaagtacccagggggatttgcaagagaatagctcagacacggccctactgccctcctctcaaggaaaaagcca

SEQ ID NO: 60122 - DNA, 1055 bp, Bovine  19866880429789
atgaaaaaaaaagcagtttacaaatgtttcttatcttctttgaattactgcaatttaaaatgaaaaaatccaaagaaaagttaatatatttcatggactgtgttaaactttcccataagcatagagattttgatgttgagaattttatttccggaacctgggtctggatggaaaccaagtacccactggcagatgtatctgatgatctcagccaaggtcctattagaatgatctgagactcctttgtggatggttgcctgtgatacaaagcagtcttaagtcaggatagatttatgtgcattggcaaagccaagtaacaaacgaaacatgttctcacagtatgtctggcctgagcctgtgtgattaaattctgactttgatgaatcccagaccttcagggaagcgaaaataaagtccaaagacagttggttaataagaaattactgaattggcctgggtctaagatgttgtagcaaaaggaacaacatttaatgtctgcagagaaacagaaggaaaaaactagaaaataaaaattatattttttccaaaaatgatagtccatcttcccctcaattttgctttcatcacattttgtatattatagatatgtagaatattttatgatcaaacttggatcttttattaaattcagagaagttgctattaataattatataaggacaacaaatataatctaggactgctctgggaaaatcaacttatatatggcactgattccaaagcattacaagattttgtttatgtacctgtctcctcactaatatgtagattccttgaagagaaagacaattgtgtgtaattcactataatatcatcattaacccatgtaatgtctagttcatggccaaaatggaatattttgttgagagagagaagaaaatgtatgacttaatgtatgtattgatggataaatatcagggaaactcaatcttcctacaaatatgcttccccagtatattttcaaattatgttagatcgaactaattttattttatacacacaataaaggtatatatgtaccaaaaatgggtttt

SEQ ID NO: 60123 - DNA, 2627 bp, Bovine  19866880547701
gtggagacaggatttgaactagacactccagctcaagaggacataaggttttgtttctgccctccaagggtctctgcttccccgagtcctgtagaagttctatagtcaaatcccactggccttcaaagtcagattccctggggattccctgtcccttggccagatccccaggttgggaagcctgacatgaggctcaaaacattcacaacagcgggagaacttctttggtatttttttttctccagtttgtgggtcgcccacctggagagtatgagatttgattttaacgtcattgcacctctcctaccatctcactgtggcttctccattgtccttgaatgtggggtgttttttcttggtgggttccaacaccctgctgttgatggtcattcagcagctagttttgattttggtgtactcaaagaagaagagcacacatccttctactccaccatcatgggcttctccccaggagcccatattcataaccatcattctctccagcttccttacacagtcatgagcaaagagtccgaagactgcagatatttagcctggaagagaacaagaacaggtatgaatgcaagttagatgagaaaataagtatagtccatcagtatagttttacagaataaatggttggcactctgggggaaaaaaaaagatgctctttggggagaagagggtatagcaatggaagaaaacaactttgtcacaggataaatctgcttagggttcaccatggtcctgctagacaggaaattgtgttaatggtttcagcattcagttttctttcagtgcccaagaaagcagctttatgttttcactctttttccatcctgctgctcatttttagcaagacatgtggctgtgaagccaaacccaaagtgacacatagataatgaatggtggcattacgtgcagggtgtgcagcccccagggtcctctggtgtatgtcactgctgtaggcaacacctttgatagtctcaggtaaaggttctgtttttggtcatggagcttctgtgtattttctctaataagcactcagtggggaagtgctaaaacaaggaggtctgtgttctcagaaggattacggtgagcctcagatgaaaccacactcagcagggctcaatccagaataaatgattcataattatatgtgaagacaaggtttgagttacatattagttttgctctgaaaatagttttacatctcataagaaggcagtgttttctggacaggaattgaagcttccgagaagatccattttgggtgttaaattcctaatgtgtgttcagagaatggatacagccaccttttacttaacaacaaagacaggtagactggagccatttcccaaggagaacattgaactggtctgaatgcatagcatactggttagtgcagtcttaagacataggtacagagaaggcaatggcaccccactccagtactcttgcctggaaaatcccagggacggaggagcctgggaggctgcggtccatggggtcactaagagtcggacacgactgagcgacttcactttcacttttcactttcatacattggagaaggaaatggcaacccgctccagtattcttgcctggagaatcccagggacaggggagcctggtgggctgccatctatggggtcacacagagtcagacatgactgaagcgacttagcagcagcagcaagaggtaggtaagctttgcttgcaggccccagagtgtcctaatgccacttacccccaactacatctgtaatagccttgcccaccccatagccaggcttcatcttctcataactgctctccactgttaaactctcaactcccaaaccctaaagaacttgatccctcaaagcaaactgataaattaattcaatctaacatgttaatggcacataacgtcctaaaacacaaccttttctgtgaaacacatttacatttaaataactttcattgttttaacctgaaataaagtgaataatatgagctaaatggtcaatccttttgagaccctttggccagtggacagtggggacaagctagagttgtttcatccagggattttcaaaacttactcatcatcaaaatcacctgggaggggcttgttaaaacctgggtttgtacccctccccagaattcctgattcagaaagactggagggctgggatatttgcatttctagccaacccctaatgtttctacctgggtaccacactttggaagccactagttctgatcttgtagtgcctttggttattatcaaatcacatggtatagtagatgatgactgtaatttgggtgaaactatggtaaagaagccaaagtatggatgctctcatggttcagttcagttcagtcgctcagtcatgtccgactctttgcaaccccatgaatcgcagcacgccaggcctccctgttcatcaccaactcccggagttcactcagactcacatccatcaagtcagtgatgccatccagccatctcatcctctggcgtccccttctcctcctgcccccaatccctccctcccagcatcagagtcttttccaatgagtcaactcttcgcatgaggtggccaaagtacggagtttcagctttaacatcattccttcca

SEQ ID NO: 60124 - DNA, 1275 bp, Bovine  19866880620442
aaatttggctgttattccaggtatctcttgacttcctacttttgcattccagtcccctataatgaagaggacatctttttggggtattacttctagatctagaagtgacctctttgataggtcactttgaaatcttcaagaaagcccccacatcacccctagtagagaaggatcaccttcccaatgccttttactggagcatccccaaggtcataggtatggctattgtgcccctgagtctaagacatggattagatcggtttcagaactatgttggtgtcactctacagattggtttgggtaagaaagatgccctgaccaaaagacgccttttggtcaatctataagggtgatccacgaaatgggctcttgctcaaaaatagaattttcacctattggctatttcagcaatgagctaaagtcataaataggataccatttgtttgactgcaccagtttttggtagaacctgtggatttgttctgaaatggcatattttggagagcataaatcctccacaatccactgtcatttttattatgtagacatagtctaagttctttactgtagtaatgttgaaccagatgttcaaagtataaaatctactaaaataatgtttggtactaagcttagaatgctggtagcttcagcctcactttattcagttttgcatttctgttatgtttctgagccacaaagatgtttaccttgttcttttttttttttttttctttttttttttttaccttgttctttgattgcacctattttaattttctccttctagcattttatttatcatcactagggattaaagtcatgggtgatatatgatgacctccagctattttaacttcaagttctataatcacttttaattgacttctaaatctaggctcatctttgagttaaccttcaaaattgtattccaatagctatcttaatacagtatctctttactgactgatctttacttaactgacttaacatatcattcatctctaaaatacacaaaatgagaacctctacttgatgaattccctcattcagcaggttattattagtaagcccataaatatgcttatatgtctactccttcaaaataagttgactatttatttatttatttttgctttggattctgttttattctaaaatacagcctggagtactataaaaagattcttgttttcttataatatctataatatgtctttctgttaattattgcttggtttatttaattttttaatattttatggaaggataattgat

SEQ ID NO: 60125 - DNA, 1664 bp, Bovine  19866880677653
ttattttaagatataaaatgcaactttactgtgtccataagtttgtacaatacataaaatatttcaatgcatctcattaaaaattgcatgactctgaattgattttctcaagtatgatagaatcattcatccttcatttgcaatcattttttgagcaactactgtttgtaaaagagcacattgtttgccctcagcttgaaattggagattaagataggtatataagaaaatttcctagtttgtggcacaagcaaagcatgctgggagagcataacagaagaaaaaatacaaattctttttatattctttcctcttcatgggacaaaattctctctgggatttaaattgtctacaattatatggctatatggttctacttccaagtcaaagtacaaattttgggggaaggtccttattctttattatttttgatggaaaatgatgaccagatgctatgtaaatagcaaactaaattaagaacttataaaacctcagataatttttatactgaaaatttacttaatttttggagaaattacatttaatgcaattacattaatagccaaaatttggataacttaggttgggctttcattgaaaccattcataagaaaatataacttcttcttaaatacaaattactcatatcccagaaagtccatagagaaacaatacctaaaacgaccggaaactgaatttataaggcagacgtttcacttgattgtcattgacaggtgcaaaaaagtaccacttttgttactgaagtccccaagaagcaaagaaaagccaccaaccccctccatcctcccacaccaaaaagtaggacttgataatacccacctttgatgattttctaatttataagccttgccaggatgtgtacagattgctaaaagttcttattgttgatattttccttctcctctcttttttaaccacctatttatctagcaaggtacagagagaaaaagaaaatgtcttttttactattctggcaccattttgatttcactatcaaagccctggtaataccacaaccatatatttataaatccaactccttatctagcagaccaacctcaccctgctcgctcatcatcacagataccattgtctccctcgtctttcatgcccactatcacaggcatgcatctgacactaccctttctccctgtcactaaaaaatggatgtcactaagccttgtcacttttctctacagcatctctaaagctccatcttagccttccaagtctgttaaacctttacccatgttttatcctgtgtgaagacataaaatgggcttatgagacaaccagagggatttatcttgaatataagggagaatttcttgaccatgaagcattggaaaaggcttttataagagtctgttataatgtttaaggatgacagattgaccttggatgggaaccactgaaaagtctctgaaacccgattttattcctcttcttatttggggccttgctttccctctcccgtatgccgtcctcactctggtgcttcctccagctcctattttcaccttcattatttctttctcagccaagtaagtggacttctcttttggttgatgtattagcatttctttacaaatacccatgaacatccctctgaagagtcacttaaatgaccattacagcagaag

SEQ ID NO: 60126 - DNA, 1312 bp, Bovine  19866880725973
attaagttctgttactcaagaaaaagatggatattaggcaaataccaaatatgtttaccattgacatcttcactttcccgttcatcttcgtcctctaggtcctggtttgctatccagttggcaactccttgagtgttctgtatctgaatcattttctcctctctttctgtatgtctttttcattatttcacaaatccattgcctgttcttgtattagttacttaagcactctaatgtgtgtgctcagtcacttaattgtgtctgactctttgtgaccccatagactatagcccaccaggcttctctgtccatggaattttccaggtaagaatactggagtgagttgccatttcctactctaggagatcttcctgacccagggatcaaacctgcatcttttgtgtctcctgcattggcaggtggattctttaccactgcaccagttgggaggcctaatcacccgaaagttcctcatatatatcatttttattcagttctaaactactcttactagccactattttttctcaatgctggccagctctgccctttgactacaatcattgactttacatttttccacatttaatccagatgctttcagagtctttgatcctttgtgattgagaaaacattagcctctgatatgatatctgttatttgcttcaaaataatccagtgttgggaggggggaaaagtcagtgatgtgtaaatgaaacaagattagccatgtcttgaaattattgaaattgatgatggatttgtagggggttcattatatcatttggagaaggaaatagcaacccactccagtatccttgcctggaaagtcccagggacagaggagcctggtgggctgcagtccatggggtcacaaagagtcgggcacgactgagcgactaacactaacatgtccattgagtcggtgatgccatccaaccatctcatcctctgtcgtccccttctcctcctgccctcaatcttttccagactcgttttggactgatatttttgtttttaatggccccaaatcactaaggggtaggagcctcaaactgattttgtcaaaccagattctgaactatggctatagaaaaccagaatgcagataacacagaaagcagtgaacacagaggaggggagtaaagacaaagcaattatgctagaatcctttcacttaaaaactcaagagctaaatttcaaaccacactaagaaagtgaaggctagggaagatagaaataaaccaacaatcagaaaattaatttattcaaataaattatttttatgctatagccagtaaaactctttaaa

SEQ ID NO: 60127 - DNA, 2512 bp, Bovine  19866880748363
gttgatttccttttaggattgactggtttgatcttagattttcttttctttgcagttttatatttgtcttcagggaacacatgccccctccccccaacacagcaattctgaagctcctctggtcttactgttatctcctcaccaccacaccagtgtggaccactgtaacccttgaaaggctatcactagaaagtggacagagaagaaatttgaagaaagattcattcattcattcattcaacaaatattaatttaaagcctaccatgtgcaaggctgtttagatgttggaatatagcaatgaatcaaacagaaaagctccctgatcttatggaggttaagttctagtgagtagagtaaacaaatgctgtcagatctcctataatgcttattttgaaaatgagaatatattccaacctggttgatatgttagaaaataatttaagcacaattcaaattttatgtttgcttatacataatttcttctgtgagaaacactagaaagcagaaagctataccaagctgaatcaagccacacaggaacacataaagtggacgtgtgtaagcacctcaaacgtctaccagctacctcaattctctgagtatgttatgagccacatctggtgttaacatctgtctaaaagcctctttgctccacttcacaataactcacgagctgcaaccccctccatccccacaactacaagcaaacttcaagtctttttcaagataaagtgatgtatttgttgcagtgtggttcagacagtaaagcgtctgcttacaatgcaggagacctgagttcagtccctgagttgggaagatctcatggagaaggaaatggcaacccactccagtattcttgcctggaaaatcccatggacaaggagcctggtaggctacagtccatggggtcacaaagagtcggacgtgactgagcaacttcacagtagttatgtatattttgaccagaaacatacatgaaactgtgatgccatttttattgtttgaattttttaaaaatatgccactggtaaagtttttgagtgttgggctcccaactccatttttcctatagctccatgattaatagtatgtaatttcacataacttgatgatttttaggaatacatatgtcactctcatagcagaattattcataaacaagcaaactatcaaataagataattccaggtaatggtaaatgctttgaaaaattctatcaaggaatgtggttgagagtgttagaatgaaatagggaggcactcctttagactgatgaccgtggaaacctctctgggaagggcatgtttgaattcacacttgaataacatgaagaagtcaatcatatgaaaaaaacaaaaacaaaaaacactaccaacaacaaacaaacctgggtaacagcattccttgtaaagaggtatgaggatgggggtcatggtttggggaatggggtttatgcagaggtccgaaagcaaataagcttgtcagaggaacaaagagaacaagagcaagaaataggcagttgaggatagtagccagagcccatatcaccgggacatggtaggacatagtcagtcactggaattttcattgggggatttttcactgctaatagaactcactccatttatagatgagttctgggatttatccttcttatgcaaagttacattaaccattaagggctagaacctaagtcgcacgtcctttagaatggaaatagatgtacatatggagccatccttaaaagagtcttttacacgaactttggggaagaaggtaatgattgggaaaatttcccagattgcccccagattctgcatccataaattgctttctctagcgtgatgatattgggaagaagtctggttttaacaggttgtatccagtatcctgtttcactccactgaaaggaaaatagaccagacaaaatgtcaactaagccatcctagatgacagcaagatttgtaaggcagccagcccagcttagagcaactgccagagcccagatctacccatgccaagtagtgctcttaagaaacctaatgatgcagtcagtggacatcggaactgctccctgttctcctgctaactgacatctaatgcaaggcaggagagtttcctgacagtgaattacaaagcccagcaatgagtcattggaagaagttgtaggatttcttcttttagatggatggacttttatttttttttaatcaaagccagtcataagacaaaagaataaatttaacctgacaatggactgaatgccacaggctaaatgtcttggcccaaagcagcctgtttggagttttgctctatgccaagcagaagaggcagctgcatctggggtgtggtggcaggagctgctgaggatcccttgtgggtcagaggaggcgtctccacccccacccccagagtgcactgcctgcagccttgagctacctccactgccttccgcctcagccctgcaagcccaccttccctctcccagtctccacttctctttcagatctt

SEQ ID NO: 60128 - DNA, 979 bp, Bovine  19866880767957
gcatctgatgggcaaagttaaaaaaaaaatcaaataagctttttgttttcctttaagcagttcctggcaatgctttctttctttctttctttctttttattttaagcagatgagtttttaaacaatgattgcatttaggactttcaagaaagcttgtaaaccacagatttgaggagcatgggtcctgaggcctgaactgtgcgctggcttggcgcacacactgcaggatatcaggaaggtctgatatttccatgcgcacagacaagcaagcacagtaagggccacatcagccaagcaccctctgggtcccgagcctcagcatacattttgcagctctgtgaaactggtgtgttaagccaggatctgggtcctgggtacagggtgagcaataaaggctgaccagacttacatgggaaaaaaatatttgtcattagttttgatagctttttcattgaaaccctattttctgagtgcacgcgtaaaccaatttcaatatttgccagtcattcttgttgcttggccgtctttgtttcctttgtaccgggacacatttgcctggtctcgcagtctgtctcccaagagtgctcttgatgagatttttttctttatcaggaaattgattttcttgcatctctttctgagattactgaatccaatcttgaggcaaataactcaattcttgggaaaatgtctgatttggaaacctggtggttgattttttcccccctggccacagcatcaaagctgtatgagcatataccagtaacaggtgaaggagatgcctcctagacgagggtcctccctcgtctcaaccagtctgcctcctctaccactgctcttcctcaccctgggttccgagcaccctctttctacccttggtgtgtcctgctcctgtgtagccttttactctctttatctagttctaaatcttagctgaattttctgtcttatttcttacacatcctggcaattcctcctg

SEQ ID NO: 60129 - DNA, 1526 bp, Bovine  19866880776266
tatttacaaatagacagattatctatactatggaactcagtaggcctgggaaatgctgacttactataggcacatctctcaaattgaaatcaatacattatacttcctgttcattgccaggaatggccttagtgacccctgggccaggttggcgctgagtgctgccctctctaatgctgggaagacagaattcaactgagccagactgctaggaattctccctgccttcaacctggaacacacacacacataaaaatactaacttttaaaaatggaagactactaaagaaataaaactaataatacagaaaaaatgggataatgtattttgtaataacgaacgttcttttttttttaatgactatggttgtttctggaaatctgtaatttttctttaattttcatattttcattgtaattgttttcaatgtgaaagtgctttctgtatttgtgggtagtgtgttatttaactctactcaaatccagggtccacgtgctccacatccctccttcacgccctgcctcctccagacacacacagtgacctcacacgtacatgtgtggtcttctgtgcatttacacacatacatgggcttccctggaggctcagatggtaaagaatccagctgcaacgcgggagacctgggttcagtccttgggttgggaagatcccctggagaagggaacagctacctgctccagtatcctggcctggagaattccatggtctgtgtagtccatggggtcgcaaagagacaggacaggtcttagaacccgagcacacagacgttcattcattcactcattcatttatttagcaaacattatttctgaaaccctacttcatgccaaccacagtacgaagagagtaaatccattctatacgcttacttagatggcaagcaagtaggggactcattcatccacaaataaccttcactagagcataacgagtcagctaatgtgcaagtgagccaagcttcctgtcatgggccagcatgctccacccacctctctgaaggaatgggatttggaccaggtttttaggaatgcagtgcccttctagcacttggcagaaggtggaagcctgccaccctgggcagagtgagcaaatcaggagagcacaggcacatgaggggagcgacaggtcgggtgaatggacagggtccttggagtcaaggttgcagaaggcaggttgtgaagagcaaaagccctggatcttccctgagaacttcctgacttctctcttgagaatagtttaaaattctaagtctgaagacttagagactagagagtcttctagaatgctggattggaaaacatgagaaacaatcaggctacatttttggtggcggggaacctggtggggctgctgcttcctccttctccccctcctcttcctcctctttcccctacaaaatagcaagaatgcatctttttgtaataattttgcaaacaatggtgcatagaaggcttagacgtggggaaattcgggtgccactctgtactagttttctattcaaaaa

SEQ ID NO: 60130 - DNA, 1282 bp, Bovine  19866880781990
atgatgatgctttatcatttgctccttgattttggactcagatgcttggttgttttcctgttttatgtttttctggccccctcaagtgtttacacctttttctgcttaagcattttttttttgtctttgtttcctgcttgactagtgaatttgtaccatgttagattagctatattgttgcaaagggagatgttaaagactctctcttttaggtaaggaggatctgaaggaaaggtactaataacatgtatgacaaaattaaatatttatgaggaagaaggaaagatgacataatgagaatctgagtgtcagctgatggtttaaaattttcataaacccaaagtctagcaattcacactaccacagggtgaaaatttggcaaataacattgactatattttttagaatctgtcaatcaattcaattaaataattttctattgttttcctatagctataaatagataatttaagacataattttatttcttaatatgtcttcctcagcacataggcacagcatagaattaagaagactaagaatgtttgagaactaagaagacagaaattaatcaaccaacagctagaacttagtactatagtgttttgattcttccttttttatcagtattttgattcttcctttttttttttagacaatgaaaacaaaagggcaggtgatttgaaattaacactttgctatctggactttttttttttttagtttcgctacatattgttagattctttaatcatgtattattcaattaaaaaccaaaccaagtaatcatcatccttaagtgatgaaatacatgaaatgaaactctaaacagaagagacaattgaaacagattagtttccaagcctcagttttcttgattgatactgtcttttcaaaacaattgggtatttcatgttgttaaaataacagggagaaaagaatatattctgcctgactgtgtctctttggtcatcttttcacactctattagaggctttatctgacttttgtattccaactttattgtatttttccggtgctagaagaaacttcaatgaggacatgataaatggccatattaaattgggtccctcgcccctttttaattaaattcatttaaatttaattttgtaattttacttcagtaaaccatctgactccagatgttggatgcactttttcttatttctgttcccacataattgtacctgtaaaagatttatagctgcaggagacattttggaaccttttagagcatttttggcatatgtttcatggatga

SEQ ID NO: 60131 - DNA, 1712 bp, Bovine  19866880812350
ctatgggattctccaggcaagaaatactggagcaggttgccatttcctcctccaggggatcttctccaggggatcttccctacccaggaattgaacctgtgtgtctttcgtctcatgcattggcaggaagattctttactgctgcactaccttgaaagtcccatatgttatttatattatgcactgtttatagttcatatacttattatatgtatttataagtgtgtatatatatacacatatatatagtagctgtagggttttattaatatgtatatatgtttatatatgtctagatgtagtaagtataggatatgatcttttattatctgctctttttgcttaggtatacattttaaatccttccttaccaatgaatatagttcagtatcactttaaaagctgttattccatggcaatgagattcattactttatttaaaaacttctattcatagcatttgatttttggcttgagtgtttgctattacagataatcttatgatgaacatatgtttgtgaagcttttgaaagaatatgtcagattttatacaaatttctgcaagtgccactctagaaaggtggtagtgattcactgtcctgccagtagcatatgcgcatgccaagtgtgccacaccttctccaaataatggtatcaccactctttgtaatctttttgctaggaaaataaaatatagcctcatttaaaatttttatttctctgttttctagtcactttgaatatttttccttgtgtttcttggccatttttaatatacttctctgaattgctttgcttagcataattatgtgaaaaaaaaaaaaagtgttctctaaattgatccctatcataatcctaccttgctcactgcagagattttagactcagccttgccacacttccctagcttactcaattcactgtttttctctggagtaggcaagactcaattattcattgttcttaactattatttactctttggaaataagaacaggggttggaggttttcagatctaagattggtcagtattatttcctttcccatattctaacgacctgtgacagaacacctaccctttaaaatgcattaactaccaaggcctctgctccaaagatgaaaaaaccttgaactctctctcccattataatcgcctttatgcggctccttggtcaccagtacatccatttctttcatttcttattgttctggctccattattagttgttgggtctaatgtttagcgtctctattcaccataccctttccctgcctgcacctcctctgtgcctagagttgccaagtctttaatgaaagcactgatttgcatcttgatatttcatttgcaattgtcattttatcttaagagcttcttttgtagtcaaaaaataaaaaatctaaaaattgcttataagagacacgaatttgctgcttcgagcagttgcccaggtaccagggggaaaaaaaaaatcaaatctcatgtaactagttattagagcctacatcggtaattggatttagatttataggaaattcagaagattttccagaaaaatggctgctgttaaattactttgaacattaggggtccaaaccaaagcgactgtccatgtttccttgtgaaaacctccctaagctgtaccgcttcagagaggatccatgtgagaaaccattacagcgatagattctcaaagcaattttcataatttct

SEQ ID NO: 60132 - DNA, 3011 bp, Bovine  19866880812642
tgggtacacttacgcgtgtgctcatcctgttgtgtctgactctttgtgaccccatggactgtaatcctccaggctcctctgtctgtggaattttccaggcaagcatactggagtgggttgccatgtcctcctccaggggatcttcccaacccaaggatcaaacccacgtctcctgaattggcaagtgttttctttaccactaagccacttgggaagcccgtgggtacacttgggaaggcttttaaaaaatacttatgccagatctcaccccagactttctgttttatttgctgttaagttttggaaagcattcaaagattaaaatgcttgtaccattctttattctcctacttaatatttactccttcaaatatcatatacttaaaaaaaaatcagtttctggcatatggtggactctcaatgcacagttgataaatgagtgaaaatgatgtacagatgttaagtgcatatgcagttacacagtattaaaaatcactgtgtcatggataatgtcatatcatttaagtaaaactgtttagttgcaataaaattgtattgtatcaactatagactttgatggaattaattctgacttttctctcacttaataaggagggcttttccatgtctaatagtttgtacaggtgggtcatgaaaacaactgaagtgtctccttggtcctgtccagttcctaccaactgtatgtatttccttttggaggcctggtttagtctcagagggccaaatgaggcttagtaacattacgagaaggactaaaattagcttattggagattttccagggacacaacgtgctgatttgtgtgtccctagaagggaaaacacatctgttcccaggatgacgaaagaatatccattctagtgaagatgttgagggcagcctgtcacagtgaactaagcatgtgggtgctgggactctactgagatgtggttgggttccaaatcgatttcactgcaggcccctttaataatccaaagaagaagggaaaagggagcttggccaaattgtgtgatgctttagccgctcattggaaacatctttaaggaaacagtcaagttagagataaagagcatctgcctttcatctccttcttcctcttctcctctattgtgtcactgctgttgtcatcactgtaacaagttccaactgaagggcccctcctccctctctgaaggcaccaaccaacctatgctctcatgtgtaattcacaaaacatccaggaaaccatgaatccttccacacttgctccttgtccaccccactccctggccttctctcccagatttctctttatatagactacctttcctgtaggtggtcacggaatgggtgtgggatgtgtaccaggcacactggtggaaggtatttgaggtcatgatgcctgtatagacatgagaattgactgaaatcatttggaagtatgtccatttttaaacaataaaaagacacttctaaagaaggatacattagtgaaatcatttgaggggaagaaaaaaaaaaaaaaatctcccaatggtattttcaagattcttagagtggaaagaaaatctaagtgctatagccaagctgaaaatgttctgtgggcagcgtgattgtggatgactgtattctctcgaagccagcaggactaagtatatactgatccatattcatgcttgggacgagcactcactgtctcaggtgtgatgacaaaagcagcaggaagttgttcaacttcaggataagagtgagagcaaatgactgcttgtgtgagtagcactggatttacttattctccaggcaaatgtgtcccctttggcaaaatatgtcactcgctgaaaaatgtatcactatgcaccatcttctcagagagagaagtgtggtaaatgaatttcatgaaagaaaaggattttcagagaccagaaaggtcggcatttcggttccacccagacagaagctgtaaccaaaaataatcgagcagatctgtgattaattgtgcagcaacctactccttccatattccactcaatccctgagtaatctttttgtttgtttcttgtcgctgctgtttcaatgacaggtacaattttagcttagtgtgggttttgcaaagataagacaaagcaacacagtttggctgtatagtctaaatgctgtaattacaattttcctgtgagagcaatattttggatataaactgtactttacaatgtagtgggttttaactagcaagatatacacctttctaagtaggccctattaaaacaatttaatagaatgtcaacaagtaccaacatgtacataaagatagaattgtgtggtttgttttcatgcagtgagctagtactgctggggtctgtcaaggactattgaagctcaatttgagctaacaagattacatgattggaattgtattaattgaacgcctttacttttcaggctgacaaacgcaatgcctgatcagttgtaggggatatacttaagaaatatggagtattttttgcttgtgtaaatgtgtttgtgcatatgtagttccaaattagcacaggcatattgatgtttttgtgaaaaaatacatttttttaaaaaaaaggaaaaaatagggctacattcatccttaaatcagtttggtcaagtgctgatgagaatttcacacattttgaatctttaaagttctcctgagtggagttttcctagatcagaattcacactgagcacactcaattgtagacaaaggaaatcgtcactgacagccatcatggaggcaaattatgcagtggatttaaatagccagaatgtattctatagattgtaagacggtgatagtttattaccttgcacagctcagaagcagtggagcacttcctaatactggaatagagacttcatgttgcatcccaaagcaggatagaggatggtagctgaaatattccctttcacacactcacacgctcatattctggacaactgggggatataaaacccaatagataacaaaaaaagaatgtaaa

SEQ ID NO: 60133 - DNA, 1311 bp, Bovine  19866880821883
ctgcccaattacatttggcttcatttgttgaatagctacagacaaaacagaagtgtagcatgtgagtataatcggttctgtgtgaccctctgctgctgctgcttctgctgctaagtcgtttcagttgtgtccgactctgtgcgactccatagacggcagcccaccaggccccgctgtccctgggattctctaggcaagaacactggagtgggttgccatttcctcctccaatgcatgaaagtgaaaagtgaaagtgaagttgctcagtcgtgtcagactcttcacgaccccatggactgcagcctaccaggctcctccatccatgggattttccaggcaagagtactggagtggggtgccattgccttctgctcaccctcaagcacttattaagagagctttctcaagggcagagtggattctaaccagtcaaaaccacctctttccatgagaagagtcattctactagtgtcctctctgactagttatgaaaatagcttctcagggaaccagacacagtggtgatactgtagcatgaaaggaattctgtctggggaagatggtttgggtttatcattgatgggttaagatccagaccatgaacaactgcccttcaagtagccatggtgatgtcaaaaatttctgcgggtaaggattaggtgttgcctttattcaccagagaaaaaagaaagcttggatcattgggacaatcactcatatcaccatctgtgagcatgttgctgtatgggggaaaaataacaggctataaacacacgatttacctgcagaagctttagaactgcaatttgaagccttacagacgtagctcgatcttttatttaaacagccttttgttcccatccaagaaactataagcaatttataaacagagctgaaccccaagtttcataacagacatattcttgagaaatacgtgacttaaaaccatgtaactaaaagctttgacattatcttaaattaaccctgaaagatgatctattcatcatattttatgaagcagaatatttaaatacaaaatatcacaatgacattaataatcctatcaaatgtttactatgagttatgatttgataaagctacccttaataaggctgctaattaatttttttaattttacaaatgacacacatattttatcttgtggttggtcttatctggctttgcagataaactgtggaagatatgcagaacctggaggagggaagaagggcaagtcttgagtgactgagcctgtgtgtgtgtgtgtgtgtgtgtgtgtgtgtgtgtacacacatgtgggtgttcagccaa

SEQ ID NO: 60134 - DNA, 1660 bp, Bovine  19866880843545
ctcagttttcccataagtgaaacagcaagcttagtcaaagatagtctagaatccattcaggttttagtctattctatcaaaaatcacttgacctttaacatacgcatggagaaactatgcgcacatttcatttcccctcagaataactaccacgtattattaaaccatgggtttggtgagatccctttggaattacatatttttgcataatccatgaaatttaatatttggacagtgcttatgatgaagtgggggaatgagcaataaacagttaaaagcaagttgtgcaagatgttttgcctttgtctttatgtaaccaatggaagcgatgagaaaatgagaaaaaaagggccagagtaagctgaggtattttttaacaggcaaaatgatcaaactctctgatggcaagaacaaaattttataaatgctttttgcttctactttaaaacctctagcaataaaaataaaactttcttaagacttccttaaggcctcgctattaaaatcctcctaccaaggaaaacttctcaagagagaaatgaaaatttttttgatgtggatggaacctaaaaaagtgaatctactaaatgagaaacatttataaacttgattattctcttcctgtctgtaaattatctgttactttctctcttcctttagttgttcctctggtttagctgattcacacgtgtgaaatagaaatacatggcacacaggcttccagtccttcttgctgcacccatggcaggcataactaatcaatcatagtcctctttccccatgctttcttctgcagccatagcatctttgccagtgcagcatcccatgcagtcactatcagagttggcataatgcataacacttacttgtccaccaagaactagaggctaactaggtccctagtagtatgattttccaggcctaccaccctcacagtagtagctttgtccatcatatcattcaataaagtttaaaaatggctgtgagagcaaaggcagttataagggaagttactatgattatgaaaaagggaaaacatgaaaaatatataattagtaaattgcttttttgcaagttatctatataatttattgaacatctaccctgtgcccaggtcagacatgatgagaagggtaagcctatgccagccttttgaaggcccttatttcactcctcctttaattcagcactattcaggacttcccttgaggtccagtgattaagaattcacctgccaatgcaggggtcatgggtttgggccctggtcctggacaatcccatatgccatggggcagctaggcccatgtgccatagctgccaagtccaccctctggagcccgtgagctgcaactactgaagccagcgggcctcgagtctgcgctccaaagagaagccgcggcaacgagaagtccatgcactgcaactagggagcagcctccactcgctgcaactagagaaagccacctgcagcaacaaagacccagcacaggcaaaaataaataaataaacatgttaaaacccactattcaatggctacttagatttcatcttgaagctaatctctacataatcataatgatctcagagaaagcattgagctgtcctgaagagacatcttactagtttcctgcctaagaattgaacctacccgctagtccat

SEQ ID NO: 60135 - DNA, 2057 bp, Bovine  19866880857365
cctaacaatgaagaaaacaggcctactaaaaaatcacatctgttatcttggcctcatatgcaccctgctgaaaccagcttctccacctggtcaaagagatgggagagtataattatattttaattaattcttggcattagaaaactatatctgagtttgtgcattttataggaagaatttagactagaaatgtaattgatgacatcagtgctaaatttatactactgttgactatgaatgtactacatggcttcatacgtctttcataatttgtccttatgtgtttatctcctttattattccttccattttccacacatcctacagttaagccacatacgtgacttgacattcccataacatatcgtaattttcaattaaatattcattgagcaactattatacagtcatggactgtttttacagtgatacttgccctgaaatctaatagtcaaaagaataataaataaatatacaaatggatatttaaatcaaagtgtgacatttttatacaagtaacaatttaatagggcttccctggtgactcagcggtaaagaatctgcctgccaatgcaggagatgcgggttcaatccctgggtcaggaagatccctggagaaggaaatggcaacccactctagtatttcttgcctgggaaagtccatggatagagcagcctggcaggctgtagtccatgggattgtaagagtcagacacaacttagtgactaaagaacaagaggattaacttacacaaattaactaataaaagttaaaaaccatagctgtcattattaaaaaaaaaaaatgagggtgatcactgcctatttccctgcagtgatgattttaggaaagctttatttgaaaatcaggtggcatggcctctttcggtctttcttttttctttctctttttcctctcctctccaggagtgatgttcctgtcccaagcacagtggtaacagaggaggtggagtacaaagaaaaaacatctagcattaatgtttcatctgttctgcgctttgttttccttcctctggcttctaaccttaatcagctgatttgctcacagctctaaatttccttctcacttcccactaatctccattttcagataagcaatctcttcctgctgaaattgaaaagcttccactaaatggaatcaatcacactatcagccaaagagaaatcaagatccatttgaaaaggtcagataaagtaggacatttacaatgttgatgatgctacatttaaacaagtgcactgcatccttataatgacctagttcaggaaattgctgtgaagtttaatgatatgttactaagttacactgcatttcagcagcctccatatattgcgatgtgagccttgtaaataatattcgagtagctaaagcagaaatttaaaggcaacattttatcaaccataatttaatttgcccaacatctgatgctaaagtgcagtgcttatgctcggacaatgggtactcataaaaatgttcatgtactttttcttttgggggccaaaatttcatttctttcactagatgaccatttttatcatcacagcaaataatctgagctttgtttatgcatcagtttattctctgttatcttcaggtgtctgatttaatgccagtcacgctttcttaggcttcccaggtggctcactggtaaagaacccacctgccaatggaggagacgcagcagacacgggttccatccctgggaggggaagatcccctggagaaggcaatggcaacccactccagtattcttgcctggagaatcccatggacggaggagcctggcgggctacagtccatggggtcacaagagttggacaggacttagtgagtaaaccgccaagtctgagaggcaagccaatatttgaaaaggtgaacatttttggtgttctgaatcctgaaatactccttcatgtttcaatcaacaatcggtttgatcagaagctctcagtgtgcactttaattagcaacaggatcaaatgttaacaaattctgtaaatgcccttctcagcctactgtctaagaggctttataa

SEQ ID NO: 60136 - DNA, 1468 bp, Bovine  19866880922581
atttatttttttatgcacatccttacaagtcccgcccccatattaccgttgtcgcccccccccccaacttctctttataaccactaagcaaaacagctggggagaagcaatcaaacattgttttatctttacaaaatacagaaattgcctactaaaaatcccatttctactttgaatgaaagccattcagtacagtataattttgtaggctaatgagccggttttacaggcaagtgtttcgtgtaatatgttgtgggagaaatgaaaatgtccttgaagtgacatcatttaaaattgactgtcacaaaggaaaggaaaaaagtcacacatttaaaaacgagaggattttaattcaaacttcatatccaagaacgggcttagttttattaaaatttccagttgaattatgactcactgagggttctaaatgtctggaatgaaccatgatgccctcatttaaagaaaaagatgaaagctttcccgccaaacttttaattttcatttgagcatggttaattaccgtgaaagagagaagggggcatttcctttcttcaatggttcctgcttctcccaagcacagttacctgtttacagttagaaaaaaaatacccggttctgagttatttatgaaacttccaggacagccttgaaaaggaactcaaaaaagacaccccaaggaactgctgcaggactcatccggagaactgtttccttactagttaacactttgttaccaaaaggaagaaagaggatgcacccggagtcttttaaaatataagctctcttcctgctgttcttcccattccaagtaaagggtagggggcggaaagaacagctttggcaacacagctttgtgatttttctgttgttgttaaggcttttgttggctggctggctggtgttttcgggttgtgctgggctctgacatcattgcaagttacttggcagtcagggcccttccccagccaacttctgacccagaaaactctgcatctttcactcgtacccagtcattctgtcctttctccatcaagagagcaagccccgctgcaggcagagggctctgtgcattgaatgaatatgcaaaggagtgaccagtggcttgacgaatcatatatcgccacccacctagaggcagaaagcttatgagttgtcctctgtctgcagtagcagccaagaaaaaaaaaaaaaaaaaagttgagttctccagatttgtgaattctttgttgaaattctgcgatggccagctttaaagagtaccaccccagagagtgccatttaccttagactgagttttaaattcaagaatgaaaacaccttttaggttgcagaagaatatgctgatagatcatttcgagccaagggttagacatgatttcagtctaagtagcagtgtacacctcaaagccaatccccatgtttggtccagtacggaaagagagagacaaaagcggacagtttagtgaca

SEQ ID NO: 60137 - DNA, 755 bp, Bovine  19866880993691
aaacccagatatctctaactaggaagagaagtcatgtacacacatgtgcacagacacacacacacgaagatttgtagatcttgttaaatgaagttcttaattcttatcatctgatgccgtcccttcaactgtcaaattttccaaatgtaaaatcttaacgtaacatttattatttttatatctaagaaaatatataatgtattttaatctccaaaactagtacaggaagaaaaaactgaagtcacgtgagtgaaagtccatattggtgtgggatttgaatgtctgtatgtgacagaaagttgattcatattggatttttgtatattttagagcctgtaatgagttattgatctgtgataaagtaaactgacatttttgtaacccactatgccatcagtatatccagtaagcacaagtttcagtaatatattattaggatcaagtcactggtagttttagcaagcacttgcaaacatttgttgcagaagagagcatatacatatttacaagtaaaagtgttaggtattcagtagagtgccaggcgcctctgtccatgggattctccaggcaagaatactggagtgggttgccattcccttctccagggtatcgtcctgacccagggattgaacctgggtctccagcagagagagaattgcaggcagattcgtaaccatctgaactaccaggaaagccccatatttacattttttcaagtgtgcctgtgtatctacgatgttttattctcttctcta

SEQ ID NO: 60138 - DNA, 1350 bp, Bovine  19866881005848
gtgggctgccgcctaaggggttgcacagtagttggacacgactgaagtgacttagcagcagcaggggaaacaggaaaatggcattccaatttgctgacatgttctaagaaggaactttaaatatctgaagttaatactgatcatactgtgtcattgattcatcagagcactcaatgtttatatctgttctttttttactacttgctagtgaatgtttgtagtcgtctgtaagctgtcttcttatttctgatcttattaataactttcagcaatagctttaccttaatgatgtaaaggggtaaaggtccattttctttttcctttaatgtatgtaaaccaataaatgatcaaaaacttagtgagctttaattaatggggcatgaacacaaaatagacaaatcctgccctcagaaagcttctaccagtggaaatttttctggatcctaatccactcatgactggactggttatgatctttaaacttcacgttataaatcttggcagatcagaaatgttctagagtcaggcaatcactcaggatgttcccatgccctgcctctattttcaatcttaatttctcagtagatcttctaggtcagacctcctgcttctactatatattcttcccatgttacctactggattttgcatgctttctgatgttcatctcagcaattttgcatcttgtgtgtcctacacattttctgatatactattatctgtattgatggtgtttagtagcacctaaaccttttaaggagcttcccaagtgcttcaggggtaaagaatccacctgcagtgcaggagattcaggggatgtgagttcaatccctgggttgggaagatccctggaggagggcatggcaacccactccagtattcttgcctggacaatcccatggacagaagagcctgatgggctgcagtccatggtttcgcaaagagacacgtgactgagcacacacacatgcatgcaaaacttttaagtcttcatttgtagttcacataacacttgagttaaactgtattataaagtagacctgtccaagaaaatccttttttagtatgtggcttgtagaattttttttaaagtgaccttgggtttgttttttcatatgggatgtaaatgggtactatcagagcctctctgccatcactatagtgtaatatcattataacaccacactgaaatgtgttcagaattagatgtttttagctttatcctttcgtcagaagtgtttcatatgtactggtgatactgttccttcttgaatatatgaaaactccaaagtgtttatattggggagatattatggaggtgtcatattgtaaaagatagactgtatctgt

SEQ ID NO: 60139 - DNA, 822 bp, Bovine  19866881008191
acttgagaactgcatctgaatcataaatgactcaactttttccatctaaggcacttctaaaatcaacattgttttgggaaggatggtaatagtcatacagtatttggagtgactatagttgttcagccactctataggactaaaatgcaagttgtaattaaatctaaagccttaggcttagtctctttgaaaagcaaagctgttttagatttgtggttttaggagtggctatttggttctctgtaaaataaaatatatacatatggaatagatataaatagaatggaatcacaattagtgacacacaccatcagtaccattgggattattacaaattataaaattgttatttctcttcttttcctacaatgtagagatattgcaaggattttaaagagtaatatttttgtcctttttatgggaagcaaatgctgtgagtcagtgaagaacacatgatttagatgaatgaacttttcttaacagttaaaatcattcattattcattcacacccgtactgttagttatttctcatgtcccactccaagattcaatcttcttgttattctcctcaatctcccttaatatggttcccaccacctgcagtttctgaggcagtctgataaagggaagaacataggttgtggcatcaaagggctggtatttgaattctgactttgtaacttatcagctatacaatgtcaaggaagttacaagagtggtactatcctctgctttcttattacagggttaccatgttaatagttgtaatgtatttcgaagtgctaggcatctcacataatcagtaggtgctcaacacatat

SEQ ID NO: 60140 - DNA, 2390 bp, Bovine  19866881159223
cttatttgctattgtagagactgggagcaagaaccaaaagagcaggggattcttacaagtgggtcatagtgggagtaatttagctgcattttggtaactctaagaaaaaaaaattctatgagagcagaaaatattcactactgtcttctgtgctgtactgtactctgcctactaagggctgtgaatacttatgatccgtgtctctgtattgctccccctacacagatctgcctttggaaggatgccacagatacatagcacttgccttgtttgaaagcattctcttaggtgcagcctccccaagtctcctaaatgaaaataaaggagttggtgactaagcatgggattatcccttaaatgtcataaatttaccccagccaggttggtgctaaatataattcctagtacaattactcaacaggagtaaaataggggtttttcttagggcactggccttgccattacatacagagacatgtctgggcccaacttcctgaaggaggatgacagtcctatttcttgttttctttcagaatactctcataatggagtgaagatgcaaacgttgttagaacaggactttcaagtaggaactggtaaacaaaagcactttttgtaagttaagaaagaggtgtcatatacaattttgtttaactgctggcttgattttacactctaagaactgggacacatgatccaacaataggaagaactctggaacactgtatttattctggatactcttggcttgtattattgccaaatttaattccttaaggctgtttcttcatctgtaaaaatgtgagtcttaaaactgatttaatgctgactagttaagttcttctagtcactaaaggtaaacattttttaaaaagggactgaaaagtttgcccatatcctctctctaacatcttgctctttgtccacctgctgttctgtcttgttgagaagaggggagaaaggctgggcaggaaaagcaggaaaggaaacaccaaaacatgaacaggagaaaaggcaaaaaggatagaatggggagatggaaagcagcaccttgtagcacaagagcagtggagacgatctaaagccacgtatagagtggagaagaattttcctttgaccctccattcttcctactcaagagctgaaaatacaaagaataattcataaacaaatttaaattaaaaagtcaaatacaaaccacacctagtcaatggacatttgccatggatagcggagaaagaaatgaacttatgaagtataaagtggttctgagaggagaaaggatcttctacgtgatactcagcctgggaatttttccctacttccctcactgctcagtaaagctggggaggtgaatacaatccttccatggtaacagcatttctgtagcagccatggttgcagatgtcgactgaaactgcccagcatttgcatctatctgtccaatccatgcaaatgctgtgaacagcataaaaagttgactggtaaaacccaactctagagacgagttttaaacaaccacaaagaaaatgcttgtaaactttgcaattagttgttcagttctgaccctaggaagtggctaattgctacagattggtgaggttcaagtgaagaggacagaagcagtgaaaactggacacagaggaaaagggaaatgaaaagcaggaccaagaaggggatctcatttctcctaaggagagatatctcatttcttcttaaggaagcgacttcacagagatgctaaaagatatgcccagggtcacttcctgttgagaagggattattagacccctggtacaaattacagttacattagtatggtatttgtttttgaatattttatggctgtgcgtgtatgctcagttgctaagttgtgtctgttttttttgtgaccccatggactgtagcccaccaggctctctgtccatgggatttcccaggcaagaatactggagtgggttgccatgcccttctccaggtgatcttcctgacccagggatcaaacccatgtctcctggattgcaggtgggttttctttttttaccattgagctgctagggaagctccattttatggatgtaatacatgataaatggttcagttcatgtcatagtactgatttagatcttaactattttattgcctttggaaggaatgatgctaaagctgaaactccagtactttggccacctaatgcgaagagttgactcattggaaaagactctgatgctgggagggattgggggcaggaggaaaaggggacgacaaaggatgagatggctggatggcatcactgactccatggatgttgagtttgagtcaactccgggagttggtgatggacagggaggcctggcgtgctgcaattcatagggtcgaaaagagtcgca

SEQ ID NO: 60141 - DNA, 1050 bp, Bovine  19866881170640
aaaaaggtcactcatagctaggctttcttgttataagaattatttgaatgtttatgctcattctgaatctgccttcttgctttcttagtcaaaacagatctaataccatacttgatagctcacctgggaccttgtctaatgaaatttctagtcttcatcaaagaaacatagatgactacaatctaacccttagatgacaactaaagaaaaacaacaactacaaatccacaggataaaggaatcaatttcttccctcaagtgaaaaattatacttcatttttttatatacgtcattgtgtcttgatgtgtatgaaatactcacactgcaataaacaaactagagtatggatttttgcccaaacttaagggatttagtgaccaaattatcattctgttcttttacagtcttgttttgccaggacaagtatttgtgcattgaggatgggagttctctaaaaacgatggtgtttgacattactcattactgtttacaatttctcatgttgctttgactaccaaatgagactatttaaaaataataccaatcactgggagcaggaaaaaggtgtttgtccataactgaccaacaagaaactcacagtctacctagtttctataataatataacaaaacaagctcacaaaatgattgttattcatacttttacaactttaataaattttaaatggaaaatcagtaaaggcctagagagcaaccagtgtctgaagcagcaaatggcacatggcacatagagtattatgaaactgtaagttactcaatacatttgtttagaaagtaactaaactaaataggaaagtgcacttaacagatacagtgtgtagtgactatttaccagtagctctgattcctgctgggaattaaaaatatatgtctgccatggaactataaagagaagaatttggaatacatatgaaatgttaaaatactgcatacattctaagtaataaaaaaagtaattcattttgaaaattttaaaatgcattatgctttcagttacttctggagatcatgcatgatgaaatcaaacaa

SEQ ID NO: 60142 - DNA, 1239 bp, Bovine  19866881201470
ccaaagagaaacgataccatgtgttcttataaagaactgtacatgaatgttcatatatgtagaatttatttacatttacatttatttctcatggccccaaactagaaatgacccaaacaaatgtccgtcaaaaagtgaatagttaaacaaacgttgtacaacaatacaatggagaactacactgccattattaaaaaatgcactattgatatgtgctgcaacatggatgaatctcaaagtaataaagctgagttaaggaagccatacccccaaaaatcatattgtatgattacttttaacagacttttaggaagtgtgagcttatctattgtaacagaatacaaatctgtgtgtctaaatatatatcttaacatatggacattttattacattgattatacctcatacagttttaaaaatattatataatccttataaaatgttggttcacaatgtatataccagcatcaggaaactgttgctctctgtatctcaaaggaaggatgagacaaagacttagtttagtagtttcagttttgctaagccatattccaacagtgaactctattggcaggtgtgtccgtctctcctagtaagtaaagggcccccaggagactagcttttcgtgttgctcaggctttcctttcaaaggcagaaagcagttttggaaggcagtggagtagtgtcagcagaccaagggttgttgccctgtgtcaccttgccttcacttgttgccctgtgtcatcttgccttcatttgttcgtgtgtctgagaaatcttttaatatccctggactgcatagggaaaacaaggagcttaaatttgatccctaaaacttcttccgtgactgtcattttgcctccaggttgtagctgtgtttgaaaggattgaggtgactggaagttcaaccaccagatgataacacaaagtataagggagaagagttttatgattttaaataaaaatcaaataaaggcaattcaaacttagaaacagaataattatagtgatattctgtggtgacatagtaagagttgaataaaagatttgctaatctctttctctatttttatattttaaaaaaagagttttaaaagtacaatcttctcatctaggaatggtgccaggtttctgtcttaagtgattttttgggggtttttctttttctctctgcattaaaaaaaaagttaatactgtcccacccaactctagcagaatcccactcaactctagcagaac

SEQ ID NO: 60143 - DNA, 868 bp, Bovine  19866881229909
ccttagtttcctcatctgtaaaatggagataataaaaaaccttctgtcataggttgataagtgagtcaatcccaatgcaatatgcttcaaacagtgactgatattaattatcagacattcaattaatgcaggccactttcatacttatttcatagtaggtggctcctgaaaggatgaaaacatttactacattgtatgcagcttttctagtcagaatcatagtatctcactatttcaaaattttccctttcggtaggaacttcctttattcttacggcaataacatatactttagcaggagctggtaatccaacacaattctaatgtactaaccttttatgtgtaccataaaatacatcaagtgattactataatgatcagtaaggttaaaacatgaaccacatttcatcaaaatcggtatcttatggcacaaagagaaaagaataattacttttgaatttcaataggaggatttaagccatgataacatattgggattcaaattttcactctaagcccaacagaatagatgaaacatcgcgcaataatggaaagatatgaaggacaattttctaaaatgttttttcttttataaactattattgtctctttttccctggaaaattttgattcattgtaaaagtgtcagataattcaaagaagttgcttcaaaactatctgggctctaggtttgatgtaacttttagaaatgtttttattgaattagaccatacatatagaaaaatgcacaaatcacaggtatgtgattggattaactttcactagctgaacactcccctgtcatcagctccatctcagaaacagaacatgactagtaccccaaaatccctggggcccttttcatttc

SEQ ID NO: 60144 - DNA, 1126 bp, Bovine  19866881273846
catctcgggggagcccagtaggaacatcagttctcagttcccatcgcaaaagtattagcccttggcagctaaatgcaaaaccttctgctgctcctgctgtggtcctgcaacctcctaccctaagagatagtgcattgctggcaggatcagccagatttgccctttcctcagagttgaaaatgagactttgctgtccatctttgtcttctgtgcacctgcttatcagaatcacagacctctcctcccaccttctgaattcttccaaggagtctcccagcataccaactggctggggcctgtggccggccagctgcttctgtcccccaacactgacccccactggaatggccctgagttgtccccattgtcccacagtgcaggccaccccctgtctcccttgcaagggaagagctcagcgcaagcacggtgttcattccaccccatggcaagggcattgggaaacctgtgctgctctattatggttaacactctgatagaaaagttggggattcagagagccaataaacaagacccttttgccctcccgagatggaaaacaacacagaattgcaggcatcagacagataaacatcaaaatagcagctttattttttgatgaagctaattagagaatgtaagagggctttgatgtgccacccaacaggcaccctacactgccctctaaattgaacgtgtctccctaacagcacccaccacacacacaggcacacagagaatgctgtgagcatgtatgtgcgtctgctcagacaggcggctcagaacaaaagaggagggagttgcctgggcatgctcagatttgtcctccagttttcctagtcacttcacagagcctgcatgagtccgttagagtctccccataactcttctctttgtggaggggaatgaaattccctgttctgtatggcagtggtccacaaatttggttatatttacggaagacaattgttccatggaccaggggaggaggggatggtttggagatgactcaagcccatttgtagcacatattatttctgttattattacatcagctcatcttcaggcattagatcctgaaggttgggaatccctgccttatgggaaaaagaagagtgaggagtaaggg

SEQ ID NO: 60145 - DNA, 1831 bp, Bovine  19866881276388
tgacttgagaaaggagagaaatatcctatatggttctatacagctgcatctgggttcagagccctctgttcagttgtgtagtcagatccgtccattccaggcttgaaagcttctattctgagggccatcgagagaacttggaagcttcccttgagtaggcctatagggtgtctttagggtcttatactcactctgacgtgacacgcagttgaagtccaggtgctctgtcctctctgatgcttggcctatagaatgcccgcagactttctagtcatgtaagcacacgcttcattaagattggatgggttctttttttttccccacagagaccgtgccctattgcagtttattaaaactacccatgcagtgtgccattattcttcctgcttgtatccatgaatggccaggcctcaataggaatatccaggtggagatcaataatcagtctcttagttagggtaggaaaaaagaaagagaagaaaaaagaagatctattggtgcactgcattcagctgtgttgaagaggtcttatcattaaagcagcagcaggtgttcataaaccaagcttgctgggagtgttgtacatgcaggattaaaataattgtccatcagtctctgtctcataaatgttttcctttgacttttggcaggaactccaacctgagcatatgccagttgacatgggaacactgaggccagcagtttaaggattttcacatttgcttgcactggtaagatttaaagatataataatgaaggacattaaatgttactgggtcctggctgtttgcactaggtatgacattaaccttgtttaggtgttaagtttttttgacctagataggtctctattcagttactttacaaaatcacagtaaaaacaggataaatatataatccatgaatttgagcatagtatcattggtattggtgaaaatatggaaactaagtaatatcagatttttttttaacttctgtacaattggaccaagtgggataaacaatttcccttttgaacaatgaaattgtctattctaaagagatctgattctcagagcacaaagggatacagtgtttaagatgaatgtggagaaagaaaagggctttccaggtggtgctagtggtaaagaacctgccagtctctgcaggagatgtcagagaccctggttcaatccctaggttgggaagatccgctggagaaggaaatggctacccactccagtatgcttgtctagagaatcccatggtgggctacagttcatggggtcacaaagagtcagacacaactgagcaacttagcacgcatgcatagagaaagaaagggaaagtaatcctgttttcaatacatcagtggacagtcatgcctttaatatggatgcagagactggatttttaaaagaaccaaatctgtagtcaattataggattgctggaaaatgagaactgcgtgatgccgatggtgtggtgttcactaggtgcttattggtatcaaaggcacaaccgtatgatgtttctttaaaagagaggcataatggtgaagatattggcagatggatagcaaattgtgttactggaagatagttttgaaaagaggagtctaagatctgagaccaagatataatattggtttaagtaataattaagcattctatcttttatggaagagaacagagtctctggacatattttcaatataaagtaaaaaatacaccatggatgtggttaactgaagttaagacaatataggcctaggtagattctttggatcctgacttgttgaattgaatgggttaaattcagtaataatactcattccattaccatcttcaagt

SEQ ID NO: 60146 - DNA, 1599 bp, Bovine  19866881300385
accttgggcctgcgggcatccacccatggccccaaatcaggactcacttggtctgagtctcgcattacgaggctcagaggcttacgtgactgcatcacatcaccttgctcctgggccagtggtcactggggcattcattctgctggcaaatctaagattgcgttagaggcctattaaggcctctttcacttctgtgattccatgacttcttttattcaaatgcttaccccttgggcctgggctagcaccagaatactatcaggcagggctttctctggcttggtaaaaaggaacaatcctctttaattctctctgtgtccagactgtatcatccaagcctttctactttgcctaacaatccagaaccaaacgagtcatgtggttctcagatctgaggttagatgtcccctttggttttttgacctctcattacctgtgatcatatttatgtgcatgtatgttcgtgtatgtacaaaaatatgtctcagtatttctgcacacgtggaatgaaaattttcttccccatggaagaaaaaccattaattgtgtttctgtttatgcttctattccccaagctaggacttttgtttgagtaaaaatttgtgccttaattataaaatggtagtagatgaaaaatgtttgcatttcacaaatatatagtttcacaatctttatagcatcaactcaggctcatgaaatataatatttagttgactatttttttcttcttttccccagatattttcccaccaagaaccagggtgaagaaagttatacaagcagatggtttcaccctaacaatcatcattaatctttactttcctcatctttgtttactataaggctgagttaaagtatatctggactttctcagatttttttctacagtagtgcttcacatttctgaaaagtcacttccagcaaaagatggcaggaaaggtacatggttccctgtttctgagaaaaaggcaaagataatttgcaagtgatagaaagctggtatttatggtgtttcggatatttttgaatctagggcataagcgtttctaattcaccggaagaggcaagagagctattgtagaattacgtccctccctcccaggactgaaggtgccctggggaagcagtcttatgcctcacagtccagagaggatgggggcaggcagggaggggtgtgagagggactggacagtgattgaggaatgatggctaaaattagttcttgcttcccctcccttaccattagcagacagtctgcttctccagctggcttctcttaaagtcaaaaagttaaccttttctctgccttggcaaggacaaagcatgctctgctcttgcctgttggtacggttagagttttaaagtgtgaaaggaaagatacgtgtaaaaattgtcttattgatttttcttttcagaatgtgtctaagaaagaaaatccaagtgccaaaaaatgaatatagtattttcatgtttcatacatcaatagagactaattttttgagacttttatagacggtagcagtgttttaagcacttttcaggcattatgttattttttcctcaaagtagccctctgagatcagcattgttaaccctaat

SEQ ID NO: 60147 - DNA, 762 bp, Bovine  19866881305795
cttcagctggtgggaagaggccaagtagtcggtgatgtagtggcctggtgctgtgagaaaggctccatatgtttcagctactctcagaagagtcactgaggtgtagatgcgttttgtgctcagccaaatatacatctacggctaggaagtttcagcctctgtgcacagatccaaaagctgacataaattttagaccataagcaatctaaaatggggcaaagcaacaaacttcatccgattttcctcccatcccagcccccctcttgcctatctgcacactgtgcctcaatttttagtggtgcattcatcaggacttttattcttaattgacagggtcataagttcatttctcgtggagaatcattctccagcccacttatttaaaatatatttgaggccaatataatagagcatagttggaataaagctcttaaaatctcagagcccagcttagaagaaaacatttgaaaatcaagcaagagatattttcagaggctgatgtccctggaatttatacaagtggtcaccatagccattggccttgagagtgccaattacagatattctgctgtctgattagagaattcctgagttcaaaggagtacattaagtcaaagtgtgggtctttgaattctgattaatgaatttgattaactatttttaattacagagtgatttaaaaacatcccagaatcatcactgatctttaatctgggtttaagaaagctgaatatctgatgctgagaactattttgtggctgg

SEQ ID NO: 60148 - DNA, 4358 bp, Bovine  19866881353330
tactggagtggggtgctattgccttctctgaatacagtaattatttgttctcattcatgtacaatattctactgtaaaaaacagaggtaaattctacaagcataatgttaagcaaaagaagccaagcacaaaagagtacatactgtgtaattccatttataagttcaataaacaggtgaaaagcatctacactactagaagtcaatatagctaaaacacttggtgggggtaggtagtgatgaggtttctggagagatggtaatgctccaaacaataactgtcatgtcaaaattagccaatgtcttattttcagggacaacatatacatgcatgtgcacacaagcattctttgtgtttaaagagcaggatgctaggctcattgttatcatgttattatagtaataaggataaatgtaatccttcccggaaaaatgtatagcattgtagtggagaaaagataagttccagtatttaagctgaattaaactgtgatttaccttaactgctcattatttctataattggggcaaatatctatgtgctttaatttacttgtctatattgataaaattaggagaagaatatctacatcatcaaggtgttgtgaaatttaaagaaattacaaatgacatggactaaaagtgactgttaataatgatgttaatttcattcttcccactttctcaggcagcacacacacacacacacacacacatatatatgtattgcccatctttgtgatatgactgtaagtgtccttttcaatgctgttacagctcttggtcacagaaacttcaggcaacccttaatccaaatgtgacaacctgtctctgtaatggatgattagttagcattatttcttcttactggactaccatcaccatagtctctgaggttggatatcagcagatcctgttaatgtttcctttgcctattttgtttagagttagtcagctatatgtagcatatgttgctggtggtggtggtcagttgttaagtcgtgtctgactctgcgcatccatggactgtagcaagccaggcttccctgtccttcactaagtcccagaatttgctcaaactcatatccattgagttggtgatgccatccaactctctcatcctctgctgacctcttctcctccggttctcaatctttcccagcatcatggtcttttccaatgagttggctcttcacattaagtggccaaagtattggagcttcaacttcagcatcaatactttcactgaatattcagggttgatttcctttaggatttactggtttgatcttgctgtccaaggaactctcaagaatcttctctaataccacagttcgaaagcatcaattcttcagcactcagccttctttatggtccagctctcacatccatacatgattactggaaagaccataacttcgactatgtgaatctttgttggcaaagtaatatctctgctttttaatatgctgtctaggtttgtcatagctttccttccaaggagcaagtatcttaatttcatggctgcagtcactgtctgcggtgattttggagtccaagaaaataaaacctatcactgcttccactttttcgccttctatttgccttgaagttatgggaggggatgccatggtcttagttatttgaatgctaagttttaagccaactttttcactctcctctttcactctcatcaagagcgtatatagcctgctttattctcatccacactgtgcaaaccacagcccccttcttcatagctctaaattgcagccacagtgctgatggacagaatgcacccacaagcctgcttgaaaaacttgcccttctctgttagaggttacctgcagtttaggtaatgcatgattcctcatctccatagacaaacccacctactggcaactggaacatctttgaacttcttcactgatgtgaatggtccaaaggacacaggtgaaaaacctttgaagtgacggaacatcaggttgtacaaatctggggagacaggtggaagagacatggcaggcactgaaggtcacttctctacttcccttcccctcaccctttacatacatcttctaaaatcttcacagcagttccattcccttatttctcatcccattttattttcatattttactctacattcctaattctctcattcccttttaaatttttcttagctttatgtttctatttttctatcaatccagatttggtattatgcacttattgagctcataaacagaacttatgccctggaggaaaatcctgagaagttaaatacattgtattcaatttattttggaaattaatatgtcagcaagtgaaccaaattttcatttctttatatactggttaatgaacctacattttggcagccatgaaagcttctttcagaactttcccctcctcttcttttcaaggctttttagaaaggagcttcacagactagtttcaggagggggtgaggatggaagtttgatattgtaaccttcccttttctctcaagcttttctctcaagtctcaagcttctcttcttttgctgagcgtcttaaacaagcaaggggatgttgttcctcttttattttttaattgcttatgttgatgtgcaagtcaatgttttcaatgagatgcaaacggagtcgcccacacagcaataatgggggctttgtgggctgcccagcatgtgctatgtttctctgaagactttaggtccatatcccaagctctacaaaggggttagtacatttcagcttccctctgtcccataccaaggagatgctctgactgtgagaaaaacagcaggtagattagccactgatagaatatgtagtctctccggaccaccactatgcataacacttcttttccactgagagtcaattattacattttaaataatcagttgtacagagaatttaatgaaatgctgccatgatatggtaaactagagctgactgaaaagctatttttgctttcaaagatttttgctattcagttaacttttcctattaatacatcatgatagcaactgtgattagaaaagtaacatccactaatttacacctgaatgacacaggaaaggttgctaagtgctttggaagtataataggattatttttttctgtggggagtaatatattctgggtaaggacagaactctggttaaagtctatagaattaacaaatagaacttatctatcctgatttggcatgttctcgaggctaaatattcatttatgtaaggatttttgccctctatattactattagcacgtttaaagccttttattcaacatgggcagaacagattgcttatactttctcaggtccttcttacattttataagtgctgaagtccaggaaatctctatgaaaattaaggctacaagagaagagtgcatttgctgttgtctgggtaacaggcttgggcactaagtactggagacttctgcaggccaattttttctttttaacaaagaacaaaagagggttcccacttcagaagggttagctcaccctcgaggcagtaaaattggaaatgaaaggtgaaactaaggacacatatccccttagaattctgtagaagaccacagtaaatggtgcatccacaaactagtgaacaaacaatggtataaataagaataaactgagaaagattcccaaccttacaggaggagtgaggaaggctaggagtaaggaagccttcctagaaggctcaggaacctgaagaaatttcaaggactgtgagaaaagaggaattcaccctaatttacagataccataggtgaagtcaggtagcaagttttggggttggcctgctatccttaaaatgtctttaaaagttcaatctgagattccccatacaaagttcagcaaaccaaatttaaggtctacaatgtaaattaccattcctgctatacttatgtatgaccaccttattttgtgatcaagtcatttttctttgagattggtgttgttcagtcactaagtcatgttcaactctttgtgactccatggattgaagcatgccagacttccctgtccttcactaaattccagtttgctcaaactcatgttcattgagtcattgatgagttccaaccatctcatcctctgtgaccctttctcctcctgcactcagtctttcccagcatcaaggtcttttccagtgagtcagttctttgtatcaggtggccaaaggattggcgcttcagcttcagcattagtccttccagtgaatagtcaggactgatttcctttaggattcataggtttgatttccttgctgtccaagggactctcaagggtcttctccagcaccaattctccagcaccaacttcgaaagcatcaa

SEQ ID NO: 60149 - DNA, 894 bp, Bovine  19866881404959
tctaggagaaaagctgaaaatttctacccttttcttttttaaagactgttccttgaacataaagtggtaataataatattacacacctacacagtcttttatattcaagaaacctcaaagcatttcaccaattattcttcagatccacagggctcacatttcttgggaaaggaagtcactagtgataaaaacctggtccccaatggtctgccttttcaaagccaagttaaatggagcagagtgggaggggagaggcattgctccagatccccacagtttcttctggccccgcagggccctcctttatcccttcccaaatgtttatgcagcttggggaccaggctagaataatgagtggtcatggtgaggggcaaggacagcaggaaacgagaatcgcttacagaaatatcacggccttaagcagatttttaaaacacatggaaactcttcaaaatgtagagctaaaagagagtgagaactgggtttgttggcagagggtctagctgtgaattctggggtctgttatttactggtttgtgtagccttaagggatgtctgtctctctgtttctctatttttgcctctctttgtctctctgtctctttgtctctctgcatttctgtctgtcttttctgtctgtctgtctctctgccatttccaaaatctctgattcctaattccttcccgcctcatgctgctgaaagtacttggggtagtgcctgaagctcagtaaagcttagagaaactacaagatccaggtcggccaggctcttccaaagagcccttggccaggagtttgtgggaaatgtggatccttctgtgaggaagaggcagttcccttggcatgtggcatctaaactcccattccttagccaggcatccggctggcaggac

SEQ ID NO: 60150 - DNA, 2907 bp, Bovine  19866881411149
ttgagacttatggcagatggcatgaaagaaaaccacagttgcagtataacccaaaagtgatctttctgtttcagaatattttagtaaagcttcccaccatatttgagagacttcatttatgcaaaattcaagcagctcatctaagaaacagctcaaaccttgtgaaaaatgcatccttctggaagaaactgaagatgatgaatgtaaaactgtctagatgtacaaatctagatgtgcagttttctgatacagctgtagaattaatctaataagataacattataaatcactgcaaatgtacacggtgtagtttctaaaacttaaattgacattcttgtctgagttgtgaaaattatgtaatatggcttaagctatgtcaagtaaatgcttctggtggagtagggaatagaatgatgtaaatcaaatctatctgactaatgatttaaataaaggtataagatttaatttgaatctcattgatcccaactctagtcaattttggattagctgtgagtagagatgaataaggcaaacaattcaaataatttaggaactgatgtagtaaatgatgttatgtcagtcaaagaacctgtagcctcttactctctgaaaagagactggatactcactagaagttataaactaacttaagtggtattcaagagatatatcaataggtaatgacaaaacagatttatcatttggatgaccaagtcatagacagtattgtggaaagaagatagcttggttagcttatgaagtaaaaatgaaaagaaaagggaaaaaaaaaaagaccaaagaagtcatagatacatcatctgaacaaaactttctggcagtaccctggctggctgaactcattggcatgggatccaacccaaattcaatctgaatctttacacagccgcttattagccatgctatctatagtaagtcacttaacatctctgagtctctagctttgtcatcaataagaataataacacttcatctgcattgttttaaaaaggactacagataaaatatgcaaagcatattagcaaaacagtaagtacttcataaatggtagctattcttataaaatgataatatgatgattaccccttgctacaaattgcccaattttgagagcccttaagattattttctcttgggaggctgccctttatgtttaactggattgcacttatgtataaatgagtgaaaatagaaaataaagtaatttgaatttctagaaccttgtattctactgctaatgccaacccccacttctggttgatacttagaaaagataggaagcttatgcagaaaacatcacctttattctaatcaagcctggtcaagaatggagaaaccaaacctcactggttatcttttacaaaattaaatgaaaatacttatatatggcaagcttgtaattatataatgtgccaagctgcttcagtcatttccaactctttgagaccagtggactgcagcctgccaggtagctctatccatgggattcaccagggaagaacactggagtgagctgccatttctttctcgagttacaaaacaaggtcatattatttgttagtcctgaaattacagtaactcaaaattgcatctcagtattctgtagcaatttcttcattagtcttacttccccaaatagtttctagattcctcagagtaggcgtatatatttcacttcacctgaagcacgaggtgaactacctattgcacaatgacatattctttcccaactgcccttattccaaggtcaataaccacagagctcagagaggaaaacacctcatggccaaaaccccagttcatctatccagccctcctttcttgtctcctctcacaagaaaagatctatactcagtatttccaaagttctcagaggatacccatctccacatcttacggcgaacctacttgatgaataaccatagaatgattctggcacatacagttgcaggatattgtatcctaaagctaagtactggatccagtttcgggacaccagttctggtccaggtcgagtttctgttgcccaggccaatctctttttgactatatttccactgctctgggatgaaaatcaggcttgcacatcttttcttactctctctgtgacacctgttgccaatctaataaaatgacttgttggacaagacaaaatacaagcattcctcccaagagtaagtgaaaatgttcagggatgatgaaatctaaattgttacataaaaaagaaaccattacttgaccacaaggcagaatatttgcagaatatctgactagattcctattcacatgtacgaaccagaatacttggctttctagtcttaaaatatctattcactgatttcttacttttatcactgatttttaggaggaaagtttatatttcttttgaatttcagggataatctgtaacatttcttaataatctacattaaaacttttgaccttcagtaacaccaagaaaaacttttaaaaaataaaaggattctattttaacgcatgtctttctcaggaatgattgttcaatacttgccttatatttgcataattaaagatcacagttttttaatttttttattaaaaagagaaactgcaaaggtaaattcatgtcacaacctctttaatacagaaaactgccgaaagctttgaaattactgtcttccataaaccttttaggaatttttttaaaagagtcttcatgaaaatatgatactcattacaagcattgaagagaggtaaataaaagaaaaatttccatgctaatctaaataggaggtttgcctccaaaaaaagaagtctgagagagatctgatttaggcatagatttgatttaaggcttccaaggaaagaatatgcatgtgtcacttcagtcatgtctgactcttcattact

SEQ ID NO: 60151 - DNA, 926 bp, Bovine  19866881477950
ataaaagatgtgtgtggttatgttcatatttgtgtaacaagataagtattttacactttaccaatatgaataaaacaagactgtgaagtgacatgaagtgaagtcgttcagtcgtgtctgattctttgcgaccttgtggactgtagcctgccaggctcctccgtccatgggattctccaagcaagaatactggagtaggttgccatttccttctccaataataattaagatatttaaaaataagactagctattataagttgggacaaattaaaagtgatgagtcttttttaaaagaatatatttatcttagtgttttaaaaggataacttttttccttttcaacatctgattgtgcttttaaattaaaaatagtacccatctgtgttttggccttgcaaaatgctaatagactttggtctgaaagcctagaatggatttgctacctcatttgatactggcaagagtaaaggaagaggtgataaaaatatacctgtgtagcagctctggtggatatgattttgaggaagaaacaggaatgtggcccgttgtgctatgcgtgtgtgtgtgcgctcagtcttgtgaagatgtataaaaggaacatttgtgcagtagactgatggctgtaacagagtcagacatctgtgtgcatatgtgtgtgtgcaaaccaacaatgcaccttgtaatattccaaatgcttccaaaaaaaagaatagaaccaatttatatgtccattcttagcttctccatgaatttacttacagcctccaaccacactaatacaataggggaatagtcagaaatgtcaccagaagtaaataagaactctaccaatactttttggagaaggaaatggctaaccccctccagtactcttgccttgaaaatcccatggacagaggagcttggtgcaggctatatccatag

SEQ ID NO: 60152 - DNA, 767 bp, Bovine  19866881480400
ctgactgataaatgagaccaaataattaagttctgttctttatacaatcaagatttagtgtagcaatcaatctgggtaagaatttggagtctggagacttcagaagatgaacaagcaagtagctaaaactggtcatgtgggaagctggttaaatgagtatacattttatacacagctgtggatacctttcatattttaatcttcattagaacctggttgattcatcgctcatgtggtcccatactaagctggacatggcaggcacagaaacaaacaatagaactgtataaaagataagtctgtgtattcaatgaacactatgatatttaaaatctaaaataatgacagactgaaaatatacaagctttttttcaaagtcaatccctcactaacaagaggcacaaaaactgtgatgaaaaagcaataaggatctaaatactaagagtgataaaaggagaaagagaacacactatactttccacatatatatttgtggaactatgagtgtgattgggatgcctactcaggccttccatttttattttcttctgcctaactcttgcttccctccttagaataaatcacacagttttcattaccctaagtaacactctactgcaagggtttcccctgtggaatcagactatggtcagagagaggtgttcatattatttctcctggggtctggaattccagatttcagcagactgatgcacttagcaagtccatcaggcaagtcaaagtaaatataactagcgcagttaagt

SEQ ID NO: 60153 - DNA, 1719 bp, Bovine  19866881686579
acagcctctaggaatttctggtggccacagtgacctgagagcagtctttagccaacttccagcaaaaatccagttccctcagtcaaacagctgtaaggaaattaattctgccaataacctgaataaacttgaagtcagatttgtttcagttgagcccccaaataagaacataacccagcaactccttgattgcagccctgtaatacaggttttggactgaattactagaacttgcagatgaattgtatgtggatggagttataggagggtctgagaaagaagagaatgaagaatgacctagcttgatttggcactgggtacatggtgacatactaaactgaagatcatggggtaataaatgggatgctgagtgtgggaatcaagatttctgtattgactgtaccaagtttgagatgcctgtaatacctgaaagagaaattaaaacttgtaaaataaccacaagacaaattatacattttcttactttttcctgcagccttttatttaaaccaacactagattttattaacaatggagaaaaactctcttaaatttttttgaagaaggttttgtctttctgacagtaccagagataactgtctggagggacatgtggagtagtagagaatatactgtatttggtccttctgcttcaggtttctaaataacacatgaatttatgaaataaaattcagtactaaaaatcaaattcactagctcctccattgaccttttaaactctttagatccctatattcaaatccccaagtcagagagagtttaaaaatctgacacagagatgaagaaaaatgtcttttttctaggttttgttaaaacatagttaggtaaggttaaagtcttcctaattagccatcccacagctgtgtcttctcatttgcaaacaaatgacactcagctaagaggaggaattctcctcttgtgaattctcagaaattatttagaaattacttagaatctaatttttatacccagggatcctagtaagaagtcagtctcattactgcttatcagaaattacttttcttctcaagtccttttttaccctgaaagagcaattttgataagaagtgaagatctgagtcaaagagaggggaaaatcattgcaaggagtgatcaatgaagttcagttagccaggcttatttagagttgctgagaaatcttcttgccagtgtccaaatcttgcaaaataataagtaccctactcaaaatgtgctttgaaagcattggagaaaaatcatatacctgttatgattaaagctacatcatgatagcatatgcttgaggacagaatataagcaggagtaaagacaactgaaaacaggtgatttgttagtgttacatgattttgggctttgtttctctgagtcctgccttttgtgtagataatattgtgagacagggatggggaatattgaaatgtactaaaaaaatcccataatttttatttctccaaagaagacttacagatgaccaacaaacacatgaaaaaacgttcaacattgcttatttttagagaactacaaatcaaaactacaatgaggtaccacttcaaaccagtcagaatggccatcatcaaaaaaatctgcaaacaataaatgctggagagggtgtggagaaaagggaaccctcttgtactgttggtgagaatgtaaattgatgcagccactaggagaacagtggaagatttctttaaaaaa

SEQ ID NO: 60154 - DNA, 939 bp, Bovine  19866881738443
tcttaaggaagataagaaaatattatttggaagtttagccttagcataaaaggttttagcatttatctatatggggctgaaaacgaaaacaaagaggatcagaacccttgtacagactttgtaaatactgcaaagaaacaaaacattcagggagaatggtccgcattgtagttaatctttctaaaggctttgcctctgagaaatatggctggaacctgtgatcatggcccagtcagtaagtatccaacactatgtgtatgatccttagtgagtctaatgatgaataaaatatgaatgctattcttaaagttcccttagtatggttttttagtcactaaatctgttgacaaggcaaagcctccttgccccagcttaaatttgcatcacatttattcatccaatagacataattgaactcctggtattaggacctgagaatattaaaataaatagaagggaaatgttgctctcaaagagcagagttaatggagaggacgatgcatttgtaatatcacagtagtggtcatgtctagctcttcgtggttaattaggagggagccagagagataaagaaaaatatatgtaacactgtttgactatcctgacaggactaaattatgttttcagtgacaaaggcagagtcactaatagatttgttccaggttgagaatgaacattgagcctccctggtactatcaggtcaccatttttgagtatgtttggcgatagccaataacataattcacaaatgtgttctcaccatgggaatgaaaatggaaggcttgtgaaacagggttcaggacattggagaggggtgcaagcacagactataaagggaaaaaggataaatggcaagaacatgaaacctaagaagaaaatatttggcgtgtggaaagaaaataacttgggcaaaggacatgtgacagggaaagtctgaga

SEQ ID NO: 60155 - DNA, 1618 bp, Bovine  19866881987605
aagatttctctcctacatacttattagacctcaataagtgttcctttgcaatctgttgctattcaattaccaagtaataactgtcttaatgaatctaattgaaatgcttatttcagactcctataacacacaaagaaggaggcttcatggagtgcttgccctggatggggcctgacttgtttattcagaaagaagtgacttccttgggaagaggttcacaggcaaaagctttagtagagtttcaaggacattcacttctccatcgttcactatcataaaacttaaagccctcctttaaaccttgctactcaagcccatgcctacatgaacattcacaaaattttcagcttgcattttcacttctgaagtgttggtttagcttttttcaatgaaatcagaataataataaaaatgtaaatgctgctgctgctactgctgctaagtcacttcagtcatgtctgactctgtacgaccccatagacggcagtccaccaggcaccgccgtccctgggattctccaggcaagaacactggagtgggttgccatttccttctccaatgcatgaaagtgaaaagtgaaagtgaagtcgctcagtcgtgtccgactcttagtgaccccatggaccacagcccaccaggctcctctgtccatgggattttccaggcaagagtactggagtggggtgccagtgccttctccgaaaaatgtaaataccaatagctaataccctatgtatagggtactcctagtgccagggctgcctaaacacttaacatataggaactcatttaatctccacaaactccctaagaggtacatacattgttattgtgcccatttaacaaatgaggaaatccaggatggtttattttttgcagaagggcaaatttgcacagcttgttgttcagtcgctaagttatgccctaccctttgcaaccccatggactgcagcatgccaggctttcctgcccttcactatctcctggagtttgctcagattcatgtccattgggtcagcgatgctatctaaccatctcatcctctgttgtccccttttcctcttgccttcagtctttcccagcataggctaataaatgccagtgatcgtgaaacaaccccaggtcaactggctccactgcacaaactcacaaaagcaaaacttgaaataaatgttagagcttagttgatgtaacctcttgttactcaggaaattgagggttcaggctcatgaggcaaagagtctatacctgacctccatcccttgcactccaacctaaactatgttgcgttgtttaaaaacaacaaagtagttgcaaaacaaaaataacaacaaaaccccttgggttaaatattctccctccatcttgctgtaatttttgtttggatcagcaactgggctttaaaacatttatctcagggtgatgatagaatttgtttgaaagaatgtaagagcacagcccaaaacatagcatggtgtttattttccttaaagaagaaacttatatttattgatccaaagaggaatgggaggttgattcagggaattgcacatcactgataattcacaattcctatgcaagtctgtgaggcttccccattgaaaccacccttgtagaa

SEQ ID NO: 60156 - DNA, 530 bp, Bovine  19866880646293
ccccctgaccccacctgtcacccagactgccgcgaggagcagtacccgtgcacccgcctctactccatacacaagccctgcaagcagtgtctcaacgaggtctgcttctacaggtgaggggtggggctccagccagccccgaggggcggggacagacccccaggccgggggtgggtgtggggtcctccccccggggctgagccctcccggcctgtcccctcagcctccgccgcgtctacgtcgtcaataaggagatctgcgtccggacggtctgcgcccacgaggagctcctgcggggtaggaagcccccaccccgcccctcccgctgcttatcaaacgtgggtcggacgtgggtcccgtctcatcctcagacggcccctcaccagggctggggcgcgcggcagttccctcacctggactgcgcgctgaccccagctcttccccgccctccccacagctgacctgtgccgtgacaagttctccaagtgcggcgtgcggccagcagggcctgtgccagtctgggcggccgc

SEQ ID NO: 60157 - DNA, 1438 bp, Bovine  19866880654080
ccccccatctctatcaggtagcttccagcattaaagatgaagaagcggaggcacagagacgctcccctgactcatccgaggccttatagctggtggctgagcccgtaagcagaccaggaagccagactgcagagcccagccattgactcctttcttccgtgtctgatgctggtccactgcgtttcctagcttgttagtggcaaacagatgggggctgctgctgagcggtctccaaccccttggacgcatctgtacagagataacagctcctgtgccctatggggggctttgaggggttaatatagaaagaagctttcagaaagttgagactcatgcctgccaacctaaaacgttcctatcggtgggaattaaaaaaggatagtggtcttatcttgtccgtcccagacactagtcaccatcaggaacgctgcctttggacatggagggtggtcatgtaactaagtatcaaccagtctgagggatacactcttggcatcaggtggattagagatgccaacctgaaaagtgacaacaactaatttacgaaaaacacttaagaaactgtcatggcgtctcactgaatccacctgatcagctccctttgtttccacggttaatttaagagcaaagctcctcccagtctgtctgtctcaattacgtgtctgaattaagcagacggtttctcgctccgggactcatggtgaagccgtcctgcattgcgtcgtcagctctgctcttcttcctgcccctaaactgcaggatgtacgctcttctctagcttcgtttccaaagcgcaaggtccccgagtgcagatggcactttggttttgaaccacttaactctcctcggggctggtgccatctgaagtgtcccacaccatgtcccgaagaaccacaggccactgtcgagggtcataaggggcggtgggcggcttgaggtgggggtgacgaccgcgaggcccacagaggccagggccgcctcccaccaggatgaccccacggcctcagagcgggctggacgaccggaagtggagctggctgtccgggacaaagcgcttaccagccccatcctcccaaaggccccctgggggcctggctcgctgccagggccccgtgggcactcacctttgaacatgatggcctccccgtggccctccttctgcttctctctgaagagcttgtagcaggctgaggtgctggccatgagcatccggaatttctgcgagagaccgtccggccggccggtcagcagagggcaggtggccgagctggtggggggctcccgccctgaagacccggggccctgcctgcacattgtctcagccacccacaccgagtggcgaaggctgcctggcaggatttctctatttcagaggagtattttcacccttcctgccacagaaattttcctgcctcagcaacgccgtcgagtcgaagct

SEQ ID NO: 60158 - DNA, 1813 bp, Bovine  19866880720430
agttgtgacagtccaagtgtcccagacattgccagatgtcccttggcagaagggaggtccaaatcacctgtgatggagaaccactgctctaggctgaaagcatccgggtgaatcccagatccccaggtaccaaactagagagggcagaggagttaacaagaagctacaaacttggtccaccgatttggattcagttcagccttgatcgcacagtcacctccgaaccataggatttagtagaaactggtcaatacttgactcatcaacagagattagcacactcgaaaacaataccagttgtaaatgctcgaagaagatgtgtgttgcactacaccctggagagccgtagttgataagggggtgtattttacaagagctgtttttgttgttttttttagttctacctgtttattgctaccaattcatttgtctctaaccccctccgtcatgccagcgcatggactgtagcccgctaggctcttctgtccatggaattttccaggcaagaatactggagtgggttgccatttcctcctccaaggaagagctgtttttaaaatcagtcactcttttggcctgtgattagattaaatcagcctgcttcaggtccttctgagagtgcagaaacccgcctgcttcactgggttcacctgtcccttgagtcctgcctttggtactggaatgatgcagaacgtgtgatctccctaaaccagggcccttagggtacaggcagtggatgtgaatgggcgagacacggaatggtgaccagctccagcccgtcattctcacgtggaagtggaagcccaacattgctagagcttttgattttaagagaagccagaaatctggattattttacatgtaatttgattttgaagtgttggcagttaaattgaaagtgctaaactaggaactgagtctggcctgtaggccacctctgacctagacgtctcatcggttgtattcctgttgtgtccctttagccagaatgcatttgacttgaatccagagtcaggtttgccgctctgcctcgaagggcaagggccctagtcatgggatagaaataggctgtgagggcctcaaggctcatcctcacttccgctttcaggggagctctttgctcaggccccagtggatcagtttcccggcacagctgtggagagcgtgacggattccagcaggtacttcgttatccgcatcgaagatggaaacggtaagctcgggactcggggcttcctcttccgagaagggtttcctctgcctttggaaagtaggattgattgtgtgttgtcccccagggcgacgggcgtttattggaattggcttcggggaccgaggtgacgcctttgacttcaatgttgccttgcaggaccatttcaagtgagtggttccaggagacacactcatgcttcctccctctttcgtgggacagaatgatctcccaggttaggatacccaggtggttgtgtgtgatctgtctgctggcagtctcaggggaactcacttctcctttaagataggtcccctctgcgctcttcgagtcctcatctctgccttgaggtctccttttcctgaggcccatctctgacccccagtcagctgccccagccttggaggtgtcatgtctctgcccccgtcagtcccttgagtggccggggtcctttcccggctcccttggcctttgcagacccgttcctctatgctgtgataagcagtgctgggatttccaggccactcagcacatgccctgctggtcctttctgaagctagaacggcaggaaaacctctcccctgccatactgaggcctccatc

SEQ ID NO: 60159 - DNA, 1338 bp, Bovine  19866880751762
tgagagcaacagctggagtccgaaggcgctcctcctgggagagctgagctcacaggctcaccgtgaccatcgtccccatcacgtctgcagggcaaggcttgccccatgggtcaggccggggcccaggtccgccctggagtccagctagcaccaggcctgtcctggtggtgagaggggatggggctcccaaggagaggccgggcagtccagagaggcccagccgctctgtggagccgaacaagaaggggagggaattcctgggctgctaggacacctggcttttccctgggccctctggggtccctgccctctccctggctctgagcccaggctggacctgggtgggccctttttccttgttcttttccaggtgtccacgctgaaggggcagctgcagcaggagcttcgaaggcactcagcctccttctcctcgccctccgggcccccagagaagtgagcacctctccgctggcatcctagcgacgggaccctgatgggagggccagatgggaggggcgccctcagcgcagtccagggggcctgggccggagctcgtgggggtgaggggcgaggggcggggtgccagggccaggacggggctccagcctgtcagagccaccccctcgggggccccctgagggctgggctggagggacccgtccctggctgagcctgggcgcaggcgtgctggccgtgagggttgggcctggggcaggcactgtggctgctcagaggtctgtccatcttagttcagtgtttgtcagtaggttcctcagagttcagagttgctgtatttttatacctttttacgatgttaactgttcagaattgttgtttttgtaacaaccccattttttaaagaacgctttgtacagatgtgtcctcttgctgttaacgtgcctcctgggagatggggagactggagggccctggggccagagggttggggtcccctagtgaggggtgcacagggacgtgggggagactttagaaaggcccctgcagaaaggtaaggaacaacctcacgggacggcgggctggggaggcctccagggtcctgggccatccacccatttaacagacggagccatcgaggcttggggctgggcccagctctgctcttgccaactgaagctttctgccctttcctctggctcctcctcaggacaggtgcaccccccgagcaccagcaggccttccaggcggcacggtgaaggaggacaggcctgggggcggacctggcatcccgccgggccccgctgggtgatcctgggcacagctgcttcagctgtcagcctcagtgtgctcattgtaaggtggaaactgcctcccaggccg

SEQ ID NO: 60160 - DNA, 745 bp, Bovine  19866880914399
agtcggacacgactgaagtgtctaagcatagcatagcaaggaagtactaatttgggagcccagagagaaagggcctacaggttggtcccaagtaggaagccctggagcttgcctggaagataagccacacgttgacttctgctgttagcttggtttcttaatcaggaattctgcttatcaactaaatggtaacttcccagactgaccacacccactaactgaaagaactggaaattgtccttctcagctctttctgtggcgagaggacaagccaagctgggctgtgttggactcagctgatagttgtcccccttggcaaaatctctggcaatcctgcgccaccagcgcctctgggtgggctgtggagggcaacatggcctggagcagtcccagcctaccccctggagttggagtcagatgcagggcttctcagtcagatgccccagcattctgtaatgtcttctttttctaccatagaggttttcctttgtggggcaaataaaatgcaaagattcgtgagcaaaactggctgcctcttctcagatctgcatcactgtgtctgagctatggggccttagacaagccacatgacctttgataccttggactcctttttgggtgaaatggggagcacattatttcctgcttcccaggattgttggaatacgaaatgagcacatagatatccgaatgctttgtgaactgcaaggtgacccaaagcgccagtttgtttcaagcatgactg

SEQ ID NO: 60161 - DNA, 957 bp, Bovine  19866880962817
ttcctgcctgcgggtggggagcaccctgactgagtgggtggagaagcgttggtcaccagtccagacccccaggctcctttggttagaggctgccttcagaatagtggctcatctccttggacttttctggctagaacaggtgaggtgagttgagccaaagtatcaatatcgctgagtggatcttgaggccttatccccctatggaggagactccaacagtagacacgatgcctgctatggactgaagggttgtgtccgcccagaattcataggttgttatcctaaccacccaaggcgatggtaataggagatgaggcctttgggaggtgattaagttcagatgaggtccccatgatgggattagtgcccttaaaagaagaaataccaaaaacttcctctctctaccacgtgaggacacagcaagaaggcggcagtctgcaagccgggtctgtcaccttgatctgacacttccatgatccagaaccatgagaagtaagcatctgctgtttaagccacccggtctggtattttgttaaagcagcccgagcagactctactgttactgttgttggatcacatccactaagtggctaagaaggactcagtggccacattgcacctacatgtccggtgttgccatgagtggcctttcgttctttgaaggacaattaacatttatttagaccttgtatactaaagcaaaataatgtttattttttggaaacttcttcagcgaacatgctattttctgtgtggtgagggtagagatttcccccaccccattcccaaccccgtagaacagaaaaccaagcaatcacaaaacagaccatgtcaccgttgcttgggacactctggtccagacttgacgatgcctgtgacatctctccagaccttctttgatgacagcctctcaacttttcttcgtgactttctggccaattcacttatttggcacga

SEQ ID NO: 60162 - DNA, 3112 bp, Bovine  19866880967662
ctggggtccccaaggaggcaaaaggggtctgtggttctccaggaggagataggggtctggaattctcaaggaggaggaaaggataaactttttttttctctacattccttagtcttagccacataaaaccttttttttctttaagtctggaactgatgattacacaactcagtttaaactctgtactagggattatataacaacaatgcttgaggacagtttctccttcctgaaagccttggagctaatcctgttatcttagaatgtatattatgggagtgggtctggtaggatctttctgttgttaagttctaatcctgttatcctaaaatgtaaattgtgggagtgggtctgtaaaattgtcacaaacttgaaacattcttttgatttattttaatacctaatttaaaagcatacagctcccttgctgacactggttaggggggcactctccatccccttctgatgtctgtcagaagcttcctctgtccattttcttactttaataaaactctgctacacaaaagctcttgagtgatcaaacctggtccctggtcccgaagttgaatcttctttggaggtcacggatccgacactgtccaccgtaagctaccctcttgggggctcgtccgggatcttcaggacaaggtaagaacacacagagctctagcctccctgctttctcagtacacacatggtctgctttactttttagctcttcggtgtccttgtgtgagtgagtgacatgccctgtgtgaagcaggtgatgagccctgctatgcagttttgtggtgcctcataatgactgaaggcagcccccaaaaggggagccttgttgggggttcatgccaacccgccaaggccaagagacacccaaggtccctgctaggggagcagcagagatgggaaaagcgcgtggactgaactttctcggtcagcttttcctgatctctttgaccattctgtaattgtgtggggaattagagctactaacctaatctgtcggatcacagactttcacgggaattgtgatccaggctgttattatgcacttttacttagaccccgtgtatggaagcgcctggccttgctaggagcccaaagttgcaggagcgcgtatggagtgaggaggagctctggctccaggaacgtctctcaggctagatgtcaccctcctggctgcctgccccaggggtcagcgacctgaaagggaggctttgtcacagccgtgcctcctgtctatgtggagagaagcactgctggagcccgtgaggccttctgaggacataggttgggaactgcagggtctggtcaggctggaagtgcaacaggcttcctcctttggtagcgctagctcttagcgggccagaggaggctctctgatggcttttgtctcaactccttagatattcctttcgtggaatctgtcgaaatgaactggaaggaatggccctaatagtttgagaacaaaaatcacttttccttcgctggccagccctccaccacctctttgctctcacatacaccggcgtggcgacagtcaagagggacatcctggttgttgttcgtccctttacaactcacacacttcccctaggagtcctagcttgggaaacattctgggaaagctactctcctccacctcgggaggcatcagaagaagagggcaaatcaaaccaaggtcctggtgttatggaactaagtcagtctgggatgccatcaggtctaccccgggggcatctccacacaaccttggtgggcagacagaatgaaaaccacaatcacagaaaactaagcaatctcatcgcatggaccacagccttgtctaactcactgaaactatgagccatgccatgtagggacaccctctgatggagaaggataagcttaaggaagcttcctgatgggagagactgactgagggggaaactgcgtcttgttctgatgggtgaggccatgctcagtaaatctaatccaattttctgtgttccctccctgttatttacctggggccaaactatggtggagataatgaagacaatggcgacctccttcaaaacgccccatgcagacactgctgcactcagggcccccgaccctgcagcagccaccgccacccacgcctccaccagcgactcctggatgctcacgggcaagtctgggtcagtctcttgtggggtccctgctgctttctcctgggtcctggtttgcacaaggttctgtgtgtgccctccaagagtctgtgtccccagtcctgtgtaagttctggcagctctatgatggggttactggcgacctcctccaagagggcttgtgccacacccaggtctgctgcacccagagcccctgtccctgcagcagtccactgctgacctgtacctcctcaggagacactcacacacagttctgtctccgtctctgtggggtctctgggtcctggtgcgcacaaggtcagggctgaacaggaacccagttggctggggagtgagccacaggtgaaaatcacattgctcacatcatccaggcttgagacaaggctgcagagctgggctttctgcatgaatatgtcttttatctggttgtccagctggaggagagataccacatgccgtcatttggtatcaccacactgtattatcagtaacactgccatcagccccttggagctgaggccccttggacgaggatcctggataagtcctcctgggcaggcagagtttatccctggctgctcttttgcttggggaggagggattccacttccacaggcttctggctatgccagggtgtggatcagatcccatctggaatgaagaggctgatataatgacgaccccaatgccccttacctgggaacagaagacatattaaaatgcagaatcaggttgtatcccagagaatggtgacaggaaggaggctagaggtgagggagttaggttttccctttccacagtgctggtggggattctcttcctgatgtgagaagaggggacttggccaagggcactccctttgtcgagaggccagtcctggcaacatcgcagcagccatgatccaggcaagagaaccttctgtaggggcgagatgctgcacatgagggccaaggagggct

SEQ ID NO: 60163 - DNA, 1002 bp, Bovine  19866881015209
cagcaggagcgtgacgagggcctgctcctggccgagactgagaagcagcaggtgcgtgggctccggcggccgcctgaggggccaggccctgctcgccacccagacttgcagccaggagtcctttccgggccttagtttcctcacctcacagtgggaactcaaggggcatttgtgaggcgtcaccaagatccccatgtccagcgggtgggcctggcacacggcgggagcgtaatgcataaccaccacaatcctgacaccatgagtgttgttcccgaaaagctaaccccctccgctcacccttcctccaccccgggcccggtgtggcgtccccgtgactgcctacgagctgtccccacggagcccacgtgcagcagctgaccctcctcagaaagaactaactcctgaccttctgtaacgaaatggagacagggcaggcttcgcccatctctccttacccgccacgtaacccggggcaggtcactttacctctttgagcctcagtagcctcatctgtaaaatgggagtaatgaaaggcccttcaggatgtgcgatgctcttaggttgtgtctgtgtccaggttgtaactgctgttgtaacaacagtgcaccagcgctttcctggggctgcgccttgaccctggctccacctgcggtggccggtcagggccccaagcccccgggggcaccgttcccagggcagggtggggaaaggcccaagcatcccccaggacctcccagggccctgagccctttgctcccgcctctccccaggccctgtccctaaaggagtccgagaagacggcgttgtccgagaagctgatggggacgcggcacagcctggccgccgtctccctggagatggagcgacagaagcgggacgcccagaaccgccaggagcaggacagggtagggcgggcggggtcggggtggtgggggggtgtggcctgggcgggcgggcataggccagggcgtggcggaggtgtggcccctgggtgggcgtggc

SEQ ID NO: 60164 - DNA, 891 bp, Bovine  19866881056944
acatgggacctcccaaggcctcacagctttccgcaagacgtcacctttagtgactgactgcaatagtatgcttgggggactgtcagcactaatgaagatggccgcgacgagggtgtgccccactgtgggccaaatctagaaaccatcctgggggctggaggccaccaggcactgtcggcattccccttcttgaggtgctcagtaaatgcggagcgagagaaaaccccgagttcagagactgcgggcagtgaaagccatcataaaagcagctgatggcggctccacagagagttcagggctctctaagggtcctgatgacgataaacagcaggcatcaggccaaggccacgcttccctcacctcatcctgatgcagcctcaggaagcagggctcctcatctctgtcagatgaggagcccgcagcccacaaagaggaggggctgggagctgggtcaggcagagccaaggatcccaacttcagggagagcccaagactccacggggtacggtctgggtggagaccggtgttccccgccccttgccccaggcctgcctaccggtcagggcctccttggccagcagcaaggcccgcccgtctgcctctagctgttcccgccgggactcaagctgcgccagctgcctctgcacctcaaacaggctgctctccagggcttccttctccgatctgcagcacaggccgtatctgaggcatgggacccagcccctcaggccccagcggattccggggtgtggccaggcagggccaggtgccaccctacctgcccagccaggtccaatgcgtgggtggggctagtcaccgggcaaccctggccaatccccccgaggggggccaggcagagcccaaggccttaccgcaggcgtgcagcctcct

SEQ ID NO: 60165 - DNA, 1406 bp, Bovine  19866881103493
acctgtgagagcagcaatacagtgcgagctgtggggaggggcgcgccaggcgggcagaagcagagggaagctgctgtctctcacttgtggtcattgggaaacctgtggctccagcgctggcagggtaagccacccacggtgatggccacagtgccccggtactcgaccccgttgtccacgatgcaggtgcgaacatagtctgggagcaaaagacccagaatcaacaaggctggagacctcaagcagccctctccccagagcacccttcgcagccactcacttttcttttggaagaggtcacagcgcccggaacgctgcagtcgtgtatgaggtgagtgctgggtccatggcagcaactggcaaccatggctgctcaagttgtagtggaaggccctgggaagaagaggcacagggtcaccagtgcccaggttcctctccctccagtcttatctaggtccagtggccactcacctgcagtccaggaggggcccacagaggcctgcacattcctcagcatttgccacatcttcttgccaaggcccgggccccactgagtgtagcaggtgttgcagctccgtaccccgaagcacctggaagtcattcaagggcgagcgctgccctgcagggtgggcatgcgaatcagcacatgcatatcagcatgtgcacactttattcattcaggagatcaaaatacaaggcctctggagtgggtcagtgacccttcaagggtcagacccctgcactggatgggaggagcaggctcagacgtgactgtaatcactagtgcacctgtttagtgggcaaggcactgggctcagctgtaaaacatatactctgagcgcagtgcctgctggtgctggccctatggagcttatgctagctcatttctcacgtgaggatgtgaaggcccagagctatcttattaacaaggcaaaggcccaacccaagcattctgactccaagtctaagttctaaccaacataagggtaaatgctgaaagtgttggtcgctcagtcctgtccaactctttgcgaccccatggactgtagcctgccaagctcctctgtccatgggattctcatggcaagaatactggagtgggttgccatttccttctccaggggatcttcccaacctaggtctcctgcatcgcagacagattctttactgtctgagccacctaaccagcataagggtatatgctaggtaggaggattaggtctggttcataagggataaatgcctgcatgtgtgtatgtgtctatggtcctaacactgcctcaaagctacagcagacatttcaccgcaggcctgaataggcaatgtgtttgtgttcctttggctgcccagctctgtgaaagaagccaaggtcactcactgctacaggctcagtaggaaagcaagtt

SEQ ID NO: 60166 - DNA, 1474 bp, Bovine  19866881330733
tcaaaagcatcaattcttctgtgctcagctttttttatagtccagctctcacatcaaatacatgactactggaaaaaatatagctttgactagacagaccctttgttggcaaagtaatgtctctgttttttaatatgctttctaggtttgtcatagcttttcttccaaggagcaagcaccttttaatttcatggctgaggtcactacctgcagtgattttagagcccaggaaaataaagctcactgtttccgttgtttctccatctatttgcaatgaagtgatgggaccggatgccattatctttgttttctgaacgttgagttttaagccaactttttcactctcctctttcactttcatcaagaggctctttagttcttcgctttctgccataagggtggtgtcatacgcatatctgaggttattgatatttctcctggcaatcctgattccagcttgtgcttcatccagcccggaatttcgcatgaggtactctgtatataagttaaataagcagggtgacaatatacatacagctttgactatttctctcccgatttgcagtcagtccattgttccatgtccagttctgttacttcttgacctgcatacagatttctcaggaggcaggtcaggtggtctgggattcccatctctttaagaacttcccacagtttgttgggtggctcctggttccttccgccacaggtcgtgaggcgagacctccagtaaagggcgcgcggcgagcagcggctgacgcccgcgatctgccgctctagcctgacgtgagtcatagagtcgcgacttccgtcgggccgggaaggagccggaagttcggcgggctcggggcgtcgagatggaggaagcggagtacgagtcggttctctgtgtgaagccagatgtccacgtctaccgcatcccgccgcgggccaccaaccgtggttacaggtgaccacctgccgccaggctaggctagtcacgacctaacccctccccggccatccccacacgcccactgtgggagaggacggcccggccagttgacgggcgaggggcgggcacaggtaatgctgccggttctctcaggtcgaggccggagcagcgagggtacccagactttctcttgtctcagtccgacgaatggggtcccggcggcggggacggttgaaagcgatatatagcatttagaccctaaacatggtcgggagtggtggtgtcacagacctttttttcagcgctagctgaaggccttgaagggatccttggaaagacttgaggggaggagccctgtcactggaaaaaatccccccaagggaaaggaagggagcccagaaccggtccaaaggacccgtcctgggaagttttaagctgatgttgaaagcccaggggcccttccttgcccagttttcttgcgcacgaacctcggccttgatcacagcctctggctgttgagaggcatccatccgcacttgt

SEQ ID NO: 60167 - DNA, 1324 bp, Bovine  19866881451030
ttcagtaggaaccaacacggtgctgtaaagcagtccttcaattaaataatttttttaaagtttttaaaaataattcaagtaacagttactttaaaaagaaacacacagaaaaggctgtttttcctctcagcagacctggagcgaggagctaggacctgggggccctcgagcgccagcagtgcccctgggcgggcaccttccagcctcagggctgctcctggtttcacagcagggtttgggtctccagccttcagcgcctccgttctaggaagcaggggagggaaaggtggcgggcgcctccgcacggcactccagcagtgccatcctgggcgggcaccttccagcctcagggctgcccctggtttcacagcaggttttgggtctccagccttcagcgcctccgttctaggaagcaggggagggaaaggcggcgggcgcctccgcatggcttgtgcgtgttggcgccccccgctgccgcgggagcctggcagggagccgacgcggtgggtcagggcgcccctgttccctctccaggcatctgcggctcctgtgccatgaacatcaacggaggcaacactctggcgtgcacccgcaggatcgacaccaacctcagcaaagtttccaaaatctaccctctgccacacatgtatgtgataaaggaccttgttcctgtgagttctgttttttaagtgggttgggaggtgtgtgggttatgctgtagttcttcaaggcaggtttctttcctgtcatgagtttaattaaggaatgtgaatggcagaagataaaaggcctagaagatcctccagccactcctttggtgaggattgtttgggagtaacaggacacagaattttagacctgggagtttcagaaatgaagaatttagccctaacaccaaagaattcatgtggaaaatctccattgggaaagctttaatttgcaccccccgatatctgaccgcctttcctgtccctcactgggtgctttcaagggcatcgggagaaagtactgcagggtgggaaggtttctcacgtggctagaggagaggtttcctgagcacgcctacacgcgaccacttctcctttcacggatttgcacgtgtctgccagaggaagaggctgactgctgcctgtcacggggtgggagcgcaggcagtgtccaagaaacggggtacataagggcaccgagcgtggcggtggaatctgacccgtttcttcctcttcctgttaacaggatttgagcaacttctatggctcagtacaagtccatcgagccttacttaaagaagaaggatgagtcccagggaggcaaggagcagtatctg

SEQ ID NO: 60168 - DNA, 753 bp, Bovine  19866881687039
actttgtaaacttagcctttagagaggagataatcagaatcctgtgacacagtcacactgttacacagttgacatgaattgctttgcattaaagtttttgaatttatttttgagttagatcagatttgacatctggtattaaaagctactgtcatatatgtggtccttcagttaatttaaaaagttggtatgtcagttatatgaaatgcatattctcaaaggacaaagggttttagggagtacaaagctaccttgaaatatgatgtctgctttttgatcagtttttccatttttagtaattcagatcacttcctcactcttacagtgctgtgcacattaacagtgagtgggcgggtagttgaccagctgcgtagtctccgcttttctccaccccaagattatgtattggtctttagtcctctattgtcttggtccattaggatcatttctgtgtcataaaataaagctaaccttcaattcacctcctcctggctcagcatatggtgcccgtatgtcagtttaattgagttggttaaattccttgaaaggtaaaagataccttgacagcctttaaaaatgatacagtcaaagatttcactcttttatgtctgatggggaggctgtatggcattatgtcagccattttaggttaagttttctgctgatattcagaggggtatcaaaaataagactcctataatgccttcagttttacattttggcctgtgtactattttattatcatctggtttt

SEQ ID NO: 60169 - DNA, 967 bp, Bovine  19866881104780
aaatgtcagagaagcaaggctcttgaatccaatgtgcaatggctcaactaggcaacccctcgtggtcacaaagcacagcagtactcaagagggaagacagcatgggcttcctgccccataatcagaagtggagacatgatttcctaccccagactgtgctggacccagagggagaacagtactacctgcagagccaggatccagacccaggctatcaggggatgccaggcgactgtgagccaaggggagaatccctccccttgtcgaatctctgccttctgtcattccctgacagtgatgagggacagcacgcccactgccactttgtcaaggaacatttctcagggtgggtttttcaagaggtgttgggtagagctttccatcagagccttcctcattgtgacgctggtggctgcaagaagggatgacaagatgaagactcagcaacaggaaagcaacttaaatttgacatgttcaactccactttgattcctactctacttctgtgaggtccttttcaaattccaagtggggtcattaaatgctcacttagacttattagaagttgaagtggaaaaaaaccagtaactccattactcttttttgtagctgccacatcaaagggctgggggattcatagttgccattttccaggagctagttatcacaaaagaaaaggattttatttaaggtgaaaaaataaaagccagaaaattgaccaatttatgtttcttggaagcagcaaatgccgggaactggatgcagataatattatctgaactaaaagtgtagcagatagcctgtttcccagtccatttctcatattctactgataaagaactgttagttagagagaacctcaaccttgcatttctgaaaagggagagtcagtagtcagatggagaaactcagatgagaagtatcagtaactttccatgaagcaatgagagaaaaacagttatactat

SEQ ID NO: 60170 - DNA, 1312 bp, Bovine  19866880543292
tttgtccctcgcttatcctcatgtccctggcacctgacgcagcacacctggagcctctatgagtgaagcagagtggccaatgggagaggctggttcagggagatgcccccacctcattcatactccagagcagctcagcggctgtctcctgggctacataacgctgctcagctggcaccgaaacagagaaaattcatccctgctctctgcattctaaaatcctatgtcgggagatgaaactcaaaatgcaggccattcagtcctttacagggaagtttccatggtgacggcagtccttgctgagtcggggcagcctgcctccctggagcaggcctgagtcccacctgtgatagcaagggccccctgtctctctccactagggcaggtgttcacacgtttccaagtctcttgtctcctactccacacactgaacagcagttaagaccgtgaacttccctccagagtcgagagcttgggacagggtggcactaacattgagagacgggcctgcctccacacacactagactcccgggctcttgttgcagcgccgccttcaacaccatgtgacctgactggagccaggggtcgttcagccttttcttctgtgatgtgtcaacataattttcacatgtttcgcacctctagcccacccctctgggacacgagtgagctctgtggagaactggccctttggggtctaaatagtctcatctgaaccttaaaagtgtcagacgcaatgttagcaaattgtaattacactgtatttccatgtctgccagcttcctttctacctcccttcctccccacgctgctccctcctctttactgtccctgcttccccacgcccaaccttcctgcccatctccctttcctatcctactggctccaggtggcccagaccttctagttctgcccactgacctcccagcctctcaggagtgagatcctgggagtctcttcgtctttctcctgggtgtttggaccccagtccatcttcaaatgaagaagaggctaagggaggacagtaaacagaccaggctggtacctggccagggtgcccaccaaattataaagaaatctctcaaggtgcctgcccctcaaccccaactcaattacgcctctttctcttgcctttccccaccatctcctgtcacagcgtgccctgcctgcaggctctcttgctggtcattaattccgcaggggccagctcagcacccctctctcaaggatgtttgtcctgtgagtctggttgctttcagttcctaccttacatggtctaagaagattaaatgcaatgttgcttattgggt

SEQ ID NO: 60171 - DNA, 1716 bp, Bovine  19866880543437
tctctttttctcctcttcctatgctgcctcatattcctgtgtttctccgaagtttctcaaggtgagtctgttggggtgtgcacagttctcatgcctgggcttcctggaccctccccttcactgcccttaccctaccccacgctgctcccctacccgtcccccgcctaccccccacttcctgcacacaaacaccccgtttccagttggccaacaagcttctatttttagttttttattttggaaaatgtttaaacatagacacaaatagaaggcctagtatagcgagtctctaaacgcctagaccagcttcagccatcctccactcatggccgctctgttttcttctattactgcctgcatctgcctccacccccaacaccttaacttgataagtaacctggtaaataaagggagaaaaaaaaacaaacgcaagtccactgatgctcctctgtgggctgacttaccagctaataggggtaactactcggcaaacccagatgacaatttcacccttaaatatcccagtagatgtcttaaaaaataaaggaaccgcagtaccttttcatgctcaaataaactagcatcagttccttaatatcaacagtgatcaagtttttctcatgtcctcatagtcaccaccaaggctttaaaggctcgaagccagcggtcaccttggcctgtgtcacaggttcacaggtgtccaactgatggagcacgccggcctggctcctcccttctgtatgctggcttccttttctcttccttcctcctctccatccacacgtaccagatgcccatcacttggggaagtcttcctggcaccttctcccaaggcgccgcgttaagaaatggcagcaggccagtctgccggggccacgtttgtgcagtggcttcaggggtgtggattcaggagcacattgataacctttcaacccccagcaggtctgtaacagaaattctcctctcatgtctccccgactaaaccccaaaatccactctcttcattcataccctgtttcccattaagaagacagcgcccttgggaaaagctgggccacggctatagcagtcattcacacgtctgtgtgaataagttctagcatattcaagtccggaggcactgcctggagaaatggtgagggaagtgggtgtctgaccatctctcttctgcttctccctcacaggctacaaggagcagggcatcccacagcagctgtgagcccgggcgagccgctgagaagcccggtgcccaggagggccacgtcaggcagcggccggcccggggtcttcacgtgttctcttctgccgcttcctgggtttggagtggaaagaagggcatttgagaatactatttattttgaaaacgcacctgcttttctcagcaggctctgagagctgccagctcctcctgctgctccagagagtcctgtagcacagacacccagagggtatctgggttgggtggggagtggggttggaggcggggatgctgatgcaagaagctggagtgccccaggctcgggccacctcgccttgtctgctgcccaccgtgagggtgtgcggggcggccaggccaggcagcagtgaccccgtccaggcgagcagggctcgtcaaggggcaggactgcagtggacacctcctctgggcccctgtgggagtggtgtcctggggccaacatccaggcatgagtaaggatagacagattcctgcctggt

SEQ ID NO: 60172 - DNA, 1479 bp, Bovine  19866880556312
ggggacagctgcactctgatagctgacaagtcttgctcatacttgggggttcactggtgtgtctttctggcaacccatttcctgtgcctccagcagtctgcacgtgaacagatgcatgaccgcctcactgagacaggcctctacccagaacagccctggtcgggagagggaggctgggtgactcagagctctgcctcagctctgttgggcagggccgccgcagtcgggttccgagcctctgcaagcccgccttcctatttgctgagcgccactcagccacaggcaaatcagcgtcatctgttagaaacatgaattgcagccatgtgtcttgcttggaaatattttctaaatatagctaaatatttgatactgcacatgatttgttctcatgtggtattcacgctcttcctgaaaagtttgcttgttagaaatgcctttggtgggagttcccccaaaatctgactttggcatcagtccagaatatccccttttgaccaacacccttacaggtgcttcctggggtctcagaaactacttaaacagtagtttttaatttgtgaatgttcttccctagagaagaaaacttttatcaagctgaggagtgaggagttcttgtctcttctagtaatactatgtacacagtaggatcctcaggttcttaagtttataaccagaagatttcagtctcagagcatctttgagagaatacagggaatctctgagctgctaacacaggagaagcttgtttccataagcagtgctgttctgcttgtgagcactggaggaagagaagaggacattctccattcttccacattttgcagaaaacttcctctccgattcctggccttttaaatgtcatcttctagaaaggagaaggggcttcccaggtggcgctcatggtaaagaacccacctgccaatgcagaagacagacgtcagagactcgggtgcgatccctggattgggaagatcccctggaggagggcatggcaatccacttcagtgtttttgcctggagaaatcccatggacagaggagcctgataggctacaggccacagggtcacacagagtcagacgtgactgaagcgacgtagcacgcggaaaggagaagggggcaacagaggatgagatggttagatggcatcattgactcaatggacatgaatctgagcaaactctgggagatagtgaaggacaggggagcctggcgtactttagtccatgggttgcaaagagtcaaacacgactcagcaagtgaacgacagcaaagcatggggagaagaagtctgtttccagtgggccacctgtcagagctgcctggagcctgttgcctggcaataggcagagtgacttctttcacatcttgggtccctgggggaagactggggtggtgagaggggagggtcaccagtaaatagaggaactgctggtagttgctgggcaaggctgcctctcatacccatcctagaagggcc

SEQ ID NO: 60173 - DNA, 2193 bp, Bovine  19866880584530
tttcagagtgactacatcagtttacattcccaccaaaagtgtaggagggttgtcttttctccacatcctcttcagcataaaatttaccatcttaactgttttaaagtatgcatttctgtggcattaactacattcacattgctgtgtaaccaatgccagaaccaccccgtattcagaacttttttcttcttcccaaactcaaactctgtacccattaaatactaactccccatcctccctcctagcccctggcaaccaccattcgacttcctgtctctgtgaattggaccgcctcacgtcagtggagtcatttagtatttgtctttttgtgaccggcttatttcagttagcataatgtcttcaaggttcttccacatttcagaattctcttcctgtttagggctgaataatattcccttgtacgtgtagaatacatttcattcatgcattcatccattgatggacacttgggtggtttccaccttttggctattgtaagatactagttttgatgtgttgggatgaaggcctgctttccttgcctccttgtgaggttgacaagtactatcctatggacagtactctgtgtgagtgagtgagacacatctggatgtgtttggaagtctgtctgtctatgtttacgtaaatagttaggagataaacgtcctggctcagtggtaaagaatctgcctgcagtgcaggagacttgggctccatccctgggtcaggaagatcccctggaaaaggaaatggcaaccctctccagtattcttgcctgagaaatcccatggacagaggaacctggtggactacagtccatggagttgcaaagagtcagacgtgacttagcgactaaacaacaacacgtcctattttatatgtggaaaaactcttcctgcccacctgacttgtctaagaccctttatgaaagggtaaacagtagacacatgtgaggccagctcctgatgcaagaggagacatacacaacaagctcctccctcaggtcctgggtgcccagatcaagtttccctgctctgagcagtctctcccgacttgccccatcccacttcgcctcctttactttctttttttattttatgactttacaatattgtattggttttgccatatatcaaaatgcatccatgcctcctttactttctagtgcacacatactcagtcatgtccgactctgtgcgaccccatggaccgtagcccacaaggctcctctgtccgtggaattctccaggcaagggtactagagcatgttgccatttcttagtctaggcgatcttcctgatccagggatcgaacctgcgtctcttatgtctacatgcactggcaggttagttctttacccctagtgccacctgggaagcctcatgtattaggatggcctatatactgccgggtgctgcaggggtgggaagtcctagctgggagcctgacagcctggggccagcaccagttctgcaattcctgggttgtgtgacattggctaaatcactgaacctcgttcagtctcagtctttgcatttaagaagacttttctttttttttctttctggtgtgcgtattaaaggcaacgtatcagaagttgttagcacagaacctggcttatggtatacagtctccaaaaaatctttgttccctttctcctcccttttctaccaggtagtgtgcacttcgataggacaggccttattttacttacctgtttggcctcggggcctaaagtgcagcgcttaccgcagtggcggctagttcagggcttactaataatatgctggactgtatgcaaaacaaaggctctgctacaaccaggctttccaaaagtgttctgaacaaacacagcaccagtggaatgagggcagggcctcctaaggagaacactttgaagaaatattatttggatgggtagattctggccggattaaaaaccaaaaacctgatattggtcttgttacttttttggtcgttgcctccttgtctgtgtgtagagcacttctcgaagattattagttgggactttaaaaataggccagttgtcagatgtcttggcaagaaaacatatcccagtggctttaggtattttcataaagctaaacaactctccttggagagagctgttttgatgaaaagtcactaaatactctgaggaggtcagaaaacaaattcaacccctccccagct

SEQ ID NO: 60174 - DNA, 1308 bp, Bovine  19866880593448
ggctcggtcctgcgtcctccggccctcagtggctttcctctgggtctggtttggagctgagggggaactgcgccgcctgacttccccagccaagggtttgggaagttggggaagaggaaaccgtcccaggagctgccggtccatccgcgccctgctggccaagcaccctgtaaatagctcatctgcttgcattcccggggcaaatactttccattttcctcttgggtcactgtgaattctggggttctctggcagtttattgcctcgcttcctcttccaaagattgaaatgacggcggcttgaaaatattttctccatttgggtttttccttggtgacctcactcggagacagatgtgccctaataatagcatcgaaaattgagggggatagatgagccagctggttctgttccctagaagttatgttacagttcccaaatgtgggcggtccccagggacctggggtggaggcagagcctgtgacagggccagggtcaccatgagactccggagtgcccccctctctgggacagagtccctgcggctgtgtttaccctggagggaggctctcacgcctagtccgggctcccagctcagctgctgggctcccggcacatggcaggtggacagtgcaaaggaggtttgcacttggcatggattggcagaccgagcgctttctcaactcctgccttttccctgtgcccagaggcttagaacttggcgagacctaagcccagtctgtctggagcagccagtcttccaagggtctctctggttgctttggctcaggcccgctggctggaaggaccctcggtccttaagcctgtttctcagcttctgccatctgagaatacgttttccagacaacccacttgcatctctcaataacctttcacttcccccgacttagttggaagaggctggaaacacgtctaagggaatcagaagcattccataagccatgtgggcaagaagggggacttttgtagctcaagctttgaggcagagggtggggtgtcccttgtatagaaaacccttcaccatctatatgcaggtgctggtgctgggttgtgggttagctcctctgtaatctgagggagaagctgggagagactgtggcagaagccggctttcagttcagttcagtcgctcagtcatgtccgactctttggaaccccatggactccagcacaccaggtttccctgtccatcaccaactgcccgtgtcttcacacaggagatccccaacgtggtgttagggatccgttccctgtgtgacttaattatcccaagagctgctgtaaaat

SEQ ID NO: 60175 - DNA, 1574 bp, Bovine  19866880604906
aaggtcagtttttgaagtacggccttgttagaagatgttagaaccctcagagccttacaggaattctcctttggggattgtactcttctgtagaaatggtacttcttccaaaagcaggaagttcctggctaatataacagggagccttgcctgcagctcccaccgatcctgtgtggctggcttctgatcagagtgccaagagcatctgaagttcttggaagtgtgttcacacgaagattcgaaggtgccgtgagcaagtaccctgtgcagtcggaattccagagtcaaagggaaggcagcagatgatgacaaacttaggtccagagaaggacacaggcttttataagatagtgaatttgttctgaagtctacagcatttctttttatattcttgtcctctcttatttgactgctgtttaaagggctctggtgccgtcttgctctgtgctgagcaggtggtagtcagcagtcaggcagcgtagcctgtggctctggagtcagaggctgagtttcaatcccaggtggccaattactagtatcatcttaggcaaggtagttatcgtctgtcaaagtacttcctgcattgggtttatgtggggactgagtgatgtaaatccccacgatgctcacatggtaaatggtactaattgtttttgtttcacactgatgaggccatgctgggtactgtgtaaggactgagaaaggactgctctgagaaagttgtcagtaaagatgctggtagttaactcttgtgggcttaatatacgtcaggcgttctcgatgctttcaatatcctggcttgtttaatcctcataatgggcctgtgagatcaggctgttaatatatctattttggagatgaggaaactgagacacaggttaaataacttctcaagtgtcagggaaagttctagtatgtgaacataggcagtttggctctggagttgaggtcagaactgttctgctctccccgacctctcagtgcagactgtagactagggaatcaatgttgtcagagccagtgggtgcctggtggtgctgagaccctcagaggtcatcccccaggcatcccgcccttgcacttcggctttctctgtcacacagccgctgtgaccagaaggctgcttattcagccttcctattgagcaaacggcccactgaaaactccgctttgggctgagacctttcgctctctcttggcctgacaggtctttattatcagtgtgttagaaagtcaaggctgctctttatgggagatggtggtggggcggggggaatggaggccacagggccatggagagttcaaggaacccgaggaaaacttaaggcattgttccttgcccatcagctcctccctgggtcctccccagcagtatgtttgagtttccagatgaccttggtttgatactcgttttccagctctttcttaagctgccaggctcagccttcttcattttaagtaagtaagtgcagcagtttggagagggcaccggcctgcgccatgaccagagtaacagagctggtgcagccaggtgctcttcctggagcccagtggcaggtctgcaagtgctgagt

SEQ ID NO: 60176 - DNA, 4094 bp, Bovine  19866880612225
cctggcgggggcaggggtgatgatggtgaggagagggagtgacactcaccccatcccagaaagcactgtcgtgagccttgttgttgttctttagtctctcagtcatgtctgactctttgcgaccccatggactagagccagccaggctcctctgtccctgggacttcccaggcaagaatactggagtactctccatgagtgcctctactgagcaattattggcaatggcaaggtctagagaaagacactcagaacagatggctgaaagaggcgcagacaagaaggcggcactggatggaggccaagtaatccatgccggttgggagcagctctgctcctgcctaagaaggggcatctgtgtgcccgaaagccatggtcactgggggtgctcagggaccccatcaacactgcctgagcgcctgccctgtgtctggcactgcaaaatgtggaaaactgtagttaaaaggtcaagtctctgctctcggaatggaggagacagaccccaagtcctgtagatggtttggaaacactgagcagcatgtgggagatgagtgtagctggggtgcactcgctttagccaggggttcagagacttttccaaggagttaacatgggagccaagagctaaaggatggttctctctgctgaggttccccagggagcaaagcctgaggaggaggcttgtttcctgcttctttatcagcatgaagccccaccggatcctccaacttacaaagatacccttgcccccgcccccagacacccttcaaggacgtggggtgggaaggacagcacacagatggcgcccagcaccatggtctccagagcctttattcaggaaggcaacagggcgtttaaggtctgtttgacaggcacgctgcgggggtctgtaacagctcagttttctccaatgaagcttctttgtcagaatgaagaccagctgctggtctgatctgataggacctttggggagctgcatccatcaggcaggtgggtgtgtggtgaaggtgcagggacctagtgacctgttcttgtctcccactggggaaaggtttgtaccacgggaagggggactgttaaattccccagacttcagggttacacaggcacatgggcacgtcccagggctctgggctgagaggaaagaaagggcaggaagcagttgggatgaatctggttggagcccacagagctagtgtggggcagggacaggaatgagatacaggcgtgagaatgagcacagttaccacgggataacctggggagagcagtccagccaggagggacagaaggtgcaaaggcactgtggctgttttgtgcttttgtcctgtaatttttcaaaatgataaggatgaaccagccccctggatacagaacgctgggttctgcaaatgaagccgccagcaatctagagctgggagaggcctgaagggaagggcaaggcgaatccttgatatgctgccagggctcctgctctcagtggtcttcctcggccaacccagccccacggccgtgcattagcccaccaaaccctcgctgggcggctgttatgtgccaggcttggtgctcagtgcctgggatgcatggcaaagacaagacaagctctctgccctccagatgtcctcccagggagggagaagacagaattggttttgaaaacaggcaaattctggatctgaatccctgcttcccacttattacccaggacaaggtgtttgttctaagcctcagtttccccactggtagaactatacagctttactcatggagccgataccgggatccaaggggactagagacgtgagcacccagagccaggctgcataagcaaaggctgctggcagctctgccagctccaggggggagcagactgtggcttcgtccctgagatactatgtgaagttttcatgggaagagtagaaaagagttttgaaaagtgtttaaaaccctttgccgattaaaatattacccaatctgacccacacacctgggagttatcatagccccactggatcctccaacttacaaagatacccttgcccccgcccccagacacccctcaaggacgtggggtgggaaggacagcacacagatggcgcccagcaccatggtctccagggcctttattcacgaaggtacagggcgtgtaaagtctgtttgacaggcacgctgcaggggtctgtaacagctcagttttctccaaaggtgtggcgaggagaggggtgcagagggaaggagaacacccgggggagtcttcttctccagaaaaaggcactggcagggggtgagcaccttgcttcttcccaagcaagggcctgggttatatacacatgggggttggccagacgcagagaaactcaaagctaaatacagctagcggtggaaagagtccatggggagtgaggaggggaggggggcagtggccaaggctacatccgggctctttccactgggtgggaaaagacgttcagaaagaaggcagagctttaaaggagaaatagcatccggcctctcagacttagtgttttgtgcaattgaaaaacccacaaaataaatataacttaaaaacctcttacatgatactaaaagcacatttgggacaagcagttgagaacccccctccactgctgagcagtgctgaaccccaggagccccacggggccacccactcacgtgtgtgcaggtgtgcacacctcggccctccctcctgacacctgcagggccagggcccagggggtccccacctggaccgggctggctggggaaggtttccagactgcctgaatcccattccaggatccatcagcccgcttggacaacggaggagtgggggacagcggggggaatggggtgcgagacaggaggtgtgcaggagaagtagcacaggaaatacaaacccctcaaacccctaagtaatagaataaccccacagagataccactttctaccattcaggtatacacttgtcacccaaagcaaagaattgccaaggggaggccctctggggcacctttaatgaacaaatcacttgtatattagcacactgtttgcaaacaactggcgtctgcttaaagtgcttggaaagtttgttctcttcaattggttaggctggtcccctgtagtttttgttcatagcattattttgctttagcaaactttttttcatagatagaatgagggtaacccgaccagcccctagtggggctttacatctgaattcatgatgtcccagacccccccagacagttgcagcagagacccctggggtcccttctgacccagctgaccacagctcccagaccccgagctgactttggcgcttctggcttctagggtcaggtggtgtcacgagctctctagtgctcagccgggcgggggtgtgacctttagcaagtcagcccacacgggagctcactgctgttttgaacaagagccaggaagttgaaaagtgatttccttttttaaaatctgtacttacacatcctcgtgtgtcccactctccgcccccaccaactgtcactcactcaggatggaaagggaaacgtaagtcacgtgggcaagttgacagttcccccagagaccctggggtgatggcgggcagcccaggaagccctccctgtggactggtcctccaggcacacacacctggggacacatccactccatgtgtccctggagcatctccctgcagagccatgggtccaacctcctgcagcagcacctgggccacagcacgaaacggccgcagagctggagttttgttctttaaaagtcatgcaagatttacatccttctcaataatacagatctacttgttttacaactaaaataaggcttacaagtggttccctatgaatcttcaaacaacctagtaaccccaggaagagatgcctggcatcttccacatattctggaagctgcccacagcgcatttgggaaattggtctaagccctccaggctgctatttcagggggaaaattatgccagtgagccaatgtcctgcttcctccttgctcagcgctggcctgaggctctgccccctaactgatggaactctgggtttcgtgagagcccttgggtgtgcatcaggggg

SEQ ID NO: 60177 - DNA, 1109 bp, Bovine  19866880624626
tttcctccctcttccttctaccccactccctgcagcaccccttctacacagcaggccccatatgccccaatttcacatacacaatctcattttaccatcacagccaccttgtgagggaggtattaattgtacctatatgacagatgaggacatggtgactcagaaaagttgaataatgagctggactggattggtcctgaaagctttctccccacagtcactaagtttcacctgcttcttcttctcccccaccagcccaggtctctccttctcctcagattctcttctctgcctgtctcttcccagcctaacccatcttccctcccctggattttaggctgttattcttttctgtctcccagtgtaacaggctggcttcactcagctcctaataaatctgtgaagttgtaatcaatctgtatatcagctctcctgaggaaacctggtggggattaggtttgcgtttctctgtaattatagctgaagacctaggcaatgaatcaaactgactgacagaaagaatggggttacctcaaaacaccttgcgtctcctctcctgtggtctatccgggcaggccccaaccacagatgacctgcctcgctgctgcgcccctcccccccatccccaaggctgagggtgtgagagccagaccagacctctgaccttgggctggaggtcaagatcctgaaggtcacagaaaaagcaggtctgcaagatgtgcaagaatcttccagagcgctcatctaactacgcatcctctctcctcctgtgggtctgggtaatttctccctcctttagtttcctggggtttctctccctacacttgggtaaagtgggagagagggggtctttttgaggagtgtcagtcccctaactagtctggaaactctacacttgattttggctatttttggcagaatcagaaggagatggtaggcagcagtgcgcgtgacagtggagaccaaagatggggggaggggtgctaggctgccaggtggtggagatgccttggagactgacaatccatctgcctctcctttctttccaggggcccaagcggggttggcgcaagaggacttggtccaggcagggatgctggcctttcttc

SEQ ID NO: 60178 - DNA, 2217 bp, Bovine  19866880645123
atttcaaaaatgtcctgcccgagtgtccatcactgatgaatggaggcacaaaatgtggaatatttacagtggaatgtcattcagtcttaaaaaggaaggaaatgctgacacgtgctatgacatggataaaccttgacgacatcatgctaagttgaataagtgttagtcgctcagtggtgtccaactcttggtgacccctgtggactacaggcccgacaggctcctctgtccatgggattctccaggcaagaacactggagtgggtagccattcccttctccaagggaccttcctgagccagggatcaaagccgggtcttctgcattacaggcagatcctttagcgtctgagccgctaaggaagcccagctgcaaaaggacaaatatggtatgattccacacagaggcagagagtagaacagaggttaccagggaggggagggagcgggaatggggaggaactgttgaatggagactgagtttcgctttcagatgataaagttctagagatggagagcggtgaaggttgcagggcatcgtgaatatacttactgctgcagggttgtacatgtaaaaatagttaatatggtcaatcttatggatattttaccagaacaagaaaagtgcgctctggatgtctactaactcactagttgctggcagccttagtgagaatagagtctttaccaaggacattcacaccccacagagcaaccacttgagagctttgatcctgtgtaatcttgccatgatttaacttcattacagctttgggcatacgggaagaacccctttttcttctctgatttgaatgccatgctgattaaagaggcccaacccacagggaggcagcatgtgaatgccaaaatgagggcccctagataggggcactcacagcttggggaccccaggacatacggcctgccccctgccccctagtacaacgcagtccctctaactcttcccctgcagtcaccctactcagaggctccaggagacggaacgtcactccctttaatgaggtgcttctgagacccggggtaagaagagaccatcagtctacctgccaagggcggctgggagaggagttgtgttcttttccggtgatccccgtctgactaccgagccaaggagagaagcacagggtcagacgagttgcttccacagctcatggatttctgggagcaaaagtcattatgtggaaggagtcttatctgcggctttgcattctcagtagaaggttctcttttccggtctaaacaagcagaatgatggagttggcagcccaggagctggggggtgggactcggccccaggccagctcccaggcaggctctggggagagctcaccaccagactttgcctattagggcaagaaggctctgcagatgtgaaaggccggatctgtggtcacaatgtagttgcctctgatattttggaagttcaaactagccactgtaggtcccagtcacctaaaagggggctggaaaatgggtgagtaaggcatacagctctgtagaaacagctggttgcttttttccttccgaactagcactttgggaaactttgtatctgatggactcccaggaatccccattccatctccccagcaggagtggtacaggcagaggctggcccaaggccgctgccccaaacttccctgttgcctctgagccatccctactttgctacccaagggccagccaggcctggctgctgagtgcaggggcctggctctcttctgtcctgcctgtctctcatgctacccaccctgagtgctctgctggggtgggggctggagagtggcctgtgagaaactcaggccaggccaatctgtctctctgagaaccctcagctcccagctggggtgcttgctaacttcatgctccccttcctgcatctccccatcccgtgtgcaatggggtagggcagtgctcaccttcacctggggttcacctgagccaggcctggcacagtctccaccctgctcataacatgggatggggggtgacagtccatacctgttccgtgagcttgtcccctgtgagtgcccggcaggccttcccctggagggtgatgaggtctgcagacccagggtcccctgatacccagccgggtgcccccttccatttctctgactcattcactgtcagagcctgactcctacccgctctgggcttcaggggtcctctcgcagccccagtctcaggtgcagccc

SEQ ID NO: 60179 - DNA, 2026 bp, Bovine  19866880813690
catcccccacaagacttagagctgagtcagggaagctgtcctccacaggagaggcaggggcctggccacaatgtttctggcgggggccaaggtccaatcagggcttccctggtgggtcagtggtaaagaacccacgtgtaatgtaggtgatgcaggttcgattcatgggttgggaagattcccaggagaaggaaatgacaacccactctagtattcttgcctgcagaatcccgtagaacagaggagcctggctggctatagtccatgaggtcacaaagagttagacgtgattgactgattaaacagcaacaaggttcagccaaacactaactggcacaaaatgatggtaatgaactgaactgtcaactaccataatcagtgtgctgaaagacacctgggacctaggtgcagacatatgcattctgtgtccctatgaccccaagggagagagatgggcaggggaagcctgaggaggaccctggccccaccccacagaggcttacagcaaagacgccagagggctttgcagtcacagccccctctggccaccagggctctgctgaggtcactggcttccccaaggagctagggctgaggctccaggaacgggcagcgggagcggaaggactctttcacttccatcctggatgtcccaaagggtcctgaggaggtggtggggacaggaggaggagaagcagggcaacgcgcgagctggcagtctcccatcaggacagagcctgagggctgaaatcatccttctcgagccccttccggctcaggttttctcttgactcacaagggagtagtggaaggttctgagcttaaggcaggggagggggggatggggagggtcacaacagggagaagggtagagctttcctctgaagcagctgctccagagaaaatgtgctcccctgggacgaaggccaggcagtccagttggattccaggtatcacctgcagctgcctctgtggtcattaagatgtgccgctcatcagtggctgagactcacacctggatgccctccatcactcctctaagagtgtgagtctcaagaaggaaatgtaagagaagccttggtctggacttcacagcctaatgacaggacaagccacaccttacagaacacatcccactgctaactgtgtccaagtcagagccagagtgagataaatgggagatcacgttcagggtcaaactcagttctataagattccatttctcaaacctgatggggggtggcataagaagcaatggaaattgtactaaaaaatacatcttcctgggtcaaacaacactgagattctaattcagccagtctagtcatcaagttttcatcattatgcaatcatttcaactggaaactggacaaaagccctaggaagacagaatcaagatagtttcaaagtagggcttccctggtggctcagtgataaagaacccacctgccaatgcaggagatgtgggttcgatccctgggtcaggaagatcccctgaagaaggaaatggcaaccaactccagtattcttgcctgggaaatcccatggacagaggagtctggaaggctgcagtccatagggtcgcaaaagagtcagacaagacttagcaactaaacaacaaccctcaatttacttgatactatattttccttctatctgcattagtgagaaaataggaactgcactaataaacaatctcagaattgcagtgatttaacacataacatccttgcttctcctccttttgctgatcacctttttctgcatcttaattctcaaagaagatagctgtccctcggcactttatgtcaagtgaccaacagggactgaggcattttgactttaaagggaatgtaagtttccaagggggaaaacatggcaagtcatcccaaggcatgcttctattgttgatacaattatctagggctgcaagagtggatttccagttcataagggactattacagaccaccctttgtttttcagttggcaactggtgttttggtagtattttgtttttataattt

SEQ ID NO: 60180 - DNA, 1809 bp, Bovine  19866880884216
attatgtggtcagcattgaatgaggagttaatctgcctaaaatcacagtaatagaagagtcagaatatgaatatgaattcagacattcttactctagaataggttttctcaactttgacactattgacattttggggcatcatatatatatttgtttggggggctgttctgtgcactgtagggggtttaacagcatccctgaccagttgcaccttccccaggtttaacaatcaaaaatatgttcaggcgttgccaaatgtcccctgaggggcagatcacctctggttgagtcaccgctctagaccttgtcctagtaaccatggccccatactgcctatccaggtaatagtgttcagcacagtttctgtgtgtttagaatgataagtccatttggagtcctgctggaagcagaggacagatgccactccatctgtgactgttgggaagagaaatctccgaggtggtgctgtttgagttaaattttggaggaattcacttaggcaggaaagggggaaggatatttggagtagaaggacccccttgcacaaaagcatgaaacatgagaaaacaaatctggcttaagggatggcagataattccctctggacccttcacttccctctctgttgcagttttcttgtcttagcagcaagcttggttcacagcagccttataatttttactttcaatcagaggtgttgtattagtcaggatgagctaggttttattgcataacaaatagccccgaaaccaacaaaggtgtgtttcttgctcatgctgcctacctgacctgggtcagctgtgggctctgctgtttgttgtgctcaccctgtaacccaggccggtggtgctaccactgtctggagctccgctgggtaccaagacagagcgaatgagaatgtggcgaatcctgtcctggcttgtaaagcttcagccaagaagtagcacctgccacttgtttttatattcaattggccaagaaaggctcatgccctcacctaactttaaggggacagaggactcaagacataccacgtgcccaggagaagaactggaaatgctggagatagcactcacatctcccacagatgtcaaaggcccaccctaggatgtgcgagcatggacacctcatcctctccccgagggcctcctgcttggctttcagtgatggcctattgccaaagccactgtgaaatagccgagcaaaaagagaaaattagataatcaagagtccaaaaaaattttaattctctgaataagtcagagaggtctttgtgggttaggactaagtcacaggctctcattttagagttaggacgtcgaggggtgagagtgggagaaaggattccggtaaatacggcctggatgtggtaggttgttttatggaagtgggtgtaggtgttcaggacacacacaggtagttgtcttcaacattcaggatgctggctgtctctatcgtaagtaagtagaagagctttcaagcctgaactaagtagaaagatggtctccttcgtgggctgttctgagatacaaggaagaaatgaatgagagcaggagccaccaagagcatttaggattattttagaaagtctccaccggtgccttataaataacccaggagaaattttccttgttggaaactcactcagaccgcgcctctgtcctgggccctggggcgaggagatagacacagagacgggctgccgtggatctaaaatgggaaaagaccggaaatctgcggggaggatgcagtccttgtcacccctaggcagagggggcacagaggtcttagaaaaatagaaataaata

SEQ ID NO: 60181 - DNA, 1007 bp, Bovine  19866880972188
ctaatgggccacggtgactgtgtggaaagcctgtgaccatccaccatcctcactgcctgggttgggctcaagggacacgtgtaaaaatcctctgttcgttttccaaaactcctctaaggccacgcagaaaacaattccttctttgtgatagattgtttgtgcacattcaccaaaggagattttgcaaatattatacttcattagaccgagggagaaacaaccatgtcctttcatttcttatgactcactgacgtgaagattaaggatgcttatttcatgtgctgtgaagtcccgtatacatcattaggcagaaacacaaaaataaatgcattcttcagtcagctaccctgcctcccaggggagcccaaacgcccctgcgggtcctcaaactggcagcaatcccatcaacactcaggaccacttcctgccaccacccccacccccaggaggcagaagacaaaccatcaagaacacttccaagcaactaagggtgagacgatgccattcagagcaccctgaaaaatgactgcggtcgccactgtcttcaccggttttaaatgatacacacacttttctctgtttgtttaattaatataaaaaaggaagcatatctgggaccttcaggatgaccgtggtgcaaaactaaatccagtacaggcgccactgaagagacgaagagggaaggagcgcctcggggaggggggctgccgggccacagccttccaggaggcccacgggaggccagggaggcggcatggagacactcggcagctcttcctttgtttttctttgtatttccaggcccgacaacacctttccctaaatacagcacccgctgagtcagcttgggtgggatcctgaggagccagagcctggggggggtggcagcgtgtgggtgggggcgccctgggtctcctgcacaccgccgtcccgccgtgggggcggctgctccgggtcaccatgctttttttggaatcaagagatggttggggcaggaagggacctca

SEQ ID NO: 60182 - DNA, 1507 bp, Bovine  19866881092242
ctgaatccttcctgttttcataggaattcaagatgcagggttttatttgcttgacgttttctccctcccttccttttttccttccctctttcccctgttcccacttccctttcgccctttctccttcctttctagtggggaaggagggaaaggagagagaatgggtaagcagacaaagcacaaaccctttctctgtagggaactggccatctaaccttacgatccctctgacccggtgctcagacatcccttagggtcttgtcgagagagcttccccatgtttaatccagagcaggggctggctggcctatccagcagaaggggcctccgtgactttccccgtgggagccaggaggggccccatgtgatggcgaggcagcctgtccagttcaggcccgtgcagccagaacaggaaaggagcaaaggcagggatgctgtgctgggaggcaccaggtgcacaggatttcttatttttgaacttcgcagctggacctcactctgcgccgaggggctcctggagcccacctgctcactgccgggagcaatggaggagctgggctgggaggatgagcagagcacgctgatggaggtgaggccctgctggaggggatagctggccacgagctgctcccgccagctgtgacagcgatgccttgctcctgagaggtgctgcctggccatcaagggctctcacattgggctgcctgcccagaagcaaatctagaaagttctgtttgaatgacaacatgagtgcactcaccaggagtccacaactcatgatgtctttgatgtaaaatttttctaagaaacttgggaacttctcgggctgtgtagaaagcacgtgtcacacacctgctggcttgggcctctcgggagccacatccttggtcgtgggcaaggtcgtggcagcacaggtgtgctgggggcgccatggtccaggccgtgaggcagggttgcaggagcacaggtgtgcagggggcactgtggcccacggactctgaggaacgggagcaagcagggaaggtgctggaggagtggagccgggcaaacccatccagctctttttaaagggaaaaagatggattttaacatctacattgactacgatgtcaagccacaagaaaatgctaccaaatattgctaagttagttgatttttttaaagtacttagtgggtaaaaatcagtcctctctaggtaccactaattaataaaaataagctttcaaagatttctgtgtaaagatgttaaagccagattacagcatcttccttttccaaaactgataccaaaaccaaagattttatcaggaatgaaaatcatgggcccagttcactcatgaatacagatatgagaacactaaacaaaatactggcaaataaaataccagcagggcattaaaaaatgccacatttagttgggtataatggcagatgttcagttcagttcagttcagtcgctcagtcgtgtctgactctttgcgaccccataaccacagcacaccaggcc

SEQ ID NO: 60183 - DNA, 1203 bp, Bovine  19866881093667
atgctacaaatctgattccaagaatccatgtgatggcagagacctgggtctctaaacaatgcaattgacttgagaggcttctggaaagtggatgtgattagcagaaaaggaggccagtctgctctccagatgaaaccagtgcagtgccggaccgtgggcatggtctctgctagttaatggtcctgtccgggtcgcactgacctgcagtctctctaaatgtggatttcataaaacctttaagaactagacactctggagctgcccaaggaatggtgaagagcctgagggctcttttattccttttaatcagatttgttaaaaataaaaaatcccatttaatgtataatactgttaaaatgctgaagtctgtaatggaaaatagtaggaaatcaaagcaatattcctgttaaacaaaagaagaacatattgaaccagaaatagttttatagtcatcttgaacactagcagttaaggaaaagcagatttaattagaagaagaggtagagggtcccagtggcacccaactttttaccaataatgctagatatttgttcagttcacaaacggaggggcttctcagtgaaacttcatctcccagaaaatgaaatatacaaagccatcgagggagaagcagaatgaataagagaggattttctagaaactaaaaatattttggaagagaaatgaccagtaagaggagttaaaagtggaagtgtgtcagtgtgagatgaattccactgagggctctctagtgagcaggctgggcactccgtgccaggagccgcctaatcgagcacctggacacagccgaggggtttgaatcatacagaattatgaatcataagaaattatgaattactagaaagccattgtgttgactgttattatttatgtagcaccggaaatacgaacagggccacccaggggacgtgccagactccctgtctggcagcatgctgatctccattccttgaaagtgaactgtgatacccggagggggctatgtctgctcatccagcgtgtgcacacgtgagtctcaccggtggtgcccccagtgtgcagaggacaggggcacattccggtttgcacaggttggaaaggtgcggagccccagctacaccactcatagtctccccctcacccagtagaccgtctgtgtagactggagatagcaactgctgctctcttgctgttaagggtgtt

SEQ ID NO: 60184 - DNA, 1277 bp, Bovine  19866881188870
tgattcccctgggcctcttctcgtcccacaactgctccagccccaggtcctcgcccatgcaggtgctctgcctgcaaagctttctgtcctcctttccttgatccacatttgacctgtggctccagccgacagtgctagaatctgtgagccggccctatcttctccataaagcttagaccagtgacacaccattccaggaagcctcctcccagcaggataggttttgagagcttctttgagagggattcttttgggctgtactgtgtctcccatcagagggtatgcttctggagaaccgggagtgtgtcctctcattgctagatgcgccccaggctggacagagtggagtacgatacaaccagccatgtgacggatgagcaaagtttacagacccagccacacggcaagggctgaggctctgctatatcccacctcttaggaactacatgcacgcatgctaagtcgcttcagtcgtgtccggttctttgcagccctatggactgtagcccgccaagctcctctgtccatgggatactccaggcaagaatactggagtgggttgcagtgccctccgccacgggatcttcctgacccagggatcgaacctgcgtctcctgtggctcctgcactgaaggcagattctttaccactgagccactggggaagtcccataggacctgaaacagatctaaaccagctcctacctctttacactcacatgcttgagcttggatctttccagagacatctccagggggcatacttatggggatttcctgtccaatctgcctggggttcactacacaccgccagggctccagcacagcggagccggacccaggggccttttcacacacactcatcagggtctggaggatgttctttcactctggttcatgaagaaagcacttctaccaataattctttcagatccaccctcctcccctcttcctaactttacagaagctggcaatcaaggggcttacaatcttgccaaatcagccttttttttgttgttgttacccaggaatggaggtatccttcacccaaaatggaaatgctccgaacactccctaccaggcagccccagcaaatgctccatctctgattgagaaggtcacgggcttggctcctccttcctcctccctcctggacttcatcctcttaagaactaaaaataatggagcgctagaggaaagaggcaagacggggagggggaagcagctgaaagcataggaaatgctttggtgcgcaggggcctagcccacctctcccac

SEQ ID NO: 60185 - DNA, 2439 bp, Bovine  19866880420787
tgaatatctatttataaagttagaagagtatctgggacacagtaagtgctatgtgtttgttaaataagtaaaagtagacttccacctagccacggaagggtcaccctggtgaagtacagtgcaagtgacaaagcgagccccagctccaaacagataaccgaagacaccgagggaaatggaaacaggtggcagagacctcacgcctcgggaagccccttgtgccagggacccactctcctcctctccccacaccctcaagagccagaggaccccatttcctggcctcttcagtcttcgggaccctaatccccctaccctaagccccaagccacttcccctcccttccctctacctattaactctttctatatagccagattgattatagacagagtccaggccctgctttccttcgttgctgtgtgaccttggacaagtcacctagtctctctgaatctcacttcctcctctctataggggataatcctcccttggaattctgtcctagagattaactaataactgacatcacacccgtggatgtgttcacaggtatctgaacatgtgagtgtctcacaggcctgaccacatgggatgggcgagctgtttggcaccaaggtggtgaagggagctgccatttaaaaccgacccacactttatacgagtttccccaacggcccgtaagcaccacttaggttgcaagccaagtgccctgtcctttagtccacgacctatgacataaaaatacaattcttgggggacaggcaggggcttcatgttggcctctcttcatgaagttacagcatctgaggtcctgaggcaggccttaggggagaggaggaagaagtaggagaggctaccagtgagggggaagacgagagccccgctttggagaactggggagaacagagaagacccctggagtgagggacagaggggcagaggggcaggcccccaaggctgtccagggcccccactgccaactcggcagctgcctggcccggccttccacccttccgaaaaggaagaggagccagcggcaggcagcaagttacgatagaccattacccgccgttaattaattaaaataatcagcaaattaaatacagcaaaattaaaatagcacaggaaattaattctctgccagccccacctcacaggtgagatgcttaaagagccccttgcagccaggattccgggtggctggggggtcaccaggactcgccttagatcacagttccaggcaacaccaagtacccatgaacccagccacccgggggtgttcactggctctgccaccctgagattggcctcctggctcctgaatctcaggggactctaagccctgggccacattcctgaacccaagctctgctcctctgtcagtgggcaagaagggtcctgatgccctctgggccagggactgggcactgtgccctcctgggcacatggcccacatctgccgccatacgggtcaaggcaggagggaagagggaccttggccttctcttccgggctccctctggggctggagttgggtcctggtgcatacctctcccttctgtgcggggctcctggcccctcatttggagtgcccagaacctcctccggggaacccctcattttgctcctttctttggcagagaatgctcaggaaggaagcactgctgaggcccagaatcccatgtctagcaaagctggctggaccaatcccaggacatgatactggaactccctcctaaacaagactaaacacttcatcacacagatggggaaaccgaggtcaaagagggcaaggcatctgttctccgtcacccatggcttcctggcagagcctggagctgagtctctaatggacatattccatgtcacctccaaaacatggcatttctagagtgcagctcagtcctgtgctgacctccctcttagcctggccaccacggtcttgcctccataatcccatcccacgacccccctttcctgtgtcccacacaacagccggattagactccttgcccttgggctgttgttcacatggctcctccttgctgaagctccttcttacacttctgcctgcttaagttcaaccccgcctctttagggtccgggtcagtgccagctcttctgggagcccccagagccctccttctcttttaaccttccaaggtgctccacccccaccccactccccactctctgctgtccacgtgagctgtggctgtggcatgtgagcttcttgaagccgcagaccacctcgcctctgggccccagcacttggcacggtactcagcactcagtaagtgtgcagtctcctcttcatctgatgctctgccatgtcctactgctaactatcgtttattgagcatctactacaagtccagcccctgtcctgtcccatcctcccatgaggacccagggcacagaggttgtggacttctc

SEQ ID NO: 60186 - DNA, 2207 bp, Bovine  19866880440326
acagggggactggatttgatccctagtcagggaacgagagtccacaggccaaaactaaagatcccgaatgccacatggaatgtataagatcctgcctgctgcaacccagcacagccaaataaaaataaatattttttagaaaacaaaaataaaccaccctgtttatggtgattcgttatggcagccctagggaatgaatacataaggataaccgtcttgccagcagtggcttaaaacacagaagcaatgtctgttaaaactgctccactcccctgcaagaccagcaaaaagacttttttcatcagaaatacagaatgctagcactggaaagaaagacagctgataagagtatttactgggcatttactatgtgccagttgccttgataagggctatatgtgtgttcaccatcccactgaaggggcataaccaccacaggaggtgaccattattctccccatttacaggtgagaaaggttgaggctcagagggctgaagtgactcacccaaaatcctggaactaggagtggcaggacctgggtaagtcttgggttaattccagaacccagagtcctgacctctaccccatcttctctcagttggtcaagttcaatccctttgttttacaaatgaagaaaccaaggcatagctacagtggtgatcccaaaggctgtgcccactctaggggatgaacagcttaaataaagcaacggccacccagcggtccagctgaggctccctgtatttgtaaacaaggggtgcttgctcttcccactggcaaaacaagttggggtgggcagggagggcagcaagctatgacctgcccaccatctgagtggcgagtagccagaaactagttagttatctcagttttggcaaagcctgaggaagcaaagtggttaatgacaacgaggcccagcaagcgtgtcgaaagagaagattgaaggctggaacatagaaatacaaggctcctgagctgcacatgagtgaggggggtggggtggcctccagagagcactcagcaataaacagggcaggcaccttgtttggttcagttcaagaaccacaacacacccatgggaggcagggaagagaaactcgtctccactctggctctgcttctggcgtaaggatgactggaccagcggatgaggcagctggacactgccccagaggcagatttccttagatgtgacgtatcagcccatgggtctctggaaatagaacatgtccgtcctgcaaacacctactgatatgcttacctgagtatcagaccctagactggggctccaaaggatgctcactgcaccccctcatctggggaggcaggaatgagtgatcaggggtttgaaaactgtatgggtctctgatgcggcatgtgctggacactgtgggaacacggaggaggcatcagagaaggctccctggaggagagacttactaagcagaaagtgaaaagtgaaagtgaaagtcgctcagtcgtgtccgattcttttcaaccccaaggactattaagtccatggaattctccaggtcagaatacaggagcgggtagccgttcccttctccaggggatcttcccaacccagggatcaaacccaggtgtcctgcattgcaggcggattctttaccagctgagccacaagggaagccctacgaagctgaaaaggaaggggtgttactgtagagcaaacagaagtctgaggttcctgcacatcttctttccctcttgtcttgtcattgggagagttttcttatacatcccagcccctcagagggaatctcattaacaaagtcccaattagatatttaagaaacactcagtgaagcctcctcagagccagggattgagctaggaaacaggatagaagatgatgggatgcagtccctgccctccaagagccaccagtgtaaaagggaagacaagcaccggaacgtgcgattacactacagccagaaaatgcccaattcaagaccactgatgtttgtgtgtgtctcccctcttcctatatgacaggcactggatgaaggtacttgatttccatcactgcacttaatcctcatgacaaattactctggtgaacactgtcactgcatttagcagaccaggggactctgaggctcaaagaggcagagaaacttgcccaagatcatagagccagtaggttatacgaccaggactcaatcccaggtctgtttgaccccgt

SEQ ID NO: 60187 - DNA, 1428 bp, Bovine  19866880508620
accccaaagtggggcccaggtaggatgtggaaggagggagggagattaagaatgtgaaaagggacattctctgctcccctgccacctctggcctcagcttggccctgccacgtactttcagagcccccctttatttcaccttcacagtagttatcaggactgcagtcaattacttgtgtgactggctgttcagtgtgtcttctcccggagtgtgggctctcaggggcaaggaccaagtctgtcttgtctaccgttgtatcccctggccccagggcctgggctatggatgctacgtaaacatttactgagcaactccctgagctggtcaggctgagttgggatttagatccaggcaggtctgactcccaaaggagccaggggactcagggccctggttgatccccaggagctggtttgggggagcaggaagctgaatgagccctgatcactgggaggatcacttcgtactccacaggaagacagcagagctgacctggggacagggaggtatgggcagggccacttgtccactcccctctggtgggcagcaacatgccacctacaaagcacctccacctatatgacccactgcatcttcagtgaaccgggagatgtggattattacctccatgttacagaggaagcaggttcagagcagttgtataacttgcctgaagtcacatagctgctaagtggcaagatttctaattctgccaagtccaaagcctccttccactcctagctcttgcaatgctcctctggacactcctgaaagtgcttcttctagagctgtggtctaaattaaggctgggaggaaccttaaaatcacctaacccttgggctttctaaaccctgggcctggggagctgtgcaaccttccagatatgcagaccctagtccagggagtctgactcataaatctgaagggacatctgggaatctggtggttttttttttttttggaggcactgtgcagcctgtgggatcttggctccccaactagggatcgaacctgtgccctgtgtggtggaagcacggagtcttaaccactggaccaccctagagaaggggaaggctacccactccagtattctggcctggagaactccatggactacatccatagggctgcaaagagagacacaactgagcaactttcacttcacttcactttactagggaaggccctgggaatctgcatttttaatcagcttccccccagtgggtacactgttccagtgtcacctcgtgcccctcccatttttcagacaaggaaactaagaccggaagagggaaacagactgtgcccaagaccacaagatagcatggggagggggtggcccccagtgtgttgttcatccaagcagaacacccccgtgtctcttcaggtcccaggccgcagctgctcctcaccgtcccatttactag

SEQ ID NO: 60188 - DNA, 1438 bp, Bovine  19866880525210
agcggcactggagcaggggctgggcggtagggcgcacgcagcatggcggaagcggaagggagttcgccgctcctgctgccgccgccgctgcctcccccgctcgggatggcggaagtggaggcgccgacggcggccgagacggacaagaagcaacttagcggtgctggcagcggcgccatggacgtggagcggagccgcttcccctactgcgtggtgtggacgcccatcccggtgctcacgtgagtcttctctggcattcggccgggacagggagagatgggccggcgcgttgtcctccggcggccccgggccagcctccgggcccagcgcgcagcaaagccttcccgaggggccggggttcatcagtacccccgccacccgcgtgctgccagtggtgctgacggatgggaccggctcctcgctctcgttacacctggtctgatctgagagacagttgttgaccgtggagaggttcagaggctgggaagctcaggacctgtgggcgtacagaaaaggggccccttgacttagtgtgagagagacatctttcattcattcactggcttattcattcattaaacagacgattactggtcacttcctgtacgcaagacatcctgctgggtccggaggcccagaatggaagtttggttggaaccacacctgactcctgggatgtcgtcattggaagggcccccagaaatatcaccacaccatctctgttgcaaagcgcgtcaggcagtctgcccatcagaccaaagttatttctatagcatcagatcagcctttgtcagaaaagaaagcaagtgctccagaaagtgctggcaccttgtagcaaggagccgcggggttagggaggtagggagctggtttgccctggtgcttcagccctgacaattgatgataaccattaccccccgtgctggacacttggctaagctcttttacactcattttctctgaatttcacagccactttctgaggtaggaattatagtctcagatgatggatctctaccattaaatgtcttgatcaggttcacacgaaagtaagcaaagccatgcccaacaccgttttctgacttgctctcttttgaccacagcctgttccctctcacctgatggaatagacttatttgttccctgtatcaaaaacagccaggtggtatggagaacggatcatttttgtccttatatgtttctgattctaaaatgagctctttttcttaagtcttgcatcatgttaaaatacttctgttgtttctgtttcaaatgcttttgcatttgtttaagaatgtccaagtctgagtcctttaaaaataaaactatttaagaaagtattttcattgattaactcaatattccttttaacacacctgctcagtgactcctgtgtgcctagaatagttctaggtgataagaatatacagtggtgagt

SEQ ID NO: 60189 - DNA, 1072 bp, Bovine  19866880542498
acagggtgcaaaatgcagagaacctttttttcacacacacacacacctcactttccaggtgtgacaaaggtacagcccccctccccacaacacatcgagtataagccggggacacaaccttccccgtgagtcctccccctccagattgccgggtgggtaaaggacatgtcaccccgggctgctcgggacaggtgacagcccaccggcccctcccccatcactgccagcctggtggtgccgtcctctgcctgcagaggcgtcacagctcacagggcatgaatgtcaccccagcactgccagcgccgggcacagccacacgttgccccagtgacaaacaccgctggccccaggaggtggaggcgcacagggctctgggcgtgaccttggtccctggacaccaggaggggcggcgccatggcctttctcctgggtagtccggggccaggaggatgagtaccgggaagaaggcaggccgcctgggcatggacaacctgaaaatgccaccttcccaagcagcgctcccccccatttctaatagaacgtagttgctttggggggaatagaatgcagaggccaacgaggttgtcctggccctaaggcctgaggagcaggtcctaacaggacttctcggaggctgtggagtcaggtggggtaggggtggctgtcaccacacgctggggggcccaggatggacagggtgggatgatcgcttcagacacccactgcggccagaggagcccctctttcttaccaaggccccctctccaattcaggccacagagcctgacaaggaggccaaagtccaggggcatgactcacccagggaacaggcccagcctgctggccagaaagtgaggaggacaggagccaagaggcctgggttcaagtctgagctcctcccagggcaagcggagtgaccttggagcagaggctcagtctctttggctctggggagggggaagaggcagcaacccgggaggtgcttgaggaggaaggacatggcggctcacaccctggcccactgcttgcttcctcaccaggaacctctgctttctggagctcagttgcctca

SEQ ID NO: 60190 - DNA, 1710 bp, Bovine  19866880658093
tgcaggagacttgagacgccgggtttgatacgtaggtgatcccctggagaaggaaatggcaccccactctagtattcttgcctggagaattccatggacagaggagcctggcaggctacagtccattgggttgcgaagagttggacacgactgaagtgacttagcacatataaaagaaaatacaaacatattaattaggaggtaaacattttagccttgcaaacaaatagtggaatttggtttcagtctctcttattttttattatctttcttctcatgctgttgatgatttggtaaaatttgagtattatcttgtaagtctaagttaccaaatcatatcattttcttttttcttttttttatatcattttagaattggaaagaactttttaaagatcatcgtgtttaccctctcatattatagaaaaagaaatattatgtttcattaattctgagatgcatattttccccatattttaacatctctggaataatcatgcatcttaaatttcatgaaataccgtaaaaacccattagagttgtgacttttccataaatacttacggtagaattcaagtcttctacttatattaccctgacctagaaaacttcccttctttattctttaaatccaaatcctgcccagttccagtctttattccaggaattctgctcagttgaaagtgatcttttcatcctttcttttgtcataattgactacatcattcgtttgataacttctgtttactatgttgttacttacctgtgttttatctgtctcctcaaattacaagctcttggtcatgggaagaattttatatttgtatcatctagtgtctgtggcaccccactccagtactcttgcctggaaaatcccatggacggaggagctggtgggctgccatctatggggtcgcacagagtcggacacgactgaagcaacttagccgcagcagcagcagcagtgtctacttgataaatattcattgattgataagcgtgctataattagtagttagcaattaatgcaacccaaaacttaaagagttgtttactggttaaaagaaccatatatttaactggatgccagaactaagtgctagatagatgtagaattagtatttctgttactactactgctgcagggactactattaatactacagtcattgctactattattgtaattatgctgtgccaggtactatgttaaatattttatacatgcattatttcatttttctgcacaacaaccttaaactaaggatcattttactgattttaacaggttaggaaacagacagggcgagtactgcttgccaaggtcccagaactgaagtttggcagtagtggggtgaaatccatacctccttctctaatgtccatactcttgctgctctacatcactgcttattaggtcttttgagggctttggtaacctagtaaactgagaatagaaagaaaagaaatggacacgtacttttcctgctgttcagggacttttccttataaatcccatgttttgaatggtggatagaccttgtgagaggaagatgtacagctgccctttgctgctcttagtcagttgctggcagcttggccgttagtgacagatgagtgtgtgacactttttcagcaatgaattcttgttacagctggcagaacagaatagttgctagaaatttcaggcagttgcttcataattccact

SEQ ID NO: 60191 - DNA, 1624 bp, Bovine  19866880699863
tacttagaacccaagataatgcgtggaagaagcagtagtcttcaaaccagaaagtctgaatttaagtctcagttctttctctctatccttgtcttactgactcttcaccaagtcaaactctcagcctcagtttcatcatctgtgaaacgggggcaactgtatctatctcaccaagttgtcataggactaaataagcccaaaacgtaaacagttatataatgagattcttccttatactgatgacttttaagagtatcgatatctcagtatcttaagacttatgcttgaaaatgaaagtgaaattcgctcagttgtgtccaactctttgcaaccccatggaccacacagtccatggaattctccaggccagaatactagagcaggtagccattcccttctccagtgcatcttccaatttaaaatataattccagttggtaatgtgatcagatcaaatcagatcagtcactcagtcgtgtctgatgccctgctctataagtactaaaaagtactacaacctctgaaaacaggagtgtgatacttacatatcttgttcagagttaaatttcactcattcagattaccaagacagatccactatcaaatcagggcattcataatagacatctacctcattctgcaaaagataccttagcagtagaatttttcaaacgaaaacaaatcttcttaatgacccaagaggaggttccattctcctaggtggtcagaatactgattcagtgctggttggctgcacgttttctaagacatggcaacctaatacgtgaaatgccaatctcactgccctgagggaaaataagaactctggatatgctatcagggagcaatccatggctgtgaaatttttagttttgtgcttcatgcattccataatcagactttccctactagaccaagcacttccggctagaatatataacccatgaggtcaaggtcataagcctgaagtacacaggagcccattcctgcacccctctactgttggacgtaagcctagtcatctttcaaggttcggttcattatgtaacctcttttatgaagcttttcttgactctccctattcctgctatgttcccactccccgtaggaaatattccttctttccctgtattctctgtgcaccgacagcatggaaggacagaaagaatagaagcacgaatcacttaacaaatatttactgagctcctattgggtgccgggtactacacaagatagacactggggttcaaggaaacaacacacgatttctgccttcaaaaaccttttagtttagtataggagatacagataatttttaatataatgtggcaggtaataatacagcaagtaataggatctcagaggagtactcagtccaacctggaggagatccctgagctgggtcttaaagatccactgcaaagatggcaagggctctctagcagtgggaacaacaaaggcacagtgcagaagtatggagagtacatggcccgtctcagaagctatgcgcagctggcagttcacctttccttccttcttcctcccccccttctttttttccctttttaaaagaatctctttaaaagattgtaaaatggggagaagatggattgcagaagatgagg

SEQ ID NO: 60192 - DNA, 1332 bp, Bovine  19866880720517
aaaattttctatcaataggtgactgctactgatagaaaataatgttaattttatgggtaggggatgaaattatgataaacttgctgcaaaaacagaattggtgagaatattatacattctaatttctgggcttccctggaggtccagtggttaagaattcaccttgcaatgagggggacacgggttcaatccctggtcctggaagatcccacatgcttcagggcaaataagcacatgcagcacaactattgagcctgtactctagagcccatgagccacagctagtgagcccacatgtcacgactaccaaaacctgcacaccatagagcccatgctctgcaatgagaagcctgtgcaccgaaactagagagtaggccccactcactgcaactagcaaaagcacatggcagcaacaaaaacccagcacacagccacaaacaaataaataattttttaaaaaactacttgcattaaaaaaaataacgtttatttctatggcacaatgacggcaaggattgcattcattgtgcataactgtttcttatgaacagcaaccttctgctttaccagattatcccagaatttgtccgtcagcctacatctccatggtagccactctttcttagcaccaggcttagctccacctatgctgagtgatctcaagcaagactgtcatctactcctgagcttctctgcacagagacgagcctacccagcattgtgacatcacaagaatttgccctagatgctggaaggagtcgatttaattcaattttccttctctcacagggattttaagaacaagttgatgaaggtcaaataatacacggatcgttcaagccaatccttcagacagaataaaaattcaagttggagaggaaagactggattctctggattctaccatgattaagtaccccacagtcacttcaaaggtgtgaatttgctattagagctcacctgagcatgattccacccagacgaatagctctcttccagtccttcaaggtggatttgccagccagatgaacaaaatgcttggggctgatcaactgatcattgaactaatgtaaaaggaaaagtccaaaataatccaatgttaatttaggcaggccatgagggaaagaaagacataactctatttgttacaaacaaaacaatacccagatgacatctctcatcatagcctgtattctctatcttcccatcctattgtgctagagggaggtgatccttctctggccctgtcctggtgttaatatattgattaggatataaaatccatttttgtgtcctgaatcaagcagatgggttttgatattgcaaaggcta

SEQ ID NO: 60193 - DNA, 1046 bp, Bovine  19866880734500
gtactaaaaaagtttgtaagggagacaaacctaaccttggaagtgccttttttttttaatttggccactctgtgtggcccacaggatcccagtgccccgatcagggactgaacctgggcccgtggaactcaaagtgcagagtccccaccgctggaccaccagggattcccagaagctcttgtctttaaagctgggttctgggatcagactgcctgggtttgaatctcttaactcactatgtgactttggacaaacgatgtaatctctctctacctcagttttctcatctgtgaaataggattaattacatatttactgtatagcaccattgtggggattaaacgagttagtctgtgtaaagcacttagaacagtcctggtcatatcgtattatggaaatgtttgctcatttgtttgtttatttttccttcttcctttaaggagccgtgtgaagccagtggaatacagtcaaatgtacagttacagctacaaccagtattaccagcagtaccagaactactacgcccagtggggctatgaccagaacacaggcagctacagctacagttatccccagtacggctacacccagagcaccatgcaggtaaccatgatttggccagtctggccccgcatcctctagagacctgggtgagtctccgggatggggtggttaaggacaggagcttgtgcttcagaaagacagggaaagatgcagcagcttaattccccttgttaaaaagaagccatcctagtcctgggccaggctttcactgtgcttctcacccacctctctggtctcttggcagacgtatgaagaagtcggagatgatgcattggaaggtaagaaaggactcccttcactcagtgtaggatgtgaatgtcacctgagtcgggagtgcgggtcccaaatcaccccagggaccgacaggtggaggtgggcgcctgaggctccctggactcgtggtggtctaccccagggtgtaggtctgaaccgaagactccatggccttatatttgttgcacagtttgtcagattcctgtaaa

SEQ ID NO: 60194 - DNA, 983 bp, Bovine  19866880752809
atgcagagtgatgcaaacaccctcccttacaagaggtcaagtgatgagtgtgtgctgggactcaggtggtccctgctcaggaccgagcatggctaaggggaacagacacctgatgaaccaaaccagatggccccacccagtctacagtcctccagccatttaaaaaatgggtccccggaatgtctaagccccgtactgggttccccacccaagcactcacctcctccccaagactgttgccaacagctaacgccagactccctgaatcccaactccctgttcggttgttgggtccccagtcttgccctcaagtccttctggctcgcggccatccttctgccccctgcccaagctctaatgtcttcacgcctccccagtcccagcccccaggcttcttctgcccactgcacccacatcctcagactcacccaggaacaaaacctcgaggtccagtcggcacttcagttggcactacagggaggtgacggtgaatgtgtcctcagggtgaggttccgccataggccccaggaagccgctcttggggcccccacccaggccgggatgcgcctgcggcataaagcctggatacctgtaggcagtatcctgcaggggcagcagcgagtccctcggcacaggggacagggtcaagtcactaagaagtgggcagccatagccagcagcggctgcagcggggccacggggtgggccgggcggccgggccatctccagcggctccttgtcggccttgggtgtggccggtgggctagccaggtgtggggcactgaggcacgcggcctccgtcctgcccaggaagtcagccagcagccccgaacccaccttgccttcgtagggtgggctgcgggcagctgagcctggtgggtaccaatacgcagtacccttgcagctgggggagtcgtagtgaggctggcccagtggcaggtcccggcagctcaggtgggcctgagctgcagccgcatggccca

SEQ ID NO: 60195 - DNA, 1223 bp, Bovine  19866880760899
gccctcgaggacaggggccgtgcctggcatcgggacaggcatcagagggtaggtgggggtgatgctcaagatgcgaggttgagctcagtgactgctcctgcacccggccctgggtcaaaagggctcgctgccctgctggtgaatgagtgtgtcactgtccttgtttaagccctctgttgacaatgacactccctgttaacgagcgccactccctctgttaactcttcttcctcaccactctccttccctgcatccccaacacttccttactccccacaatgcttttaatcagtccttggcactgggagcgggggctgcctgagatgagagagtatatgccatcctggatgaagaaggggggacagccttcccgccgtcacggtccaagccagcaccactgctcgcctgagctactgcagctggtctccctccttgaagacctgcctgctccgccaccgcccgcggtaccccagctcagaacccttcaatggtttcccatttgtcttggaacaaacttcaaactccttccaatggctgcatgatctggccctgcctcctcaccccgtcattagtgttactgtcttcccatcaggtcgtcaaagctgagctgcttttggcctccaggctttacccactgctgttccctctgccccgctccctatctagctgacgccccctcatctttcagacatcagcctcagcacctggccagccggctgcagacctttacggcctcctaccttttcttctcttgcatggtccttcctatggccacaattaccaaatgctttgtgttcttgtttcccgtctttccctctaaactggaagccccctgaggaccaggggctcactgtggtgttcactgctgtgtccccaatgcctggcaggcagtgggtgttggatggatgtctctggaacgactgagtgcctcggtctgaggactagtgctgtcaactcccagctctgagtggggagcgggccagaatgtggggctggatggtgtcccagttcctcctgcgttcaggcctcgctgggtggttccattatgtatctcactgagccatgacctgcccaaacacccagcccccacattggtttattttcccacccagagcccgcgaggaaaggttttcagattatttcacattttctggattatccacgagacatcttccctccagtgagaaggatcaagagttgacattttaaaccctaagcagctt

SEQ ID NO: 60196 - DNA, 2050 bp, Bovine  19866880897019
ttttcttacctgctctcccactagactaaattgaggttagtgatcagtcatctctaattctaatgcctaccaccatgcgagacacagaatgttcaataaaaatttatcaaatgaataaagctacagtaagtggctactatgctttagccctcaaaaaggtgaggtggggagagtgtctctggacctccagtcttacagcactgcttcctgagggaagagaacccaatctgaacggtccaagtttaacctctattttagattaagagtcctggtagcacaccagatcacaagacagaatctccatacactttccaagccctagaaaatatcaagggtctaatctggtacagagtgagacattaaaaattaaaacccagggcaaaaattaactaaaaaacaaaaggctaccctgaccaatatgatcaatctgccacctcctttttattcactcacttcaaagttcttacttcctaaagtagagagagatgaatgataagagtcatcagccaaagaagataaatttccaaaaaggctagggaaggtcagaagagggtaagtcatgaaaatcagcacatgtccacagcttgaaagaaatccaggctgttattagaatccccgggcacttagcctaaaacgttaataagcctctgaatctttcctttccctcccaagtcagcttctggcttcccttccctcgatacttcttccccatcatctactcacccagcagcctgccccccgtctttcttttccttcctaccttcacaaatactgacagagattatcagaatgtggcaaacaagtgacaactaactgcatgtggggcatcagtataaaggacatccaattactcatttgtttgttcctccttccttcactcattcaacagaccttatataccagacagtgtgcacacagtggggaaataattcaacactgccctgtcctcatgaagcttgaccgctcctgaaggagacaaattaaaaagggggacaataatataaagtgatgaatgtgaccacaaatgttaaaattcaagggttatggaggcatccagctcacactgtgggtgaaggggtcataagaaagagtgtctttaaaaaaaaaaaaaaaaagagtgtcttaaaagatgaaaagggttagttaagagaagtttcaggggaaggaagcaatgtgtgcagaggcgaacagtgttccaggaacagcaaacagcttggtgtggctgaagtgcaggaggtcacgagtgatgaggctaatcagacggacagaggcccaggtgcagagagccttgtgtgcgtactatagcacttgggagtgtgttgatggctacttcgaactacttaagattgaggccagggagtgacatgatcggatttgcatttagaaagctctctctggcagcagagagaatgtattacatgaaggggagaaagactgaggcagtaatccaagtggaagcacttctaattgatcgatagaatctacataatgggaaagttgcaacgtaagatgacagaaattgctctatattgagtttgagaccaagttgtcactgataagctttctcttttgaacaattaaattacctaatctctctcagtttttacattctgaaaaatgcatttgtgtgttctagggggaacactagactatcacctatcatcaaccttttcttaatgctttaaaatttatagtataagttttttaatatatgtatagtgagatagcaagtatcagtgtagagtgtacctaccgcctagtttaagaagaatattaccattagttttaaagtcccctgcatgtctctccccaaacccaccttcttctcttttcaccatgaggtaacactatcccaaacagtgataactttaccacatctgtatctctaaacatttttagtttcacgtttcttcacatgaatcttatcataatatatattcgtctgcaacttttcactctacaatttgttgagattcattcatgttgctatagttgcaatttaatcatttccatggctacacggtgctctactgtatggccacactgagat

SEQ ID NO: 60197 - DNA, 1643 bp, Bovine  19866880906084
cccagaaaataccaacctgttctgaagtagataaaggaaggggcaaggaccccagttccttcagtaattcatttgtttccttggcaagctgatttgtagagtgttgtaactgttgcctaagagagaaaagacgtgttttaggatattctcacttcttgagagctgttagcatccagtctgttctcagagtgtctcatgatgcagggaatgaaagggcacctgaaggatgttcccagatgctcaggttcacaacagaattccagaagtaccacctagtcaaactcacttcaagttgtcttcacattaccgagtagaaagaacctacctcagtgaaaactgctgattaggtattttaattctttggggagaaaagaaaagcattctcagcagttctgatagaaatacaaaagcagctgcccccacacctcaatctaatagttttaacacgctgaactctctctgaaaattctcacgctcattcgcccaagagttccgcatggttactgtctgtcacaggccactgactagtgacagaatccacgccctgggggttggatgaaatgtgcattagaagcagagcttctaccctagggaacaacctccaaagatcaactcccacgtttgtgcttaaagctggtgctttttcagctttacccttggctccctacctatgctttatgcttgactttctggctcttttctccaaaacaaagaagccctatactgtgtttaaaaaaaaaaaaaaaaaagtaaggagcagaggggaaaggaaattaaagagggaaaaatgtgtgggattgaaaggtactggaaatacaaaaaagattcctttcagtcatggtttcttctactatatggccatttctgcaacggttttaagggaggacagagaaaccacactactgattactaatattttttcactgcaaaggggtctccaagatagaagggaaaaaaaaaagcaaaaccaaaaaaatttaaaaaaccatgagagtcaaaaccaagagggaatcaaaaaaccaaaaaacaaaaatgggaatttcctggtggttcagtggtcccctcttccaccgaagagggcactggttcaatccctgcttggtgaactaagatccaaccagccatatggtacagcaaaaaaaataacaataacaaaataaaaatcaaaagcccccaaaaagagtcaatccaaagcttgagcatcatggacagtactaacataccaacagctacctcacgtctccatcaaaaaagctcaaagtactaacagtaagtcattctctcacttcccaatgtctaggacaggaaacaaaaatagtgtaaagatggaaactagaacttctaacagcagagatagagtcaagaaggacataataaaaagaatctattccactcttctctcctcgggctattccgaatacacttctttaatattatatacagttggaaatccaacagattagacaagcaatgtagatcatcaggaggcctgtgccaacaaggaagctcctgtagggagaatgcagtttaagagtcgtagggatttccccctctacttccctaaattgttctgtaagctgtccaagggaggaagaaaagcagagtccaaggactcagagaggcaagggagatcacaacccatt

SEQ ID NO: 60198 - DNA, 1505 bp, Bovine  19866881040372
catcttgtgcggcaggtctaggactcggctataacatctctctcaaagaggcctcttgagacccaacctctgtccccccacaacccaccccacgtcctgctccgactgcagtcacactgccagactccgtgtgggccaccactgtcgggtcaggaggtcagagggtgtcttcattcatactatcaaggaaaccacctccctgtgggcaaagaccagagactgcccagagaacctggagaaaaccaggcccagagagggtgagagaattacctgggggccacagggagggccagtcatgcctgtaccccgagtgtctggcctctgggcacagggctctgtgcactcctgccgcatcgccttcttcacgcaggaaagctgctgcaagcactttgagataccccaccagccccagagcagggcccacgccccgcctcgtgcccaccccacatacttccttctaagtcgcaacacttccaccaccaacccaggtctgtctttctggctggacgcaggctccccactgacctcagctcttgtcccccaacaggaagacaacatggcctttgggaagcctgccaagtaagtgacgaacatgcgtgtgactggccctggagccaggttcctctgcctggagcagcaggccaggccttctggggcacagcaggagccaggagcctgaggaggggttgaggggggcgcagccagggtccaccagagggtctggccttgtaccacacatctcctgctctggtccctggccgggtcctttacccacaggccttctaggccttgcctcagccctgcaaggtcgtgttctcagctgcgtcggaaaggtgagggaaagaaggaaaaggtgagaaatggaaaggaggtggcagaactggaacttgcacgcaggtctgtctccctccaaacctagaccctttctcctgcccctcagggaacaaacacaccatttaaggtgtaagggaggcgttgtttagaactctgctggaaagttttggttggagagaatgaaagcaaattcaggccctcctggagtattgctagtttgcatggggtttggggacctcagtttttctgtctgggggcctgtctcttgtggcctggagacagcgcttcagtcatcggtctgctcaggagagcgtcaggtgccctgttgcccgaggcagcgtccaggagggtggagccctggaggagtgggtgtcccccacagcactggcagccaggagcggggctcccaagccctgctggcgtcctcaggggcctctggccttggtgtctgctgctagcccactcttcagcaggagtcggaagggcaccgggcacccgtttccaagcaggaagcaccgagcagcccaagtccccagaccacgtccccagacggtggcggtttctctctggtccagtctgtaggctctgtcaagccactccccacacagcagccagagggcgcttgagctcccagtgcccccgcctgagagaccctgtgggccgacccccag

SEQ ID NO: 60199 - DNA, 1146 bp, Bovine  19866881063364
tgtttcctgctcacccagggcctgggtcttctttgtctccagcacccctcttccccacttttttgccccaacacaccttcacctgcctatgcaaactgcagggtttgactaggccagtgaccccaatatttctgccttcccctgtctttccatcctgaaccccaaatgccaggtttgaatttcctcccagcttctgtaaactttggaaaaagaaaactcctaatcctgagcctatttctggtggacctggcagggcgagctgggtcccactccctgaccttgacgagctcttggctgcccttgaccaaataatgcccacattgggctgcctggtcctgagcaggcaactttttcccatagcccagtttatgtctgtggccctccctgctgaggctcaaggtgacccccaagggacagctccgtactacctgcccccgctcctcacccaagcagcatggcccaggcactgggagagtcagaggaaccctcgatctgagagaagataaaccccccaacttctgggcatccctatctgaaagaagacgccggagggttcagacaggggcaagtaacagcccctaaaacctcagtctctgtggtggatgtgaaggttcatttctcccacgaagcctccctcctttgcagtcccaagactccccctcctgcagtgagggcccaggcatcaggctgcagtggggtgggactggcaggggtggtgagacctggcgagggtttcctggaggccaagaccaggtgcgaggcagaagaacccagggagttcccaaaggagagagagccaggggatggaagccacgtgtggctagatccaggtggagtagacacttgtctgtttggggaggaaagaaggctttcatgaagtcaccccagggctgggggccggggggcgggggcaggctggttggaaggggtgggtggcctcaaagcgaccagcgggggaggccttgagatgtttgttttcagccccaagagtctcctgcagggagaaaatgagtacgttcatcggctgctgaggaagcagaggagacctagggaggctgtccaggtggggcaggctgggtagagggtggggccccggtgacgggggtcggtgggggtgccatgggggaagggggtaacagaattatt

SEQ ID NO: 60200 - DNA, 1952 bp, Bovine  19866881161219
ttagtctgcacgcgtggaaaatgcagacaaagttgtacctacatccagtgagtgcttatgcgaagagcatgtatataaagagctcagcccagagcctggtagtgctccatagacgcatacagcatcaagacggtgacggtcaaggagacagaaagtgcacctgaagttctgatcctcactggtgagttcatttcggaactgtttaccaagcatctaacttgtggagcattttatggaagggtatcattcaatatggaccccctgtctcccaagtctaggatgggagagaggacataaataagaaagcgtgcgccagtggtaaatgttattttatcaaaggttattaagggagttccctggtggtccagtggttaggactcctggtcctattggattggattactggtcagggaactgagtgagatgccacaagctgtatggtgtggccaaaaaaaaaaaaaaaaatactaaactaaaccaaaccaaaccaagagactcaaaaacttgttgaatgaaagaacctagaagcaaaggagtccgtaccacatgattccacttttatgaagttctagatctggtgatggagagaagtgtgattcccactggggcactggctgggagaagcatgagggaactttctggaaatgttctgtcttgatctgggtagtggacccctggtcgtatgcaaaatatgcaaaaattccacaattcggacttgtggaaatcttatatacagtaaactgtatgtaaattatattttaaaaaattgcaccagagtagtttagagaagggagcgacttcttccagccatatgggcaaggaaggctgcatggactgtagagggaatagcagagaggaaatgacccctttgtctctcttggtggctcaataacaaagcatctaaacaaagcacttaaatggagtcagaaatcatcagtaagtggttttggagattatttgctctctgtttacattgaaaaaaaaaagtttgagattatgtaattgccaaagttaaagtcagggaggtaattatcaagtgtaacatgagtgctctatttttggcctcacggctagctcttctggcccttcattcccttcagctaatgtgattgcaagttgttttgctggttctcttctgtcggaggcggctggatgatgggaggcagtggatggggaaacacagagtggaatgataaatcatatctctgccggggcttcgctgttcacaaagcacctgtgtgcacagcgtctcacttgatgacagcaatctaggaggggggcgggggtatcagtcagggttattgattgcaagcaacagaaaccaattctgggtagcttaagcagagaacgagtgtattgggaggtcattaaatagctcacagagtcacaggaaaactggaaaactagggttagaaaataggcaggaatcaaaggaagcttacttaagtctgggtatttgaggctgtctttgcttcagcagcttaactgtcatggttacatttggaaatcatcgagacagatcttcacgtaagtggtagtgtggacatcgctgatggaaagtaatttgaccagcaaagaagggagtttccaggatggactcattggatgagcagaggcagggaggtaggaagaatgttgaaggtgtgcttggggaactgagtttgttgcaaggtagcagagagctaaagctgggaagggaagcggaggctgtaccatgaagagccttgtgtgtctgggtgatgagttggtacttgagccagtgggcagtaaggatccttggaggtttttatttacttatttattgggctgcatcaggatttatttggggcttccccagtagcttgacttccctggtggcccagacggtaaagcatctgcctacaatgcaggagacctgggttcaatccctgggtcaggaagatcccctgagaaggcaatggaaccccactcca

SEQ ID NO: 60201 - DNA, 961 bp, Bovine  19866881207559
acatcctcgccctgcctccctgagattacaggcgggtcaccttgattgcggtttccaccgttcacaaaactcttcagtcatttacaaaaccatctctcgcctcattcactcccccacctggctcttctcctctgcgatgcatgattttactggcttaagactcagagggcaattttatttccaagttcatggtgggggaggaggacacctaattgactaatgctgggtgtttcacatgcatcatctaattcgagcctcaccatgaggcagtgcagaagtaggattattcccgttttaccaaaagtggaaacaaagactctgaaaggccacaacgcttgctcaaggtcactcagccggatgatagagtcaggatttgaacccagatttgtgtgacttcagagtctcaggcatccctctgtgtctcattcccttatttgatggaacagcatgggaaagtgtgatactaacccagagtcaagcccagggaggacatactgcagactgggggtgggggtagccccacatgtgccggactgttttcataaaagagccgactcatttattaattttacacacatctactgatgtctcctgtaggctggtcctgaccaggaggcagaacagtaaacaattacaacacttaggggcaaggtcagtctggaggccaagggagacttcttggaggaagtgaaagaaaagtctgcctgatgaagcagccagagggtgagatcatctcccactgagggaatagcttgtgcaaaggtccagaggtattgtagagcaaggtcaagtcaggcaagtacaaataattatatatgggagggttgaggcaaaggatgaggcatggaagaaggaggttggaaggccagagacaaaagatactggggggtcaggaaaacaagggttatgatccctgagttgagaaaagtcagagagaaaaagtctgggggcctaggacata

SEQ ID NO: 60202 - DNA, 1974 bp, Bovine  19866881420161
ctgagaaaaggccagaagacatggaggcagaaaaagtgcaagaggaggcagaagccagactacccaggactttatgggttgggtttggagttgggactttatcctgagggtgctaggccctgaaaggaaggttctgaatagggggagtggcaggagaagcaactgaagcaacagttgggggataacttgaccttaacctgggtttgcagagtgctacctcttttgatgtgtctgggattgcaaggggttgcccacacaaaaaagagaataaaagggaacactcgccttcttccctgctcagcaactagacaaggccaggcttggattctgcttccttgcagatcaagatgtagttttacaacctgaaaagtcacttcatgcaggtgccaggatgaggcggggcatggcaggtggggacttgggctgtgaggctctgtcctgctgggcccagccctggtcttggagcagctggagtctgccagctcccactcacgccccagctctggctatagccccacctcacccctgctcagcacctgtgcctcctcccctcctcctcccatctcgtcctccctcagaggactgcagaggcccggcaggaggaaagagcacagaggtcaggggtttcttctgcctacttccactcccacccgcataccaacatacctgcgccagagctgaagtgggactcaggcagccaggtcccagcatcactcaggcctcctgcctgcaaggcgctcaagaagggcaccgaggatcttccctggtggtgcagtgtgtaagaatccgcctgccagtgcaggggacgcaggttcgaatcctggtctgggcagattccatgcgctgcagagcaactaaacacaggctctatggtcctagaggcgcaactactgagacccccgtgtgcctagagcctgtgctctgcaacaagagagtagtgggtgcgaggagaagcctgcgtaccccaaagaagagtagcacccactctctgcaaatagagaaagcccacacaaaagcaacaaagacccagcgcaaccaaaaaaaaaaagagaaaggcgctgaaagtggtgcctccattcaatattacctacactttctgagctgcactccaggcaggggctagagttaagaaggtgttgttcctgctctcccggaactctaggggtaatgggggaaagggtgcaaccatattacaagtgctttacagaggtgcaaagtgcaagtgagcctggaaagtcaggctgattttacttggggaacagagtgtgaatatcaagcaagatctcctccaagaggtgacatttgagctgggtcataaagaatagtaagactgactgtaggaaatgctctttatagcagaggaaagggtaagaattaagggaactactgggagtgttgggtgctgtgctcagcaccctatttattcatttaatccttatgatgaatctatgaagaagtattataattatgcccattttcccagatgtggtaactgaggcttagagaagggaactgatttatttacaaacttccacatctggtaaatggcaaaattcagacttgaacctaggtcttccatgctcttaacttctacgtagagtggtttgggcaaaggacatgtggagaagggtagccggtgagactggggggtggggagactgctgggggaggcagaggtttgggtggtagaagccttggtgagaagtgcagcctttatccagagagcagtggggagccatgcaaggttcattagtgagggagggagtaaagagggatgggacacacaattagctttctgtttttatttattaccacttttaagtgacttccctggtggctcagatggtaaagcgtctgcctacaatgccggagacccaggttcgattcctgggttgggaagatcctctggagaaggaaatggcaattcattccagtactctcgcctggaaaatcccgtggatggaggagcgtggt

SEQ ID NO: 60203 - DNA, 946 bp, Bovine  19866881660748
cacccctagcagctccgccaacctgcgctgagattgccccaggctcagctctgcttccctggcttattgattgaggtgattcttctgtcagagccctgaaggagaccaatctatggtcaacaaacagctccagggacaatccctaagcgcttcctatctgccgttctgactccaaggtccaatggatctagtcagtccccttctcaaggagttcacagtctcctgaggtagacagacatgtaaacagctaatgctaatgcaagtatacatgaatattcaataggcagaaacagcctccgtgctctgggagcaaagagggaggatttgctggaaaccttgaaagtggtgtaggagagcaggggaagggcaccctgctgaaggaacagttcgagcaaagacacgaggtatgaagtgcagggctcattctctgaagggcaaacagcgcagtgaggttaactccaagcaagtcccaagggagacagagagcgatgagggtggaaaaagaaggttaagggttgggccagaccatgagggccttgaatgccagaatgaggagtgagatggcctggggaaggaaggaaggatgtgaactctggggacttctacctggggccaattgagggggtgtcctgacccacaccaagagaggacgtgccctgagttcacccttcaaacaagcagtgtcttaccctcaaagctttcccggcttgacgcttccagctctgccatccttccctcccccagccagtcctataagtgagtccagatggtcattcctattttaggtcggggtgtgtgttggggggaggggtaacctatgagctctatcaatcctctcctgagctgtctgttagaggagcttcttccaggacactgctgtgatcctctgagcctggaagggagtgttaggccttggtggagataccccatctgtctgtgcgtgata

SEQ ID NO: 60204 - DNA, 797 bp, Bovine  19866881687193
ctgaacacggaagaattgatgcttttgaactgtggtgttgagaagacttttgagatccaactagtcaatctaaaggaactcagtcctgaatattcattggaaagactgatgctgaagctgaaactccaatactttggccacctgatgcagagaactgactcattggaaaagaccctgatgctgggagggagggaaggcaggaggagaaggggatgacagaggatgagatggttggatggcatcatcaactcgatggacatgagtttgagcaagctctgggagttggtgatggacagggaagccaggcgtgctgcagtccatcgggtcgcaaaagagtcagacacgactgagcgactgaactaaactgaccccggggtccctttatttttcctccttttttctcactcatttttaaaattgaaagtaagtataaagtataaaatcccatctcaactatctaccttagaataattcctttacctgtcaaaggagacgagctgttcctctctctgcctctcctccgcctagaaagtagatggcatcattgctgctgttattcacaaacatgtcacagacacagacacacacactcacatacacacaatggcctcctttagctacagtatgaagaagcaatatcctttggctctgataggatctataagatgacacagggctctggcaatctgtcttgactgagaaataggtgtgaagtagtcaaaagccaatctgcactccactttgggttcagaatcaaaactatactaagtaggtaggagagaacaggtaagagaaag

SEQ ID NO: 60205 - DNA, 595 bp, Bovine  19866881915991
ctctggtgtgtgtaccccctggtatagatcccactgtgtgaccgtgtgccccccacccccagtgtagtgcgtcatcccctcacatgtatcctggcgtctgtctgtccttccatccatccacatacatcccaggacgaatttcccctgcacctgggcacccatgggtacacccacacacacaccctggtatgtacatgcccctccacacgcacagctcagtctgtgtgtacttgccctgcttacagatccctgcagtaagcgtgcttcccctggctcccttcccgcagagtgaagacctcacaggccgagttgtggaggacatggagggcgcctcccaggccaaccagcggcgcatgaacgcagacccgttggaggtgatgctgctcaacatgggctaccggatcacaggcctgagcagtgggggcgccggggcctctgacgacgaggacagttcggggagggccaggtgcagtgccggcccagctaggccctcccagcccccggcccagcccccgccatcggctgcatcctccgccctgggcaggaggtcagggggttctgttttggtttgtcttccctgtccctccattttttt

SEQ ID NO: 60206 - DNA, 2587 bp, Bovine  19866880410075
tccctgggttgagaagatcccctggagaagggaaaggctacccactccactattctggcctggagaattccatgggactgtatagtccatgaggtcacaaaaagtcagacatgattgagcgactttcactttcactttataggcgtatgaacacttttgcacataataaaaccatagcattattgaattccattggatagttttaaattgtcaaagtgcttaaaacattataatcatatttttctgtcttctcaatgacctagaaacacaaggcaatatctccacttaacctataataagattattttttaaaatgagatttgttaatgccttgaaatgttgggcaatattaattttgttattcatatggttcaatatgtgcctagtgtatatgtgcatgctagagagatcaaaaatgcaaaattttggtcaataatattgtgcaaagccacatcatcacaccacagtttaacatactttcatttgatttagaaaaagcaatttatgaaatagccacaaaatctagtaagcctgaatcaaatagagaaaagatatacttggggaatttccacaacagatcctttagtgctttcacctcttattgatatattgataatagttaataatcatcattttaacctgccatcttaactttgtatatggtttaccaagtaattaacatcatgaattctgaagtacatggtttcaaaaaactggtcttaccactagcttcacattgttttgaaaattattgaacttctctgtgtcaccatttcttcattgataggatgggaataataccacttactttacaagcttgctggcaagtttatatggcattataccagcaaggtgcttagacagaattgtacatgcattatacactcgtatatatttaaataccattgtttatgcaatgagctgatatggaaagggacttctcagactctagtaacaatatcaaccaaaactagcaaataaaggcaacaattcaggctccacataagcaggttcactgcatgtgcgtgagtgctcagccatgagtgcccagtgttcttcgtgaccccatggactgtagtccaccaggctcctctgtccatagacgtctctaggcaagaatacttgaatgggttaccattccctcccccaatggattttctcaacccagggatcaagcccacatttctggcattggctggcaaattcgctaccactaagccatccgaggggcttcccttgtggctcagctggtaaagaatccgcctgcaatatgggagacctgggttcaatccctgggtagggaagatcccctgaagaagggaaaggctacccactccagtattctggcctggagaatcccatggactctatagtccatggggttgcaaagagtcctacatgactgaatgactttcactttcactttcaagtcacctgagatgccctggttcactgtagtaggcccaggagtaatatagaatacagtagtttgcattgatgataataatacatcaggtgtgttatttgtacgaaagacaatgcatttttttgaagtatgaattcatagaacacctaggatacacatattccaatatatatttttccactgtgttctgtacttcatcttcagttttcagaaaagaagtgaagggattgactttaggttggaggttacacaggtccgctcttacagcaagagacagagagcaggggagtgggcagctatgtgaaaccctgaggtctggtgacaggaaattagaggtttatctgctcacttagtttggtggcaacattcctaggaaagggtaatgtgtttgctatttctttaatgctattctcttttccaacgacacttaactaaactctgcacactgtgaacactccacaaataatctggggttttctgaagtttccattactctaggtcataaaaggaaatatcagtagttacaaattaatgaatattttctatagtttataaatatctaccattctgatggagttgccagaaaggacagaatagaatttattcctcttactcattacctacataggagcactcaactgaattttgggatgaaaacagtactataaaatttacttttaggtagaaatcattaacaaatattatttttgcttttagactgtgaagatctgtacagcaccaagtcaaacattaaaataacatttgattgttatttgaatttaatatctattaatttgaaccaattcttgattttcattttgcttctatttttacgtacagtgttctgaaatgtccacataatccttgaagtattttgtttagcttgagaaggtacaaaagcttttaaaatgaagcacaaatagcttggcagatttcacaagaatatttactgttaaaagatctattttcagaaagcattagctttgtcatttccctcagattagaataaaatataatcatgtaaggtagaatgtgtcatctcttaaaaaataatttatttttattccttacttgactcccattctcctttttatagcatcttttttatttcaacttcaacaaagagccttagcgtccttcagtaagccagaatgcactcat

SEQ ID NO: 60207 - DNA, 3683 bp, Bovine  19866880625868
ttccaaagacaggcaggcagcagaccagctgagccaaggcagggaaagaaaaatggtttttttttcaccccaaacaaaaagaaattgggaaccagcaaacccactggttaagaataaaaggctcggttgggaactgaatgggaagcatagtagcactggtctgaaggtataaacaatattaaaaaaaaaaatacaaaaaactaagttagacaaaaaaaaaaagaaaagaaaaagagagattctaagaccttaaacatgactacagttccaaagggtaaaggaattttcccactaaagatgacctttagaatgtttccataccagtccaatttaaaggaaaacatctaacatctaacagaagcagtttgatgttatttcttaaatcaactgctgaaaaattctccagacacctgtcatcagggtctaaggctcttttctgtagaggaaatgaacttgagtcatttgacaaacaaagtattgcagattctggtcgtgtggttagatttagtgtgcttccattccatatttgagaatagaataatgaaaagtttagtatgttctaccaaatgcaaacattcacagacacatacatatggacatatacacatatttcagacatatggttagacaaatatattgtcaccctgcttatttaacttatatgcagagtacatcatgcaaaatgctgggctggatgaagcacaagctagaatcaagattgccaggagaaatattaacaacctcagctatgcagataacatcacccttatggcagaaagcaaagaggaactaaagaacctcttgatgaaggtgaaagaggagagtgaaaaagctggcttgatactcaatgtgcaaaaaactaagatcatggcatttggtcccatcacttcatggcaaatagaaggggaaacaatggaaacagtggcagactttattgtcttgggctccaaagtcactgtggacagtgactgcagccgtgaaattaaaagacacttggtctttggaagctatgacaaacctagatagcatattaaaaaacagagacgttactttgcctacaaaggtctgtatagtcagagctatggtttctccagtagtcatgtatggatgtgagaactggacaattaaaaaaaaaaaaaaagctgagtgctgaagagttgatgtctttgaactatggtgctggagaagactcttgagaattccttggacaccaagaagatcaaaccagtcaatcttagaagaaatcaaccctgaatattcactggaaggtctgatgctgaagctgaagctccagtactttggccacctgatgtgaagaactgactcattagaaaagaccctgacgctgggaaagattgaaggcaggaggagaaggggaagacagaggatgagacggttggatggcatcatggactcaatggacatgagtttgagcagactctgggagattgtgaaggaccatgaagcctggcgtgctgcagtccatagggtcccaaagaccaaacacaactgagtgactgaacaacaaagttaggcaagtgataagtttaaaaactgtacccttaattgttttaaccgtttttgtttgtttgtttacatttctgcagcttaagaaattactgggtaaagtactagtaattatttcttatcgttggtcaatccaggtagagtttatagttttggggtatatttaatttacttatggtataaaataagaattaggttttgaacttttatattttacctgacatataatattttgacctttaatatctagtttcatactcaattcagtctcttacttagggaagtcagatgcatagaaaaataatacccaagaagtttccaagtgatatttatgagtaaattcatatatttttctaaatggtagttgttatctttttcttaaatatatttcactaaaatttttcactgaaatagattcactaaatgttctacacttactgtaaatcaaaaccactcttttatcatctgattaaacttgggtgaactaggcaacacctttggcctcaatttgtatctttatttaaaataaatgttatctgccccagggaaaggggggcagaataaaatcagatcacagaggatagctcaccatatctgacagatatgaacacatagagtggagtttagcaaatttctatcaatgaaatataattattttctctaaaatggtgggtcaggaaacaaatagaaaagtcctactggtcaaattggatccaaactctgtcccaatctccagatactatattggggaaaagacattagtaagaaaaacctcacagccttcactaatatgctcccctcctccacacatacaaacacatatgcagaatgagagaaagggaatcaatgagaagagaagcagactggagagataaatgaaaaatcacttaaaaatagaatatcctgccagtcactaaggatgtccttatcttgatatcttagtgtttcggaagtaggtgcaggataaagtgctagggtctgccatttccagggtttgaggctggagagagtccacattcagagctgttatccttagaaacatgattaacccaagcctcagccaggtccaactctttgcaaccccatggactatgcagtccatggaattctccaggccagaaaactggaataggtagcctttcccttctccaggctatctttccaacccaggggttgaactgaggtctcccgcattgcaggcagattctttaccaactgagccacaagggaagcccagaaacatgatacccatctgcattttgttagcgctcttttagagcattctgcattgagagcatccccacgagttctgtaggaaatcttggttcactagtttctacaccacccctccctgcaccgataaacaagaagcttgactagatttcaagttacagattagaaaaaaaaaatagatttctttttttttctgataaagtgcgaaaagtcaaggagaaaccaactgcattttactaggctgaataaaagaaagtgatctgtctataaaagtataaaaagagaagaaatagaagaggaggaaaagagaaacatactatttaaaactactgaagaatataatctagaagaaagcataattcaagaaacagaggtataacagaatcatgaatttaatatgtcagtttatagataaaacaatagcatgaggctgtataaatcaggtgtgtgtgtattatatatatatattctatattatatacatgtatatacagtatatatatataataatatacatgtgtgtacacacatatattgtatatatacacacacacatacatatagcatatatgtacatacatacaagcacacaacaaaatcagtggtaaatctggtcatttctttttcttttcagcaaaggattaagtatttaacattaaaattcagcatataaaataagtacataaccagaagttcttaaggttttttatatttatcctcttatataccctctcttgaggatatatgagaatgagagaatgagagaaagggagcttctcaggtggctcagtggtaaagaatccgctcaccagtgtaggagactcaggagacccaggttcaatccctgggtggaaagattcccgaaagaggaaatggcaaaccactccagtattcttgcctataaaattccaggacaaaggctt

SEQ ID NO: 60208 - DNA, 1028 bp, Bovine  19866880915208
atgctgctttgaatgaggatgaaaagggttaagtgaaaactaccgcactgggagtttcccaagttcctgtctcctttgaggcagaggtctcacaatggatgtaaatgtcatttgtccgagtgtgagtgaaagtcactcagtcacgtcagactctttacaaccccgtggactgtagccggcccaggtttctctgtccatggatttcttcaggcaagaatacaggagtgggttgccattgtccaggtatattagattcaaaatattgaaaacactcctccaaaggattgcccttaaatttccaagttaataaagttatggaaaatatgagaatactttggcagagcaaacagagaaaatccaaagtaagcttaagaacaataatttgaaagtccagaaaattaacctgctttgttagttgcctttcatacttttcatgggaatctatatttggaaatattccgggtcacaggaagaagcttaagggaattgaatatatcaggttatatggtgccctacacaaattgcatgtattcattcaaagaacggttattaaacaccttctataagtcagacactactctgtcctggatgatagtaatagaacatttaaaaaatgttcctttgttctcaaagtatatattcacacatccatgtgtgtgctttcatgggataaaagagatagcctctcagataatgggggaaaataaatcatttaacaaacagcactagaaaactgagtagcaatttgaaataaaataaacttaaattgaaacatctcatcttacacacacacacacacacaaatccagatggctcaaagatccattaaagatgcagatgtcatgaagttaaaaaataatacataaaaataaataagcactttgcattggaaaatgcatcataatcaaagttaaaagacaaagaaaacatcttgttttcttaacgtgtaaaaatcaccttgacatcaataggaataagaccaacatctcagagaaaattataacaatggaaagattctttgtagttta

SEQ ID NO: 60209 - DNA, 1088 bp, Bovine  19866880934186
cttctgaaagcttacatcagggaaagggaagtcagttttctataccacactcatcttgttcacctccttgtaatttatattccaagaacctgcaaggatttattttttctcatcctcaagggcatagagttagcaagtctccaagatgcagaaatgggtcaaagcaggacaaggaaagtaaatctcagttcaaggtcttggaagacccacactctgcttcttcagaaaaggaggaagcttcacaaaacgtcaggctgaaaaatataggtaaatatcaagattctgatatgaaatattgatgcaaatttaatacttgaattatatatagcttccagaggcctcagtgacatttttactagaaggggctactgtttgtaaggtaatgataaagaaatcctttgagacatatagcattcaccaggatatttaggagaaaacagagaagaggcaattggcagtaactgcatcagaaaatgatggtgtttgagaaaaaatataaaagtggcatttacttttactttaattgcatttatttttcaataagcagggctgtcacattgttgaaaatgtgaaaaatattcagtaaagtctccccgacacgcacattccccaagcattcatgccctgtctatggaagccatcaatattagcaatttcttacatattcctctggagatattctatgcttttatctaagaaaatatgtttctttatattattcctcctactttacaaaaacaaaagctatcatttcataacactgttctctttatttcacttagcaagactcactatgtaatgagacataatagtgtttcctccctttttaaaagcagcagcatagtccaggccacggacgcacaattattttattcacccagtaaatggaatgcttctgattttactctctttctcctcaaaagaggaggagtaagaattagttgattcattcattggcctgagaaagcctgttctctactctgcacatttgggatcatcattctccaaggtctaagtctgggcaggaggagcatcacctaagtatgtcatatcagtaatggtgttgctgccattcacgatcttcttat

SEQ ID NO: 60210 - DNA, 1409 bp, Bovine  19866881022977
acaggctctggattaattaattattagttaatcaatagcagacatgcctcctaggcttgtattccaggtgccaatatccagggctgcttatgctgagcataatggcttcaataagccattaggtgaaaaccacaacaaggcatttaaaaatgctttgcaattagatcagaggatagctatcatcattaggacatcctttcctcccagtatccatggtatcagtttaagttgctatatcagataggcgagaattttttctgccttttagcattactgtggtcttatgaaatggaaatggctgacctcccaaatgctcattctatgcattcccattagcaaaatgaaattaatttaaaactaagtttatgttcccgtacacataccgagagtgggatggagaagccttttagaaagaaagaatgagtaagaagggggcaaagcccagtagggtatgttatcccatgtgtcccgaacaaaatcagctaccatgtgattcagtttccacatggacaggaaggacggaagtatcaccgaagtatgccgaggaaggcagcgactccgtttatggaaagagtggtgctttcaattattccacaagtattttctatgactatagggtgccaatgctattcttgacaccctaggtagagaagatggagacaggaagagaaagacgagtttgtgttctcatgcgttcaccttaacctctgcgtggatgatatgtggacggttagagcccctttctgacccatcttctctccttctctgcactcctgctctgcccgctttagcagaaagactaatggttagttccctttatagactcagttcacttcagttcagtcgctcagttgtgtctgattctttgcgaccccatgaactgcagcacgccaggcctccctgtccatcaccaactcccagagttcacccaactcatgtcctttgagtcggtgatgccatctaaccatcttatcctctgtcgtccccttctcctcctgccttcaatatttcccaccatcagggtcttttcaaatgagtcagctcttcacatcaggtggccaaaatattggagtttcagcttcaatatcagtccttccaatgaacacccaggactgatctcctttaggatggactgggtgaatctctttgaagcccaagggactctcaagagtcttctccaataccacagttcaaaagcatcaattcttctgcactcagctttctttatagtccaactctcacatctacacatgaccactggaaaaaccatagccttgactagatggacctttgttggcaaagtaatgtccctgcttttgaatatgctgtctaaggttgttcataactttccttccaaggagtaagtgttttttaatttcatggctgcagtcaccatctgcagtgatttt

SEQ ID NO: 60211 - DNA, 1780 bp, Bovine  19866881029112
tttagttattgaaatgaaagctgtattgatgtgaatttaaaagagactgggaaggaagacatgtgaggcagaaaaaacagacaagtgctttaggaaattttcctataaagaaaatagggtggtagatagaaaaacaatgacggcaagaaagcgcttttccccctattttaaatgagatggaaattttcatgttcatctgtgactctccatatttccatatttcagtggagagagaaaaaaatgttgatgcaacctgagaacatccacttctctccaacccctacagaaaagtggttggtgggggaagtggagaaatctagtgtataagtggaaagggctgccctcagtaagaacttgaataatctgaaaggaaattaattaacactattcatgtctaacctctttgctaccaaaaaatctttacttatcaactcaacatttagagatcaatattcgcattatgttttttcgttttgagcaaagttaattctaacgtgttcccttgttctgaaacattttggggaaaagcacctccaattaagccaacagctttctcacttttaaacacaaatgttttaaccctggtaacactttataattagtaaaacactgactggatttcttttaattactataatcctaatactatccccatggtgctgggatggccagatgttcagcttataatttacaataattgtgtaactggacctctaaaaaagctttatttttccacagaaagtagctcttttcgtggtgagtataaaatttcaactggaaatgacatattccttctttgaatgctgtttaatttttccaatgttccagtctttttttttttttcaaactgtaacttttctttttttactgtaaaatgaaaaagtatcttttcataataaagaaaaaaagtaaaattaaaagcgagtgatataacagccttgtgattgtacttaattctaccatatggttttgttcgtggatgtgtgtcttttaatcaggaataaaacaaagggtagaatgtaacaatccctttcagttagcatgttaatttctcattttaacaagaccttctttttgagatacaatagttgacatgaatcccataagtttcattaccttttttcttgccctttttaaaaaaacagcttgcacatctccagcattgcataaaatacccatttgtaattatgcttaacctttctgaagcctctgggtatagtctgctcatttaatctttaacctgacaagccttgggggggttgtgaaattagtattagagacacagataccataggccaggggtacaaaagggggtaattaagaggaggaaagaaaagaaatagaacaaaactagagggacaagattatattatggtaggtgtcagggaacagcagggacagtagaatgcaaatcattatagacagagttcaggaaataattgaagctatacgtttttagaacaaaaccaattgaatcataccctgtcctactcattgaaaataacttgtggcaaattgatctaaaataaagatttacaaatataatcacccaaaatatggattggctctgcctttacagaacattccccatgcgcattaccccatgtttttactaaagcataacaaaggatatattttaagtaaaactcagatccttgcctgaaaagctactttttagtgatgaaggaagcatcctattttttttatctatacagacattcattatttttgtattgggtattgagaatacaacataagataggatttctttatatcacat

SEQ ID NO: 60212 - DNA, 1087 bp, Bovine  19866880142478
tgcttttgaatatgctacctagggttggtcataactttccttccaaggagtaagcgtcttttaatttcatggctgcagtcaccatgtgtagtgattttggagcccagaaaaataaagtctaacactgtttccactggttccccatctatttcccatgaagtgatgggacctgatgccatgatcatcgttttctgattgttgagctttaagccaactttttcactctccactttcactttcatcaagaggctttttagttcctcttcactttctgccataagggtggtgtcatctgcatatctgaggtgattgatatttctcccggcaatcttgattccagcttgtgtcttccagtccagcgtttctcatgatgtactctgcatataagttaaataaacagggtgacaatgtacagccttgacaaactccttttcctatttggaaccagtctgttgttccatgtccagttctaactgttgtttcctgacctgcatacaaatttctcaataggcagatcaggtggtctggtattcccatctctttcagaattttccagagtcaataaagactttttaaaaacggtctgcatcagaaaaaaaaagatctttaaaaaaaattagctgataataaaggaaaaaagatcatttaaaaaaaactgctttgatgaaagggattggctcaatcgatgaaatttccctgcctaggggaggctgggacgggaatctctgaacagaggttcatgcccatctctcaatggtgtgtcttgacggctttgtcctccgctccccagtaccccccattttccagaaggtggctgatgccactgcagactttgagaccccgttctggggtgaagaggcccggggtggggtgacggaataccgggagatcgtggagaacaaccctgcctacctgtactgcgacaccaatgcggtgccagccgcggagctgacctggtacagaggggacctgccccctctccatcgaggacgggggtgtctgttctgcaaggtaggccagggctgcgtggaagagcgggccctttacaggcaggcaccagggtcacacccacaccagggctggtcgc

SEQ ID NO: 60213 - DNA, 1339 bp, Bovine  19866880356123
caacctcggaaggctctcagaagaacaaggtctttccagcaccactattgatcacttactataagggcacttactttcctgggctcaaagccgagaggtgggccccattttagggccgtggaaacaggctcggagactcagtgggggtctccctgcctccagagtcgaccctctcaacctctgcattcctgtgatatgtgcatcttaggggctgagatctctggctccagacgtagtgcagctgtggcctcaggggcagagggatgacagcgttgggcactcaggtctaggacttagcctgaattgaatggatattctggccctcccactgagcagctgagtgaccttggaaaaatgactctccctctctgatctctgagctctgcattctcctctacaagatgaggaagacgaacaggagctggtttgaagtgccaggagccccagaaggccccatgtgtcaccctgtggccgtcggctccctgccggtctgtattgtcacgtctttctttatttcggtggccccgcggggacagtcccgccacgaatcgcaggtctgaacccggagcagatcaccgccaccctcaacagcagcgtctccctgccctgcgacgtccgtgctcaccccagccccgaggtcacttggtacaaggacggctggaccctctccctgggagaagagatcttcctcctgcctggtgcgtaaactgaggctgagggcctggctcggagactctatggggaagctgagtggcctccccaaatctgggatagaactgggggtctgggagggctttaggattgtgggcgtagggtctggggattggggcctgttcactggtgccaagcgctggctcccccccgacccgccaccaccacccctcgcaggcacccacaccctgcagctgactcgggttcagctcttggactctgggatgtacatatgtgaggccctcaacgccgccggccgagaccataagctggtgcagcttagcgtgctgggtacgtgccatctgtccccccacctgcactgtccccgactccttccatcaccctcacaccccttctccagcacagtcaggagaggggcagccggccccgggggagcctgggacacaccgtgccgtctgctgcagtggtgtctggggcaccgtggggttacgttcctggttactagactcggacgcccttgggtttgaaattcagctgtgtgcttccttgctctgtgaccttgggcaagtcactcttcctctctgagccttgagtctcccatcactataaggtgatggttggtttaaggattagatggtggtatgtgagcatttaatccagtgccagg

SEQ ID NO: 60214 - DNA, 1438 bp, Bovine  19866880366115
gttgggggggggggtcgcccctgacctgtaagattcgcccattttccaggacctgcagccgtgggcttggggagaaaggcagcccattttggagccatgagatggtgggcgcagggttgcccaggactgggcaatgcaggctgacggtgctgttggcattgacggtcacctcctctacaagctcctccgtttcacccaggatcacaggtggagctgggggcgaagagggtgagaagcgggcagcctccttgggaaaggccccaggaggagcagggcgtggagacgagaggtcttggtgccaggtgctagctggggctccttgaaccctgcccaccaagcccttctgagccctgggacagctaagaagtctagggcacagagagggctatgattcactcaaggtcactcagctagcaagcaactcatgtgtgctgtcactcagccgtgcccaactctttgcaacctcatggaccgcagcccgccaggctcccctgtccctgggattctccaggcaagaatactggggtgggtagccattcccttctccaggggatcttcccaacttgaggacggaacccacgcctcctgccttgcaggcggactctttactgtctgagccaccagggaaggcccaggaagcagctcacttggaatctgaacctagtccagtctggtttcagagtccgagctcgaaagccctgcatcatccatttggagaaaggcaagactacgcctgctctctacttgggcccccttctggaggtggggggccctcatggggccttagacctgagcctcccccactgcccacccccaggccaggccactcactcagtaccagcagctcgtagtgcagccagtcctcgcccacctcgttggaggccttgcacgagtaccttcccgcatcctccgcccgtaccagggggatctgcaggacccggcctcctgcagggacatgggggagatagaggtctgagcaagaaccaagaaacctgccctctcccctggaggagatctgggacacatcactgccccactccccccacataacctgtgacatgcagagaagcacctgctgtgccccggtcacggcacaagagggccagttaaagcacagtaatggcttgctctgcaccaggccctgggctgagcattcccccagcctctgactctgtgtgttgtcacaactcccatcttacagatggaaaaactgaggcttcctaagagtacttggcagggctgagcccagctccttgatgaaggcagagagaagaggcggagagctgggcacatgtctgggcagaggctctcaggaggctggagtggttggaggtgggggctcttgaggggcatcacctgggaccctctgcgatcgagagccagccagggccagactctggcatcaagggggctggaacttgtgtctagcaggagtggg

SEQ ID NO: 60215 - DNA, 1664 bp, Bovine  19866880455043
cagactccccttccctgcacagtcccgcccgcgatcaagactgggctccccgacctgtccatcaccgagggtgcccacgccctcttgccctgcacggccaccggcagccccgagcctaaggtcacttgggaaaaggatggccagcctgtgtccggagccaaggggaagttcaccatccagccttccggggagctgttggtgaaaaactcggaggtgagggtctggcccctgggagcagagggagatgatagtcacagcaggagcagcagacacctgctgcgcaccgactgtgtcatgctctgtgctgagccccgcgcagcttctcaatcctagaatctgggcaagcaggtattatcacccccgctacagatgaggaagtgcttccccggtggctcagtgcttaagaatctgtctgccagtgcgggagacccaagttcgatccctgggccaggaagatcccctggagaaggaaatggcaacccactccagtactcttgcctgggaaatcccatggacagaggagcctggtgggctacagtcctcggggtctgagtcagaagcaacttagtgactaaacaagaacagatgaggaaacagcttcagcatgtacccaggtgtccaagacacgctgttgccaagaggcaggatggagttgaatcagggcctctgtggctagttcctggggagggaaggagccctggagggagggagagggatgcgtggcaatgacttcatgtccccaaactgcccctactgttctcaacctgagccacgggcgtgaacgggacccgggccccctttccctgtcagcatgcatcatgtgctataatgaagaaaagttgctctccagtcagatgggcggctggctgctgggcgggcaaacctaagggagtctcagggccagggatcctgccacacagggaaccagatgtgcagtggtgagccctgttgagatccccgtcgggacgtctcctctcagaggactggcctcaggggtgatggatgagcgagctcaggtcccgtcctgcgcacataagaagtgctcagcaaatagtgactgttacaagtgtgtggtcaggcctggatgataaaggctgaaaattcaataaacaatcgaatgaagaatttttttaaaaagggaattttatttgagcccaactgaggattataacccaggggacctgttagacatcaaagacacagtcgcatacatttttaggacaaaaaaaaacatacatcaaaatgagatacaggtattgtagataaaattcaccaaagccacatactccaggtaagcacatacaaagtgagcagcgagtcactgtgacccgcttagagagctgtaaaagaatgcttttcttttaagaagttatgttgctagcatcagaggaaagaaaaaagattggtctttacggccaagcatgcacatccgtctttgaggaggtctggttaatgagtaaagcactttagggaggggaaggggaggcccaaaaagacacggagagagaatctggtgtttcatctttcttgtcctggccttaaaatataaacttatttcatcaaagcacatagccaggacttccctggtggtccagtgggttaagaccctgtgctcccagagcagggggcgcgggttccatccctgcgtggggaactaaaatccg

SEQ ID NO: 60216 - DNA, 983 bp, Bovine  19866880513944
gttgggggagagcggtccctgaggctctaccctgctgggcctcactccttggaggagccataggccttcctcagattctgaaaactcaacccgcgaaggcctggttctgtgctggtcagcgcaggaaggaccctctgagaccttccctcctatggttggaagcccggggctcagagaggggaagggcctttttcagagtcacacaggatatcgttgggatttgcatgtccttagctgcctgtctcttcttaccagtctctgagaggtttgggggcctctttctgggcaagattcagggggccaagcccccatccggaagcctggatgaggccgggggaccctggtgggggcagtgcagttgtgtgtctccagctgtcctgtgtttgcagggagtcagggaacagcagctgggagattccacgggcctccaaggccgaagaaggcacgtatgagtgcacggcagtcagccgggcggggaccggacgagcaaagactcagatcgtcgtcacagggtctgtccccttgggcccgtcctgactctcccctgtaggattccctcccaggctctccccatctgtgggtgagtgtgccagcccgctgctaggggcccgtccgtcatccggagcccgacgcccacactgcatctgcgtgctggcctccggtttggactgtctgccccacgaatggcctgcggttgcaggaaggttgagaacccctgctcaggctctgcctcccagtccccagccttaatcccacccttgacttcttgatcagcccccaggcccttacaagggccaccatccaccttgtccccaacccttaatgcctccaggtcctgccaccatggcaacattgaactcaggaaggttggaaaagccacagatcctcttacaatgaaattagctttattttaaaaataatgaacctaagctgccttgatgggctttcccagtggctcagtggtaaaaaaatccacctgccaa

SEQ ID NO: 60217 - DNA, 2478 bp, Bovine  19866880538071
tatgtcaggctagttaaggagtgagcaggggaccaggttcagttcagtgcagggggaacagcatctcccgtgcgatctcaactgggtttttacaaagtcattaacaagagattcacccaagtgttagcaacagtcctcggagtggtgggagcgtggaggagagggttcttttctttgaactcgtctggcagttctaaactttctctgggtgtccggtgtttcgtgagagtccagggtggggcccgagaggggctggatgttctcactgaccctcccctcggctcccaccccgcccagctgaacaaggcgttccaggccgaggagtcgcccagcgtcatctactgtatcagcatgcagtggttccgagagtgggaggccttcgtcaagggcaaggacaacggtgagtcagggggacccggcccatgcccgccgcaccccgtgctggcagggacttggggcttgcccacctcctgggagtgtcccaggaggtgtgggctggggtgcccggatctgagcccgcccagcaggtttttggtgccaccctttccagctctcaccctctgcacagagcacgggtgttctccccgccccggtcgggccttctggttgcagcaggacaggagctatctcgtgctgcccgttccgttcctgcccctctgccctgtggtgaccagggtgactgcccttcctcctgccaggccctttcctctggggactccgtggccctagatagatgttagttgttcgatgccttcagactcttaggacttggatgctgttattctccactcacagaggtggagacagcagggccgttcattgagaccctgggctcgctcacctgcacgcggctctctccctaccccttgagtcccacactcggctcccagaccagggtttagagcccagcggggccagcagagcccggagcctctgaatgttcatttcaccctttcgagcacaagcactggacaggacgtggggaaaggaggcgggtctcactgccatccacacaccccctccccgcctgtagcggcttcgattgatcaggaacccggctccagagtcacagccccatctcaggccagactctcagatgagggcagggtccagctgacactggatgtccacctccccacgaccgcctctgccccaagctagggtctgaaactggggctggtgtcctcaggatgcccctctgccgggtccagggacaccatgagtgcctccagcctttagactcatgtagatgagcctttggagccctgagtgcctaccccgtaagaccttgaccctgactcctggggcccagcaccacctctccagggtcacaggtatgatctcacacctggagagcagctctcatctgctgagggctggaggctgccagtggctggggactgggtttctgcccaccgctgcagaggcccagaggtcctgagcccgagctgtctgttccagagcccccggggcccattgacaacagcaggatcgcacaggtcaaaggaagcggccacatccagctgaagccgggtgaggctcagccctgccctgccccctcccagccggccaggctcccctcctggctcctgggagccccctcttgccacctcctggcttccaggtcctcccaggagcccccttgccccctgagtcaggctgcgacatccatccaagtccaggcctgggccttgagcagagcgatcgaggtgcttagcctctgcgtgggtgccccagcccctctgttccctacccacgccctctccccactctgccacctcacctgcctgtcctttttgcatgacccccaccccaggaaatgaggggctgcagccacagatgtgccctctgggggtcctcaggggatgggcttgcccctggagaaccccaagattcccatttacagcttggcacagaagcccatgattgtcctccctgcccccccgccacctccttggggcctggcgctcccagagcccccctctcagagcccccatactgccaaggtggtggctccagcaagggcaagcccagcctgagcggcagcccctcggaccctgcaggagctgactatgggcagatctccgaggagacctgggtgtacctgaacaacctctatggcggcggccccgagattgccatccgccagagcgtggctcagctcccggacccggagagcttgcacggtgaacagaagattgaagccgagacccgggccttgtgactcggtgggccagtctgtaagtcccctcctccctggcagagaccctcccgtgtccctcaagcattggggagtgccctgcgcacacaaccccccacccctgcaccccctccctgaggctgctcagaagaaggaccttctcgagggatgacccagctgtccccacaggtccccacctttgccctccgccccgtggagggtgtctgtccccagaagagaggctggccgctctggaaacccagatgtgtaaagaggca

SEQ ID NO: 60218 - DNA, 2612 bp, Bovine  19866880549046
ctgcgtctcctgtgtctcctgcatcgctggtggattctttaccactgagccctgatgaggccccaactcttgaatacaaaatatgataaacacacacgaagcatttctgctgcatgcccaagtgagttactagctaaattagccactcttctcataaaccatcattcatacttgactgaaggactgacaggcaaaacaagatcaatcagacttgggtttttggccacgatttgcataaaaatgaagtgaccctgtcacttcaaggaaaactgagtatttgttgccagtgataaaactcaagctttccagcaaaaaaactagaattatggaaaacttgtatctgacactgtgaacttgacagcttcctaatacttctgatgtgagttttattgcacttcacagatactgtgtttccttcgtactgtgagcttacgtgagcagggaccatgacggccatgttcatctgatggcccgctcactgatactgttgagtggatggaaggatgggagggtggacaggtagatggatgaggggtgcacaggtgaatggatggatgaggaagaggtagacagatggggaggtgggatggggaggtgattgggtgcaagagaggctaggagaaactagaagatggttcacacagcaaagtgaaagtcactcagtcgtgtccaactctttgtgaccccagggactatacagtccatggaattctccaggccagaacactggagtgggtagcctttcccttctccaggggatctttccaacccaggaattgaacccaggtctcctgcattgcaggcagattctttaccagctgagctataagagaagttctcacaccaacagcggaaggaattgacctcacactcttggaagcaagaggaccaactggaaggggcgtaggaggcaaggagctctgggacagggacccccacagctgaccccaacgtgtcagatcccatttccagccccaaaccctgcccacacttggtacctttttggccccaagcttcagcgccttcttcctggcttcctcaaagtcttccttctggccgatgttggcctgacgagcagaagcagagaggacccatcagcccaggggcagaaagaagagctgagaagaatgtcaccgccacctcgccccaccacccgagggtgagtcctgggcaggtgtctttcacacacaaccgtcttcagatgatttctttggatggctgaggtcacgtaggaaggagaaaggacaagaaccagggtctggggatgctgtactccttggagctgcctgaggctctggaaagcagtttcaaggagctggacaggctgaatctgggcctgtgcacctgggctgtggggttgcaacattcgctgtcactgcactgaaggtctaaagctgcctttgaacccatcaatcttttcccgaaattcccccaaagccagtacaaaggttggcttgtcagcagctgcccgattccctgcttactgccccagccaagtgcagcaacttgattgccccgggcaccagagctggcgggaagcagaggcccaggctaggagcgcccagctgtccgcctgctggagcccgacctctggttccgacagccccgtctagacacagtcatgttttctgctggctacactgtggcctcctgcccagaccttgaccctggattctgctcagcagattccagagtgttcccagagtccagctgcaggtgctttttctgaggccactcagcttttaaatctgcctggtgatagtctgggatccggaccacccattggtgctgccatggctcaaagcacacactccaggctctttgcattcactcaaagtcaccacttgctctcagcagggggctgtgggccagacacttcccctccctgggcctcaccctcaccctccacttgagtggcgtggggtcggcactgttaccagtggtagactgactttaactgcaaaccattcttgacaagaataaacttctcctgtccagtgccccctcctcatttcctctgggaacagaaccttctctcctgggacctctttctacagggatgcttatgagtgctaagtcacttcaggagaccacatggactgtagcccgccagggctcctctgtccgtggcgttctccaggcaagaacactggagtgggttgccatttccttctccaggggatcttccccaacccagggattgaaccttcatctcttacatctcctgcactggcaggcaagttctttaccactgtgccacctgggaagcccacacacaaggatggacgagagcaggtgcttcctgctcactatagggacaagcctccaagggagcaccatactgacaaatgagtggtgagcaggcactcgggccagtgaatgagtgttcccttggcctttccatcagagcctctggggaaagctttcctttctctcagaagactaggggatgaggagagccttgcctgccctgtggagaggccaagaatgacaccaagccgagatggaggcaaatctggataagcacctggattcagccttgcctgaagccatcttaccctggccttcttggttatatgaaaaactgaattatgttggttttcttttttttt

SEQ ID NO: 60219 - DNA, 2507 bp, Bovine  19866880605619
tcgcccactccattgctcaccacacactcaaacagggctgagtcctgggggctgggctcttcaaggagcaaggcattggagggcaggagtctggaaggacagacagacagtcacctgctaagtgactggcttggctgacctgaaaccagccgccatggcttccccgcctggggaacttggaggcagggcatgtgtctccagactgttcccccttcccgtctttggcccccagtgccgactcaaaaagtttctcctagaattttccaccttctaaggtctagctgttgagtttgtgggcgttttaatgtctgcgcctgggtttctccataactcgagaacgttttctaaagtcaccacctaggataacttctgcaatacaaccacatccaaagccctgattagaactgcttgtgtccactgaacgcctgtttcatcacaaagctccacatgacccggcacctaatacaagaaacacctggtgaattcactgctgaaccggctccctcaatcctcccagggatctgttcaggatcacacttgagaaacagggagaccaaggctgctacaggcactatacgggttcagtctcagccagcatgaacttaagcttctaggtgggttttgaaatagtgactgaagtggtttcaaaggccatatattccccatttggctgtatgtccccaatgcccccacctcctaccgagcatctcctgtaaagacctccttgccccctgaggtccggacacaaaagttctggtgctggctttggtgagtgagacccaagcacgtccctacctcggttctgacccaagcaagtccctacctcagttctgacccagctccccgtctgtgagatgggcaagccctcttccaccctgaggatctcacaaagtccctggaaggaccggctcagcacctgtaggcgccctgctgcaggcggaagtccagcttctgtccgtccttccaccaggccacgaggggcttgggggagccactggcctcacagggcagtgaggctggggtgtaagcagtcagggtcaggttggaggggccgggggcgatggctggaggctctggggagaaagcagtgatcaggagacagggtgcggaatgtgggcaggggcagggggtctggtggggctgtgcccagagatgaagtcgaggagcagggtttactcttatccccttcaacccatccccgaggaagcagggaccgggaggcaggagaaactccccgcgtgggtcttccaatgggctcccaaagctggggtgatgggacctttgctcacccttgaggttggcttctccctaactacctctccttgaatggggcctccagggcaaaatttcccagcagcctgcctgaggccagggctcagctgcctccaccaaggtgatcaatcggattgaagagcagattagagcttctggctcagtgattctgagtgtgatacagcttgtacatcttttatcactcaatataatagtacagtagtaactgttccctggtggctcagatagtaaagcgtctgtctacaacgctggagacccaggttcaaaccctgggttgggaagatctcctggagaaggaaatggcaacccatttcagtattcttgcctggaaaatcccatggacggaggagcatggtaggctacagtccatggggtcgcagagtcggacatgactgagcgacttcacttcctagtaagtgtatatgtttgcataaaaataaatatgcatctttgagtatacacactcaaaacttttaaccaatgggcttcatagtcaaaaaaacatttggaggccattgctcttggctcctgacagctaggatgacccagaagctaagcaggacctggccccgacagggagtgggtgctgaaacaaaaaacacaccttccctcgtctacctaccaaagacctggaggtcacgaccctgccgatcggaacctgcagggttggatgccaggcagagatagtggccagcgtcctcggcgaggactggctggatcctcagggaaccttcaggcagaacttgaaacctggaacacagggaggggacccctggttgtgtctccagcaagaccctcccctcggcccctcaattttccagcaagaaggtgctaactcaggagtcctgtaggtttaggccaaggttggggtgggttggggggtcaccgccgtgggcagcaactcacatggcaacctagaatcagaaagggtgagtggggctgcttccagccttccatgctcccaccttgacccagcctctccccaagagccagcaggcaatggtacccccactccttctgagaacagcctctagatcagatctggcaactgccctttcctgggggccatgtctgtactctgtgatcccacccatggccacagccgattggacaggggacaaacacgccccgcaggctgggccaatggaattctctgccctgggaatttggaactgggattcacagacagctctccaggctctgcaacttgtgtg

SEQ ID NO: 60220 - DNA, 1682 bp, Bovine  19866880624984
atgcatgaaggtattttcagggcgaccaacccccggcccctgcccgccccagtcctgtgacaccctcaagcttctctcatcggtcccacctccaggcctttgcacccgctgctccttctgcccagaaccctcgccctcacctctgtcacctgggtaacctctacaacacttttcaagtcccatctaggaagtcccctctttgggaaccccctttgtgtgtggaaagcgcagtttacatggagtcttgtctttccatcaactgtacaacagaggctcagacagggcgctgcagacagggccacgccagggagaaggggttacaggacattggaaaaatagggcagaccgcacagaaggctctggccgtgtgcccctgggcgaatgaactcacatctctgagccttggtttgctcatctgcgaacgttaaagtgttagtcgcttacttgcgtcggactctttgcaaccccatagactgtagcctgcaaggctcctctgtccttgaaattttccaagcaagaatatgggagtgggtagccattcccttctccggggatcttcctgacccaggggtcaaacccggatctcctgcactgcacggggcagtctgagccaccgacgggagagcaacctctctctgagagaaggggtgaagttagagtgctcggtgtgacgcctggcacccagcaagggctcatgagaagcccttttccccctcattttcccagatggatgctaagcccccagtggtcaaacgcttctcctagcatcaccctcaaagcccagccccagtgtcccgacgtgggaggcagagaatagaccctgttgattcccacatcgtcaccacaccactcggctgggttgggaacgtgtcctaaaacatatttctcacaacgtgtttaccttcaccattacgactggctccggccagttttaaaaacaagcttcctttctccagcttgctcccacctccaggctcattagggaaaccggtattttaagaccacacggcccaaacttggagaggctctgggtcagcagcctgtctcaactgctggtagactggctggctccaaagcaagtgacttatcctctctgagcctcggggtcctcatccgaaggatgggtacagatgcctagcaggcagagccatcgggaggattctggatagaaaattcccagcttagaagacagctgggtgtccactggactccctcccgctgacctgccctgagcaccgggagcagcggagctagaacgggctgctgggggctcagtgtggaaggcagggcctagcccctgccccccaatccagtcttcatccctggctgtggtgggggtccgcccaggccccctgctccccctcccacgcccagagccatgttcccgggcactcctcctcccttgcccatagctctgtctgctgggaaagaacatgagagccggtccctggagtccaggataaatgttgagtctgattttgatttccctaaagcaaaatacctctctcctgatggaagctcagctcaaacacggtgggaacagacagcaggggctgcagcccccacagaggcgcttggaggaccccctgcgggtggcctccccgggccgttctgcgggggtccctttccatctgcagggacaaaggctgcaagaatgtcggtcatgcctcccccgcccccac

SEQ ID NO: 60221 - DNA, 1463 bp, Bovine  19866880629524
tctgagctctcagcctgcgagggcagctgggcaacctgatggccgatcaggctctgtgtggcgtttaccgcgatgtcgggcggtgctggcccggccagggacccagcaggtctgcacatctctaaggtcaggaaaagaaaacatcaagtcatggctcagccaggcctagtcagctcttgactaggatggcatcacgtcctgccagcccgtgacatgcctcctttaaaatggttctcattctgaaatatttactgttgctttctaatttcaaaagtcatacatgttcattattcaacagcagaaaatttcggaaaaaaaaatacaaaatttcaggaaagcacagcaaagaatcatcaacactagcagcatcctgcagagataatgaccatgaagatttccagacgtttcctggacaatgcagacacaaaattacacgcaggtaaacacttgaacgtggcttaaagttggagctgtattgcatcatgctgtttaataatctgcttttaatttaatatatttcgatgcactcactttattcccaatgttaacgttttcctggatctaccccaagcatctggtctttaaattccttttacactgagctaaagcccctggtcagtgtcagccaccacttctgaaaccttgttcaatgtgcacagatgtggctgagacctaggagtggtcaccgtgtgtctccagaccgcagcacacacgctctgaagcgctgccagctgcagtcaatgccaggttcaagttcttgctgcgcctttcacaagatgtgttatcttgggctagacgcttgaatctccctgaacctcagtttccccagtttgcgagccagagttggctgtgacctgtacctggaagggcccccgtaagcatgacacaggggaaagtgtggcctgtggtggcgagaggttgagggcaccggaagtgctccatcaaggggcccgacagaaagcctgtccccatgcccctgccagaggtcggggactcggtcactcaccgtttcctgtgccagacctcagagaccagcttctgataacttttgcacagggctggcttcttgtctgtgcggaccaggcctccacactccaagaagaactgggtgagcggggggctgggggagggggcagggagccaggtcagcaaagaagagaagggtacacggcatcatttacaagagctggctggaggagaaaacctgtcctgtgtggggatataccagggccccccagagccataaatacctgtaggtgacttgacagaccccacctgttatggggctgaattgtatccccctgcaaattcatacactgaagtcctaacccccccaccgtagaatgtgaatgcactggagataaggtctttctttaaagactgttgtgtaaaaattagaggaagcatcacccctcctttcatcggcccctgcttagaaaccttcctgaacctgaaggcctctc

SEQ ID NO: 60222 - DNA, 721 bp, Bovine  19866880649736
gtctgggcttatcctgggggttaagcagaggcaggacctggtaggtgtatgtttcagagccccgccctctggccggtgagatgttagggatgggatggaagagaacggggtctgagtccctctctctctttctccccgcctcactctcgtccctccctttgctcgagggcgtcaggatttcccaggtgcagctggcggattcgggcaccttcacctgtgtggccgcgagccccgcaggtgtggccaacaggcacttcatcttgcaggtgctcggtacggagcagggggcgggttaccaggccctttggcctcagggttgagaatcaaggccctgtccctgcccctcccctctgagtggaaccgagggctggccctcagggatgtcaaggcagggcacacactcagcctctggctcattcagtcactctttcattgatctcacaagtggttctcggacacgagggtgccagggcctcaccaggccccgggatacggcagtaagcagaggtggccgctgccactaggaggcccatgaggaaaacagctctgtagaaagacaattaaaattccaggcgactggtgatgccaggggaaggggcggatcccagggagcactgagggggcacctcacctggcctcagggtttcagggaaggctccctggagaaggtgaggtctaagttatggactgagatgagaaggaatagaccaggagaagggca

SEQ ID NO: 60223 - DNA, 1102 bp, Bovine  19866880651674
aggaatccctggggaagacctcaagagctgggactcctctctagacgggagaactcctctgtcttctcatctagaagaaatgtgggttctccacggttcttctagctctgcggcatccgggggccacttggagcagagtcaatttcactccttcccttgtagatttcataatggcttctactgttttcctggccctgtgacagacacgtgacctgcatcggtcctgacccccacggggcgggaactctcatcattcccatttcacaggtgtatcacccgagcccagagagatgacagggcttcctccgggtcactccctcctggtctggcctccccctccccactccattcatacctgaaggggctgaggacgccgtgagccaggctgcccgtctgtcttctaggtggtctttgtgctgacaggggactgtggtgaccgcacccaccctggctacctggcctacgaggagatcgctgccaccagctccgggcaggtgttccacctggacaagcagcaggtgaccgaggtgagtctgccctgacatgctgcatccctgggtggctctgcccatcggctggcttctaggaccagtgctgagtgctcgcctcacagcaggaggcctggtgctcagggctttttgacaccttcttgtagaaccctctcaatcacccccaaagtaggtgctgcaggttccttagttttgccagtaaaaaagcctggggcctgaaggaatagcctgggttttaaactcgggatccccagcaagtccaggctggcaggatggatctagcaaagctcggcagagtagggatgttaaggggagcttctccccagagtcgaggagcccaggggtagctggaggatcaccagggccgtcagattcaggcagtgttgctgggacagcaagccatgcttggggacttggcagggaggggcttgcttgacgctgcggcccgacatgcagggctgccgatggcccagctgaccaggtgtttgtgttctggtctcggtcttggagcaggtgcccctcctcccttccaggctccatcagttgctcatatctctcccatctctcccgctgccccgcacgtccattcctcc

SEQ ID NO: 60224 - DNA, 1441 bp, Bovine  19866880785841
ggctacagatgagatatcgattgcactgaccccaggagagccctttccccagcctgagacgcgtgcagatcagctcggtgcctggctggcggctgccagggccttgctgcctccttccctgtagccgccccggtgcttgggatccaggggaagccaactgtggccccaccaggtgggctggtttgggctgtggccatggcctgagctccatgggctcttggctttcaggaaagggagtagggaagggtgcagttcacgtgagcaaaggtgtgaaggtgggaaaggacagtcagcagagagtctcgagcgtaaggtctggctggggtcccggggagtgggagaagcagggggccaggctgcgggcgggggcgggtgcctgatgccgccatttgggcaggcagtgccagctttgggaccaggcgtgatgcgaccctgacctcctttgctctttgagggtccagcctccgctccaggcagtctggcctgctggcagcttctgttgtctgttcctcctccctctgtttgggcactggagcaccagaagtggaaaaagggatgccctccatccgggtcccagaggaggcttggtgagggcagaagcggtgtcctgccccctccctgcccagcccgccatgctgtgccccctccccagaatggggcagggagcatggtgcactgggagttggaatgtcccaggagaaatcagctgagagtcacaggcaggtgcagcctccttcacccagtcacccattcttggaatcctgcggggcaggaaccaatcacaacgcggagctcttatcggacaagcaagatgccctcgctgacccccggtcatccagggacgctgtggtaggggcagcccaggtggcttgaagctttcttatttgcccaacatgcccccatatattttgaaaagaaggaaggtgggcttccctggtgactcagtggtaaagaatccgcctcccaatgcaggagacacaggttcgatccctgatccaggaagatcccacatgctgcggaccaactaagcccacagcacaactacagagcctgtgctttggagcccaggagctgcaactcccgaagccctcacacctagaccctgtgctctgcgacaggagaagccactgcaatgagaagctcgtgcaccatatctagagagcagcccacgcagcagcaaagacccagaacagccaaaaataaatacataaataaatattttttaaaaagaaggcaggcattcttctttccttttttttaaccctatggtttccacccatctcatcatggaaggcttctagtgcactgggaagattgcatagctttatctgggtgatggttacacaggtcaatacatagggagaaatttatcaagctgtccatctcagatatatgcacttctgtgtgtgtgcatgtctatgcatgtctacacatgtgtatg

SEQ ID NO: 60225 - DNA, 618 bp, Bovine  19866880793744
aaaattcaaaacagatgaaaaaccaatcaacccgcttacattcttgatgaaaatgtggaaaacttaatgggaaaaaaaaaaaacccaaaaccctccagatcttaaaaagactcttttatgaacaaatattgtatgtggtatttttcaaaatagcctttaccactttgcagatggtaccatgatcaaaaatgagtcctttccattttctgtgaattatacttgatttaaagagcggcagggagagaaagagagagagaaaatgtatcctttgctgtttgatgtcacatcgcagcagttttgaagactcctttcccctcttaaaattcattaaagaccccaaagagcctttgctcatcttattttatcacatacgcatgtgtgtgtgtatctgtgtacacacacacagaggctgtgctgggtcttagcagcagcacacaggacctttttgctgcaggatgtgaaatctagttccctgactggggatcaaacccagactccttgcatcaggagcgaggagtcttacccactggaccaccaggcaagttcctgtttatctgctttatagctatcaatatttactctatcagaaattaaaagtgaaagacttaaaaaatatca

SEQ ID NO: 60226 - DNA, 1524 bp, Bovine  19866880798049
acatgaccattacttatctcctgtagtgttagttgttccatcatgtctgactctttgggaccctatggactgtagcccaccaggcttctctgtccaaggaattctccagggaagaatactggagtgggtagccattcctttctccaggggatcttcctgacccagagatcaaactcgggtatcctgctttgcagatggattctttaccttctgagccaccagggaagccctctcttccttattttccatctaattgcaccagcgtgctttcaatgctttaagaccctgctgcagaattctcattgaaattgaaaactaccaaactaccactacaaaggaaccaagtcgctcttagaacgcagaagacagggtccaaggactattgcgtatgttaattatttgcgtgcttctgagaaaactgctttatctacctttggcttattattttcaaatataaaatgggaattataacccttatcttgactatttcacttggttgtcgtgaggagctgatactggtatgataaaaccagtggtaaacttgtcttattaatcattacaatggcccagcacccagcaaggggccctggactcagcagatcctcaaataatggcaggcaatctgaattacatcacaatttccatgaacgctactcagtcttgcaagtgatttgctatcatctgacattaggataaaaatgcagttcatgcttccaaaagtattggctattctttcccaagtatccttgtaactgaactctaaacgcaaaacattttcaagagggatgattcttaacagagtgaaagaattgcacagaaaagctaggggagaggggaaccttgaatagacaacccaacacaacacattagaaaggaaaagaatcaaaataataccatcaaaatttttttcagatctagctagacagaagctctgaatgtttgtgagcttgaaggggccattgagattatctagcttaatgtttcctaaagtctgatccacaggaggtgatctggtttcatgaaaagagggtaagaagtgacagatcttcttaggcatatttacaatgcatatcccaaaccctagtatgaccttatgaatagaagcaaacttagggttccaagaaatggcaacccactccagtattcgagtctggaaaactccatggacagaggaacctggcaggccagagggctgcaaagagttagtcaagactgagcgtaacaacaagggctccgacaagtcctgaagtgaagaagccaattcacccttatttaaccctgtatcccccagacctctctggccatgagccctttccatggaagacctatgaacagcttgtagatcaaacgctgggaaaggccaagctggccccaggtcatgtagctatttgcaaaagactcagatgtcctaactctccacccagagttctcgccattagaaatttcaagtaacagtatggacttacaatttggacaaagatgaggggacaaagctgctgatcaggcaatccaatgggcagcata

SEQ ID NO: 60227 - DNA, 918 bp, Bovine  19866880817953
cgtgagtttgagtaaactcccagagttggtgatggacagggaggcctggcgtgctgcggtccatggggtcgcaaagagtcggacacgacttgagcggctgaactgaactgaactgaactgaataacgtgttaacttttacggtacagcaaaaggattcagttgtacatatacgtgcattctttttcatctgctttgtcgcaggatactgagtaattctccccgtgcacacagtagggccttgtcgttcagccattctctatataatagtttgcatctgccaagcccaacctcccggtccatccctccctcactctccctccgtcttggcaaccgcaagtctgttttctaagtccgtgagtctgtttctgttcacagataagttcatttctgttgtgtttttttagggggggagggttaacattttttaaatttattttttaattggaggatgattgctttatatcgttacgttagtagcatctccctttgttgacaaaattcctgagctgtgaactgttcccatccatcgattcatcccctcagccattatctatggcctacatcctggccaggtgcggggttgacacagataccatcatggaatcactgcctccttgactttaaggaattcgcctttcactctcttcctaacactcagggactgtatggtgagttttcccacgtgttccctaagtacttcttgaatgccattctggtgacaaacacattaaagtcgggttttatctgtccctgtgcgttggaataataacacactagacagacgtggaagagaagcggtgcctcatctctgcttccatgataatgctgcagccggctagtgtggcgctgggatgaaaaggaaaaggttatcaaaatgaatggaatgtgcactaatatttcccaacagagagcacagt

SEQ ID NO: 60228 - DNA, 1617 bp, Bovine  19866880823717
agatatttgctgtaatatggagtaattaagtagtaaaaacttaaaagaaaagataaaaaatttccttaatttagaaaaaaggaatgcaattttgatacaacatagatgaaccttgaaaacatgatgctaagtgaaataagccagacacagaaggacaaatattatatgattccacttgattgagtgggatctcttataggaaatgcctagtatgtgcaaatttagagacagagaggagaaagatggatgccaggggcttggggagggggaagtggagaattagtgtttaataagtagggcttccatttgagaagatgaaaaagttttgtggatggatcatggggatgtacctgatcccgctggattgggcactcagtgcttaaaacggtaaaatcttgtgttatgtatatttaccacgattttaaaaacaaaaaattaagttgtaaaaaaggttcaaaatcagggtgatccctcaggccttaggagcctggaggggtgggagtcagggaacagtaagagaaatgagaatgaaacatcagagaggcagaactgcaggggggatggtggggggcttctcccagagctgacccaagcctcagtctgcccctgagcagaggacagggacccaggagggagacccaagtgaggcgttcttgggtaatgaacctgtcacatgcaagggggcaagctgagactcactcttggccaacagagggactcagggaactggactcaggggtgctgacttaaaagaaaaaattttaaattgtggtaaatcatgcataacatatccattactatcttaaccgtttttaggtacattcacattgctgtacaaccatcaccgccacccatctcctggactcttttcatttagcaaaactgaaaatctgcacccattaaacaataggggtcctgattgaggggtggggggggtctttacctcacccacacccctctgaggtcccagccttgtggagttgcaggaacccagggtcaggaaggtagcctgatccccgggcctcctgtggcaaccacgggtacctgcctgatgttttctcatctttggtccaggggatcttgagatgattctggcccctgaggactccatttctgggatgctgcgggatcccggtggttcgtgagagggatgctggcgtctatacctgccgagctgtcaatgagttgggcgatgcctctgcagaaatccggctggaggttggacgtgagtgtacacctgtccccacctgtgccctgccacctgccctacttctgggcagggaggagagaatgctaccctgtagcctgccagtggggagtttgcatcatttggatccagagcacgagggacagggattttagagggagatggtgtatgtgctcccacttgctacgtaacaaatcgccctgagactctggcttaaaacagtgagcatctatcgatgcacagtcctggagggttaggattctggttctgactcagggtctctcacaggaaggcacttattatgttggtcggggatgtggtcacctgaaggcttgactgggactggaggatccaccttaagttcatgtatgaggcttttgtcaggaagcctctgttccttacccttaggt

SEQ ID NO: 60229 - DNA, 1083 bp, Bovine  19866880830791
ccgcgcccagctcattctctgccaggcactggtactgtcctgcgtcgtccatctgcaggcgggcacaggagggggcatggagttcaggagaggagggcgagggtggtggggagcatctggggacagctggacacaggaaggggcccctggagcaaggcccacctaaccgggaaggagctgagagcccaaaccagccaggggcccacacattccatcagctgggcagacgtggccgctatgctgtagaatccagagaggaaacccctgccctttcatacttgcagcttaagggtggtggcggttcatggctctaagtggagccatatgctgccaaagcatgcttgagatccacctcttctaaattacatacattaaagtattatgacaccacagcacattattagggatgcctttttaaaaaaaaaaagtttgggcaacactgagttagaaagaacaggtttctgaactgcaggctccttgggtgcacagctgcaagacttccggggtaggagggagggtttgcagcacttcctggccctggtgaaagggaagacttcgtcctaggatatccatgaccacggcaatgaggcaactcgggaagaatgctggctcagattcacttccgaggggcagtaccgccatgagatggagctatgggcagccaaggccagggtccacacccagaagatcatatccgggaggccactcccaagggactctaagtgggaggcatggcatgcaattaagagtgccgagttgggcgtcagtccaagatgagaccagctctggctcccctgcttagcaccttgaacccattactagagcatgaccatgtctctggagactcagtttcctcatctctaaaatggggatgataggatcgttgtaagcatcaaatgagatcacacttactaagtggaggcacagtgcctggccccacaatgtaaatatgcaggtcacggaagccctgtcgctgctactgtagctgtcttgataccagtctgagacaggctcccaaatgagtgagatcaaggacctctaaagtgagtccatgacagccccgaactgtgggtttctgcgcag

SEQ ID NO: 60230 - DNA, 1187 bp, Bovine  19866880852033
cgcataaacatctaaatataatgcccagcgtgttcctcctcgcagtgggcagcctgggttcagctggggacagaaggctgctcgcagctgtgcttggagcccactctcccacttcccaggtggctggatgctgaagctgacccgggcgcaggagcaggacagaggcctctactcctgcctggccagcaacgaggctggggaggcacggagggacttcagcgtggaggtcctgggtacgtcaccgcgtggttctcacgggcgcccacccatccttccttccagcctgcgagcctctgggagtggacccagcacagacaggagggagagaccaagccttgtcttctttgcctcatcagcagcctctttctgaggctgccatagaactttccagaaacagccagaatcaacccaagatgaaagggggcaaagattttcaataccacccaactgccttcctctgattggggccttctcccagcggcactggtatttgcctcagccagctgcaaatttttattagatcccctgccccatggcagcaggtgtgagggaatggagaatggaagacagaaccagtgggcgcttggcttcctgctccgtggttgctcagcctggtcagtgagcgtctgtcttccctgcttctcgcagttcctcccagtattgagaaggaggacgtggaggacacagtcaaggtccccgagggggagatggcccacctgatgtgcaacgtctcaggtaagggccacacagcggactggaggagggtgaagaggcaactgtgggaggaggggtcttcatagatctggggtgcctgcccactgccctgctgttccctgcagggtgtcccttgccatcttggacttttcactctctatgcctctgccacaaacactcttccttactcatctgactgcagagctcagttcagttgctcagtcgtgtcggactctttgcgaccctatggactgcaacacgccaggcctccctgtccatcaccaactccaggaacttgctcaaactcatgtccattgagtcggtgatgccatgcaactatctcatcctctgttgtccccttctcctcccaccttcagtctttcccagcattaggatcttttgcagtgactcagttctttgcataaggtggccaaatattggagtttcagcttcagcgtcagtctttccaatga

SEQ ID NO: 60231 - DNA, 2085 bp, Bovine  19866880892190
cttgcaggcaggacgcccaaagctgacatcagttccttcgtgcacctttcattcctcctcacgtggctgtctggatatgaaagtgacccaagaatcccatgactcgtcatctgcatgattccagaaggaatctttttaccttaatccaaatgggaaactagccaaataatcgtcatttcttgaaactacagctggatacgttattactttttctaggacaacatttttaagggcagtaggctcctgagagtctggagactgtcaccctcacagatggggcccacagatatctcgcaggcctacaaagtggggaagctgtgattgtctcccacaggctggctcatttcagtctgcatcggcactaaacattcagagcttgactcaattcttatgcctcaatctttagagtgtcagtttcctctcaaacaagtatgctaacagtgaatttcaaatcaaatgggaacatgggggaatatttcaaaaaataaaggaagctgtggaaacaattcatgaggtggccctctaatctcaagaaatgactagaagggtgaaaaaataaacacctacaagagaaaactctgagtctgtagataatatctaaagatgtcttaagtctagcactagggaggctatgatgatttatcccatgaccagcccttcctggaccaaaggaggcttcatggcaaaggcattcttttatctgttgttggatgtagcctgtcttccaacttattttccctgatagtataggtatttcataaatgactccaaaacatgaatacgtactgcgtgcccccccaaggaaagagacttggtgaaaggaagggcagccatcagccagtgaattttaaatacatcattcctataaaacagaaagaaaagaatttaaggacaattttacactcccaaaggatagctgaagccccacccaccatatatttataaggaagtcataaatatgatctaagcaaaccacaaacacaaagcttttttaaaaagtggttgctgccagcagagaaggcgtggaatggggttccaagtcatctctaccatgtaatccaactctgtgaatggagccaagttatgcacaatgggttcccaggcctgataagatagaaatctaaacaggttgccagtttcctctccggaaaccaccctggaaagcccacagaggcaagaaagaggcagatggatctatgaaaatggcacaaaatccccaagaaggcagaggtgactgggcacagctctagggaaaattgctagcccagaggagaggtgggcttggtgctaggtagcagggatggtcaaagaccgtgcccctctctgtcccctcaaggctggaacctgccaaacacaccaggccagtgagacacagcacccactcccccccacatcctctacgggcactagtccaccctcaggctgccagacattcaattcctctaccccttcccgcctcgccctaggagttaacctgtgagacacacaaaaccatgacagagaaaaagttttaaaccctatgaaagaaagcaaagacttgaggaagagcgacagggggaattcccactctctgatatcaagacaatctgcaaagatacaccagttaaaatatgggggacagtgagcatcagagaagtaaaccaacagaacagactagaaagcttatggatagatttgtgcatgtatggaagcttaatatttaaggtgacaccaagtcaatgggaaaagaagaggctgcttaataactggcactggaggaaaaaaaaaaccaacctcagctcaaacctatataataaatgaggaaagctgacctcagcttcacacttacctataccccagggggatttggctgctaaacagaaaatagacattttgtgatctggagtaggaatgggcctctcaggatccacgaggcatgacccagaaggctacaactacatggcctcgactccatcaacgtgaaagattttccctcaacatttcaactgggaaaagaaatcgccaatgtcttaagacatacgagggactgagactccaatgtgcacgaactcaagcacagcaaccagggacagacagcaaacccgg

SEQ ID NO: 60232 - DNA, 1239 bp, Bovine  19866880901257
ccctcattttacagatgaggaggctgaaccccagtagaaagtgacctctccaggtcatgcagccacttagaggcggggggtgggggcatccagagcctgacttgcggcccctgccccacctcctgcacctcttgcaatggccaggctcgcctacgacgtcagcatgtcccgagctggcctctcccatctgtccccagagtcccccacccctccccgccccctgcagcggaagcttgtgacgggtgcggtgctgtgacccacgggcaggggcttgggcgctgcaaggggcggtgcaccagccgcctccatgctgggcagcctccctgagaccttctctcgcccccgctgttttcagcaccccccaccatctggggctccaacgagacgagcgaggtggccgtcatggagggccaccccgtgtggttcctgtgcgaggcccgaggggtgcccacgcccgacatcacctggttcaaggatggtgaccccctggtccccagcactgaggtggtctacaccagaggcggccggcagctgcagctggagcgagcccagggctcagatgctggcacctacagctgcaaggccagcaatgctgtgggggttgtggagaagaccaccccggctggaggtttacggtgagcggcccgggggcgtggcaggagcaagggtcagctggggtgagtggtgggaggactctgggccacggtggcctccatctggctccaaaggtgggccaggggagcagccagaggcccaagataatgagattgaatagttatcctggggagaagggtcatctcatccaacctcccctggctagagaagaaattaagccaggagacgggtctgtgtcggggcccagggagagcccagtggagaaatcaggtctcccctcgtggtttagggcttttcagaaacttgcacccagaccccaaaaaccaccactaataactaactgctcttgattaatcacttactgtggtccagacccccagggcttgtcatagcaacagctaatttcatctcagggactagggccctggtcccccaactcatgggtgagtctagtgggctctgggactgacccaggtcctcccgctagggggtgagaggacctggttcacaccgagagggtctgactatagataaagtgaaagggttagttgctcagttgtgtccaactctttgcgaccctatggcctgccaggctcctctgtccatggattctccaagcaagat

SEQ ID NO: 60233 - DNA, 2557 bp, Bovine  19866880912229
cattcccctgcccgtgaacacccacactggcctagctcggggctgcagcctgggatctggagagtcctgctccacaggggtaagagatagaccccaaggcctctgacctcaccccctctctcagtcagctcctgcccaggaaagcctaagcctgtgcccagcactagctgcccagaaaaggaatcccaatcactgtgacccatgcaacacatctgggcagaatccagaaaagcctgggatcaaacccctgtactgccagctgtgtgctctgcgaccctaggcaagtcacttctctctcatctgtacctacacctctggaggattcacccaccatgcatttcaagccgggcggggccttgataaatgctggcttgaggagggacccttggctgagcgtgtggatttctgggattttctggaacctactctcttggtctgcgaagtagaccttgacctctggtcactgctgactcccctgaggccaaatcccagggaacaactcccccgctgcccctaggcctcttctgccctggctctctcgtcccgcctctgcctcggtgttcagccagctcttctgtctctgtgcctcctccatggtttcactgtctttggtttccctccatctttgtctgccaggaactgtgtcccggaggaaccaatactccagggcttttctgtgttcccttttccagagatggggagagggaggcagggaatgagagagaaagagagagaagagaggagggaaaaaaaaaaaatcaaagcccacatattggttccagatgtggctctctctcccagccctctccagcaatttaattaaattcccccagacagccaggagggtttcttaatgatcaaatttcccggctcccctcctagaacgggccctctctgtctccctgacggatggccgacgggactcttcctgcagtcagctttgccaagcagggtccgtggtggtggagtggggtggggtggggggcttccccggagcacaaaggaccctgctctgcgccccactctgtctccctccatccccaagggctctgagccctcccgagccttcgcttggcagagcctcccactcagctgagctgcatggggtggaggggtctgagtggtccttgccctgagctccgcctctgggccggcctgccaggaactgaggccaagcgggtgacagtgggggtcagatggggagtctggatgaatcaagactctgggctcacagatcagcgaggcacagggcaggctcagacctcctgggcaccctccccaacccattttggcaaggggatagaccaaggctcatcgagggcaaggcctgggctgagattacacatacctgccttccagggatggagaaggcaatggtaccccgctccagtactcttgcctggaaaatcccatggatggaggagcctggtaggctgcaatccatggggtcgctaagagtcagacatgactgagcaacttcattttcacttttcactttcatgcattggagaaggaaatggcaacccactccagtgttcttgcctggagaatcctagggacgggggagcctggtgggccgccgtctatggggtcacacaaagtcggacacgactgaagtgacttagcagcagcagcagcagccttccagggacagagaggcagacacagacagactagcatttaggtggagacgatgtgcccggaggaggcctgggatgcttcccgcatgtggagttcagtgtcctcagtagcacccctgacttctggagcaggaaggaatctaggtgagcctcgaaaccaccattttttgtgcccatgaagcagttaagttgagaacaagccaggccagaccccaggccccagacctcctcccatctcgaggtgggggtcctgaggggctctgcgtggactgaacgtttgtattccccaccccacaaattcatacgtggatgccctaacctccaatgtgatggcgttagcaagtgtgactgttggaaggcgttagcttagatgaggccatgagggtggaactcccgcaataggattagtgcccttgaggtcatcccccacaggggatggcggccgcctacaagcaggaagaagcggccttggaatgaaacctaccttgctggtgtcttgatcttgagcttctcagcctccagaactatgagaaatgaatgtctatggttggagccacctaacctatggtactttgtgcggcagcccgagctaagacaggctgcaggtaccttctctccctgttctccttctgatccctaaggactcatctcttctggaagaggctggggggtcaggtgaggcctcggatgtgggcacacatgatggcagagaaagggggaggggtccctcaacatcccctctgcagctctgggctgcccatctcagagcttcgtcaggggctagcccagcccacaactggctctcacaggccccacatcaggaccacctggcaatgtctggatgcggaatgtggtggggacatgtcagggaggaggctgcccttggagcaggggctgcagccagcagggccggattt

SEQ ID NO: 60234 - DNA, 3467 bp, Bovine  19866880918827
ccagcatccaggatggccccactgagcccctccgggtgctcagtgctccccaagaatgtaaccatggtcacccaagtggaaaggccttatagcaccgagtgtgagcacagaaaggccagagaaaacataaccaaactcatcaatcagcttctatcccactaccttgactttattggccacctgggagcccacatttttgaactcaagataatccacatttttcccctgtttccagaaggagcggtctcagtggggttatttgtttcctagcataccacatgtttgctatggagagcatcatgggtctggcccatccactcgaagaaggcatgcactcttatggctcctcccaccactctcagccttggcttgggaatccaggcctgtctactgtgtctacattgggatccaagaccggctgcggggctggatcaaaacctgggctctagacacttggctggtccaagaaaagtggccccttccccacccgtgggccttccttacccttcctcacaccccactgcctaaatgcatcctagtctcagccatattagagcctccctcattctttttttttcttttttaatgtggaccactttaaaagtctttattaaatttggtacaatattgcttctgttttatgcttttgcttttttttttggccaggaggcatgtgggatcttatctccccaaccagggatcgaacccatatgttggaaggtgaagtcttaaccactggaccgttaaggaagtccctagcctctgtaattctaacaccccacctctcaccttatcccactccagtcttctccctgaaggaaacttctcttttcttctgaaagagtaaaaatactaatgatggagagtatttgctgcaatcttattgagtgccaggcagtctgcatcatgcctccttagatctcctctagcaaccatggaggtcaatactcacccttcacgtgacggatggggaaactgaggttccaagaagcaaagtcacctgtccaggctggacttggcatccacgcccacctttctctaagacctgtgatcagctgctccactccatgctacgtcagaaacgtagcatgtcagtcccaacaagcagaacttctagagctacagtggaccctggtgggcagcccttgggctggactcggacttacctttcagactctcagcacctttgaaatgccgtaaactcatagcctaccatgtttcaccaaactacctggggaaaatgagaggagagagaggagcaatctcgtagataagtcttcccatccttgtgtgatcacacacccaggaccagagaggtcggaaccgtctcaaagccttgcttccctcttctagaaggaattgaagagttgagtgagggccctggaggacagaactattaaggagttgaaggaactgacagacaagtcagaatgatggagctactgaggataagaaggagcagccgggggagccagtatcatcacagtggtgtgtgggctccaggcagccaggcacttgagtgatttactgccgaacccatccctctgtgggaccagcctccaagtcacatgtgccctaaggaatggtttgggatggtcccaagaaatactggagcagcttaagagttacaggaactgttactcatccccatgcctccaagactgaacaatgaaaggagctaaaccacagccaagagctccaagacttgctccccaccacccagaccggaccatcacccccccgatggagctcaagtgtcaccaagcccctggtgctgtcatcaggggggaaggagcccgcctcattggcaaggggtcattgctcactgtgctgtatgctaagccttgttgtcacttatggccatgatgtcccctttgtcattgtcatcagtggctgggaagaatatccaggatgaattgaggtttcctgtctgtcccttttattcttttgttctctctctctcccctaattaaaaattccactgacctgctttgtgcatttgggcagaatctgtcggcttcttaccctacagtttcccccacttcttcctggaaagcttggctttcacctttgacttttggattgaggtgtctactcttcactcccctctccaagtgaagttctgacgggctagctcactcatgtggccccagtcccctggccagtggttgagctgggaatgggagttgatgtggctctggccagtgggatgtgtaagggtatctcctgctagggtgttttcagaacagacacacaaaagaacaaggtcactgtctgatttgaaggcttatttgaaagcaatagtagataagacagagtggtatgggcaaaaagaaagatgatatccttctggctgattcacactgctctatgacagaaacccacactgtaaagcaattatcctccaagttataaaaaagaaaggggaatcggccattagaacagaaaagagagtcctgcgatagatctgctcgtccatgggcaactgattctttttccaactttaaacttgttgttttgtattggggtgtggctggttaacaatgctgtggtagtttcaggtgaacatcgaagggactcagccagacatacacatgtatctattctcccccagtgggagaaggcaatggcaccccactccaatacccttgcctggaaaatcccatggacggaggagcctggtaggctgcagtccatggggtcgctaagagtcggacatgactgagcgacttcgctttcacttttcactttcatgcactggagaaggaaatggcaacccactccagcgttcttgcctggagaatcccaaggacagcggagtctggtgggctgccgtctatggggtcgtacagagtcagacacgactgaagcggcttagcagcagcagcagcagtgttctcccccaagcccagcaattgatttttgacagaggtgccaatgggaaagggaagtctttctgagctaacagtgttgaaacaactagatatctgctatctgtatggaaaaaaattatgaacctggatcccaacctcacaccatacacaaaaatgaagttgagatgattagtaggccaaagtgtaaatgttaagctataaaacttctagaaaaagaggcacaaggaagaaagagcccctcttcttccactccgtgatgtcgtgtctgcttagaccccctgtaactttgcagcctgaaaccatgaggaaagccagcctgcggggaagaaaagagcaaagagaagggctctttggaactgccctaggtgtgcctccatcatagttaaggatgcgttttccttcagagttaagccagttgcattgcatcctctgttactggcaggaaaagcttctcactgagacatgcctgtcctgcagcaaggacacacatagcagcatcattcacactaaaaggagagaacaacccaaatgtccatcacagacaagtggataagcaaaatatggcatgtcccg

SEQ ID NO: 60235 - DNA, 713 bp, Bovine  19866880972589
tcttcccggccctgtactgtgggcatgatgatcccattttacagacaaagaaactgaggctccaagagttagaattgaaacccagggaccgcccaactcctgagttcatatccttcttctctctgctaaattgcttgatatacaagattgcctgctcttgaaccaggattcatagcccagtcccacccctaaccagctgtgcgatcttgggcaaattggggggaaaaaaaatcaaaaaacctctgtgcctcagtttcctcatcagtaaaatgagactaataatcgtgtttcacagggttgtgtgggtttggtgggctgatgcctgttacgtgcttgatccattgctttgaggggcaggaagtgctcaggagggacctgctctgatggtcaggatcccacagagagctctggtggacgtgtgttgccggggtggcatgccggggaggctggtggctgagcctctcatctctctcaccaggccccaggctacacaggcccccaagctcaaggctgtgctcacccacaactcctcgggggaaggctcagggcaccgcaggcgatgttgccctttccgagtgcgattcgctgacgagacgctgagggacacagcactccgttactgggaacgcagctgtgctggtgagcagacaggagggggagctccaggactccagaaagttccagcctgaaacctggccagcagaggctgggcc

SEQ ID NO: 60236 - DNA, 1944 bp, Bovine  19866880973028
caattcaccaactcccctgcgaccagaacatcatggcactctcacagcatgggagatgcaggacttactcctcttctgattgaggggaaactgagccagaggtcaggtgaacaggtgaactcccttaaggctcaaagccagtgaggccagcaaagaggtgagaactcagacgtctcccaactttctaccacacccgaagaagattctgaccctgtatttcctccacaaaatgtccccttttagagcagatgctttgtagttgaaatgaaaggaggatcacggggtgggtgaaccttatcactgctcctgctgaagcgagcgggagactacaagcacctattggaaggactgtgaacaaaggctaaacaaaaacaaacactttcagaacttccccggtggcccagtggttaagaatccaccttccaatgcaggggacttgcgtgtgatccctggttgggaaactaagattccacatgccatggtaagcccgtacgccacaactagcgagaagccagcatgtcacaatgaaaagatccagaatgctgcaacttagacccgaagcagccaaataaataaataaatataaaagaaaaaacagaaagaaagtatccctctactttataaaataaatacttttgtttttggtggtgacagtccctagggtctttaactcctctgatcaacccaaagaaactctgggcagcaaccatgtcagcaggccagagagggtaagtttgtatctgtggatttccaaggagacaggttaagaaacagcccccttaactgttacctggaaagcagagagctagcccttctgcctagaggcgggagagaggcgcaactgtgggtctgaaactcactcgatgccgaggtccacctcggggatgccgctcagcatctggttagacagcatctcctccgtcttctttgccgaggaaacccggatgttttctggcagctcataaaggcaatcctctgcattctttggcttgactttctgttcctcatgttccacgatccctttccgcttcttcagttctgtctcaatgtacttcatcctgaaatgagatacccgcaggcctcagggaggggcaggacagctccaaccctggcccagagccatgatgggtgatgatgaagttgtcatcattccatggagaagtgagaaaaataaaaataacttttttcagtttttaaatcaagctaaaagttttcaatttaaagcaccagtcgatacaatgagatcctgtcccaccacattatggttggaagtttctttgatggcagtttttatttaacagccttggtggcaaaatgaaaaatgggcaagtccaatgtttctccctccaattttctttaaggggtgggatgggaatattaccagccaaggaatttaaaaattctaagaaccacgttcttaaagaaatcttgaggttttcaaagttctcaagcctgaggtggtggggtaagggggaccagggacacaagaggggtcaaatttgctgtttttggataagattagaaatgtcatctgtgactaaatgtcagacactatctggctggagcccacctccaatcgctcagcgctgaaaagactgacacctacatgtcggcatcctcgtcccttcggttggtttctgcggaaaatgatgtccccagatggaggtcttcctcttcgctgatcctacaaaaaagagaacagtgaaggagagccttagagtcacatataaatgaggctgaatatgatgctacatgaataaaacaagtatgcaatgaaatgtacaacatcctgtccatagttggaaaaaataagatacatatataacacgtaaccagaaggaactccaggaatatacgcaagcacactgatggcctctggagatacttcagggggagagagtagatatatttatttttcacttttgcgttgcttgtattattttg

SEQ ID NO: 60237 - DNA, 797 bp, Bovine  19866880987437
ctcacagttttacaaagctggcctcagtccaaggccccagacacatgcagctcttaataaacatttgccccaatgtctcgtattctaccttgtggaaactcactggtatcattcacattttacaataatttgctgggaatttcctggtggtccagtggtgaggacttagtgctttcactgccatggtccaggttcaatccctggttggggaactaagatcctgcaagacgagcagcacagccagaaaaaaaagaaatcgttaaccaagtcatggtgtacccaagcttctctgctaagaggaccatcagatgcagaaaaggcagcagtacatttccctaacttctcagcagctccctgttcatgtgctgtttaaagacgacggatggtggagcatctcccagtgcaagaacctgagatctgggtccatcagaatccagaaagacaggcccagacttcaaccccaaaggcagaggagggggttttccaggagacccaactccctctccccagacaggcctggagctaagcccagcaaaggctcgagagaaggaggacgagcagggttagggatcctttacctgcagcgggatgacaaccatgaagaccttcttgtctttatcagaaaggatgtgcttaatgaaagcccagccagtgccgatgagcgcaatggtgatgaacagcagtgcccccttcaagctgcaaaagggaagaatgaacagacatcaacgggtctctttagcctttcactctgagtcacagtctacagctcattctatggtttcatgcacttcctccaa

SEQ ID NO: 60238 - DNA, 1621 bp, Bovine  19866881027854
ctggccttgtgggggacagaagctgctgagtaccccgcatctgaggaagttgacagtggcttgtcatccctggcctccagtttctgtccccttctacagctgccagggccatagtgctgccgttttacctgctgctcccagttccttccttgcccccttattacaaggccagggttaggttcatggcctttccctattcccccgataaaccccagagctgcagatattgacaggagacatcccagatgggcatcaaatctcatcaaaccccagcaggcaatggcactgcttcctggaatccaaaatcaaccagccccctgatttacccacttaggatcttggcagttgagtgttttatgttattttttcgacagatcattggcaatttcttgttaatttcccctgagggctggtgagtggagagtcagactagcttctgttctcttgccccctggaatgccatctgtccagacgagacagctggcccattaggcagaggaagcacccccctgtgcccgtaccgtccatttgattagtgttcaagagcgtctgccagcagactgcctggcggctgctagaaacccagcccaccccagcggggccagcggcagggtggctggagccaggactacactgatggaatgggaggcgttccggtggtggcatctagttcctggctcggtgccctgcctctccaccctggctcctccggtgtgccagccaccaccccccatcacctggcattttagaacccaacaggtatttggcacatctgtggtcccacctcttcattttatagaggaaccaactccagtgtggcatgggagcctgacttgcccagcttttcaagaaggtgttggaatgagaagctggaaccatctctgcaagggcttcctcttaaatgccccccatctctctcgaagccaggatcccctaggtgtcgaattcatcacccacgagctgtgtgtccttgagcaagtccctgcctctctctgagcctcagtttactccttcaggaaaatggacaacagcacctgcgtagccttgagggcacagaggcggatagtgtccctctcgttctcttccttcctcacaggagagccccgggggagccggggcagcatgatcggggtgatcaacggccagaaatttggtgcagccgtcctcaacaccagcgtgcaacaggaggcacgttccggggtccccacaatccacagcagcatcagccacatccccacaagtgtgggtaagtgggggccagaagaccctctgactccagctgaatccaaaccaaagtaggtggaggtggggaccactttcctttcccaccccacagcccccaaccaaacaaaataaactgcatttaaaatcagcccaaggggggacttgcctggtggcccaggcaagagtggctaacactctacgcccccaatgcagggggccggggttggatccctggtcagggaactagatcctggatgctgcaactaagacctggagcagccagatatatttttttaaaaaatcagcctgacagagtgtgaaatgaccaggtttatatgaatgcagggtcagatcgtgcctttttgcccccattattgccgtggaggttttctccact

SEQ ID NO: 60239 - DNA, 1063 bp, Bovine  19866881028383
aattttgcacaggggtaatgagataatgacggggcactcaagcctaacttggcagaacgatgcttctagatggagagagatggagctctggtttggatggccatgagttctttgcgacaggtctttgcagctttcatagaccttcacaaacgccatcaggttttacacatgttttaggaacgcaagtcaacgtccctataggcttttcaaaaggacgtatttctaacgtgcacttcacattaaagttctgttcttagccacatcctgctttgtagacagtaaaaccgttctcttctcttttttcttttaacctcttcatcggcataaattttgatattcctgatagtgagaaatcaggaaatgtcaggaaggtctcatgcaatcataaaaatgaactcaaaacccatgatttgtaataactgtactagattgtgtgaaaattggggctttctattttataccagtaggtcgtaacaaagtataaaatggatgatttgaagtgatggggtcattacagagtatcgagcagatgggaatagaatgtaaaaaagagtggatatatcaacttatgtatgtgtgactgattcactttactgcacagcagacactaacaatattgtaaatcaactatactccaataaagtaatttaaaatttaaaattaatttaaaaattaaaaaatatagtaattaggatataataaaatatttctgtacatctcttcctaatttgcattttagtcaatttttaatttttttattgaatagctattgtgtgtaagactgacaggagcctgtggtttcgctttatatacttcgaagggaatctgcctatttcagtgaaagcatgtaaaatcgggtttaactctagcctgcaacctcaaagtcaaaaaagagatttgtttccaagattaaccaaaatgcatttactcaagactgtgtttaaaaggtcatgttaagaggctatctagtttgtactgacttgttcaagttgtctctggtcattggagaaatggcaaagcaagaatttcttttgaattttttggggttttgtatctgcatatt

SEQ ID NO: 60240 - DNA, 906 bp, Bovine  19866881031605
tctgtcactctgtcaataccttgagctggcggctcctggctgctgtggccttcctccttcccatagctgcagactcagccctgcctccactcacagtgtgagaaaaatgtgctaacacttgctgcaggacccccccagcctgtggccgtgcctcagaacccagggctcagggtccctctgctggagtttgagagccttccctggatttggcttcgaggagctgagaaccccctgagtcgtatgccataaggtgggcagtgctgccctgcctcctccctctaaatgtctgcaggcagggcattagtaccacacaggactgtacctaccagccagccctgacttcctgctattaggagctccttgggagcactgtgtgactttggacctgcacctcaacctctctgagagtcagtttcttgctttgctgctactagggccaggctgctggctatggcgcaccaagtaagtgctcaaccagtgcctggggtcaaggctcagctcacccttctcatcccaaccggtactgcgaggatggatctcgagtgctgagtggacatctctgcaggcagcgtcaggacagaaccaggaaaaccaagccccattccctgtgctggggcgggaagtcattcagctgggaaatcatttgtccacaagcccaagcctagtcatggagttgcgctaccatgagggaaattgctctaaatgtgaatccacctgcgagcctggggaaagtgattttgatcctcatgagcggacagcagtagtccttctgtgcacaatgttttcagcctgtctgccttccaatcactcctaagtaatatgtttcatttggtgtgactgctcacaggggccctgctccaccccgcactggctgcagaagcataacatttcaaatcttatcgaaca

SEQ ID NO: 60241 - DNA, 947 bp, Bovine  19866881107553
gggaagtttatgtgactttccatggtcttcagcagacccaagccaaggccttggtccctccctggacaggctggcttagcagctccaccacactcactcctggtgcccccactcccgcttcagcgagtgcacggagagccagcctcctttatgctctggggggcacatctcagacctgggggacatcaaaggagctcacttaacagatagaaagagacagtaaacaagaatttatctacagattaagacaggcttgggtgagggggcaggcttggattagtaacagcgggcaggtaggcagcagggccaacaggtagaaagacagacacgccgggctccccctcaccaggtaggcaatgacgtcatagccttgctccttcagccacacgaggatgcaggaggtgtccaggcccccactgtaggccagaaccacggagcctttgccggacatcgtgactggagggagacgagaaggaatgtgagtgacccagagccagccccccacaccccgcctgccagcccctctcagcagctccctcctggcctcgggcacccttatcccccagacaagccaccatggggttcagaacaggatgttcagctgtcatcaggtcatcagcatgaggagctgacccttcatgcagccacacctctttcacccccctgcccatccccacagaccatgctggggcttggcagggggaggcatgtagccaatctcccaccagccagagaagaagacaaaagactaagctgctgggaccgaggtcaggatgccaaggtcgcagtgtcaggagacgggaggagccgtctcctgagtctcaggcagcccacacatctccttgctaagctgggccagggcagggcatggccctgggagcctcatacagatcacccagcacccctactctgaccccaggaagtgggagtcatgcctgccgctgggg

SEQ ID NO: 60242 - DNA, 1702 bp, Bovine  19866881186626
gggtcctcggggtcccagagaggaggcttcagttcccgtgctttgctcttctttaactgtagatcgggatcctgtctaccgtggggtcagaagccgccaggtcaggtgtcttgtcgggaaaggaaagatggagaagccaggacgccgggtctcctgctctgacatgaagatagctttgtgaaatgacttgaatacggctcttgtcaggaggcactgccctccgaggggtaggagcgggcgggggttggagggggcagccactcctcggcatcagacaggatcgtgtgaccaggagcagccatgccaggagactggggcccgaaacctggctgcttcacccactttcctttccttctcaggaaccaccagtgctgagtttggtgcctgggcagagacgcggctgctgacagcatgacgagcgaggtgatcgaggacgagaagcagttctactccaaggccaagacgtactggaaggaggtccctgccaccgtggacggcatgctcggggggtatggccacatctccagcatcgacatcaacagctcccggaagttcctgcagaggtttctgagggtaggcaggtctggtgtgctctccaggaggagagcccacgtccaccacccaggccttgacgagcgggtggggcgggccagctcgtaggctttgccgcaaggtccccagccaggagccggctgtcatgctggggcctcctggtgccggaacagagcagctttctcgcagactgttccatttttccagaggcggaaacctttgctctcttgccatgtttgcaaatatctgggctgtgggtgttggctggtctgctgaacacagactcccactttcttgtcctgccaccgcctctgtgccaggctggcagcgctagggccagagcctccccaggcccgcctccctgcctctcccttggcacacaccgtggctgctgttgccccctgctccacccgcgtgccagcctcccaggtgtgctcaccgagtgccctcttccttctttcactgcttctctccacggcccttgtgagcgagaggagatgagtgcatctagtcaagttaacacctttaagtggaggttggctttcatctcaggaacatgtgacccagaaaacggctgtgctgtgctcacgcccaccgccggcgccacccacgccagccaccagcctgtgctgatctgagtagttctgggggctcacaaggaaaggccctttgcagaggggtccctctggcttctaacccttctcttcagtctgtcttctctgctgcttcaggaaggcccgaacaagacggggacctcatacgccctggactgcggagccggcattgggaggatcaccaagcggctgctcttgcctctctttggagtggtggacatggtggatgtaacagaggacttcctggtcaaggctaagacctacctgggcgaggagggcaagagagtgaggaacttcttctgctgcggcctgcaggacttcagccccgagccacagtcctacgatgtgatctggatccagtgggtgataggtgagcctgccgcgcctctctgcactttcctgcccatctctgctcctgcgggtggggggccagaggctcctcaactcctccctccccggggctccacctcaaaggctcatttgtttccacattttgtttcaactcagtatctgctgcgacccatttgggggcagtt

SEQ ID NO: 60243 - DNA, 1314 bp, Bovine  19866881195487
tctatgctaaaacccttattaaaggtgatttcccttggtttggtttggaagaacagtttcatacccttggaagagatcacctgaagaatctaagccattggctgcttactatcgatcctttgaagatcctttcatcctgagtgaatcaggatccttcagaggaattagaatcttaaggaatgtgaaagaatggattgttttgaagaacagttttaaaaaagacttctggagtctaggtgaaaagtgtggatgcggggaattctctgcaggtccagtggatagactctgtgcgctcacttccgagggcccaagttcagtccctgtttggggaactgagatcccatgagcctcgtgtgcagacataaagagcaatagtgtgtttgtggagagttctggggagtgaaagccagcaggagaataagaggggtgctggggggaggggagcagcaggagagggggtgacggcaacttgaccagagctgctggacctggactgggctgggggtgggggctgcccagtgcccagacggtcagtattatgggggggaagttaagtaactgcacacgacacagggaggcaggcattttaggaactttaaacaagtccattgagaaagtattttttgttataaatgaatttggaggaaacaggtcttactgaagaaaaccacaaggccattcccatcacaaatgtttctggggttatggtttgggcttcactgaagtgacaactgccctgaacctgtctgaaggtgcttcacagcttccctacacagtccacatgaatatccacacacacagatttatcattaggttaattaaccctgagtcaggctagcactagaagcctgctggtattcaagcccatcacactgtagggttttttggaaattctagtatctgtcacagctatattttctggaaactcctttcttcttccccttttaaagttttttgtgttcctttgttttcatatgtagaatctgagttttatttaaaattccagatggctggctggctggctgtccttatttgagtgtttattctgttatttttttttccaccttttttttttttaaaagaagtggctcttttcacatcaatgccgtattttgcttttttaatgtagttttaaaaattgttgatctatgttatatatatagcaaaatgagtagctgttgtacctaattgcagtgtgtgagtaacaaataatctcaccatttatctattcagcctaagggatgatttcttgcagcacagttaaatctgcttcgaagctttgtctttgtcattttgctttgagttaatgcctgc

SEQ ID NO: 60244 - DNA, 1209 bp, Bovine  19866881210210
ttcgagtggctctgacctgctctgtaattacgttactttctacctactgtgccgcggcatttccagttctgctacctctaggggcttcctcgccggtccctgtgacgctgtcactcaagggctttcaagtcagcgatgtagaaatcagaaagaaaagggaaatggtcggagacacagtgagaataaatgctcctgcttttctctctttttttcccctttccctttttactttattcatttaatctccccgagtgagactgtaaggcttaatgaagggttggacagattattagaggctgtagatttggagggggagggaagaaagagccagagagagaaagagagaagataatttgacatttaccccgactgatctaaactgattcggttatatttatggcttataaagtgtttagaaagaattgaagggggggagagaagtgcaacatggcaaagagaacagagagagaaaaataatattgactgccaaacaaaactcgtactttaattcctgactgccttccgggaggggccacacagggcctgggccttgcatcaggtggggttgcctgtccccacctcttgtttgaccaggtgacctccaaaggggccacttggctccatggtcaaggccagtctctcattcaagatgcaaacacaggtacagctaataggcacctgctaaagaatctgcctgcagtgtgggagacccaggttcgatccctgggtcaggaagatcccctggagaagagaatggcaacccactacagtattctggcttggagaattccatggacagaggagcctattgggctacagttcatggggtcacaagagtcagactcagcgactaaccctttcacactttcacctttgacccagcctgccagggctccccaacctctcccacagccattcagctccctcaccctgacccatcgcgggaggcagctcttcaaggctccctcctggctccctctcacccaactctgttgttccccttggcagtctcctcttggccttaccacccaatgtcttcagcctatgtttctccttaactctagccctgtgtgtccaaccgccaactatagttctcctggcccaaatctcaaagaaaactaaccctcaagatgtccaaatcccaatgcgtgattttctcccattctctcaactcagtcattgccatcaaagtctacccagcggctcatg

SEQ ID NO: 60245 - DNA, 1076 bp, Bovine  19866881261172
acacgactgaagcgacttggcagcagcagcctggcaggagggcctagccgccagcggcatgtgggatcttccccaacctgggaccgaacctgtgtctccagctctggccggtggactctcaactgctggctcaccagggaagtcctgtttgtttttctccagagacttgaagcttagctgctgcctctgggatgagaagagaagagccctttaatcccagagcccaggcagggaagcatcttggtcaatccaagaaccccagctgggaagttctgtttttatgttatatagtgagagactgaggcatagagaagtgaaaggtgggccttagtctcacgaaaactgaccgagtcacaatttgaacccagcctgtctggctcctgagccacggtgcctgacttgatagcactggccccagggcgtggggctgtcaccaccgccttccctgaccccacgggccaaacgacacggtcacagagcctggcagggtttctcagtgtgggacctcgtctgccaagagggcagtttgcgtgggcctccccaggatgtcaggtgtactcgggctggtgggatgggatgggtgcccggggatcaggcagatgccaccccagcccggagatttaaaattcctccctggaaaatcagataatcaaggaagtcaaataccgtgaaatgagtgtgatccttgccagaaacccacagggagccgcagagaatcatcacacggcaagtgcaagagtgtgacccaccccctcatcttataggcagggagactgaggtgcaggacacagcggggagccccttggggggctcctgaggggcagggtctgggcaggaacatgttcagtccctgggctcctagagctcggggtctgctgagagtggtcctctgtgtcccagcaatgttaccgtggtttcgggctgatccaggagggcttccctgaggaggagacttccacgctgagacctgatgttacataggagtcagtgaagctagtgggaatagcgtttcaggcagaggagaaagcaagtgcaaaggccctgagggcatgaagaaagcctgcttgctgcagagg

SEQ ID NO: 60246 - DNA, 1017 bp, Bovine  19866881283931
ctcagtacctggcacagtagagttggttttctgcaggttccctcctcgtgaagaccatccggaagtcgggcagcatttctggaatgccttactgttctctggaacagtctcctctgaggttgccgtcgtcttccgtgtaccgagacagatagtagactcgggacttgttggaacagccttgtggttttgatgaaaagccatagtttaaaagtgtccaggtctaaccctctgcagtctggttcaaccaaacccagatgcacatgggggtcactgggcccctcgtctgtgatggctgcaggagacgctccttgggaactgccgcaggaacccagggagtggacgcctgcagctctcacgctgtcagagttggctccaatgttgccctcccaggatccctcccaccagtgggtactggacagcactaaggagagggctgcaaggccaaggacatttctgctgatatcccaggaaggaccatctggtacagatgtactgtccctgctgggcaagaccagcgtgcacactgataacctcggtctgactgagttgagtttagcagaagtgatgctgcagaagtggcaggggtgaatctggtggcctgtggctgggctgaggggctgcagatcctctgaacttggctgggccttttagggggtgggttgaaactgcttctcggagggagcctgtgggaaatctgagttctcttcagttcagagaaatgccatgtttttcgtttggtttggaggtttggttcttgaagaaagtgtccaggtttggcttgagtttgggttcgtgcactagctcctggaaccaggtgaaatgtgggcttgtctcagtgagcattaatgtctaggtcgatttaggaaaatcattttgcaatccagcaaaatgattgcagctcacagcctggccatagtaagtattcattgagtgtgggacagacttacttattcagcaaatatttactgagctttcagtatacagggcacgctttggggcttaaatacgtcagggagc

SEQ ID NO: 60247 - DNA, 2066 bp, Bovine  19866881318954
tgctcccatttgtgccttagctttggtccctgcgtgtcctggacagaggctgaccggtccaagcgtgaaagtggctcttggctccttgcttgagattctgggggtggggtggggctggcctcctggggaagcccccgggaagccaggtgcccttctccagagggctccaggttccacgcttcttctcctccctcctgcccatccttcctttcttccttccaatatgagtgccgcatacagtgccaggcccgaccctggctctgccctctcaggcatcataagctggcacccccctggcccttctcaaagctaccctgccctacatgcccctcccagctacccctggcctgtgtgccggggactccagcacagaccccagctttagagatgctccggttgccttcagccccctcttcttggctgaccattcacgctaagcccctggacagacttcccccccccccaggatccctctacaagaggacctgggggtactcattgggccggctgcctatgccaaggtggtaaaaagcctgggctctggaccaatgtgcagatttaagtccctgccccagcctttactggccatgtggctttgacaggttgtttaaccccgtgcctcagtttccccttctgtaaaaatcaggctaagagcacccaggtcggatactcatgagggttcagtgaagtggttcctgttacctccatttctcagggggattcctgaggctggggtggaataaaggcttcgcctgtggccactgtgctgatgagccagcgccaacctgcggccctaaaccaggacccgggcctccttaaccacctctgctccctgttacttcttatctgatgaggcgtgattctctcccaaggctctcctgctggccctggagtcagggatgctgcctggaaggcacataagggtacagattccagaattcctgtctgagccccactcctagggggtctttcaaaggaacccagctctctcccaagaaacctgggtgttagggggcacagcctccatgcacccccccacctccacttccttccccagcctcttctggctgtaagtatttctgcagcctcaaaactcctttgaccaaggcccagtgttaatttgttaaatccacatcgaggtcctggggacccgttgtttatttttgtgaacgtgttggcagagatcacatttggggtgggggagaccgcttattcggtcggaataaatgctaattaataaaagttatttatttgggttggagctcgccgtggccccagggtcaggcacaaactgactatttgaagcaaaaacaaacagagagtgtctctcaacagcttgagaaaggcagaaacgaagaggccgggtttatttgtcttaggaagaatttgcagttaattccctccagactatttagacccttaaattaaatggaataagaaaaaccatgggtgcaggggaaggagccaggaacacttgatcatttggccgagagcagagtttttaaatgtctttggcctgaagtcagccaagtaaatggtatgtgtgaaataatttaatggcagagaacagggcagcagtcactttttctcactgtaatgtagtaagagagagagcgtggctgcctctgctatctgagtccgtttatctttccccggactcagcccctcacggtagcccctaaagagcccaggtaaatggaggtggtttcaggctttattttcaatcccagaacttttactgaacaaaaggaaactttgggcacagcctttttgggacagacctggccccagtgctcgctggcccgaggcttcaagagtatttatttattttccaaatgcttgaagctcaagcgtggaacccccagaggacacacgcccaccacatccacttctcagggggcgattcaggaactcgtggtaacgaacatccggcgcatccactgggaagcaaagtgcagcctgagagtgagccctggctgaggccaaagctgtgggttcaagtcctgggtcacctccaagacacctcctaaatcttccacatcctcaaggcctcttctcagcctctg

SEQ ID NO: 60248 - DNA, 651 bp, Bovine  19866881341888
ctggccctgatcgtgtgttaagggggtgttggggaggggcgagacttgccagagaggtggcggcagcgaagggtcctgggcgcactcttggctgcaggacttccaggctgatctctcctctggcgctgatctctcctctggccctggtctcatcttcctggcttccacctctacttgccagactgggaagtgggtttctgcagccccaggtgatctggcccgacgcatcctgtaaccatctggggcacccctgagaggagggtctgcccatctcagatgttgctaggtctgtcccagtgtgtctctctccacttgtccgactccacacctctccagttcgctcacatctccagtttctccatcctagacttctcccttccctgcaagcctctgggagatacccctggcacgccaagggttaatggcgctgggtcctgacccacagaggttctcttttgggggctttcaagaaagactgctgaggggtggggaagggcttctgcctggatctgactgggaagggggcagagattctgggcttgggttggaattcagaacccgtacctgggcagctgtgtggatccggcagctcttgcgccgtccctggaggtggcagactgaccaccagctgcaccattgatggaggctccg

SEQ ID NO: 60249 - DNA, 976 bp, Bovine  19866881415676
ggctggcttgcctttattgtggagtatatccgacggtgggtccacctccctgcctgctggaagataaccacccttgacctggtcttcctggagctggcagcctgatgggccaacagacctttaacagcaaaataccagctttcacagggatgagggtgtagttcggaaggggcttgaggctgaaggatgctcgtgagttagcatgttctgtggccatactgaggtggcctggtgtgagcagggccatagattggaaggcagtatgatggggagagtgaccaggtggcagctagaaaggagggcagtggctgagtgagggcctggccctgcagggagagccggtgggctttctggagcccctgtgtgttccacgaagcctgctttaccctcctgatgtcaggaacctgtgctctgccctgaagacaggccagcatggccagggcctcttcacagacagcgaaggcaagactcagggggaggtgacgtcaccctcgcaaggacactggctggtggtcccaggtttctggctccagacctcagctcagaccatgtgccaggccaggctgcctctctggatccaaacagacctcagccccccaggcccccaacgtcttactcttgccaagaccctggcagcacccccccacactcgctttctgtctctgtaggttcgtggtgtcctgtacccctagctggttttgggggccagtcgtcaccctggaagactgcctggctgccttctttgctgctgatgagctgaagggtgagtggatcgggcgggaatggggctggggggctgggtcagcatacggttcaaggttccgggacgcactctcagcgtctcacccctgcctgcggactgggtctgggactgcacactctggcagccccaccagcctgaagcttttaggggttcccctgttttcctttctttacttatttggtgggcaaaattggatagcattctttaattttg

SEQ ID NO: 60250 - DNA, 1058 bp, Bovine  19866881667366
gtttatctagtaatttatatgaggtctttaaagataactttattagttacagtattatttatgtattattttctcagtttgtcaacgttctaacacacactaaaagacgtgcagagtgttccacgtgtgtgatggtgcggctccatgtatgtgcaccgtcttctcctcgtctaggttccttgagctcacgtgaccattccctaggcagaacattttcgtccttctttttattctgaaactctctcccttcctatatagtttgagagtttcttcctcagaaagaacgacttaagtaaaaataagacacagaggccctctcttttcattgaaagaaatcattagcaatctttacactccttgctgtgagaaaaaagtatgctttatgctagtaatatttgctgttttttctacatatgtaaataaatctcatacgtatatattttaaacagtgatctggtttcaagtgtcattacttagaaaaaaagaaagtcattccacgtggtgtctttggcagttacatgcactaggttatttagagacgatttcctttgttgatgctgagtgttgccatttattaaattgtgttcgtaatagaacatgtccaatttgcggcttctacagctcaagagtgtttggggttttgaggaattgcaagtttgtaagatggcatgtggcctcaccattttgtttatttgtttgaattatttgatgttagatgagctagagtctcataaagtgataccgtactatacttatgagctgaatcatgcaataatatcttttaaatgattcttcttttagaaagtggaaagtctaaaagaagtaccgtggattcaaaggtaagaactaaccccaacctgtgcgctctcagcttttccaggtgtgtgtgctcacgcgcatgtaggactgtccttgtgcatatgtatacacacacacacacacatctgcatgctcagtctgcaggcggttgccttctgtttggggagagaacttggatgctctgaaataatttcagagtaagactgagtgctgagttacacagcccttatgtgatagaa

SEQ ID NO: 60251 - DNA, 842 bp, Bovine  19866881908761
ctgggctgaccccacaggcccctccgggcgtctccacgcgggccgggccggcttcctcaggagggcgcaggcgtggagcccccttgcttctctcagtgcttggcactccctcccatcaggagggtctgtgcttgtcctaaaccctgtccctggttccactgtgggctgaggcttggagtcgctcccaggggaagcgggggcagtctccctgcagagagaggccttcccccgctggagcgcttgcggccacctggctccaccctgcaccttctgacaggcggatccaaggccctcccctcgggctgccctggtacttgaatcacccacaggccgacggggctgcccagaccccgccccgcagcccggacggtcagagatcgtcctcgacggcgccactgtgctcgctgaggaggtaccacttgagcctgtcgggcagaggcagggccttgaccttggcgtccacgggccacggctgaaggcagaggcggatgcacacgcggcacaggtgcttgaggggcggtgggtagctctccagctgcctcagggaggagtgcagggcctggatcttgtccgccaggctgcccacggggtggatgtcgaagctctcgggcagccgcagcttctgggagctggtcaccatgaggtccagcacggtctcggccttgcgcagcaggtccgcgtggctctcgtcctccgcgcagcccgggtgggagcagagcctctcgaagacgatgtggaagccggaccagcaggacgcgccgtgcagggagcagttgtaggcggctcccgactccagcaggaagcgcagcagggggaagtgagacttaagctcttgaggcaga

SEQ ID NO: 60252 - DNA, 1564 bp, Bovine  19866880369501
acctaggttcaatccctgggttggaaagatcccctggagaagggaatggcaacccactccagtattcttgcctagagactttccatggacagaggagcctggcaggttacagtccatggggtctcaaagagtcagacatgactgagtgactaagcacagcacagcacagaatagttataatgggcttccctggtggcacaacagtaaagaatacacttgcaatgcaggagccacaggagacacgggtttgatccctggattgggaagatgtcctggaggagggcatggaaacccactccaatattcccaaaccacagctgccaactttaagctcaatacagatggtatcaactcttaccctctctcatagtcagataatcaggggacacctatggatgtatacttctcctagctctcagattcattcactccatttttctctcctgaattcttctaggtattttccactaatatgttttagtatggccccagggaccatgagggctttccaggtggcattaatggtaaagaatccatatgctaatgcaggaggcctggattagatccctaaatcaggaagatcccctggaggaggaaatggcaagccactccagtattcttgcctgggaaatcccatgggcagaggagcctggcaggctacagtccatggggttgaaaagagtctgacgtgactgagtgactaagcccacatgcagcagggaccacaaaatagacaatgactttttaaatataatattttaaaataatattgaatgcttcagataattgaccacaagacaagggtaattatcaggatacaaaattataaacacaatgtcatcccatcactttaaaaataaagtattacatatataaatattttaaaaaggaagacaaaatacaccaaaatataaacatggttcatattgatattaacactggttttctctgggcagtgagttgagagtgacttctactgccttttctcaaatccaagcccagattccatgccatcacctagtcaagtcactgtcgtctctcacctggcctctacagcagctcccaactgctgtcctgcagctggtcttgccaattcactcaccatgtaggaccaagggggatcttcttcaaatgcatatctgggtactatggagacaggataacaaactggtaccagctgctggctccttccatgaaatccaacactagagattccccagaggcagaagtgagcttaatggacacttactgaatcccaatactcattgcaaaaactgtttgtttgcatgcttgtttgttggtagaagtccagtgtgttggttagatcttgggaagtgtagcaagtgcagagagtgatagccaacagcaaacaaggattcgcaactgcagagggtatattagttttctaatatattgacatgtaacattaccacagacttcatctaaaacctcatgcatttattatcacccagttcctgtgggccaggggttcaggcgtggcttagtagtgtcctctgctcaggactgcaatcaaagtgtcagctggattgcattttgttatgga

SEQ ID NO: 60253 - DNA, 3095 bp, Bovine  19866880427752
atgcatcaaagtcccatcagctgagacttgccctgtgctctctcacctgggggtgcctttctgatctaggaactgctcaggttgtcttccatatcatctctgtcagttccgtccccagcttggctcaatcagcagctataccaaagctttgtactcacccctgcaatatctacagcttcatgctggttcagtccaatttgattcttttggctgattctccccaccctgaggagtcttagcaattgcctttgcatcaaggattagcatctctgttcctgaccaccctaacaatccctcttactttcactcactccagaaactgcaggagagggttataacccaaggctatcctggccattggagaagttgatttggagaggaatagaatgctgaaagggtttgtaaagcaaaatctcaatccagagatgacaggggagagagattagagatgatatgagaaacggaagaaagagaaacaaggcgtgtgtgtgagggtagaagagttgttgggcgaacagggtagtgaatccatcctcccaggtcatactctgttcccttgagaacaatacatctcactgaagcaaggttgtgtctctggctagctctgaacagaagtggagatcccagtctcatctggtgctacccaacacaggacgtattgatacatttgatctcttgtgatttaatttggaaacagagttaggtattcagaaccattcctgagcttagaggccaaaaaatcagagataatatcaagtgatcttttaaaaaaaatcaccaccagggttatgttgtgggagagtcaaccactgtatcagttggcagtgtcaaaattataaaaacaatcatggcagcaaaaaccctataacctcattcacataagaggttatagaagtaagtgccttcttctccacttcgacacccccctcccttagattaacaccctttgtgatttcttgaaaactatgctggatgtttactaacccgattttacctatataaacatgtgaggggagagcagttaacatcttctcccctggaacatccagaccaggaatggacaaactttcactatcatagatgatagtttatctggaaatctaaacactggaaatctctcaacactgtacatatgctaagtgtcttaagtgttatattcatttgaaatgaacatatctaaactccacacacagaactggtcggatgttccaggtgagcgcttctctcctatagccacacgaatgcaggcacctttcttcagtcactgcgtctttctcttctcccctctccccctccccagcttccctgtgtagagcctctttctgccctccaccctgggcccagaagcagcattgcttgtagaacgaagtgctaagcttacctgcacctttctctgtttttaccctgcaatttggggaagtgacagaactgtcataatgtgtatgtttaagtctctgagttttaaattcaacagagggggaaaaaagatgaagatgagaagggtagcagacacattttataatttttcaagatattagtcccatggcctcatttttttcacccccacctcccaaaattcctgcataacaactagatagaatgataagcagtgacactttggaaggcagccagtctaacagtattagagagataatataattttagaactggagggggcctcagacctgatttaatacaatgctctcatgttaagataaggacagtgaggcgcagggaggtgttgtgacttgctcaaggtcacatagggagtttggtctattaccagccctgtggacagtcaaggccaggctatctagactcgggcgggactcaagtagcaacagcagagtctgtgcagagggttcgaggcaatgatgaagtgaagggcaggggctggaagaaaagaagccaagagaggttgcagaggaagatgctgtagccgcacaatttcaatccgaatggtcaagcctgagacatctgggcgtgagaggtaccagatgggcttgggatgggcagcaatcaggcactgggaaattcactgggagtcaaggcaaccggaagaagctgagtcaaagaggctgattttgcaagcagcatagggctctgcatacagaagctgcagctgcaactcaaggacagcatttagatttacagagtgtggataggacttttggtcagcgtcagtcaccttagccaggcctgtgaatcacagccaaatctagatgagttgtattattgactatgataatgggagggtgaatggtggctctgactgcctgcatggcaatcaacctttaagatggctagaaattttgatctggccagcccttggcctggagaataatgtcccagagacacagtgatcaccgtgaacggaagctacttcaaagacaaaggccacgacacacagccctgtgatggaggagtccactttgtcatgggtcagagcccaggttaagcacagaccttagttggggaggggaaggggggatgaggagagtgatgacctggagaatgaagagaactgagtggactgttttcatctcatggatgcagaagctatcagtggggcaggagcaaaacatcggtgctatggatactaagatggtaaacccctaaatccttttacgtctgacagtatattcagaagattttgtcacagatcctgagaaagtcacttaactttgctatgcatcaggctaaatcaacacaatgcagaaacatctggatgaaaatgaaatgcctctgtcagtagtctgggtgttttgtcgacctgacatcaaacagctggatccttataaacatttggatgaagcactgaatttttcatttttcattcagaacacaaaatcatagactctccggcttggcaggaacttaaaggtcatctaatccctgatatctggcatagcctcaaatgacctgttttgtgttattgtgcacattaaacgcttaagatatggggatgtgttatgtctaattatacatattgtatcttatttaaacacatgtttattttaacattttgttctccttggctgtttaattgaattgtaaatgaattgtttacagggtagactaatttattatatgta

SEQ ID NO: 60254 - DNA, 1407 bp, Bovine  19866880433719
acccatgtgatgcatatttgtatctcagctcccagaaaattatcaggctcaatgcagacatgacagatggaaaaaccagcctttttaggacttaaaggatttagaagctgcttgtggcatgtgccacagttttgaaacgcataattttaaaagaccgttttctttattatcaccagaagatgcttaggaattatacctgtggaacagtgcttgtgggtacatttttcaatctactgcagtgtcagggagggtttaccaaagttgaaaagacacagtccaggctccaaggaatctatggtctaatctagacagatgaacttgtcattttattacagagagagaaaacattacttaaaaggaactagtataaagtgtctatgagcacaagaatggggctttcccggtagctcagcagcaaagactccacctgctgattcaggagccacaggagaggtgggtttgattcctgggctgggaagatcccctggagaaggaaatggcaacccactccagtattctttgccgggaaaattccatgaggagtcgtcctcgggctacagtccatggagttgcaaagagctggacatgaatgagcgactgagcacgagtatgagcacaagaagagagtgactgagtgtgcatggagtgagatttggccatcagggaagactctgaagaggaagcaatgattaagggcagccatgctggggcaggagggggagtggacatcttgtgcattacatgtaaatgatctgtcatctctagtagctgggtaacactgggtcactgacttgccatagtgctatcagagatgaggcaagagaaagtggcagagaccaagtggagaaggaattggggtcaaggggtcgtgtgcagtgctgttccccaaactaaaaaatgaacacggcacacttgccctgctggtgcagcttcatcctgtttcctcatctcctccctcctcccaatcgattgctacctgatgcctcttcagcatacaaattctggaatttccactgcttggatgcctctctgcagaattctctccagtatgtggtaggagccacagtagaattttcagccaaggaaggacttaacttcaccaatacgtctattcccaacaaaccgcaggtgggacctgttggaaatctggaacttcaagggctgccacttagctcccaggtgtcttaatatgaattggaaaaagtttccccttctttgagatgctttattccaatagtcagaaaagcacgtaatatattgctttcattagaacacacactttactgccaccttccagaaaattactattctgtatacaaatcgagaatgtgtgaaatataaatggaacccccttcaatgcatcattcttatagtatgcaaccttcacaaccatacatagcaatccta

SEQ ID NO: 60255 - DNA, 1451 bp, Bovine  19866880445079
ttcttgtctctttgttagttttctctaactttttcttaagaaagatctcaaacatatgtgaaaatagtccgaataataagtcctcatgttcccaactgttaccaacaaatgttggcccctgcgggttctttttaaatattatttatatcactttttaaccccctttgaatatgtttttacacgttgtaaataataatataatgcacttaatataattaaatatatgtactgaataacactaccatacattttataatttgtagattagtaaacatatacacattggagggcatgctcaaacatgtgacactgcaaaaagaaagtgtggctagcagtgatctacggacacaagtgacttgtcaaaacagaaatagagtgtctgggttctgggttcaggttcggactccattgtttctcagctgagggaccttgtacctgtcacgtctcttctcttcatttttctcatctctgaaatgggtctaccttcctctcagcattgctgtgttgatcaaatgagatcaggaatgtgaaaggctttgcacatgaacctcatgaaggtgtggagcaaatcagaccaacccaaggtggggtatccggtggcactggcattgaaagcagaaatccaaggtcaggaagttcagttactgactaattgaatcatgtttctctccaacataagagaaaaaaaaaaacatgaaccaagaggcatgaaatagagaatcagttgccaactggaacaatgcaggctttaaaatatggcccctttgtcctctccatgggcatttgaagtggtcacagtcacaaccaggcccagaatccctcaggtcagtcaggcctgatgggacgctgaggtcatgtagtaagtaagggttggaggccaggcctcattttatcttcccagtcccccttcttttcacagcctatttggatgtcttctttggatgacatccccccaaaactttaggtgaagaattccctctccagccctggctcactagctggacaatcccctggtcaccttgccagccaaaaggaatttagagacagtcctctgttctcaacaccatgggttctattgtttaaattgtatttataatgtttttcaactatcctctgtcactgtgctttattagactagtgactccctcccctgtgtctccaaggacacagcaaaggcaggactggccacccactgtaagtggaatcaagatggcaccagggctgatttccagggccagtggaaatggcattgcacactgtcctctcttgatggccacactgccgcccagctcatacccagccctgtccactgctgcccaacctgtccccggactcctcaggaggatccgcactcccctgatctccatccctggaggacgagagtctccagcgggacccagcacttgtctgaggttgctgacctcttttctaaggggctccctgcctctcat

SEQ ID NO: 60256 - DNA, 1839 bp, Bovine  19866880472765
tctccttcagaatggactggttggatctccttgcagtccaagggactctcaagagtcttctccaacacccaccattagggccccttgaaaagaccaaacagtggtttccttaagttcaaattttctttttccaagctgtacctattaagaagctacattttcccaacagaagaaataaaaaagcaaggggaagtttagtttgcttagaaacaataagacctccttctcctctctctcatgtaacagcccccacccttcctccagtaaatctacaggtgatatgtcatttggcttgatgacagccttggagatgatcttctatttgcaccttcttcacaccagaaagggagctttgagtctgccccagggctctgatatcttgcgtgtgagttgtttgagataactctctggacttagtgtgataaatctgtcctggaagcttctgctttgactcaagagaagccacataaaagctttccgagtaccattgtgtactctccacacagtttcaaaagcatcccaagtggaggatacaatatattgttttaattacaaggggataataggctaaagtaaaggagttttaccaagaagaaatgagtctcacaaaaggagcaataaaagctactgctattgttattactggtttcattcaggcctagacctcagtaagtttgggacggaggccaacttgtacttgaaagccattcttccctgccccatacgttccattcttctctgggcatcgtttctttcctcctctttcatgattttcagccaccagaggagcccagtcctttctattgagaagaaagcctgggttaaattcatttatacaaaagtaatagggatgtaatgtgttactcctcccagaggtatttacatttcaaaactttggcccagagagggtaatacttaattcaaagaagcaagcctctgtggtgggactgtaagccttctggaagcaagaatttcaagagagattttttgagaggaagataccaaggggataggagcttggacaatagtcccttatttttaatgccaaagcataacggcttaacataaggcatttgagtaggatgaaattggtttcctcatttccccatatcaaatttatgaaggtgcctattggccttgcctctacagaggtacggccctggtttcactgactgctttctaaatcagaatgactcatttgagaagtggtatagctcagctcaagacaattcacttgaggatgtaaattcatgtcaaatagtgatacaaaggagtgaaatgtcatcattaccttcaaagtatgaaagtcactcagtcgtgtccagctctttgcgaacccatggacaatgcagtccatggaattctccagaccaggatactggaatgggttagttgttcccttctccaagggatcttctcaacccaggggtcaaacccaggtctcccacattgtaggtggattctttaccagctgagccactaggggaagtccaagaatactggaatggatagctgtttccttctccaggggatcttcccaacccaggaatcaaacccggggtctcctgcattggaggcagattcttttccaactgagctatcagggagattataattcccttgggagagagtgatgcgtctcctcagtctaagctagtgcattactgagggccattagctttgaaacatgacacttaaaaacaatcttctgtttttaccctctgctcccttgtagcaagattgccatttctctcttttttaaaaatacttctgggccagcaggctgggtcttagttccccatcaaggactgaacccatgccccctgcagtggaagtaca

SEQ ID NO: 60257 - DNA, 1681 bp, Bovine  19866880502605
ctggacactactgaagtgagatagcagcagcaggagcagcagaaaattgcgaactacagtttttacagggcaaaaaaatgtttaaagaacttagtttaaataacaaagttaaaatacatgtattaacaagagattcatgtaaaaatagaccatcattgtagtgagaaatagaaattccttgctccttcagaacaaatgaatacagcttcttcattctttttaaacagcaataaattaggagaacggactcacaggtgggtaggctgagaagataacctttctggaagtggccaacagattaaatgcccccaattctaaaggaaataaaaaaaaataaaatcagttaatcctaaaggaaatcagtaccgaatattcattggaagggctgatcctgaaactgaagctccaattctttggccacctgatgggaagaactgactcattggaaaagaccctgattctgggaaagattgaaggcaggaggagaagcggacaaaagaggatgagatggttgaatggcatcactgactcgatggacataagtttgagcaagctctgggagttggtgatggacagggaagcctggcgtgctacagtccacggagatgcaaagacacaactgaatgactgaactgaagatcttaacactactttttaaagctcaattattttattttcttctttctccaggcaactttctgaaaaacctctaattgttgccaaagacctgtgggtgcttttaaaggagtctgattaggtgatcaaggatagtcagagatttgcttgagttcagagtatttgatttttataattgttattttagtgggggtaaataataaactggagttctatgcatttcataagatgtgcaccatgtatgtgcccacccacgtaccatcctcttgggagaaagatcagccttgagcaacattaagaaccccaacaatgaaagtcttagagtgtctgttatgaacagagtacgtatgtaataatacaactggcattttagtgggatggatggaccattttgtcttgagtcttctcccttctaaccaggatatagaagggagcacagaagacctgagaagggcctcaggaatcaatgtcagctgaggcaaggaaggcagaaaccagcacagggtgcatctgccgtggactgtctgaaatgcctcttccctgagatctacttctgcctgaagcttgcagctcatcagagcagaaagaggcagcagagctaccggtgggagcaactggttttggtaaacaatgaggcaacttctccctcaagagagcaaatcagaggcgaaataatatacgatggagagaaactctccagcagttacaagacagccaggaaagggctgcctctcttgactgaccttggtggctgcagaggctgaatttttctggccttgataaaagggcagaaggattcaggtatgatctggggcactcagctgctcctggacctgcgtagaagccagcataggcagcagctatacctagggcttccctggtggctcagacagtagagaatctgtctgcaaatgcaggagacctgggttcaatccctgggttgggaagatcccctggaggaggatgtggcaaccaccccagtactttgactggagaatcctcaggtcagaggagcctggtgggctacagtccatggggtcgcaga

SEQ ID NO: 60258 - DNA, 1167 bp, Bovine  19866880512717
cagcttctgcctctgccctactctactccagtcttaaccccgtcccatttatctcacccaacccaaggctgttagtgtgatgatcacaagcacaggctttggaggctagctgtgtgaccttgaacaagtcacatagccttttagtaaaatggatccaataaacacctacctcttggggtattgtgacagtgagtgagataatgtacaaagtgtttagtatcgggcatgaaacatggtaagtgaacaataaatggtggctgttatcactcttgatctaaacaacctctgcttcttgctctcacctccctagttcttgactcccccatcaatcttagagttagttttgatcactatctccctaaacctgcagcactttaaggtcaagatcttaatgtctatctgtggcatcctatttagttccctacatctaataaaaactgcatgctcaataaatgctgggtggtggaatgggactaatactctgacttagataaggtgtagtggggctgattcccgggctcctgagtcattacctacgatacaactcctctttaactgggcttctgattgagttccattctggtttcccagttctccagagaggtctaaacattttctccaccaaagacactgcagtcctatccctgaatcccatttcagtctggggctaaagcccaggaacaatcccaggcatcagtactctgcctcaggttctatatggcccatccactaatggatgacttaaactccaattcttttcatctctgtcagcacctctcccattgaggtggacaatggtcattttcttactcttaaataaaatgtattttttaaagtatcactttatttaatggtttatgctatacaatctaagttaaaacagtgctctctatgcaaaagcagtttcaagacaagaatcctaacacctatgcagcagcctcattggaaggccatgtggcatctatgaagagccaactcgttggaaaagaccctgatgctcggaaagattgtagtcaggaagagaaagggatgaaagaggatgagatggtcggatagcatcactgactcaatggacatgaatttgagcaagctctgggggatggtgaagggcagagaagcctggtatgctgcagtccctggggtcgcaaagagttggacatgactgag

SEQ ID NO: 60259 - DNA, 1296 bp, Bovine  19866880557318
tgggttgctgtgaggatcagatgatatatacatatcatttacataaattaacatatgcagtagcaggacagtgtttgaaacataatgctgtgtgtgcatgctcagtcgcttaatcgagtccagcacttttcaaccccatggtctgcagcccgccaggctcctttgtccatgggaagaatactggagtgagtcaccatttctttttccgggggatcttcccgaccagtgagtgctacatgtacttgctattgttatgagagttagagttccctctccccttatcttcctaaacataatgcatctgaattctcagggatcctgctttccctatttccactccctgacaatctctgaaaacatctaaattaaaaagaggccaatcctttctgggtaagtgggatttggaaaaaaggaaaatgactctgccatacattacacatcatagggggaaaagtttggtggaaagaggtgaggtgatgattcaggaaagcagattgtagtataaattcagccccgtgggacatgctgtccacttcagtgggtgtctgtttcatcatttctgaagggagtaatttggaacagacggccccataggctcccttcagagttgacattttttgactgtgttctgagttactctgagctgtgatcactcaaaatttttaatttcaagcattctctttagagcccaatcataaggaatactctaatcttagattctgacataggccatgtaactatgtgcccatatgccaggttcccttcaacacaacaaatcacaaattatgtgttaaacttttaaaagaacaaaatgtatcatagtttttattatatgtacatgatgattggttgataacataggaattcatagcagaatgccaaataaaaatacacacgtcatataagctaatctctatttagacagttgtatatagctagctatataaatctctatctacttatagatattttatgatgcatatatctagttatatgtaggttagataaatctgagatacgtttcagataccaacttatttccaagatcctgtgtcactagaaacatctagaatagtgcacttaagaaaaagaaggaattcatggttttaaaaattttatgaaaagtcacatgtgtctatatataaatatagatgttggtattaaaaagcagagatatcagtttgctgacacatgtctgtatatatagttaaagctatggtttttccagtagttatgtacagatgtgagagttggaccataaagaagattgagtgtgggaagaattgatgcttttga

SEQ ID NO: 60260 - DNA, 982 bp, Bovine  19866880709937
tggggaaatagaaacctcttcaggttctcgctatagcaaaggctccacctcccacatctcatttctttctctcctttaccttggctggcattatctcgcagcctctcatctccagaagcgaggatcacccctctcctttgatcttcgctgctctgatcgagaatcgtgtctttttccctgcctcccccatcagtacttcctccttcctcctcctaatccacctcctcgctcctgctacagatgagaaattctaaaccactcctttgaaataaatattcctagagaggctacatgatatgaacaagttcctattgaaagcgtcaggggagctacacctgcctcttagattctgacagtgtgtaccaggaactcattcagcctgaatcagaggtcggttgtcggagccggcttttcactgagcctcgcagttcagttccactggggaccggcgtggaaggctgatgcgcgctgtggttggaagccgctctcggttgaaagtccgtttccaagcgcggaggaatgctgggtggccttgtatcccagagggacgttctctcaagatagagcctccaaaggcacctttaggctctgcttttagagcacctggttccttgagaggcaactcgatgttgcaggatgtgcagtagtgggtgatgaaagcacaagggattccctcttaaaagttttcatgatacggccgaagttttttgtttgttttgctttttttttttggacacacctgccctctgcagtgaaagtgcagagtcctaaccactggaccaccagggaattcccagaagactgaggttttaagcttgagctcttctgtttgctagccaggagaaagggaaagtgttagtcgcacagtcttacctgctcagtcttgtccaactctttgtgaccccatggactgtagcccgccatccccctccatccatggaattccacaggtaagaacactggagtgggttgccatttcctt

SEQ ID NO: 60261 - DNA, 3018 bp, Bovine  19866880824130
taaaggaaataatcttctaacctcacatctcccaatttggggtgaaacaagccctcccccaacctcccactctcaccattcttcccaaagttcccaaagagaccaggaggaaagcaggacagagggcagagcaggagtctggctggctgggccagtggggtatctgcctgttcatctaggggcagtcaggtatttatctgaaagggacgctgcaggtgggtggagaacatggtctgagactatatcagggagttctgcccccaaatttcaggtccccaaagccatcccaacaagtgacttctttctttgaggccccagacagcttctccttttagaaggcccctatgaaaatgcaaatatttctaggatgttaagcctatcagctaacactttccttatcagccatagcacatttgttatcagcaaacaccttggcttaaattatttgacaactttccaagtgtgtgtgggaaaaagaccccgctttgtccctggtaggggaaggtgaagagtggagataggtttggggaatgcaaagtgggaggagagacttgttagacgagaccaaagataagtctccactaacttgaccacttgccttgctctgaactcatgggagaggggtgggtgcagtggcgggaggttttgtgtatatgtgtgtgtgtgtgtgtgtgtgtattgtgtaatctatgtaaggacttctagaaaccagaaagcaagttctgagaagaggattgcagggaagttagtgggacctgagtagaatgtatagattctcaaaggatagttgatttgttgtttagtggacttaatttttaaaaaatatttaaacagccaggttgctctcctactatccaacttgttcttgcttcccttataaaaggttatttgaggggcttccctggtagctcagtggtaaagaatctgcctgacaatgccagagacatagattcgatctggggtcctggaagatcccacatgccacagaataactaagcccatgaactacaactattgagcctgtgctcaagagcccaggagctctagagcacaataaaagaagccactacaatgagaagccagagcaccacaaccaagagtaacatccccctcgctgtgactagagaaaagcccttgcagcaatgaagatccagcacagccaaaagtaaataaataaaattagatatatattaaaaaagactatttgacaatttacccttatctactccagatcacattaagcacccagtagaattgtaggacagtaggcaaaatgccgggctggatgaagcacaacctggactcaagattgccgggagaaataccaataacctcagatatgcagatgacaccacccttatggtagagtatgacgaggaactaaagagcctcttgatgaaggtgaaagagtagagtgaaagctggcttaaaactcaccattcagaaaactaagatcatggcatctggtcctaacccttcatagcaaatagatggggaaacaatggaaatagtgacagactttattttcttggactccaaaatcactgcagatggtgactgcagccatgaaattaaaagacgtttgctccttggaagaagagctaagaccaagttagacagcatgttaaaaagcagagacattactttgctgacagatgtctgtctagtcaaagctatggtttttccagtagtcatgtacggatataagagttggactataaagaaagctgagtgctgaagaattgatgcttttgaactgtggtgttagagaagactcatgagagtcccttggactgcaaggtgatcaaacatagtccatcctaaaggaaatcaaccctgaatattcattggaaggactgatgctgaagctgaaactccaatactttggccacctgatgtgaagagctgactcattagaaaagaccctgatgctgggaaagtattgaaggcaggaggagaagggggaagaagaggatgaaatgattggatagcatcactgactcaatgaacgtgtgagcaaactccaggagatagtcaaggacagggaaacccagcatactgcagtccatgggggtagcaaagagtccacacactgccaaactagggcttttagaccagggcttgtttccatttttgagaaaccacaacaatgagaaagtttaaaaataaagttgtcttctttaaaatatgtttacatacaacttcataggacaagaaaagtaaaataaggtcaagggcaggagggaaaaaaagtcaagagcagagataattgagaatattttaagtaatcaagttagaggacccagctaatttatatcacatacaatgctaatcctgacttcttttagttataacatgtgctgaataagagagcagtgagaaacaggacaactgggagaactcttcaagatgaaactagattccttgggggagggaggggacagagccaaaagtccagaagacattaacattcaatgtacttgaaatatattcaaaaaagtgtcgagatggggaaaggaaagaaacaaggaaggaaggaagtgagcagaagaatggagagagggaggcagagagaggaggaggaaggaaacaagactgaaaaaataaccttcttggtagtgaaaattatttcagctttttgggtttttcaccatgaatgatatgatttcactttaaaggttgattagaaaatacaataagaagatacaaagcatgagaaattaaaaaagcatttgatgaagaactatgaaactcagcagaagctctctattaacagagaaaatgaaaaaattattattatataagaagcaaaaaaaaagtgcagttatatttcttgtctcaaaccaaagttagacatccaaagccaagctgccatgatgcccatgagtcctgcaataaagaacattgacagataccagactccctcctcagtcagtcattctactgctctgcctttatgtacaaaaagatcaaacaacaacgagttggattttctaggttatttaaagagattgttgt

SEQ ID NO: 60262 - DNA, 1579 bp, Bovine  19866880832894
ttggctccctgctgttgcagaacaaactgatgtggtttgcaaagctcttaacaatctggccccgcactttggctctgcaagccaagctcccatgaacctttcagtccagctgttgtagaattattttttggtcttcaaaaatgccagttttctttctcacctcaggtcttggctcatgttgcctggggtggactgctcccgttcctctgtctggagaacttctgctcactcttcaagagatcatcacgtcacctcctttggggagcttccctggcacttttactacttgctcctttttcggtttctacagtcttctgatcttagctctgctgcagcccttctcacatttattttgcttgtgatttattttgtcatgtaatttattttatggtgagtgaacagacactgagatcagattgcctggattcaaatcctagctcaaccacagaaatgttggatgaccttgaacaaagtctctgtccttgctttcctcctctgtaaaatgggaatataacaccacagttactatgaagattaaatgaactgtatattaaaggtttaggtcactgtctggcacttttagtgttagttggtatcattatcagtagctgtttgaagtcgcctgtcaaggttccatccttttcaacctgtgcttcaaccatcatgatgtggcctcttgcaggcccatcaataagtcaatgagccagacctggaagtgagtgagacgctctgtttgcacccttgtgtggaggtgaatagatgctgacatgcatggttcctgatttctattctatgttcttctagaccagagctccaactggatcccttctgtagtcctttccagctccttccaacatgctttgcccagccccctcaatccagatggactccttgggtatcaaaatgtccttgtagactcagcaatctaaaccaagatagcatttctcctccaactagttctccatgcctgtgggtctcccttctggaaacatcacccagttgattctcagaagagtctgggagcatctggagctttattataccactaagttctggtctacatgctatgtttgagtcactcaaatatctagttctcagcacagtaccaaactttgtgcattttaaaaactagacaaatggatgatggaacgaatgaataaataaatgggatcagtgatagagccatccattagcattaatgctccctatgctttcccacagtgtagtggtgtacgaggttgactgtacctggattttctgtaactaacagctgaaagcatcctaattagaatacacttccaaagcatatgctcatttctattgttcttatctggaattctcaacacagtgccaccatctggaataaaacaggtctaagaacatattttgggctcccagactgctgggaggggaacacctccaagagcagaacagttgggcatccaagacaaacttcaacttcttccaagctttggcttggtttggagagaaccaatcacttagaatcatagtgatggtgaattttagagcggaaggaatggtgaatgcaattcaacccaattccttcctttaaccaaga

SEQ ID NO: 60263 - DNA, 1852 bp, Bovine  19866880837794
agaggctgtagtgtgggctggttaagagctttcacctcaggctgacttgggttttaaactcagctcccacttagctgcatgatttaggacagtcacttactccttgaagcatctggcgcctcaactgtaaaatgagaatagcagttcgtatctcatgaggttattatgtgtattacatgagacagtataaatgtagtgtttagaatagtgcctggcacatgcaaatactaaatactcaataaatgacagctgtcatcatggttgttggtgatgacctttcctgttagcattttctacctacacaagtgctgttctcctttcagtccatggcttgctcctgtctctcttcccctgaagtcatcaacccctcttggaactgcccaaaacctacttcaaggcccagttcaatctgatccttcagattattgcttgctactccaaactctactcattgctttttttttcctttcctatgaaagagttttgtgtcatatctgttatacaatttaggaattagttgttattaatttttatgcttcctcatttggactataaggtgcctgaggagggactatttcttcagccgctaatgagattctcgctctcagtaatttggcattaagacagatagtaggtgttttattagtttttgataactcagaaagcaaacaagtaaaagtcattattaaaatttaaatccaggggtttcttgatcacctgtatggtctccttcattaatataaatcaagatttatcctgagaaaaattatttattctaaaacacagcacagagaggagaaaggcgtggtgattgaagagttccaaagttaagatcagcactgtttgttaagttagtgtctttactgacacgaatgaccttatttttgctttcctcatcacttcttggcctctctctgctgtctcacctctttttccaatcccagaggacctgctgtcctcgggaagccctctgaatatctccttctagcttgagtttctgaggaaaaagtttctccaagtttcagaattaaccttttctgtgttctccatatttcctcagtatagttggcagttaagaaggatagaggtctggccagataaaattttaaagtgacaaagggccgaccccttattatgttccttcccaagatactgggaaagtgacatctcaaatccaaaggtatgaatgtctaatgacagcatttaaaggagtgtattaggagagttgaagagataccagcgagtgagaagtgatgtgacaataagtgaagtattgaggagatggccttttcagtgctcctaaaatctctcttaaggccaaccccattgtggataatccagagatgcacaaatgtaataataataaccaaggtttattgggtacctacagtgtgccaggcactcttcctacatgtctatatgtagtcattcatttgttccatacactatcattactccattttatggaagaaaaaactcaaccctagagaagttaagtaatttttctaaagtcacacagccctctaatggaaagctgggattcaagccagacagtctgactgagaggctctccaccgagaaatgcttttttgattcatgattctccccttgtaaacagcctggaaagaggcaacttcatgataaaaacctagatatcaccaccatcatcataatcatcgccatcatcacagcaaacaaggtcctatatcactgtgtacagggcacagcacagaatgctcagaggacaaagaggtatccagccccaccgcgtgtctgaacttgaccccttaacccttcagattgcttcaaatgcctccactaccacacagcagtttctgctcacctcacccga

SEQ ID NO: 60264 - DNA, 1654 bp, Bovine  19866880873772
aaaataaagtatgcctaggacttgaaaaaataaaatgcaatatgcccatgacaccagaaaggacaggaaataaggagtgtggctgaggcaagtgcccttttcccccctggcttaatctcaaagttgcctttgatttagtaatcacacattgcagatttcttaaaacaattccagtttcaactattttgctctatttttccacaagtaagtttgtagaataaaatgccccaatttttgttttggaaaatgtggtcacaacaaccattttaccattatagcagtgcaatagtggaaagggagcaggctcagagaggcacagaacatgcactcaagcgctccgtgctagcttcccaagcatcattcctccttcagtcatattcgtgtttcatccaacattctcttggtgggcaaaactatcaaacccccattccacagatggaggcactaaagtctaaaactctcactgacatctcttcagctttcttccccttgattcttcagcttctcaaaagtatttatgagtgaaacaaagcgggaaacatcattaccttgacaaatggtgccagaattctttggagtattaagactcctttccagtgagggagactgccctgctgaaagttatgagacacaagaacaaaccaccaatggaagatgagatatcatcctttaaagggatcatgtttactctttctggagtggctttggccccatctgactccgtgacctctgactgtccctacatccctaagattctctaagcccacgataaggtgctgggaaaatatgcccagggcttatgtcctctggagagaagtcaaagatctcctgttgtggagggccagtctgctgctaaaagaaacttttggaggctgcagaagccctggctaagctttcccacatcagcttttcccccactctcctcccctcaatgcctaacacagctctcccattctctctcgcctattgttttccaaacatccctcctttcataaaagctgtctggctgggagcttaaaatattgctggacagtaaaacctacccatcagggtcaatccagtcatatctgctcagtcgtgcagcacagtaggggcggggtagagaagtgggaggtgggcttttaggtgccaaaggaaagaggccaaagttgccattttaccgctgagcgccaagagacgaagagaacacatatctctccgggagatcctactcctattggcaagtttaccctgggtgatattagcttgaaggcttcccaacccctcccatcccccacttctttcccagcctaatctaagggctacttctggaattctccaaaaggagaaaggttgccactaatgttcagtcttggattaggatggctggatttagagttcaattccaaaaaccttggaattagcctaagagttggcagaggtttggaagggaaagaaatgcgagaatggagggacaaggtggggtggtggcagagatgtccaaattctaactacaacttgactttctaaggcctttcttttatcagaatgaattaacatgcccccaggtagcccgagggatctaaaccatgtatttgaggttatgaaagttctctgtactttttcactcaaactctgccatagaagtagcagtgatgttaatatctgttgagtg

SEQ ID NO: 60265 - DNA, 916 bp, Bovine  19866880950595
ttgatgaaaataactggacttttttcatgctttaaatatgtgtgagacactcatttctgacccgtctctttatcttctttctgtgatcatctacttagcatcttccccaggcagtgttggttgccaagcacaactaagcactgggccagaaagttcccagtcaagtgtggttacctacaggcagaaaacagatcccgtctgttacagcaacccagataaggagccgtgtcagaggctttgttgtttatacaacccttagagtgtatcttctttttaacttagtttattatttaactccctccaatataaaatattgggccacaaactggtttctgtgtgctataaactctttgctttaaatgtgtcattaaaattttaccaccaaattaagctcccttgacttttcttaaataggtgtttgtgactttgaaaaatatgagttgtctgggttagagaaaagaaagtggcagtaggctcaagttattaagcagcagaggaaatatgacccaatttgatgtttttttaaagcaagagagatgagtctgtgagtttaaagattttgtagaataaacaagtttttgcaaaatcttcctgtggttctctcactccatccccaccctgtcctccacacccagccagtaatctttccgcagaacctatctgatcaccagattcccttgcttaaagctgtgaagttcaaactccctgggccaccctgggttctcccatgacctgctctctctgagctcatttcttctctccacctccctcccttaaagagccaccccattgcaacaagtaggcctttgctgcccccatgtcctgtttaaaagctcaccagcaccctccactgcgaagtgcttcttccttcaagagataagttcaaaacccaccttttcatggtttcctgaaagga

SEQ ID NO: 60266 - DNA, 1367 bp, Bovine  19866881000105
gtgcgaagtcggagcgattccgagagaaggctttattacatccgttatgcccagaagcccgaggtacccaatgaaggctccccaggacccagcctcccccacggctaccagagtgacaagcgccgtctcagcaaggccagtagcaaggccaggtcagatgacctgtcggtgtgacctccagtgtgggagaaccagatgggaacagaggaactcagagagggaaggcatgtcctttctgaccccatctctttcattctcaccactgctatgctatttttggactctgggtctcaatggcattgctcattcttcccagaagatgttagcaggtctttgtggatgcggtcagagacatagctatctgtccaggctgctgtctcttccccatcatccacccagaatcctcaatgaagcctttcagattactctgtgaatgggatggaagaagggaggggatcatagcaaatctggcctgggagggatagccagaggggtaggatgactctacacaacagccacacagctgatggattctctaggtccttctgacttccttgatctgaacacccttcctctggcaagaaagagcccaaagttcccaatccaacaatgagcatgagtcaggaaacatgcctcagatgtgctcttgtgtgtgttgtcttcttggaccataccttggaatggtggtgaggttgccgtggtctgccctcggctgcccctccctctgcccagtcttacttaaaaagaagtccttggaactcaaccagcaagctcaactttacaagtgccttggtatgcacctctggcaaatgtctcaccttggtgatattgcagcctttccttctgccagggtgtgcaaccagcccctggggctggaaagctctcccggggagtcactgtacacacaattccactggaattcctgccaccacctggcatcctgcagctcttttacagttcaagctgatgatagacaccatcccttccattccccctttggcagtccctcgagtgctcccctaaacaccttattgaccagaatgcccaagaagccattgtcctctcttgaatcctgaccagttcaccagccatggaggccagtggaatttccctaggtcttatgaaaacaaagaggacattgtgcttctcagattccccttgggaaaaagaataattctgttgtgaagatagaaataaaaaaggagagaaaatgctggaaaactattttcccctcctgtttgcttcccttgctgactgccaacttcgagtgccaagaggaggtgtgatgacaactatggaggcccccagatttccctttccctggagtatttagcaggggcagaaagcagtaagggaatctccaggtt

SEQ ID NO: 60267 - DNA, 1393 bp, Bovine  19866881065608
cgtctcttcctctcctcctaccactcttctttaaaccgaatgacataactgatgtagagttaaattaatatccttcccattgcccatgttttcctcacctctgacagtcatcctcccccacgtggtagcacatgggggcggtccttgctgaggccctctagccggcctgctcatgtcaaatgctgagtcaaggtggctcgctgggtcttatttgagaggagtttttactggaaatggcagaaaacaaggaactacatcactgagtggctactatgtgcctattatggttctagatgtttccacttattcacacactgtttaatccccatgaggaaacatgccctctttacaaatgaggaagaaattgagaggttatgtgacttgccagaggtcacactactagacagtgatggaggcaggctcgaatcccactcttccgaggaagcatgagtcctaccacctaactatttctgttcccattgctcttgttgcaatctgacatcaatggaactccagcgcctgctgtttggccagctgagaacccagcggtagacagtgtctcagccaagggcatttactggctaaaaaaggaaataactttctatatgtgatttctggccaacggtggcagatgctgaggagtctgggaatcctgaccactgtgggctgagggctccatgtgatcatcaattctaggaacagcatatgcaagggatggccagccaatgaaccagaggctaaaaggaaaaaccctgggcctcttatgggaaagtggggaaagccctgcttgtggagttaagacactggagctccagtcatggctttgtcaccagctgtcagtcctgtcagtcctgaggcctctttgcttttctttcccttttagaggcacagagagaaaggcaggctttgaagtcaggtagaccaagttcaagtctcctacacagcatttgctacttgtgtgactctgtacaagttctttaaactctgagtctcagttttctcagctctaaaatgggataatactgctttcctagcagggctaatgtaagagttagaaagtggacttgtaaaatgcttcacacgtggaaaacactcagatagtggtttctgttattactaccacttaacttccctggaccctggtcttcatcttgggttgagacataaggggttgattttgattgatccctagattcctagattccttttagctctactgtactatgaattgatgacaagatgttggaaataataaagcatttcataaatgtatttttcattaatagccacataagtatcaatcaaccccttctgggataataaagatctcccaatatttccttgtaattcaatatctccatttgccattccctcccatccattccttggaaat

SEQ ID NO: 60268 - DNA, 727 bp, Bovine  19866881233364
aacagtaagccatacacacttcccacccgcttgcaaggatgaaattaatccttttaatattttcattactcccttggtgctggatctgaatcctgtggatttgacagctattttggtcctgatcctgcagttcaatctgggcaggacttggttcttaatgaatcctattggcgtgcgtgcgtgctctggttaaacctgtaacgcagcaggtatcccattgctgttcagcggatgaatgaatttggctcaggttccttatgctatcactggtcaagcctctccaccatgcccattcatgaccttctatccaaggctagtgccccctactctgaacccatctgtctccagtatttttttaatattaaacaaaaggctaagcgttaaggaatcagggtacagctcacagtacaactctgctttgtcacttcactgaaaagagagaaataaacctactcaaaggagtagctgaaatggctgaaatttattccatccaatctttccctcaagttcaagttaaacagtgacagattctgttttgttttccctaatttcaattccctagataggaaaccatctgccttgatgaacgtgatatagctctggaattgtatgtagtggaaagagagagcctacttggataagggttgactgtgaatttctagtgtgaaccaaccacagtaactattcagctggaggcaccagtgttgaggacagctaactctacctt

SEQ ID NO: 60269 - DNA, 1522 bp, Bovine  19866881363141
ttggaactcagagaaggtcatggaggctggagtcttgcctacaaggaatgacggacaaaaaggcctccaggcccaggatccaacaaggccttgctcagcatcacttgtactaaagtccatggtaccaaacctagatttagtatctctgtcaaattgcagttttaacctcccctagaaatgtaatgttaatggaccagtctggaattttctggttaagcaccagtaaattaagctgtcacagggtccctctccatcaactcccccatccccagctgcagaagaggcaatctgcatgataaaacccttgccagttcccttctcctccctcttcccactaggggaatcctttttttcttttattactaccatcttttcttttgttaatactttcttgctccaccctatgaaaaaccttccattttgtacaaccctatccagcatccttctagttgctagatggggtgctgcccaattcatgcatagttgaataaagacaattaaatcttcaaatttactcagttgaatttttttttttaatgttaatatactcagactctcttcacaacttgacctttgccttgaggacacagatgtgtcctgttgcaaagacctggaacagcagtttggagccgcggtatattcatgagaaaccaaaccagcagctggtttaggctagcaaggtgcttactcactgggacatctacagacaaggcctggatttttccacaagaaatattctggatacaagtaacgcatcaatgggcttgaacttctatacgtttgcaatgatctaaacctctttaaacatagaagtgggatatcaaatgattaaatataaagcccccactccctgtgtagccaagagtaatcattcagtaagtggtgtcttggctcttaactcagtaacttcaacttcaaggaagtcctctgtgctccctagactccaaatagatgatctacatcactcaattctatctacccctttcttcatgtctcctacccaattagcctggcaagctcgccaattcattcccacacactggccgccctgcccccgagacttacaacctgctaacctaccaggctaggcccactgcggagggcggggtgatacctccagctagggcccacggcgcgcagccttgtgggagttgtagttctcgaaacttacagtccccggacaggcgtccccacgggactcgttttcccgtgctcctttgcatgggtccacttggggcaagtccctgggtagatgagaaagtggccggcagcttgcttataaaaaagtggagttcagcggtctttgttaatggagccactgctacggaggaagtcagggcgtgtttctgtcccgccaagagtgctggaggccgaacctgaaatataagtttaatgttccctagaggacgaaagatcaggagctgagctcccggctccgggtatccccgcccagtctgctgcaggagcggccaacaccgacccgggttaaaactcccgggaagtcttcgctgcgcccaatctg

SEQ ID NO: 60270 - DNA, 959 bp, Bovine  19866881667733
caggcctatttacagagtctttctgaggtcttcactttcctaaaaccttagccactccttaaggccaagtcaggtatctcctcctctaatgtagcttttttcatgtggatcacttcttagagccttataggtcctagaattggtcattaatgaatttctatttcattctcttttgtttcctttatgtaatttagtttaaccatcttaagcagactgtgagctccataatggcaagttctggaatcattcctgaacatcccaggttttcaaattctatgtagtcaatataatagcaaaaataatgaagataatagcaataattgtaatttaatgacagactatgatttcccaggcaccctgctgaactctttacaaacactatctcatttaacaacctgtgaggtagatattactaggttcagtttacagatgaggaaaccaagcttcagggattaagtagcttgctggagtccagttgtaaatcagcagctgcaattttcaccctagcatgtgtgattccaaagccctttgcagtattgatcaagtgctcccctcccctaccaagtctgctacctctatcttatagtcataccatgaaagggacacaaagaagagatacatggagggccagactttatttggacaaactacacatattatttcctttttccttcctgaaagccccttcatgaaggactgatttcatagaatttctaacccaagaacacttattgcataaaacaaacacccttgagagatagtgagaaagatagtcttgttttgttttggagagtcttaatgccagtgccagacaatagattaaaaggtgttccctccagggatctgggataaccaatcattcttccctaaatggcatcccagtcagtttcctccacccctctgcccacatccttctctctccccaccaatagcattcaagtctcagcagaggggcccag

SEQ ID NO: 60271 - DNA, 1010 bp, Bovine  19866881738393
caaataatgttaccagagtcttgaactccagctcttatctctatctctgcgttctccaaagtatcacgtgatggaaaaaaaacacaagctttaaagttcagggggacttgggtataaatcctgattctgccgcctcttagcattgtgaccttggacaagtgaatcaatatatttaaccttcattccccgcatctgtacaatgggaataaaagagctactttgcagggtttacatgattaaatgaaaagataaatgtaaaggtgcaagccatataatgtacatttagcaagtgctaactattagagaaaaaaaagactcttcaattctaggtatatacttttttcatcctcacaataacattgagactctcatccacagatgtctaactcttagaatgctatggcaaatgagacctacattgtgtcagttcctgatagcatgagtgatggacagtagcagaccttcttacttataactttggtcaagaaattgttgtgctttctttttgtgtgtcagatttccagccaaaccaggtgatgaattcgcagagctgaacccgtatctctgctccagtaatggacagaatcatttctcaacctaatcccacccaatcctggggtctttcttattcaccatgtagagtttggagaagaaggttggcctccttcaagagaggaagttccagcagaaacagtggcccagattttaaccaggaacaacctggtgaccattcagagacttatcatgagtccagaagcagggaactgttctatcattcagtaaacacttcacagttttcaaagggctttcatatttctaaccttctgggaaggccaattcttaattatttgcatattcaactccccccatgtctcctccattgagaaaatactaattagcccattcagaacagatcagtcgctcagtcgtgtccaaccctttgcgaccccgtgaatctcagcacgccaggcctccctttacttatacatattattttggtccatgtcaat

SEQ ID NO: 60272 - DNA, 1252 bp, Bovine  19866880766345
tggagtgggttgtcatggcctcctccaggggatcttcccaacccacagatcgaacctgggtttcctgcctcgaaagcatcaccccttgctatgttgattgcagtagccctgcggctcctattctttatcccctttgggcatcacacgaggtcttacccaatctgagccactgctgcttctctcgtcctgtcttccactgtaactgcctcaatctccgtgctttatttacacacactgccctccttgttatatctctagtccaccagggctggaggccttggggcttttgcagtgctgagtatatataataagcagagcaaaggcccttctcccagttatctgtcagacttaatctcattcccttcagttttttgtagtcaggagtcacgtttatcatgaggccttttttaaattccctataataaaacagcagagccttttgccactcagcattccctattcaacatgccttgctttcatagcatttttctctcatgttacttttaattgcctctatccaaccttctagacagtaagccctctaagatcagaggtttcctttgaatccactattgttttctcagaatatacaatagtgccaagcagtagtagatgatcagtaagtattttctgaatgaataatgggccagggagtatcaccttgtaaacattgtttaacagatttttatttgatgatgtagttttaagagttggtggggtcattatactcccttgatctctgtcatattatttcctaactttctccctctcccagagtttaattacatatgttatgataaaatttcccaggagggagatatgcacgtaaataatttggggccctatgaaagtagccaccgattggggtaacggtttccatgccagatcctaaagtggatgcttgtcttttgggcaggtttttaatcgcctttggtttcctctcgtgcgacctggtgctctcgcagttctctctcacatgctgcttagttttcagcattctccagaggcgttccatttggtaagttacgactcaagtttcctacttcgaaaaaccttgttttaaaatttcaacttagtattgagtcacatttgtatttgtgaaaagattatagattggtcctaaatctattttcctgtagctttatgagtccttttaaaattgatattgggagatttcctctcaaagaatatattttaaaaatgttttggatctcaccaaaacttccactttgggatcacaatgagcaactga

SEQ ID NO: 60273 - DNA, 3375 bp, Bovine  19866880398501
acggaggcatttccctttctgaaggggcttagatgacattattgtgcagacagacctgtgcagagcgggtgacgctgcccccagcactgttgaaatgctctctcttgcccagggcttttatctggggttttgtaaatgaaacacctgatccttcttttcaggttcttcagcaaagagactgattcctctttctctgaaaaccacagtgcttctggataaaatgaaagaatttctgaaacccaacacagtgtgaggataagtgggtccattcgtggagacaaaggagaagattgtaaggaatcagatttccagggtcttcctgagtccttcccagagatgattttatagtgatgggaaaacaattctcaaggaaaaatcaaagatgtggcaatataattgaaaagaggacctgcagaaggaaggaaggaaaaataaacttcaccccatggaacatgtcattcatgatattctttactaaatttggacccaaaatcatggggacaccattgattgataggatagaaagagctattttttttttctgaggcatgaacaggactattatgataaataagtggtttccaatgctaactggaaataagcaagaaagaaaactaaatgaaggaaaagaaatattctaagagataagttgttttcatgaagtagttaaggatagtataaatgagtgtatacttgaagatacggttataaaatcatagggtttaacaagttaccattttccttgttagtgatgatgatttgtttctaaggcaacttgatattctatggagacattggtctccatggcccaggtcactttatagcattcctaaggagtgactcttcttgctttgcactcagcagactcaagacttctaatcggcaacatctcagactctcctttttggctgtgaggctgctgagctctcaacaaaattcctaaataggaatacttgcgaaactttcatgcctcagctgtcagccaaagacagggctaagacacagctattttatttccttgtaataaaggtataattgttctgtatgccagatgtcagaaagacttgtaccaggtctttctctgtgtcttcttaaaaatcaaacaccaaaaaacaaatgaaagagaaaaaaaaaaaaaactcagaatgtcagaaacaaagctatcatcattatcctttggcatcacttaaaatttgtatgtagcttttaacaaatggcagggtcctggtgttgaggatatatgttatgtgacagtgttttttattcttcaaagtcaagttgcaggtaaagggggcagctgtttctttaaataattattttttctcattactgtccccaaagggccttggactgccaacaatcagtgccaggcaggccctcagtgttagcattcttcatcagggtagccctttgaatgagaccactgaggggagtgcgtgctattctgcttgggtcctgatgtggctggggtgaatagcagggttgaaactgtagtagttcttttaggctgctgatagaatgttagattttgtcaaagagaataggaaagggagctatttcatgccccttggcagtgagactgccaggctggtacccagcacaggcttccccaccctaatcctggcaggtagacccatagcaaggaggcgttgccaaggtcaggctgtccaggtgcttcaggattatgtgagggaggaagacagggctggaagcatatggcttaagctgaataagtaggagacaaatgagtgaccaagaagtgcctagaagagtctaagacaaatataaaaagaagggtcagagagaagaattttgaagtctatatccaataatagcccaaagagattccatgatgatttgaaaacctgttgtactgtggaaatcccaacccacctgctcaaccttgtcccagtgagccagcttttgtaaatagagggcccatgctttttccaggagacttttggcaatctggagagctttttctgtgggcaaccttgaggctgaagtgccttgagactatcccaggctattcttcaatcttgctctccctttaagaagcaggaacaccagacaactgctccctggtgtctcaaagctgatgattggttattactagttagaaatgattgtttatgggccttttaaaacatgttgaaaatttaacatccaggaaaaaaaaaaggcattggagacagaaggcagtggtgggatgactgctcaatttttccctcctcaagtctaagcatttgtagacgtgagcggaatagggctccaggagtcagaggtactactgaccatcccctttcccctatgcccaagcactatgtctgaattctttcttctccattcagacctgggacttcttttctcctctttcttctccccatttctaatcacctcatccaggctgtctggtgttgtggatggtcccagagtgaagctggagttgggtagagaacagacatggtgctggaaggctgtggatccgtgcacgagcgtgtgcccatccacgggtgccaccccacacttgtgcgtggttcactgacccagcccttgaagaactctgtttcattgtatctgtgtttgagtgtctgtgcaccaaaggctgtttcaatcatgtactccatcacgtccctctactagaaaaataagagttcactgcagaggagctgactcgagtcagtggaggtagagaaacaagggactaaggatcattcagtcagcctcctcagacagtttggtgaaagctgaagcagggctcatttggcaagactctgtttagcacagtagcttaactctgatttattacataaaagtttctggcaaatacaaatagtaattccactctggtaacaactgtgattgaaataattgtagtctgtaaataaactgcagaaaacaagcattagtgggtaggttgtcttggatatcatttcgagagtccagcactgaagaaatacatactcttacggacgtagaattggaagagatattcagaagacctgtgactggttcagccccctccctttcctccagacccacgctaagccatccaggtaaatgaaactctttcctctgctcaagacctgaaaaaaggagaatacacatgtcctgtggccccttattaaagtgactcatggtcttctatgctgggaaatcttggttaattatttagtatttatgagacttgtatgactgccttcatggacataactttttcccggtgtttctttttttcgatgttaccctaagttaaagttgtaatacatagaatcacaccagatgtcagctcactgcaaatcctattgggcatttgaattatattgcaacacctgataaggaggcaataaagcagatacaaaaaaaaaacataga

SEQ ID NO: 60274 - DNA, 1038 bp, Bovine  19866880419677
gcttattcataacctatagcctgagcttctcagggatttaataaagagtgttttcctctcacatggtttaccagccttgaaatgttagagaggaaatcaagaagtcatcattatatggctgcatattaatcattagattttatagttggtcatagttcttttatttattaccattttatgcatcaaatgcaatattcagacacacatagacagttacacagattcagggacttatgacctaggaaaagtgggcttggtttctctgtgtgtgtgtgcatttctaattatgtcgggacgtcatccaaagatgtgactgttgtgaaaagatcacaaattaaccggcgagaatggaaggcaacccggagttttttgagagcaatcttagagcttggagaattcataaaccaagtaaaccttctgacataactataaaatgtggtataaaccctagaaaagaatggccatcttgaaagggtaacagcacttttatgagaattccaaccgcaccatggcaacatcaacccgtcaaagcaaatgaagggtagtaaaagtaaaattaaacatgatgaaggggacaccagcttgctaacagctttccgagcagtaaagctttcaaatgttatctcttcattggtctgttcaatcacacatgcctgctaccaagctttatcatattatgtatctttctcatcactgccgcctgccacgggcttgatggacttgtctgtatattcacacaggaggggaggagagggctccccttccccccactgtagccccctccttgtgagccctcatctccctcctgtaattcttctctcccactgtcctctcttgcccttgctctggtgtccaacatgagtctctcttgcataacaaaggttgccgtgcagctctgagctttgggaactaaatatagatcaaagccccatcctaccctgcatcacccaaaagacagatcccaacatgcgtctgactttgtcctctcttttagtctaaaaatcagcatccttctttctcctctggttctcctcccag

SEQ ID NO: 60275 - DNA, 2795 bp, Bovine  19866880456040
cttgatggattcaggagagaagaggaatgagtcatcccgactctgaggacacccgttcaccctgtaaggaggggcttcagataaaagggtgggatgctatattaggacagccacccactcctgggtgcataactggaaatttcttattttctccattttactaagtcaatgcccagaaaacaattttagtattctaagagagagttgtacctccctcattgcaaaatatgctctttttgtacttttaattcatcttaagagctagaattctccttcttagggagtaattaaggaaaagctggttgctttttctatataatctgactttccctttgcctggggcagtatttcctttgccagaccatagcatggagtttacggcatattagataattattctgtgcatgccatcagcactgacgtcaacaccctggaaacagacagacaatcaagcaatttgaggtccacagagaaaagcaggaggtggaaaattttccctgttaagttcctggcattttttggtaattagttgcagataggaaaagcgatcaatcactttccttgcagaatgtctgactaaacgaaggttctggtttttgaggttcaccaggcccacaaagtggagaaggaaatggcaacccactccagtgttcttgcctgaagaatccaggggatgggggagcctggtgggctgccgtctatggggtcacacagagtcgaacacgactgaagcgacttagcagcaggcccacaaagatgcctgtgaacttcagaagttccgtcattttaaagctgtggtcagccagtgacttggaaagtcctgccgaatgcaaactgtgacagggatgctaacttcctaggaatcaaattaaaacagaaacccctttataaatgcaccagttctcagaaagatttacatcatagatacttcataactatagcgattttgattctgaaataaatcacaagggtgtgtatatatgctgttttaggatgaaatggtccccaaactgttttcatttgctatcgttatcagaacatctgaaatcctgacttcgaaagaaataagatgcaattttgcccaagacaaatgtagggattaaagttaaaaatctggactcaaatcctccttgtgccatatgctagctgccatttccaacccctctgtgccctggtctcctcacctgttactggagtgagttgccatttcctactccaagggatattcctggcccagggatggaaaccaggtctcctacattgcaggcagatttgttgctatctgagccaccagggaagcccccctcacctgttatgggggtgatactggcacctaccttactggctgctatgagaatgaacaggtgacacaagcagcttagcacaatgcctaccacagagtaagcattccattaaaagctttctggaaaattctcggccagagatgaattagggggggtaggccaactggccagtttcctggaggtcaatgtataagatgcccaagaaatcactggaaacataacaagatcaaaaaatgggattttcaacaagagtacttaccacacatgattaggaagaatgctggggcaaaccacttgtaagaaggtaagcctctgtaaggataaattcaaagaccaatagagggtctccgaactcctggagccaagtggccagggccttaggggtatctctgtaatagttttcttcctccccctccctctttccccaagaggaagctcagtctcttcactaaataagtatttaataaattataaagaataccaatctgaaggcatgaaaatttattagcctgtccaggtgtctccttggtctaccatgctctgagctatttgggcactgggatctaaacactctcccggctcttctcattctctctcattatttaaccacccctcagtggtcagaaattccagctcaaaccacctgtagtcaagtcacaaggcacctccctccactggggccagactccaagggagaagtgaccctctgtactcgtgtgaggacctacagcacttaagaccaagaaaagaaaaatccactattaaaatactgctgggacctatcagtgagtgttacttagaaggtgtggttgaaatttttctgtagggatgtaagtttagattgtgaataatataaatagttgctgacttttccaaagttaatatagcagcctgtggtccacagttttttttttgctagaatgataagaaggctatggtctgatcaataactactccaagtccatcctgaaccatggacactgtggaaagtaaaagaaaggtgagtcatccacctggagaatctcaagatcaaaaggtagcccagtttatcttcctgatttcatcatgaacatttatctccttcaccctcatcaagaggtatacacagagaatagataaattaaaatttcagttgttaatttaatcaagcatgatttgacagggaacctgctgcaaagaggacactctatgatgaagtccaataccaaaaatagtgagagtttaaaagtggattatttgaaatctatcccattcccgttactcgtattcattgctgagaaagaagatggtttactcagtctactatcgtctaggcacatggaatgaagtgactcattatcttcactcaatattaaggaaggcaacaccatggccagtgtacagataaaatggtcaagacatacagagaccacaattcggccaaggttgcactcctagaaagaggcagacctgcacttcccacgctgccccgctggcccactcctaaaactg

SEQ ID NO: 60276 - DNA, 1503 bp, Bovine  19866880466262
gtagagtagcaagcctgtcccaggctcagaggtacgggcggggtccaagctctcatgagtatgaggtccagctgcacactcacgtgtgtgcgtgcatgtacacacaccccagtgccatccagagacctggagaaggaggagtgatggtgaaaacctcccaggacacttcttcagtccacacaccttgtttgcaggtggtcccttggagcgaaactgctttcacgtagtgactcgtttattcaggaagcatttgttggtctcctgggttcagaaatatcaatatgcccttagactccactccagcaacctccatttctgtgtgctgcactcatttcttccatcggtatttaatgaatgcccactacttggtgagcacttggcctgactcctccaagcccacatggaaatggtatgtgctcagggattttgcagtcaaggtgaagagtgtcccaggtgagtgagggcacttttctccctgagaccaggtgaacttggggtgggtggaccgtgcatgggtggagaatgtggaacacggagttctcaaactcaaggtgagcatgtgcacagttgaattgaggaaaacagctggctctccagagattaaacatagagggattttcctagtgttacagtttaggggggatcagaaagaaaaccagtgttggagtctacgctgttttccttatgattccttctccataaaccacaatcctgtctctcattcaggggcagtactcctttgcttggctgccaggagactccaaggaaaacagctttgggggagggaaggtggcgtctctctgtgtttgatgtggaaccagtaatgagaaactggaggctgctcagtacctgcctccaggtgtcctgtctggacagaatgactccctgctgggttgtgagcaagcgtttgtcccatcttatgggccatattccctacgaaataggcagtcaggtgacccagagaggactccattctgccaaatgtgccagtgccctgccattatttcttaattgctggcaagcactgtcccctcttgctgtgtggaagcccgttggaggtactgtggaccggagcctgctggcaatgactgggaggctgcccacggcccactgcctcccagcgctcccgggtggttcccctgcagactgtactgggctccagccagtgggttgggtggtgggcacccagggtcacagtgtcttctttgtctctggaaaacccaggacactaaagagaaagtgaggatgttggtaatccaccggcaccaatctggagaagtcttgacagcagcccctgtagcggacgtgaagtttatgaacaaggctgtggctggtgaaagctcttgaggctgtgaactctccctccttcctctgtgatttgaaatttcagttagtgtgggagtgccttaagccattgtttagatttgaggctgaatttagattgaataggaaaatgaatgttgcatgtttagaaagggatgtcagttccttttcttctccttc

SEQ ID NO: 60277 - DNA, 2256 bp, Bovine  19866880500443
aatctgctgtcactaaaacaggactgagttggcaagcatttttatcctcacactcaacactttgtcctacagtggaaaagttaaataaaaattagggatacaaattagagccattttctgaaagtttcattttaattgaattaaatatagccatgtcattgttccctctttacacagcccacattgaaatggagactaagctattgttggggtccctgaatcaatggagaaagactaagtagataaatctggatgcctgaaatattttttagactaatgaccacagcaaccaaaacactgggatacccatcttgtgtttaattatccacaagctttcactgtaactggctccagtatttagtgatacttgtagaaagcatcctttttcatcttttactcaaatccgctaagccatgattgagtcccctggtcctcaaagccatgatggagaatacttgttccctgttcttcactctctttgggagtacctctgctactctaagtgtgatccatctttgggaagtattgatgttatctgtgagcttgttatacatgcagaatcttagaccttattctaggactacagacaacacattttcatcagagtctgggaagcactggactcgcagctttaaatgtttccactggtaagaaattatcgtgtattaacgtcagtgaatttagtgagattctccccaaactgtctaaaatattgaagattttctaaaagcataggtaattctccagtgatttgtctcatcagaagaaaccttatgattcctgtgctgattcaagtgcttctctaactccttccttttctcccagttcttaattaattaattagttaattaatagccaacagttgtttttggcctcagttttaggagcaatggaattgccaagtacagcctttgctggactctatttcctgctgaattgttgtttgatcctacattgaaattcagagagtaaaataagaagactgagggctgggtcacatgggaaagagagcatagtcatggacagagcaaagggggctcctttttgcaggcagggtggtgggactgtagctagtaagaacgagaacttctattagattgctggcaaatacaccagttcctgagagtccctcctttcatattcaagtctctaaggtattggatctaaaatttagaaaatcataaaccacttactaagtagcccaagatgttctgtgttgacaaaatttcccccaaaaatgtattgctcagcaagttctgggaagtttaaaaatcacctaattatacacattccctatgagataccaaaaatgtagaatttttcagcattcagaagcacaaattgatttcttttatggttacacctaatgttgtgaagttatcagtactgagttgtgattggatgcctagaaaaattagacttctttgtctctctttctccagttttgtcttgctcagttcaattagacaaatattaattaagcacttcttttaagcacctgatagggtagtatactgcttgttctagaggatacaaagttgaatgcattagcgaggagcttgtgtttcaaattccactttattataggtcttgtcagtcattagaagtttcagatgctgtgatggtagctaactatagctaatgtgtactgagtgcttcctgcaagccagggagtgttctaagcgttctttatccatcaacttactcagccctcccaagctccccagaggtgggcattattgtgttccgaataaggcaggacagagcacatcaaattggggaacccagggaagaccacacagatgaggtggcatatgatgggaatttcacagtaagagttgggttctgacagtagaatcagggaagcaaaatggtggggagatgagggagagagaatgttaagaagagcatcctggtctccaccagttcctccttgaaataagggattccataactaagtatcacgtttcctgctatggagatttaaaactcatagtaacatgtgaagtactctgcattgcactaagaaaagtccaagtttggctttgtgaaatccactgcttcccaaatgtatttcatcatccattcaacaaatattgagctactgctgtgatccattcactgttccaggcattgcagacttagatgaatttttctgcctttaaaaaaacctacattttaatggggactaacaggactccttgttcactctcttgtgttcaaggcgacacttgttaacaagttctgttgagttta

SEQ ID NO: 60278 - DNA, 1071 bp, Bovine  19866880508051
aaatgcagctactcaaggcgaacgctgcatatttgacattaaaagcatttcacaaataagaaatcaccagaagcatatgagatgttggtctgttggaatgcactaagctcctcacgggtgtattttctgcttacagctcagagaatgaaaatcgcatctgcttttctctccccacccaccaaaaattcagaaagttatagggttattggttaacaataattttttcctatacagaaaatactggccagcatagaggagaaattacaaaacatgagacaagagaatagatcccatgtaaaatatcttactgagatctgcatgaggccttgagagcttgtcttaagccactatcataggttctgcactgcctgggaatccaacttgagtgctgacctacaaaacttgttggaccccactgttctagttctgaaggcccttcacctccacccttcaagccaatttagatttcagtacaacgagaaccttttgtacctcattttgatgctacagcaggcaaacatcatgacttatccttagcacatgcctgcctgctcctctcacaagatgggagaagaattcatgtttattccaagcatcacagccaaatagtcagctagactggagaggtgttattccctgtgcccatacctttcattttgaaagtcatttttcctccatttttttttcttagtggagaaatggttgcactcttactttaaaatatggccagtggttttgccctcttggaatgttaccgtcaccaggaagagaggtttaaatctctccaatgggtcaagtcctgttctaagacctttatgacttgccatccagtctatttgtcaagcagggggaacgttatgattgtgaggaacaggcactgggggagatggatgagagatctcttcagcagcaactccattcccgtgatcttggctcacacttctagcgacaggttctgttagcatcctagctagtcagctgttcaggtcatcaccatgcagccccagccctgttcgatgcgtcattcctgagcttagcttttacaaagaaaaaaagcaaagaaaaaaaaga

SEQ ID NO: 60279 - DNA, 1360 bp, Bovine  19866880536056
tctttaaattaaaattaaaaatagttctaaagcccacaatgactgggatagcatcttgattatgaagataacttcaagaaaatggaacaactgataacatattgccaggattatgagctagtcccactgttctgtactgtgcctgcaggccccagggacctatttgtggcagtttctcttccttcagcccacactgtttgtttaataaatggttatttatggccttttcagccattatagcaactttggagaaagtacatccttctcattggttttggcgctgaaatttcattctcctggcaaaggtataaaacagagttgaaatgcaggatctgccctacaaagtgtgagggcctctgagaagagatcctcttgattcttcttgttagtttctgtaggagcttattttttttaatttagggtcttaaaagagacaaacttcagagctgaaagaaactttagagtcatccccattttatagatgaagaaactgaggaccagagtggcctctatgactgtgatcacatgacaggagatgaacccggattgtctgttaatgagtggattggatgcagggctcctggagggaggattagctttatgggctactcctgagacaggatattatctcctgcctagagctgcgatatgcacactgctcagttgtcgtgtgcagtgcctttagtacgtgtctctcatgtgcctgtactgatgtgttttttgatgtgaagtattgcaggcgacataaaagacttgagttcgatccccgagtctgaaagatcccctggaggagagcatggcaacccacttcagtatttttgcctggagaatccatggacagagaagcctggtggggtacaatccatgaggtcacaaagaatcagacttgactgagtgtctgagcacacagcacatatgccaggatactagaaggaagggctactgtctctcacgtttttcgaaagatgatcccagaaatgactgcagacattcctgaatactgagtggtcaaactcagagttatcatggttctaatattgcatacggttccccagaattaggatgatagatttttgagagccagaagccactgggaagcctttgggaagccattgggaagccattgctttatctgcctcagttttacacatgggcaaactgagtttggataacatgttgaatctaaattctcacagggatttaggggataacctggagctaaaacccatgtcttttgattctctgtttttctgtcaacatcaccagtctaccactgacatcatcatcatcaaaaataaagtagtatttataaagtgcttactgtgtgctgggcactgttgcaggcagttcatctgtattt

SEQ ID NO: 60280 - DNA, 4847 bp, Bovine  19866880544951
tttaaactttacaatattgtattggttttgccatatatcgaaatgaatccgccacaggcatacatgtgttccccatcgtgaaccctcctccctcctccctcccataccatccctctgggtcgtcccagtgcatcagtatgttttatgacaacattatgtatgcaggcttccctggtagctggtaaagaatccacctgcaatgcaggagacccccattgaatccctgggttgggaagatgccctggaaaggggaacagctacccactccagtattctgacctagagaattccatggactgtatagtccatggagttgcaaagagttgaacacgactgagtgactttcactttcactaggtatgattagatcaagttactgctaagtcacttcagttgtgtcccattctgtgcgaccgaatagatggcatcccgccgggcttccccattcctgggattctccaggcaagaacactggagtgggttgccatttccttctccatgcatcaaagtgaaaagtgaaagtgaagtcgctcagttgtgtccgactcttcgagaccccacggactgcagcctaccaggctcctccatccatgggattttccaggcaagagaactggagtggggtgccattgccttctccgaggaatctcttgatttgcatctcttgaattacaggtggattctttaccattgagtcaccagggaagcccctcagggtgtgaccccagactaataggattagccattcctcttgaacttgtgagtgaggcacactctcaggtcccaacccagatacactgaatcagaaactctgggaatggggcccagcaatctgtgttttaaccttccctccaggtgattctgatgcacgccactgatctattaatatccagaatatgtcatgtcactgttccaaagcagctacccttcatcatgaccaaagactgactcaatagatccgggaaggggatcacaggtacttgttcttgttttctaagtttttcaggcatccaggtatgtttctgattaccactcctgtggagggcttctcaaacctggctgaacactggaattaaccagggaactctaaagcattacaatggctgagttctaccccagccattcacacttggtctgaagtacagcctggcttggcgatagcaggggagtctcaaagttcccaggcaattctcatgtacattgccaagtttactataatatacactcgtgtacactaatatgttagtgtatctaatatacagttcaacatgtattaaaatcacctggataattcattgaaccaaattcctcagccccccgcccaaagaatctataggtttgggtatgggtcctaaaacgttcacttctaaagaattcccaattgatgtgctaaccaataccactctagaggaatatgcttactttttagatacctgggatctactttgggctgggatctactttgggctgggatggccaactttctaccctctgttcctcctccaaactcttatatatttaacgttcattcttccttataaagtacccatccagttaaattatcaacatttttaaggcagagctatgttctccccatctgtgggccactctaggaatcagtgagttgcactcagtaggtattcaggtgaataagtgcacaagtgtctcagcgctgcttcccaatgcttcttttctccctactggatcagctagccaggtcaatctatcaggggcccttgatctcatcgaaaagaatcgaggcatctatttttcttttaagatgacgggaaggtaaatatccgtccagtcctagagatttaggttgcttggggagactgttccaataataccccagatgaagtacagccatctggagagtgtttggcatcgatggaaacctactgctgaatttgttcctggaagacattcattttagaatgttatttccaatttggcacatcacagagctgtacaagtcagagaggatttagaatccctgctacctacagagggcatcttatttaaagcatgtccctgacaaagcagtatcaaggaagcacaattggaaatctcctacaggggaataatctctctacagctatagcagctactgggacagcaaagcttcctaaaaaaaaatctaaacttttatcattccactttgctggggctgccttcttcagagcccagtcacaggaacagaacttaataagttcgtttctcttgacccacaacagcaattcagtctcaatgccattgccgagatgcatgatgccactgaggcttcccccaccccacaaaataaaagctcaggcaaagagtagagcccataatctctaacacgatggtccattctagatggactaacagaaggtagtgccgtggtgaagaatctgcctgcaatgcaggagatgcaggagacttggggtcaatctctgggtcagaaagattccctggagtaggaaatggaaacctattccagtattcttgcctggaaaatcccatggacagaggagcctagttggtggctacagtccatggggtcacaaagagtcagacatgattgagcaccaccaccatagcaaaaacagcaataacatgggttatttttactaccccactccagtactcttgcctggaaaatcccatggatggaggagcctggtgggctgcagtccatggggctgctaagcgtcggacacaactgagcgacttcactttcacttttcactttcatgtattggagaaggaaatggcaacccactccagtgttcttgcctagagaatcccagggacggggtagcctcatgggctgccgtctatggggtcgcacagagtcagacatgactgaagcgacttaacagcagcagggtactcatatggaataaagcaagaagctcagaagagggggatgagtactttggaagtaaaaaaaaaaaaaaaaaaacagtttaaaaaagtactttggaagctggtaagttacagaaattatcattaactcaatttttccaaagaatggaatgagttactttgcttctcaatttcctttcccacctgggagaaccagtgcaatactgatagggagtctttctgccttttgtcaggggcctggagcaaggaggaagctgcgtttagtcttcaatcttattggacaagactgctagactcatttttaaggtgtaactatcatggccacatacacttatatcttgagcatagtacattattaagaagcatggaccttgaaggtggattgcccaggtccaaagtcactgtcacttacccactctgtgactttcggcaagttactgaatctctccatgccttggtttccccctttataaaatgacctatttcacagcatcttttggattactacctgcgataatgatctatatgtacatgacgtacatacatgtacgtacacagataatatgtatactataaatgtataatatgaatacatccatctctactctggttacagaagaactctcttttaaagcatgttctctctctccccacttctctttcaatctctctccactcccaaaacatatctgaccccaaaaagagaaactaaaaaaaaaaaaacaaaaaacaaaacttttaattttctttattattattattttaaataaaaccactgactacagggaagagtttacttcaaaggctctgagctttagagactctagatggaggagttaaaagtccagcaatctcagttttggagtaggtggcctctggggactctcaaaggccctttcttccagaccttgggcactgtgacctggaacccccttggccatggtggttgggtcaaattatcagatgccaggtaccctacggcagggcaaagtcagcccgcccttccctctgctaaccatgcactgcccgctcgaccacgagctcatttgtcccccttccctcttctatcagacttatctcactctaacccagcaaactccaggacagtcctgtagggggaaccagagtcctttcttttcagagctcaaaagagttcagagttctggagataaaggtggggctggagccagggcctctattacacctttttgcctacgcaagccttaagtgcatttaattcagtttgggtgggctagtgaggggtttcatttcattcaccatattaatgaattcccttgcatccatctaagaaagctatttacttctttttgatacagactttgtaccattagtatccttccactaaaaataacttcaatcaacatttgctaagcttccactgcatacaagagtgtcccagctgtacaaaaggtgaaaaagttcatagtactttctgtcacaagactcacatcctagagcagtggggtccaaaagaatttctatgatgatggaaacttcttatatctctgctaatatcttagccactagccatgtgaaactctcaggtatttgaaacatggctagtatgactgaaaaattgagtttttactttgattttgattggtctacatatagatagtcagacgtggccagtggctacgctattggacagcatggtctagactggaaaaccatgctacttaagagtggcccccatgatccctaggccagagtatctgcatcccctgtagcctgcagaaagcagtctctgatctcaccctacacttcctgagttagaaactgcactggaataagatctcctggtgcctcatctgcacattgagtcttaggaagcactcttctagggacgaatccattcaacagtcataaaagatatatatatatatcttctctctctatatatacatatacatgtatatatatatgcaagtgggtctcgcaatctctcagagttt

SEQ ID NO: 60281 - DNA, 844 bp, Bovine  19866880558638
gttgagtcacaagcagagaggaaacctctggggaaaacagcaggagctgtgggaggaagaagagcaagctgggatcccaaaggccatgggagcctcacccatccactctaccacctctgagaggctttgaacttacaggaagggaaagaagtggagacagtggcctcgaggcaggctgggctacaagagggctacttttctgaataagatctaaggtctcagcccaaagagactaattgttcccaagacctcaactcgagagactgcctgacaagatactggttagacctttggttattgaccaagtccctatcttagggactacatcataatggataaactagagaatgactctctttctcacacacacactcacactcactcacacacacacacacccctatctctactattggctctgggtgtcctgtaggaggtcaggccagggatgttgataagaatgtgagcgtgagcgaccgtgagccctggatgctgtgctgctggtgaggatgttctggggacactgcatgaactgtatctattatgccaacatagattagaactgaaaatgaggtgccactgaaacgttcatattctccaaaaccctgaaattgggtgttgtgtgaacaaaacaccatggttctctacccaaatttttttgactttaaatcatctttgaatttccaatgcatgtgtctccatggctttggatcacgcgttaccttgagttctctgacaagttaatgcattgttagaagaagttatattctgagcaaaatgtgcacatgtaaacaaatcccttaactatgtatacatttaagttactttctgggcatctatctga

SEQ ID NO: 60282 - DNA, 1614 bp, Bovine  19866880564201
aaaattttctataaatgtataaatataaaactagtaatgaaatctttatgcatatagctcttcctcaactataaaataaaacaaaagctgtgagctatatagcaaatttgaaaattaagtaaaaaaatttaaaagcaatacaaatcaaatttaaaatattaattcagtgtgacagatattattgtttacactaaccctaactcatagaagttgtcattatttataaaaagagcctcagatctagttctgtaatgaacttattttccctgtattttgaatttaatactatgaatgcacagggcatttgcatgcaaaggaagcttttcagaatgaggcaaatactatccagaccttgtttgctaggtcaggaaaatcaggcctcattctctgtcaatactttacatgttagaagtcctagaatgccaattttaattaaagatatcagcattacattattagtgaaacccacacaaaattgttctctaaattgcaaagttgctcaagtcagaaatttggcggccattcacgattctacgtctttgtcctcatgttttaactggccaagaatctctctaaaatattcactgactctgccctcttctttttatctccttctaactatatgaattcctgagactcaacccatggagttaaagactctagtttgagtaaggaggtatcccatatgctagtgatctctgtgaaaaccaacgggaggatggttgcatgagagtgctatttatacaagtggggttacacggtacttatgcatgcacctcttctttgtatttcttttttttaagttaaactatagttaatttacaatgttgtgttagtttcaagtgtatagcaaagtgattcagatatatgtatatatagtggctcagacagtaaagaatcagtcagcagtgcaggaaacctgggtcggatgcctgggttagatcccctggagaatggaatggctatctacttccagtattcttgcctggagaattccatagaaagaggagcatggcaggctacatatagtctatggggttgcaaagagtcagacatgactgagtgactaaaactactcctcctcatgtgtatatatatgtatgtatgtataatgtatatgtagtcttttttagattctcttctattataggttattacaaaatattgagtatagtttcctgtgctatactctaggtccttgttttttatctattttattatatggtagtgtgtatatatttatcctaacctcctaatttatctctcctctcccatgttttttgctttggtaaccataagttcattttctatgtgtgtgagtctatttcttctttgtatttcttttgaacagaactctaggttctagaataacccagagttacccattggtatgatgaagtccttcatcaatggagaggtcaaagcaattacttatggctttctgacttcccagttacaatcaaatctaacctagaagcttctttctcatagtatctgttatgatgtgttctgttgtcctctgcagcctaaatcaatacatttcatcattaaagagttcaacctctttgtaaagagctttggtttttcaacttggttggggttggggcagaaacg

SEQ ID NO: 60283 - DNA, 1633 bp, Bovine  19866880564590
ggaaactcccatggatggaggagcctggtaggctgcagtccatggggtctctaagagtcgggcacgactgagcgacttcactttcccttttcactttcatgcattggagaaagaagtggcaacccactccagtgttcttgcctggagaatcccagggacagaggagcctggtgggctgccatctatggggtcacacagagtcggacacgactgaagtgacttagcagcagcagcggcagaagcttagataaggggccttgcataaatggggtacagacctctgaggatcaggagctactgactggaactggcatctgctgggggtaccagggcactggtatttgggaacacaggaaatactggaaggaaaattccctttctcctccctcagcattccagtctcactttaatttcctctataagtagatcctaataggtgcccactggtaaaggacaaatataacctgcaatttgcagccccagcaattatatggtatattattgaaggatgggtttgagctaaaagacaataacttaatagacagtataagttgcttagcttctttaaaaaaaataattttctgctctatacccttgcttttcttagtaacatgtgaaaacatttccagtgcccatacccttctaaagcatgaattctaatggctgcatatgtattccatcatagggatgaaccataatttagttaaccaacttcctgtccttagccattagatgttttgaaatcttgttgttcttatccacagtaatgcagcctgctaaatctaagcacatatccttaaataatcccttagaatagatttttaactgtaattactaagccaagaaacaaaaaaaaaagcttctaaaataaaatatcactttttctaagctaagaaaacatgaaacatttatggttccttctgttctagaatataatgaggtaagattataccatcctaatacactgggtacaagggagggcttaaatagtgtctgatgaatgcaggcagaagaatggggatgaaattatttcagagtgaaacaaaacctttcctttaagaaaatatttaaaggcaagggggctattaatgatatcatctgcctcagttggtagagataccgtgttgttactgattttaactgaaatgcattcttagcagaactaattttgtaaagtatttctctacataatccaattttgctcagtgtttatggttttgacaaaggaacaggcagggtttgtgtcagtatttatggatggtagccttgtaggaattacactgcctagaggatattgctataaatctataatgatggttgtttttgattccatctttagtttctgaattctagccttcataattagaattccatatcataaactattggcctgtgacaattttatttttctcctgggatgcctggattttctgaggtatgacatgcttggccctctgtgaaggacagaggtcttgatggttctgagccagatgtttgaagcccaccttcctaacggagatgtgatgtgccagcttgagtgctatcttcagaaaatccgaatccaagcctttgtcagatccctgaggacaattccgagaaagttactaccccttgtgctggtttctcagtgctg

SEQ ID NO: 60284 - DNA, 816 bp, Bovine  19866880569178
aatactcgagacctgagagaagaagtagacagactgcaggggtggatacatctgctagttctggattctgctgttgtttccatgttaggagtaaagccactaatatcagttataaatagaacagcactatgtactcagcaggggcgcggaccctctaggcaatgttctcaacctcttattagtccgtgacccttcctgaaaaatcataaaaatagcacgtgctccttcaatagtatttggcatttcaaaagagattgaataccatgtctgaaatcacaaagggctggcagagcatgcttattccagcctttcagagccctccttcctctcctagattctgggagaacatgggcctcttgcctcatagtctcatatctcttggcaacagaagtcccagggcactggcaggaagttacctctaagttagaatctggggtctcagcggtagcaccgcggggctgttagtcatggcccaggtgagataattgagataatgatcccttgggaggggtccacagtgctgtctgagctgtgaacgggacctcagcagttttggtttcaaaggaggttgctaccctcctttttgtggacatgtggccaccgtggcttcccgactgcctcccgggtcttagtccctaggctcctcctgaagtcacaggagggccacagtgcctctctagtggtggttacacggtggccaacagcccaggccagctctgtgagctgtctgtgaccaactataggggtgtcacaagcttcttaggtagataatgggggcagcaccagcatctgagtctcaggagctccagctccagg

SEQ ID NO: 60285 - DNA, 1201 bp, Bovine  19866880579151
acacttcacgtggactgatttttttttttttcataatgcctgatggaagaaatctcacttgatagtctgcagcccactagtcttggaataagagatttggctcaagtccaccccaaaatttatctttggagttgtttatttattcgttcagtgctgaagcaaccaattatctggcattccatcaaatcccaaataatgtattttaattgacattatcccaaagcctttggacaatctgagatcctttggtcctatcctctcattctggaaaatgcaatctgaaataggccataatggtggaatgccaaatcattatggggtccctgaaatccaacgccgttctcggaagggcagccggcctgagtccacatccaagaagtgcagcgttgatatgcagtttggcgcagaggagagagagattctgaaaaggtgcaaatcaccattggtttcccatctcttctgcttttctgtcatctcaactgtatcacaggtttcttccacccctagaaagctctgcagggaggcattctttgttctggcacccaggaggacctgagctgctgctgctgctgctgctaagttgtttcagtcatgtccaactctgtgcgaccccatagacagcaacccaccaggctcccctgtccctgcgattctctaggcaagaacactggagtgggttgccattgccttctccgagtgaccagcctagagcccaccaatgctgatcccattttttttttaaattgtaattaaaagcttgacacattctgtgggggttccctcttttttgtgggaataaatatgttttgtgggattaaagatacattggccagttcctatctcagtgctgtgttttagactgtcacattacaaaggacagagataaagtataatttatatgcacaaatattcagatgcaattaattaattctaattaaagacttatgattgaaagctgtacatcctttaaaggaagaatattgagaatttggataggtttttaaaaaatcataaatgtaaaaaatgcctactattacaatagctttcttctctcaattttaggtgacgctggtgtgtttgttatgactcacctcttcttattgcagctattaacataatggtcattggtttttataatttcctcttagttcattatttttgatgtgcacaacataacatatatttagattaaaacaatgta

SEQ ID NO: 60286 - DNA, 2330 bp, Bovine  19866880585279
tttcattatgctcgatagcattttgaagcaggcttcaatttaaagtgacacaccaaatctaactttcttcaccctttaatttgactcactggtaacacaatttgggcataacagacaatgtactgtctattaacaatttgatagtgaattactgttagagtctgtcatcttagtatttatttaactgagctgcatatgatctagttgaacatttcatgtgtttgtattttgccttctggcaacctgtgtagagagcacattcagcatggcatatgaaatatgcatgtgctctcccttgaaaatatttataaatgtaagaggttaatagtgaaacacttaaacaaggatgacacaatggattctactcccatatgcatagttattattgaatttttaaactcattaaaggaaaaagtctggaggaggggctttaagaactagggacactgcatcagcttttgtgtttctgaagctcttgctgggggtaagagatggggagagttttcagttagccactagaccatagaaaaacacaaaaaattaattgacctttttgtgaatggggtaggaacattttttttcttatttgttgctatagaaaatgataaaaaggaccttggagaaaattcaggtttgtctataagcactatcaactcaatcacaatagcacttaaatagatctgaaaataactgtatatacacatacatacacctgtacatgcacacatacatccatgagataatacaaggtatatacatctgtgtgtgcacatatgcatgtgtacatacaaatatatgtatgtatgtgtgtatgtacatacattcatatatgtacttgtatgtatacattcactgtgtgaagaaaagtaatatctcatcttccatgttctcaaacttagttttcagccattcttctcaactcattccttatgtgtccttcaaatagtcttggattagtgccttggttatgttcctttaaactttttagttgattttatttagcaaggtgcttcatttctagagtcttagtcagcatcactgttatcaaaagtgagagagactttccagttacaccagacaacagatttcttgctgtttttctttggttgctgttcctttgtttaacttagtttgaaataggtcacaggtcaggcaatggtagatccaggggctcaatgatgttttcagggctctggctatgttgccatgtctggattcattccccactgaatgactgtatcattcgcagctaagttctcttcccagtggtgagagagagtattagcatccctagacctttatactaatggctcatcattggaaaaaatagggacattctctcactgttaagagttagaatctagggagatttctaaatggccctacctagttcacactgccaatcactggactaatcactgtatttgtttacattccaggtctagctggagacagagcacagcttaggaccagggggctaaaaatggaatttcagtataaatagccccatcagaactacacgtaatgttgtgtgctgggggttggggttgtgtgtgggaagagtagctttcataggaaaggggaattagaattctccttacctacccaggtgccttgactcaggatcacctcatatggtcatcttaccatgtacaggactcttgccctccacccaggtctcaatttctttcttttttttttttcctctaagtagtctttaatttatagctgaagttgcccaggactttccagggaagtcaggagtcaacaggagcccaagagataaaacactcgcatggccaatgagcctcaaaataagcagtaaaaatgggcagatggcctccattcaagagtcttggaaaagtagccagatgttctgtgctcacttaatagacatcaaacaaatcacatgcaaccacaaaatagattctgctcatgaccactggctgaatcaccgggagaagaaaaacaaagtctcaatcatgtttcttagcccagttcctctttccatcttcaaactgtcttgccattgaatcaaagccttccctagaatgacttgtggtgtagtacatggtgtcaaaattctagaagaaggtagatgtgtgacaatgagggcaaattccctaatttctgtaaacttggcttaccctttacctgtagtatgggaacaagaatatttctttcatgggacagttgtgaagcttcaatcacttaacctctttaagcttccatttcatgatctgtacaatgggcatatgtatagttatattttactcataggatacactagagatgcctatttaatatccttcctgctctttttccttagt

SEQ ID NO: 60287 - DNA, 2170 bp, Bovine  19866880636660
tggaaggaggtgattagttgtaaattctttgttatatgaccctttacagagagagtttgcctaccgctatccactgctgccttagggtttgcagggacacaactagagcgaccacttgtgctaagtcatcagaggaagactcccaaacaatcacgagacggatcagaacagcaagagcaacaggcccccgtcttcccccaactccaggcctacaattcacaaagggaacaaatgaaagaataaaatcaccccagtttaagcttcccaggacaattaaacctttagcccctgctggcccctctgcttactgtgttcgtgcaaagagcaacacaggaggccagtggtgggtctttctctgcctctctttctggtccaatgcctcccaacttcctttcttcctcccagttcacccattgcatgtctggatggccccatgtggcttacaatgcttttggggaggcatattaatgtccactgcacatatcaaactctgctcaatttaatctctagaattgaccagtgtattgattgtttaaatgccaatattgcaattcatgacaatgtcagggttattacagcaacccccaaggagaggaagaagctagcttttactccctgatcgttagaataaagcaggggctgtcaccgttattggtttctctctgcaacagtacagggacatctaagatgcaggccataaaacatgtcttataaatggtgaccaaggaggagccgctagggagtcacatccccatcactgcttcatggatgagtgagttatcttggctggatggagcatgcatgtctaggtaccagcagcagagggtcaacctgtctgtaatgtgctgtgatgggattcctgattagttttatttggccaggtcatttgggaggctagctcccttcaggaagcctgggaaataaaaactaagttcagaatagaggccggaaatctagacgtgtggagctagggaaagcaccagttagcagagtggccgttcactgtgctaatcccaggagcttagatctggtgtccaacacacgagatcctcagactaaccagagcagtatgacctggagaacctggtaaagaccccaattcccaggatgtagccctggggagacggattcagtcagatattagacccaatggagaaaccacttgtgtgtatcttctttttcctatatatccttcaaggcctagtccatgtatgtggggccttcacggccattaaccccttctcagctcaacctgtttgtatctaataagatttccctggccacttaaatacatgctagagtgaaacagcactttgtgtcttgccacgcttagcttttaatatattgtttcatggtacattttatcttttaattagatggtcattttctcagaattatagccatctcgaattttcaactccaaaagcacttagtatcctacatgcacaaacaatcctcgtgcagctggctctcgcaagcattctcatctctttgagagggttatttgacaacgggttttttggaccaccctgtctaaacagcacctacaagtccctttctagcccatgcatgtgtgggtgctccgttgcatctgacgacacggactgtagccctccaggctccttggtctgtgggatttcccagacaaggacgatggagtgggttgccatttccttctccaggggttcttcctgacccagggattgaacccatgtctcttacatctgctttactggcaggtggattctttagcactgtaccgcccgggaagccccttctagcccacactgctgctgttgttcagttgctaagtcctgtctgactctttgcaatcccatggactgctacagcatgctgggctttcctgtccttcactatctcctagagtttgctcaaactcatgtccattgagtcagtgccatccaaccacctcatcctctggttgcccccttctcttcctaccctcaatcttccccagcatcagggtctttcccaatgagttggctcttcacatcaggtggccaaagttttgaagcttaagcttcagtctttccaatggatattcagggttgatttagcccatgaccccattttattttcttcatagcattttatcaatatctaaaatgttattacatagtcattgtctatcttgagatctggtctttgt

SEQ ID NO: 60288 - DNA, 2248 bp, Bovine  19866880669529
ctgtgtgacccacggccccagtaatcgcctccaggtgatgctgtctggaaaagctctgagacgaacagctggggcagtgaacatcaggcagaaaggaggatcatgggagtcaaagggtttctgaggatgattttccagctggcgtgttagattctaagcatgtctgtgagctctgggagatgggcaaacaggaagacaacaccctagatccaggaactcaagggtgaaggaatcacaaagttcaaaatggcatgtgcgtttgtaaagaccttctgtgattcgtggagtagtatataaacagcccgtctctccatactttctttggtaagaaaggtgaatttctactcatttcatggatgaggaaattgaggtttcaccagatgaaaggctaagccaaggacactgggtcagtcagtggtagagcaaagcccatccctagtccccagtctcgaattgaggctttcaaattgtggtgctgtggagaagattcttgagagtcccttggacagcaaggagatccaaccagtccatcctgaagcaaatcagtcctgaatattcattggaaggtttgatactgaagctccaatactttgtccacctgatgagaagagctgactgattggaaaagattctgatgctgggagagcctgagggcaggaagagaagggggcaacagatgatgaaatggttggatggtatcaccgactcaactgacatgaatgtgaaagtcgctcagtcgtgtctaactctttgtgaccccatggactatacagtccatggaattctccaggccagaatactggagtgggtagcctttcccttctccaggggaatcttcctaactcagggatcaaactcaggcccgtgtcttcaaaaggctcatggtttaatgtgggagacagacaagaatatacagcaaaatataataaaggcagggtggcgacctaccaatgtaggctgagagaacagagagagccctcattgcctctggtttgggaggctgagcctgggctgtgaaggatgaggagaattcttcactacccacccttgtccactgtttaccaggtgccaggcatcatttctagagcattatgcctattatttcatggagtcctaactacatgaggagggaccactgtttcattttatggataaggaaattgaatcacagagatataaagggtagtaaatctagtaagtcctacctaattgggaaggtatgaacctaaatggcttagtttccaaatccattgtatttactgcttcacagggcagtgcttaggccattgcaagtggctggagaaagaggtccttagttgacagtatgagagtgttctggcacttagtcatgaaggcctttcctgttgtagactagaaccttgcaggtttttgaggaagcgataccctaacttgtgttttgagaggatcactgatgatgctataaggaagggtttagaagcctgcatctgggccttctggagacactgacacataaattcagaggtgtgaagagaaggcttatccccgccttggcctctgcctaagtcctttgggtaccaaatcattcagggtctctgtcaaaccgtgggccagatgtaggctaaacaatcttcccaagaaggacatatagcattcctgacatcagttacatcgcttccctcaggtgctggggaacttgggataagacgccatgagccctgaggatctacccagggtgtgttgagtagacactttccacaaagagatagcccccagccaggctagtgaggataaatgacaatgccccagagagaaactgaacactgtgaaaggagcttcatatcctaagacccaggaaacatgagcggtttgttttctgaatgaaagtggagatatgattggagaaaaacagattatcctccttgtgggcactaactgatcattaagtgaaataaactcatctgcttgttaagttccatcccctcccttttgattcatacctctcactgggtctttttgttaggattgccagcttgaaaggttttagtaatagaaaacggcaaagtggccctgagtccactcagagttggagacagaatgccattcttacagttccgtccactgggcagaatgaagaaggaaagccaggacagcttagctgagtaaattcacctcttaatgtacaaacaaatcacaagtgacaggcccccacaggactggagaggaaagaaatggtgagtctcgtcatcccagggctggggtgagttgg

SEQ ID NO: 60289 - DNA, 2387 bp, Bovine  19866880675323
tgaaaagactgcctttgctggcagaggtttaggacggaatgcaggaaaattgaagtctttcccaaatctgcacatgcttcttgctgctgctaagtcgcttaagtcgtgtccgactctgttcaaccccatagatagcagcccactaggctcccccatccctgggattctccaggcaagaatactggagtgggttgccatttccttctccaatgcatgaaagtgaaaagtgaaagtgaagtcactcagttgtgcccaactcttagagaccccatggactgcagcctaccaggctcctccatccatgggatttccaggcaagagtactggagtggggcgccattgccttctccgacatgcttcttgagcccacgctaagtcatgtcggacatttcagtcatgtccaactctatacgacctcatcgactgcagcctgctaggctcctctgtccataggattctccaggcaagaatactggagtgtgttgccatgcccttttccaaggaatcttccccacccagggatccatcctgtatctcttatgtctcctgcattggcaagtgggctctttcacacctcggaagcccggtcgagagcagaggactgtgctgcagctggcaccatgggggataaaaagtgaaatgaccatcacatcccctgcctttaccttttctggagcgtaacttgcatcacatttgacttccgactcttaacatggttgcatattatatagtatagtctttatttttttgcatgcatcgtcttagtccattggacagtctgttaataaaaacagctagtatttattccagttgtgctatgcactgggccctatgataaacccttgcatacatgaacttggtccttagagcaaacctgtaaagtaggaattattttcccattttacagataaggagatgcgggctcagaggagctctctctcttgtccaggattctgtagcttgggagtgggggaaggccttccttacccaaaatctagtctgacttcatgcccattttcttacgctgttcttctgcctctgttctgacccttttgagaggtttggggttttgaggactgggttgggaataactgagccacttttactgctttatgttggcatctctctaactcatcctgttgtttcaggcaggcagggaggggaagaggtcttacttaaaaacacacagctcatagttcctccttttctcactcttccttatctaccgccagtttctagaactagagctagcgtggaggttcccgagtcccagactatcctagcaacttggggactggatctgctccacctgaagagagagagagagactgggggcaggtccttgatcagtagagctgattggctcagggtcccgttctgggctccaccgcctcagttcacattgtgctcagccacatgttcatgggttgctttgagcacggtcattttccctgtcataaactcagtcttctcacctctcctatggggataatgatagcactcacctgagatgagtgtagtggggattcagtgaagtgtaatgagtgaccaggcacacaggaccagctttgtgaacagaagccatggttatccacagcctttctttctaacctccctatcatattttaaaaccccagagaagaaaacaaaccagaatggaaccaaaaataaggcagtgggatgtgaggacatccacgtcggcaggcagcaagtcaatgcttattttaattcctgttcccacacaccagcttattcacaaaatccttatcctgcctcactaaaataaatgtaccttgaaatgagagatggatcttattttgagacttgaaaaacatgctctggggagaactcttgtctgtttgtctcattcttgtgggaactgtgtccccagggtgggccagtgggctctgcctccttgtttatggatatgtctttgttgaggggcatcttccagaagtaaaggcagccagtagaggaaaaaatggtacacagacatcagccagtcatctaactgactgttattgagtacctactgtgtgcccagtcctggggtaagagggacacatgcttggccaccttctttcctagttttactgtgatttccaaccttgcccacctcctctctgactgatgagatcagggtatgacgaggagctccaatcactgtgttcgaaaactagagctgttctctagtctgtgtcagacctggccttaggcctttcagtaaactctgctagaaaatagaaaactttgctaaaaaagtagaaaaatgagttagtgtccagtcatggaacaattaaaatgattgagtatctgcttataaatgtatgcctgggcaggactctctgtgtcaaaggggttaaacaggacgtaaaaaaaaaaggaca

SEQ ID NO: 60290 - DNA, 1024 bp, Bovine  19866880681137
tttttttcccaaaatagttggcaagtttccttttcccttagtaaccatttgaatattctaaacccagtaatatatccatgaagcactctgcctcttcacttttaaagaacatactaactataaactagaagaaatcagtagcacggtaagagattacttataaaataatgcattcagctcaagatcttaggaaaaaagtagtctttacaaccctagaataaaagatgatttctactttagtgtttatacttgaatagtcagagaactaaaaaagattaaaagtgataaaaattttcgaatcattttctgggggtaaaaaataacaataataaaacaaaataaaaaccaataaagcaacagatagaaaaggaaatcatgtacaattatggactaataaaacttgaaatctgcggtgagagggatgacatttcaaaaaatgtaaactttgtaagttcatacacacaaaaaagaaaaccattacaggataataattgaaatataaattgaaattttttacagatagcttcccctcagcgactttgctcccatataatttattacatttttgaaaacatgtacattatattgaaattctaaactattccataatacacaaaaagatgcaaaactatgaaacttgctataagataatcataaacctggtaccaaaaactgcctctcaaagcacaaaagtaaaataatttccctaagattagtgatactaaagttctacataaaataccaattatatataattcatccctgaattaaaataataacctagagcattgtggttacacttagcaaattggatagaataatttatctctgcctcctctcaaaatctcattaaaataatgctaataatactaataatagcataacactgaatggggaaaaatagcaatatcccacgtgggcaaaaagaaagggagaaaaactatagcacgtaagagaaaatcacaaaacgctagtagatgaaaagtggatattctgctgaaaattacctgacagagctcagaaa

SEQ ID NO: 60291 - DNA, 1457 bp, Bovine  19866880719742
ggagaccaggctcactgtaggggaaagaagggaagggaacgcagctggtgccaagagaaatattaacttgacatttagaaagcagtgaatccattcaccgcgctgcaacaatgaggtgtttgcatcatgagtcaccttctgttttcccattgtctttcctcctcagtggtctgacccagctaaagtcttggcagtttaactcagcatgataatgaaagggaggcttccgatcagttcagagttaatctctctcaccctgtctctctctcatacatacatcccctatacacacacacacacacacacacagtccccagacatatagtgattttgttcaaaagtccacttctgcctggttccttctttgatgaccctgaatttgcagttccagcccagacaacttgggcaccttaaaatgcttctaccttggcctggctttccagctactaatgaaaccatttccaggcaggatggagcattgattgaaattttgctgtatgcattcaggaaggccaagaacatgacaaaaatcatctacatagccacgcatggattttagtatttcagggcttttgcccttttatcctcttcccagaggcttggagaggtgggtggggtggatgccattctaacttcagaagctaagatctggatggttataaagtaccagactcagtactgggttatttgattgtattgtatcattcagttttcagcaggatccagtgggtcccatttaaaagatgaggcaactggaggattttggagtgttctcagctgggaattccagaactgggaaggattccatatctccctgactctacagctgccatcctgctggtgcagggagcatggaccagtctggagtatgggcagtatccggtgtgcaccccttcctctggtctcatccactccagtagcctgtagtggtccatggagagtcctgagtgttaggagggaacactccttttgcttcaatgcccatgctgcccccagaatcctcagagaagatattgcttcttatctccttgtcttattgaaactggatcttggcaggcatctgaatatctgtttcaggaccaagaagctcacaaaatgtcctgtccagaaattgcctccaggaatggatacaggtagatgtatgactgagttcctttgcggtccacctgaaactgtcacaatattgttaatcagctatactcttaatttaaaataaaaaggtaaaaaatacacggcctccaggccttacccatgacagctataggccagtggagggttctgttgctttgctcccagtctcagctctagaacacacccttgaatccccttgaatcccttgaatccccaggccccaggcccctcaactctacattatgagggaaattctacaggcctgatatgacacctgacctataagttttagcagtagtatgcaaggcaggagagagaaacagaaa

SEQ ID NO: 60292 - DNA, 1557 bp, Bovine  19866880724939
ggaaagagagtgtcttcctcacctggtcagcattaatagtacaccagggctttgtgccttgtctgagtgttcccacaggtctctaaaccagtctttaccgtatccatgggctaaatgaaattattaaattttgactacccagaagacgaagctgccaggtataacacttggaaacacactccttagtgaaaaaaaaaaaaaaaatttgcaggaaatacgtgtaattggtttccaagagccttctataaaataagttcaaatctttaattaaggagatgggacaaaagcatttcgtcttgagatattttccctctacctttgtggcttctgcgtgaatctcagaatgtgtgcaggaaagacagagaaaactgtgctcccattctgggtaaaggagagctctgttgtttgcatttggttagaaggcaggaaggtaagtcatctgactttgccaaatatggcccagacagcctcatgcaggaaccactcagcccatttgctggcagatgactgcattgtcagcgctgcgtggctgagggtgactgtgtggtgctgatgactccccctataaacctggcatcagaaggcaaattccgagtgtcatttgagcagtggagaagaggagagctggattgcaaggacctgtcgcccgttacctggggccacactgacttgggtgggggtttgtggaggcacaaatagaactgctggctcaccagggagatagttacagtaatgcagtgttaggtttcagacattactctctgttgcttggctactctcagccccctattcaggttggatattcttgttctgggcatgggccataacttatcatagtaagcactataaatgcaagctatgagcaagtctttttaggctgaacaagtgcatcttgaggattctttcacagaattaaagcacagggtccctatacttctgggtggttatcaaatatttctaggccttagctttctcttgttagaataaggatgataatgccagtttttgcagagttattgtgggggtaagaataataaatgtaaagtacctgtaaccatatataactcataataattgctagataaatcatatttgcatatatatgtgcatttattgaacaattaacatatgcatgtgtaaaataagcatatacacacatatagctgtagtaataattatcatatgtagttataatcagatgaatgagggctgcaggtgaattatctagatatatgagtatcctttttttcagaaggaggcaacttgtaaagtaacgttctagcaaatgattcacctggagatgtttggtaaagtttacttctacctgactctattttaaagctatatatatcatagtaatgaaacttatgagctatttaatactccatgtagagcaaaggttaaaagaaacaattttctgtgacataaatattaatagtaatagattggtagagggggttctgatgatagtaataataatatcatataagaaatgaatcgccagtccaggttcgatgcatgatacaggaagcttggggatggtgcactgggatgacc

SEQ ID NO: 60293 - DNA, 1448 bp, Bovine  19866880744220
gcctccctctagatcaagtacaggcaaagcttacggtgaaaggtggtgaaaggcaaaattccaatagcacaactattattaatctacttaagccattaagtgttgtccagtattagattggaccggaaatcctggttttcaactctttcctatttgaacgcccgagaggcgtgtcagcaagtaagaggaaatgcgggaattggctttcagtggcctgaggagaggagcttaaactcctagatttatggctctgctttacctgaaacttttattttgcttttacttttatgtagcaattgagtgtactatattccagttggtgcttcttaaacattctaaggaagctataaaagtaagtatcaaccaatttgtacaatcatgttcatagtggtctttattgaacagtctattatgtgggtgcaccctagaagcccccaaaatgtatgacattttcagaagggatcttacagggaaggaggtagaatttctagtgtgaatggtctgtttgtaaactcaattattctagcttttcaaattctagtagcagaggaaaaggcaagcaaagtagagtagtgggggttgggtcctcattccactcatgtggaatgtacgtgtggcttctcttctttggccaaagttttaggactaacatatacacattactgtatataaaatagattgctagcaaggctctgctgtatagcacagggaactatactcaatagtttataataacctataagggaaaagaatctgaaaaaaaaaaagatacatatgtatatataactaaatcacttttctgtatacccaaactaacacaaactgtaaatcaaccatattttaatagaaataagtagataagaatgggttgacctaaatatcctcagaaatgattactacctctaaacttctatgtatcaacccttattcagacaataaaagtgaacatccaaagactactttggccaaaatgaaattatatgtcagtgtcgctaagcatgcctcacacttctaggaaggccccatagtattctttcctttgaactttctggtttcattcatatcctgaagtgaagtgaaaatcattcagttgcgtccaactctttgcgaccccatggactatacagtccatggaaatctccaggccagaatactggagtgggtagcctctcccttctccaggggatcttcccaatccagggatagaacccacatctcctgcattgcaggcagattctttaccaactgagttatcagggaagccatatgctccctttattgcctgagataaactgtctattttggggggctccaaaatcactgcagatggtgacttgaagccatgaaattaaaagacatttgctccttgaaagaaaagctatgatcaacctaggcagcatattaaaaagcagagacattactttaccaacaaaggtccatctagtcaa

SEQ ID NO: 60294 - DNA, 1445 bp, Bovine  19866880747366
gaggaaggaataatttgccaacaggtgctttttcaagctactaactcttggtatttcctctgttccctgtaacactcattgcagtgtctgatatcatgctgttttactttcctagcctaatttgtgtatttatacatcattttggaccatgaactcctcaagatcaggggttgtgtccctcttctttgtgtagaatctgtaatgcacagccaggcacgttgcttttgcttaaaatgatttttcccttgatgaacaagggtgattcacatccctggttttgatgtgcgaggacttggaaatcttcttaacctaagaggagaaaaagtttctgccaaaggacggattgtcatgcccttccccatgcacatcctgtttttagtacattctgaataaagctatgctaaaggtataaaccaatttgcccagatcaaaagcaagtcccactttgtgattccaaagtccttggctcatgtgctttcatcagcacattcttccaaaaaataaatggcaacatgaattatgtctctttctgcccatatcctcagtgtccagcatatggtaatattcactaaatatgtgttgaagacatgcggaaatgaatataagttgggcttagctcataaaccctttgttctgctcaaaacctttgccaactggttcaggcagttacagcatctattaggcaagaccttgagctgtggagctgcccagttcaaatccacatttagcactgcttagtggaataatccatctccaatctcagcctacatcccctaaccctgatttgtcctgagcagaaggaggtccctgatatgagtttgaatggcaggctttactgacccccaccagttccatcagcctcacccatctccgcctataggctctgagtgacaggagctgaggactgaaatcgtcatccttccacagaaccagggcagaaggcacaaaaccatctgcttaatggtcatgtggcaacagataacatctcaaaagtccttacagtatattacttcactgatgaagatggatcacacttaagcagcgattcttgatctctacgaaacagctcatgcacagcaggacaatctcaaagataagacaaacagcagcaagctggtctgggactatgaaaatgcctgccgagacatgatttatgtgaaaagaaatgaggtgggtcactcctttatcatcaacagtaagtggattcttcctgccacagacgaacggaggatgtaaacagacaacacacttgcattattacttacgctgtttttctttaccaatggcctgcctgagatgtgggtttacaaataaagtcaacccactattattctggactgattattcattggggtggggggcgtggggggcgggttaaaagaggacacccctgccctcatcttccaccagataccctccttgtggctatttcactgactgcatga

SEQ ID NO: 60295 - DNA, 1685 bp, Bovine  19866880759928
attgtacagtacaaggaataagccatattttatcataactttaaacagtgcataatctataaaaatactgaatcactatgctgtgcacctgaatctaatataaccttgtaaatcacctctactttaacagcaagaaacacataatgggaaactcaatcgcatggtccttcctttcagggtctgactcaagcagctctctgaaaatagacccttcctccctctgctcaccctccattgcaagatcagactcggttcctatcttttggaaccacagggacagagtctggcaagagtcactgttgtaccagctgatttaaattgaaatgttttccccagataaatgtgtgctaaataatacaccagctctccagccaaagggaagtgacaggcgctctgtaaataaaggcacttagttgctggtaaagagctgtaaagtggttctgagctgatgtttgctgaccagcaagaagcggcttcacctgctttatataattgtcactgcagtcttgcctgctgtatattaaaactgcatctcatagacccaactgtcacatcggatataccatccagcatggagtatgccgcctctctctgtaattgtttctgacaaccagccatcacatttcagatcttttcagaaagtatctggtccagaatccctatgctgggccagccctgacaccatgtgggctagaacagtgacaccaaaagggaatgtgaaaaaaagaagaggaaaaagagcttttgtgagtctaggagagcaagtgacacgcaatgtcaagtgtctggacacaaatcccagggaagactctgcctcctcaatgttaagacacatcttgtttcatttcatgttagaacaacttgccgtaaggctgcatgaagactgtggccccagaggatacacatctgtcctgggtccacagttctgacctgctatgttctggagagatggaaacatagctctcaaggcaaaacaaaggaatggatctcataaggactacaaaataaagagtgatgaaagtggggagtggcaatcaacctcaatagctcagttgtgtccaattctctgtgaccccatgggctgtagcccaccaggctcccctgtccatgggatttcccaggcaagaatactggagtgggttgccatttttccctccagggtatcttcccgacccagggtaattccaatccacttggagcttggtcatgccaaatgcccagatgaaaggtaacaaaagtatctgagaccaggggacgttctagtgggtcaccggggtctcaaggagggggagcagttggaatctcaatttgtccatctgaccccatggattgggatgaacccgagaagtgggctgtacagtgagcaaccagaggtgaatttacaacacccacccatcacggagtgactcctacgttgacagccaccacagggccaccacttttagaaggtcagagtgtcaccacagggaagtgttagaaggtcaagaacaagagagaagcaggtagaataagaaagcaagagggaatatggactcagtgaggctacagcttcaacagtccttcattaagagttgaatgaaatgcttgctggttactggggggatgtacactccactccagtgccaaccaggagtctctgaagactaccaccagccatagagcacatcctctgcctcttctggggg

SEQ ID NO: 60296 - DNA, 2385 bp, Bovine  19866880762574
cctcactctcccctggggactattttagcctcatcctaacgtcagtctttcttctgtcactaaactgtgtggttggcatagcgaggctttgtttataagacgatcttatgtttatttgtgtagccctttctacttttcattggaattactgcattgggttctgaagtcaaacctcaggagtctgtctatgggtgacctcatcagtacagtcgataccaagggtctactctcttcctggggaaagtcagcaaagatgctccctgtgagtaggaagacgaattaaagcagaagctataaggtaacctcccatgataagccacagattcattcccaagaataaaaagaaagtccattagacaaattataattaagcatagtaagcaagataaaaagttctatccacatataagatgcaaatgagaagcgagtaagaaagcagaatataaattcttaaagtgcatccctttcattcaaaactgtcaccagttttacacactcgtggtttgcctggccatctgggcatcttggaaagagagctttaagcatctcttggaagttacgctaaatcatcaccctggaaaaaagtgcctcgtattcttcagatgaatttcagttatagtatttatacccttcgagtaaatggaagacaatgcataggctttcccttgtgtgaacctaattggggagacaatgaatggttcatgaaatggcttgtctgagtgagttttaaccaaaatgttggggggtgctcaagttcaagatgtgtggctctctgcacctggccctttaaatcatgcaagaaatacacgttaatatagaaaacaggctccattggtcattgtggccgactcggtgtcaaggcaggacagtaagtgcaggtggtatgaataaacaggcagttcagataaatgtcgtcatcggtgggtttatgatcttcttaacctttcaaagcttatttcaccatcaagaggcagtgggtaagtcatttccaaagacgactgctacacttctttccttttccattgttaagccaagatggatccccacacaggtctttttcattcaggggtttgggaagcccttctttgggtttaattttcttagggtggtcaccacagaagaatcacgtgtgcagcctcaagtgattactatctgcttgagacagattgtgctcagagctcctggtctggaaagccaaagagaattacatgaaaccgtgttaacaggtttcattaccccagcagcagtctcttaagaaaccacccaagcagagggagatgttccacccaatgattggatggacacagagaagcattaagcccactgcacacagtaatcccacctcccccccaaaacgttaaatggccacacgaggcagatactgtcccagagaactccatttccttttccttctttttctcctcctagttttattgagatatgattgatacacagccccgtgtaagttaaggtgtacagcgtaaagatttgacttaatgtacgtcataaaacagttaccccagtaagttcagtgaacacccattatctcatatagatacaaaattaaagaaaaaccatttttcttccttgtgatgagcactcttaggattgactctgttaacgactttcattttttaaaaggcacctgatttaaggcgcttcagctcctaattctgatgtctctccatacccacatcccttttactcctacacactctgatcatctgtgaagcaaagattttttttaaaaattgtacaatgtagtgaaaagtgcccctggacatcccatgggtgataatgttactgttgctggtcccatccctctctagttcctccctttgacgtggaaacagtaattcttctctaaaaaaaaaaagacccaaagatgtcagtgtgagggcaggatccacggattgcataatgtatacgttcctgctgcttctagaattccaagggaactgaggctgagactcaggggcctgggtatttgccttttttccaagggcattcttggagagatgactcaacctgtgtgaagatatttattcctgcgattcgtgtttaaactccactagttcttgcgttgcagttaggtggattatgaatatttaacgttgcacacgctgaaaatgaaggtcaagtcctgctcactggtgacttcattgctggcttgcgtctctaaaaaggcaggctacctgctgtgagcagagtaaggctgaaaggttatgcattgttaaaaatttccttaatgactttatctgttccgaatggctggtgcacagtgaggggcacctgctgatttcattggtctttgctctctgcttctggtgtcagaagtgctgttccggagggttgggacattgggcggcggggggggggaggcag

SEQ ID NO: 60297 - DNA, 1454 bp, Bovine  19866880770250
ggtgagagcgtgtctatgaggcaccgccttggtgcctggcatataacaggtgctcgagaaatgggagattccgccccactccccttctgcacaaggcctaagcacagtgggtggggccagtccttcccctccccaaggaaacccgtatgtgaccccagagatgtgtctactgcagtgttcttgatggggacatatctcctccaaggaggcaaacacaggtaccgggggcggaggtggtaaataaaaaataaaaccccagatatacatactgtacctaaacagataaaagctcaggtatacacacagtacctaaacagatatactgtatatctatgatattaaaatttcactgggcgaagggtagagaagatgattagggaaaaaatgcaaaaaaaaaaaaaaaaaagagactccacatcagggagtaatgaaaaattggttgagaagccctggtctgatattacctccaatcaaaacacagacagcctctctcacacccagctcagccgagcctcttaacatctgtctcttaaatttcctctcccatgtctcttccaaatcaataatacgatatttttgaaacttctgtcaaatccacattcatgcctcctcagctcccttcccagcctctccactccttcactgatctaatctgcctcctctcctgggatgtgagccgtgcaacaggctgcagagaaggcaggcagtggagagctgagagactccagtcccagtttcccatgacagacaggacagagttcatccccacctccagcagcagcagggcaggaaggagctgagtgccccggcctcccctacccctgccacttgccactacctggatgaggccgccagtccaggctggcctgcatcttccatgggagctaaaggcacaccctcttagtagggggcagtgggcagggaatgaagcttaccactgggtgtgggcttcactggtttgttggaatattgtagacactgcagttaggcttgcccaaggtggatttctacctgtcctagaggcttaaaggctgcctactcacctcacttgtagctttgaatggccatgtcatatactctgcatgggaagaaggctgataaggaggaggaggaggagacagcttaacctgatgctgcccttctgttcttcctaaaatacacagtagttatgatgtcgcgccttcttcttgcaaccacgaggaaaactcaaaagaatctcgacattctagagaggtccaccttgacaggatacaacagctgaactggcggcagcagccacctacgtctagacttcattttgtgtagaagaatggtgctctctgttgatcccctaaagcatcctaataacacaaggtcaagggtgagatacataatggtctcccatctgctttctctgcagtctctataccagtgtatctctactacaaaagacagcaccatatgtctctcatcat

SEQ ID NO: 60298 - DNA, 1805 bp, Bovine  19866880781772
agaagggagactgaatcccagaatgatgtgaagtccattggagagaaaggggaatgggaaagaaaggcagaattactacccagcacaggtcacctgcacgtccaggaggtggtgggggttcagggcagttatctttcacaggatgggttctgcaagtaaaagattggccttcagtgacaagcgcttcctccgcttctcccacctcctctgagatgtaactcagggggcactttccatttataatttatcacattttccacttaggttttcctgtacttttctccccaggcatgaccccttgttaattcctggcaatgatcagattgacaacatggactccaatgtgaagaaatatgactctactgggatgtttcactggtgtgcgcccaaggagatagagaaagtcatcctggtgagtgacaggttgcagaatctgtgccatccgcttctgtcccaaattatatttgctgtgaatgaagttttcctagctgggtggtggggtgtttgttcctggccctaattatttttggtaattaacattcaggacatatgttgaagcagctagaactcgtatcagagcatgacccaagagtggaattttcgatctgtgaatatgtattggctcattaccttagggtgtgaaagccatcgtgggagcagtatgtaccatatcctgcaggcgtggttgtcaggccagagcatgcctatgccattagctgtgtggccttggatcagtcccttgaagaatttgtacttcgtctcttatgtggaggaagatgggatgagaatgaccttaactcatagaattgtagtgaagattaaaacccaacataggactccataaacttacctatttttattatatattaaatgccatgaagaaatctgaatgctacctgtatcgtcatttgtttataatagtgtcttgtatctttctagataatatatttgcatatttgtgatccttcttagctcataaggtaggcaggcaaatcccacttgctgatgatgacaaggatgaccatgatccacctcagaaaggctggagctcatagccccgtttcctggttgactcatctcagtagcaggggtgggcttcttctggtctgtctcaggaatgctagaacagataataatccatgctattctttagacttgtccgattaacagcttaaggttttacgcctacatcggctttcctaccagtttattgtcttgctaatccatgcaaaatggattaataatcaggaaggtcagatggaaaggctcttcctcccttgtgctttctaatcctcagattgctgaggcctgctcctttatgtcagccaggaaaatcctatcattgctgatgttatggccactgttcctaagaaaggaaggttccagttcctcagaatgcctttgtgctctaatccactaggttttcccctgtgttttatctgaatatgtgtgtgacttctcaatttaattataatcgagcattaagaaccaatacagctctgttctggaggttgtctgggaggtgtgaaagttgcagacaaaagcatagaaagtcagaattctcaggaagcaatccttttccaaggagtacaaatggttctcattacaaagctgctgctcttgtttatattctgatgttgtatctgccccacttttgctctggggatgtaaactcatcctggtgttacccaccttggggcatgtcagaagctgggttgacattttgggatgtaagctttcaatggcttgcctagataatcctgagaagtgcatggctgacattcaaagcaccctaccagccccaa

SEQ ID NO: 60299 - DNA, 749 bp, Bovine  19866880785578
acatcttcctggttcagcagcatttagaaaaaaagcatgatatttcatctgacattcttgaaggtccagtgggggagtaaaaaggggtgggatggaagtccttactctactgggtaaaagacagcatctgaacagcctcagctgaaagaactgcatcatcactttcctccccaaccatatgctttctccctctctatctgatttatgactcccaattaccacagatcctttggctagggtgctttccaaatgtcttcctactgctgaatgtttgggtgctgatatctcccgagggaaaagaagagacaaagaataatggtgtccatacttctgttccccaccgctgccatgccatgcaatgtttctggttttgttttaatcgtctggaacaggaaacccaagctgattctgtttccttacctggtctttaaagcaagacaagttgggattacattcaccagaaaagcaggctgattgagtgaaaaaaaaatactcaaaagccatatatttagcaatgctcttgtatattcacaaccatactattctccagtggttcccctccaaaaggctaacagttaattaggaagaaggatacaaattggaggacctgttaatcaggtcataatgagtgtggaatgtcctctttttctagtccttcaaacatgacagcttccagaatcctcttcaatcagaaatgcccatgagtttcagggggaaaaacatagctcatggtaggatgctagtcctaa

SEQ ID NO: 60300 - DNA, 1044 bp, Bovine  19866880791418
tgacggcgtttttctcttcttttgcaggttgtcttagtctttgctctcgcattggtgcacttgtaatatacttcatagattcgtcaaagtgagtattcagtatgttttcttgccctcttttctaaaacaatcacaaacttttacattgatctttaacaccagcctttgcaagagcctccttgagtgtgggagacttttggaggaaggcagggctgtctgtgttaattttctgaatgggaaagcaagctctcatgagaaagactactttgattatactgtcctaggagggtgagagaggaatctggggtcatcaaactttttcgctggctgttactgcttttaaaatagctgtttcctggtgtggtatttgcactgaaggtagaaagaagtcaagaggtctctgatgtgaatttgcaacctctgagagggtcatggtgtccaactggtgagggtgtgagccatgcttgccatggcagtttagaatccttttcttattagggttgccaatgctttgctcttattggaggtcaacttagaaagcatgatgctgtcctttgcactggcagttgaatagtcaactgaagcatcgctggctggtgcttcttgactcatgaaggtaaggagatgggacagaggagtttgtgataactcccagagtggaggcccacggctatctgagaattcctagagtgcacactcatgcagacgccgggggtgccagctgaggggactggtgctctgggtggggtctgtctgtgtcacacacagaaaaggttttgtttgaggcagaagagggcactgagcaaagctgctcagtggtggccagttctgccctggttcccgcaggtgtcgcccccactcccacttgtacatcatttgttgcaactgatctgtcacaggcttgaaattgacagcatctgggaaactggagctgagctggtttgactcccttctgtggggacatgaacctgacacctgacggtggccttaggctctttgcattgtccaccgtgacgagtgtttttgattccctgaactctcagc

SEQ ID NO: 60301 - DNA, 1133 bp, Bovine  19866880794176
tgttctggaaaccagaacaaacagattccagccacagtgccatctctcactacacatgcaactttggggaagccatcatgatgaagaaagaaggtcatctcagagcaaacaccttaacatttctgctcaaggataagaatttacagtgagaaagctcagagaacttctatctccattggcccactgggacttggcttcaggtcatagacaaagatctctttttctagagtctgctgggaacattttaaaaatccattgatagtgaaagcatcaggagtgacatttttccaagatgtcataaaccatcctttccttcaagagttttaagccatttgcactcaaataagaaaaaaaccctgtgccgcctcctttccatgttgagagatggtgaggttgagtgtttctctccttgaattctactgggggaaacaggtggactttcgagaccctcagtccttctgtaagtcctacccagaggaaccgcaatttggttcaaaagcctgtggctcgactgaatgagagggtggcagttggcagttctgtcttagttcactgtctgccaagtgaccatgagttatacccctcagagatgctctgagacagaacttagacccacggtctgcagtgacactgagatactgaaatgcacagacggttaactgagggttcaacgagacaatggatgtctaagctcttttaaaactgtaaaatatgacacgaatgtctgagattatgatgatgacaaactcagaaccagttttatatggaaagaagactgcttccctacatccctagatcctagaagaccaccatcaacagatcatgggatattgaagttcttcctattttaaggttggtattcaattatggaattaactatcctctggaatatgctgacagtcatgtaagtgtacatgcacgcaacaggttctttcccgaaagcaagtttgttttgttttgtttttttgaaagcaagttttaatggatggagatctattggcatctagttgtgggtaaagagaaagtgctaagaaatgaagaaaagtaatattataaaggcagctaggaggatcttagaaaaccagcaaaattgtaaagcaaggtgaagaacgcctattgcaattctacaagga

SEQ ID NO: 60302 - DNA, 1040 bp, Bovine  19866880826444
tgtgtctggttctaaaaatgaaagaaagaaataagcatttgcccattcttcaatatcacgggtgatgacaatgcacatttattgagtgcttgttataaaccagactgccttgagtattttgcatattttattttatttaacccccacaagcacaacagtcctaggcaacatggatatctatttcagttttatagatgaataagatgagattagagagactaagtaaattgctcaagataattcagttaggtcataaacagtggaatagagctcatattctgaatcttaggtcatcctgtatttattcccttgagatcctcagaatagaagggcaggtataaactttttcttggcagaaatataggagatgtgattatatttgataagatttgatgctcagtcttttgttctgttaatgacccaagcagggggttagtgatattctagaagccagggatggcagattaagttgccttaagagtcataaggcgtgggcccagaagtaaagatgggtgtgccatgcagaagggttaataagcacctccagtcaggatcattttgctgcaacatctgttgctaacccactgctgtgagagggaatgtcaaccctgatgctgcctggagtaacctttaaaacagaaaacatttgcctgttgcagtgaggactggtgttcttttggttggctgacataaatcctcgtttctatgtttccccactggtgtatttgcatttgtgtgaaggcatagtgagtagggatgacacatatggatggagggtcagctcagtgtggtatcaactagtctcattaataaccactgaactgtaatatcattatgagatggaacttcagatccttccagaaaaatatttttctacacagcaggggaaccctgagtcccagagtgggaaaacaggactgaaaccattcagggtgagtgtttggaggaattccctggcagtccagtggttaggactcagcattatcacttttgagggcccaagctaggtgaacaaagagcccacaagcttcacaatgtag

SEQ ID NO: 60303 - DNA, 2120 bp, Bovine  19866880838924
aaggcttttgagattgagtgagtatcttagaggaaaggggaagcatttttttttttaaaccagtttggccattaaataggatctcagagtctgggaaaaggtttaagagagctggaagaaacaccgacgtcagatgcatatgtgactatactgtatgtcaagatactaaactaggaccttgaaagttatgattactgaattgggaggaaactggcatgctggggaaagggagtcttttccttcccacctgccccccaatttggttccttctccacctgaagggagcacttcccctgcttctacttttttccattccctctgctagttcctgccaggagaagaggggcatctaattgggttgggtcatgtgtccactggaccccgtgctgtgaatgtgaacattttttgtgccttaaagtagtgcacacagtcacccagcgatgctgttaggatgcaggttctgaccacgtaggtctgggtggcatgagagtctgcatttctacatggtccctgtgtgatgcccacgctggggtatgggtgggacgacacagtgaagatcaactccctaaaggcagaaaccaaaaacctagcttgcctcttccttctccaagaagacaagctcactgtttcctctcatcctttgtcatctcagctccctgagcaggccgttcaggaggcaggaaagagtttaggctctttcttcgggccttggcacattgctctgtccagcaggcatgaccgagcaaatggagaccaagatttaaattggggggcaaggcaaaggaggtggagtggagaggccaaaaccaagctacaggctgtatcaaccagggtatgtcaagaatagaagccactctgctacaggtaagatgaaaactagaggctgacactacctagagaagggctggaggagcaaagtcaaagaggccagcattatccatttcacttgcaacaccaagggggaagttctcctgaacttcagcagaacctcgggaccctcagggaaactcacaccccagtctccatttcaagtagcaaagtcagtggttgccaaagtttctgctgagagttgctttgaaccttgcatctgttcaaggtctggctataactgcctcccaagaactaaggcttctttttctctcctaccatctagatagacccagagtcctctctcattggtagactccagcccataaccatgcaggtaaagggattctaggaactatcgttcctggcttcactgtgatgttgaggagacctcaggaggaggcagtggtgatgctgagttgacaaagataatgtggcacataggcctaggctgcaggatggagctttatcaaaccaccaagacggtgcttcatcgcccagtggctatagttctcatgggctgtgcatcgtctacctttactcttggggtgatggcattcaggtccccatcaggcacccaatgccacccatccagcagaccacgtgtgacaatgattttccagctcatggcaaacccacacagaggtgttacttggcagaacacacttcccatccaatcccgtcaaggccatgatgagtgaggttgtttgctgcaggggttcagcagtgctgcttctctgagactcctagacaacatctttacttgttaccatctgtccaggatcccagagcaaatgacaagaaagactggggcagagcagagatggcagatgtgtcatttaaagccaccgcgcctcctacagagaacgcttcccgggctgacaagtgtcacctcttgctaaatggctttgagtgtccatatagtcctcactctccagagaccaccaatcccctgatcatcctgtaacaatgcaaagcttaacacccccgtgcagctctaacaatggcaaagcttaacccaggtcaatggcaaaaatatgtgtccggcagaaacattgggaactgtttggccagcatcatttcagtgctctgacattttgctggtgaccttggtcatgaagccactgtttgggaaggctgagggggtggtgtttcaaaagctggatcattctcgggaaggcagtctattgtgagtgtgggtgttcaggtctcaagcccgcttcctgggcggcaagaagaggcaggagatgccc

SEQ ID NO: 60304 - DNA, 1112 bp, Bovine  19866880900958
actactcgtttcattccttaggagttctgttctgccatgaggcacttctcttattttgctaaaccattggatggtttggagaaagaattgctgtggaatcatagtcttagaagatttaaaataaggcaaaatgtttctccagggaaatatattttgtgggaaaaaaaaaagcaacaactctgtgtatttatggctttcttcaaccctgatttataagtctaaaataatcagctagagccactggcgagagtaggcttcctggctgatgcagagagaggcacattcagtgaaggccttgtgtccttacatgttgctttggcagggtgttaatgggattacccacgcttcatttggacaaggcttggcccagaatacatatctggatcatacctgaataccaaaggagagattcctccatcataaacatccctgagcccctgcattgatgttaaaaccttggatgcctttgttatggcccttaattctgttaatcgccctaggtaaagattagctgctcttgtcaatttaattcagcttcaaacaaagcaacaaggtcactattttttccccttctctccctctctcccattctctctctccctctctctctctttgccagcacacaggattgagttgtcatgtagctctaataggcagcgtggggaatcgttagtccacctcaacgccctgactgatgggcacttcacttcaatcatctgcctgagcagtagtggcccagtactattgacactgtgtcagctgcaagagaagatgccttaatcggcctcgacaccctctgcattgatttgacaagttgctgtaatgaccttcttgtttttctgaaggattactgtttactcaggaggtgctgctgactaaatgtactgcatcgtcatggaaacgccgctggtggaggctgcctccccaccaggactgggtggagggtgacattgataggagactctgaatatttcaatgaactggtctgtcccaatagtactaattccagcccattaatcagacctgcttctgaagagccaactggaattagggaccagccttggtcaggtcccctgtaaaagacagtttgctacaaaacccattttttcccc

SEQ ID NO: 60305 - DNA, 1729 bp, Bovine  19866880911656
ccagaaggaatttcaactgagtaatgagtccctttgaggacaagcttggtgcctcctggctaaagagaccccggtctcctggtgaccagcgtgccaatgtgatcttgatcttgccctccttgggacttccctgctggagtatgagccatggtttggctgcacaaaaacccccataagatggcacctctttagtcttagggaccagaatgtaatcaatcacctaattaatataaagaatgaataaactgggcttacacattagggatcagaatagaaaataagagttcagtaacacatggactccttccaggacaaacctattatgtctcttggaaagtgggtggggaagagagttgtggatgggaacaggtctcagtagttggtccttgtgataacttggaggggtcattctgacatcactccccacacagaatgtggcccttcaggtggggtgtaaggggggcaggattcaggtgtcactgccataggggctctgaaagtcactcaaccacatctcttctgatacaactgacttactttctgcctccatgtttgttaaatgtcccgccgaatttattccgattcaggatgagagcagcaatttcgggcacgtagcgggcaaacattgcctacatgcatgaaacaaagaaacaagagccaaaaaaaaaatggcatgcagagaggattctaccgcagtggaggcagcaaaacctcttggcatacttactttcttccactaaccgcactataggagcccccgtatttcttgcggtttcctattaactctatgatttcagggacgtagctggcaaacatggcctgaggagaagataggagacagaagagagactaaaaagacaggccaaagaaagggggtgaccttttcagaagggggaggggggaaatactaagatctgaaaacacaaaaaaggactagaactgcaaaggtaacgtattcatgggctggattggttttaaaaaaaaaaaaaaaaaaagagcaagcttctgaagttacataggacaaaaaacaaacattaaccaacctagacaactaaaaaaaaaccaaaaaaaatcagttaagaaaaatgtaaaggagacaggaataaatagacattagctctacttcctgaagagaaataaggggaggcatgctagagaaataacacacacacacacacacacacacaatcaatcattcataaacttacacacaattttaagagaaaacctttctttctaattaaaattcaaatgagaatccatgcctttatgagtgattaaagacaataaacaccaagagaagatttaaaaatatacgaacttttccattaaaaaaagaatcactaaaaagcacacaaggtaaatttaggaaatcacatgggaggaaagaatagtgaggagaaacacaaatctgccatgttttgtccaacaaacattgtgcttgtggctggataacgcggtcgtgtgatctgcagggacctcacgggtaccataggaacgctgagcacatacacaccacacatacatttacatacatttctcaaatgtatacgccatatgcatacaaaacagagtgtgtatgcatgagataaatgcatgtgtggtgtacatatatgaaaagctgtgtgtgagtttaggtttaccttacacacagcaaaaatctaaacatcgaatgggctactctgaaagacaaaatgcagtcaccgccgatgagtggccagaaatcccc

SEQ ID NO: 60306 - DNA, 3635 bp, Bovine  19866880952921
agatgaactctgtttctctttcttcccatgtgtttgggcatatttcttaatatgaagtatctcagttttcaccatgtgacctcaccctgttttgctgctgttttatgttgcatgaagcacgaccaaatcctcatcaatagatgttttttccccccaactttttgggttaatatttgcagtgttgttttctcaaagacagtattgttgaaaacatactattgagatgcctctttgttcgtcttctctagagttgttttgttctgtggttgtaatcactgccatgtgtttttgtctgtaattgtgtgtgtgtgtgtgtgtgtgtgtgtatctatctatctgaaactctttccaaaatcagattcttctgtgatgttcttgagtagaggtggcttcctgtcagtttggtattattgatatgatccaactgcaagaagttactgcaacactttgcatcttcaaaggtccacagtggggcacctctgctgttggcttttggcctttgaccccttttatcttgtggtgaggcatgtcgtgatataggcatgacttgttctgaagtgtatcagaaagtgacacggtttgctcccagaaccaaatatgcatcatggtccttcccaaacgaactctctctcccatcgcatatggctactgttttccttatgtccaaaatagattttaaaatgacatttctaaaattactgagatggattcaggcaaaacaagtccttgcccctgtcactggcagaccacagaggtggtcatttgagtgtgaccaactgggagcaatctttattatgctgtctctgtgtaagtgaattgggctcaaacatattgaagcatggaatactcaccgtgcccttacatatattttataggaaaagtgcgtgtgtctagttgtgtgggactctagcagaatatattttaaacccaagaagaaatggaaagttccagaaagtcaataagatttgtgatttggggtttctttaggctgttcctgaacatagcccataaactgcagggcgaccactggtcaaagtcccacccaatagcaacctctgtgaccttgtgtggtcagaaagaccaccccccagtggcatgattcatctgggcacagtgtgaaataaagtgctcgatgtccttatctttttgctctagttcatgaagtcccattagcttgctagacacagatataattgccatgttatcaagtacaaactgttttctcatgtgagtgatatttttgtaattgctcagggaatggtacgctacacctatcaaaactgaggggagggaggagagaaataaacacctgtcatatttatccataatggataaaaagttcactttaaaaaaatgtgtttcagttgaatgactaatccttggttgtctccaaaaatagcgaccaagtaaagtttatgatgattgaagaagggataactagatgtttcccagttgttatgcgtaagtggtggagaaagggaacaaatcattttgctgtcaagccccaaatccccaggagtgtggtcactcctttgataggcccaactggtgagaattgcagcttggtctttggaagaacatctacaactacgtttctctttattagagaaggaaagagacacttctgtaactgaggccactgcttatggttttcactcattcaagagagttgaaatgtgcctattgcaggcagggctttaagctgattactatgagaaacttcggagaagataatggcacctcactcccgtactcttgcctggagaatcccatggacggaggagcttggtaggctacagtccatggggtcgctaacagtcagacacaactgaacgatttcactttcatttttcactttcatgcattggagaaggaaatggcaacccactccagtgttcttgcctggagaatcccagggacgggtgagcctggcgggctgccgtctatagggttgcacagagtcggacacgactgaagcgacttagcagcggcagcagcagcatgagaaacttgcttatagaagtaaataaaataggattatggttttcagtcttttatttaatgatggtttccctacagaaaataaatatttgctccatagggtgtataaggaaccaaaaaataagtctagatacaaaactaggaaaaagagggggagagtaagaacccttggggaagggatcacaccagccctttgcctccagctgttactgaatgttttcagttcaaattaacaaggtcatagaaaaaaagaggatcatttatagttccttgaattaagaaaaaatccacccctgccaagaagatgtccctattggaattctgctaattgatatttaggcttttttttcttagagattttcttgattcttcacatgacacatcttgaagtttatctctgataagctagtgaattagacaaaattggagcaaaagcctgttttcaagtgaggcacagggagggagacttttggcagccataaaagccaaacaaacttaacatcttttgagatcaaagatctttggaaagatttacatattcccattagaaggtcaatagcatattctaagggtagcaagcatttggcaggaaaaaaagttacttctgtctaggatccttatctttttatagtttcaaagagaagaggatttaatggatttaaactttctagatttggaatgtggatagaagactcactgtctaaaatatcaaaaagagtaatagacttccttcaagagactttgaaactttgtacccttacacaggaagtattatatgcaatggtcccctgaaatcaggggcacgtgcttctttaccaaacccttaaatctatgagtggaatccagcacaactaacttctttgtgtatctagatttctttccttcattattctcgagagctgagctcagtcttttgattcccactcagaaggctgccttagcctgagcagggtactgcaaatgatgcagccttgaatctcacacagagatgatgtgaagcctcccctcctgtccaaacgagaacaagagggcatcctagaatcacacagtcagcgatgccctaggaggtgcttacagtgccttacacaatcagccatgaggtttaaagaacagggagatactccactgtgcagccaaaagccggtccagatgagcccatctccagatacggcatggggataaaaacgctttggatatctcagtcagtacagaggtcttccagtaccagtaagatgcctcctaggtagcttattggagaaggcgatggcacccaactccagtactcttgtctagaaaatcccacggacggaggagcctggtgggctgcagtccatggggtcacgaagagtcagacatgactgagtgacttcactttcacttttcactttcatgcattggagaaggaaatggcaacccactccagtgttcttgcctggagaatcccagggacaggggagcctgatgggcctgccgtctcaggggttgcacagagtcggacacgactgaagcgacttagcagcagcagcagcaggtagtttattagcaccaaagatcaaacggagagcagtgaggctctgagagattgtctacctcttggttaaggtgctggcattaccttgcttactaataatagt

SEQ ID NO: 60307 - DNA, 1482 bp, Bovine  19866880977964
tggctgggctccaggttgtcacacagcccagcaaaccccaacaagttaatttgtaatcttagggggaaaatgatggtcgctctgcgtctgtcaccgagcactctccctgccagtttaaacagctgattagttagcaccactggaatcgatccgcatcagttccacctgcatgcacccaccaggaaccactttattgtaaatcaatcattctgcaaacatctcacaaagggatcaggctttgctaacaagccgccccttcctgttccctcttggaagcgcccagcaaaggtgaccaacatttattcaaaaattatctctttaggttcttttgagcctgagcagggagcagaaaggcagaaaaggattgaggcttcctaatacaagcgcatgctcaaggttgtgggtttgtctctctggaatcagggccaatgtttgtccacgccctccctttaagaaaaataaaaatgtctgggcaaaagttttgagtcgacttttcacaaaagaagaaatatggatggctggaaggacatgaaaaaacgctcaacatcacttgtcatctcagaaatgtaaattagcaccgcagtgatacctacaccaccaccagaaaggctaaaattaaaaagacagacacctgatgtcagggaggataaagagcaaactgaactttcaaacatggtaggtgagagcgtaagatgagataactacttggaaaaaaggtttgccgtttcttataacactaaacatatatataccccatcaccaacaattttacccctacttattgacccaaaataaatgaaagcatatgtgttcttgaagactcgtacacagatattcacagccacgttatgcacaacagccaaaatctggaaacagcccagataatcataaccaggtgaatggataaacaaactgtggtatatctacacatagggaataatactcagcaattaaaaaaggaatgaattactgatacacactgcatggatgaatctcaaaaagattatcctgagggaagaaatttacccaaaagaattatctactcttatgattccatatatatgacactctagagtgaaccaaactattctatctatagggggggatagattgtaatattggatacctctagggaggtggcacagagaaggcaatggcaccccactccagtactcttgcctggaaaatcccatggatggaggagcctagaaggctgcagtccatggggtcgctgagggtcagacacaactgagcgacttcactttcacttttcactttcacttttcacttttcactttcacttttcactttcaggcattggagaaggaaatggcaacccactccagtgttctttcctggagagtcccagggacaggggagcctgatgggctgccatctatggggttgcacagagtcggacacgactgaagcgacttagcagcagcagcagtagcagtagcagctagggaggtggggtcatag

SEQ ID NO: 60308 - DNA, 2132 bp, Bovine  19866880980018
ttaatttatactatattgcaaagtgactcagttatacatatgtatatgttctttttcatattattttccatttttttaaaatcacaggatactgactataggtcccagtaatatacaataggactttgttatttatccatattatatataattgcttgctctgctaatcccaaattcccagtccatcccttcccaacccttctcctccttggaaaccacatgtctgttctctgtgtctgtgagtctatttgtagataaagtcctttgtgttgtattttggattccacatataagtgatatcgtatgtatttgtctttctctttctgacttcatttagtatgataatctctaggtttatgctgcagataatgctgcaaatagcattatttcctcctttctgtggccgagtactgttcaggtgtatgtatgtaccgtatcttcctgattcattcgtctgttggtggttgttcatgccgtttccatcctttagctgttgtgaagaggactgctgtgaacatagggctgcatgtatttttctgaattaattatcctttgtctggctatgtgcctaggagtgggattgctagatggtatggcaactctatttttagttttttgaggaaccatcatattttttccatagtggttgtaccaatttacatttctaccaactgtgtaggagggttccagtttctctttgtggagaggtttctaactgaagttttgatttctttaacagatgtatggttgtctggattttctgtttcttcttgtgtcattgttttaaaattttctatttcatttagtttttaaacttatagccatactattgttcattattgtttagttataagtcatgtccgactattgtgtgaccccacagactttggccccaccaggttcctctgtccatgggatttcccaggcaagaatactgaagtgggttcccattcccttctccagcggatcttcccaacccagagatcgaactgtgtttcctgcttggcggcgagttctttaccactgagccactgggaggccccagtgttcactatagcccttcattatcttcttaatgttggtaggatctgtagttacatctctcatttttagaggactctgggtgttaaaaagttcattttgcatccattgtttcattttccactcaatgaatttctttcaaatcaggaacagatcattttcttcactctttagtgtatttgttatgcttttgacacaagctgaaaacaaattcccctcaccacaacctttatgtcttctcacctatccatctgcttgctactcaaccattaggattcagaataaatgtgaacccccttctgatatgcacatcataatatattccatgcacacacacacccagctacacgtatgcctaccaccacacacatactcacatagatagctacttaatgcctttcctttgcagcactttactcaaagtactaatttcttaaaattgtgatagaacctttatattgtttctttctcttagtagatgataagcaccatcaaggctggacttgtattattcctgttggaatacttagtacctattgcaatgcttggcacataacagatctttgagacatcctgattgggtgaacacaccaatctacactgaggagaaataagttgttctctttgaaaattctatctaataatattagttttgctagaaggcagtgttgaaaaataggtagagatcaggttatggggagccttggctaacaacttacagaatctagatatttctttgttcttatttttcatattttcctcctgtcccttctatgtctttgttacactcagtgccctgggggatagaggggccaacccctggtcacaagggaaagatgctgagaagtcaagacagagagtggagtgagggggttgggggttgggtgtaacaagagtgtctcctcctgtctgcctctacacagccaagtgtttcttctctgcctcagtcctatgcataggattagcagaggatttgagtatttgggttatgttggtagtgggaggtgggatgggaggacatcttcccaaacagcgatgccaggcacacagtcagcactcactgctgaaaatgaacgaatttgtaagaaccc

SEQ ID NO: 60309 - DNA, 1337 bp, Bovine  19866880994624
tttcttcccctagaatagtgaaggggaaaactaaactgttttcatcagaagtttcattcaaaagcatgaaaaactgcaaaatgacagctgtgcagattcagtggatgtgacgtttttgaatttcttcaacttgacaagtaaacaccttaaatcggtaatgctatatgcataatacatggcctgtattttgacatccatcaacaaatgctgacttgagaaaatacgggtttgtacatcaaggaatagcacccataaagcagggagaaatgcaggtcacacggtattaggaaaactgtatttcattacagaacctgcaacaaaccaaagcatccttttattttatcttatttaaagattccattttcagctgtgaaaagactcaattcctttgcatgaaaccttcatttagaaatgacatgcttgcctcttaggcttcttgcattttgctttcatattccattttccccttcagtcaccaagcctggttccattagcatctgcaactgacaaactatggtggatggccaaagacatctctccattaaaggtctttttctctcctacacgtgaccccaagaacgaggtgcttttgttggaaagaaaacttcagcaatgataaagtcacttattatttgctacttttatagccacacgtttttacaagcaaggggcaaagacaaaagaaatagattgtatttactttttttttaacccttcctggagagttgtgttaaagaggaacagaatgtattagcattgtttctttcttagagattctcatacaggaaaattgtggcttgaaatagcaggattgacccagattcctgaagtgaccttgaaaagaatagaaaatcaggcactttccttccaaagggatgagtgaattcggcctttggtatcatttgttggcagctaccctattcatcacagcagctgttgataaaggggcaagtctaaattgtatccagttctctgattgtcttgctcctcaatcccttgtttgctgcagtggataacatctttggttgaactttaaagccctctacataaagcagtgctctggtcctgcatgtgaaagtccttgcacatggagtatcctccagggaccctgatctacaactagaggatagtgaaactgggaaatgctccttccgttagttgaactaacactcaggaacttaattttagaaacacgctcattttgccagaagagatgatgaggaatgttggcattggatggatagaatgaaaagttctcaatcagaaaagattcaagttaagtaaacacagccgcagcccaagctcttaccaagacagcctcctggttctttaaatgt

SEQ ID NO: 60310 - DNA, 785 bp, Bovine  19866881004046
ctctgcccaacccatccctggggtcaagtgaactgtgctccttagtaagaagaaaaccttcactgatgtagtattctcaggtccggagagtgtgggagtgggtctggcctgtttgggagtaaatatgggctatgaaatcccagaaggaatttgacagaggacccccatgactttcccttcttcttcaatttcttgcttaccttggctgacaagagatcgtgctttcaaatatcagtgacaaggctgatatttttatttgactgaggaaagtcatccttgtgcccttttaatacctctttgatcagaccatgaggatgtcagggatgtattaaacctccgaccgagggcccagagctggttgcccagtgttctaatgagtggcattgagggatattctcgaaaatgcaagcagggagggcagacgtggtgtgtcacgtcagcaaaccctctcccagctccttttcaaataaaagtttatgaaaagaagcactaactcaaattgcagaatcctgtgtttgaagtaaattgtcttgcaacaaacatttccgtctatgaatgtctaaacctttcagaagattaaaggaaattagtgctggcgtgtttcattaatttggcaccgtggtggaggaaatgtggtcctcatttcacttgggtggattatgaaatgtgtcagtttttccattctctctctccagggcatttttttactgcaaggcctgtcatgatgacatcacggatcccaaaaggataaaaaaatgcggctgcaaacggcgtaagtagtgttt

SEQ ID NO: 60311 - DNA, 771 bp, Bovine  19866881025606
tccattaagagaggcaccaacagatcttctgttcaggacaatctaaggtattaagactcacatcctactttatatatctcctgtgcctttactgtttccctttgtgggatgggctggcagagttgagacccaccctgcccatgtgaagccatcctggaactccagacaggaaacagcatgaaaataacatgtttccttgactcatagctgatgagtctgcattctttatgtaagagccctattggtcaaaagagtgaaaaatcgctctttcgttaacttcaccttcaaaactagaacagttatctttagcaagggtaacacagagactcatcactgaatgaatccagtatctctctgagtgtgtctgaagtttggaagctaagatgaagctgactaaatgactcttctgagagccacacacttctgtggttcccacatctctcctctcagtatctaacctgtcttttctgacttccttgctgccacctcacagatgtgtttataattccctgtcactcccaaactctcctagctctgcctgatgaccccacaaatccccagtgttcaatatctggtgctctggggagggaagcagatggtggaagttgttcattctgccaccctgggaggcaggtggaggggcagctagggttacagcagcaggtgggggttcagggctgagcctgaaggagacacagcagatcacccaggacccagggcagaacagctcaccggaaccagcccttgcggcagcaggggcaacagctgggg

SEQ ID NO: 60312 - DNA, 1428 bp, Bovine  19866881033127
tgatggagagattttctcccttctgctgctattttttttcatcaaaataaaaatgtatggataaggtggcagatggaagggttacatctttatagtaaccagttaagaaccaattcacatgtatgtatgtatgcacacctgtgtgttttatgtgcgtgaaaattacacgtgggcacatggtacttgtaaatacactgttatatgcatgctctgtatgtctggctgagaattatatgtgtgggtcgtttttgtgtgtatctcacacacaagtgtgttgtgtgtgcacgtggtgtgtgtgttggtgtgaatatgttgacatcgttacaccacatcagaactcaaagtcaagcgattcctgattaactgccaaaggttccgttcccttactgtattttggtctctgacataatttttagtctgttttcattttgctccagcctcttcacatttctcaggatttcaacagaaatgtggtagaggggatacctcttcatatggatggtacttaatactgtgcttcttactggctcacttttctttattgatttgaaatgtaaacaaagctctgaggctgaactatgcacctccacaaatccagaggacctgactgaaggagctcaggaaggatggagatgtagtacgtttagtcttgaggttggcagcccaattttgatgagctcaaagatgagaggtggctcaggacactcagggaagcgggggtctctggttccccaagtatcctctggaagcatgagaaagggcatatcagctcttgccagtgtggcggaatccaaaggtcagcttctagttgctgggtggtggcggttgtcctgtgcaacgcggcaacttctgggcctcagcctttcagcatctggagaaaattctctataaaggctgtttctgtcccagtgaatataatgtctattttcatctaagcatattggctatcctgtgcatggctcacatagttaacacaggtatagaatttttttacatttccctctttttgtttccttggtatgtctccttccctcctagcatatgcatgaatgtcatataccctcttgcctttatgggggctttaattcctttatcaaaacataactatcctctctcagaaacctgtacacatcattttttttacactgtttctaagaaacaactagttctctgccaactaattcacattaggatggcagaagttgacaatgaaatgagattcataacttcagacaaaatattttacttaaaaaatacacatactaaaaaatagaccaactgaataaatctctaacagaatttcaggctgtatgggtaagcagggaagccctatatgccagggacaatgaatgaaagccaaaatggaagaaaaaaaaaaaaagaaagaaagaaatggggagaggtttttacatttgagcaactaacagg

SEQ ID NO: 60313 - DNA, 1120 bp, Bovine  19866881037867
accgtattcttcaacatggattaaaaatgacttagaaacttttaaagacaaggcagatgttccttggtttggatgacttgggataacatggagaactgctggggtcacagaatctctgcaagtttgcaatcgagagaggatgacatcatttcatggcctcagaatgggccttgggctggctgtcatcacctctgtttcctgccagggtcccctgagaaagcccactgtggaccactcttcaccttggccatgctttctttctccttggcccccaggccccaagttctgctttccagtattggtctggtccctggaaacactgaggttggatgaaacctccctgagacccttcttggggcctaaattattctttcggctgttgacactgagctgttccctttagtgtgctgaattacacaacacttggaattgtgctaacatggtcatcagagccaggacaggtctgtgggcatatagctcttgaggctgcagtcctggaacagcacccactacaggcctgggttgggagtgtctcaaaagtctttgaaaatccacaaggggcttccttaaacataactgattccaaggaatcctcaagaatgtggaaggatgaggctacaggatgttaatttctctctacagcaccaggacagcaagaatttttataaaaagaaatgaatagggctgtcagatgttataaagaacatagtctttctcttgagtgaaggaacgaaaggcagatacagacacacacatatacacgtgaacacacacacacacacacacacaccatcagtgggtgcatttactgcaggaaactctccagcacattggggattgaatttcttctctctgcactctctccatggcaaacttcaactgcagaccttgcctatagagaacctggatagcaactgcccttctagaaacaggctggatattcctgaacgtgggctgtaatgtggagggagggagtgtgttctgaggcatgtgcaaccctgcccttctattctggtcggcactgataaaagtcctttttaaggcctgccctgttcctgtgggcctgaaagtgagaaggtttatagacaccccagtgagaaagggctgtttgatgaatgca

SEQ ID NO: 60314 - DNA, 2121 bp, Bovine  19866881095036
tgtggaggaaacagtttgcttggaaagaacgctttgatggggaggcgctccgaggttggaattcgggaacccgctggtggtgactcggcaggcggtggtctctgtgtacatctgcaatgcattcacttgtttgtatctcttcaaactctaaatgtcttgggactagatggggaacaacacatttaatggtgtatgcagtgtttttaattaaaatatctggctttgcccataataagtgaagcaggctcgctgcgaatcaggctgacgtgtagtctgcatgggggtttcttttggggagccctgacagtgccctgtccccttgggaatcttctcctaccaaatgggacaatctgatttttcttaagtagccagctctgccatcactgtaagctcttaaaactttagctctggaaacaatatgtcaggggaaatctattttaaagaggtcctttatctttaaaatgtcccccacccccacactgggatgggtgttctaattatgcaggttaggttatgaccttggggctgcctgggggttgggattcagcatcttttcttggctgcaccagtgtggccatggtcagataggactgaggaaaactctaagtgtcctggaaaggacagctttggatacccttgcagaggccagcaaacaccccaggacttgctgacatcccatatggccttgtcttaccatctatttagtaaggggaggtggggaaagacctgtatttaaagccagtttggcccctaacagctgaggacacatacccacatatgttccctcactgggctggttttcccacttgtaagatgaaggcaaggggccagatatcccagagttccaccttgcttgtgaaatagatgattcagcatttctgaatgtttcccttatgaagataaggatgccaggtaccacactgcctgatgtaggagacagagccaacggttagttaatcaaaatttgatttggaccaagtcagctcttgaaacccatccagcccattttcccataatacataaaagggagctctgctggacctccaaacacccaaggaaagaatttccactcactttcttgcaacctgcatttcatacccagagctgggacatgctcaccactaattagctcatgtctccctagctttgacatagctcgagtctcctaactctatggtcaacagaactgaagactaaatatcagagtaaatggtctaccatttatattttagctgtgaaagaataatactttcctcataccaaaactcatctgatgatggaataccagctggaccaataaattcatctttgtaacatggagaaaatatagattttattatcactaataacgttagtttgggtagtcattgctttaaatgctattatcacaaatgtatgtaagtgtaactgtgtaatgacaaacagattgtaatctgtttgtgatcactagcaccttataattactgttacaaaataagcgagggacagaggactcctcattcaactcctgttctcccatctgtacgggtaaagcaaggaaccagactgtttgtggcctctaaagagtgatgatgatattgtgaagacgtgggtgggcccagagatggaaagaatatttgcagagtctttctggttcatcatggaaggttctgtgtgacattatacatagtgtgaacatgtcgcctctacaataatccctcctcctcaatttctaatacccagtgcttcaaacagtacttggtactaaggaggtgttcaataaatatttgaatagataaatttaataccattcaaattatctgtacacaatttaaacagaatccataaagtgaggaatttcagttgttaaacactcatactttaaccttcgttaagatgacaggcatctgaaatgttttaaaaatatacacagattaaatatttgcaaagaaacagaaggcaacagcctctattcctcaacactgatgttgtttttatgctcaacactttcctcccacaaaaacaaagcaatcaggacgtctggttggagagagttcagtggactgaaggcacattatcatccagccttaagagctgtaaacatcgtacagggggaaaggacattccccagaaagcgcattc

SEQ ID NO: 60315 - DNA, 1415 bp, Bovine  19866881109457
tggaagtggatgtactgggttctaaaaatactgtggacagtgactgcagccacatgaaattaaaagacatctactccttgggaaaaaagcaacgacaaacctagacagaatattaaaaagcagagacattactttgccgacagaggtccacatagtcagagccactggtttttccagtagtcatgtctggatgtgagagttgaaccataaaaaagtctgagtaccgaagaattgatacatttaaactgtggtgctggagaagatttttgagagtctcttggacagcaaggagatcaaaccagtcaatcctaaaggaaatcaaccttgaatattcactggaggaactgatgctgaagctcccatactttggccacagatgcaaagagccgactcattggaaaagaccctgatgctgggaaagattgaatgcaggaggagaagggggtgacagaaaatgagatgattggatagcatcagtgatcactggacatgagtttgagcaaattccaggagatagtgaaagacagggaagactagcatgctgcagtccatggaatcgcaaagagtcagacccaacttagtaaatgaacaatgacaacaaaaatgtacgcatacacaaacacacataaacaaattgcaaagaatacagaaacaaagggatagtccacagatgagtcacaaatgctggatctctaccaatatttattaagcaactacattcccagcaacgtgtgtctgtccattttcaaattaggtagtaatttcaaaatgactgtacatacagagaagccctagaaaataatagggctccttctcaatgtaagctaagaacacacttattataaactatgtgtctgctggaaaacagacaaattaagtacaacagtgggttttctagagagggtggaggagaaattgattaatatagtagatatagaggggctgggttctccttggtttgctgtgctgttcaaagaagaatctgggatgtaagtgataagtcagttgcctcctctctgctcctctgaggatccatgttgggtgccagttctgtgaacttaagtgtcctcagttgccacaggaggatcatctgtcttatatcctggatttcactgaccatgcccatctcattctgtgcaacttaaaaatacagaagagttcaatgtgttcctctaaggtctaaatttattacaattgaaacaagaaactgaaataaaggaaagcaatagtaacaataagacagaaaaatttccctaaactgtctccttcctgagagttgaggtttaatgacattaaaatcttaggtcattgcatcataaaattcaaaaggttgatttctgcatatttttaccaatggcattaaaactgatgtcttgacaaacaagacaaaaatcttccattcaaggcctaaagtt

SEQ ID NO: 60316 - DNA, 1823 bp, Bovine  19866881136972
cactggagtgggttgccatttccttctccaatgcatgaaagtgaaaagggaaagtgaagtcgctcagtcgtgtccaactcttagtgaccccatggactgcagcctactaggctcctccatccatgggattttccaggcgagagtactggagtgggttgccattgccttctccaaagaaagcctagggattatcaaacaagagaaacgacaggaagagctgactgttgggctcatttgcatctgaatgtgttattatttaaaaactggagaagtgctgagtggatgggttagggaaatatggctgccattctggaaagggtgctggcacagtatacatatcctgcagtattcccttggcatgtataaagggaacatactggtgttttggtcacaatgctgtcttttactgaatcttctgtacggagatagggggaaagtttcaatggcatcttcattggaatccactatgatccacaaaccatagcgtcttgatgggagtagggagagaggtgttactattgtaaagaagttttggatgaactttcattttgtcctgtattctaagtacatggcccaggaaagatggaatgagaactcatttggtgtttatttaaaaaaataggaaagagacagataggcaggagagagatttcttgagaagcttatgttctgaagaagaatgtgtgagcctcttacaagggtcttttagttgccttttttcccccaccttgggaagttacagggcactcagtggttcttctcgccttgtgtgccccttgtggttgtcacagaagtgggctgcactgtggcatctgtctgccactgatcttcgaggtgggttccgtttggattgtcagatgccctttcatccatcatgaccctgagtgtgtcccttctgaaagcgagacatactgggttcaagaggggccttccctggagcagatttgtgcaacaaaaaaagaaaccattattactgagtctgtacaacctggcaaactctttgattctacctacttttaacatatcaaatctttaaagtttaaaaaaactcagaaagactgaaagagcttttcaaaatttcagttcagttgagtttcagttcattcggtcatattcccttctttaccatctaacttaccatccaagcttcagtccttctgtccagtctgatatagttcttgagtgcctatgaataagagttagttcatatctgaaaaagctcgtaatgttcattggaaggacagacgtgcagagctgtggaccacgtgctcctgtagatatgtggcaggtggagggtacgtgggaaaggcgtaagtacttactatatgctgggcatagtgcaaagaataaactgataaacaaacgaaactgacttcagtctctacagagagtggagtccgtagaaatggtttattttcattaacaactgttactcgtaataagagctttgtagtggatatacagacctagaacttttggaggaacacaatactcagtttagggaagcattagggagggtttccttgagaaggtgaccctgaagctgagacctgacgatgcatcacaactaaccaggaagaagtgtgggaaaagtgttcaggttagagggaacagcatatatgatggcacggaggacagatgcgtggtttgttgaagaaccagacttttagttttcccagagtgttgtggggggaggtttggagggagagagagaagaacaaggaagcagatgaggaaactggcaacaagggtgagtagggcaagatcatgaagaactttgtatgccaacttaaggagtggagactggccataaaggcttggag

SEQ ID NO: 60317 - DNA, 1698 bp, Bovine  19866881201158
caaaagtaatccacttctgctcaggctaaaagcaatattaattatggaatagagcttgtgtgcactcttctgctctctttctctccttccctccctccttctgcccctctctctgctcctcacttgctcccttccttctttcctttcttcccttctctctatcttgactgcagcttcctctaggaaaaggcaagtgaagccaatttttcagtagacttctgttggttcctcttcttggcctcttcatctttcctctccttttttttgtctccgattcatctgccaatcctagtgcttatttccccatcatcctcactctccagcacctcagtgaaacagggatgatttcagatttgcactttccctaaatgttgcctgccatgggaacacctgccatcttcatggtgcgttcttcttctcattgccactggccagtctcctccctttgatgattgatacaaaaatcaggatgaattcctcctcctccctaccttttcctagcatttcgcctcttcctgcctctccacaaccacctttctaggatggagacagggcagttcttcatgtggttgagaacacaagtcccagaagactcacccagccccatgtccttttccatcacaatcccctctccctgttcagtgtttcctgtctcccatttgctcagtcttccttgggtgctgctgatttacctgcttgtttacagtttgtgaggagaaataaaacgtgccaactgccaagcccttgtttttccggtgccacttgtcatgcccgcatccattctctattgactcaccattaggtgatcgccttatctcatgctaatggttttatccactgaaaatacagagaagcccaggcacttgcttttgcctaaatttagagaagcaaataaataaataaagagaagtctgaaaaatctgaaacctttggagccaaattccctgtccctgtttgctatgtaaagtatggctcatttctttgatcttgagtaataataattctgaggagttatactgttttcatatacttcaaagctgtgtcaaagttttgctgcttaagggtacttctttattctgttggctcttgggtaccaagatgacaggtcttctgtacgaggtggaagcttttttaagtcgtagccttcagcaaaacatcaaattaccaaatccggggtaacatacttctacacaaatgcctttcctgtagatatattataccctatatattaaatactttagtgttacacgctacattttatgtgcaatagaaagtgatggtttgaggtagccttggggggactttttttccacaagcagaaaaagcaagtatataccgtatcaagtatggtttttacaggactttctgcccgaaggcctttgtaaataagtaatgatcaacagattggctgtgggtttttgaaaagcatgcctgtgtcagtttgcatgatgggggagaattttcaaagtgggtcttgctttcattgcctgtcggagaggggctgagggaggcagtcatcccgggccggggctgtctgctctgcggtacatcagaattgctaaacgtgggtcaggcggtgagctgaaacttgccgggctacagaactcaggtttctggtgttgctgcctttgggctgctgctatggctgtggctgctgtcgctgggagctctttaccccgccagcccatgacgacctgg

SEQ ID NO: 60318 - DNA, 964 bp, Bovine  19866881216421
taactttaaaaatctcgattacgagaaggtagcatctgagaattacccgcttgtgttctgtgtagggattattcatctcttacctcatcagatacagttgtcacaaagcatgcactcaataaatatttattgaactaaattatctatcctcatattgaacaaatttattttcacttcaagtgggctccacaatctcttagcaacctgattctatgttccctgcagtttctataaggatgcgttctgggtttgggatatcgatgtctttgtcccacctcatccataaagtcttccctgacaagtctagtctgcctactctcctttttctgaccccctgttgtacttattccaggttccagtcactttggcccacgtgtgatatcttatcttgcatggaaaatgtgtttcataaacacatcatccttcccaggagcctataagttcctcaagggcaaaggccatatttggtatttattttgtacgtcccatggcacacaatgcaatacagaacccatagcagactctgaaaaaggaccattaaattgatttgaattttaaggacagttctccactgccagtgaagactttctttcagagaagtattgaaaggcaggattggctatattcatagttcatttcaccaagctgagcccataagtctctacagttgatgtgctagttaggaaacaaagggtcaaaaagcagctgcttactttcagcaaagaagaggtcgtatttcagtcgtggattgcaggatttcacgtgtcagtcactcttgactcttggccaaaccctttggtgtcatcaggaataaaaagcaacccagagatatgtcaaatatcaatttccaattactttcttgcaacacatttctgccacttgggaaaactcccaagggatctgttgcctcttatcagcttagattgggtttatctttcagtccaacaggtaacactcggcaatg

SEQ ID NO: 60319 - DNA, 857 bp, Bovine  19866881232704
gagactgttggaggatatttttgttttatttaagctatcgtatgctttttaagcagagtaggctggatctttctgaagagtatctgagaaaattctgaaccttgttatagaccaagaaagataaagttaccacacaaaaatactttttttccacataagagatttagtcagcagggagtttgtaattaggtagtttagttgcttttacaactttttaatcattttccagtatatacttctggcaatagttatcctttaagtgaggcatatgtttggagagactggaaggatttttgaagttaaacttttcattgcacacaagaaaaacacagatgggccacctaagtctgaaatatatcctaaaggcaggatgatagcacctgtaagaaattctttggtcatcaaggaaagtcccaaggcatcagaagagttgagggaagggaaattgttttaaaaaaggacacacacagatatccatttccagaaaggcagtgtgaggagacctgtgagctgctccccagtgaaacaagcacaaatggtgaagattatgaaagaaaattaacatctctggatactgacttaagggaatacagcaaataaagaaatctttatttgagaaagcccagtgaaactaagacaatgagattcggtggtacttgaatcatgacccattccttccctcccctccttggcttagtttgaagaaaactccagtgagcatgtgtgccaagaaggtgtggatccctgatcctcatctaccagtcaagagatacagcatcttattaagagagtcagcctgccttcaagccaaattgtagaggttaaattccggtaagcacagccataatggaggggtt

SEQ ID NO: 60320 - DNA, 1490 bp, Bovine  19866881274693
tttagaaagtctactaaaggaacttggagagagaatggagggttttgctttgttttgagaagtaattggccaaactagaaaattctttaaaatgtgagcgacaaatcattcaggaaaaatattcttcctaggagcctgtgctctgctgacatttcatttgaatgtcaactctgaggacgaggaagtagggtccttccctttgggggcttaatccgtttgccaccgcccatgggctttgtgattatatttgtgccacgcagcaccagtgttttcttgctataatacttgtgccgccaggaataattgtgtatcttttaatttgcaggtgtcctggggaagtgccgctatgtttactacgggaaaaactcagagggcaacaggttcatccgtgacgaccagctctgaaaggcaagttctctgtgccttagccagtgacatgagagtgagaaaaaaaaaggaaaaataaaggaaaagctaaatgaaaagataatggcctacaacccttctctgtaggaaagctatgacttcagcttttggtaccttctgctgacttggccaggcctgtcaggatcatccttctgccttagactgagtggtcacagagagattgacatgattgcccttaagcaggtctcatccactagggtgacagacagtggtggcgaagcaccagggctgacaggatgaacaccatgatagattgcctggcccctccactgctcacaggggagcagaggtcacacctggggcctccctgagcatgctcagtggttgtcgtcaagtgcgagagactgtgtcttcagcttgcctattgagcagagatccttctgataccattgtgctgtgggttaatttttagtgacagagtcagtttagaggaagcctcctttctgttatttcccttaaatcttaatctttggtattctgcatagtcccctcccaccccatcctcatcatcctttagcatatttatcacgggcaattcatttcagtttgcagttttttggagaacagaagaggtgagttcttagccatgttgtatttttatgatgagctttgtgctcttacaatttgttgtttggagtaaattgctgtcactaaaccttgactttgaaagcatggattttaccatgttttgttcatttctaaatcctcttcttcccctgaatactaggcagtgtcaggcatctttcccaacactgggttctatccggggactcttatttatttatttttaaccacataccctcccagctacgtctatggccatatgtgtatttggagctggcttactcctttgggtgctatataaaggtagtgaagtgataaaagatagagcaataggtcaggaagttaaaaaggaaagtggagactgtagaaaacactcacgagaccaaacagtttaataaaaggcacaaaccctttgaatttaatttctcagaatctctcagaaatgaaatcccacagcttgtgagatgggctttgtatat

SEQ ID NO: 60321 - DNA, 1195 bp, Bovine  19866881364978
aagaacatcccctgcttaacagatagaaagggctccattaaagttactcgaatatggaagagaggtgggaatacagtctgatggaaagactgttcgacaggggagccagatatccattccagttctagccctgccaccagggacttactgtgtgatcctgggcacatggcttggcctcctgggcttcatgccctcattagtaaaatgagggcatttgacactttataatggactgaggatgcctttgagctagaaagattccaaagcattttgctcctccattcagcaccatacatcagatcagcctctccaaacactccctaccaccctcaggcttcccactgccaggtcatcagcaggacaactcaagactctcttggactcatgacctgatcctctgccctagagtcctctggcttagctatagcccatctgactcagctaacccaagctatgggccccactttctcagcagttcaacctggcatccttcttgctgaagccctgtgacactcctccaagatgtttttcctcctttcatctgcaacgagctccactcattgataattcttttatggtggcattctagactggaggatgaacaagggtacatgaatatgctcagaggggacaagtatggtttcatccagagtgctgcattcagatgggcattggagggtgaggcatacacgctcagagagagacacagctgtgaaattgattttcacagcccagtttgggggagggacctagaggagctttgaagtccaagttccgcattgaagatacaaaattcatttctcctccccacctacattttcatcagccccgtcgcaggctgctgcactagctttctgctaacagctgatgacagagaaagggctctggttggcacaaggccactgtgcattttgcttttatcagatgctgacaaaatttccccatcaaggaagataaattcgaggtgatattaataaacctccaaatgcagagatcagatctggctggcactcttaatgatcccatcagcggcaagccatttccagcctggggaacccagaagtttatgattctgtgtaaggcaacctgaaggctggcgtctctttgcttggctcctggtggaacctggagcccagctggggctccaactggaaggtggggctcctccaggccccctagtgaggcaggagctgag

SEQ ID NO: 60322 - DNA, 1070 bp, Bovine  19866881497631
tacgcgcctccctgacagaggaataataatggtcatacatcactgctccgcatgtccaatcatctaaatcttccctcgctgcagcctccgagactcaattactttattgacatgcaatcttcataaggggagaaatattgtgcatgtaaggtcacttggttatgaagacatattatcatattatctgcatgagggttgcagggctaaggcctgacagagctaattataatggtacatgatagaaagctcagtacacattattcgcttggctgcactaaaggtgaggtaagtccatgacatcatggtttggtgaaaaaaataatgtggtttggaggctgtaacttctttttaacttcccatatttttacattcgtattgcagtggacaatgaaagaattggttagtagattcctcagacagcaaggaagagagctggcatacctatgccgtgtgtatctgcatgtgggtgtgtgtgcgcgtgtgtgtatgagatccacgtagttattccctctgcaacaccaagtttcagtccatttcccagcaagtgaaatgagagtgactccagggaaaaaggtaaacggatacaaatgggtcaatttggtaacagagtaaaacttgccctcgccctcaattaaccccttctcagatcctcctagtctccttctctcgtctctctgacagaaccttatcttgctaagatttagtgctcctgcacgtgttttctttgttcagatacaccaggctatttaagcgttcaccatcagatgcatgctggaagtgttgtgtattgctgagatccatggctaggcagtcattctcgtctctgtatcctcagcctatatatgttccccattcatcccatgtgtatcgcctattgaggggccagaaagaggagcttgagtggaaattctgcaaaaaaacaaaaaaaaaaaggagctcggggagaggaattggggccaagcccttggactttccagccttgccatagttcacagggacctggaaggaaaatcagggtggacgaacctacaatgagtcatgaaatcagcatcaagtcagcctccatggag

SEQ ID NO: 60323 - DNA, 1301 bp, Bovine  19866881670059
ccctcccttcctggaagatccagggagtgggcacttgaaatgctaaggaggagataggcagctatggctgaagacagacatcgtccatagacaaagcactgggggacataagcaactgatttaaatttctcctgggaaataaatcagggaagaaaaccaaaaactaaaccaaaaaacagaggcagtcttttgggagaagggagagctgaaataagcataaagcttactagatttttgtttttctgattattaaaatttgagccccagaaataatctcaggggagctttacatacatgattcagcaaactttttcttaaaggaccagatagtaaaattttaggctttgtggaccaggaggtaaaatcaaggatgtgacgtagatgcattaccacttaaaacagtaccttttaaaaatgtgaaagccagccttggtttgtggtatgtacaaaagcaagcagtggaccagtcttgccccatgagctacagtttgctgacccctgcattaaagtcttcaatgtgtttcttctcggaaatgtatcttctcttaagagaaagaaacaaaaagagcaagaaagccattagctatgagtgaatttaatgttgcaaatatataaacttaaaattaataaagttcctagaatctgactcttattcttcacaacttaagagcttataaagtctgggatgtataatgggtcagttagcctcaagggtctcagggcaaaagttggttttccccaactctatggtttcaagtaatatttgtaaagtggacttagaaatactgagactgttaggttcccaagtcaaatcctgccttcataatctcctgtgcataacagtttatgagaccctagtctcagaaaacacttagaaataaaaagaattaccttggtcttgaaaacattctagaaatgaaggcatatgtaaaacaattatcctccagttaaaaataaattttaaaagaagaagaaaaaagaaagaaatgaaggcacagtatttttaattaggggaaagaagaaaaatattgtgatttttcttctcataaagatgtccctgaagttcatttttggaagatcatgtatgattctaacatctgaaacaagtagatacaatgaacatataaatagcttgatggtgggcatattgaatagttaccaatttcattcagaaaatttgttaaggagaatttaagtcatttcagcctttatatgtctaagatctacttgaaggtcattttatttatagtgaacacaattctcaccagaggaaagcaggaaacctttgttaggagtcagta

SEQ ID NO: 60324 - DNA, 889 bp, Bovine  19866881675323
atgtattaaatacaatggggacctccttgaaatattactatgctgaattctcttcctaacaggcagatcagttttggatttcacccaagaggcttagtcaccaaagaaccaaaagtatttcattaaatgtgttttctcctaaaagagaagaaaggttattagtagttattattatctcatagtctcaaaggttgttggtctttgtttccagtttcaatagcacttgaatcccacagaggaggaggctgaagggctgcagtccatagcatcacagaggtggacacaattgaagtgactgagcacttatgcttctgaacatactatataatttacttatttattaggcttcttttttccctgttcttcccccaccgcaatgtcagaggaggggatgctgcctactttattcactgttgtttcctaatcatatagaaaatgcacctggcatataatagctgctttataaccctgttcaattcgtgagcaaattaaagcatattttagagcatattttttttgaaaagcaactacaactgaagcaaagcatctctaactagtcttctcttttctgtctctgcccccttttttgtttaactgaagtatagttggtttacaatgtattcgtttctggcgcacagcaaagtgacttattggtgcacatgtgctaagtcacttcagttgtgtcagactctttgcaaccccatggactgtagcccgccaggctcctctgtccatgagattctccaggcaagaatactggagtgggttgcatgccctcctccagggatcttcccaacccagggatggaacctgcatctctcatgtcttctgcattggcaggtgggttctttaccactagtgccatacgggaagccatatatataaattt

SEQ ID NO: 60325 - DNA, 850 bp, Bovine  19866881725039
tttacctttatgatgacatctagtaatttctctaggctttgtgagatttgcattgcaacaaggagcttcctctcatgaagcctgtctcatcctttctccttccctcttgccattattaatcaggggatacagttaatgactctgacaaatcataaaagatttctcctaacttctttaagtgtgactacccaggtcagagcctgaaagtacacccagccgtgaaccacatgctatttataggcttaaaacccaggcagaatttgtatcacacacgatgaaaatgccagcctctcacaggacccaggatctgaaacaaatcacttcttccctaaacctccaaaggataaccacatggttcctccgatatgtgtttaatcagaatcccctcctcccctgcaatcaaggaacacacaattactgagctaatcatttaaatgatgctagtgagaaacaaagccattttccttgttaaaaatgtgtttgctgtcctatacatttatctgttttcttggcagtgctctgcattaatttattgctcaataaagcacagacaccagcagacttgctgagccatgcctagtggaaagcccactatttcatcctacaaagacagcctgcgagccaaaggcagaaaaaaagcacactgggcctcacaagccctggctggttaatcctggctccatttactctcccagagactcgaaagggaggcaggtgtacagcactggggagaatgcaggtgactaaacagttatcgatcgtcagaggaaatggagtaagtttggtctgttggccaagtgccattgggtttcctttctgtggaggtaaacctcactgtcacaagtatctc

SEQ ID NO: 60326 - DNA, 1427 bp, Bovine  19866881734817
tgtctacgctggggacccagggccctggacacagcaagaggaagcatgggccaaggagagacaagcagagtggtcataacctgatcgtaggtgtcggatctataaatcattagccataaagggacacatacgcatggtcctctatcaggatcaagccaggtgagcaattttgttaacatatccagccatatggatatccagccatatccaacagttatgaactgttctgaaagacagaagaagaggccagagaggccgtcgtttctatagcagtgggcgtgcttgaaagctttttcctttttctttgcttttcctaaaagccgctaaaatgaggcatatgattctcaagttagaatgcactgtttgccccagttcctttgtatctatgcccgtggctgatttcccagaatattccagtgtaaaaaggtagggacaagggctgagtcttgtgaaataatactagctgccaggaggatgctaggccatcgcatcctcaccccagcctctgagtgccctgactcagcattctcttctgccatctctggatctagggtgagaatgaaatgccaagactctgtcaagctcccttgttgacagcttgggtgattatagtcggttaagatagtgccactaggaattcttttcataacttcataccaagagagttttattgaaattacagccatttcaaaagccttttaaaacattggttgctaatctaatgtttcaccctcactggccagcaaaaatctgtgggcttactttaagactcccaaaactggcttcaaaagaaataaaggagtgttgtaacggagatatacctttaagtgagcttgtacaagcaaagccaattaaaggctgggaagaggaaaccctgcagcagattctagatctcctaatctgtggaagggacagtgtcccttcatctccactcaaatcaatggatgcacaaggctttctttaggtgcaacacccatgcctaatacttgttatatgcgtcatctcctcaccaccaaagcttttcaggccaccaaaggaaccccagagaacactgccagagttaatcttccaacccctctttattctctgaagtccacgcctggtgcctccaggtcccaatagcccgttggttcatcacttgctacaggcagcagaggtatgtttcaggttctggggttctccctacactgtgccgtctctttagcaattactcactgtcagcttctctcgattacctttttgcatttttcaatgaactttccaaaatctttggcctaggactaattaagcttctaatttttccttcttgttctctatccgttttgccctttagcagaaaagaaatggtttacagatgaaccggataatgcctatcccagaaacattcaaatcaagcccatgagtacccacaggctaaccagatcaac

SEQ ID NO: 60327 - DNA, 869 bp, Bovine  19866881871971
tcttcactggaaacagaaatcacagtgatcataatataccccagctgggaaggttgatttttcacattcactgggttgttagcattagagaaacacagtttcactctaatcagagaaagcataaaatataaaaggtgtcattactgacccaccattagtaacacatgcagaatctgggatcaagaaggtgttacttcccccagagccaaggctgatgtttccagttggatggtacctttgatgatggagccatcagcccacggattggtgtacaaccatttacttaagggattgaactaggctggttgaaaaattggataatgaagggcagataaataagaccatgagaagtgtggatgagcgagccccacggcttggttctgttttctctctgaagatctgtgagtatttgatgaataaggacccagagcacatcacctgctcatctttgctaggtgctcttctaaagcagcaggagtttgatgtgacagccaaaggagaaattgctgcctcaggaaatgcttcgcctttgactgattgctgaatggctggcaaaataattttggcacctttacctaagtcattttgctcccattcctccatttctctgctggaaagtatgtattcacattacagttaaaaatatgttgacaacacaaatgtggagaacagcatgtactatttcaggaaagaagttgtaggctgggatggttccattttatagaatagaaatgatgtcgtcgtgctctgagaggaggcctgaactctcctttcagctcaacttaaaatcaaataatatttctcactgacttcttaagatattgagtgcttctgttctggtattttcctctagttaatatttagcaaag

SEQ ID NO: 60328 - DNA, 1504 bp, Bovine  19866880339319
ttttgaagtattagtaaaagtcccactagggcagagaaacggtaactctgacccttaacggtctttgtcaagagacatttttggaccttagaatagcaatccatactgtcctgcttcctcacatttttttttaatcaatatgtggatggtgtagtaggaagagccctggacagggagtcagagagacctaaattctcatccgggctctaacttctctggacctcctcaatttttagatctatgatataaaattcaagatctctaaaaggggatcacttccaagattctctctggctctaacactgacttttttattaaaaaaaatttttccccgatgtgttactacatgctgggcaatattatcagagctttgtattcacttcactttctcaaaaaccttatgaggaaactgaggcctagagaagataaatcatttgcccaagatcatgtagtaaatggtaaagtcaggagttgagccctgcaggttgactgacttccaagtgcatgctctgaacctcagcgccatactgctcttgctgtccttgggcttcaggctgcagccactgtcttaggctctacagcaggtgtaaaaatggatgtgacaggtcttgtgtagcttatgatcttgaagaatgaaataggcctggattatgacagccaaggagactatttgaccccttttcttccaaaacacatttggagtttgagaagcttagcatcaatcccatcacataaactgaccttagaggctaaataaaattctctcactctgacccaagttcagatggtagagtggcttcaatgagtgcaccatagaggatcacatcttccctcctaccccactgagcagctgtggctagaggacttggtggatggtccctgaatcccccagaacctcaatagaaacttttcctgccatttctgccacaggagaccactgactccagctctgggccgttccacagaggcacaaggaaaaaaattacggagatgaagtgaaagcaggaaggaggtcttgtatcagaacgaccacattttaagaaatgacagcaacagcaactctctcttgagaaaaacatgatagacaaaaggaaggagcttcattctacaagtggatcaaactttgacattaacagaaaataattcttatgaaattattctctgggctgacatataccaaatgacagtgtattctgatcactaagttgccaggaatccttagaagaatagatgaacgagtcttcttcccaatatgccaatattggcccaatggggagtaagtttctaataccttaagtctgaggataactgaaggtcaaaacatacagcagcaagatgctattgtttcaactatttaaaacaaaaacatttataaaatatttttataagacacacttccttgccttggtcaaccctggagtcaggatccacttgaccatcagctagtggaaaaagcagttgtagctgtcatctaactagttttcctgtctctatgatcttcaat

SEQ ID NO: 60329 - DNA, 1288 bp, Bovine  19866880522651
atcaccatagcacataaagcagtggcttccatgcaatctccatctcacctaacccacctcaaggtgtcttttccgcattcatcttgagcaagaagcaagtggttctagaccaacaaagtaaatggtgggagacaggaaggctctgatcggaaacctgttccccacagtctccaatattcccctttggcagaatgatgtccccactatctcccctagtcttgtttccttctgctcacagcctgcttcctacttagataaatgaaatgcacattctcgtgttgtgtggggtcctgagacttaaaaaaatcaatttaaatgatttcttcctgtgatgggtcctggtcaagtgaaggagacatacaaatacataattacacagagaggtaaagtatgatttcttagagatatttataagctgtgctgagagctagtggggaagtgagaaaaatggggacagttccccagagaaaaggacctatgagctggcattttacatacaagtaggaagttccctgtgcggcaggagaggcacaaagggaactttctaaaccaaaggaacagtgggagttgtggtaccacaaggtcaaagagctttatttaccccttctctctttttctccaatacttcagacatctcaggaaaatttccttcctctcttgctctccattctattctgtgcccaaaacagaacccaaccatggaagttgcagcaaaacgctgtggtttccagtccttcttgcgcgggggacagagaacaccaaggctttaaactgaactttcaaagagcctgggttatggaaatgacccctgatcaccctggaatcccgttaggtctatagtactgcctcctcagatgaaacccagtcctcttcaagcacaagcattcaaagcaaacaagttcttactttgttagtttttctttttggctcagttactatattgcagagagtcgttttctattttcatcaccagagcagccttttttccaacagtctttttgagcctggggaccaaagcaccatttatagctttgcttctacggggaacagtgctttcacgttccaaacaacagacttacaaataaattgttgaactcacactgcttttaagcaatgagcttcctgtaatgttttgcacacttcagtgctagaggctggtgtgtgtgtgtgtttaaaaatttctaaatatgggtgccaggtgttacattttcagactgaccaagtgtaactttttttttcccctcttaaagcaacagaatcattttttagctaacacatatccatttaa

SEQ ID NO: 60330 - DNA, 653 bp, Bovine  19866880524203
catttaggctattgatcatgaatgaaatagtatggtaagagggagcaccagggaaaatgatgggattttacatttcttgttgttcacacaatgtccagttttgttaaaatatatgtttaatctgtaggagtacagagtgatttttggccagagttaacacggtaggtgctgaatgtgtgagtgtagatactatatatgtgaatctacctttgggtgggcaactgggcttgtgccaggacttggatgagacggttgctacatgccaccttggaattccaaagtaacctcaatgccaatatcagcttcttcttttattcctctaccttttcttcttcccctgattctttctcatttttctcttctttccaccatctttcctgttgtgccactgctttagagatcactaaaaagcaatattaggaaatggaatttagagagagaacagagaacgaagtcttttattttgcttagtctgaaaaagataaattgcttaaatctgtaccccaaagaaggcaggataaaaatagcttcctacatttcttctccaaaatgttaaataacccaaattccctcccctcatttttctttagaagaaaaacttctggttgtagtatatttttatacaaaagttctactgtgtggaaaaacagcag

SEQ ID NO: 60331 - DNA, 600 bp, Bovine  19866880535541
tagcactatagatcctcctggaagaaaaggttcaaaggtcagaggaaaggaaggagagtggcctggattggaatgaagaatttctgttgggaagtagttgtagatgtgactgagcaagtgggttaaccacattacagagggtcttagaagcctggctgagaaagctggatcttatgttctaggattatggagccactgaagttttttgtgagcaggacacggatagcattccagtgttattttaaaagactaatctggtatacacaatgatttggagggggagtcatgggttggggagctttgaggagctacttaagaagatgaatcactggaccagatataagatgatttaaacctcagtctggttcctacagtgctagaaaggaaggcaaaggagacatatgatggacagctggcatcacctataaaaggtgaagtggggaacagactcaactattactccagcttatctatcacactcaagtgttatcacttttggtagaaatagggattaaggaagttccatctctttggaggaaggggtgggggaacaaaattgaagtttatttccagctgccttgaaaggatggcttggagatc

SEQ ID NO: 60332 - DNA, 1449 bp, Bovine  19866880540218
gaaggcagatgtcctggatactctgtgcttgctccacaggcactgtccctcctcctccacccagctctgcgccacgggagactgtccagagcgaactgcatcaaggggcctctgattaggttcagcaggagattagggggatgggccaagagcgaggtcaggtgtttatttattcttctgctccttctctgtggggccagagtagcagtggctacggtccttaactgaaggcatagcagatgccatgggtcccccacccaggttccttcagccctcaccactgctgatgtccagtggtggctccttcctgtgtaaacacctgccactctctgcctgagggctttttctggacgtggaaacatgcctactctatgttcagggcaggctgaaggttctggacagttgatggtctcagggagcagccattaaccactgttgtatgggaattggtgggtaaacatccccatatcttctcccctgggttgggacaactctgagccgtgttcttcatcatctcctatgtccctatggagactgagccacatttgcactcagtggcaatctctgccaatcagtgcacactgccttggcctccttccctgccctgtctcacttacccatccctttccaggacctcctgggattgcttccagattaactacttgtgctgaaatcctactcttgagaatggctttgggggaaccccagcccaaagtagaagccaccattcttgtcaagcaactgtcttctgtagccatcattaccctgtgggttccaggaacctcttccttcctcccgatgcccctttgggccacgcataatcatggatacccatcgtttctactcccagagtgagtcactgcttttgtacacacagctgcaaaataggttgcaatgtcgtctttatgccgggtgtctaaacaatggatattcttttagataggaagaaaatgagaataagagaagtgaacatgtagcagacttcagaagaatacttcaaattctagaatctttggagccatattgtgagataattaaatgattgacagcaacgctagtcaggccagcagggattataatgcaattaccaccataatgtcaataaaggtatcagggtcatctatggggtgcttttcagggtgattgctatttgaagaagagctggttctgtcctgtctgtgctctttggaggcagagttcttggaattcctccgtagtcctatctgatgacatgctaacctcatacttcttagttacagcaaagctgctccacactcagctgcctgatgtgcttcatttcatgtctcaggcattgctgggatgttattgatactcacttgtaggaaaagaattttttaaacatgaataaaaaatttggagggactgctaggcagggattgatttcttgtgtgcccggttgagaattcccatgtgaggtattttagagga

SEQ ID NO: 60333 - DNA, 3612 bp, Bovine  19866880646306
caggaaaagtgctcagggagccagacttggggatgaggattaaagtggcccatctcagggagacagcgctccctaccttggtcttgtcatataaagcgtggttatccagcatcatcttccgctcgtgtgtggcatagcgccggatgtctctctcaaactgctggataagaaagagatcattaaaataaatcactatcaagtctagaatgtcttcagtattatctgtttaaagatatttaaatccctataatgaaacatcttagggcttccctggtggctcagtggtaaagaatctacctgtcaatgctggaaatgtgggtttgatccctaggttggaaagatcccctggagaaggaaacggcaacccactccagtattcttgcctggaaaaccccatggagacaggagcctggcaggccacagtccatggggtcgtaaaagagtcggacacaacttaacaactaaacaacaacaacaatgaaatatctatctccactaaacactctccaagtgaatttccgccccaccagggcaacattccaccatgacaaagctccatgctcacacgtaagcattggattgtaagctccatgaaaacaggaacctgatttgttctgttcacaaccatacttccttcctaatgatgcctggcacacagatggtgtacagtaaatgttgctcagtgaataaacaggtattatgaggattgtgtccagaataattcctgatccagagtaaacactacataaataatagtttggtgttgttttctatttggaatacaactactgtaaaagaggatgaggagtcaggagaccaggttccagcctggattttgtccctatctggctctgtatctttcggcaagtcacccaacctctctgaatcttggttggtcaaataggagggtggaggaagtgtgtgagtaaggtcctctggctgtaacatcctctcatgtgaacttctataaaactgatggtctgggccagctgcttcagagtagcatctcctatgatcagcatgggctctgaggctccagggagaaaaacttgaagccttagatggatgacaggaaaaccttgggaaaagaacgacaatgaatggagttgttgagattaattttcctgagagaagcatagatctagaaatgtcctttacatgtaggattagggagcaaacttggaatcactgaacatgaacttgggcaaactttgggagatggtgagggacatggaggatggcatgctacaatccattgggtcgcaaagaatcagacacgactgggcaactgaacaacaacaccatggaataattgtactaaagtgaaagaggagagtgaaaaatttgtcttaaaactcaacgtgcagaaaactaagatcatggcatctggtccctttcacttcatggcaaatagatggggaaatagtggaaacagtgacagactttattttttggactccaaaatcactgcagatggtgactgtagccatgaaattaaaagatgcttactccttggaagcaaagttattaccaacctagacagcatattaaaaagcagagacattactttgccaacaaaggtccatctagtcaaggctatggtttttccagtggtcatgtttggatgtgagagttggactataaagagagctgagcacccaagaattgatgcttttaaactgtggcgttgggagaagaatcttgagagtcccttggacagcaaggagatccaaccagtccatcctaaaggagatcagtcctgaatgttcagtggaaggactgatgatgaagctgaaactccaatactttgtttacctgatgcgaagaactgactcatttgaaaagaccctgatgctgggaaagattaagggcaggaggagaaggggatgacagaggatgagatggttggatgccatcactgactcaatggacatgagtctgagtaaactctgggagttggtgatgaacaaggaggcctggtgtgctgcagttcatggggtcacaaagaatcagacatgactgaacgactaaaatgaactgaactgaacctctgcaaataaatttatttggaaaggaagaatatattatatttactacattttattgtgttattataggggaagcccctataatgtggctcagtggtaaagaatccacctgcaattcaggagacacaggagatgctggttcggtccttgggtcaggatgagctgctgaaggaggaaaagtaaacccacttcaatattcttgccaagaaaatcccaaggacagagaagcctggcaggctacagtccatggggtcacaaagagtcggacacaactgagcaattgaacatattattttattagtacattacattacagtatactatgttacatacatatctcactatagcaattcattcacctgtaacattcttgatgatgaatcctggacttgaattttaagaacttgataaaaagaaatttttctaaggggaaactgatttgtcttgcctaattagactttaggattttcagcagtgctttgtggactttaatgtgaatatgaataacctggagatcttctaaactataatttcctgacttagtaggtctgtaggaggcccgagagtctgcatttctcacaagctcccaggcgatgctactggtctgagtggaccgcagaggaaattttacagactatcttcttgcaaactggctctgtagtttcttctggcagagtttagcgtatggtacaacttctttgtggtatttttaatcaagtgtgggtcaaaggctccagccaatggttttcaaccatagctgcacttttgagtcacctggaggtgcttttaaaaaacaccagtgcctaggttctgctgagaactagatttaatgaagcactgccctaggcaatgaagtaaaacagatgcataaacttctcttatgttttacacagcagatctatgacaagtctgcccttgagaagtttttcaaaatgataagatggtacaatgcatattatgaaggacttaacatttaaattattaaaaggaaaaataaaaggcaaaccttgttttgctataaaatatgatagattacctgcttcttaagatgaaaaccaaactgtagccctgctattatgtgcatctgtctctgcagacacttctaaggaaattgttattaagaagagaattcttgattacttgcctggataatgaggtaggtcatcattatttgtgtagcatggtgagttttcagatattaagctgtagattggattatgttcctatcctttattcccttccttgttatagaattcaagacttccaggcagtgccttccacaagagtaaggagagcatattttcttgtctcattgatgttgggcagggccaatgaaatgtcaggacacggagacttgaaatgttcttaagtggttttggttggcttcttgtactcctgtcattccacaagatcacacccaggaagcttgaggttctgatcgacccctaaaagatcttggagtacagctcagacatctgcatttgttagatattacaaacaggtaattcactgacctctggttttgaaggactagaaagtaaaacagataatgtaaatgcatttt

SEQ ID NO: 60334 - DNA, 2114 bp, Bovine  19866880752879
attcaggacatagtgaggaccatagtcaggtgtcttgaggacaagaatcagggcccagtgaggacccgtcaggccctaatgaggatgacaggtcccagtgaggcaaagagtccggccatagtgaggaacagagtcaggtttcagagaagaccagagtcagtccatagagaggaccagagtcagggcacagtgaggcacaatgtcagtttccagtgaggacaagagtcaggccccagtgaggcatggaatcagccatagtatggcaaagggtcaggccatagaggacagagtcaggccttgatctagatgagagtcaggctgtggtgaggatgagagttaggccaaagtgaggactagagtcatgcccttgtgaagaccaaagtcaagacatagtgaggaccgtagtcaggccatagtggtgactagagtcagagcccagtaaggaccagagtttggtcccagtgaggcaaagagtcaggctgttgtgaggcagagagtcaggcagactctttgttgtgaggcaaagagtcaagagttaggttgcagtgagagaaagagtcaggccgttgtgaggcaaagagaggaccagattcggtctatagtgaggaccagagtcaggctagagtgacttataatattcttggaatattatcctattttatgttcagcatcttctcagtataatgtctatgaaattcatccttattattggattagtttgttataattgctcttatcgtcacacatgtttatcttttctcttgttggacatatggttaatgcaaggttttagctatggagaataaagctgctaagaacattcttacataaaactacccaatggttaagtcttaagttgcacgtctcttataaagctgctgtgaacagtgaactagcaaatactgaatgattactccaagaagaaacacaaggtaagtttctgagagtgtctggtcccaaaattttagtcaactgatcagtacataaccatgttttatgtgcatttcttcttaaagacaccttatttaatatgtactattgatccattaatattgaactcacagtcaacagcactataactcaagccaaatgaagcttcagttcagttcagtcactcagtcatgtctgactctttccaaccccatggaaagcagcactccaggcttccctgtccatcagcaactcccggtgtttgctcaaactcatgtccatcaacttggtgatgccatccaactatcttatcctctgtcttcctcttctcctcctgccttcaatctttcctagtatcagggtcttttcaaatgagtcagttatttgcatcaggtggccaaagtgttggagtttcagcttcagcatcagtccttccaatgaatattcaggactgatttcctttaggatggactgggctggatttccttgcagtccaagggactctcaagagtcttctgcaacaccacagttcaaaaccatcaattcttcggcgctcaggtttctttatagtccaactctcacatccatacaagactactggaaaaaccatagctttgactagacggacctttgtcggcattaatgaagcttacctaacacatattttctccaaagaatacatcacaattttcttgtacttaggaacactagacagcacctaagtactacattcgtgggccattttaaacaaaatcaccaatgaaaagcacaaaaatgtgaaaaattcggcactaaatggaccacaaaaaggacactggttgacagtgtgagagttgaaagaagaaggcagagcattgcctcactccgtcgtagctaggaatgtgagcactgagtgactcaaattttgcctgcttttcatatggtcacaaataatctgcaaagtcactatgagtattgatctgagggctccagtaaatgttagcgagtagataaattcacaaatatgtactccacaaataataaggatagactggatgtgtaaaacagggttctcatctcttcccaatgcctagaattggggcaaaaaaaagaaaaagaagtggtgctggaaaaatattatgtatttttaaagaaagcaacttggctaataagattatcattactatagacatctacattttagt

SEQ ID NO: 60335 - DNA, 1240 bp, Bovine  19866880753758
tgaaggggcgtcagcctagggagagtggaggagcagaccctggggggatttcctggagcagaaccgccatcctgatcatagatagcagaactcccgactttgaagtgagaaagcaacttctggcttgtttagggcaggggtctggctatcaatatattgcttatcagctctagatccacccttgttatgttttgtgctagatccgaaccctgaaaacgttttttgtcagtagagggcactagagggacatgacaagaggaagggatttcctcgttctgggggggtctcatctttcttgctcctataaagtggtcaccagcagtgctcaggagacccactggcacccaaccttcagagttttgaccaaactccaaagggcaattccccacttgtcagccttttcctgcagtatctcaacaaacttctccagctgtcagggggccacagccacatcatttcctattaagtcacagcctgggagggttgtgggggcggagggacctctttcaaatatattccttccctaataattgctccctatatctaccatccctgttttctttaaagttctctctgcctcttttagtagtcatccccttttgcgagttaataatccttatattaaatttttgaattacttctgaaattaccgatgtggtttcagtctcccaactggatcctgatggccacagccaattaacatgggttcattactagcagttcaacctaatcttaactgactgagccatgcaatcatcgccatggagcaagtgagtaataaagatgggataagctttctgcttttcaaaaatcttctctccaaaaattatttgcaacaacacatgacagataaaaggttgaagtcttaatctttcatggttcctgcaaaatgtttaaaaaatgactatctaattagaaaaatgagcataaacagaaagaaaaaagaaagtccataaataaggaggggaaaagcccataaataggaaatgcacacagaaaaataaatacaaatgaccaaaatatattttcaaagtcttaaaattatttgaaaaagaaatacaattataatataaatgcaaattgaaaaaaatgtaaattatttttctcttatcaaatctacaaagactttaaaacctagaatataaaaatgttaatgttaatcttgagatacaaagagtaaaaaatatatatatatataattgaagggcaattgaaaataagagtcagaagccctaaaaga

SEQ ID NO: 60336 - DNA, 3295 bp, Bovine  19866880780948
cctgggaacatgctccccatgacaccataattcttgtgctcataaaacatcctcagaggataagaagaaacatgtaagtgaatgcttatttctttggaagggcccccatgagagaagaaatctttcaactgcagactatcaggcaccaagggcgttaagaacaggatggaaggagggagagctcagaactgtcagcgaagcaggcgaccctaaggccgtgtggacccagcacgaggacagcacgctcaacttcagaccatcaccatgttttcagtccctagggtcctggggcttcatctctcctttcctcagactaagtccctccccgtggggatctgcctgtgctgctcccaccaacacctgaggccaatcagtgttcagagaagaggctgtgtcagagcagggtgtgagagcacaagggaggggagaggacgggggcaacaaggagtcacagaacttaaatagtgcgcacaggcttttcataagaactttatttctcaaaaaggggtgaagaatccaaagtattaaaataattctctaattttttgtttcggagagaaaggacaggatgacaaaataactcataaaaatttcaagcacaatggcggtaggtacttcatcctccaacttgcacctcccatccacagctttggctccaaccgcatcacaagtaggactgagctctggatccggagaggctatcaagcagctagaaagctttttatattcactccacaaataaatacagaaggccaacctgcccagtacaaatgattcagtccatctctgtgactgtttcggatgaaaatgctaataagaactgcccctctccagattccaaatctctcatttttaaagaccaagaatgtgaaagaaatgaaatgtggaaagacttgtcaggtacgactggctcttgtaacaaccacatgccaagagagactctacctcattgaggtgataaaaggtaaaaagcgactgtgatttttccattgccttttatgtgggaaaaccgcacctttctatttttatcatcaaaaggaattgcactatgtgaagcaaagtccctctctgcagcaactatgcaaaatccctatctagagcaattattttctaacttaaagagaaaagaaaaaaagagaaggcggggggggggcggggggactggaacgtgagtgcttagcccagactgatctcgccacacagcccagaagcatggaggtgcactttccaacaggcaggtcctaccaggaggtgggagacaagaccgggctcacccccaagatgcttgagatgagcttcactgtgaagacccctcggaatacacccggctctcctctgaaggctctcagttagtgtttcgctgaggaatagggaggttctcatgaaggtactttaaacttccgtgctctgagaagtccgagaccacgtggtcctgccctcgcagcagccacttggtagtcagtagtccttctagtcccactgccccccgggcgtggattcgagatgtacttattcccacttcagctcctgcaggaaagcaaagattgaggaagcagctttgcccagactgcttcctgtctacccaccagaccatctcttccttctcctcacttggcatcctctccctttcctccgctgacctaccctccctaggttggcctgacttccactctcccccgtaaacatgttctctgctcactgtaaatcatggtcaggccccttcttctaatgaaacagactccacgggtttctctttcatattttatttgcagtgcattttgacaactccacaaagtgctgtctctgacatctgtcttgtgtctggattgcataccattatctgatatctgggcattgtttgaagtgtacaacaatgtacagaggttttatctccctaagtatccttcaaaccctagatagtaagggacatgctctagatattccccagaatgctcagctggtaggtgctcataagacagtgactgaatacatgaaaggacactgttcctttcccttcctcctgctccagcctcagatgtggggcatcgaggctttttctgggtctggcgtggtggtctgcactgtatgcagtggaggcagagctcccctgctcatcccaactttactgagcaggcactgggctaggccctggggataagctatgtgaataactgatgcaattcatggagcttgtattcttgtaggcaaggcagccagagaacacctcagcaaataattgcatgtggtgatggggtgcagtggagggtgctgggatagagactggcagggtggcagcacctgggacagggtggtcagggggagcctccctgaggacctgtctttggctgaaacccgaacaatgagaagcagccagctagtggacagcagtggggtggtgctgcaggcagcaaagaggtgcctggggcactggctggcaaggagactaaccactggcttcaaactctggtttaacagcatagagaccacatgactatgggcataccgcctaaccatctcttgcttcagttttttcttttggaaaagcaggaaaataatagaatccattatgtagaactgagataatgcatgtgatgtacttatgcatggtgttggaaatctagtaaatgctcagtaaatatcatctgtcactattattcatgcatttcacaggaatttactcaaccagagtctgagcttttgctctgagtgactgatgggaagacaaggcagtggtctttgctcctcccccattttggaccttcacttgaatgctgggaacctcagcccttacaagtgtgttatttcttctttaaaaacatgggaaaaaaaataaaaataaaaacatgggaattaaaaataaagagcccaaggactaagaataactaagcaaaattccctttaacgtttcataattcagtgagaattattcctctaggcagttctctattcaaacattcagaggagttaaaatgttttaagtagctgaaataattgtcagatgtgccataaatgccttactggagctttgtataagggtacccctgacaatcagagactgtctgaaaaatccttatactaccgggggaatggagattttactagtaatgacagaaagggggagggtgccctttccaaaaccttgtatttcaaagtctgttttagaagtcaaccttgcacctctgggcttacctgtttatttctgatgcttatacttcagcccagcataggcagtagtaatgccttcttttttcctatccttggggggatccctatctctaaggcaacctggatgtgt

SEQ ID NO: 60337 - DNA, 1990 bp, Bovine  19866880786231
gcatcttcaaaggtccctggtggtccctgatttaccgtggtgttgaatataaattataccaatgattagaaagaagtcagatcacttagagtaagaccaaacccctcaccagaacctgcaaagccctatgagcaaggcacccagtgaccccacccctgaccctctcttactcttttccccttcattactcttccaagccacactggcctcatgcccaggtactgttccacccctgagcctttgtacatgcaattccagttaccttaaatgctcttggccaagtggtgtgcttgctgtctctttgtccctatcacttttaatatcaccgtctctgcctctttacctgccttttctcatttcttagtgcttataattattaacatagtataaactttacttgttttattttttcaaactagaatataagcaccatgaaatggaaacatttgttttgttcactgctgtaactctagcctcaggcaggactagtgaatagtgtaaagcattgaataaataattgttgactgactaatagaacaatgaatgaaataacaactacagaactcccaaaccaaaataggccaatccgttaaatatctagaggtaagcacatgaagagaggagtacaggaaccattgagctttgaagcatatggagggaagcatagcctcctattgagcttgagtttgaatgtgacaaggaaaaagatttggtggagaaagaggggaatagaattccagctgaaggaaatctcatgttgaaaaatatcagcatccaaaattcattgattcattcaactaggactatagcaatgaacaaaccagaaaaaagtcgtggcacttagggagcatacagtctagtggtcgtaatgtcaggcagtatgatctcggacacacacatctgcttattggaatggtgagatgagaagcgcttaaatttctaaagggctgagagggctaggtagacagtgaggctttcatctggcaatcagaaggaaactaccttcattcttaatcaggaagagccctgggaatatcaattatggaggaattctgcaggtgcatgaaggatggattctgataggaaaaagaattagggagataccagaaagggctattatagagaagtggtggtgattggaacagagggatgggtgttgccatagaagaggttgagtctaagggacctggaaggaagcagctgagaaaggatcttaaagcccctgaatgtgagaacaatctaagtatgtgtcaccaagaactccctgatggagaggaaggaagatggcagagagggggcagagactctaggagctggagaaatggcaaagtcagattaggaccagtcccctgagcttcagtgattgtcccatcactgcgctgtgtaaacacaggaagggaccacagcactccactgatgtttactctccagtgcttgtctgtattggctgttttgttctctatacgacaagccaagcttggtctggatgtaacccatcagaaattggaaacaatttgaatctaatgcatcacactgaatctgcagagcaaaacttctgggttttttttttttttttttgcctaaaatccaccacatctgccaacaccccaaatctttcttaattaatagagtgaaattttaagataaaacatcttggtatcataaagtagagaagctgggatttctctgtattgcagaattttgactaaggacaaattacgtaattttaatctttaataggatgccagctctggatgtcatgataactgcttctattagagttaaaaagaatcagcttttttgcctctgacgtagctaattggcttgaaatcagcctgttttgtcaaagcttgtgtttccttcagttttgtctctgttaactgaagaattgacatttctacctggcttttagctcaaacagagaaggtttctcattcgtcctgtgacaggaagggaataagagggcaggggcagtcttgagttccttagg

SEQ ID NO: 60338 - DNA, 826 bp, Bovine  19866880812695
agggagaaggtgcccaaacaggctgccttaagacttggaaacttaccttcctgtgggttgtctcttatccggatttcaaaataacttcatagacaccgttttttaaaatgctttggtcagtctgtatttgggtcaccgtggcaaagcctaggtgtggcaattcctgcctataagacttcggaggtaggaggtgaaggtttggaaaaggtagacaacttgcatcagcacagccagacagctgttcccagcgagcagccttctctgccgtcccaccatgccttccaaccaataccacggtttctcaagcggccgcaacctttgcttgggtgacccagtgctcttctggcgtaatgaactccaaaaagggattgctcatcagggaatcagaaataagcggatttgtggggccagcacaactgttcttgagtcccgtcctttttccagtgagtatcaaggtaacaattttcttgcttcaaagttgcaaaaagtaaatcgcttttttttatttgcttgcagacaagatacatttttcaaggctggggaggggggaatggatttctgtatcagagagagagggaaaatctgaagagagatctgaacacacattgcctcaagatagaaaaagttacagcccgggcaagctttaggggaatgagctgctgaactcctcggcaagtctgtccttcagtcaatgaaaaagacatagggtttgaggttccttccgaaacggggcaggctaatttagcccctcccacgatcccgagggtctgttatatctctgttccttgagtacctctttcactgagaccgaccacagcaagcagag

SEQ ID NO: 60339 - DNA, 832 bp, Bovine  19866880823741
aaactgagattaagcatttagaaactaaaacagcaattttacaaggttaagtttgtctgttgaatccaacaataaaaatttgaacttgtttgtatgctttctttttaaaattttattttccggtaagtgatatactatgagatactaacaataggaataatctgacaactttcataaaaacagtttgtaaaatatatgtatttattataaacattataatttcataaaataatataaacacaatatatctacatctacatatatgcctggggagaaagtactttaacttctgattcacccctagaaatctatcctaaaagtaataatcagatgttcatgggagcactgtttacaaaatcacaacattaaaaataattaaaagcctaccaataaataaataatggtatttctattcaatggaatattcttcaatttataaaacaacactgtaaacccacgcttagtaatagggaagacacattaagtgaaaaaaaaaaatcaaaacagtagccatatcaggatttactttgttcaactgttaatagatggtagagaacagatgaataaacagacacatggagccctaaacactcttagtagtcaagaatacatacatagaatgtgtttatagtgatcactggttatccttggggtcagtgtttcttaaaatgtccttggattactatggcctccacactggcatacttccttatcatagcacaagcaaatagcctaacatttggatgtaacaagaataattccaagaccacactattatgaaactttaagaaaaagcagcatgaatccatgaaactttggaattctcaaagca

SEQ ID NO: 60340 - DNA, 1751 bp, Bovine  19866880882897
actctgtcctttctatatatcttgaaatccagaatttctctggtttaaattttccagtctctcattgaaacagggaaagggtggttgtctgatttcattgaggaggatatcactcagtaaccatgttctgtccctgcctcatccctacctccctgttatctcctattactgagtcagggttctacagagatcctcttctagtttctgaaggcttttaggtttggccttctaaccctctgtgaaaccttgcttccatctattttctgtattcatgtattatgttatctctccatttcaatgaagatggagttttgtatctgtttcttattagagtggttttaggatatatagaaagaagatatgcctttacattgccatcctaaaatcaagtctagtagtagctcttgatgagcctatatcctcagtgaatctgaaaaaaacaacccaattcaaagaacttttacaaaaaacatgcaggatttcccagctgtgaaacaccactgtagacttaaatatatattcaagtggatggcttccctgatagctcagttggtaaagaatccaccagtttgattcctgggtagggaagatccactggaaaagggacaggctacccacttcagtattcttgggcttcccttgtggctcagctggtaaagaatccacctgcaatgcaggagacctgggttcgatccctgggttgggaagatcccctggagaagggaaagactatccactcctgtattctggcctagagaatgctgtggacagtccatggggttgcaagagtcagacatgactgagcaactttcactttcatacatgaaactaaaagttgctttcttgggctcatagctatcttaaaggtctgttctcaatatagaatgacctcaagttcatagaatgaccaaaagttccctgatttgggagtttgcagagctaatgacacttttccctacctgagtttgaaatcaattaaaaagagtcagatgaagatcacaattccagctttatcactaataaacgctaggcaggtggttatgacttgagtgtgcagcagggagcttcctaatgtacaactgcactcttccattatgagttcagtacccccagttttaaccacaattcctcctgcttgtgggcagtttaaaacttgccctcccccaaaggctctgaaatgagtcagaacaacacattaattaaatcaactcttaggtaacactgaacacaaggctgaaaatccattctctattctattttccatccataaagtatttctagccatcccagcttatatagctcatcaggcattctgcagtgaggttaaataacagtattaacatatttcagtaatgtcaactgcaaaagatttgctccaaaaattgaatacatcctctccccattatgaagttcctagggaaaaattaaagtccgaacaggaaatccttttgtaagttacagtctaaagaaaggttattgcttattcttcagtaataaactcctccccgttttttttaatctggttagtctcagccagtcttggctggaatcagggaaccctggcatcttcagcctaagctggctgtacttagaatgcatgtggggctttcagagccacagaagttacattaattgtataccaagccctgcatgaacgtcactgtttaaaaaaaaaatccaaagagttagtatgacatgcaaaattatcacagcactggccccacattcatttttaaaatatctatagaagg

SEQ ID NO: 60341 - DNA, 959 bp, Bovine  19866880989836
cagaatgattactttagtaactcattccagtatttattaaggtctgtggtgataggtagaaaactgtgagggaaggcagtcagcaggaagttggattctcgagaagtgataaggaggttcagtgcctgatgttcaggtgtgacttactttcagctttttaatcaagttttttgttttgttgtggtgaggattctttttggggttatttatttgtttgtttttgtttttgtttggtttcttagaaatcttgttcaatgttacaagaagaatcaggaaagaattgattaggggcagatgtccacagggatacaaagaaggatctgactccaacattatttttccttcagaaagctatccagtttcttttatccttgttacagctatctgaattcttgctgccatgtttgagagaaaatttatagggagattagttatgattttttattacttataccagttactttatattgtcttagctaatcagacttttatagcagtgtggtttctttaaaagcacacatatttttctgcttatgaaagcaatacatttttgctgcctaagtttggaaaacatagataagaataaagaaaaataagtcacccataatatcatcatgagataaaatgagattaatatttttatttatttacctttttgtatgcatttagaaatgcatgtgaaacaacatatcatgaccatttccccatattattaaaaattctaaaaatattaaatcttcctgcctgtttttgaacatttgcttctgatttttcctattataaataatgctgatgaatagcctgctgattaatttctttgtgtctatctctgattagttccttagattaaatttcctgaatgtgaaattgctgaatcgaagatgtgaatatttttaaggtttttaatacattttgccaacatgtcttcagggaaagattttgtataaattcttgaccag

SEQ ID NO: 60342 - DNA, 597 bp, Bovine  19866880993151
gtgtgtgtgtgtgtgtgtgtctgtgtctgttggctgtgagggagggaggggtggcggaggaggatattgccagcaattttctgccccaccctcttgatgctgccttaaatagctccttgtcatcagagctctgatgtttcaggctcttagtgggagaggagggctgggaggattggtctgttggtacctctgtcctgggcactgttagagtggttggttaggaaagggttagttcttcaggggttgcagagagctcatttctctgctggagggcgctgagtggcactatctctggtgactatctctggtgcagggtattggcagctgaaaagagatgctttctacccctagggtgaagagctgggagggtattatcatcgtctgttacacacccactgtctgttacacacccaccctcggttggacctttcttcctgttacctcctgctttcttttattctagttggagagtttctatgaacttttctgaaagtacttggaatgttggaaggtgaggtaggagtttttggaaagcagatgcttcttggtgtcagaacaaagaactgtatgggtttccgcttctcacttctccaaaat

SEQ ID NO: 60343 - DNA, 2596 bp, Bovine  19866880997207
aaaattccctattcccctccctcttttcttacagagcttataacaaccgacacatattgagtcttctatttgttatctcctctactatccactggaatataatttccatgaggtcagagtagagattgttcagtcatatcctgagcagcagaaacagcatctggcatgtagcaggtgttggataaatatctgttgaatgagtgaatgcctaaacaaaccattacctcattcaaaacacgcaatggcccatttgacagatgaaaagtcctagcgctcaaggtcccatccatgctcacacagggagtaaagacgaagctggccttggcctcaggctctccttcagtccgctcaccggcacattcctctgctggccagagattttcataccatcgggatttcccctgacctttagcccaagaggaaatgatattgcaactggaagaatacccagagggctgggagctggcagcgaagtccccagcagctgcagggagcgtgtgattggattcggagttggccagaaaggcagcggacagcagaatgaaggcacgcaaaaatatccgcgtgcgcctgggccgccgcccgcgtcagtcaccagagggaaagaggtggtctgcgagtcaggagttgggattctggaacagccgagcagtctatcggggttgtccggggccagggcattaggttccatgtttaggacccttcttcgggcagcactggaagcctgtgacctctgggacacaggaaacatcattgagcttgtgaccaggaaactgtcttgagccctcggcttcccttatgggctggcaaccccaggctgatcattttgtgtctcagttttctcctctgtaaaatggggttacacttctgccatggagttttttaagcaaagtcaaaggggagatggggaaacttctttgtaagctgaacttttctaaacaaatgcaagaagaaataattttgcaccagtagcttgttctgtagaggttttgatgtggtttcatagtctcctggacacaggatttgtccttaaatctgctttggggtatcctgacccacccaactgctcaaccactgaatgcgggagacactgggggcccctctcagcccctcatgtctaagccatcagcctctcctgttgctctgcctccaactcttaatgtattcctgatatccctgtggatccagcctccctgcctgcctaacacggtcaacaccttgacaccacatgcccattcccaaactagtgtcttttccagatcctccttctgctgggatgcgctggcccggatctccatgtggccggctccttgtcttccaagtctcaacccaaatgtcatctccctgaagggccttctctaaccactttctaaggctgctccagtccactttatcacatgctgcattcggtcttcagagcattttctgaacctgcaatcatatcctttattttcttacctaccatgtatcgtccagccgcccatttggaactgatgcaccacctgtcttgttcactgctggattcctgctccctggggctgtatctggttcacagtcggtctaatagtggacaatgatagatcatcttcctggtgggtcaggtgggaacctggtttccagatgatgctagcaaatgagattgtgcatcactgctcttgactgaggcagtgtctgcagagtctgatttataaagtaaacagggaaatttctaaaaggagactcatcccaaagaggaagccaggttacctaagtttaagccgaggcagcagccactgtcacatcacacagtcaggagcagcgctggtgatgtttccctgcatcccacaccaggggctttagaagcagagagcatactttgtgtactgggctttctcagggaggcgagggtgaagaaagctgtcgatagtattcatctgttcactttgtatatttcactccaagtaccctgaactgattgaggaaaggctactttattaataatctgtgtactatgtgcatggttgtaagaaagcaagttcttttttagcttcagcattgagaacagcaccaacctccccctcccaccctcctcctccgcacgtggtaggagcctggatatcctttgttaaacaaatctttggggacttcccctggtggtcttgtggttaagaatttgccttgtaatgcatgagtcagggcactaagatccccacatgccacgcagcaactaagcctaagcactccggagcccttgcaccacacctagacagtccatgcaccacaatgaaagatcccacacgactcgaataagaccagaagtatctgaatgaataaatatttaaaagaaaaaaaaaacaaaaaaaccccccacatacctttactgatccactggtgattctgattgttacccaggagaccaggtttgtcccctcattcatggtgctgatgcaaaggccagtatgtcctcatgtgtctcttctttgttcctttaggtgggcttggagagcagccatctgggagctggctgaatgctacagccacgaatgccagcaacgaggaaaccagagagggtaatgtgagaccccaccaggcctgggggtattttttctttcagttg

SEQ ID NO: 60344 - DNA, 877 bp, Bovine  19866881031888
cccattcgtataatgatcgatatacacagtcaacatgtggtagaagcttttagaggtcaaggtgggctggctgcttcatggctgtgctgggctgtctctccagcagaggtattagtataatctgggtgtcaataaagagcatcttttctgaaattggactggctgatttaaggagtaacatttaccactccttggccacatgccactgtgagtgttcatggcctttctcttctctctgctaaacaaaattgttgtctattactcagccttcccagttaccctaccttttaaggagaattttctcctggttagctcagttcctgggcctttttcatgtagggaaaacgagtggaggctgtgctggagaactaagagatgggtcagtcagagtttgtgtgagtgtgtatgtgggcttgtatttgcgtctgaaaggcccaatacttgtggtgagaagaagaaacagaggctaaagaaaaagagagggaaagtgtgtacgagctgggggttggagggagatgaagaggagtatctatagaagggtgaccactggctgtgtatgggatactaagtggtagagaaggaggaggggttttaaagatgttttccaatgtattaagaattgcattccctcccactggcattcaagagatcaataacattttgaattttgtttgggctggattgtaattatgattatgtgattgtgattatgactcccaagtgaagccagggctacatagagacagttacgttcatgctactccggcatgttctatctgggagatggaggctagctatggagcagaagaatgtgagaagcagacttgggaggagtatctaggaaaatgctctgcggtttgggtgcaggggcttaggg

SEQ ID NO: 60345 - DNA, 1138 bp, Bovine  19866881044834
aaaaaccagcccagatgtattatagaagacaaaactcacgtgaatttttaacataaaaattggtgacttcttgtttgagaggcccactgtagacactaagctatttgctgaccgctgagcatcaagattcaaccatctctacaattattacaagagtcagaagaaaggttaaagtgccatcgcatgcatccatcaaagcacccgggacttcacaccagcaacctctcaagggccgcctaccctccctgagttgggtcccagcatgaatgggaaagttgagaagcatgtcattgttttccaaagtggtctggggcctgctattgctgggtaacttagctctgcctggggaaacaaacaaacaaaaaaaaaactatcacactgagtgtttcctacatatcttctcttggtcataagcctgtccatctttctcccatcccctctctaaagattaccaggatcactgataaaaccccagctcgaccatcagcacctccgatcccttatagcccaggcctccattagagaatacattgcagacactctttccatggaaggaagtcaagtaatagggcacatctcttgggagagggtgtcccctgtgtccacaaacaagggtggaaactttttctattgttgtggctgtttttgtgataaaaacaataatatccatgtgacagtgaactgggaaatttttttttttctgtaaagactcactactgaccacagaagaggatcagagagggggaaaaaaaaaatctctctctctctctctctctctctctctctctctctgtctcaatggaagaccacacagaagtaaaaagcaatttaattgggtttagtttgttttttcgtgtgtaaaacacatacacacattcaaaaaaagtgaactcaactgatttcaaacagagaggatgagattttaataacaccttaaatatcttacaattagttatgtcattgacagaaaataaaagatgggagaggagatcaaagaaaaagatacaataggaggagagaaaaagaaatggacagaggggggtatgggaggaaaaggacgggaagacagcaagacacagggacagacagacatgagtagccacacacaaaaagaaggaacagctaaaggattcacaga

SEQ ID NO: 60346 - DNA, 1122 bp, Bovine  19866881081789
cctttcccaaaatgcctctcaaaattaaagtaagttaataggttagttatgggaaaaaattgcctttaaatctctagtcttgttattgaaggaacaaagaaaagaaatccaatatttaggttcaatctcaaattcactattcagactcttgaaagcatttttaaggcaaatatattattcaatcagtctctttcatgttcattatgaatttctgtataaaactgcttaacacggggaggtatttttaagaaatctagacactttatctgccttgggataggcagaaatactgtttttcatgtacttgtgtcctaattatatttcagtttcaaaaatatgtgttgcctacatcagcaaaaatgagtcttcgaaaagcaactgggagaattctttttttggatgagtagctttgatgctgcaacagtgttctggtcgattctgttcctgttaggaaatggagttggatttcactgtcctttacaacatggaatcattttgcttctgctctaacctgaaagctctagcagatgacctcccaagaaggaccacgcatggatgaaggacaaagtgctggtgacaaaggcctccatacttacaaatgagtgtcggtctgcccctagcaacccctctctttcctccctcctgaccccatgatgctacctgcctgacccccagcaacccctctctttcctccctcctgaccccatgatgctacctgcctgaccgctggcttctaggctccatacagactccttacctggctggatgttttctctgatgatggttacatgctggtctctgtctggccgggtgtgttcatgccagaacccaaccacatggcccagctcgtgggccacaatgccaaacttgtcacagttttttccaatggatatggcctgtgggcctccacctcggcgcccaacataggaacaacagctggacaattgcagaaatacccaggtcagcagatcagggaatgaagcttgaaaacaatctcattgtccaacttccctcccaaggcaggaattccctccaaaaatggctcttgacctttttggtggcctggagaatccttagaaagatacagcctctcctccaggaaaaaagtcataccttccccca

SEQ ID NO: 60347 - DNA, 1391 bp, Bovine  19866881155864
ctcccctcctgaacaaaccttcatataccgcgaaagaagcccttgcccaggatgttgctgctgctccggaattccacccagaggcggctgtccgtggaggtgaggggctctgggactttgtcgccacaaaacctacctgggaaagggaaagaactgtcaggctgctggcagatggcaaggaggggctcagcacaagcagagagagagagagggcggtgctgcttcagatgaggttcaaggggagcagtcctcactggaggactcatcctgtagcactgaaggatgaaaagctggaatggaaacagtgactgctggtgtgcctccttccggagagtctcagacgccaatcaacgaatacccagcatgtggcctctcccctgccagggggtcacgatgagtgctaaggggtaggaggacatctcagcaaggccaggggtggggtggtggtctgagcgagtgatgagggtcccccattgtatttctactacatacatagccttctatttgaggggcatgccttataccttccttgccccaggaagggttgccagaggacacaagatgacgtgatcagatcttcttggcttttgaattccacgagtctggtcacaacaccaaaaatttagggaagtactcagtaaataagagcacattgccttccccttgttgtcttagaaagattcctgggatggagaagcaaggggctagggggcagagaattggagagggcaccatgggacctccgaaaggacctggtgccccaggtggacaagggtgatcgatgccccagggaggtttaaggagttgggaggagcagagatctgtaaccccgggagcagttcctggcagagccttgagggcaacaagaccctggatcccccatgtcccacctgggctcagaacaggagtgtctatatggtttcttaggacattagggcaggagacaggcaggcagagttcttcaggaaaagcaggacaggatggcagcaacaggactcctgggaaggggatagaaggaaccttccccatggcccagagggcctggacagtcattgactgtctcccatagaacgtcttctagggagatacagactcggcactgatctacatgggcctggagaagttgagacaggataaggcacaacagccacttagatgccagaggactggagactagagggggatgaggccgaaccaggaatgccagtcgggatagcaatgcagatgcccctgggacaccaggccctggcacaaagtgtgccccctactggcactctggtggggggacacaaattgaattcaattaagttcccactatctgatgcaaaggggctcataattgctattgaacttgtgttactgaatatacaaataaatgtgtattacttaag

SEQ ID NO: 60348 - DNA, 1404 bp, Bovine  19866881155869
ttgggggcaccatcaaatagccaccctgaagagcagccctagagattaaatgaaatccctgctcacagcacaaccctttttcaacagacaagaaaacagccctgagagaagagcgctgtgcatggcctaaaaaggctttgactgcattcagggccagctgagatggggaacactgggggatataaacagtgtgtcagacataaagcagttcaggttttacacaatcacggcaacaaagtgagattgattcgggtctgaattaagctctttatattgtttctacttaaaaaggaaatgtattgactacagtcctcctcacagatttatcttccctgacatcaggcacattcataacctattttaaattccaaggaacaatgctggggtttaggaaaatgaataccagtgtgttgcaccagaatgttttggaggctgggaagaagcttctctggcttttaattgctcaggaaacaggcgtgttgtagatggttttcttatcagccctaacttccagttagaagaccgcttgtccaggatgcaggaacttttagagcgggtctgtctttggaagattcgctttggagtaatcttagagaccatgtgtggtatcacttcagcttttctcctctctcgtaaccatctcctcctttcagatgtcaccacaattcatcaagctcaggcctgaattacctgaacttgggatgtctcatctcccgcctccaggcttcaccaaggactgtgggcactgatctccccaaggccagcctgaccatgtcccacccagggctccccacagcctttaggacagcaggaccatctgaccatcacccagagagggacacctgagagatagggggctccattaataatcacattggagtaagaggcagagccaccctagaagcaaattggaaggtgaggtcatcaactgtagaacaaatccagtctctttaccataagcttgaattcaagactctccaccctctggccccagcttacctttccagtctttctgcattttgcaggtccaattccaatggacctgtagttacacagcacatcctgggctttactatccctgtgcatttgttcccagcatttcctcctcctgcctccacccgaccccagcgctggccagagcaccacctacagaggtctaactcctactctccctgcaaggcttttgtgtgttagtcactcagtcatgtctgactctttgtgacccccatggactgtagcccgccagactctcctgtccatgggattttccaggcaagaatactagaatgggttgccatttccttctccaagggatcttccccacccagggattgaatctgggtctcctgcgttatagacagattctttaccatcagagccaccagggaagccctactctccctg

SEQ ID NO: 60349 - DNA, 993 bp, Bovine  19866881197650
tctgtgtttaaaatctaggacaacacgctctgactataaaaatatcatgatacatttatatcttcactaaaactgaagaaatatgtgactggaaaggaccttggaaaacatctctgtgagtccaagcagtagagagagcacagggaaaatgagaggagactgaagttctagttctggttctaataattatgaatgatgacaatttgactaggtcattttgcacttcaaactgtttcctcatccttataatcagcaagctcctattgactgaacaaagctgttatgaaaatcgaaagaatgtaaaataccctgtagttaaaagggttatacagtgaggagttaatataccttcaccatccagacagaaaggaagccataccacttttaaacactttttggaaggaaatgccccgatttttgtgtgtgtttctttcaattaggaagatatttacatgtttaccaccacacacaaaaatttttttaattatacaaggcataataattaacacatatttacttacagtgattttcttaccactaatcccccaaccaaaaaaatctacattcattttaattacatcagttactattctaatagtcagtcatttttctctagttatttccttttatttttgacagtgtgcttttgacccttttaatgacttcctctctgtccttacatgcttcagcatttctgatgacccagtaatcatgcccaagatcacaattctacatcttttctcttttcacttcccttttaatgtagaaaataagcctaatgatggaggcaccattagattatactaaaaaatactagatagaaaatcttctaggtgcagtcatcagtctaaggaatgaataaagttacaattattgcccctaaatggagatgtcagagttgctcccttgctgaaaatcagaaatcaagattatcagtaacccagagaaattcagaaacaaaaggcagtgtttcccttgggattatcacactgt

SEQ ID NO: 60350 - DNA, 670 bp, Bovine  19866881231070
cgtgatcctcacttctgaacatgttcatcaacctctttaaatattaaaaaatagatcatgaagccttaattctttttcttagaatcctttgccccggaagatacatgatgaagatctacaattaagtgagaaatgtatgttgcatgaatctgagttttagctatcacagtaacatcttcagatacttaaagaacagctacaaataggtgcaatatgtaagccatgtgacacaggctacaggaaccaatgacaagacaaggaaaactcaagcagaatttgacagagcccagtccaacccagcatcatccgaggagaggctgttcttggcccatcttagttccctagagaggagatggccacatcaggctgaaagctccatgcaatttatgatggcacttaaatagtacctgcttcctcaggctccaattcatgtgcactaagcaactttatgacaataatttggcttcccaatgacttaaatgtccaaagcctatttaagaactctttcagaaaaatgggtcacagactgtaatcatcagtttaataagtaggctgtctctcatggtttctcctttgaagatgttattcattgggagctattgttcagaaatcattctgttggatttctggatatgatgcaaggactgggtttgtgtattgattttagtgt

SEQ ID NO: 60351 - DNA, 1947 bp, Bovine  19866881269345
ggcattatgagctaaaagctgtggtatgttagctttaaaaaagagtatttatgttggaataattttaaaataatgtttacatagccgtaagtcctgtgtggttggtattgaacacaggatcgcacacgagaagatttttggtgagagttgaaattgctcccaagcaccagaattcttggggatgaatcaacatcatttgaaacaaaatatttgcaaaacatttaaaggtgatatttttgaaaatcagaatatggccccagaggactatgtttagttaaaaagattgctgggagttaaaataaaaagacataaaaaaataagaatacaagaaaggtagaaaaaaatgcatgggaatattttttccttaaaatagaaaaaaatcaaagtattattattaataatatatgtctgtatatatgtatgtatgtaaaggatcaactgtcagagccttaaccagtgcagtgtgataaatgctgacccacagacttgactgaataggccctcctggaccggccttgtgttttatggttctacttttaccaagcctctcttggcctttcttggccctggagggaggttcaacctacattcttatattgtgatctttcacagcccctgtcttggaagatctttgtttcagcacatggaacagcttgtcatgtggttcgggtcttacccgcctcacagggtggattccatttctctgattttttgtttgggggcttttgttttgtcccatctgatcttcaaagttgacaccaaaatcaggatgcagaaggtggctgttaagggtctctcgctgaggacttgaaaattctgtagtttcagcctttagaagtctgaataagattgatgaattccctggaaaagtgagaaggagtcagaaacagagtcagctctgcctctgtctttgctgctctcgtgaaacaatggtacttgtttttctctctctagtatgattttcaaaaacacacaagcttcaaccattatcaacctgtggccagttggaaacaatgagacgcttatgaaaacctttctttaggccttctgtgagtgacgtattcccagaaaagacaagctctgattcagctggggctggccagacagctcccctggaagctcagactcacgggacataaacacaatgtgggttctgcaaagaactgaacagatggcttcacgagagaaagtccactcagcagaaagacccaggcccctgccttggctcttccaaatgctcagtgacctttctgtacacatcccacgggacgttacccctgcctgctttgtccttggggctgttgcaaagctccaagcaggttgacttcaactcagagaattctcttgatgacctggtgaaacatttggggtccaggtcttcagcctgatcgaattctagtgtcatctggtctagcaaatgctagaacctggatcccagggcggggtgaagatctggaattaacttcagcctgtggaatttctccaatcagagaaggaggctgtgcattgattcaccataagatggttttcctctaaagttaagttttatgttactcatgaaatgctcaacctggttacatcatttgtaaaatcttgttaactagcaaatcaccctggggtttgccgtcaatctggtccatttgataaatctcagataattcgtggtattgtcattgttcagtgtgtgaacaagtattccctaggctttggcagatggttttcaagtttcctttgtagactgaacttctgaaaaataatcccaaatgcctagaagatttctttaaaaaaaaaaaaagaaaaaccgtttagaggattatctataaatatactgtattttttatcttgtgtaattgtacgtttcatgaaatgtcagtttcaaaaagaaagtggaaaggagctaacatatgtctagaaagaattgtttcattaaagaatgggatttatcgg

SEQ ID NO: 60352 - DNA, 1354 bp, Bovine  19866881435931
tgaaaacagagaattattgtttttccaaaatgacctataccttaaatatctcattaaaataaacaattcagtcaggatcctcaccttcagccagtctaatataacttcgaaagcctttgataccatctgtgtttgagaacataatatattaatagtttggtaaaggaagtccttggggattccctagtggctcagtggtaaagaatctgtctgccaatgcaggagacatgggtttgatccctgggtcggaaaaatccccaggggaagaaaatagcaacccactcaagtattcttgcctggaaaatcccatggacagagagaggagcctggcaggctatagtccatggggtctgcagagtcagatacagcgactaaacaacaacaaaggaaatcctcactacctaaaaaatggggaatgacagaattggaaaatccaaaagatcagtaactaaagcttttgtcattaggctgtagtaggccacccagatacccaaaaaggatactgagtgtctcatatcaccagttagaaccaggagtggctttccgacaatatacccaggattcccacttctagacccagtaagagacgcagctgtgctctgttggaaagcctgcagaaagagtgaaggaaagtcagtatggagaaagtcatgctcactcacttttccggtgtggcctcatgcccttccttaaggcaatgctgcaggttagctgcactgaacaatctggcttccttccacagtgtagcattttgcaaaaattgctcctccagcatcttttactttttttaattcactaaaataaatccttattcatatccatctgaacactccttctactaaagattgcaactaaagatctatcaaagatctctcaatcctgttttccaaaattactattaactcagggctatgttcagtgtagctagaatcagaggagtttaaatgtaatttagaactatattttaattaactatagatgttccacagatgaatactctgagtgacatgggatttagtgaatcacttgagggtagagttgagaagaaactggactctgctatgttcaaaaggaaagaaagtagaagaaagtcaaaaggtggtgatcaagactagaaacttaagccggacatgaataaaatgctgaatgcccagaaacatgaaaaaagctagttaaagaatttgtgtgggatgttagctaagtttatgattcaaaatgacgatttaaaaaaagtgtttggctttgtgcgtgaagtcctgctttgctgggggaatatgttaatgaataaaccttgctgaatccttatcactcgaagttaaattacagaatattaaatgttagacttcggtgacag

SEQ ID NO: 60353 - DNA, 1325 bp, Bovine  19866881441242
tgcattgtgtatttgcaagttgctaagatagcagattttaaaagtcttcatcacaagaaaaaaattgtaactatgtgtggtgatgaatgctaatttattgtggtaattgtttcacagtatatacatgtatcaaatcattatgctgtacacctaaaactaatataatttatatatcaattatatctaaatttaaaaaataactggataagggagactaaaagtgttatcttaaaaatgccaaatacaaatactatgaaaagataaaagttgacttcatattatatctacacatgaaaaaagaaattgaatagagctctttgaaagagttcatgggagaggtgaatttatgataagaattgaaagggacgaaacataaattttgattgcatgcagagaaagtgagtaggagcacaggcagaagtgaacatggaatggaaatctggtttactttgctttcaccatgtctgaggatgagttaagatagtagctggagatggaagtcataaaaaggtaaaggtaaccttagatttctgagcataggttttaaaatgatgctttccaataattcttacttttgtttgttgcttagaacagagagaatagaggaaaagaagttgacaagtctatttcagactttcaggtgatactgattttgtcaacaaaagaaagtgtggtcagtaaaaactaaacagactgcacatgagcaaagaaagaagaatgataaataatcttaatattctggacacgaaatgacagaggacagtaacgatggcaacgactgaaacacgctgggaggtaggtgatgggctcagcttttggcatgttaaatttcagataatgcacaaaaattcacgtggggttggtctggtacttaatggaagatgaagcacctctggtaatgctgatcaacatacattagtcccgaatctgacgtcagcactcctacctgggcaacaacattctgacacgtgtttccagccaacacaggagagccagcctgtgagacaggtgttacaggcacctggagctggaacgggaaagaggcagaagaaagcatttcctcttctagcttatatattatgctgaaatgagtatttttcctttctgacaatcaccttcctttctccttccactgccagtctaccacttcaggtcaaaagtcattgttattcaacacttcccaaatgtattttggggaacattacttgtattagatataaaacaaaggctcctcggtcaaataagttttagaaatactgtatctgacacatccctcttagagatgagaaggctttctaggtattaaaaactttaagaactccatc

SEQ ID NO: 60354 - DNA, 2536 bp, Bovine  19866881493494
agagaagccgcagtggggcaggtgtacacctgtggtgctgggaactgtcccccagcttttcctgctgcctctgcgagacccactggtgtgccatcattcagaactgcttcatgttccccctggtctttgatccttctccagaaggcctgtttctcctttgcctggtgaacgcccgctcctttcagatgtcctcacatctcaaagaggtgctttcttcccgtgtttgcctatcagcagtagccggggccctgttttctctaccggattatgagctctgacaagagagaatttgtgtttcagctcttttaaaattaaaatttaatttgtatcaaagtcatatgtatgactttaaaagtcaaatgacactgcaaggctcaggaagaaggctgtgtcacccatcctgatgacccactccccagggctggtcatggaacacggttttctgttgctgcaggaacaaatgaccaccaacgtagtggctttaaagcaacacaaatttaaattacagctctctggcttagaaatccgaaaagggtctcactgggtgaaaggcaagatggtgccagggctgcattctcttccttgcatcttccactttctggaagccgcctgcattccttggctcatggccacctttcaacatcttcaaagccagcaatggccagttgagtacttccgtccatcactgaccttctaacatagtcacaccttcctgactgccttccccttcccttttccacttttgaggaccctgtggttactttgggctcacctggataatccaggataatctccctgtttgaagttcatttgattagcagcctttcttccacttgcaacgttaattcccttttgtcatgtaatgataccatgtttgtgggttgggggattaggatatgggcgtcttcatcttggaggggccgttactctgccttccgtagtcacttccaggccttttggctgtttatgctgatagtactgttgtcctgctgtggattagaggagccctcactcccctcttctctcttctccccacatgcttggtttccttcatgtcctcccagtgtggtctatcacagtttttgttacactgatagtcaatacttacattattttgactgtgtggatagagttcctggctgagccttacagttgtactgtaatgaaatttcttgtacatttttttgagttaataattgcttttttcctattgatttagtttcctttgtggttatcccagagtttctgagaggcttttgaaaacctctctgtcttatacacgtgttcctttttcttttactgcaattttttttcccttggaggtctcactcccagaggcctcagttcctcccctttattccgagctgactgacttctaggcctagggcatggctcgtcctggggattccctcactttactctggttggagcctctgttttctgttgatttattcctcaagagtttctgagagagggtctgtacaagtcagtcacctcatacttgcttgtctgaactgttcttactctgcattcacatttgattggtgttttgatttgtttagaattttaggttgaaagccattttcccttagaattttgaaggcatggctccactgtctcctaggttccaatattaatgtcaaaatttgaatgctattttgattcttgatcatttatggataacctttttttttgttgttgttgttgttgaaagttttaggatcctttccctttccctatatttggattgttcttgctttgaaaagtattatgctaggtccttgttgtgttcttttgatctgaagactcacactgttcattttggggacattttcttatatttttctctgttaatttccttttgtcctttttcgtgttttgtctttggaactcccattacttagatgttggacatcctgggtcaagtttgtaactttaaaatcttttattgttttccattttactttgaagattcatttttctttttttttttttctaaatagcatcttgttcttgcttcatgggtgcagtgaattcacttatatatgttgtattttgtttgtttttgctgtttttctgcttctcctgtgctgtctttgtttctgtgaagtccctttttccgcttcttttggttattatatttcccattggaaccatctttccatgcatgctgatcactgatggtttatattttaagagtggacaccaagatgctgattggggatctgtgggacaaggaagggggcttgtgaacctcattggagggtcattcagtagagagcctccccttttttcactggagacacctagatattggtgtctgtagatcttttctcggggaacgttgggtgttcctggagaggagtgtgcctggggggggtgtaacaggctgtgtgttgttccttccaggagccttgatggggaaggaggcagggtaccctggttggtatgcagacgttcactctgtctgtctgttttccgaaagttgctccgtgctttccctacctccctcagctgtatctctccctaagctgtg

SEQ ID NO: 60355 - DNA, 1091 bp, Bovine  19866881510244
attgggtgtcctgtacgttttccttctccctggttggatgagcggagttgagttgaaaagacaggccacagcatgctttgtaaggaaacttggaattctctgccattagatatttatgaatgatttaactaaaaaatgacttcttgctcattgcatcttcctagtcattacttggcatgatccttccctgtttgctgactttcccaccagcctgtggccaggattctgccttgatcactggaaaatcctttctcttagcttgttggtgaaacagagtcagcacttagtatagacttgttgaatgaatgggtatgatcagaagtggcacaaacccgaaggcagggttatttaaggtagggcatgtctgcatttctggcagaggaggaagtagctacagctgtgtggcatgatcctcagggtgctcagtagctgcaatttcctggtcttccttggacacctggggctagaattttagaaaggagaagttctgtattcaatctactaatgcatgttttatccatttgactactgattgtaggctgaggataagcagttatggttttgttcgggtcattttgaagcataattatgaaacttcaaggctaaatggggctttagagatgatcaacctaattgtttattaagcagatgaggaaacaggctcagagagagaaaatgacttgcccaagatagttactaccaggctgaacccaggtctactgattctcaatcttatgtcttcccaacaaagctgtttatgcacaattgccatttctatgcaatttgctcttactatgtagtggactaattacagtatgtatttagttattcagaatatttgcctttgataagtgttgcatccattaataacaactcccaataaatcattaagttactttgtctaaagactatgctctaaatatattgtctatttccgtaatagaaggagacccattcttgacagaaagaggaaccagagatcatgttaggggagtgagtaagaatggggaaaaccttcctagattttcaagagagctcatagtttaatcggagatccacagaaagaagcagcaagccttacgtttgctata

SEQ ID NO: 60356 - DNA, 649 bp, Bovine  19866881596766
ctcttctctgaaactgattggcctcagcggtgtcaggtgttggtgggagcaacacaggcagatccccacggggagggacttagtctgaggaaaggagagatgaagccccaggaccctagggactgaaaacatggtgatggtctgaagttgagcgtgctgtcctcgtgctgggtccacacggccttagggtcgcctgctatgctgacagttctgatctctccctccttccatcctgttcttaacgcccttggtgcctgatagtctgcagttgaaagatttcttctctcatgggggcccttccaaagaaataagcattcacttacatgtttcttcttatcctctgaggatgttttatgagcacaagaattatggtgtcatggggagcatgttcccaggctggctccagatgctacctctcatccagacccttacatggtcggccacgttaccctgcctgccctgccccctgagtggggagttctggcatagcttgcctgaaaaggcaataaacatagctgcctgaaactgtatggcaagtaccacaatcagctcccaaccagacaacaaatgcccctggaatcaaaaatagaaagtgacccaagaaggccaagcccttggggaggactccactgaagaggcaggcctggaa

SEQ ID NO: 60357 - DNA, 813 bp, Bovine  19866881675689
aaataattctaggttcgactgaatgaagtctgtgaacgtatttgttaatttgcttttagatgcagtgtctacaacgttttctcaaaaggatatggagcaacatgaaataaaatcagacatgtgacaagtcagttcaaaaataacagagctcataaaccacacataggaagaggagggataaatataccaagaatttggggaaactaggtttctgcaattgaacattatatctacatgtgaacttcctggtagccaagctttaccatattttcaaggtttgctgcactaagcatatttgctatgatatatactatgatacatacttaatgtatatattatagtaaaagtatgtacattaagatgctttacattgtttactgagatgtaggtaaatctcaaaagcagtggctatgaactgaagagaggaatcaggtgtactggtagcttttttcaaacttcagtgcttccccagattcaagtaaacagcagcaacacactcagggcttagaaactgaataccatggcttcctagttggcatgtgatcactagaatctcaatattgtctattatgacccttacctccctggcatttgttcttcttagaagaaaagagagatcagattaaaatgggagccagcatatattgcattttcttttacaaggtttttacatttctaaactggactgtctgcaagaggaccattcaatgaattttcttagtcaagaaatggcccacgttaacctttgttgtggtggctgttcagtcaataagttgtgtccagctccccctcccccccaccaaatttagttta

SEQ ID NO: 60358 - DNA, 684 bp, Bovine  19866881720059
attcatttttgtctctttgaaattaacactcctttgatagtatatctgaaaataattcagtggaaagcctaccttgtctagttctggactacagatggcatatgatatttgaggttcaatagtagcaaaaatatttaagaaggtactttcttttaaattctgtccattataatcttctttaggagacacataagtcttactccaagtatacccaagcaaaacaggtggaatatttacttgaaatgttccactaatctgaaagagtatatgaacagaatggattctgcatgataaaaataaacatcagtcaaagatagctcagttcagtctactctattgcaggaaataggcttgcatgggttcatgctgattcgactaatagggacttgcaaagaatgataaagttttccatgatgatctgctcacaagcaaccttgacaccctgggtccctctgtaatatgtagtatgtggaaaaggcagaagtaagaaagggatgaaatgaggaaggaagttaacataccagagtgatagaaactcttagagaataaaatttaagctcagagaaaaatgctaaaagaccatgttacattttgcactgggtctggaaagagaaaaaaaatggaacagaaggagagatgaccccaaagtccactggaggagggaccgtgtgtgtatgtgtgtgt

SEQ ID NO: 60359 - DNA, 687 bp, Bovine  19866881796061
tgtgtgtatgcttgcgtatgcgcgcatgcacacctgtgaacatggagacctgactcctgcctgctgaaaggaggaggatgataaaccatgttagaagagtaatatctgaccttagttgagcaatatgtgcctttattttaaaatcttcgcatgaccccagggaagtagatgctcttactgtccctctttagaagatgtggtaaccgagactccaagcggttaagtaatttctccaaggtcacagttaataagtggatgagaccagtacagcttccaaggattgtctgatggaatgaataagtatgccaagttcttatttgaataaacaaacagcagatctgtctcatgagaaatatctttcgtaaatccagttcccctttcctgccctggtgaagtagtattaaagtcaaaggaaacgctgtgatctgtgttagctttgtgcccctattattgagtgtttctgccacatgagacaggtttaggttgcccgcccgcattatgatcagcactccaaggggtgactgatatcaagatggcctccctagaatcttttctcactttcaggtttctgtatttcagcctgaagaaataatttattctgatactaataagagcatggtagaagatctaaagaacaggtatgatctctatatgctagattatcagttttctccctaatctcccatt

SEQ ID NO: 60360 - DNA, 932 bp, Bovine  19866881882651
ttaaggattccagacctgagaagaaaagtcatgtcccaggatctgtcaaataggatctccaagtgagagccctcgttgtgagacccagacacccatgacagggctctgtcatgcttgacagtttattagccatttagatgaaggcagagaaagggtgtttgtcacgtctacagtccatgcaaagctaaatgccacagatgtcagaatcaacaggtaaaatagccaaaatagctaaaaagaagaactgaaactgacatgaaatttatcaaggattcacgtaaagtgctctttttctgttcagaaagtcaatcgcacacctatagaattaataagaataacaatagaggtactaaataaccatcatttttccattcaataggtattgtgtgccaggatctctctaatccttgctgcagccctttgagattggtgctattattatctctatctttttagctgaagaagctgggaccaggaagtttaagtacagtttcctaaagtcacacatatgttaatttgactgaaaaataccatattcttacaccaataagataaggactagggagacgtggcttatctgtgcctgtgtcaaagacttttcgcatttgtaaaaataagtgaatatatatttgtgggggctagaaaggaaaatgcacaagcacaggtggtgagccaaactcaatgttttgtgcagcctggatgggaggggagtttgggggagaatggatacatgtgtctgtatggctgagtccctttgctgtccacctgaaattatcacaacattgttaattggttatatcccaatagaaaataaaaagttaaaaaaagtatatgtaaaacataaaaattccttcacaaactagtttcactaacttgaaagaaatatagtcagtgtgattcaggcttgtaaatgtcaaaacgtttacccagaa

SEQ ID NO: 60361 - DNA, 1365 bp, Bovine  19866880223011
tgaaggataattgctttacagaattttgctgttttctgtcaaacttcaaccatgaatcagccataggtatacatacatcccctctcttttgaaactctctctcatctccctccccattccacccctctaggttgatacagagctgaagtttgagtttcctgagccatacagcaaattcccgttagccatctatttaacatatggtaacgtaagtttccgtgttactctttccatacatctcaccctcttctcccctctccccacgtccatagagaacagacttatggtttatgctttcacacattggtaatttgggctgtgctcacctgggctgttccaatgatctgggccagacttggctactcttggctggagttcattccagttctgtgactggctgccaggtcagctgaggttgatggacttttggctggggtgctctagttttcctctacacagtattttattttccaggacttgttcatatgatgatggtggaaggggtcccaaaagagtgagtggaagtgtgcagagcttctcaatgcctatgcttgaaactgcagagttgtatctgtacccatcaaccaaagcaagtcacaggccagtctagatttaggagtaaaataataaattttatttcctgatggatttaaagaaattgtgggggaatttgtagctgttaatacaatctaccacacaaacacctaaagatctaatttaaaggagaaatgacaagcgaatacaggctctagcaggagcaagatatctgaacaacctctggaggaaatgcaacctgggagttaggagtgtggttgagaaattacatagaactgaattccagtcctgactgtgttgttcactggctggttcctcattaataacagctatctcatgggtttgtgaggattacatgtatgtaaaactcttagcatgatgcctggcatgtgctaaggaataataaatgggacctgaaatagttgttatcactataggatacttcagtgacataaggcctgggttggaaacaggactaaacagaactggagatggagagccaggcaaaagagagattggctcaggttggcagagagaaatgagaattattacagtattatgtagtagaatagggcaggacaaaatgcagagtcagacagactagggtctcatcagaggcttagacacacaggtcagcacaataccagctgatgcttacggagcacttacaatatgccgggcacaattctaagtgttttatagttatttacacatttaattttcaaaatacctctatcaagctgctttccccattttatctttggggaaattgaggcacaaagagatatttttagattttagccttgcata

SEQ ID NO: 60362 - DNA, 1280 bp, Bovine  19866880415728
tgtggccataacctagagaaataaaaaacctgaagtatcaagggccctcttcagagtacatttccagtgtcactgtctaacagctgggctataagcagtcccatatcattcatgaggaaatgtcattgaaatgtgaataatttgaagctccattgaaatcccctatgtaatttcacatagatgagcggctttctagcttgatgtcacatggagttcttcagatggaggtgggtgttggaaaaacactcagaacagcatgctataaatagaagattgcctcacacattctaataacaataaccatccctgaactatttagccatcacctgctatatttcacactcctcatatttcccgactcatttgcaagagtcaaacctcagccgtgaatcactctgtgttgctagctcaatcctttcttccagaactaacctacatattcagcagaaaatctcaagtcccacagtaaatcattcctcacacaggtaaattggaccatctcccttttcaatcctctgtgggtcatgtatccctggggaagctgttcctcaacaagcacctctcaagctccgttcacagtctttctatggtgcattaatgttctctccaaccttggttgccaagacccagttttgtcactttctgtagctcatttcatagtaatttcatgagtatgagctcttgctatccatccagactgagattttcttaaggtcctgatcagatcttcccttttcctctctacccagagctctgaaagtggtatctgcttaaaagatttaaatgcatatttatttgtcattcattttcaatttgttgagaattccatttaaaattctacttttaaagcaattcaaacaaaaggaaaaacagtacaactcaaagaagatgcttactatacattagttgacatgtcgttgatgatctacaacttacatatcctaagtccatttatccacttgcagttgatcattctaacttttacagtgctggtgaaaaatacccaaatgagccctcttcgaatggctgtgtggaggatttttaagctttgctaaaatgaagattctgctagacaaaaatcctccttcactcagcatcggaagtcagtttttgtgaacctaattagatattgggatttacacaatgtaaatgtaaaaaatatgtatgggcttcccagctgactcagtggtaaagactgcttctgtcgggaagatctcctggtggaggaaacggcaacacactccagtattcttgcccggggaatcccatggatagaggag

SEQ ID NO: 60363 - DNA, 1383 bp, Bovine  19866880425992
ttgactcattggaaaagactctgatgctgggagggattgggggcaggaggagaaggggacgacagaggatgagatggttggatggcatcaccaactcgatggacaggagtttgaatgaactccgggagttggtgatggacagggaggcctggcatgctgcgattcatggggtcgcaaagagttgaacacaactgagcgactgaactgaaggagcatcatattctagaccaatataaaatacagtgccctgagaactgcaagcagtgctgcccctgagaactctttttaatttctgcttggttgatgatagagctttggttccatggagtttcaccaacaatggccactctgtttcaaatcatatcacagtttcctagtgaggggaaaaggatcagtttaaaatctacctataatctcacgctaggagcttctctattgctgtgaaataacatttaaacagaaggttaatgccttacactaaacctgtagtcctaatgtgcctccaaaaagcgttagttctaattactctttgtagaaaggctgactagaagtggccctatatattctaacattcaattaaagggctgttcttgagaagtagatttttttttttattgttgtgtagaatattgagagaattattagttgcttctgtagtccactctgcagtaatatgcaattattttgcctctcaaagagagagaatttttagtcagcgtgaactaattgtactatatacacaggtagtttttagcaatgtccagtgattcctcctcactgcttttctttgtcaagagtttaatcaacagaaggcccctggagggaggagaggggtatttagatttcctctaaaatctgtaaggtcctagagaaaggattatctcttcaaaccatgagcctctttcttcccccacacgcatactgccctgggattaggcctttctctgtttggaacgaggccttgagacataaggagttgatgaagttatctgaatcagaggttcagatagtttagatagtggggcagtttattcaagaatccattctccctcagttcttcctgtcacccctttattattcccagaacccttgtttctgggtttttaggaagagagaggatctcaaattacttttcagagaccactgctccagatggttcaagtatggataagaaggactcctgatgggaatctaagtccattgctcttgagacacacctcaaaacttggaggccagagtattaagagaagaagaaaaaaaaagttcaatctaagaagtcagtaaaggtatagacaccacatgcaaagaaaaaagaaatccaaaccaaaacacagtagtgttggataaactgaagacaacattgcttttttcgaaattttagaa

SEQ ID NO: 60364 - DNA, 1247 bp, Bovine  19866880516879
actccagtgttcttgcctggagaatcccagggatgggggagcctggtgggctgccatctatggggtcacacagagtcggacacgactgaagcgacttagcagcagcagcagcagcaggtgtaaaggagggagaaaacctagtgtttaagacttaaggaaatcaaagcctgagaaggtaacaataatccatttgatttcttctattcctttcctttgttgctacccaatttaggccttgaatcactgaaacctcctcctgtcactggctcccatttccagtcatgtgttatttgtgtaacataacctccttccccaaatcatattgctgccaaatggatcttaataaaacaattataacactgctgctgctgctgctaagttgtgtcagtcgtgtccgactctgtgtgaccccatagacggcagcccaccaggctcctccatccctaggattctccaggcaaaaacactgcagtgggttgccattgccttctccagtgcatgaaagtgaaaattgaaagtgaagtcactcagtcctgtctgactccgtgcaaccccgtggactgtagcccaccaggctcctccatccatgggatttcccaggcaagagtactggagtggggtgccattgtaataaatatattacctaaatgctggataacagaaaaaaagtttgaagaaacaatatttccacaaaatattgtatagccaataaaaaagtgttccaaaggatttttaataatatgggacattattgctgttgtattaagtataaaaactaaaaataaattgtatatagtataatctcaaccacataagcacacacacaaagaaatagaactagatagaaacagcaaaaaataaaccacaattacaattattggtggctacagaaatttttgaaacatatttatttataaagaaaaattataatcaaaatgcataacttttatacatctttaagtccacttgtaccttttactaaccaaaaaataatcctaaaactacaaatccaattatttaattcatagtcccatcttattaccctttactgccttactgtgactagtgagcagcagaggccaatccttagactcgaccagcctttaaaggttagatctgatacagccttatcagtatctatatgctgatgccccttccttcgtcacagtttctcccacttctcttcccaagtgatagctcatttttccagtgtgttactcccaagctctccagcctctgtacctttg

SEQ ID NO: 60365 - DNA, 1304 bp, Bovine  19866880605089
acccttataattattattctcaaatttaaagatgtacaaattgagggacaaagacaatcaataatctgcccaagttaacacagttggtgggggtggcacagttgtggtttgtcaatctgtcctaggaatttgtgttcttgaatagcaagcttgtaagtcatacccactatgttctgactgcctttctaactactaaatttttttataaaacataatttgcaaataaaccttaaaatatgtgaaatgagtcagccctttttgattagaattataaatatctgtggcttattaatgacacgggtcaaatatagaatgcaattcaaagagaaaaaagagctggtttttaatataatgtggaagaaagataaattacagctataaggcattgatatgatgctgtgattaaagaataactgaagaccaaaataagatatgacatgtgggtaagttaaaaaaggaaatatcagagaaagaaactcaacaacaggttgcttatatggaagcattgtttatgggaactattttcattaattgagcaatgggtcaatttgaaatattttcttaaataggtaaattatatctaccaaattaagagaagatttacatcatgattaaaatgtaattctgagaaaagaatttttagaaacagtcactgaataaaagggtaaagaaatatctccctaactcctgacagctgttatattatattggtttactgaaggaagcaatgaaatctatttctttgaagatccttaaaaagagaaggcatacattatcagcagttcagaaaggtttaggtgtctctctgccagaaggcaaccagcggagtaatcacttatggttctataaagcctagtgactgcataataatgctattcttataactatgaggaaagggcaacacagctgctttttcttttctttggtgatcaggatttgctattccaaaaagttgcagaataatttgaatgtaattagatgaaattttccccagcagaaaagcaaaaattaattttgactctagttactgaaagaaaactcagaagctccacactgggctttttaaacatttatggtctccttcacttagaaagcagtcctttatgttcaacttaaaaagcaaactcatttgctggatgaccttaagcctatgagttgaattaacggtaaattaaaaattctgaacatctctacagtttctttgtttggataaaatgcttggagaaattcaattttactgcattctactcaagtttttatgagtttacctttatttcatttcatattatttacataatccttta

SEQ ID NO: 60366 - DNA, 786 bp, Bovine  19866880677322
attgctggaaaaggaaggtcagtaggataaaagtgaatcatggcacaaaagagaaaatctgtagcagctacctgagctagggtttatctttcagaagggtaattagataaatgcagagccaaaggaactagtatttaaaaatccattttagccatgtcgtcacaggaaaagactgtctagacagtatggtctattagtctggtcagaaaaagttggacttttcaatgtgatagaaaattttcccacataattatactataatatggagtctataaatatcaattctaacacatgaaatagttgagataatccctcaaactttcactggttaaatggtttcagttcaactctttgttagatggtccttgttggattcagttcagttcagtcgctcagtcatgtccaactctttgcaaccccatggaccgcagtactccaggcttccctgtccatcaccaactccaggagtccacccaaacccatgtccattgagtcggttatgccatccaacaatctcatcctctgtcatccccttctcctcctgccctcaatctttcccagcatcagggtcttttcaagtgtcggctctttgcatcaggtggcccgaagtattgggagtttcagcttcaacatcagtctttccaatgaacacccaggactgatctccttttaggggtggactgggttggatctcctcacagtccaagggactctcaagagtcttctccaacaccacagttcaaaagcatcaattcttcggtgctcagctttctttatagtccaact

SEQ ID NO: 60367 - DNA, 1164 bp, Bovine  19866880700838
caatgaatgagtctaaaaaaattccaggtcagctggaagacagacacattagctggcaattactaatacagaacatggtaagcagtaccatcgaggtaagaggtaaggctaaaaatattggtaaggctaaaaatattaagtccaaatcttcaggtattaccagttgaaactttttctatataaattagtactttccattgcaaaatcaagaatctcacctcagcctgagaacacaagtgtttgtcatccttccattcaattaaccaggtatttgtccgctatgattttgttacatttctaattaagaacaacagccttcctatcaaatctacctcttcccaggtttaggtatgtttagtcattaagtcgtgttgaactcttacgaccccatggactgtagcccaccagattcccctgtccatgggatttcccaggcaagaatactggagggggctgccacttccttctccaggggatcttcccaacccagggatcaaactggggtctcctgtattgcaggcagactctttatcaactgaaccaccagggaagccccaacctcttcccaagacaattccaaatcaagttagacatcagaatcagcataaatttgttgtccccatacttcctaactcaacacgtaagagaaagatatcttaaacacgccttttgaaatttaagtacttaaaatgggtaacaaagtctagttaaaaagtactgcttaagagaggttgtcctttaatgactaaaaaagaactattctcaactagcatatcaaagctacaagtcttcaaagtcaagatttctgctcgtaccacaagtaatagcaggtccttttctatctgtacccacttacacaccgccacttgggaacagccaattaacctggatgaccaaggtggcctagctacttgggtttccctcctcattctcctttcagctaaagacaagattacgttactcctccccactggaacccttgctgtttctagtatgagttaggagcccatattggtgctgagatatgaaggagcagggagaacaaagaagaagaaaaattaaaggtaaaatgacagaggccctctttcctaacacatcatgtcactcttcatatagttcctattttcttccagtggccctgtccttatatttaaatcaatatct

SEQ ID NO: 60368 - DNA, 2136 bp, Bovine  19866880702148
ttttatacccttaaggttggctttataaaatctcagcagtaaaaggagatagaatgagtcattaagaaaataaaaaacaatctcattggttagtgagggtatatagagacaattttgttagagcttgggtaaggcatgagtttcaaaacttgaggaaatttattctagcataccattgtccaccagaaacatgagctacataatgtaattttagatattctagtagcaacaacggacaacaaaaagaaggtgaaaggtgagattaacttagacagtaagctttatttaatgtaccaaaatatttagatctgtagtcaatatagaaaggtattaatgaagttttttattttcttttgtgttaagtctttgaaattctgtgtgtttacacttaaagcacattttgattcactgattagtcattggaaataattgctctttagattctttaaattatttgtttagacccttatttagctgaagaagtaaatttacattctgaaattgtttcaaacatacttaaaatgttctgttagtttttaaactttataaaaatagagttccacatttcagatcctcaagagcccattgaggttacatattgaatagcacagctctcgaggactttatgggaagaaacaccttttatgaattttttaagcagtgcacccataagttttttagtatcctttataaggatattaaaggatattagaagtcagaagcttattttttagggcaaccaaaaaaacatgagatcagggcattgccattttcttcaaaacaataggaaaaatacttaacgtactggaggttggttttttcctcccttcctaatgatagtcatggtttatgggaatgtattagtggaaagggttagctgagcacttaaatttttactagtagcttgagactggtcatttctacattttgattaagaaagtattttgctacctagaaatatttgaagtctcaattttattcagccaatagccagatcctctagtattttctcattttcagaaattgcctgaacaatttttcttttcataagaatttttctagtttataaagaatgtatcccagtagtatttttcacagtgaggcttaagaatagaaaggtcagtgtatcagtatttaatagttgattggtcctaatttaatgttttctttttttcttcatatcctaataaagtaactaaaacaacaatcatggttagaaaagacatggtacatgaagggctaagaggaagtggacagtaaggagccctattaatgtggggaagatggaagaaagggactttctgacaggtggtagtggtctctgtcagacttcttcaggaaggaggggcctgtcctctcctccatacctccaccactctgctgagtcatttacatacaggatcagctaaacaggtgtgctgctagaggtcttccctgctgccctctgtttttacagctatattaaacttttatacagcaaagtctaacaaaacaaaacataaaggcaaatttgagtaacctgggccattagttaaaatgtactggtcttatcagactttgggttttcatagagaaccagaaactctgttaacttaagtactaggaaaagatatgacagaatgaggtgaggaacaaaatcagattgtgcagttgagttgtttgttccgtttacattcagtgatgtagggacaggcagctctatactgacactgcctcatgtgatgtgtgaagtttttatgaggttgatgagaattgtttttgaactttactgacatctattattacattttgtttcctagtactctgttctaaaactgactaaaatcctaactgttctctggcttaatgttgtttacttcccttattcaacctaaactatttgtttcatctttcaggcgtttgaacacttacaacaattagaattaataaggcccatggaaagaacatcagtaaatgcacagagggagtatcagctgatgaaactacttttggataatacacaaattatgaatgctttgcagaaataccccaactgtcctacagatgttaggcagtgggcgacatcctccctaagctggttatgagtataaccatgggtttcagttatgggagtttcaggcagacttctctaaagaa

SEQ ID NO: 60369 - DNA, 1895 bp, Bovine  19866880709113
atgtactctgcatataagttaaataagcagggtgacaatatgcagccttgagttactccttttcctatttgaaaccagtctgtttgttccatgtccagttctgttgcttcctgacctgcatataggtttctcaagaggcaggtcaggtggtctggtattcccctctttcagaattttccagtttattgtgatccacacagtcaaaggctttggcatagtcagtaaagcagaaatagatgtttttctggaactctcttgcttttttgatgatccagcggatgttggcaatttgatctctggttcttctaccttttctaaaaccagcttgaacatctggaagttcacggttcacatactgctgaagcctggcttagagaattttgagcattactttactagcatgtgagatgagtgcaattgtgcagtacattctttggcattgcctttctttgggattggaatgaaaactgaccttttccagtcctgtcattatagcatatgacagttaggaaaaggtggtgaaagtatgctttagaaaacttgttccagttaggaaagcaagatgatttgaattaaaatgacttttcccccttttttacatttcaggacctgtagatgaatacatgctgccatttgaggaagaaattggccagcatccctctcttgaagacatgcaggaagttgttgtgcataaaaaaaagaggcctgttttaagagattattggcagaaacatgctgtaagttatagttagcttttcactttaatttccaattaaaaaaaatgctcatcagaggaatgatttatatttttgcaccttttctttctggatttcctgaggcagagatcttggtacaaggtattctattctagagtcctagaaacagtgcagttaaggccacatctgtacactcgtgagggagacggtaaagtcagagctgtgggggacacttggctttgtgctcctgtgtcacagtgtctcctatctggaaggtttccaagggaaacaagtggctgactgtgagcctgtggagagttgtataaccttgctgaccaccaccgtcgcatatgatgtcgttttaaaaagtgaagtacctagtattattctatgacagttactgcattttgattggatgattttcaagttcataagagactaggaatgtgaaggctggaacaatattgccctggttattttgttctagatataactagaaacatggataagccaagtagagaatccttaagtgtggcttcctaacccttttcctacttatctgcaaggtagaaatgctgagaaactaagaaaagaataaaaattggtaaacttctcaaagccttagttttgaattcagttcaaaggttagcttaaattacctgctttgtgaataatgatcagagatatttggaattaaacaaatcacctgctgtgatcatctccagtgcttaaaaaaaaaaaatactgttttctctcagtgcttctctccatgtgagatattcgaaagtgaatgttgacaaatatcaaacttggctaattttgagactttctttaacccacaagaatagcaatttctttatgagagttttactctagttcccaatagaaaacaaaaattgctatgatatttaaatgtgtttttcctttttagggaatggcaatgctctgtgaaacgatagaagaatgttgggatcacgatgcagaagccaggttatcagctggatgtgtaggtgaaagaattactcagatgcaaagactaacaaatatcattaccacagaggacattgtaacagtggtcacgatggtgacaaatgttgactttcctcccaaagaatctagtctatgatggttgcaccatgtgtacacactgagaaacaggactctcaactggagctgcta

SEQ ID NO: 60370 - DNA, 2130 bp, Bovine  19866880730921
aaaaaaagtatacagaagaaattatgaaaagcataatttatgttgtaaaagactagaacattcttagtcaccaggggaaaaatttattcggaatataagttcctataagaaaatataacattctgtgagaaatcagactgttgccttagagtaaatttgtcatatatccatataagcagcataagaaaataaaattacgttattcacttgtattatttttttctttattaaaccaaagctgaacacggtcccagctatgttgcttgatctttctattattttgctttccatctgtgacttttttcctcttcagtgtaatagataaccctaattgtggggtcgcatttcttacagaggtcaaaattaatataattgaaaacataacagccttgaaacaattataatatttaacttagtggttcaagagtaactactattggagtcatggaaaagatagaagtggtggtataagaaacaattagcacaggaagaagagccaatagtggcccttgttaagggaaccttttcagaaaaacacaacctgttggtgttctgatacatgctacatgctaaggtggcaaattagtccatggaatattttggaatggtattcagtgaagtgccctttctttgttctagataagggataggcccaacttttccatcccatcatagatcgcttggcttcttagaatttctaactgtacatgaaacaatgaaacaagatgggaatgattttttaaaaaattcattgtatactaatcaaaaatgaatccctaaagtttgattggaaaatgaatttaagatgtttgtcagaagaataattcaaatacattatgtaattcatattattagagttcatttttagcatcatcattgctgtttctcagttgctcagtcctgtctaactctttgcaaggactgtaccatgccaggcttccctgtccttcaccatctcctggagtttgctcaaactcatgtccattgagccagtagtgcattcaaccatctccttttgtcatccccatctcctcctgcactcaagctttatcagcatcagggtcttttccagtgggtctgctctttgcctggggggccatagtgttgaagcttgagcttcagcatcagtccttccagtgatattcaaggttgatttccttttggattgactggtttgatctccttgctgtccactgtctaagggactcaagagtcttctccagcaccacagttctgaaacattgattcttcggcactcggccttctttatggtccaactctcacatctgtacatgactactggaaaagccatagctttgtctacacaaactgttgtcaacaaaataatgtctctgctttttaatactctgtctagttttattatagcttttcttccagggagcaagcatcttttaatttcatggctgtagtcactgtccacagtgattttggagcctaagaaaataaaatctgtcactgttttccacattttttccatcaatctaccatgaagtgatgggaccagatgtcataaccttagtttttttgaatgttgagttttaagccagctttttcactctcctctttcacgtttatcaagaggctcttcagtttctctttgctttctgccataaaagtggtgtcatctgcatgtctgaggttattgatgtttctcctggaaatcttgattacagcttgagcttcccccagtctgacattttgcatgatgtactctgcatacagccttgacatattcctttcccagttttgaaccagtccattttttcatgtccagctctaactgtggcttcttgacctgcatacaggtttctcaggaggctggtcaggtggtctagtattcccatctctttaagcattttccatagtttgttgtgatccacatagtcaaagcctttatcatggtcagtgaagcagaagtagatatttttctggaattcccttgctttttgtatgagccagtggatgttggcaatttgatctttttcagttcagttcagatcagtcgctcagtcgtgtccaactttttgcgaccccatgaatcgcagcacgccaggcctccctgtgcatcaccaactccccggagttcactcaaactcacatccatccagc

SEQ ID NO: 60371 - DNA, 799 bp, Bovine  19866880741230
tacttgatgcttggagaacatgcaccttttttttgtagcaggggttaaaggaccttaatcagtgaaggcaggttacaagtttaatggatctgatgattacccttagtgtcacaagtctttcagcaccatttttccaatgacatttgctcacttgctcactttgtgtcacattttagcagttctcccagtatttcaaacttcgcgttttattgtatttgttatggtgacccatgatcagtgatctctgatgttactattgccaaaagatatgactccttgaagatgattagtacttttttgcaataaaatacttgtcatatcatagatgatatgacatgatgattagcgctttttagtaatattttgtaattaaagtatgtacattaattttttaagacaatgcacacaagagactgcagtataatgtaaacaactttcgtaagcactgggaaacaaaaaaaattgtgtacctcactttttgtaggctggaactgaacctgcaatatatctgaggtctgcctgtaaagggaaagtgacttctttaaagtaggtaaattactaaaatatgtactaaactgtactatggtgaatgtcatatcttgcaacaaagagagcatatgtgctctggaatccaaccctctcagaagacgagacaaaagcacactgacaagtgattaaggcaggaaggcatgaggaggcgagatgacaaaggcatttgtgtccagctggctacgtaagccaactaactggcctgtcaagtggggaaatgagagaaaagagccattaaggactccattct

SEQ ID NO: 60372 - DNA, 1811 bp, Bovine  19866880784483
taaattacacatttttattattcttgtttttacgtctagtgtgtatatatgtgacataaattgatgtttgttctcccagaaaagaccctctaaatattctctcaagttctgattctcagtgaccaagaagaatattacataaaagccagtcatgggagcagggggttaggcatccaaggagtgaagctggaaagtgcaaagatctagggaggaagagatcaacagacaccatggttgccaggaatcagtctcaggaatactgggctatggtgctgaagttaacttgtcctaactaaacactctaaactgaacaagtaattttttgatctgttcctgactatgctacaacttgggtcccccaggaaaatgtcacaagtccaaataagaccaatgagctcaattctggtatagacccattactttcgttctgtttcacagccaaagatatcttccctctctgccgtacctcactgtcacccatgtacacattttatcagtctttatcacctcccaggttagctatatgacacagcggtcaaaatatgagttctggaatcagacgtcctgaatttaggtcctgcctccactactttacaccactgtggccttggacaagttacttttctcatctataaaaggtaactagtgaacatttgtccttatttattcttttttagggagatttctctggtggtcccacatatttttagttttttgatcattatttgtagccctacttatatttggagagtctcttcctttatgaatcttggtgcaaggcagagtctagcctcccaatatggaaagtagaaacgtgggacattcatcatcccctggggtgtagccacatactcaaatctagacagattcaaccactttgagtcacctattttcactcaaagaagcaggaatggtgggaaattattctggggctaggtagtacttctctgataagaaggcccactttctctagcaccagagatgaagggacaatggggacatcagacttggcagcatcagcagtaaattgaggcatctagagcttagtggttgtcagttctgagggacagtttatactaaggtgaaaagtagctgcttaactgaaatatactgactagaaggaaaacaagaaccagagaaagaaaagcaactgatcaaatcagtcctctatctaaaaacctctaatagctttctatccaatagaataacatgcaaatattactttgacctataaatctcttcggaatttgctcaagccaaactttcctaattcaatccatacaacttagtgtcaaaccacaacagattcctctctaggttgcaacattatcatttatattcatgtctttaccatttaaggcttctcaggtgacactagaggtaaaaaacccgactgccaacacaggagacataagagacgtgggtttgatccctgagtcaggaagatcccctggaggagagcatggcaatccactccagtattcttgcctggagaatacccatggacagaacagcctgtggagtgaggtgtggggctacagtccatagggtcacacagagtcggacacaactgaccctccaggggatcttcccaacacaggaatccaacccaagtctcttaagactcctgcattggcagtcaggttctttaccaatagcaccagctgggaagcccttaggacccttcttaaaaatcccttccttggtcagccttttctaactgctctgccaagggagaaccaattgctcccttcctgggtgttcccctagtctttgataagcacctcagttcagttcagttcagtcgctca

SEQ ID NO: 60373 - DNA, 1164 bp, Bovine  19866880793730
acatgaatttggggtgaaataccaagtcagcttaagacttcactgggtagtctatttcccctacctacttctcctacccctcaaacaagggcactgaataactagggcatgggcaccatcaactcagaacacaagaatctttacctaagatccaatccatcttcataaaccctattctaaaatgtgtgctaaaaaattttaacggaaaacacatgaatatgcctttctatttatctattacttgtttacttccgcttctgtcctctgtaaaacaacgtgatcatgttattgttccttttagtagtcagactactcaatgtcccaaagtaggaaaatagcttagagaatgatttggagatggcagggatgtttactgaattatctgaggtagctaaagcatctgctttctgaagaaagagaagcagaacaggataagcagtaagaacaaagatttagtgtcagagagtccttggttcatattccagctctgatacttgtgggcttcgctgtgtctcaatttctttatctatacaatgggcattatagcactacataaaaaaccctgtgaggtaaaatcagatcagtgctttccatacctggctggtcaccagaagtgcctggggaacttttattagaatcataatatcccaggccccattccatactttcatgggtatggtccaggggtattgttttgtttttctgaaccaattccaaagatgatccttacatactggttacaactggaaatcaggggaagttttacgtattttttaatatttttacataatgtatacattaatacacatctatgtaacttaccagtaatctagtacactataaatgtacaattaatgcttgatacaactatcaatcattttttgaaggagaaataaaactgagcattttgtgacaagagggccactaagtgtcttgcagaagtagtctgcataaacctcaccaaaaatgagatagcatgacactatattgagacagtgaaagaagacgtaaacgaagttccacattgatgacaatgctccttttccacaacgcagttcatgacagaaggaatgcatagtcaggcatgtcttgtattttccacaataaagtctgaccatcccagtcattccatctcaaaacatttttaagtttattcctattttt

SEQ ID NO: 60374 - DNA, 2178 bp, Bovine  19866880798260
ttaagttgtgaaatgagaatgtagtctaaggatcagagacattcttagactactcagaatgtagtctagagtttgataccctagactctagagcctatacccttactctctctgtgcttagtcactcagtcatgtctgactctttgtgacccttcagattgtagctggtcaggctcctctatccatgggatttcccaggcaagaatactggagcaggttgccatttccttctacaggggatcttcccaacccagggattgaactagtgtctctagtgtctcctgcactgcagggagattctttacctgcttttagagaaaagaggcaggatttaaatgataaaggactttgtacgccagtctaaagactttagattttatgctaaaggtgacaagtgaaaggttttaagcaggagtgacatattcagacatttttaaatgaggctaatctggcagctatgtggttggactgggagaggaattagtggcagggaaattagttacagtcagaaaggtactataataaattcaggtaaaagaaatggcagtggcagtgctggcacgagaactcaagtctactgaccaccacaaccactttcttgtccagtatccagaagaacctcccatttttcccccttaagtcaccatgctaatagtttaagaaatccaacctcagaaacaacaacacattcctttcaggtccctttattaaacaaaccatggacactagaagtgttgcatttgtgaaagtgactaacacaatccaattggagagcgacagaaagtctattgctatctgcagtttccttaccttcttgactttttctccttcctctatacattattcctggaactttcatgttcaatagtcgatttgaaatcaatgttttgtctagacatgactattataacctaacagaattaaatctaccacagaggaagtgtaatgtggtcccagctatggcaaaaaatatactctctggtccggtcaaattttggtttaaacaaagatgatgaatgaacagtaataagacagactttttgaaaacagcaagaaaaacagaatattaaaaaggtatgtgagtaagagcaacgtaaagttcaagccatttgatttcaagagagtaacaccagctcaagtgtgtgcggtattccagaaaccaacaaatgaaaagaacagtagaaaagactatctggtcaattctcgagcattctaaatctgatctgttttcatttaaaccaagcagagccctcttgagccacccttgatactaagtaactgagtaggttccacaagtaagcagcctacagtagaggagcaacagagaagataagcaagagtggaaaggagaaagggactcacatgaaagggaaggaagaaatgataagttacaaaatatggaataaaactgaggaacactagtaacctcaatatcaaacgctgccaaccttacctgactgagtggcaccatgacaatggcaacattagggagcatgaaaaaacaaatttgagtcacaggtttacaacatgccaaagatgagaaatgagagtaatgacaaaagtaaaaaagcgatgaaagaattttagcatctaaagagacaatttaaagattactaaaatctcatttggtttagttatgctttacttctcatgaaacaatgagtccaatggacacaaaagatgaaaatgtcagctagtaccagagatatgtctagggaggtgtgttacaaagaaaagtatgagatttatttgcatgttttgtgagagcaacttcagaatttttcctctctatggtgtatagcgctatttaccttaagtacttcactgtaattcttatcctggctggctaacttccttaaaaccagagttcaaaacaaaataagcacttattaattatggtcaaatgttaacctcaaaaaggacaagggtctgcaatagatcatagaatattacttagtagtatagcctaaacgagtctaatggtaaccaaaatccagataacagattcttaagaaaattatgtaattaagaaatcactttaaaagttttttaaaattaaaaatttgctagataaaggaaatattctttcaaaaaaaaaaaaaaaaaaactcaaggtgtaaattcagtttttccattcaggggaagatgtaatagtgaaaatatttcttccatatgaca

SEQ ID NO: 60375 - DNA, 918 bp, Bovine  19866880807640
cacactgtgttctaattccaaaagattttaatctcctcaggagcaaaaactctggcaggacacccccaatataagcctcatgctcaccacataatagctacctaataattacttcttgaatgaaacagtctctgcctccaccaaaactttcaatgttaacaagctgttatttgccaagtgcacaccaaagaaaaggtaggaaaagtaaattttttgtaacctgtgacactaaatttttactttcatgtaatttgaatttaacaaaatcatctaaataacccatctggttgattaaaatgtaatttttacctgaaaatacgaataggagtttagggtttaaaataactctgtatactatttgaattgttctctctgatggaattctatctacagtttaatcacagtgtttattgatgtttccataaatgtatctgcactgaagcacagtttattttccagaccgcagagctctaatttcagctaccccagagaatacccatcattttcatccaattccttgacttcataggaggtcttcctttcttctcaatgggacaaatgaaccatttcccatcatttaagctcacagaggctgctgtagtggaagccctctgcaccggagagaacaattcattaagcactcaacaatactacactaagtgccaggaggagaaattaaggacctagataaagaccctgttgttgaggaacctccatttttgggtgtaagcagacagcaacttgggagaaactgctgtcagcaaccctgcattctgctccatctctccacctcttgctggcttgctttttctttcccttttctgctttcctaaactttttgtcccctctctctttttcctttctgagaattccttcacgcttgcccttggatttaggcctgatatcgacaatcccaat

SEQ ID NO: 60376 - DNA, 902 bp, Bovine  19866880851108
tttttaatctttataagtgacatcgtttctagtaccttagtaaaatgagttcttagtcgaatgatttcttagaaacaaaaagtactatcttagttctgtcacagtttttaatatataaatttaaaagcatgttagagatttcctgaatttcctttgctcttatataccttttagaataatactttttcaccggttaaaaaaaggaggggatcccctgctgggtacagtattttgtgaaggtaaatagatttctgatggtcagtcaattctgatctctttcacattcattcttaattttctgttttagtaataattatattaccattcattttaactgactagctctgtgataaatattatcaatctcagtcagtccttaaagtggtcctataaacattgtaacagtgtctccatgttataaatgaggaaacctattagaataaaacaaacaaaaaacctattggcagcaaaatattccatcatggtaaattcatgacactttataattaaagacagtaaagaatttttatcagtcagtaagtactctgataaacagtaaaattgtggctccagtagcttgttgatagggtaatggaaattttctcaaaatttataaggacagaaaaataagctaaaaaaatctagttctttataaggaacgtagatgcagaccagtgtacaacttggaaataaaatatacataaagtcagtcttatcatcatacagcaaaaataacacttagaccttctagatattgaacttcctttgtcttgcatagaattaaatttagcattttgtctcatgaagtttggaggtttcaacaatttgtgatccagtgaatatttactataaaaatttttgtataactgttgataaggaaaacctataaacaaaacagttta

SEQ ID NO: 60377 - DNA, 701 bp, Bovine  19866880864637
agaaagggagaaaagaggagccggtgagggagtagaagtgcttttttatagagagattagggaaggaccctctgagatggtattatctgaatcaaggatggatttgtacaaaactcaatggagtaaaaagtaaaaagtgtttgtgaactcaggtcacaggacacctaagagagacagttcatcagaattccacatgaactccagcagtgcccttggccgtactatttttttttttaatttaaaaaaaccacattggcctttattcagtgattcatgcatcaggcagcatccagtctagcagacagaagttccaaggagctgcattaaatgtatatttagaaaagacctttgagcgctcatagggtctcattaacagaaagctacactaccctggtgaaactctgctgcagagttctataggcttgctaacaacacgaacgtgtgataatagggaccgctgaacaatcccagtttggatgctgattttgtttatcattgtacctagtcccagtgacgacaggaacaaacaaggcaattatccaactctagggaaaaacaagtcatgaagctcagtccacacagtgcactatagtcattctttttgacaggctgtcacagtatgttaaataaaacctctcatctacacatctgaggatgagaagtagtaacatggcattagaagtttcagcaagaatagaatt

SEQ ID NO: 60378 - DNA, 1832 bp, Bovine  19866881111755
gattttccggcaagagtactggagtgggttgtcataagccctacctgttttcaaccagctaaggggcccatcttcccagagttgctccccagggaagatctccaagcctgcgatcctgcctttctcttctgtgtgtggttcccaatagcttttcctccattcctaccagattctatgtggacagttttagttgtagaaaagtcgttatgccagtctccacgtcattttcagtgagagctattcaacatgcagttgtcagtgtcctcgtatactaccatcttgatctctcatgtgttaaattttttttaatctgcgtactttccctacagattaggttttagaatccaagattcttgacatttaggtctgatccaagtttgttctggtctacatgaagtgagtttcttaaattctgaactgatagtccagagcaatgtgcaattctcacttccctcttatttctcgtactattcacagatgtgtacctggcttctttttttaattaataaagataaggataatgtgtgacaatataggcaatgaacatgagaagtggcaattatctccattaataactagaaatgtgattatatgaacatctattgcttaatcaagtagcttttagagtgtccattagtaaaaatgtttattattaaatgtcagtggggaagagaaaatagtagaagagactcgacaaggagggcctctggactagaagattgaattttgactaattattcatttcatggactcatggagctttttcttcctcttttaagctcatttttcctgacttgaccagctagtatgaatatggtatgcagatttgacatccagaaagtctctctgtacctcttgatttccatgatatattcatgtaatttcatgccccatatctccatatttattctctcttccaaaagtagtcatttcaccctctaataactgcttaagtttgtcaaaggaaaaacattgtactaattaccttaaactaatacaaggagtttataaatattttaaatatcttgttgaagaatgaactcacaaactcctaaaattttggtctgttcattcaacaaataatgttgaattatttttatactttaatgtagatgctgttgaaatttttcgtattaaagaacaaaacttttatgcctctattactttggaagattattcacagttaaatatcatcttctttgtcataaaattataattggtttcaccagttttccctaaaaaatcaagtgtgacatacaaacagctgttgtaacagctacttcattgagttgttataaggattaaatgaagtaatatatataaagatttaattcaattcttggcatatataaaaaagtgaaagtgttagtcgcttagtcgtgtgcaactctttataatcccgtggactgtagcctctgtccatggatttcccagggaagaacactggagtgggttcccattcccttctccaggggatcttcctacccagggaccgaacccaggtcttccacattgcaggcagattctttaccatccaagccattagggaagccttaaaatattcaataaatactagctatttttgttattaaagataatagaacccagattctctgaaggtttttcactgaaatattttccttttttttttagacatttagacttttatgtagtcaattttaaacccataagataataaaaatgcataacaaatatctttttaaaacttatcttcatacttttatacaaatacaaaagaaatagtaaagataaagctatttaacacattgcacaaagcgtaatattgtcagatagctgggcagtatgtgata

SEQ ID NO: 60379 - DNA, 1339 bp, Bovine  19866881120360
ttcccagtgcaggagcatgaattgatgaatgaattcagacccattccaaaacttgggagtgaaagagtcatttgtatattttagacaagccatgctggctgcaacatggagaatgtagataagtgggtatattcagggtgggggaagtgggtagacaggagttagagagaccagtctggaagttcctgtgttagtccaggtgaacagtatgaaggactgaagtaaggcagtggtatttgtcatgaagaaagaggagatagatttgagaagtgttttggagatgaaaaatggccaaacatgatcaaattacatctgtgtctctcttcagattcttggctataaaggggatgctaaaggatgctggaactggaagtggtccagaatgagagggagcaggatgatgttgcctgagtgccttctgagaccagtgcttttccatttcagcatttccctggattaaaactgctaaagcattcatgtgccccttgtgtagcgcaaaagcattgtcttgctgtagatcccccatgactacaatgagttggatgtatttttggcaccagctagatgttcaataatagttttaatgatagtttctacagcaattgggtttaccctggaggctgcccatctctctaatgactagggccaagccaacttattttataagatctggcaaaattacagtgtgaactggtaatgccgtgggctgttatacaaattataccagctctgtctctgaggaacttatccaagcctctggagacttcaagaatactaacttcaaaggaagtacgtgctattacaaatactacaaaccaggtatctagcaaaatgagaagcagacccacagtgcctaacttgtagaagtgtttgatctacttgaaatttctgaaaataaatttgggctgttgaaattgacattttgtagagtgtcacaaattttttttttttcaacatggtttgggaaagttctttttagcttgggaaaatttattattttagccaaggaaagaattgtgtggcctcaaatctataaactttctatccaagagagattatgaaattattttggatgattgagacagaggtcgttccaaagaaaaggtttatcacatgggtgatttaaaacactactaaaattgcctttctaagcaatgacctagaaatctgacaatgtgataatgaattctcaaacaaataaaacaaacaaacacaaaaatcacactggaacatttcacaattggcaggacaaaactggcaacagctgacttctggaaaagtgaattggatcttatagcattaaaatgagtttgcagactataacatgaagtcaacactt

SEQ ID NO: 60380 - DNA, 1380 bp, Bovine  19866881213315
caaaataatatcatggctatgcattgtacttttttttctttactatttcatttatcaaaatatactgattgagggtatatgaaattgattttacagcctttaaatagctctaaacattgtcttaaaatattcatgaggtagttaagtccgtatcgagcatctagtatgtgctcagcactgtttagcactgaagataaaatagtatacagtggaaggacacaaagttaactgttaataacctagaaactacttgctctgctcattaaacaaaatggggcgaactcccagttcgaatattgacagttggagcatattaactgttattctagcatacagagggaacagaaatcctaccaaccaagagaattaacctcttctctcagcatttgtttccttacaataactattaagaaaaatgtgataaaaagcatttgtaaaacaaaaaccattgttacttgagaaactgaaaaatctcaagctttttttttttcatttcaacagcttttagagtaatcctatgtgttaatagaggaaccagaaatgatcagtaataaaacacacaattttgtctgaccccataagaatggcctccttgatccagtcatcatcactctgacctcatactccaaggtacaggctacattccttccttccactggtcttgcctcttccctaagaggttggccctattgactgcagagagtattttctcagatactgccaccagttcctccccactcttactcctaagttgttttggttttcggtgaagaacaaatagacactagttcctagggcttcctgtctacttctggtaaaggaatgctgagtgtttatatcaacatccaaggtacaagacagagactggtatatctttgtaaatacatgttaccatgtcattactaaggcttgggaaactaatgttggaagatctagactgctcataaaagttatctttcaattttttaaatcaatcctttaaataggagaatttttttctcttttcatgggattgaaaagtatatttactagactcaccagggcatgatattttcttctgtctctagaagcattcatttttaaggattatcattgatcctgtttgcaattgaaatacacttgccaaagcaaatgataaaggtcagatagtgaaggagtaccttctatatgatttatttcttaggttcttgaattttgtggctaaaaaatcagtatttgggcttatcaatttagaaaaagttttatagcatgaagttatatgtaccaaaattgggactgtaggccgaactggtgttatggcatttttaaattatttttaattgaaagataattgctttacgatattgggggtgggtttctgccatacatcaacatgagtca

SEQ ID NO: 60381 - DNA, 1436 bp, Bovine  19866881359865
ctacctgatattaataacctgtaagaattaatggagacatccagatattcttacaatagacatatttcttcagttagtctatatcttatcaaagcttaatagcctgaaacctaatagatatattggtaaattgtcagataaaagcaaatatttacaaatcattattctgaaaacagataagttaatattcatttgtcttaggttttacatgtgttcaaaggatatagataacagtatgtattctctaaaagattatttctgttgaccttttatgtatctaatttttttcagttctctgatgtattgaactattgaaaaacaaatagaacatttaacagttttttactataagcctcccttagtctgatatatatgttatataaatttctgtttagtttttgctcacaaagtagaaatttcttcgttggttttcttctgaatataaaaaaatattgcaaatatctattctagtaatatggacaaaattttatattacaatggttttctggttttctgaaaaacatgatgtataacattttattattaccatagctatttctgtaataagagcaatgtaggcagtacatagtaacatagcataattccaaactccaaatctctgttatgggatttgattagtttttattaagaaaatcaactggggaactgccaaataggattatttccctttttttatattttagaccagtgattttcagtatgttgcatttagacttccacttggaagtggaaatccttgttaaaaaatgcagatgcctaaatgctaccctaatagtttctcagtcagagtactgtcgaatctggcctgcacatctgcattttaacaagtatcactgatgattcttaagcactctatagttctggaaccactaatgtacaccatagcctgagaactgaaaaaacttttgttctctgctttttttgatatgtttcatcttccaaattactactttgttactgacgtataattaatatataatactatattaatttcgggtatacagcattactcagtatttgtttatattgcaaaattgtcattttgataatagccattctgacaggtatgaggtgatttctcattgtgcttttgatttgcatttctttgatgacagagatgttgaacatcttttcaagttactgcttaatggtgtcatattatatttgcattacagcacttttataccttggtttaaatcagacagcatcttaaaccaagggaaagtagcctcagctctggctctgagctaaatggtcttcgctatactagtttacccgaggaatttctcttcatcctttacagccaatggctgcccgtttgtcaggtctagagtataggtagcattcgtaaaaatctgtccctttctttctcattacaatgagtgtaggaagtactatctattgatttatttaaa

SEQ ID NO: 60382 - DNA, 1113 bp, Bovine  19866881394808
tactgttacgacatcatcacaactaactttagctactaatgtcaataatgatgacaatgatagctccttttatttgtatacttttacatgttgcaagcctttcacttacctgtctttgatgctcacaacgatcatgccagtgaatttccttagaaaatttcaaaggtaggaaactttcatatacaggaagatgtccattcccatgttatatataataatgaaaaaatcaaaatatgaatgccaaactttatcaggtagttcaataaatatgatcagtctacatgctacatggttaaaagtattcatatagagtctatatatcaaaaaggaaaaacccttgtgttattctgatagaaaataagaaaaatatatcattgtatttgtacttctattacaactatggaaacatttctgtgtatttggacaaggcctcagtggtaacatagtcatatataaagtttgttgtgatggcatagcacagcagtaaaatgtttgaattattttagattttcagtaacactgtattgttcattataacatatacatgtctaatactttaataaatgtatgtgcttataataactaatatttgctaaatgtatatattattataaaacaatgcatttctttagggtaagacattttccaaaagatgcttgtaggttccttttcaacagaatgtgattctcaccctccccacacccaccttgtacatctggatcaccaggggtgatttcaaagaatactactgcccaggctgtaccccaagagatgagttctgtgctgatcttggttaggacccagacattggttggtttgttggcttgtttgttttgtgcagcttggattggtaacaactaaaacaattatgatacacaactctaattttattattaaattccttgaattttcatctttagcatacataagattttcacaattaagaataccattggatgaagactggttaaggaatcatgagtataaagtatctttatgctattagaatgacaaagatttaaaaataatgataaacacagtgttgatgagaaaaatgagcactaccgacattgtttatagaaatataaatggaatgcatattgatcagctaca

SEQ ID NO: 60383 - DNA, 1264 bp, Bovine  19866881473313
tggggtttcctctctttgtttcgcctagaaattatctctagggagtaaaaggggatgttggaggtagaactcatctggattatttacctttattcagggatcactgtacttgcttctctggctcagtgtctgaaaactattgtttcatatgtttagtccagtttttaaaaattatttgaggcaggcaggtaaatctggcctctgatagtccaacatgaccagaagtggaagcttatggtagactttcataaaagcaaagaggcagtgccatatgttgtattcaaaacaaaatcccattttctttctacatctatgctgctagatatacattgtcttcagaatcaaactggcattggtgctgagctctaaaccacaaggtatgcatttatcagaacaacctatgacctcttctatgttgcttctcttctaatctctctctccatttgggattctcttgagaatctacattttggggcttcagttattccatttttaaactttttaccctcttgtattctattacttgctcagttaatttggaccttttttatttgcgtttacccttttctgcaggtaggtcctgaagtttaactatggctcaataattcataagtctattttttggttacaatgcaatttaatggtatatttatattgctgtatttattagctttgaaattcctaaaagaggtatccattttctgccctcagggtatgctcacatttaaaaaaaaattaatttattttttattgaaggataatggctgttttaggaggccttacaaatagctgtgaaaagaagagaagcagaaagcaaaggaggaaaggaaagatattcccatttgaatgcagagttccaaagaatagcaaggagagataagaaagccttcctcagtgatcaatgcaaagaaatagaggaaagcaacagaatgggaaagactagagatctctcaaataaaattagagataccaagggaacatttcatgcaaagatgggctcaataaaggacagaaatgatatggacctaacagaagcagaagatattaagaagaggtggcaagaatacacaaaagaactgtacaaaaaagatcttcacgaccaagataatcatgatggtgtggtcattcacctagagccagacatcctggaatgtgaagtcaagtgggcttcaggaagcatcactacgaccaaagctagtggaggtgatggaattccagttgagctatttcaaatcctgaaagatgatgctgtgaaagtgctgca

SEQ ID NO: 60384 - DNA, 962 bp, Bovine  19866881581491
tctttggggtgtacctctggtgaacctcacaattactctcctgatataccctgcaaaactgaatgcccccaaatactcttttcacccaataatttaactaaattttcatgacccatcctttttttttacatacatttctaaatataatgattttcataagtttagtatcaactatcaaaattaatattttatttgccaattaagtaagaaatattttattgattggctataataatttaaaattcacacatgcacagtcctatgtgtaaggcactgtactggagaggacagaatatggaatataaaacacatccaagggatttaggagaaatgagatgtgtggaccctgaaagatgcttaacaatacaaaaacaggtagttctttcttcttaaatgaattaagtcagacattatattaattacaagtgagtgttctagtaggcagtcaaaggaacgagtcaaatggagtaatgcaccatcaaagtttcgttgggactaaactgctggtccctgacaccaggtttgcattaaaatcacctggtgagtttaaaataatactgatgtctgggccccaccccagaccaattaaattagaagctctgaaaggagcccaggcatagacttttaaaaggctctctaggtaattctaatatgcagccaaagttgaaaaccactaggcaagactttgaagaattcagctggacagaaaagtagtagggataatataaaggttaggggaggccttacaggtaactagaaaggtgtgtttgggaaaaaagtgaggcaatccagagtggatgggtaaaggattctggtaagagagcaggggagaacagcatgagggaggaagtctggatcaatatacagagaactttaaagtctagaaccatagtttgggtatttcttctttagccacagccttttaggtctaatctctcctccatattaggatttttcatatt

SEQ ID NO: 60385 - DNA, 643 bp, Bovine  19866881645298
cttcatctaaagccatgaagctgatttccctagtgtggaaggaaagatttgtgaaattcaagcatacttggtggaatttaaacacatttttatgtactttgggtcacaatcaattcaattcaacaatcagtgaatgagttcctactaattgggagcttgaactactcagcaattatccttgggaaaacagtaaacaagagcataatttattaatttgttatttattctcccagttatataattagataactgttgcagacttctattgttgtgtatctataggatacaaatgtgtatagatatattttattagattttattttaagccatacatagaggttatctattctaagtgtccttccagctctcatttctccattttacaaattaaaatattgtaaaagaataaaggacttgccaaatatagccaacggatgatttgatgacagaacttttaatcctcctaggaaagtgctgcttctggggtccctcagaattttacataatgcactgagttttataggctttgttaattccatccattttacatgaaaaaaaattaaatatttacatatatcaggttatatatatatatatcaggtaaagatatttctttgtatatgtataataaagaataaaatat

SEQ ID NO: 60386 - DNA, 544 bp, Bovine  19866881655624
actgatgaaagcctaatttctgagccccgcctatttgctgaatccaaaatctctgttacactcttgataattgctctacataattccagtttcaaatggcatgaaatctgtccaagcaataaacagctttacacaatgaaaccttcctcaaacattctcctaagtacagtataaaggaactattttgtacaccacatgtgctgagcttgacaatacataataaaccatcaagatttcacgtgcaaaggtaacacaaacccaatataaatacccagaggccaaaacttgctgggcataagtctcatacagagcataccacacaatgttttcatattatttatatttatatgcttaccactgggcaatttctgctggaaattcatgggagcagtatatgcttagtttgtttgatctattctgcttgatgagagaatgaagactctaattagaagttgaattttgaataacttttcttgaataaaggtaaaataacttcaaaagatgaaaccatcatcttccaaagaggaaatgtttcaagatcaag

SEQ ID NO: 60387 - DNA, 1290 bp, Bovine  19866881677488
aacctagatggagtattcactccatcttatcacttcattctccagtgccatttttgttaaaagagcaaactttagggctacatatatgcactctagaacactaacaatgttaaatcaaaatttaattaaagtaaaacagaaatttatatttctcaatcaaatcactgtggtttaagaaaactaacagaaaacatatataaatatttaaccttggtaaaggaaaaactacccccagtgagacccaagtgatctagttttcaggagatgaaaatttagaatgataaaacttcagtgttaaataaatctgatacatttaaaatacaagagcctgtcatggaaagtaatgatctattgtcagggacaatcaagagccattttattcagttttttttacaacaactaattcaggtgggtcctgaaactctaaagttatatattatgtcatatgctaaatctaaaagcattcaacttaccattcaatcaaacctttagttgatatacaggccaaatccccagaaaaaaaaaagtgagtaagccaaaattaatcacaataaaaggaacaagtatttttctttatgctgtataacacagatactttgaaaaacatttttttagacatagagaaaccacattgataatttctaaaataaaaattttacctataaaaataaaagtacgcattttggcccatatattttctaaatgcttattccctggtaaaacaggaatctgcattgcatctaaaaatatattatcctgagggatgacactttgtgagacggtatgacttagtaaacttatttttaactaaatgatgattcattttcactatgcaggtttcaggtaactacaatacatgtatacatagtcccattcttgggtatctgactttcagtagatctcaagacattgcatctattataataataagtgctagtattatattggatagtatgagcagggcagaacctatgtttgaattagcatactgaattctctagatgcatataataactaaagcaaagtgaacagatatgtacatttagccataatatcctccagaagataatacggatcatgtaagacattttgtaaacatgcactatccagaaagcttaaattattttcttcatataatctttccaatttactatttgattgcactatgatcagtatgcaaaggcaaacttaatgattacaaatctcagtgttaaccatttattccattttcaattagaaagagctatccgacatagtatctacaatgaaaaatttgtaggacataaacaa

SEQ ID NO: 60388 - DNA, 1506 bp, Bovine  19866881844394
ctaaagggacatttatataattaattcacatttggagccaaaagaagccctgtattgattccaaaggacaacatctctcaacgcacacagaatagtgagttgtcatttctttgtttcaataaccaaatgtggttatggccagcttagtactaagatttgggtgatagctgcagctgtctagaaactatctctaaaaggtaggtgccaatatcccagcaagcactttaagaagacttcaagttgtatttatctgatctaagattgaatgatatatataggggaaagaatgttggcaggaatttagcagtcagaagtctgtgtttccttgcaaaagacagttggacaattcctttaaagagagcaagctattactcaaaactcaaacatttgcttctccatttaccagtgaaaattgtatcctattgtcagatacaatgtgtgttattattaaaaattacatgtccctcctaaatagctgagttcacctacatatttgagttaacatatcgaccaaagagaacagggttggccacaaaatcaatgaaagtcaaataaaaggccaaactaaacagatgagacaccatgccctaaagatcaacagaggagatcattgttaggtaagaagggtttagtcaattcagcaaggagaatttgccatgcccatcacaaagcaactcatttaaactacttaaacacaaattctactgcaagacttgtgggcagttagttgaatacaactgggtttttttctttaccatattgtattaaactacattgaatcttatgtggatatcctagagatatctttgaaatttttggtaataacaatggtggcaacaaatcagtagctttatattagttaactttttcaactatctaattgaaaaaattaattaatttcaatatttaaatttatatttaattgtgagatgtgatatttaaatgtaagatgtaatgataattatgaagtaatgaactatttgttttaaagcaatccttattccagtatattcttcctaaaatgattctacagcttttgaatactgggcattatctggactggtctagagtatcaaagacatgcccggaaaatcccatggatggaggagcctggtaggctgcagtccatggggtcgctaagagccagacacgactgagcgacttcactttcactttccactttccactttcatgcattggagaaggaaatggcaacccactccagtgttcttgcctggagaatcccatggacggagaagcctagtaggctgcagtccatggtgtcacacagagtcggacatgactgaagcgacttagtagtagtagtggtagagtatcaaagagtccacaccttgtccatatttgtccttcctgagatttgtcagaaagaacttctatccactaaactgaaaagcacaatttctttttctctgtagcatccattaggattcattctgctaaatattataattaaataccggaaaacccaagagactcaaccaaaaa

SEQ ID NO: 60389 - DNA, 1292 bp, Bovine  19866880485041
ggccagaatactggagtgggtagcctttcccttctccaaaggatcatcccaacccagggatagaacccaggtctcctgcattgcaggcagattcttcaccaactgagctatcagggaagcccttatctagagcgttgagaacctgcactgaactttgaacttcttgatggtttccctagggctctgccattccggctgctggaatgccctttccctggtaaaacctcactgacccttttgtgaaacttcattgctgttccaggctggtaatcttttcagctgacagcctgctcccctgtgatcccaaagcattttgttcatcactctgagagcccttgccagagtatagcctccctagcgatccacctgtttggctctcaccagtgagctcctctaggcgcccacggatacttgtgatgaatgaatgactcccactggcggggagcatccttcctgcggtctaacccgagtcgctcctgctgcagcgcgcgccgcggggagggtgagagagtgacagctggccaagtgcgcgccgcgagtccgagcggaggccggtaggagccgcggccgagcccccccggcgccgccgccctgccggcgaccccggctcccgccgccgctggcgcctcttcgccccggttaccgctagtggctgctgtcgctcagtggagcccaaggagaccgcggccagagcgtccaccgagcaagatggtggctcccgagtctccgtgagtcccggtgggcggggcgccccctcccggagcctccgggcagggggcggcgacgggggctggaggccctgcgggcgagttggcaccgggcgggcggcacccatcggagggctcctccaccgcgcgccccccagaggaagttccctacccctcggcaacccggcccggggaggttgggcaagggtgtgcagagagccccgacctcacctggctgcctgcggggtgggagaggggacacccggcccctaccctgcctgaagcgggaactctttctagtgggatcccgaaaggaagggacccaaagaagcctaagcaggggactggggccccccatgctagagccagatgaacactcagtttgaggctttcgtacaaggatggagtggggtccgccggccaacacgtcatcaccccatgggcccccatccagctggccagggtgtggagaggggtgaggccacctgggtctgcaacaggtacaccctcctggttagccttggtcacatagtcagtcttatttacatcctgccccacccagcccggttccctcaggaagcaggc

SEQ ID NO: 60390 - DNA, 1061 bp, Bovine  19866880534916
ccgaaggtcaggccaggattctttgggctgttgcttggccattgctgggagagggagaaagggtagccccggcccttggactagaggccagggaggcccccttcccctctgacagcgctcctgagcacagccctgggcttctgtcctcagccacccgctggcactcgggggtgccagccctgggccaggcagtggcctaagcagttgtacagggagccctgggaaacagggcctcccccagccagcggtgagccccctgcccacagcccctgctcctgcacccctggctcaagccggctcagctcctggtgggcaaacagagcgagggagccttctcagggacaactcaggcccgcttctgacagatggggaaactgaggtccaagagaggtggtgacttgacccagagtcctgagaccctctcccagggctggcccgagtgctgggtggtacagagtcagtcctgggcatcaggacatgccagtgtctgcggtgctgctcccatctgagcagcaggggagcctgccctgcccccagctggctccacctggctggcgtgtcccagagccagcagaaagctagggcgcgggcaagtctgaattggcccaggtggctgcaagtcccagcgggccctccctgcccgcaggcgctgggagcagggcctgagctccacaccccaaatcctctgccttccctccccacccacgcgttcagcctggggcccaaacgtggcatggagccagcccagcctccctccttggtaaccgaggcacaacacccaacaatagagactctttgtcctgccaaggccgcaccccaacctgggcctgcatgcctggctggggagaagcctgtgggggggaaggtgggaagacaggcagggggagggggcagcagggcccctgagcctggagacccttccctcccttctcaagttcaggggagccagggctgttgcccagcagccttggatggtgtggccccagccccttagacttggtagcaagcagaacgcggaaacgggccaggtggatcacagcaaaaagtgttattttcagtca

SEQ ID NO: 60391 - DNA, 1409 bp, Bovine  19866880535490
ctccgactggccgctaagttctgagcctcgagcacaacagcagttgctcactcggatgcagcgggtcggtagcagtctccctagcgggagccagtcggcctcccaatgtcccagcgtggcctttactgaacggaaccaggtggccactctaccggtgcagcggctcacggaggatgcagcagctgtgcgggacaacgtccacacggaggatggcttccagatgaaactgtatgcccatggcttcacccccgaggagctgttggttcaggtgaacagcgggtgcctggtggtgactggccagcgacaactggagggctgcaacccggatgggaccggcttccgcgtggcgcagaaggtgcaccagcaaatgtcactaccaccggacctggaccccgctgccatgacttgctgcctgaccccctccggccagctgtgtgtccgtggccagtgccgggcactgcctccctctgaggctcaaacaggacccgcctcaagattcagaagccgtggctctaagaaactagcctgacccagtaaacaaccaccgtagtgagcaacagcttcagtgtccgtggtcttttcttggggctgggatcagaggtggaagtagaacaaaggtagaaggccaaggggagggcccagaggggcaggaaaggcacctcaaggtggtggtctatcataaatcgggcccagggggaagctagaggggccgtgggcagtattgtttcactcagctcggctcactgcttggaccagcagctccagcagggagcagcagagagccgaaagggccccaccatcactgaactccgggaccagcagagggccccgggagagaccggggaccaggtgacttggatctggtgtggagctgctgctgtcttggccttaggactagccaagtttccaaaggtcttaggtgttccttcttcttcagggaaaagggtgagaggaccccattccctcaccagcctagtacagactagtcaagagaccccaaagaggctgtttctgatgtttagagaccaactattttcaaatacagactgcagatgccccaataaaatctggagggtgttggggagaggcaaatactggaccctcaactttcatcttggtgagattcagcctcagctcactcttacccacaccacccagttagagctggcctctctctcttggttaccatgaccaccaacatcccctcactttagatggggaagaacgcttttgtttaagatttagaggttcatgtgaagttaacttcaagtaagctggagaggctatggcctgataaactctgccagagaagaaaaggaagacaagcgggaggtcgatcgatcggcgactatattgacaagatacgattggttacatgttaagaaaacatacaatacaaaatacagaaa

SEQ ID NO: 60392 - DNA, 586 bp, Bovine  19866880651546
ttgtggtggtggtgatggtagtgatgatggtataaggattgtttggtttccagggaagctcttcacaccttcccaagcataattatctcctttacccagcatttcttcccaaaccacttcacacattcacacacagacacacacacagacacacaatgtctcatcaaagctaatattttaattatagatgacaaggcattgtatatgaacttaagaaacacaggtcagtcaccttgaggccccactgactcatttcatgtcaccagaagaatccttccaccactgaatgactcacctcctctccatctccttacatgggaagaacaatgcttccctcctctctcatggtgcaagagtaagtggctttattttgttaaatggctttgaacttgttggatgaaaggagctatataagtacaaaggagaagcaaaggtgtttgggctggggagctaaattaagactgattgagattgctctttcttattgggacccactcttggatatgtgtctcagggatgcatcgcctgtgcccacacagctctacacttgggaaaagagcagaggcacaggggaggggagggggag

SEQ ID NO: 60393 - DNA, 1411 bp, Bovine  19866880652365
tcgtaccccagcgagcactagttgggcccgaggtgactgtgtgtgtctccatgattgacctggtggcccttcggttaccccagaagtggaaggtgatagagaaagaagggtgaggggttttgtctcatgctgtacacgtcaagccctctccctccacccttccgaagatcctcattctacccagggctgttttttaagttaagcagcaaggaggagggcagctgcttgggctgttggcgctgctgggcagccgcagtggctcgagattgccagtccggaccagccaagggagctgctgagtgagtggttttcgagaacactctggattttggctacagctaaggcaggttattggaagtggggctggaacacagttgtgggtagtcatacttgtcctaaacatggagcagaattaacaaaaagcttctggaagtttggagccctctctttatcaaccacgagttaattgactacagttccacagtttctttcccacatatttcgtatctttataccaaggccattctggcttcagtctgggtggtttgaggtggtggttgtggttagttcatgaaatctgaaatcaggattctgagattttttttttttctttttaactatccatatttgaaacataagtactcaaggaggcagaatgaatggttaactagcttaagggtgggtactgcagccagttgtctcaagttcctgacttgttgggagctgagaaccttgacaaaatgtggtttgcaggttagtaggtccctgggatgggctatatgtaatttaaaatgaattcagtataaatttctgatgtaggcactgtccctaatttgagtttcatgtcaaagcccctatgtgaagcaaatctttttccttaaaaaaaatttcagccttagaggatattctatcatgctgctgctgctaagtcactttagtcatgtctgactctgtgcgaccccatagacggcagcccaccaggctcccctgtccctgggattctccaggcaagaacactagagtgggttgccatttccttctccattgcatgaaagtgaaaagtgaaagtgaagtcactcagtcgtgtctgacgcttagcgaccccatggactgcagcctaccagactcctccgtccatgggattttccaggcaagagtactggagtggggtgccattgccatctccatattctgtcataagaaaaggtaaaacaggtgatgctgtaatgtgaccaggtgatagcacctgcctgcccagtctgaccccacagactatagcccaccaggctcctctgtccatggaattttccaggcaagaatactggagtgggttgccatttcctcctccaggcaatcttccgacccagggatcgaagctgcatctcctgcctggcaggcagattctttacca

SEQ ID NO: 60394 - DNA, 1301 bp, Bovine  19866880684612
gtcgtgtctgactctgctgtagactgtagcccgccaggcacaggcaagaatactggagtgggtagccattcccttctccgggggatcttcccgacccagggatcaaacctgggtctcctgaattgcaggcagactctactgcctaagccaccaggtcagtggatctcaaacttttttccatcagaatcacccactaggtttagaaaataggcctgaccaactgcatctagaatctctaggggtggagtctagaaatcagtgtttttaaaataagtctctttgggactttctgagcggtccagtggttaagaatctgccttccaatgcaagagactcgggttccatccctgatcgaggaatcccacatatcacagggcaattaagcctgcactctgcagctactgaggtccatacactccagagcctgtgcaccaccatgaaagctccagcatgatgcaactgagacctggagcagccaaaaaaattaattaattaaaaaaacaaaaaacataacaacaaaaaataaaataagtttcccagtaattccctggcagtccagtggttaggattcagcgctttcactgctaagagcctaggttcaatccctggtcagcgaactaagatcccacaagctgtgaagcatggccaaaaacccaaaataataaaataaaaataagttccctaagtgattctaggtggctgatttaagcccaagagttgcagctgacacaggaaggagggaggaaaatgagagacagaaaggcgcccccagatgggtactgtggacagtacaggtggagcaagctgggggtggggactggctcttggctttacccaacacctgaagccttctccaagataccacatgctgctggaatgtcacccctccccccaagcatccatacccttctctaatccatgaagtcacccacttgatatgctctgtccttcctggtaaagagtgagcaattccagctggtgggtgtctctcgaacttcctgtttgcttcagaaacttcctctagctgagagtcccggcacagcgtggatagtgagcagattagggaaaccagatttcgttttggccagaggctgggctgagactctagacttgcttactcaaggttagccttgggggttgggggggtgctggccagtgactcttcagctatactttactctggataagagcattcctgaatatttaacacggtgagaattgggcaagaggacagcagaagcaacctgttagcttaaagagaatgagcaaatcagggaaggtaggagagttaattaggttca

SEQ ID NO: 60395 - DNA, 2445 bp, Bovine  19866880707678
agaaaaggctggcgaattagacctggttgcggcccattagaatgtcaccatccagaggagctagacatctaaacccaataacagtctagcatgtaagatctattacagaggtgccgtgggagcacagccaaggggtgtttaacttggggacagtgggcatcacgttatccatggaatcttcctggaggaggtcaggtctgtgttgaggtttgaagcgggtggaaggaaagggtgaagaaaatatggcaacatccatggcatttactggaactacacgtatttgggttcagtattgatagtagaaaggagccaaacaatctaagacctgtgtgtttggccaaagagttcaaaccctatcctactctattctaacagcagtggaaagccattgataggatttatgccagtgaagtgacataatcagtttttgcttttaagcagttcactctggcaaagagtgaagattggagagaggtgagacttggggttagttaggagagtagggtagtattccaagatttccaaaaaatgataagaatctgaattggggtggaaaggaggtagatttgagagacatttgacgagagaatcaacaagacttggtgataaattgggagtttttttatattggagtatagtcaatactttggccacctcatgcagagaattgactcattggaaaagaccctgattttgggagggattgggggcaggaggagaaggagacgacagatgagatggctggatggcatcaccaactcgatgggcatgagtttaagtgaactccgggagttggtgatgtacagggaggcctgatgtgctgcgatccatggagtcgcaaagagtcggacacgactgagcaactgaactgaactgatagtcaattaacaaatgttgtgatagtctcgggtacacagcaaagtgacacagccatatatatgcatgtatccattctctaaattgagagtttaagatgcagagaacacaaagtaggaaggtggttaaggacaggtgggcctcctgcactagactgtagaccataagccattgacaagcagggcccgagtctgtgcctttccaacctagctttggagagagttgaatgactggctggaggaatgatgtgtctcttccaaccccggtggagcctctcccatcctccactacccagcaacaggtgtggtttagctccctcagcactgtgttaggcaggcactgtgcaagcagctcgtggacaatagcagtgacttttactggcgaagggggataaattcttaaattaccttgaccccttctttggtaaccgttaactttaatattttaacttcaaccctccccgcccctcagtttaacgtcaggaaaccccaatttaagtcagctccacaaaaattattggtctgggtgaagcgctatgaaaattaagctatgtccttgccctgtctgagttcccaatccagactgcattcggcaaaacaagcgtgctgagcagggagtttatatgagggctgagagcactggggacactgtggaacagggacctcaccctgcgaactgccttataaactccagggcagggtctggggctctgtgccaccctccctaggcttaatgctgagatggcactcccaggcggctgacatgaaagcagcctcataaaagggtcagcgtcattagggtgatgaaccagttggtacttggagatccaggggggatgaaaggcgcggtgcgaagacgccctgcgttccccaggcttggttgggcagggcttccaggggccaatgaacactaggaaaactggattcaaagtgtctcttcttgcctttcgcaggaggcgactgtggacatactcaaaggtcgggaaggtattagtaggggggtgctctttatctccagggtcctgggtcacagcgtccctaacccaactcagactcccggagcatcaccagagacgctctaggattggaagttgttatggcaacgaagctctcagaatactgaggaaagccgaagcctagagaggcgacaccctcctataccctcttcggccccacgggtaaagtggcgccccctacgcacaggaaccgtccttggccccccgccccggcgcggagaccaccctggacctccgggggcgggaggccgctctggcccgaagcagagcctctcgctggtagacgggcccgagggagcccctctgggcgcagcgccggtgagctgctcgatgctccgacccggaagtgctcttcaccgccgacctcccacccggctctctggtcccggcggtaagatggcggctgccgcggagtgcgatgtggtaatggcggcgaccgagccagagctgctagacgacgaggaggcgaagaggtaactgggtggcagggtaggggaagaggcgagcttcagctccatggctccgggaaccacgtccttgctgtgggtgcaacc

SEQ ID NO: 60396 - DNA, 3031 bp, Bovine  19866880780951
aggggaggaaggagcaaaatgaggagagaaaagatgagtggggagggaagggtatgggtaagcttggggtgacagaacttctaggtgatcagataaacgtgcccctccccctcttcctggcattgcccaggtagcagatccagcagtctccaggtcctgaactgtaagccacctgggctccctgcccacagcaccatggccaatactctagggcactctgaacttcagtttccctgtagcatgctgtgctcagtcgctcagtcgtatccgactctttgcgacctgacctcatggactgtagcccaccaggctcttctatgagattctccaggcaagaacactggagtggattgccatgccgtcttccaggagatcttccccgactcatggactgaacctgggtctcccactttgcaggcggattctttaccatctgagccaataaggaggtaaataaaagataatgggggcagaggatgagtaaggctggagagaagaacaggggctcctgcagcagcagctgagttcagcaggaagaactacctggcaggcagagaaggggctggcagcacctcttttcctggggcctggggtaaactcttctgtatgagaggcactaggccccctgataccctccccctgtccccatacctgggggaaagaagagccccattctttccatcattggttgcgatgtggggacaccagggaacaggcagcttcttcctgggcccgaaaccacggctctccagcagaagcaagagtccctccctctggccctcccctgtccctcgcatcccccaccccttccctctgtcactctggctgggtttcatttgctcctcactcagcgctcagcgctcagcggtgcctccaaaggcagagaatgctcttgggtgagtgctgaggacgcctgagctgggggatggggagggggattctagccaagggtgggcctcttccctctcccctgccctattcttttcctcctgttgttggccccccaaagttgtgtgtttagaggctgcagtaaccagctggctcttggtacctttcccaggtacaagtatgggcaaggggagcccccactgcagctgggagcaaagctggggtggggccggcaggaatggttgggggtctggaggtccggcctgcaggaataaggcagctgcagcttggggcaggtgtgtgtcatctggggagcctgctacagaggttccttgtatcaaatcatactttccatgcctctaaggggctgcctggaggagcaggcgaggaggagactaagaggggattgtgaatgcagcagagagcgagcgagagtgagagcgagtgggccgggcagatggagggcagcatccactgaggtcccccagcacgctgaggtcaacatcagtgcccctcccacatgctttatttgtggtctcctggctcacctccccatacaaggggtttcttggtcgtttccaagggaaacaaccattaccctttaaggatctgggagatcccctgctacaggggcgagggctagaggccatggggctagttcccctgctcgggctctggggtcttcttccgatgtggaaagggtaggagcctggaacacccatgcctccattgtgctggccagcccagaagtggaatgggggcgctggagaacgtggggaagaatcctaatcctagcaggaagtggggaccttggttcaacctctcattccctgcattcggctctctctccctcttgggctccccttcttcacggagttttggttttatctgtgatagtaacgataactttactacttgaggggtgtgtatgtgtgcgtgtgtgtgcgcatgcctcggggtccccatcacctgcccctgtgactcgaggtaggggtgggaggggactctgggtttggctgcctgaacttgtgagtatgtcagatgcatttaattttgtaaggggtgcgtgtgtttctgcacatgactcttcctgaacacacacctcacgttgtgacggcgtgtgccgctgcatgtctgttttattattgtctgtacgtgcatctgtaggggactgtgtgtcctcgtgtgtctgtccctctgggtgtacatgatctgagtgtgtctttgttgctcgtgcctgtctgtgtgtacgtgcgtgcctgtgcgtggcctctgtgcccgccccttggccagcaggcctgtctgtctgctgtgggtacgacctccatgtgtgcacacatcagtgtgcacagaccgtctcaccatggggatacgtgtgtgagtgtgttctttggtgtctgtccctgtcactctctgtgtggatgcctgtgggcctcagggtgtgtgtccctgtgctctttcgtgtgattctttcccagtgatggcaaagcagcaggacagagtttccccagattctggctcccttgggtggtaggcagggtgatgttatttcatgagacacctgctctgctcccctgccccagtctcagttggacccctgtgggtggtcttttctccatcactcagtctggtttgttccagtttgatcagagcaacagttcagcctcttgaggcagcatccagcaagtcctgggtcccagctgtggacccctggccatggaggcggggaggaggggctgctctgagacacttagccagggtgactgttctgttgcaagatgctaacttagggaattccctagggacccagtggttaagactctgagctctcactgccaagggtggttcaatccctggtcggggaactaagatcccacaaacagggctgtggggcaaaaataataataaacaaaataaaaatgtttactcttaaaagatgctaaccaagaccctccagcacacacctggccattttgggggtgcagaattctagatctgtcaggctgtgtgggaccatcctggaacagggggtgtctccctttgtctgagtgtacccacaagccaagcggcaacacatgtgtgtgcatgtcccatgatatatgcgtcatcccggtggccctgggtgccagggtgcacagtgaat

SEQ ID NO: 60397 - DNA, 1111 bp, Bovine  19866880785167
ataagaattactgtaaatttttaaaccactaggactctgcaagagtaaggagcctattcttgtttcctgatggttgtgtgggacagcacttagggtattttccaatgagcagggtgaccatcagttatactggagaaaaaactaagcctgcctcatattctcatggcctcagaatccctcctaaaaaagagtcacttggttaggcaaaaagaagcaacacttgctttaaaaattatctcaacgcctttagccattctctttttttttccctagccatttttttactggaagagagaatcttgaagaacaggtgggaatatccttccaaactgtccctcaagtgtccctaaattccacagaaaaaaaagcttgcctctccgaagttcgttcctcacaagctgaaatattaaccttttctcttctcatctggtttacccttactgggcaaagttcccaagaccttttcgttggcccttaaaaatataggccccaagtcgcagatcaagtgcttgcttaccttggaattaaccgtaccccgattacagtagagtttagcatttgtttttatattgttggggtctatccccagggcttctgtgtacagttcatatgctaacttgtaatttccttctttaaatgctttattcccatcttctttctttgctttaagtgctttggcattctacaaagaaaagcaaggggagtttcagttcacatccagaaaccctcaaaccactgcagagagagtccagagtctattttctgtttcttagatccaaggatggccccctaccctgcccaaccccaccacttgggctatttgttgctcattggtgcttgctacagagtggacgggagaaaccgagatttacaaaacaataccaatgagacctgtgttacccagagtttacctctctctactccccagaataagcattactatcttttcttcactgaaggaagaaaaaaagaaaaaacactgagatattaaaaggatctgactctaaattatcatatttaccttcaggcaaatacaaagttgtcctgaaacaaattctaatgaaagaaccaagcatcctggcaaggtgggaaagaagtgctatcacattcc

SEQ ID NO: 60398 - DNA, 1309 bp, Bovine  19866880812302
gctgaactcatgaccctactaacctgacacacacacacacacacacacacacacacacacacacacacgcccctaaacaactgtaggtaggttttgaacattcacagagataaatgtttgctggctcaaccctcctacctccaacctctagtgtggatgttgggccagccccaggcttgggggacagacacctggacctcgatgtggggggaccaagagctgtgatgtacacccagcaccaagttgagcatgtacttaggagatgaactgtttgcaaagcacttccacacgcagcacagcattcctttcttacccagacatcccagagtgtggatgattggcattcagccctcatgttagacattgaaatatattagagctcagtgtaagcaacagagtgtaagcaacagacctaaggccacacagccaggttcaaatcccagcatctctgactctaaatcccatctcttgtgccctccccaccttgtgactgttaagagagatggagccttagtgtttcaggaatggggaggggggggatggcccaaagcaggtggattggctcccaggacaggctgatcaagcactcaaggcccatgccttggtgttctcaactgaaaaatggggagatgccagccatctcccgctctgcctaggctagctagggacagggagggtagcctcctaaatccggttggttcctcccctgtctcttggcaggactgacccagctggcccatcccctgccccccatgattgcaacatgacaccagaggggagagaaggggatttcagaaatgtcttaagctctggcttaaggggagtgaagggtagaccctaaggaggacaggaaagcagagatggaggcagactgtgttggatttcagggcaaagatggctgcagttgaatcagacgtccctgtgcctttgggaatgagaaggcatcagagtggcaggtggaggctgttcccggccccgtgccctcagacctagctcctgttgtaatcagtccctccatctcctctcctagtctttgcctgcagaaacctctgactgcattctgagccccagagatcaaagaccttgagcttgggtcatgcgtgagtcactggtttgatgagctattcaccccccactccctgcagatggattaatttcagtcccatcaggaggtctccaagccctccagcctgtccccccatggcttcaacatctcccttggttgccagttcctcctcagtggcccctcccaactcatcctgaggcctctgcatgcgtgtttcccctggctcccccaaggccttccaag

SEQ ID NO: 60399 - DNA, 2680 bp, Bovine  19866880827858
tggctctgaaatactacgaagcctgtaaagtgatttttctggttcattgcaggagtcagcactgcctacatgtccgaaatctgcagctagtgatacaaatgcctgccttgtgtgaatacttgcaggcttcatctgtcttaatatcatatttccagggcttcttagaagtaactccgttaactcacctgtctttacttaagaaataccccatgtgaaattagcaacacatacaagttgaggctggcaaaaacacacagaacattcttgaccctgtgcccccttccacccttaaagggataactataaataggaaattatcagagtccttatttccttcagagcacacaaagcactttccttttcccttcattcctagaagcgaatagcataagcaccagagcgagtcagtaggagaacgggcagtccactgcaaagaaaaaagagaaaatatactataccttccactaaggtaactagtggattggaaatagacttatgtagatatctagtcagtttgaattggactgttgcctaaaatttgcagtgagcattataaataaatcacttgagccccagaaaaggtgtggtgcattgaggctgcatttatacaggctgtgtgcatgtatgtatacatatgtatgtaatttctttcccctagggactcaatagatcttgataatccacaggagaacattaaggccacccagctcctggagggcctggtgcaggagttgcagaagaaggcagagcaccaagtgggggaagacgggttcctactggaagatcaagctggggcactacgccacacagctccaggtgggcgtgagttcgtggccacgctccatgtgagccccaggccacactcttccctgcaggggctcttccttcatccagaggtttctctctctcctttcacccaaggttgccaagccacatgtgacatgtgtaaagttcttattgtttggttttgtgattgtagctgccatttttaaacgttttatttgaaaaccatttcaaatttatagacagttacaagattgatactgagaacatatgctcagactcaccattattaacatttgctatacgacattctccctctgcgcacatgcatgtacagacacacacgcaggcgcgcacacacttgcacaaatgcgcgcacatgcacagatgtgcacacagacgtgcacagtttttcatcactcgaaagttgtgtgcctcatgcccctttgtccctcaagtgctccagtgtccactttctaagcatatgaaccttctgttacgtagttacagtacagttaccagctgacttactaacatcttttgggacatttttctccccctccagtccaagatcgtgttcaagatcgcttattgcctatagttgtcatgtctctttaaggaaccatttgtcagtctccctttgtctttcattgcattgacattttaaaagtaattcagctcctctgttttttaaaggtaaaatgtgccttatttggggtttgtatgacttttcctcacgattagatccagggtacacacccctgatcagaattggaaataagtgatgttgtgtcctcctcagactatcacatccagaggtgtactgcgtccaccttgtcctcctcggtggcagtaattttggtcgctcaatcaaggtggtgtccggtttctcctctgatatggccttttaaaaatgtattctattcccaagcatggttcccttactttaagcaatttaagatgtaagaagtaaaataattttaccttcctcttgtaattgagtttcccacaacatgcttttcttgtccccattcacactggaagagcagcagttctcatggttgtgttacgaaacgtctcctccatcctgagctctggccctctgctctgaggtgaggttctgccccatagcatgaagcagaacaaagtgatgtttgctcttggattctttcagaacacatatgaccgctgccccatggagctggtgcgctgcatccgccatattttgtacaatgaacagaggctggtccgagaagccaacaatgtgagtgccctgtgggcttgggaagtcctttctggctcagctctttctgggcccagctttgtcaggatctctcagggtgcatctgttggtgtctctataaacagagccttgtcctaagagcacaaaggaaatagaaaactgatctctgatcttgactggcttgtaaccttgatgagatcgcaaccacaaaacaatgtgaacaagtgcaaaataatttaaccccaattgaatagtgtttgaggagaggcacgcttatattcaaggatccctggtggttctgttggtaaagaatcttcccacagtgcgagaaacctaggttggatccctgggtcaggaagatcccctggagaagggaatggctacctactccagagttcttgtctggagaattccatggaccaaggagcctggcaggctacagtccatgtggtcacaaagagctggacacagctgagcgactcacacacacacatgcttatattcagatgagattgcttaagaacagccccttctcggcccgcctcaacctggtgttgaaggaatagatccacccaggccaggtcgatgactcaatccacacagcgcttgttgatgccttgcccgtgacttcacttggggtctccagaacgccgc

SEQ ID NO: 60400 - DNA, 2668 bp, Bovine  19866880863192
tggccctgcccgccaggcctctgcagcccccgctggacttcaagcacttgctcaccttccacttcaatggcgccaccccgctcagtctcttccccaacttcagcacggtacgggctgggcgggcgggtggggggagtgcaacccagcatgggggtgggctgggaaggtgggctcccaggggccggctcttagaagctgggtccaaccaggagcaacatccccccgagtgaccaggtgctccccaaatggggcccagctcctccttaggccagaatatccaggatgctactgtcctgtcccctagcaactggtgctgagcccggagggcctgtgagctgcaggtttcatcgagctttcataaaggggcatctgtggatgatctgtgtatgtctgtgtgcctttccgttttagtttgtctctgtaggactttgtgtgtatttatgggtgtgagtttgtgcacgtgtgcttgtgaactctttatgcctgtgcagttgtctttatgtagtgtatatgcctgggtatctgagtttttttgtgtctactgtgtatgtgtttggtgtgtgcctggcctccgcgtgtatgttttcctatggtttggatgattgtaagtttgtgaatgtgtgccattggtgtgcaggtgagtgtgtatctttctgcttgtttctgtgatttgtaactacctgtaagtttatgggctgtgtgtctgcctactagtctgtgtactagtatttccatgtatgtgtgtaaatatgaaatttacttcactatatgagctataaggtatatgaccccttttaaaaattttttgaaaaatcaaatgtaatcattgatgagcctcaccccatcctgaaaagatggtgggaaagtctatctaatcacccttgggagccccttccttcccgccctccagacttgtacaaagagcctaaggagcccgagacaattgggggggggtcctctggttttcagtccccactgtcacttgctgacatgctcattgttcaggcacatggtccctatgagggggtcaatctgcagttgttctcatcactgggggccctgcaggccactctcccctgaaatcctgtcccgccccgccacccacctacctcagcccctggccctgggtgctgtgagggttagaacctctttctggtctcagggaagtttctgaaaccatgctcttctctcaaagcctgtgttctcctctctcaggaaggtttggaaagttcctcttgacaagcaagcccccaacgacttctgcttttgacacaacaacccagcccttgagaaaagggaacataaaggcttggtttgatagaagaaacagaaattatttaaaacaaggaaaagaaaaaaaatacaaattcatattccagggaaatgccctactcttcagggaaccctctggcttccatctgctaaccctgctccctgcccccagcctggtcccccactgccccgggccgtggctctcactctcaggccctgtgacagcggcaaagctgatacgataagctttatctcccccagcccacaagcgcagcacaaggctgggttatgggggaggaaattccaaattcccttctccgcttctccctgcccccaactctgcacacgtagatgtaattctcatgaatgaggaaaaaaagagaccagaggggcagcaagggaagtcagtgtgatcaccaggccatggtttctcaagatcacaaaagtcacatgccatccccctgcctccaagcacaagcctaggccgtctaagaaagtcagccagggaagaggcttttcttttccagtgtttaatatccacagacatgagaaatttcttcctatgggctgaccactgccctcgtccatagactttagttttggacaattggcactgccctcccaccttacttagctgaccccacagttactatgccctcccacccctccacagatggacccggtccagaaagctgtcatcagccacacatttggggttccctctcccctgaagaagaagctcttcatttcctgtaacatctgtcacctgagattcaactcagcggtgagagggagttgtggaaacaggcttggggggcgctgggcagggagcgggctggacccttggcttccaggtctttcctgcctggaggaataggggtggcaaagggactgtggtctgtattttctgtccttcgttgaggaagagccacccctggccctttatccatactatcctctcctctctccagattcctgtgccccttcccagcccatccccctaggattctgttttcctccccctatgcctctctcctgtgttctggaaccttctgatgagagcaggctgcccttccttactctgggtccctggggccaccatcagttctggttcggggctgagttcttaacacacctgagagtttacagaatctgtttgtgcccatcctcttaattggttctcatgatacatctgtgagatggttcgaggtcccatcctcagcctcatttttcagatgaggaaactgagcttcagagaggttaagtgacttgcctgaggtcacacagctggtaattagcagagctgggatttgaacccaggcctggctgaccccacagtccacatacttcctagcagagcctgcccctagagagtagggaagcctcattcggcctc

SEQ ID NO: 60401 - DNA, 947 bp, Bovine  19866880870788
agagtattatctgttactggcattgttgggggaagggaggcggtctttgggtgacccttctgcacccccaccctcctcggtgcgcttaggggccagggcagctgtggttttacacagacatagagcccctcacctccaaagaggtcatccttaatagaggccaggaatataaagttagacttcacttctagaaacgcaggcttcaggccctcccctgcaggcacttcccagcagttttcctttcaaggtggcggcagtgggtgatccttgaggctacggttctccttaagagtttgggactgcccagacagccctctccatactgcacagccagaagccctcaggtcccaaggacctaggagagaccatctagaacctcatggcttgggaaggtgcccatggcttgggaaggtgcccacggccccgggggtgcctgtcaatcaagggccggggtgcctggagtggggggattcctgaatagggccaggcctgagaggaagaggagaggctggcggggtggccctgcgtgacttggctgacgcctgtcttcccctcctcacacagagtagaggcttctcccgaaagagccagacgttcctgcccaaggtcttcttccgcaaaatgtcatcctcaggggccaaggacaagccggagctgcagtttcccttcctgcaggatgaggagacggtggccacgctgcaggagtgcaagacgctcttcatcctgcgaggcctgcctgggagcggcaagtccacgctggcccggttcatcgtggacaagtaccgggatggcaccaagatggtgtctgccgacagctacaagatcacccctggcgcccggggatccttctctgaggagtacaagcagctggacgaggacctggctgcctgttgccgccgggatttccgggtcctggtgctggatataccaaccatgagcgggagcgg

SEQ ID NO: 60402 - DNA, 1353 bp, Bovine  19866880874524
ccttggcttggtaaaccccaaatgatctcctaaaggtcagctagtatctactgggcactgtgcacagtgacgcagttatttctgcatttgttgtgttaggtatataattattataggaatttaccattcacatcatgtctctaacttaagatgcacatcagcgtcgggtaacttgatgtttagttatcctgcaagtagttaccaggataactgacttcagtatcttttactatcctatcttacccgctagaatatttcacaagttgttttcacgtctataatagtgatattgtccctttaatgagaaatgttttctgccagtagaaagcctgagtttagaaggatctctggtaaatattggtaagagataataatgtagctaatgaaagcccagtaaggaatttgggaacaaatagaataaaggtaaccactctgcttctcataggaaatgtcacagtgttgcttctttgttttatttatctatttattaggctgtgctgggtctttgctgctgtgcgagcatttctctagttgtggcgagcggggactactctctagttgcagtactcaggcttctcattgcggtggcttctcttgtcgcagagctcaagagccacataggttcaaggacacacaggtttcaacagttctggctcccaggctctagagtccgggctcaatagttatgacgcatgggcttagttgttctgtggtatgtgggatcttcccggaccagggctcaaacccgtgtctcctgcattggcaggcatgttctttaccattgagccactagggaagccccacaaagttaattctgaccactggtggtcaggatctaggtttaggcctctttgaaaaatcacccacccccagcacgattctcgttaattctcccactcctttttgtaatctaaagcttttggctgatttctgatttgattgagaagagtgaaggtgaaccagcagattcctaatacggcctcctttgtttgaaagcttggcatcctgatgttctcaggcctttagggaagggagtcctatttaaaacattttggaaaaaaaaaattgggagattgtcaaataatttttgttatccgtgagttacactttgttaattcgatttgcagcttttatcataaaacaatgttaaaccacaggtatcatagtcaagaaaagctcacttgatcaggtgaagtttttaataaataaagcccaggggttgagggagaaggcaatagcaccccactccagtactcttgcctggagaatcccgtggacggaggagcctggtaggctgcagtccatggggtcgtgaagagtcggacacgactgagtgacttccctttcactttt

SEQ ID NO: 60403 - DNA, 889 bp, Bovine  19866880879914
ttgaggggcttgagggtctgagggccgagaggtcgcttctagaggtggcctggtctcaaggcttcaggggtttctgtgtggcgccccccaggcaccaggctgctgccttttgccagcactgactttcctatctccctggcagtgacaccatctgcgacctggggggtgtcaacgagctggcaaactacggggagtactcgggcgcccccagcgagcagcagacctatgactacgccaagacgatcctctcccttatgacccgcgagaagcacccagatggtgagacatacgggctcttcgttggcgtggcccagtgtcctggggtggaaagagctttggcttgggtgggaggcatgaggttgtcccggtcctttgaaacctggggctcatcgtttaacttctggaccgaggttgccctgactttgcagcaggtagtgacagcacctgtcattccaggggctccaagcaggtgaggaaggggtggatacatgaagtcctatgagcaggtgcgagggaggtggcagcagaggtagtggtggcagcatgcttttgctgactgctataagttcagttcttcatggcctgcttacacctttattattcaggctgtgtggttcccaatttccctttaccacttgtgctgtgttttgggactacagatactgattccccttctcatgagccagacagagaatcccaccagggtgtccagaaaccatgctaggtttctcgatgccagctaggaatgatgcagagattctgtgggtttggattgactacctgctccgtggcgtaggtaagggagggttgagctgatgaaactaagtcaggagagaccagcttgctccccacctctgcactggtatctcctaacaattgggggacctca

SEQ ID NO: 60404 - DNA, 793 bp, Bovine  19866880897249
atctcgccctgccttttctatttatgggccatcctatctctgttttcttgtctccctgttttcccttgacattccatccccgcccacacgccttgccgccttgccgagaagtgtggctggagctacctctgtaattaaagagccctctcctggcgctgggcacacacccactggatcaggctgtgggcagcctctggcctcgaggcgcctcaaggacaaagggcagcaaaaatggcaggagcaccccgccctcacctctggggccttgcaccatccggccctactccccctccctgcgaggcgtgggccactccagccagaagcatttgggaggctcttctgtagcccgtgtcctctccccaaacctgacggggtcaccctgagcaagtcccctcacccaacgccagcagacagggggcagcagcgcacatggatctaaataaggttcaaggcaagtgcactcttcaaagatacaccagcaaggacctactgtatagcacagggaactctgctcaatattctgtgataactcacatgagaaaagaatctggagaagaatgaatataggtatatgtataactgaatcactttgctgaaacaaacacaacattgtaaatcaactctaatccaattaaaattaaacaaacatgggtacgtgaaaatgcttagagaaaatgctggaaataggaaccatatatgaacagtgattattttactatgatggaaatatagctgattctttttcttgtttttttttttttttaatacttaacaggtattggtttgtaataag

SEQ ID NO: 60405 - DNA, 2580 bp, Bovine  19866880919199
actgacctttgctgtgccgctcttcaggggctccactggctggagtcggggtggggggcacccgcatctcatcctgggtcagggtttgcggcctctgcttgctcttggcggcttcaacagccttgagttttctggcatgtttgtggcctttgtaatgtgcttcggcctggttctggggaggggagagtctggggtcaccattcatttgctgcatctacctgccccatccatgagctggcacgtagggggcaggtcagagggaggcagggctccagccacacagggagcaaatccttgccattgttgttatcattatagcacgtatgtgggcccaagggttacagaatgcattctcgtatgtgaacgcccaggcaaaccgccactgccttccaattctgcctcaacgcctctttagctgtgcatctttgggcaagtcacttcacctttctgagcctcagtttcctgactcataagctttggtatgataatactgatatcacagagttgtgagaatgaaaatgagaacatgaatgacaagtgaaagcgaaagtgttagttgctcagttgtatccaactctttgcgaccctatggactataccctgccaggcttctctgtccgtggggatcctccaggcaagaatattggagtgggttgccattcccttctacaagcaatcttccaaacccagagatcgaacccaggtctcccgcattgcaggtagattctttaccatctgagccaccagggaagccctggtttgatgactgacaaccttggaggcctcatataaatggaattgtggcaggaactgggggaagagggaaatggttgttcagtgggtttaaagtctcggttgtgcaagacgagaatgttccagagatctgccctgcactgtgcttatagttactacactgtactgtacacaagaaaattggttaaactgttaagcgggtagatctcatgttacatgtttttaattaaaagagaatctcttttgttttgtgtgggtcagatttggagaggtttagtgaaggccctgcccctgcaccaggtcttcccagtgaggaccacatggctacctgctgtttttcaagaatgccagacaacctctcaggactcctcctgggggtgaccactgtctctgactgtggagactggcctccctgccctccacgcctgggctgtcgttaaggaaccattcagcatctgcagacgtgatcccgcagcctccagacccagctccgggctcagtcagagctatgtgacacgcatgcacatgcatttcccgggcccctttggctttcattctccgtttgaagccagggcttgagaattttgcggagctgacccgctggtttttcagcgactccatagcttggtggtaacaccccaggattctcctggctgtgtttgtcatcacagttgcaccatcaaggaagaagcaagcacaggggctgtcgtttcatacgaaagagcaggaaagttatttgcttgtgtcctagaagtgacattgaaccctctgaaagggcagaggctgctcggctctcgccttctcttcctctgccgagttccctttgggtttcctgtaggagcagccgctgtcgtgtgcaacttcaccagaatttctgtccccatcatcatacatccagctcgcctgtactcaaccccctgtggggatgcactcggctcccctcaaggtgaccttgaaggcagtgctaatgatggacttgcacaatttcactcctgacttccgaatacattttggctgcaggacaccacaggaggaggggcggtggtggtctgcagccagcgaccaacctgtaaccctgatttcgtttaaagagcccttagcctggctgcactggggattcttaatgcctggcgatcttgcacctgctggaggagcaggccagagcacgcactaagcagcgatggctgcattcaccaccccgaacctctcactttctagcgccccgtcctcctttatttaccttcctagctctcatttgcttaacacagtccacatctttcctggttgcctgtctcttgtccactctgagatttaaggcagtgtgctttctctcttgcctcctgctgtattcccagtgctgggaaccttgcctggtatatagcaggccctcagtaaatatttatggaatagatgggtggacttgatgacactgtgggcttgagattaagcagaccacagggacaattctggggctaataatggagggcagtctgttccagctccaactcctcccttctaagagcctcagtttctgcatctatgcaaggagggtcgtaaatacctagacctcccagaaatctcgtcaagactgcatgggaggctgcaggtgaaagtgttactaaacagcaatatacctgcaatgtatgtgcggcgtgatttctttggccaggttttaatgttttgatggcatctttgtttttgctgtaagttacagtccttttgaaagcatgtggaatataaatgatataggtggaaaaagaaattagataaggatatctcacaaatgagcatgtagcattagcagaaaattcacaaaagaaaaaaatg

SEQ ID NO: 60406 - DNA, 1338 bp, Bovine  19866880925927
cacaacgtgcaatctcacactcacacacacacactcacacatccttcactggtgccaccatgcacagaaacactaaagtcacaactagtattaacacttcacattatgagtattgtttccaaagagaagcgattcatggaattaaaacatccacaaaagtaactcctctggcaaggatgaagaagctagagatggcgacggggcaggaggggtggggtggggcgtcacgactgtgcgtgggggatccactgactgtccatgggtcggcctaggagctcctccacacgccgcgccacgtcaatcgtgtcgtccagatcgaagtcaccatcgttgtcaaggacggggtcggggcttgggaggaaaagaggagaggttgagggaagggagaggtcagaggccaacaagaagcagcagagaccaccctgcaccccaccaggtgagcggctcagactgcctgtacccttggcccaggcctggcgggcaactagtaaggcgacctgaaccctggggcagagtcgtctgccagttggttggacacaatgacagactaaaataccagcctacctagcctcaacactggttgcccgcatatacttaaaacccatctggtctttacacagagccagaaaaatctccactttagaagagtggagcaggtgacatggcccaaccctgttcgatactaccaatgcctgttggtcacatctctccctcccacctgggcacgtgcctgagcctgcctggcctgggtagtctcaaacccagactagccctggtgtccttgcccatcagtcctctgtgcacccagcctgaggccaggtgcccagttcctccccatggagccccagaagaacacaacctacttctgtgggtacatgttatagtgaggctgggggcacacggctggggagggagcctggtccatgtaggtggcactgcctccggcagagtctgcagaggcgctcacaaacctgtgggaggaagcggagccttagcaaggggtagtggggagggagcacttttgtgtctttctcgggtgtggaaggacaaagggcccaccgagcccggggctttggctgtgggagcagagccctgggtaccaggtcccctcatgaccaaggcccagttccctccccagggctgggccaggtatgtgtgtgtgaggggaggcggtagggggtgaggagagccaggtggagccgcggggaggagaaaagaggcagcaggagaccagcgctgggcccggacacttactcagggaccacctgcttgatctgtggcttcacgtacccgtccactgctttagctgccgaggagggaagatggtgatgagaacca

SEQ ID NO: 60407 - DNA, 2072 bp, Bovine  19866880930646
cctcctttctccgaacctctcccctgctctcagggcaggagatgggtggcagataacacaggctccccgctcctccaagatgccctcaatcctcttaccaccttcctcatcccacctgctcaatattaggcttctcaaacggggggctgcccagggatccctccaccacaggccgggtcatctgcaggatgcatttccgcaggagctgcaggaagagggaggagtagagatcagtggagcacagagccgcagaccttcccagcctccatctcgcccactcacactctcatttgaagggagctcaccttgaagaggtagaaatagacctgcttggtgtccgtgtcctcctccttgtgaacagacatgaacagattctccacgtccaccaccatccccagcagccggttaatctcatcctccgacacgttctccaggtgggacacgtggtcagctgtaagaatgagtggtagttgggaaaaactgacagaaaaaaatcaacaggacttccccctcctcattattgccagccaagacacatcctcagtccctctgaccagtgtgactgggcaatgagactgactgctcctatgtcagccctggggggcctcttgtctcttgtggtggcaggtttcctttctgcttccttggggcatacacactcccggcccaattcctccttaggaggcatcttctgtctttcagagatgaaactgtgtggtcctgtccaagcaggacgcagcacctccagcttcccaaccccagttccacaggtactacctgccttacccaaagggtgctcacagctgcggcacagctcgctcaggttcgccgctggctgctgcaggtccatgcggggtgcagtggggggcttggggtttttccagccattacacttgcaggtttcattggcctggaagcagaaacatcagtcaataagcgtgtaagccggggaagagtagccgctccccagtcacagctttgcccccattcccacccaagccctaggatgccccaagccccgccccctattaccccaggccccgcccctaccttgcaagccgagaagacccctagcttctctagcttcttggcgcgcggcagcccccggacttgcgctttcctttggctggcgcgctgctgctggctcaggccaggtcgagccggatcacccccgctcccggtacccccacttcctaccccgggccccccagtccctgtgctcccggctggggctgtagctggggcaggggctggtgccggagtgggagcgggagtcggggccgaagctgggctgagggtaggagtcggagttggggtaggggctggggactgaagcggacggggctgcgcggcaggggccggggtagaggcctgggaaggttccgccatggcctcccccgaagcggagcgcggcgcagcgcggcgctcccagccctagggccgcatgggcaaccggcattcaatgcgcaggcgtcgctgccccagagcatgatgggagttgtagtctttcacggttactttagtcgcctccaggttccagacttttctgtcctgtccctcaatcccggacagccaaatgaggctctagccagcaccccagattgactcctcctcacttgtaatccttttagaaggcttccgaggtagtcaaaattgctgccttttgaggacaaggagaagcaccccagaaaacaggcttctatttggggaatcacatccctagccataaagatggaaatgcaggcctggggccaggagtgtagtggtttcatgcccacctccctcctcccctcactctgcccctatcccacacgtttctggacacagaattgcagctagggtgattgaatagcaacagttctatttcttgatctgttaagtggttacatggttgtgctttgtgcacttttctctgtgttaacttatacttcaacaaaaaaaggtttattataaaagcactgagcgtcagagtaatggccagggtcaggaaaaaggctcctgaggcggggatgagggactatgggacctgctatccacccacacagtgggcacctcccattcagggcccacgt

SEQ ID NO: 60408 - DNA, 2174 bp, Bovine  19866880936360
cctgtgactattgacacaggtgctaaaacaactggaaggacacacaccgtggtgacacactagggcaaggggtggggacacggcctggttcacttcccttatctgcggcacctttgcacggagcacattattactaatggtaagagtcaaaactaaaaatttaattttgaagcaaagaagacagttttggagacaacatgggtaggcgtttccggaatgccccgagggttcctgttctgtaccggagaggggggtcaagctgattcaggccacatgtgggaagcccatgggggaccgaccgtcagcccctcagcagccccttcggtcacctgtacacgacagaggcaccccctccggccaccatggtccagattctccccttgggattcagtaaagtcagcttcaagcttgccccacttttggcgtccagatctgcgatgtaggcttcctggggaccagagagcaacagggtgggccctgggggcacccccttcaccaggctgcagaccccaggccccctccctttcccctggagcagtaggaaaagggcctccgttgttctcacagggtcaggaagaagggtttgtgtggggcctcatgggcctgggacaaaatgggatgctgtctgtaagcaccaaaaccatctacagccagtcaccgcctggaaacaaactttccaactgctttccctctgattttaagtcctgctaagtcacttgcttctaccctggccccacccgcagcatctccctgcctaactcattaggtgccaccctcccccagccggccaggccccatccgttcctccagcccagactcttcccctagcctaggttctgtcacacacgcccgatcctgctgtgaggacctctcagaggatggggtgggaagcagcaattaaaagtctcagcaagtggccaagacaactatctaatgacaggatcagggggagccactcggaattactgagaaacaacaaatcaagttacgagcccagggaggttgattgagagaggagtctaaaaggatttctggccaggattcagaggcttggctctctcccacccccacctcctttggggttttaagaaaattaaatggctcgaccttcctttcctgccaaatatatagctcacaagggggtggggggaatgctcatctgagattagtcaccccgcccgggcccccctcactctcagtctcctccccacagcagccttacctctgggtaagcctcccgtccgaaggggggtgggaactctatgtcaccccacttcactttgcagatgtagtcggcagtggcatccaccttggcggccaagtcaaggacgtagacgccatctttggtcacgactttaagaaaagaagaggcgattggacatgggtctcagcagaggcgaccgtcaccctccaaccccctccaggctttcccacacccaccccccgtgaggcccccaggcctcacgactctccagctcaacaagaaaccagattggttcttatggagacacagcttttccctcattcaaggaaaaacaaattctacaagaccatccccactccctgatctgtaggtactagggcagaaccctgttttagctgccatggcaattttaaaacattacccattcacccatccacaactctgctatttaaaaacaaaaagagtgtttcaagcacaatgtctaaggcccctgggtgggcaccccagggtctcttagggtccagagagaagtgggaagaaggggagctgtgggtgcaccgggccccccaccagcagaattcatttattgctgcctcgctggagtccacttccctttacccagggccactgagctaatttagttagcgcagagccatctggtccatgagaggggctacatcccccagctggaatctgaatcaggaatctgacctcagaagctctggccaaagccagcccacaccacctgcctcttgcaaacccgagagccttcgccaaggtgtttccaactgtggcgggtcaatgattgactaactcctggagcgggtggaggggaagggggcctctgaggcaccaagaggaagggagggcctgactggtcaggcagacacagcggcagcccagctcccgggagaacagcctgatctactggcgggaagagccactgagcagaatcaaaccataaccagga

SEQ ID NO: 60409 - DNA, 1107 bp, Bovine  19866880941316
cctgggtctcccacattgcaggcagattctttaccatctgagccaccagggaagcctgcctctatgaaaaggaccaattcaaacaagaagaaaaaagttggcaacttggccaaggcagctctcaacacgacctccctctgaccagactggaactctgagttgtgtgatttttgctcttggacaaaataccaagaggctgaagatgccaaaagcacagtagggacatgttagttctgagctgttttgaaggaattcgggtttggcaacgaacaccgcttcccttcaccagtcaattgagattgatgggcaaggtatgtacacatcccaatgtcagcaaagggcctccatccagaggctaagaccccagtgccccagagaattcctggcagtgacatgccagggccggtgaccacccaaggtcttgacagccagggctctttatcacatcacatacattgccaaacaccagaagcatgtcatacaggaaggaggtttattgaccactgaatacaagaacacaattaaatttgaggagattctgaagcactggagtagaaccaaaatcccagaagagacactgggaaaaaacaatagctttagtgaaagaccattacaacatggaaacaaagggaaaaaatacagcttaaggaacaaacaggaaaccactgctcagaagttatctgttatcctatgattcagtgaaaatgcctccagtgggtttggtctttttggaaggaagactaagctggtgagggcaatactagccccggtaccagcagcctggatcttctgcactgggcacagaccttcagaactggctcttagtgccggtgcaggcaggcagagcactgctgggatgaagggttctagaggcaggcgtagagcagggattacaggggagtctgcagggagagagagagaagaatgagcttgacctgggaggtgaaaagtatctcagtgatggacagaaaggtaagaccaaaagtcttaaggacaggtccaccagcaacaaattacacagcccagtggaatctacagagcagtcccactttcactctcactgtatctctccacatccaggagtccctggtcaatgggcttagggac

SEQ ID NO: 60410 - DNA, 1179 bp, Bovine  19866880974807
tgaatgtgagcaattcccggagatagtgaaggacagggaagcttggcgtgctgtagctcatgcgatcacaaagagttggacacgacttagtgactgaacaacagcaacgttggcggcccaataccccgtgcactgaggggtgtcaccccgggtaccccatgttctcacctcagcaccatcaccagtggtcaccagtcctgggccttggggttggttgcggtagtccagtttactcatggaattcttgactggcggggtctttctgtgcttcatgagaagcagccctgggtttttttattttgggttgcatagcacagctaatggagtctcagttccctgaccggggactgaacctggggccctggcagtgaaagcgctgagtcctaacaactggaccaccaggaaactccccgcagccctgggacatttgtttcccatggttgtaagcgcttgctttcttgctgccttctttctaagcacttgagtgttgtcccttggtccttccagggcatcgtgagagcaattcgagattaccagggtcccctgaaggagcacgaggtcacgatctttgtccgaagaggtggccccaactatcaggagggcttacgggtcatgggagaagtcggtaagatggggggatgttttctgtccttcccaccctgagcgtcttgcctcctcgggatttcctgagcaagtcagtcttctaacgtctccatgcttctcccaccacccacctcactccctggagctacagccagcttccgctgcatttctatgccctctgacacatggcacctgaccaaaacctaaattcaggatgggcaggaaagcagtttattcagctgttcattcagcagttgcctgtggaaggcctgctccacgcccagtgctgtgccgagctctggggtcacggccacacgcgacagctgacaggcagcaggccctcgtgccatcgaggacagtggctgcggcctcaggtacgaggcaggaccacttggggaaggggtggcctctgtgggaggggacagggccgttttaaatgaggcagtcagagcgcttggccaaagaggtggcatttgagcagaaatctgaggaggagagggagcagttggtggtggctgtctgcaaatgaaagggcaggtccggaggccttgaggtgggaccgactgaggagcctgg

SEQ ID NO: 60411 - DNA, 957 bp, Bovine  19866881015524
atgcctgcccctagctctagagctcctgactccaccttgagttcttcaaggcttccccttgtcacctacccctgggccctactcccttggggccctcctttcctcgttggaccaggatgtctcaggcctggttccttcaagtccatggctctgccagtgcctacttagcctccatctttgctctgcttccctctagccccagcatggctcctcctccctccttgtgccaggccatccactcaggtacactggtttcctgggaagcagggtggcatgctggaaagaattctagaccgggagtctagggacctgattctagtctcttgtctgccattgctagctgtgtgactttcaacaagccactcaacctctctgagcctctgcatctacctctgagaaagagagatatgagaatcttccctgaaaggttactgtgaggctcctacgtgatgatgtgtgaaagaacttagaaaactgtaaagtactcctgacgctaccgggagaaggggggactgcctggtgggcacaaaccaggtggggatgcacccaggggagaagtggggagctccatttggaagggccagagcctcagggcagacacacccacatgcacgtgtgtgggagcatgcacacacgtgtacacagccaggagaagaggcccacagcccgttggcggctagttaaatccggctgcgtgtaggtggtttcccgctatagctgagtgtggcaggcagaggagcacacggggagactgctctccacctccccactcaagggggtctggggacacagggtgggactccctctccctgggccatagaagacctagtatctgccggctgggtgcagagctgaccactgagggcgcctccaggcagttctaggactctctgcctccaagtccgccccgcagcctctacctcctcattctggcttgctacgttccccctaaatgtt

SEQ ID NO: 60412 - DNA, 1075 bp, Bovine  19866881089666
ttactcagcttctccatcccaggcagccaccaagcccctcccacctctctttgatgccagcgtctccctattgcccagccagcttcccaaaccggtgagaccgagttccagtgagtcccagcgtgggccctctggggccctgcagttcattcttccaaaccccacccagcccagacgccctcgccctcgcctcctccacatctctatctccctgggccctctccttacccggcccccaactccccagccgggcacctcagccgtactaccaagtgtaacataatggctataaggttagagacgcggccaaaaggccagtggggatgatgaccttacacaatagggccagactcagatgccacagaggtgtcctggacccagaaagcccccatcctgaagagagaatcactgctgcaatgtgtcaaatacctactgtgtgcctggctcttggcaggttctttactgcctcagaacagtcttgcaggggcttcccaggcagctcagtggtaaagaatctagctgcaagtcacaggttcaattcctggtcggaagatcttacgtgccacagaacaaccaagtctctgtgccaaaactactgagcctgtgccctagagctggtgctccgaaacgagggaagccaacacagtgagaaggccgagcactgcagtgaagagtagcacattgcaactagagaaagcccgcacagcaatgaaaatgcagaacataccaaaaaaaaaaagtcttgcaacatagatatcaattcccttctgctacaggcgaggccaaagagtgagaagcaacctgcccaaaattcccctgggagagggggggtgactgagctgggtttgaaacttttctccctaaatccatgttgctcagagaagggagctagagaaggaaccctctggtctctctatccctttaggctgtcagctgagggaggcagagagttccagaagggagagaggaaggagagaggggtagggaggaagggaggaaggggggaggaagtagaccatccagcctcactcttgggcctgattccatagctgggtcccacctcccacagtcagct

SEQ ID NO: 60413 - DNA, 1207 bp, Bovine  19866881127934
aaggctttggatgaatatttgttgcatgcctattttctagcttctggtggcttattggcactttttggcatgtagatccatcatctatctctgccttcatgttcacatggattctcctcgtgtgcatttgtgtccaaatcccccctttttataaggacatgtcatattggattagaggctcaccctactccagtatgatagttttttttttcagtatgactgaattttaactaatttcatccacaaagactatttccaaataaggtcatgttctgaagtgctgggggttaggacttcaaatgtaaatggggaagggggaggggttgcacaattcaacttgtcacaggtgtgttccgttgaaattgctggaaaaatcttgcctcatccctgcttaagaacttctcctgactctcagcgacctacagaataaagtgcaaagcctgatgatctctgagggctttcacaatctgggctgcacaagcctaattgccgccccttcagtgcctcaccgctcccccaaacgccctgtaccacactgtagccctgtggaagattcctgttgaacttcacattccctgccttttcggcgggcgcggctccctccttcccagccgcatcccgctcctctgcttgcactttcctccgcgtttctcaggaaaggcctggcgattcagaatgactggtggagcaccgaggaccgtgtctgcccccattctcccctcctagcactcacatatgcggttctcaccgctctccagggccttgcacagtttcttgccctaagagcgcccacccgagaagtggttcaaagactcccaaaccaaactccaggttttccggctctttacggttcgaaagactctcacgccccctggagggcgggacgcgaccgcacagggacagagagcagccacactaacagactttattcccctttttcctgcgagctgacactttttttttttttacccctgcaggggtgagggaggggccagggtagggccaggactggacccgagcgagagctcagaccccggaccgtcccccaggagccacggacgaggcggcctcagagggacaccggcggccggagcaggggcgcagcgctggctctgcgcctgcgcggcggcccatggtcaggatgcctgccgcgtggttgccgctggcctgcaggaggcgctgcagccggccctggagacccgggggc

SEQ ID NO: 60414 - DNA, 474 bp, Bovine  19866881144599
catgcccagggtcttgtagacccaccacacattttcccaggatcccttctctccctactcacttggagtcctcgctgtccagcagcccacggtaggtgttgatctcacactccagccgggcccgcacgtccagcagcacctggtactcctggttctgccgctccaggtcactcctgatctccgccagctgtgactccacgttgccgatcaggccctgcacctgggccagctgggagctgtagcgggcctctgtctccgtcagggtgttctccagggagtctctctgtcagagggaaggggaggaaagtcacagagctgctccttcaggggcttctccatcgcttccaaacaagtcaccagctccaagggttcaggagagggtggtccggagggcatcccagtgcccctgactccccaacctcacctcctcaccaggagtctcatcagtacccaccaggttgtgctgggcctgaa

SEQ ID NO: 60415 - DNA, 1139 bp, Bovine  19866881169452
cataagttttggaattgagggaaaaaactaatgaatgaaactaggtaattcaagattctcaagaacttaaattatgctcctgtgtattggtgtccataggctaattaaggtgggcatggttagtattttttgatgtctgttctcagatgtctccccctgctttctggcatcttcccttgttagatactggtcctctcattgactgacttcttcctcatcttatttaagaagatatacattcaagaactttgatctttcatcttttgaaacttcctgtgttttctttgaaagtcacttaccttggttgtctgtgactctaggagactctagaacaaaatttgaatgtccttgatcttcagacacactcagaggatcagaagctttatggcctcttctattcctcaaacaaagtgtcctgttgttcaataacccctggaaaagggcagccagccagcttccaggctatgctaacgaagatgctaccttgaccccactcctaagatgaatgaattcaccacgagggcccctgaggcagcagtacatattttgctgttgtttagtcactcaatcttgtctgactcttgggcaacccctgtggactgtagcccatcaggctctttctgactgtgggacttcccaggcaagaatactggaataagttatcatttccttttccaggggatcttcccaacccagagacccaacccgcctctcctgcattggcaggcacgtttttaaccactgagccaccagggaactttaaaacatggactctccaagcccaaagagatctcaaagtcctctagtctaggagcctttagcattgtgtgtgtatgtgtgtgtgttttttatgtgtgttagttgcttagtcgtgtccgactttttgcaaccccatagaccacagcccaccaggcccctctgtccatgggattctccaagcaagaacactggactgggttgccattcccttctccaaaaggaattatagaaagaaagaaagtgaagtcgctcagtcgtgtctcactctttgtgacaccatggactgtagcctaccaggctcctccatccatggaagtttccaggcaagagtactggagtgggttgccatttccttttcctcctttagcattctgctgctg

SEQ ID NO: 60416 - DNA, 1230 bp, Bovine  19866881174093
cttcaaaatgctttcaaaatgtagacattcagtgtggccatggaaaggtgtacaactgggtctatgaagctctgactacaaaatgtacagaagtcctaaggaaaaatacaaattcagcattaaggaaagaaccgcctatagttttgatatcacagacatattctttcttttacatgtgttgcaaacttgaagtaacagtaagcagcatttcaacactaatgataaataagtagcacagggattttgttaaacaatcacttatttaaattttgtatttttacttttaaaaggtgcaataaacacattgccattttgaaaaagacccaaagaaaagtggtaatatctaatgcatggattgaaccctacgtattatcactatttacctaaacagtaattatttgtacatcaaaggaacagactgctttggaaaataaccccaaggttcaccttctgagttaccgctaaggaatttatgaagcaatgttctgttaaaattaaagcacttaaaaatctttcggagattgaaaacaatatattccagctaagagttagaaacaaaacccattatattccaacagtgggtagatttttaaaacactcacttgatttcagaaaaatagttttataaaactaccacgataccttttcagactcacctaagaatttttaattcatttggcagaagatcttcgggatgaaaccagcgtgtggcagcagcgctactttcccgtgcgcaggggcctccctggcactccagtggctaagactgcacttccactgcaggaagcgcctgagttggatcactgagccgggaactaaaatcccacatgccgagtggccaaaaaaaaagttgtactttcatggacacaaaggggactaaaactgaatcttgctctaacactatgatccacagtggggagtttgaaacaaggcagggatatcttgaatcccttccagaactacctgacgactgatttgtacaattctcctattaacttgtgctacagtcagggtctggtgaattagaactttggttttgttgaatagcagagaccacacaagtgtgtcatgaaacaaaaatcccttctctgttagttgtagttgtccgatcgcataacacagagctatttatgggacaagttagttagccaacaatgaggtgtggggtggctgccagttacctattttagatttgtgctatgctatagaacatttgcgcagtgtacaact

SEQ ID NO: 60417 - DNA, 1129 bp, Bovine  19866881174690
cttgttgagaaaagagagaaatacactgggaggtgtgattagcaagaaagcaaagaggaagagagagggagcatcttggaggatgatttaaaaaataacccgtgcattcgagatttcaagcagaatcttaatccatggactgttttccttgggacttggggccactactcccatttaaggcagagcgagtagtggtgtcagtcgctcagttgtgtccaactcttagtgaccccataaactgtagcccaccaggcttctctgtccatgggattctgcaggcaagaatactggagtaggttgccattcccttctccaggggatcttcctgacccagggattgaacccagatctcctgcattgcaggcagattctttaccatttgagctacagggaatccccaaaggactgttctagagcctcttaaaacatcaaacatagagttggttctctctctgtatcccctactcattgctctgggcagatcacttctgccttctctgattccatttctcagtctgtaaaatgaaggatcagcagattcagaaccataagactttaagccaaagccatgagactatgaaaggtattctttaaattgagtttttatgttgtcaataaatgaaggtgttagtatgctagagacagaagtattaacaatgaaaaattacccaacacccagaactggctcctgttggagaggtggaaatggtcgtgatggaattcagataacctcagggccctgggatttctgaagttcagaacacttagagaatcttccaatctttccttcttaaatgtgaatagacgtctattgccattattgctttgtccccacttctcccaaatttagatcaccagtatttataaagtttaccagtcacaaatagattcttgcatttcccatccctttttatagggacctctttcagttcagtatgcttttactggcactgactttggttttctttacagcagcagctgctaattactgacagcttttgagcaagcagcttgtcatttttggcagggatagggaccatccatagcaattcaagactatattttcatttgctaaatttactttgctacatgaaaatacatctagagttaaaacatagtctgtagtcag

SEQ ID NO: 60418 - DNA, 859 bp, Bovine  19866881271384
cagagatagttaccaagggggttgatctcgaggtaggtgaagtacagatcctcatagaaattgaagaggccggagataaagctggccagaattctagagggggaggcagagagggactgtcagtccacgagggagcagactcagcagcatctctcactgctattgacaggctccactccccagcaaccgctgttgctgaccctccctctgctcgccaaaccctgctccccggatgtcactcttcagccactgaggcggaaagaggttgtcaggcatggagcaggaggggggcccacaccagacagacaggggcaaggaggtgagggatgctgacagacatttcagtctgagccagcctccccactgcccccgcattcctcctgggggcggggaggggctgggactgctggctgctccccatcttccagccaaaggctggggcggggtagccagtgcccagacagggaagaccactccgcttgccccctgtacccagagctgtcggccttccccgttcctataccaccaccaccctgccatccctctcactcaactctttcttgtcttcgggggcgtggaccagcaggtgtttcttgatgtcctcaggattcagcttctcatcgacgccgacaagtagtttctgggctttagcatccacgtcgcccacgtccaccccaccctcgtggtggaacaggacatagtccccttctcgggtagcatagatgcagacgtagaactcttcctccttacgagggaagagggcaaaatatgggtgaggggcccagccccagtagtatcatttctaaaatcccacagacacctcctactgggtgagacctcaaggacaagaggccactgc

SEQ ID NO: 60419 - DNA, 1026 bp, Bovine  19866881328293
attgcagagaattaagttgagatccccaggtaacaccttctgggttcttaatgtgttcattttttgtagcccaaggaattcccacgcatgccagaaagtgctgatttctcctagcttttccgagagatggcccatactgacatctgatccttgtccactgctgaggacttaggtgtgtgaaatggctgctgtctcagaccaaactgggaggttctttgttatgtggccaaagtacaggcctgagactgtaccttaatgagtgcagcctgactctgaaggccatgactgacccttgctatctacagtggaggaagggagggaggcatgcaatctttgggaatttctgaagctcttcagtgttctgggccatctttactgcccttggatgctccttacaagtattccagttgttttgccttgagatctttttgacctcttttggacagtgtctgactcctgcgaactttcgagctagacctaggatgcacttatttcattttttattgaacaacaaaaaaaccttgttagtgtcaacagtcaggtcacaagctctctctctgtctctctgaacttctttggaggttgctggagacttctatgaccaacctagtttctctagtctggccagtctgtgttcctgaggggcaaagtcagagaagctggctgcttgctggccattggtctctgaccaaacttacctcctcagtattggggtgtagtttctggaactctgggagtcccaggatgaggctggctagctttctgaggggaccttctttgtccgggcttggtctcccagctctgattctaaagcaggcttctgaaggagaagctctccctttcagagacaggaaggcattagtgccctgggttaggcaggcacttctgtcatccagagatgatagagtcccagcagagatctgacactgcttggcagagaaagggagggctgtgtgtgcgacagaagcccatcccctctgatgccctttggctcctgtcttgcctctgacaaacagtaggcctttt

SEQ ID NO: 60420 - DNA, 1100 bp, Bovine  19866881393928
cacaggcggtcggggttctgccccagctcccacgagctgttcccataccagacatcctccatggttctcagcacacagaggtcctggagggaggggtctgggatcacaggttcggggggccttggctggtgctttgggctcctttctgagactctgtgggggtactgctccatcttcccagagtatgagagcccagcagaagcctcatcccgtgagacagctcatacaccaccccaaaagagagagcaagcggaagggctcgctcaagagcgagaagattgtccgccagctcctgggtgaactctacgtggacaaggagtacctggagaagctcctgttggacgaaggtgtcggacactttgtttgcagcagggaactcagggcaaagaaaacctggggtggatgcttaacacatgaaccagagacaaagcctataaaatgatatttgctgacatgttcctctggacatgttccactactgttctcactttacagatgaggatactgagtcatggggaggttacataactcagtgatgcggttctcagattggaagccaagaagtccagtttcagaaccagtggtcttaagtactctggtaccctgggtgggaacgctagagatctgggtttctttaccaccttggtccctgaaggggcacccccctgagccttgagtgtgtaccaagggcaaaggaatccagctcagaggtgctcacaagggactcccaggactgtggaattagaatgtcctaaaatctcatctgttatcagtaaggaaagagagaccctgaatggggagtaacttgtccaaggtgacaagcaagttagtggtggagttgacagcagcgcccaggcctcctaagctccagttccacactcttcccgccgcaccacactggcaggaacaagaaataggaaggcaccttgaagtgaatgtctcgtatgaacactggtggtgtgagtgttgccattagctgttgagcctgcacagggatcactctcaaatccaagggcttttctccagaactgacttcccaaggtcctctataggattccccgcaggttgcatctcaggggcaacttcacggcggcccgcct

SEQ ID NO: 60421 - DNA, 1140 bp, Bovine  19866881466844
ataatatcccctttatagtttaagggaataacaagctttttttgtttttttgtttgtccatcctcatacaaccctagcatggtctttgattattcattcctgcaactgtgaaccaaagagaaatctacctaggggccttattcttgacacaaagcttcttcgtgtaacaaaaaatggccctgtgaatgttttttgttgctatttgtttttacttagctgttacactaaaaatttggttgaagctaagatttttgagctaagccagggacctttcgtcttggaggtggagggtgatcttgagcagagtacctgcttgcatcagacacctttactggatgacattgtccttttggagcaaaagaggttacttaaccctgagtgtgcacatctatatctgcagttataagccaccacatggctccttttttctgtgccatgtctcttgacggggagaagaatcttcctcagcaggaaaccacacgtgcaggtgctggccagggtgggctgggcgggtgatctgggttctgtgactcagcagagctctgtggtcactcagcctgtcctcctccctgaccgaagtttccaccccggtaggttggtggcatcaagcccgggtgctttaagatcgggaacaccggcgggatgctggacaacatcctggcctctaagctgtaccgcccaggcagtgtggcctatgtctcgcgttcgggtggcatgtccaacgagctcaacaatatcatctctcgaaccacagatggcgtctacgagggcgtggccattggtggggacaggtgatcttttttaactttttattttgtgttgggatatagccaatggtggctcaaatggtaaagaatctgcctgcaatgccagagacccaggttcgatctctgatttgggaagctcacctggaaaagagaatggatatccacttcagtattctcacctggagaattccatagacggaagaacctggcaggctacagtccatggggtcacaaagagttggacatgactgagcaactaacacttccactttcatagccagttaacagtgttgtgatagtttcaggtgaacatcgaaggaactcaggcatacgtattcatgtatccattctccccccagactcctctcccatc

SEQ ID NO: 60422 - DNA, 1504 bp, Bovine  19866881512299
ctcattcatttccccactgtgctcgcctggcaaccaccagtctgctgtttctaggagttcagtttttgtagattccacaagtaagtgaggtcagacagcattttcttctgtctgacttatttcacttagcataatgccctcaaggttcatctacactgttcatccacataaaaagaaggaatggatttccttctttttatggctaaacaatattccattattacagagctctctcacatgttcttcactgatttgttaaaaataactttcttttcttgtttacaaaagtatttcctatttattgttgttgtttagttgctaaattctgtccaactcttttgcgaccctaaggacttcagcatgccaggcttctctgtccatggaattttccaggcaagaatactgtagtgggttgccatttccttctccagggttcttatttattatcacctatttattgtagaaaaatgggaagctactagaaagtggacacatacacccagaatcccacaactcagaagaaatcttttttcagtgcctattcttatgctgggcctatatatttcttttaggagttatttcctaaaagctactgttttaatatttgtcctgttgaaatttaccaatataacaggaatatgttctgtcccaactagacctcttacacttaaggaataaaacttcaaaaccataaattttgatgatgtcacatttctgggacacaatttaaaatacatgattaaggtaataagttatcttatggacccattcctttaaaattaggcattttactctggtattgcaaaatcaaaggattatgctgcattacaattcagcatgttcactgcagccatgtccttcaggaagccaaacattttctattttgctttggtaccttaaacagttaaggaggaaggccaatctctattacacattacgatgcattagtatttttacttgatgtttaaactcactgaagaataaactcatctttaaaatatgctcacattcagggtttaatatatcattacacaattgaaacgataacagtaaaagaacaaggaatatttgcactacattcctgtgcattggaccttctgtatcttctggagtaagactctacaaagttcaattctgaccagcactctctcttactttctaccagaaacatcacaaatcctaaaaacacaaacccacaggctgaagtgactgtttcattctgtaaagagctatatatttctgtagataccttggttgctacttttttcaagcctaaaagatgaccaaatgatttttagaaacacgaaacaaaaggaaaaatagaatcagcattatttctgagagaatatttttgcctagtttaaaccatgaatatattacatatatataatatatatatatataatgctatatcatgaagctgataaatcctaatttttagtactctaacaaattaagtactcaacagtttcttttctttttttctgctacaatgatattttaa

SEQ ID NO: 60423 - DNA, 1153 bp, Bovine  19866881680307
gacagggcatgcttgctctagctttaaggaatttgggtcagtaaaagcttggaaagtaagaaccggaaagtaaatgtccttggccccttcccccatactccctgagggaagtgatgaactaggaaaatactagacatcccacctcaggtatctgaaaccttcatcttcccgggactcaacggagaacttcatccttacgccccctagcggcagattgcagtcgcaggctgatgctcctggcagtcacaaacaccctgggtccatagaggccaaattatggcccctcacctgtctccatatttattgatgaggtgagatgggtgcagagcggggaggaaggacctgcagcgttaccactccgcccagggaaatctggaccctaattctgtgattcattcaacaagaaatgtttattgagcacccactgccagtgtgccaggaaccaaccacgggactcctggtccagtgctcttcatgatgccagttgcctctctgctgtgtgtgcagttcaggctgagacccaactcaggagagctggaatcttctccaggagactgtccccactgggtggggaggacactgggaggagggcaggccttcagcagctgcaataccaccatcctgtggtccagagacccagagaggaggcaggaggggtctggggagcagtgctcacaggtgggacaggatggggcctggtcagctctgtccattttccatgtttaataaatagttcttgttggacccaggcttcccaagctcttgaggggtgcaggggggcgtcttctcatggtaattcaggttctggctctgaaaaatgaaaggagagggcattggggttagccttcccattgtcaacaggcatctgggtgctgtcctggggacaggtggtgcgggcaggagcgagggtcctcaggaacaggttcctgcttcaggaaggatgctcccccaccccttgaccaggtgggacaggggttgctaacaggccggaagtccccaaagaaggagtgccagcaccctctgcagtccagtcctcagagccttctgtccttcacctccagcccaggctgtaccacccatccaccaggactagtcactgaccagcctcagcctcgtcgcccttggcatctggctcctgccaccagtcagcata

SEQ ID NO: 60424 - DNA, 774 bp, Bovine  19866881742396
gttagagacccaaatttcatcctatatactttcctgtactgttaaaaatttctgatgtgcacgtgtttaaataaaaaaagtttttttttactgttttgttaaaaagtcagtttatagaaaaagtaagctgaagcttctgctatctacacacacacacatccaaccctgatgaacacagaaggcagagcggcggacgacactccctttaggctgtgctcgagccgtgaggggactcaagacagcagctcccctaccaccagccgtggcagtccttcgcaaagcccgagcagcctggggaagcctagtggagccagcttgtcctcccaccaagtctgctctgtcccccacctggaactccacggctctcttgctggccaggtccgccttgttgcccgcaagcgcgatgacgatgttggggctggcctgcctctgtaactccttcacccagttcttggcccgtgcaaaggtatcctggggaaacagggccagagcgtcagcaggacagggtgggccttctgtccagggccgctcactggagaggctggagctgacagtgcccaggtgtctaagatgtcaccaccctaaagattctggagagatgcccgccaacaccagaggaaatgtgcccacaccccaaacaggaataaagggtggagaagcaagagaaaatctttactgtgttgggtgatgtcgtagaccacgatggcagcctgggccccccgatagtacatgggggccaggctgtgataccgctcctgtccagctgtgtcccag

SEQ ID NO: 60425 - DNA, 1201 bp, Bovine  19866881944128
agttttgtatcaaactaaaaaaaagacacgctgttggatggaaaagttctgtatcttgatttaggaggtagacacatgaatgtctgtcgttcagttgctaaatcgtgttcaactcttctgcattccctgcagcctggggctgcaggctacagtccatgggcaagagcttaggctgtagcccacaacccacaaggtcacggagagtccgatgcaacttagcaactacacagcagctgcagcaggacggaagcccaccaggctctcctctgtccaagggattctccaggcaagagtactggagtgggctgccatttccttctccaggggatcttcccaacccagggatcaaacctgcatctcctgcattggcaggtggattctttaccactgagccaccaggcacacccacgtggatgtctacgcaagcaaaaatgcacttgagacttgtaagtttcactgtatataagttacatgttaatgaaaagattaaaaatgctgctggtacagaattttgcatatagtaatgaaaacttaaagcttagaaacatgagaccaatctaactcccctgtagataaaatattttatattttagtattacaaaaggcagagtaaagacaatccaaaaaatgttgtctgaattagaaaaagatcaaaagagagcaaagatacccaaacgaacaaggggcgagatagcaggattcaacataaacaaatatgcctgctgtatacatattaagaatatacttatggttcatacttaattgtgggttaaagaattttaaggttgtttaaagcttcagggaaaagctgacgctgatgtcttttcagtgcggagaaagaggttacagcggggagactctctgcactccccaagcagtccagagggaaaagggtttaggggtggactcaaagagaggcatgtcctccctgcgtgaccactggcaactgtgtggaatcactacaccgagggcctgagtctcatctggagtgtgtaacagaggaagctgggccttggaagccagaagcttagcagtgcacgtaggttgagatctgggcagaatgtgatggtgtgtcaggccagggctgcagtctcatcccacaaggaaggaaggggcttgggagagatggaagcaggaggagagggaaggggcgctgcctttacagtcacagcacgtgactccctatccaggggaaagggag

SEQ ID NO: 60426 - DNA, 854 bp, Bovine  19866880553210
atataaacatgcatggattgtctgagtttttaaatctcaatgcagtaaatgagtttcaagacagaagaaaacagtagagggagctttatgctcaagcagctaaaaggctgcaaagcaactgcacacagtgcctgggtaggagagaaaaatccttaacaaggtcaaatttcaaatctgcatgtggaactgttcatccttgtgcctgacaccacctatgcaagctaatactaaaaaaaagagagactgactcaacattttatatcagaggattagaaattcactggtttctaatatttccacttagagtttccaactgtacttggtatgcgatacattttcggtgccatgcatgctaagtcgctgtcacgtcccactcttggcgatccgatggactgcagcccaccaggctcccttgtccacgggattctccaggcaagaacactggagtgggctgccacttcctccttcagggccattttctatgatgcctactctaactgttgataagattagttattggttgtaaatattttactactttcatctcatacaagacaaataatgaagtcaattttcagtattaaattctgattcgattacttttatctatttgatttcataaacatattgagggttttattcctgatagaattatgatgcaaaatatctcaaatgaaataattttaaagtgctctgaaatccttcactttcatgtgaaaaagaaagaagcaacctaatattacaaactaatatttcttggtatcaatgcaaaaccaccattgtatggaattaactggttagtctcagttccacttttttaataaagcaaaccccaatgcttacattcttaggaa

SEQ ID NO: 60427 - DNA, 1003 bp, Bovine  19866880718001
ttggtagtttctgcccaaccactcaacgctgctgttatagcatgaatgcagtggtagacaacagataaatgagtgggcatgaatgtggcccaatgaaattttatttatggacactgaaagttgaactttatgtaatttcatgtgttgtgaaatactgttcttttgatttttttctttaatcataataaaatataaaaaccattcttaggttcactggccatcaaaataggtacagctgcccccctaaactaaagcctataatacattgagaatagtacctgtaaagctctaaatgctcaaaaagtgtttgctgctattattattgttgttgttattattaacacatccagcatcattctctggacccctcccctattcgtgttgccttcatcccccattctgatagcaagatggcgaccagagttcaaggtagggcatccagaggaaaacaaaactctctccagtcataaattgttaggagaaaggagacgtttccccatactcaaggtctcagtcgttagaatggggtcacgtggtccctacggaaccaatcactggcaagaagagggactactctttgaccaatcaggcccacccctgcagctggggggtggagtcacttcgccctgagtcacgttctgaatggggacaaggcgaatgcctgaccccaacagatcttttgttaggacacagcaaagtaggacaaggacactgggtaggcaaccagcacagcctatgccacccactctttcaaatccccatgaatttatgacaagcagaggacccgctaatctggtttatatataacgtcttataacaagagcaagtcttttaaagatttgagctggagaacattggctctactgacctttaagtctttttaaatagccactgtggtcataactcattggatcataagcattccaaacaactttatggcctttttgagtttactacacaccctccctgtcagatgcctcatttgaccttcacagttctctga

SEQ ID NO: 60428 - DNA, 1006 bp, Bovine  19866880719794
cattgaatcaccagggaagcccaaatgttccccttgtctgacctcaaaagggaaacatcattgtccaagcatctctttgtttttaaatcataattgtaatatgtgcctccttacatttaagccctatttttggcttactaactttgcaagataagaaaagggaatctcaccccgccccccaattaaaaaaaatgattgagtcaattgagtgtacctaaggagtattacgcaaccattagctttaatgcttatgaaaactttgcaatgccttgagaacactctgaagatagagtgttaaaggatagaagcaggacacaaaattacatatagataatgagatcaggaccatagaaaagattggcaatcaagaaaccaaagtgttaacccatttgcttctgggttgtgcagtcatgagtggttttttcccccagcttttttatatgttttccttatattttccagtctgtctccaatactcatttttatgatcagagaaaaacataaagtaaaagccagaagaaaactgggttgttatgcaggctagggtttcttattatatagacaggtccaggcaataaaggactaagtgaggcaaaccagaactgtttgcagagtgaaaggatgaaaaccacaacttgaaggatgctcgtcctccaggggtaggtgtgcagcctcggcacggttggctgatgaggaaatggacagattcctccagctacggagtcagaaactcacaagccgtgtggcttcgagcaaatgaaccactccgaccttcaatttcttcatctgttacatgagaataataatgcctagtatataggattgaaatgttttcaattacatatttttattgagttcttaccgtcgtaggagctaatgatgcaatagtgagcaaagaaacaaagtccttgttctccgccggcacattcattctagtggagggtaagggtgaattttgtcctggggcagacaatagcttagcgctttataccagagagtgttctta

SEQ ID NO: 60429 - DNA, 1965 bp, Bovine  19866880744339
ctgcagctttgggtgtcatttggaaaagagcaaatttataatgcaccttccgtttgacctagcaattctgcacagatgtgtaaagacctatagagcaaggatgtgaactaaagcctctttgtagaaagcaacttccatgtccatcatttggggagtagtgaacagtataatttaattccatgcagctgttaaaaataatgagttagcactatgtatacttatacagaataatctcaaaaagagattattaattgagatatccctggaaggttgcaccagagataatggtaatatcagttttctctggggatagagagaatagggagaaaaatcacttttcactgttttgcatttttttagccaaatgtgtatattacctattcaatacagtaagttttaaacaacacaaatcaatagataaaattgaaatcaaattttggaatcaaataaaaataaatagaaagcaaataaagcaaattgggagggaaaaaaaaaagagaaaacctcatctagggagagctcttcggctgtcaaagcaaaagccccagagtggaaaagaaaaggccagaagtgcagtgtgcaattgcctcagcaacatgagtaacagaatgaggacccaagagaactgggttctagtctcaagtgggcccctgagcagccctgttatcttagacaaaccacccgacctctctgggcgtttcctcctgtgtgaaaaggcagcccaggtgatcctccatgctaagtcatttctagcaatgaaaccctttgactctgcactgtagagatgactgataaatatctgcagagcccttaatagagaaagcaatgggagttgatggatagcttcaggagataaaatcaaaacaaaaaaaaaagccatgctggcgactaggcagcagcaagacaccaggcacttctgagtccagttccccatgtggggggctcataagaagcatcctcgttcatgacgttcatgagtttccctctttgtgaaaatgcctaactgcccaggcaggaaatggatgggcccctctgcacaagtctcaggtcctattctaagaatgacaggttagttccctttcatggttaccaaatgtcatggcagagagaaaatggaagcaaaaacctgaccggaggaggaaccaccctgttagaaagaccacaggaagccgccacagctgcagggtgggagtattttgtaggagttaagaagacggcttcagagtaagacacacctgggttgcagtctctgctctgtcatgtgctagctgtgcagccttaagcaggtcacttaacccctgttccatgagttgacctcccagagcgatagcacagagagagatctgagcacagtgatcaataaatcacaacaatcacaagtcacttgtctatcctagtacaacggaaggtagcatccagtcacctcacttggaggttttttcccttcaaccttagtttcattggatgtagtttatcgtaaataacaaaagtaacaaaatgctagctgtaacaggttaaacagcatgggagcatgccaaggaaaatctttaccactaagatcaccaaactcaaccaaattattaggagtccttatttggcttcctccaagatcataccaaatcatattggttggcccaataaagttccttcagtttttaagtaaaaataaaagacacatttttcattttctccaagaactttattgaacaaagatataagcatctgaatgcagagttccaaagaatagcaagaagagataagaaagccttcttcagcccccaatgaaaagaaatagaggaaaacaacagaatgggaaagactagagatctcttcaagaaaattagagataccaagggaacatttcatgcaaagatgggctcgataaaggaccaaaattgtatggacctaacagaagcagaagatattaagaagaggtggcaagaatacacagaagaactgtacaaa

SEQ ID NO: 60430 - DNA, 570 bp, Bovine  19866880897785
ttgtgggaatggtgtgtctgtattgtccagataacatctctgccctggagagttgtgattgggcgactcgggcgtctaggccatggggaactcaaagattgtattaaatctttagattgcatttggtagtatagtcattttcacaatattgattcttcttacccaggaacatgaaatatctctccatctgtttatgtcatctttgatttctttcatttgtgtcttataattttctttatatagttcttttgtctccttaggtaagtttattcctagatatttaattactttttgttgcaatggtgaatgggatatactccttaactgctctctctgatttttcattgttcgtatgttgaaatgcaagtgatttctgtgtattgattttgtatccttcaactttgctaaacttactgattagctctagtaattttctgatattatttttaaggttttctatgtacagtatcatgtaatctgcaaacagtgacagctttacttcttttccaatctggattcattttatttcattttcttctcgattgttgtaactaggacctccagaactat

SEQ ID NO: 60431 - DNA, 1534 bp, Bovine  19866880974183
atttctttcccttttgaatgtatacttgctacagtcctaacaagatgcgattttcatgtattacattatcttgtaatacatgattatgattagtttgtttatatccccttgacaaaaaggaaaggtcactctaccaggaattagttcatgtcattaatacctaatgagacaccatcataaaattctgttttgtctggtaattacagggttgcaacagttgccctgggcatcttactctgcttggaaccagatttaccaagtcccaccacttcacttgaaattctcaggtcaactttaaaaaagattttttttttggcacttaactgcttctagtcagaacaaagtaataaagcaggtaagaataaaagttgaggaagaaagcttggcaagactgaagtcctgatttttctctgttaaggttattttcctcagtgaacattagttaccaaggaagatgcagatgcagacagacactgggtcagtctcacttttttctttttaaggcaagcagggaggtgtggaaagaatgttttagttatctagaaacagcgtttgtccgggctgcaacttggtgctctgctcaggttggagtctaagcaggtgtgtcgcggtgcgtttaaaatcacccacacctcagaacaggcagacacgctgaaattataacagcccctttcagcatctctctggccagtgctccctattttatgtctttgtctccttgcttgcaaattaagcaggtttcaatttacctgtttcataaaaccacatgatattcaggagaactggccctgccagagctaaagtgagagggctgacttggaaatgtttgctgtggaagggtcatccatttaacatgtaagatggtccttgtcttaattaatttgagctcccaacacttttcagaaagcatttacaagttagcttctcttatttaaatcttactttgtttacttagaggcttgatggagctcttactaatttatgttatttaatatataaaattatttactatctgcctcctttaagtgtgtgatttttaattgtagaagagaatgtttatgtagttctatctatgtgcacacaccaggttttgttttttttttcctgttgacctcttatcactacaaaacttaggaatttatctccctatcaggtctaggaatcaaggtcattttttttctcatgggatgaactaatgactttccagtcatttctgtgaacaggagagtttacttaaaatgacaaaaacgacctcagattgggctgactatatactaatgctgtgagtaggcacacgggaaacgtttgttgaaagggtggaatgaatacacatcaaaactgaaatttaccagcaaattcaccacctgctgctgctttttggaggagcagaaaatatatattttatatactagaaaatagaagaactccttttatttttctgttattgatttaggttttctatttcttatgccaattttggaaattgaatttttacagggaaaaaatgagttttccaacatatactactatgcaa

SEQ ID NO: 60432 - DNA, 1106 bp, Bovine  19866881030540
aattatttcataagcatcatttttcatataccattatacttaatatgtttctctcccctacttgacagagtgtcctgtgaccaaatcacacctggctgaataaaaaccatcagggtgccatagatcacaaagccagaagagatctggtatcaagtgaatagaaaaaagcaaagtcttcccactcacctgtattttaattcctgtttagcagctttattgctcagcaaattgttttctgaggaaaaatttatatgggtccagtaagttaaaagttagattatctcacttggttgtcacagaaatcctaaattagttatgtgaaactaacccattatacagctgaggaaatgaaagcctgtgattaagtaacccatttcaaggtcattacagcaaggaggtggaaagctggtactacagtccaagctttgtgatacttggtttactgctttgtttcatgacactatccccgctctggataatcacagcaaagctaaaatacagaacttagcatagaggcagacagactaaagagccacttttatagttttctctagctctaagagtccacatccaaggtatctatgatagatttggctcctgctgttcctctaaatgactttccagaaaatgcgtttcccaaatccacactttgccattcaaaagtctaaccctaactaatctggcccatgttttctaccgctctcccaaacaaactttcagctccccacagctgcttactgctatgccacatacagcacatgtaaatactcactgctttgtgctcaggctgctatcacattcctatgtacacttgtgctaatcttttgtgttctccaggcaaactgccctaatgactccagctcacagattttagcctattacttatgagatcacattacacgttttattataagtgctctcagttctctacagaagtcagtataaagtggttaaaaccaaagacccagagccagatgccctcctcttccacttacgtgtcttctgggagttcctaacatctctatgcctcagtttccccatgtataaacaggaaatcttagtatagtctctaccacacagtaatgatatgataaaatgagttaata

SEQ ID NO: 60433 - DNA, 1672 bp, Bovine  19866881056202
aatagcaggaataaattgccgataacattccattagtttattagcaggttattttggctttcataatgaagtactatgttactgcattgtatttccccaattaaaaaagatttaaactatagtttctggatgggatgaaattgaggaaattctttgaaagaaattatttcagttctacagactcttgatttctaaatgtaatttatgagttaaataaggaataataatatagaaagttttatgtatagggactttatagtaaataatagataaaaaacggttcaacaggaaatgattacttttttgctgtattttgatacataatgtatttagaaatcttgataggaagaaatgaactttctacccccttaaaaaaaatcaaggattgacagaaatttgtaaatattattagcagatttatttttctgtattgaagcctgtttttagtgttctttatgtgaagaaaacagtcaaaattgtaattttctttttccaggctgaactcacaggaatcaaatggcgtaggtacaattttggagggcacggggactgtggacccataatttcagccccagcccaagatgatccaatcctgttaagtttcatccgctgtctccaagccaacttgctgtgtgtatggcgccgtgatgtcaaaccagattgcaaagagttatggatattctggtggggagacgaacccaatctagtgggtgtaatacatcatgaactacagggtaagttttttgttttttcttaaaaactatctgcattatatatgttttgaatagtggtaaattctgaaaaggttattaagacttgctaagaagaaaaatccaagtatttaatggatttgtgtcaaaggaacctctttactctcacccctcttctttccacccctgtttttttttcagattctttcccattcatactgggactcagtaccttgagagccactctattaaagtatagtgtcccctgggtgtttgggttggaattgaggctaagatctactgtattaaaatgatagtgaaatgtgagttattagagcaagtcagtgaaatgaaaagaattttttttttctttttggactcgtgctgttatagtttttgccagctgagctctggtggaaaattgtaaagtgataatagaaacttagtgcaagccttattggacagaactatgaggtgtcattgcatagtatatttaaagaaagatttatgtaaagaatctactctggttttgatgtagcatgttttcctgtgttttgttcctgctttttatgtaagtaggtgattccaggaattatttgctctaatgctgcctaatgtttaacttcagattacctctgatatctggaaattttgaattagtataagactttgatttttctgagctatcgatactttttgtatttaccaccaatttataaccagaggaaattttattgatattctttgaatttctagtaaaacttttttacctctttccttaaatgttttcgtctagtatgctaaagaatttttctaaatcagggctaattctgatttttagttcggataggtcattaactcttttggacttagtctcctagagccagcatttataacgtctgctgctgctgctgctaagtcgcttcagtcatgtccgactctgtgcgaccccatagatggta

SEQ ID NO: 60434 - DNA, 852 bp, Bovine  19866881317317
actgcccaaatcttttttgcatttcagttacctttttacctttcttggagtaataaagcataatatgccaaaatattgcttttttcatctttaatacgaaattcacaaaattttcaacacaaaaattccccggttttgaaaagtttttttttttttaaacgcacacttacgtatgacagctgtcacaatccaatccaggaattgttttgaatgattttagagaactaagcactactagagccatcttatggaaagaaaaaaaaccacaccagtaatttattgatctgaagaggataattttgataagccagttttatttaaatggccatgtgaaggtaatgggatcataatatgaagttagtatactgacaacaatcttgtgccctgcactgctattttgttaggcacatagacacatgtaattacctttgtaagtggtatggggtgaattaagtggagcaaccatacggcagaaatgctttggtgatgccatgaattgctgcttgaaagcagtgtagcatagtagttgagtattaggtagcaaataattaagtctgttgaatgtattagctttagcagtcagactgcttacgtgcacagactaccataatcttttatggaacatttaccctctgctggagacagttttaggtacttttagatattatctcagtaagaccctgatgctggggaaagattgagggcaggaggagaaggggacgacagaagatgagatggttcgatggcatcactgactggatggacatgggtttgcgtgaactccaggagttggtgatggacagggaggcctggcgtgctgcggttcatggcgtcgcaaagagttagacacga

SEQ ID NO: 60435 - DNA, 3976 bp, Bovine  19866881455527
tggagtggattgccgtttccttctccatgcatgaaagtgaaaagtgaaagtgaagtcgctcagtcgtgtccgactcttagcgaccccatggactgcagcccaccaggctcctccgtccatggaattttccaggcaagagtactggagtggggtgccattgccttctccgttataatggctaaattactcttattaatttgtggttgaaaaattttggttagtgtttgaatgttttgttactgcgtatatttaatttttttttataggaaggagtaaaactaattttaatgtatctgaggatctattttaaagcatctaaatttccctaaaggatttcccgccaacttctgcttgacaccttcctggcttttctttacagccacttttttttatctgtgatatctcctgccacaacagccagagggcagtaaaccacagtggactaattgagctgtttactttatggtccatttgttcagctcaaacctttctcccatagttttttagagtatttggtttatatatatataagaatctattctgggtaagattgcttacctagctggttagtcagcaaaatctcagaattatgtacatctcaaagcttattacatgtagtttgcagtgaactcaggtaaaattagttttaaacatctggtttccgtttaatcagagtttttaaaataaaatacctcctaaaagatagcatttatatttgtccatttaagtatcaaagcatatctttttcttctttcacagtattttgcacacatggtagaggaatataacttttttttttttttccatttctttccccttcattttctgtgattgtttctgactcagtctcactctctttctttttccctgttgatcctttatgttttaactttttggtctggtctttactgttagcaacacaaataatcattttataatgaagatgaaaccaagcccaactattacttaagcttatttagttgttgtataaagttatttatccataccaaaaaggcacatggtcagtgtttttagaaataacttgctaagttactgtgttatttctcatgaattttgttactgtgttaacgaaaagatgtagcctgtttgaatattttatagttgctatagattgcctatgtacatttgttcatgttttaagtgttttttgtggtacatatttaagattaaattcttttagatcgttttataaattacagaaatattacactttaattagaaagttaggaaaacagaactgccaaaggaagaaaacaaaaaaaacaagaatcccgaagtctaaagcagagttttaatgtttggtgtttctgtgtataaatgaaagtggtatcatactgttttttaactcagcccttttcacttaacggtgtcttatgaatgttttcgcctgagaatgattgcgttttaattttcttccctattgagtctgaaaacagtgtaaactgtttattttttggtatgtcaccagggaagtattagcgtgatgaaacaatcataactttgttaagtacatctactctttttaacatgttgaaagtgtgaaagttattagatcaaggcaaatgatcttttctgtaggtaaaagtggttgcaaagagtagtttcacgtttcaactaatattaggaaatatatgaaacttaattagaaaaacgagtgacataaagactgctttgtttcaagtgagggagaatatgacatgtagagcaatcatgaaaaaaggataccaggggagtattgtaatggcagtcacacagatttaggatactttcgatctgtttcattctctagtatgtgtaagaatgattccattttgactaaagtaaattttgtcagggtcctttaatattaagataatggtaccattatttgtagcattctctgtttttaagggacattttactgtcctttaaaaaaatgctttttagttatgctattaggcatttacctttgtttttacagttaagcccaaatagcattctactaagaaatgtcacaaagcattgtatttaagtatatgcagaaggagaacaatcctgtaggatacacatagttttatattacattttttgttcaattgcttaaaatacctatgaaatagtctatgagaagactaagatacgtttataactggtctctgtcacttggatgaacacttttgggctcttgttcagggagttgttgtttatattgtatagcatagtggttcagaggtttgggtttgaatccctgcttattgacttgcttgctctgtatctttggtttagttatttaccttattcgtgcttcagtttcctcactctaaactgggttacaagaataaaaaatgtttaagtactcagaaaagcacagagagcaagctaatctagaattgtgactactgctgctacttcagtaccagcaattaactcagacgttaaaatgaaaacattttggcagttggtctatgtggtataacattcactatttgctgatgtttgtcaaatactagttttttaaagtatacttttagattgaagtaatcatttttgagtttgttaatgtcgaataactgagaataataaactgagagcagtgaagatgttcctattcataggaaatttgtctagatagagtctgtaaacagaatttcataacagaccttaaattatgttgtaaagaggtcagaactttaagatttgactctgttggatccctgtaatgtagatttgtaactttactgccttttccacatagaggtatcaaaggacactggctgaatactgaatatacaagtatttccttccttgtttccatctctaagtacctgtatcagcaggtccaattatagggttttgaaatctctacccttgataaattatagtctgaaaaggatataagacaggcacacaaatatgtataatgcagggaacactgtaagtatataagagaaatacagtatattgactgctttccacattagcaaacattcagttccaggtgtgtgctgtgctgagtcgctcattcgtgtccaactctttgcgacctcatggactgtagcccgccaggctcttctgtccatgggattctccaggcaagaatactggagtgggttgccatgtcctcctccaggggatcttcccagccgagggattgaacccagctatcctgcattgcaggcggattctttaccgtctgagccaccagggaagccctcaattccaggactaatgcataaataagtgttctataaagttttcacaagaacactgtaagtcctagtgagaaaccttggtttctggtctgtttatttagtctctattaggcaagagctgtgatcagccctggatgtgtaaaaatgaatcctcatctttaaggagctcacagtcttactggggaagcagctaaatgagtccataatgatgatatagtggagtaagctccaaatgtttaagttagggatctcgcagaagtaccagatgcgacttcagggaaagagatagggagataggggtgaagcccagaggctgtgaggcttgcggtgtcttacaggatacatctgttacataggttgcaatggaatttgccctagtcagagaaagtagcctctgtaaatgggccttcaggcagtgaatgaaccgtggaagaggcaggcttgcccagaacgtgggatatgagtgagatagttgggggaaacaaaaagtggggaggtgggccatagtgtggagttcactgaagcaaggacttaatctgatagattttgaggaattgttacaggtttctgatcaagaaagataattagaaagattatatatacgatattgaatatgggcaggaagaccataatattgtaatattttattctgaattgagttattaaatgtttttagtttaggatacagatttaaattgaaaaataccaatgactatgtactaaactttatattgatagtttttgcccgttttattttattataa

SEQ ID NO: 60436 - DNA, 1346 bp, Bovine  19866881478574
atggcttattgtcttctaggaatgtgacttgaattgattaaatggcataggcaacaacatctgttttgtgaagctagtttagtgtcataaaactttaaatttccaaatttacaacttacaaagagaaaacagtgtatttctcttttgctgtaaaaaattttccactgagttttatgatagcttgttttaaccttattaagcgtttagcttgttttcttgttgttgttcattgtgaaggaaaattaacattgggaatgttggaaacttacagtcttagatgagtaactcttagctttcttaggtcatttatgcatttgagatctgcggaaagctttgggtggtctaggaaaaccacctatgcacatacttctaaaactgtacagttggtgggaggtggagctccctagggcagatcccctgaagtacattgcttcctggttgatgtcctttgtttgacctctgttattaagtacatttatcatgttgttgactgtggaccaaagttaccttttttatatacagattttatactcattgaacatttgagtcacttttacataaaatatgttgatgtacacatgtattatttttctttccctgccttattatctgtttttattatttttccttgttcttccagtttttttccagagaaggaaagctatccatctcagggtttcttggtttttacagccgttatttggatacatttgatcacgaaagttcatatgatagattgtatggtattaacaatgggcttatctgatttcattttgtgacgttctttccttgatactttctgtgcgtaatatttccaaatgatattttcaatgtaggtatagaatgccttagagaaaattgagacttaggtagagtcagatactcttcatatgacaagccacaggggcttgtccgtcaaaccagtggatgtgtgctgttgtgtttggtggagtcagcagtctttgtgtagttttcgtttacagtttggaattttgccagtgcttcaaggctagcttgaatgtttattaatttatcttgagaatgactgctcttcttttgtaaccttctctccgaattggatttcttttaaactcagaggctgggcctatgtgtgttcctcactctgtttttaagttacaggaacaatagccattgtatctactgtgtgacaggaacttatatgatgttatctacctccagccctttattgtaaaatttcaacttggtgactaatgttctttaattttatcaataacatttactcattaagacaattaaaattcattaataggaaggtgagtttcagtgaggggactgtctttgaagcatgcttcatatgtatcatt

SEQ ID NO: 60437 - DNA, 1425 bp, Bovine  19866882042575
tacttggaaaaccatagctttgactataaggacctttgttggcaaagtgatatctttgatatttaatacgctgtttgtcttttaattttaatccctaatatatcacataactctaacatcattacttgtctaatggaaatatttgaatccacataaatttatttgaactctattcaaatatgaattcatctttttaatcatccttccctttatttttgaaataaaaataaatattttggggaaaaataatgtatatatctttaaaattaggagaaattccaggtctttattacatgattgagaagcagaatattctgtttgtgtttctttccaaatgtattcagcttccaaatgcttccggccacatgcattactatcatttgaatctgagccacatccattgttgctggtattattgcaaaaggctctcagattttcctgccttttcaattgctcccctgtaagtaattcttaccacaataataagacagagtctttttaaatgaaggtctaattatgctgggctcaaaattgtaaatagttcttcatttattcaaagaaaagacagtccttaagcaatcccaccttctgtgattcagccactactcactcccccaatgagcttatttctttttagagtttcattttgtgatttcctctatagccacactgatcctctctgggtcctaatgaaccaaacaatgcccccatcttatagcctttacactggctcttaccagggttaatccacatctccttgaaatctactcaaaccattgccttcacaataaggtcttttacattgaactccactataatctataagttcctatttctagctggcctccccattattctttcccaactctgttttatttacctgagtaaccataatgcttggtattctaaataacttattcttatatttaatgtttattttgtgttcatccagccagaatcattgatgggtcctaagtgcctcaaagagtttctggcatatacaaatatgtgtatacctcaaaattattgtatgttaaaataatattatataaaatactttttttttcattacttgccctttatttttttaaattttattttatttttaaactttacataattgtattagttttgccaaatataaaaatgaatccaccacaggtatacatggttccccatcctgaaccctcctacttttaaaatatgttttgaggaattgcatttttacttttagagtaatttaactagtactgtctatatatgctcagtcattcagtcatgtccaactctgcaatgccatggactgcagcccaccagatttctctgtccatggagatttttcaggcaagaatactacagtcagttaccatttcctacccccagggggagttccccaccgaggaatcaaacccatgtctcctgcat

SEQ ID NO: 60438 - DNA, 1540 bp, Bovine  19866880066361
gcaactaagtatgatggatatgctgctatggtatttttcaaggtatggttcatagagcatctgcataagaatcttctgaggcactacttataaaatgtagattcctgggccccataagaaaccttggaaatcaaaacttctgtaagatcaggaaatttgcatttctgacaagctcactgagggcactgacttgaaactcaactgtataaatccatttaatgtcctactatttaagaatgagattggttaaaacaaaaacaaaaggacctctctctattctctaagtgaagtcgctcagtcgtgtccaactctttgagaccccatggactataacctaccaggcttctccgtccatgggattttccaggcaagaatactggagggggttgccacttccttctccaggggatcttcccgacccagggatcgaacccaggtctcccgcattgcaggcagattctttaccctctgagccaccagggaagccactatttaagaatgagattggttaaaacaaaaacaaaaggacctttctctattctcctgaattaaacataagtagtgttttttggtgtgtgtctaaaaaagtttaggagacagtaatattgactataataccatcctcaaaagcaatacctcaaagtaaattttcactttttagataaagctttaggatagtgtagttcttaaccaaggattaataatcaactaattagtcttcactcagtatagcagtccacacacaatttattcagcaatagaacagaagagaatgtcaatcatgacagacataaggcagatacagggtagatctctggggtacattctttatacagactaacaaatgacttttaacaacatgtggcaggcatgatttgttgcataccaacagccattcattcctcacttcttcctagaagagccctgattttattaggggatacaatgtgtcctacccaggcaatgtcaactccattcccctctgtcaggtttccaggctcccttgtgaatcaaggatgtaagggaaaatccctgatgtaatgagatgtaaggaaaaatctgagggacttttgagagaaagattttcttcccaaataaaaaacagagacttgaaagaacaaaggtttttgctccctacttccagtctttgagagagattgaaatgtctggagcagcaacaagctatattgtactcactgagaaaaccgtgaggacaaaaagccaatacaataaggatcccagaggggaaagacagaaagaacctgggaccttgagaacatcgttgagttgctacataagcaatggattatttagcatcttaagtggaatttttaaattgttaagtggactctgagatgttttcagctgctttttccaagtttcttaactcaaactctggttccatgattcttatgaacaagtgaaggccagaatgaggccaatgtcagggtaagtccttcttagttccaagaaaaatgcttcccctaaactgttcattatctatatggagtcaagtttgataactccttctgtcacttag

SEQ ID NO: 60439 - DNA, 846 bp, Bovine  19866880386214
atattcaactgaatgaagaaacaatctttgtctgtgatctgagtcactgatgacacgtacatactccataccggctctttacagatccgaagtagcacaggtcagcaggcatcagttctacaaggcaccactggttttgtgagtgaatgaatgaaagtgatgtaatgctagcatctgagatctagaaatattgaaaaaaaattgaatatggtatatagattttccttccatttctattgattttatactgtattgatattgatctcatatacactatgttttaactatttgttcaggaaggtctcgcctcaaatctagcagaagagtccttcacaaaggccccagtgaaaacagctcctttaggtatgtggccctacactcaattgagcacagtgtcaggtcttggttggaacagatttatacgtttttcctgtgacaaacactttcaaacagattcttcctcccatatctttattatctctctataggtatcaataaagacccctatatctgattactgtttttgaaaaaccttctaccctttagtcacttgactttggaggtcaaaacctagctgaaatattcgaggttcatggtgatagttcctaggtatgccatgtaatgggttagatccttcactaggtcaagatcattttactaaagtttctgctttaggggtgaaatgcaaatcaataatcactgtctccataaacactgttctagagctttcttacaatcacagaacatgatccaacaattaatactagctgttaaaacctcttagaatctacctaccatttctacttcctctcactaagtataatatctcctgcatttttctaattg

SEQ ID NO: 60440 - DNA, 1072 bp, Bovine  19866880391631
tgatgtatagaacagtcttatggactctgtgggagagggagagggtgggaagattttggagaatggcattgaaacatgtaaaatatcatgtatgaaacgagatgccagtccaggttcaatgcacgatactggatgcttggggctggtgcactgggacgacccagagggatggtatggtgagggaggagggaggagggttcaggatggggaacacatgtatacctgtggtggattcattttgatatttggcaaaactaatacaattatgtaaagtttaaaataaaattaattaaaaaaaaaatctggtgctagtggaatcatacggcattgtgtaactctcagtcatgaccttttaaaagcctcgtaattgtgttgtaacaagcctttaaagatcttggaacagtccagtttatttcagtttagtcactagctgtcttttaaggaagttttctggaggtttggtcaaaccaattttgcttgtatctcattggcaagaacttagtctcctggccacaccaaggtgcaaagggagactgggaaatttatttattctgggatttaagtgcccaggtagcaaattaagggtcctgatactaaggaacggggtgggaaatgatagattgactggcaacagtcactgcagcaactgtctgttgtagttcactacccctggtcttctgatcatttcttaccttcttctggctgtgtaagtgtgactacattcttctgtttccctttctgccttttcttattttatttaaatgcataaatgtgttagtctttagtctacttggaaccttgaaaaagttcattgttctttgtgatctcatcacttagttacaaaatgaagaaatgtccctcccgtatactgcctttgggggtgttcagtaattcagttctgtgaacaacacttacttggtcccttggtctgtcgtgtactacgttaggagctgagattttggagaagtcatttctcatggtagctggtactaactactacatataaaatggatatgcaagaggagcaacaactgaattagatacctttgaagtgttcatgaaagctataaag

SEQ ID NO: 60441 - DNA, 1271 bp, Bovine  19866880446095
ttgcttggctaccggcaggtggtctcaaatgtggggaaataaaaagctgcccagccttagaaattggccacagacgtcactgcaggaagacaaataaatatagaacatgaaggggttattcatttagagccctgctcctccaacatcgccctgctgtgattcaccagatcaattcaagatgccgtaattcggtgtgtcagggaggctgggaagagaacagatccaacccctcctgcctccccccaaccccagccacatcccctcttccccaccccttagccctcaccttagctgcctctgatgagattcgctcctcccttgccttgggatataagttactacagcttgtttcaagaaaaccaattaagaaaccataaattgcggttgactcggaaggtcagtgcacaggctataaatacaggcgtttctaacctgtgagtgcaagtcagtctgaagcccattctctcctccacacccacgtcttccagctgaagcttgcctctgatgaacagagagcacgtccaggatcagaaaggcacccctggtgcctttaaatctgcggcctgtcggctggagtggacctgagctctggaggaactgcaggcctcagacaccttagctagactcccagttttgtttttcttcataacaatcatttcttcacagtgcataaaacgtatataggttcaaggtagaaacttggaaaatagtgaaaagcacaacggggagataacccatagttctaccccttaaaacaaatctaacattttaggatatgttattccatgctttttcccccttggctatatatatatacatataacaaataaggagatatatgtatgctgctgctgctaagttgcttcagtcgtgtccgactctgtgcgaccccatagacggcaacccaacaggctcccctgtccctgggattctccaggcaagaacactggagtgggttgccatttccttctccaatgcacgaaagtgaaaagtgaaagtgaagtcgcttagtcgcgtccgactcctagcaaccccatggactgcagcctaccaggctcctccatccatgggattttccaggcaagagtactggagtggggtgccatcgccttctccagcgtatctccatatttgtttttcctcacaaaaatgtgttatttaatgatattgttttggagcctgcttgctcagcaatatttatgttaaagatatttttccattagtgtgtgctcagtcagttcagtcgtgtccaactttttctgaccctatgg

SEQ ID NO: 60442 - DNA, 886 bp, Bovine  19866880478314
ctaggtgttgtttttgttttggttctatcccttcattctttctggagttatttctccactgatctccagtagcatattgggcacctaccaacctggggagttcatttttcagtgtcctatctttttgccttttcatactgttcatggggttctcaaggcaagaatactgaagtggtttgccattcccttctccagtggaccacattctgtcagacctctccaccatgacccgtcttgggtggccccacttggcatggcatagtttcattgagttagacaagctgtgttccgtgtgatcaaattggctagttgtctgtgattgtggtttcagtctgtctgccctctgatgccctcttgcaacacctaccgtcttacttgggtttctcttaccttgggcgtggggtatctcttcatggcttctccagtgaagcacagcggctgctccttaccttggaaatggggtagctcctcttggccgccgcccctgagcttggacgtggggtggtaattaagtactcattgactgaatgaatgattgtgtgtgtgaggataagtgctgtagaaagtgaataaaatggtatgggaaacagatgaagtagtaattcttaagggactgcctgggaaagatttataggagatgacattagaggttggtcttgaagggtattactgctagagaaaatttaggaaaagaagatatggagataatgaaagtttcgatgtttagagaaagcgtgctaggtatagctgtttgacaggagcagttggtatactgtgacaatagcgaggggtaagacaaaattaagggttgtgaagagttcagacttccatcgtgctaagggattggaactttatcctatagataagtcataagagttacaaaaga

SEQ ID NO: 60443 - DNA, 2543 bp, Bovine  19866880617028
cgggccttttctttggccgcccggggctcgaagtcgccgtacacttcgggcggctcttctgagaacctcacttcccgccggccgtggcgcgacggcgtaggagttccgtacgcaggcacgtcacccgctgccgccattttgaggggcgagtcggggccttccctcccgtagcggagccctgggcgtgacgtacagcgcccatccttctctctccggctccgcccgctgcccctcgcctgccatagttgttgacgtagcttgagtcgatcgcgaaaggtgttttgcggtgcccttaagagtctcctgccgttggtggcgatcgtttttcgggagtgaagggcggtggtgtcggcggtcagggaggcagttgagcgtcgccggggctgccgcctgcgtcgtcgctgctgtgctgcaaaccggcctctgggcccatggtgtgctccgagggctgtgggagaggcagtgcctgtgctgggtcagctgccgcgggtcactcccgcctcctggctgaaggcactaaagaggaggagaagagcgaggaggcgtcgctgtcctcggccttcggggagggagggagggaagacggagaagggacaagtggctgggcaaattgccggtccacagtccagctgctcctggcaactgctgcctgactcgcaagaggcgctgggtcgggcccccagcacagcgtagctgggaaaggcggagtgaaacgcggggtggaggtttcgctcctcagccccaggctgttgcgcagttttcccgcagcctttttgatcgactcctgccttcgccgtacctttccaagtgtcgctttgcagggctgataagacatattcgcaggtgtcatctttccctggagaaaattttagtttcaagttccttgggaaggcagtttaccagttttaggttttaaaagtctcgttgagtgtacgaaatcgcatctacaggcttacttgggtggatttccatttacaaaacgtacgcagcaaccagtattactcctgatttcgtataaaggctgtacttcagcaacactgttcagagactttgttagtgctgtgttatggacagtgagaaatcaacaaatactttgattaaagacagcactgtaattttcagttgtgatccattattttcactttgattctgagcatgacttgatacactgcatttgatacagggttttttctgcgtttagtttactgaataagaaagcacgacaaagccatttgtttcacttctgtgtggaaaatctgcaaatatctaaagttagacacactgagggaatgttattgaaaaatcggttaatcttgccttcacatacacacagccttctcggacgattttctataattgattttagtgactagacttaaaaatttgcagtttggatagcagttacagtgaatgggcctgaaaattttgaagtgaagtgaaagtcgctcagtcatgtccgactctttgggaccccatggtgtacagtccgtggaattctccaggccagagtactagtctttcccttctccaggggatcttcccaatcaggattcgaacctaggtctcccgtattgtgggcatattctttaccagctgagccacaaaggtgtttactctttcaagtatttaaaatcactttagaatgtttttgagcaactcattgtccaaactgggtacatatttcattttaatgaaatcttaatgatgtcgtgttttcactaatagtccataaatttggtcacagacccgagtaattacatgctttagaatcacctaggtttttgcttgatggaagctctcgtttagttttctgttttgttttttttttaattatatacaatatagccaaagaaactaaaggaatagcaacatgagagatgctactttttaaagaatcttttatcttagggaaaattaaaagcatgttctcccttgtcagcctgagttagtatatttggaaaatttgtgagaattttctctgacaaaatgctgagaagtgttgatacttgattaatatctggcttttactggttttaactagtgctttataaggtacctattatattactctattaatatgtaacaggaaaagtactgtaatagatgaaaagatataatagattcaaggatataataaaggatataatagattaaaggatataaaactatacaagtagtattaataaaattcatattatagtggtaatattgatacaaatattaagctctttaaaacagttatgaggacagttaactttatagaaacttggatacagattgttaaacagatttgggggggatgtattaaaaagacaggagattcaatacattagtacatgtattgttgctgctaatttgcttcagtcctgtcccagactgcaggcccacagactgtaccccaccaggtcctctgtccatgggattctccaggcaagaatactggagtgggttgccatgccctcctccagggaatcttcccgacccagggattgaagctgcatgtctatgtctcctgcattggcaggcaggttctttaccactag

SEQ ID NO: 60444 - DNA, 776 bp, Bovine  19866880645053
cctttatgcttaattccttgaacagcctgtgttcctgtgttaagattagaaactattttagaaaaatgctttgagtgataggctctataatcacatttttcaggccatttgagaaaactatattcttgaaattttatttacagtagcttcaattacatgacgcttatgcctagaaaagcaaaagtttctcatttttaaaatctacagcaaaaataaataaaatctacaataaatttataaaatttatggggttaagtaaattgatacaatgaagacagttgagcaccagcctatagaccatacagaccattataaaactattaaacaatagaatgtctcgtacagtcttttggggttcacattaagcttgtattttaggactgctattgaggtacatggctgcgtaatgttgtgcaaagagcactggaccttggtcatattagctagccatgttgaccctcaggcctttatctgtatgacttaacgtgtcctaactcacaagctcactgcaaaagtgaaacaatacttgcaaaatcacttagtatacagtaaaacatatggctataaggtgggggtttttttttccctcacggcactttgcaggcagtgtgaagttcataaaattttgcttaagcatttctttttctgacaaagctcatgctatggttgataatgcaaaagacaaaacatttcccaatgtagatggtagattgatggaactcatgcacgtattacctggaatatattgtgctacaatataactagacataaagata

SEQ ID NO: 60445 - DNA, 768 bp, Bovine  19866880653372
ggctgggagagcccgtgaaggggctctgggtgttaagcaacaacatggagtgttacctagggggacagtcagggtcccgtctcctgcctctggtccaagactcccaagttcccccacctcaccctccctctgcaggtgactctggccttggagatggcccttccttacctgcgaggcgagcgttgaccttgttgtggctggaccagaaccaaaggacggcgctgttcagactccccacccggtgcatggagccagaggccatctgctcaaagtggccagcgcactctcggcagccgaagaagaagcggacgtagccccggatggcttggaggacttcctgggccttggctacagggaagaggagatgtcagtcaccgggggccctgcaggttacttggccctgccgaccccaccaccagccccatcacaggcccaccacggcctcctctgcatagggcacacacactgggcccaactgatgcggggactggtctcttcgcctacttcaccttccaggggtggtcacagctctgactccatcccccaccccagactcttaaacctcagtctcccttgtctgactcttatccaggccctcatcacttcctgacacttaggatagagtccaaactcatcgtcaggacactcaggctcttagagatgtggctggagagttaagcaggggctggagcgcccaccaccagacctgtgggtccctaccctgcccctcctgcttcaggcttcctgtcgtgacctgctctccattgt

SEQ ID NO: 60446 - DNA, 1748 bp, Bovine  19866880780517
gccgaagaaacaattgtacctttaatggcagaacctaaaagagctccagaaaagccgtgtgaaacgttactggcagtcccacatactgcagaggaagtagaaattcttgtacatgatgcagcagaagaactttggaaatggaaagaattaggtcatgatcttcacagcatcagtattcctgcaaaactgcttggctgtgccagtaagggtctagatatagaaagtactagtaaaagggtgtacaagcaggtatgtaacagggaaggataattctaatttttaaacttctcaccgttgtctgaaatttggattcttagccatttcatttgtttctttttctctatcaaggcggtttttgatttaacaaaagagatttttgaggaaatatttgctgaggatcccaacttgaatcagcctgtctggatgaagccatgtagaatcaactccagttatttccgacgagtgaaaaatccaaataaccttgatgaaatcaaggtaaattggaaactacaaagtatctcctttttttatttgatcttctttttgtacaggtctataaatgtcattaaagcaggtactcttttgtattattcactcttctgccctcaagacctgttccatagtagatattcagtaaatatttgttcattcagtctgtgagcaaaagaacaatgagggtgacagggaatcctgaaccctcaacttattgcaaaataaaacgtaatggtaattttatatacatatgttttataatatttttaagaaattagcaaatactcggggaggtaaattattggaatttgtacgagctttaggtgagttcttaatgatttagagataggtataatactctaaaagtatcagaagacatatatcaaatatgccaaccctagacacataaatgatataacctttccatctttgattttggaggtttcagattggttatgtggttttgaaatatgtaggatagtgtgatatataaaaaatattgcttgttgtctaagaagcccctgaaaagattaagtgccctgaagctacagggactttcaacaaaccaactttaaaatcacatgggtgaaaacctctctgcttgttcacctgttcttgaactatatagcaaaggttatattcccattgcagtgcctctcaaacttcaatgtgcatctgagtcacctggggggattttggtaaaaatgcagatttcttatggagtagatctggagtaggaccagaaagtctgcatttctgcaagctccgaagtgatgctgttgttgctgactctaggattattttgagtagcaaggctctagagttttgtctcccaaacttatttgatcatagaaactattttttccccagagagtctgcctccaattacttattttacttatgtattgtcttacattattcagttgtatatctggacgatcaaaatacattaaacgagcatacacattaatctggtatataacatgaaaggaggcactgtctaaacaatttggtcttttttttccctgagatataattgacatataacattatattagtttcaggtatttaatgtaatgattttatctttgtatatactgtaaaaagagcaccacaatatgtctggttaacatccatcaccacacatagttacaaatttgttttgcttgtgatgagaacttttaagatctctgttagcaactttgaagtatataatacagtattgttaactatagaaagcttttaaaaataggcat

SEQ ID NO: 60447 - DNA, 1512 bp, Bovine  19866880890139
cagagtcagctccccctcccccaggcacagccacggctcaggaaaggagcaccttcatctgacagggctttgtgcctctcagttccccgtcccatttcctctaaatggcatctggtctccctttttcctccccacgcccaccttctcagggacccttcctctgtcagactgagcgacatcctgtctcattcctcaaaggttcctgagcacaggttgtgagaagcagagcaggtatgacccagagaatcccggcccacccttcccttcccagctggtggggtgggccctctcatcccgctcagccccaggaagtcagggcttctccagcaatgggaagccctccgccagctgctcgcagcggctccgggctccagcccactgtacaggtgtccacagcacaggcaacaggagaacccaagccactgcccagccctgctgtcccctccaccctctcactgccatgcctgccatcctgccaccccgccccgggcccaccccggccccagctacctggcaggctccagcgggggacaggccgggggccacgtgtcactgtgggactccagggcatcgatgagcctctcccgaagcgtctgcacatcagctccggccactgtaaatgatgatgggggaggggagtgatgaagggggcaggggatgaggaagtagggtgcagatcccagcttccctcacagaagaaagggcccaacgcacgagctagctctgagcaagacgaagcatctgtcagtcctcctccacgtgaggcaggtgggggtcacccccggccctaagctcggcagagggacccatccctcagggcaggagagagcgccccaaaagccctccacacgctgtctggctgctcctctgggtgcccatcccactttgacacaagggccattctgggaacacctgaccccgcttcccaggacgggcttcttcagcctcgttttcccggaggaatcttccaggctggctggggagggcaggttcaggaggacatccctctggctttccctggggccctcctcccccttcagaccttgctgggctctctctcccctctcagtagaagcccaggtgaaggagggagaggaagacgcggacagcgccaacgggaccccgagagccgggacacccacctgagagcgtggttcctgagccggtcttggagaaggccttaaagaactggaagcaaacacacaggcaggagtcagtggagctccgagtaccacagccacagcagctgggctgtggaggcccagctgtttactcaatggggcggctatggggaaatgacttttgtgagcctgtttcttggtctgtaaaatgagaggaggaggtgtctgctcttggagagcacccgggttcctctccccagtgtcctgcgcccgagccctgcccccacagctctggagcccccggggaagctgtggctcagacacttgactggaggcggcctgtttttacgaagctcagggacccagcatgtaggactagtaaatagctctt

SEQ ID NO: 60448 - DNA, 1332 bp, Bovine  19866881093773
acacacacacacacacacacacacacacacgcacgcacacacgtctgtgaggttctgcacctctgctggctgacgtgcccacctgtgcaaacagcagtgacagcaggagcccagaaagcgcccctggagagaagctgtgctgaggagcccggcaggcaacagagggctgtggttaaaaagctctcccaccagggacatctcacaaccagctctaaagcccagcttaactacttactggctgtgtggccttagacacacacagacttacttgacctctgcttcttcatctgcccaatgggaacagtatctgccttctactaatgttgtaaggattaagtgaggtctggagagagagcgctcaacagatggcggttcactcgtgaccaacacaaggactcaaccaagactacagcctccttcctaaatgcggattggtgaggaggtcagaggggacaaggtggacccttctgctcccatagatatggaacatggaggagagcttctttgcctcccagactcacctccttcctgctgtccagcgcatttttaaagaaaccgtatggaattttctttctctgctgcttcttgagccagtcgttcatggagtgcaggaagttctggactaagggccggccacggaaatactatggaagcgataagtggacagtgagaagcaattcgccgggggttcccctggggagggtagtgggggtgggcggaagggggctcaggtatgttctggaatgttccaaaagcaccaggaaaacattctaagacccaaatgtgaggagagaaaaaaaaaacacccaaatgtgggctcctcactcactacctttgccctgggacaccggaaggtgaggcagagggctgggcagaggtgctcagtggagctgggccctcaaggctgcccctactccaggctgcaggctggggctctgacccctgaccacacacccactggggggaaggccgagcacctgtgtcactgcccagggcggctgggacccctgtgccacacgggcctctgttcaggtaatcttctgatacagcagctgattagtgaactgaccagctgggctgggctggcaaatggcctttcatttgtattccacgggctgccagtggcgaccaggcagcacaggggccagagccgagatccaaatcttgatgggaactccccgtagtctctgaggagcaggaaaagctactctgaagataagtcaactcaaatctgattagtatcagcactttaaaaccacaaggactccagggaggaggatggatgtgttgtgtgtgtgtgtgtgtgcacccatgagcacatgcacgagcata

SEQ ID NO: 60449 - DNA, 1460 bp, Bovine  19866881311420
cacctgggtgatatttagaaacttgagggtggaagcattttggaaagaagatgcatgaagctaaaagcagaaagaacagaagtaacatctttagaagaatatattgcagaccgtttggccatatggtaaaacattaatacatttctgattaagatcataaaactggcacagacacacacacacagaagtgacgctttcaactgctcaaatatttgctaagtatctcaactgactaaaaactaggtaagtatggaatctgacttgccatactaaaaatttcatctgaactcatggaaaaaataggcagggaaaagctactctatgttgaccagaaaatgtacgtttcagagaactacataactgtgtaacatatccagttacttgttgaggttactctttcgagacagttgagccaggtcaccaagtaaaattttaaaaagtttcttttcttaaataaatttttaaaaagcttctattcttatatacaacaccaatcacagaatctaaatcatgtaaaaactatcaactgtttgagtgcaaaagtcagttgcaaactaacacccagccctgattttcaattcactcaagaccagaactttgtttataattccaggtttacctactttaaatcccatgttgaatattacaattaagtttttctaaatgtggggtaggacaggggtactgtgaagtaaaattattttaagacaggacaggaaaattaaacataaaatctctctctgcccatttgagctattactcgctttagtgtgtactgtatgcctgaattatacattaactagattcccttagaagacacaggaatgcccactttggaaaaaaaaaaaaaaatttccttctggctccagcaaagtaactccctaggagacaacattcctttctcaatcctctaggtggtcacaacaacccactattcaccttgttggactgtgtaaacttcgatgtataactcttggtctcaaaaactgatttaactgtgccttgacctctaacaagtggaacagtcttcagaactttctgaaagaccgcctcgtgggttataatcctcaggttggctccaataaaatttcccatttcattcttagatcaactattgattcattttttttcactgacagtactcttgattgtaaagctagagaacaaagaaataccagatccctgtacttgaaccaaacactctttcagtcaataacctattaactaacatcactgttagctgtgctctaggcttacacactcatgcagagaattctgaagagctggactggctagagtatctgaggcttcattcactagagtgataatggctaacccatacttgccaattcacattttcatctcccatctaaacttaccctaaagagatcaaaataaaggaaattgaatagaatgtggtaaaaagatatccatgtcttacaaaaatagtttaaattatt

SEQ ID NO: 60450 - DNA, 767 bp, Bovine  19866881356652
ctctagctatcttttaaaacatactgaggctggatcactcctcacactctgttcccaccctatatacacacacacacactggacttcctccatctccaatgtagctgaggacagctgtccctactggagcagtttaattcattgcctccagacgatttgatggtacccatcctgcttgtaaggaaaaaggaaacaggagaacgaaaaataagccaagaagtgtgcatttctcagctagatctcctggacaacaatctctgtcttcttaccattgtggtgtctcatacttacattaacttctcctgtgtgcgatcaagtatagccattgcttcaagatactttggggccaatgtaccttgatgagctgattctctctgacaagaaaagtatgtattatgaatgaactgaaagtcccaacagtaaatagcctccttcttcaggatgttctggaccaagctatctttttctactattcatatttatatagtagatgattaaacacactcttaatatgaaagaagaacaaataccataccagattgccaattattcatacttaggtggatataaaactatattagagttgtaaagaagaagcagggaaaacaatatcaacaaaaagaagcagggaaagaagagaaagtttaaaaaataaagagaagggcaaacatatttctctaaccaagttaaatatcaaggaaatcaattatatttctctcattataatttacttcactaagcacataacattgcatatccaatcaaat

SEQ ID NO: 60451 - DNA, 1097 bp, Bovine  19866881365802
ccctcctcagccaggtggtctacatctccgctgtccctggaggaaggagagagggcttgtttgtgaaagccggcctggactggctgctcagcagggaggagtcagccagattagagaggctgcccctaatccggcctgctgggttttacaaggatcagagccgctgataatgaacctcattaagggggagcaggagcctcaatccgatttggggttttctctttgacatcttgctctgctcagatggcctcggcaccgggcggagcaggtggggtgccaggcctgctcctctgctagggcagccgggtggggaggggttggccccccttccctgctttgatagccctgggtcacctctttagctgcctgactgcacgagtggatggcggcattggagcctctctgcaggcctctcatcttccccagagttccctctctgtgtccccactctagtcatccacctgcctgccccatccgcccaggccgtctctgctcatcttcccctgacccaccgggccctggttgagaggctgacaggcccacaagagggtgaaagaggctcccagcccccgccgggccaagaccacttgagtacgcctgtacctccaccacctggtacctgacttgatgccaggagcagaggatttctaccagacggcccttacggctccagtgaccatattttctaaaaccaagctcaggcgttcagaattagaactaggctgaaaaagctgactctgcgactacccccggtgcccaaggcagggggtagggcctcacttggggccacagggggccctggtggtggttgtgggtctctgtcctcaccttggcccctggcagacagcctgagcagctttccaccctgtcccagtccctctgattgatacacaggggtgggcctcctgagcaggactgctgcctttcaccttgatttccccagggctctcagcagcatcagcatcgataaaccggcttcgcccaccagctggtcccctcccccacccaggctgccagcctggaagccggggcttctgtgatttgagcaccgcccacctgtccttccaagttgttttctgtaccttaggagagctccc

SEQ ID NO: 60452 - DNA, 1861 bp, Bovine  19866881694366
ttttgataggagcaaaagcctgtatctgatcaaacagggtgcttttgacttcacagactcaaaaggaggctcaggacacagtgctgcacaggatcttaatcacagacatggatcagaaatcatttgtggagcttttagaccgtgcagacaacaggcccacttttacattttctgatttagtgggtcatggataggaccaaacgtatgattttatatattcctgatttagatgttgaggactgcagttattagaggacaggaggagaaattaggagttggaaaatccagatgcgtcgcaattctaagtcattttggttctagagcgagatttctctcctctattctaagagtggttactgtctactccttatgtttcttgaagatatttataaagcatattggtcacttacatttctcttcccaaattcatgccagtatctcaactgtgttagttaaataagaggtactcaatattgttagtgtattttcccttctttatatctgcttttatctgagcccctacagctttaggaatgaatggcagcccactccagtgttcttgcctggagaatcccagggacaggggaccctggtgggctgctgtctatggggtcgcaaagagttggacacgactgaagcgacttagcagcagcagcagcagcagctttctcaaagagtagccttggaatctggaatagtagctttggtgataatacttgaagtattgagagaataaaaagaatttagataaggattaatattggttcatctaaaaggaaatatgagttctggggaagattagaaatctccttcatcactgaatggcattccatatgtcaatctgttgctcacaacctcagtcttggcaagtattaggacacgaactctctagggctgtcccaaacacagtgggtcccagaaaaagaagtatgactcgtgacaagaaccctgtggggtgcttcaatctgtttccatgatttatgatccccttaccccagttgtgactcctaccatttggtccaaacctacagagaccatgtctgacattttggcagagagaggggcatgtactatcttgaatctatcttgggctcacaaatcacctttcttccctgcaaagttattagttgcttaattatagaggagaagtttgcatctgtggccagataccagggccaagtttaataaaacctgaaatggctcccagttcccaaggacaatcaaaatcgaagaattccactgcacacttgcccaggactatagggttgatgaaaaatgccagtcttcccaagtataatattttctcagattcctgaatagctactgatgatgtgtaataaaacaactgctaatacatctgggtttgagtgagatatcaggaaaacaaaactatcaaggtgacctacaaaaactcacttcccatctgtctccattcctcttcctctaaaacaatatgtagggcaccttggtatggcctcaaaaaagatagggaagagggatgaatgacttttttaaagagtcattcactttaacttcccatactgtataatcctatgttgggggcttttgtgcaattataatttttacagctagtaatatacacattgtacaaaacttaaaagattttaaaagatctacagaagaagtctccctcccattcatttcacttaatcctccagtgtcttatcccgggatgggggcaatggggcaggcatggatggtgctaagcagtgttttaggtcctggggacagagaagcaaacctaacaaagtccctggcctcaatgagcttacattctagtgtggagagacacaaaatagggtcctgggaagtcctatgagaaaaataaaatagcctgagg

SEQ ID NO: 60453 - DNA, 5510 bp, Bovine  19866880442600
aacatggcagaacttcactatttttatggctaaataatatttcactataaacatatactacattttttatccttgcatctttgatcttgttcctgatctcagaggaaaagctttcagccttttacctttaagtatgatgttagctgtgggcttgtcatatatggcctttattatgtagaattatgttatttctatatccaatttgttgagtttttaatcatgttaaggatactgatttttaaaaaaacatgtattctgtgtataatgtgtctatcaatatagtcatatggtagttctattttattctattaatgtggtatatcacttattgagtcacagatgctgaataatctgtggggatatatcaatatttcatttgatcatggtgtatgatccttttaatgtactactaaatttattttgctagtattttgttggaaatttttgtatctatgttcatcggtgatattggtctatatattttttttcttagagtgtccttatatgactttgatatcaggctaatgctagcctcacaaaattagtgttagaatattacctctcttcaatctttaagaacagttttataaggagtggcattaattctatcaacatttaccatttaaatttaccaaggaagctgtctggccctcagtcttcttgttgcttttactgttgggagatttttgttgttgtttttttaaaaattactgattcaacctccttacacattattagtctgatcttattttctgtttcttcatgattcagtcttggtagatgagatgactatttaaccatagcaagttatccaatttttggcacatgattgttcatagtaggcccttacgataatcacctttgtatttctgtgatataagttgtaatttttcatttataattttatttatttgagcactctgtcctttccccttggtaagactagctaaaggttttaattttgtttacctttcagaagtacctacgcttagtttcactgagttttctattgttttcctactctctacttcatttatttctgctctgatcactgttatctccttccttctgctaactttgggattatttgttcattacctcattcctttgaagtgtaaaattacattacttatttgagagttcttcttttcttaatgtaggtgttagtatagaattatcttctgtccatcctgatagggattctgaggatttatcagtgctcttctatggatacacctatttcacagttcttgctacccaagaggacttgtgtgggcatacttaagattatctgctgtctctctattcttcaaagctaggctgcatgctgacagcttcactcttatttgctttccctggggtactgcatgctgaggtgctttctgcccatgcaacagaggctgagcagctgtcagggccggctagcagtttgcaaaggattgtacttgcaactctctggaggacacaagaggaaccagccacaggattcagggctgtgtggatgaggcatgtggagcacagggggtgactatgtgctagcagggggaatccacaggtcaggtgtccttagctactcaggggcaggctttctgagggaatccatgaagtggttagtaggatctaccttccttttgatgccctctaagagccctaactgctgttctcctagcccctcactgcccccagttgtgcagcacaccttagcattctggatgggacaagaacaaagtgagctactttggcagtatctctcatagctgggaagccagaagcgcactcacaagctctcagtttaacccatgaaagaaatcataggtcaagaaggtctcttctggcactacactccacctccttgaaaggaggtgaaactgctactctgactcttctcaatgtgtctaatcttggattgttttcgtttcaatggtgtgcttgaacatctccgctggacaccccgacttccccaaagtcattcataggtgaataattgtcagaattgtgggtttggaggggaggatggtagaaaactcctattccaccattttgctgatgtcactcctacagtgagctttaaatgatacagtctcctctagaaataacttgaagatggctgatagaataataaaaatggtcaaattttaattaaatatgcaaaacacagattctggggaaaatgccttataggcatcatatcattttaaccttttcaaaaccttcaagacaggtaatcactttttaatccattttgcagctgagaaagttacagcttagaatggttaactgcccacccaaggatgcactcatggaaatggcatagctgttaattctatcttaagccaaagcccatacacttgaccatttttcatgagattgtaagaatgggattcattcattcacttgctcattcttgtaataattatttactggacatttatagtatgctagcttctgttctagaaatggggaaagaaataattctctgtttgtggacttacaattcaatggtggagacaaacaacaatagtagaaaccaaataagcattatactttcagataataaatataaagcaggaaactgaagaaggctaaggaaatatagtgaagtgggggtgatactgatatttggtaaaagagtcagaaaccatgtaggcatttgagacagacacaagtgttgagtgttatcatctcaaccctgaatatttaattggaaggactgatgctgcaggtgaagctccaatactttggctacctgatgtgaagagccaactcattggaaaagatccaaatgctgggaaaagattgaaagcaaaaggaggagagagcagcagaggatgagacagttagatagcatcaccaactcaatggacatgaatttgagcaaactccagaagagagtgaaggacagggaaccctggcgtgctccagcccacggggtcacaaagagctggacgtgacttagcaactgaacaacaaacaacatcatccctcggataggggtgagttgtctgagcctcaagaagtcatgtgtggctagagaaaaatgagaggggatacaggtagagagtagtcaggctgataggcagggccaatgatatgggaactttggagtctggctttcacttgtagtcctataagtggtttatccttaggagattcactaagccttcctggactgttcccttatttataaaataagaatgtaagagatgtaggagcaggagacctgaaaggtcctttctagccttgacattctgtagtgagacagagaaaatgatagatgacatggaaaaggtaaaaactgaataacgaatccagtcactgagggtggtcaccttgaatgtctccatctttttgcatatgagttgatgtgagcctttataaataaagctactcttttcaaatattgtaggctcatctgataaccatgttggtttcatgattcattaagtaaaaggagataagccaaatgcccctgacattcaaatcaaggaaattaaaaacatttggaaaatcaacgcaaaattctaccactctggtgaaatattttgatctgatgacggttcagtgtgagacagttattgaatacctctattgaactgaattcttccagaaaaaaatagctcctaggactgactgttttgggtgtaattcaaattatccttgaattaaaatgagtcaaaataacccatgaaatgccccattcagaatataaagcaaacctaaatactaaacctaaatatatttcctgtgattattcctagtgttacaaactttgctgaggaaaatacctctggattttgtatacacacaaataatgctaagagccaggctagcttcccagggtgtccaagttccagaaaatttattcattccttcaagaaacttaccctctacagtccagaaataattaaatgagtgaattaaaagcatgaaaaggtactacaataaaatagtattgtatcagaggtgtaagtgataggctgatagagccagtgcactaatgtcaagttgcagaggaagctaatggcataaacacagacaggaattaactaaaagtaaaggtgaacccatttcctgattcagaggctatacatcattttgccaaatgaaatgctaagaatagcgaacatttccagatttattatgaacctggaatttattcagtgccaaaaagctaaatatacttgtgtatgtttaattaagagaatgcattatttagcaggataccaaaaacacctgctcaaccaaactagatcattttgcttcatttcttcaacaactcctatgcaattaaaaaaaaaaaaagcctacaatgtgtacatctcctatagaaacaattatataaatgacagtaaatgaaaataactacaaaggatacagaatatttctggtacatatgtaactgagtctatttagattaaaaaatatttgcagaaaagtatttattaatataatgctaaagttgaaaaaataatccattaagcagctgaagcaattttgaacaaagtagtcatttgaatgttttctacttctattttcttataacctcccatggaactcagactatagaggcttataataagttttactattgcaaataaccaaaaaaaaaaaaaaagatttttaaccttaaaaagcttttataaagctaaaaaatgataagacatttgacttttttcacatatcacatgattatttggtttagaaacattcccataatcagcatacaaaaaaaaaatcagcatgcaaccatttgcaaatgttaaactattctaatcatcagggaaaatgtgagtaccttggtaacaataaatgagaagaaaggagaaaaagtaaaaaaaaaaaaagtaactctagaatcaaagcctcaaaacaagattataaaagttttatcaaaagatctgatacaaatgtcagagatttgattcctatgatgattctcattggaatgtgacctttcacctcaaaatcattccaagtaatgagggcaagaatatctgaaccctaaagttttcagtgactcccaacagtcaggcatgagagttgtccctgaaactaaaaaatgtgtgaatgggaatggactcactcttcagatcatctctcttagcttcctaaatcatgatatttagaaagaatgttcattttagccattataagtgtagaacaaaacattattaagactctgtgagctaaagtgagaccacacttactggacctctatagatgcctaagcacctagtctaccccattcttgaggatgacgctcattgacctgtggaaaggagcattcaaaaaaaacattcattctattttcatggctgagtagtattccattatatatatatgtgtgtgtatgtgtatatatatatatatatatatatatacacacatattctttatcttctttatccattcatctgttgatagatattagtttatttccatgtttcggctactgtgaatcatatttctagaagacaggggtgcatgtatctttttgtaaatcaacaata

SEQ ID NO: 60454 - DNA, 1746 bp, Bovine  19866880446785
agctgcctgataccaagcctcatgttggtaatgctgcactcctcatgactgccttttccagaaagtgttgctagtgatatatattgttatggctgattttatgtttatggctcattcacacagtctcattatgcttagtttcatttctttaccaaacagaatcatgactaacttgcatatcttagagaaagatattaaaagtttaatgattaaaatatgcatttttatgcatctttcctatagttactttttaagtgagagatttaggaatgaagaaagagagaagaggaaattagtttattttaggcattcactttgttctagacattgaactagatatttcgtgtattaaattcttgtaatgattttcaatcttcaatcccttatccaaaatctacaagccaggtgtgttttagaattcagttctttttttttttttttttaagaaaggtaatacaatgtacatattctgctgggatcctggacagaagcctacatcaaatcatatgctttttttttatatatatgttagacattagattttattttatttgaccatgccagcatagcatgagggatcttagttccctgagcagggatcaaacccctgtccccagcagtggaagcagggtcctgcccactggaccaccaggaaattcccatatgcttttctgatgtcagaaaacctgtgaaatgcacacaccatcatcctgaatggaataaacaaagactattcatggccctctgttctttcaggtcacattttactaccaggtgaattcatgtcaggttagatttgctaccagataaactctgaaaacagtttgtttttcatatcttttggttctgaattgtggattatgggttctggatgtgtattatccacacaccatagattaggaagctgtggcttagagaggttaagtaacctacagttcagtcacttataaatagtcgaacaatattcacacaaaggaacactattcagccataatgaagaatgaaaccctgccatttgcaacatagttagagtgtgctatgcttacagaagtatgtcagagaaagacaaatactgtgtatcacttatatgtgaaatctaaagaataaaacagtggattcagtgatatgagcacaaggttagtgaaatgcaaagtcttactcatttcctctggtcctgctcaccacctgacctgcatgtgccctaccatgctctttgcctttttggctgccaggtcagtccagcaagaacacacagatgcataggcacaaatagattctttatattatggcccaaactttcaattaaattttaccttaagctaataattttctccacataaatagtaagggctctgatctctggtcaaggtgttctgtatctcaaacaccttctctccatttctctttctgagatagtgctggatgtaaggcttaagggtgtggcctcattcagtacatctcaaattttgagatgcttatgagttgattgggatcttgttaaaatgcatttaaatgaatcagtaggtgtgcattgggcctgagctttagtttctcacaagctcccaggtgatgttcctgacccaaggccgcacttggagtagcagtgacttaggtgaccgaatgcagattgggagtagtaggagtcctctgtccctttggtctccaaggcagaattcctcacctagcagtttgctgtgatgtagttctataatttacctgggcttggggttagagtcttggttagtg

SEQ ID NO: 60455 - DNA, 912 bp, Bovine  19866880463987
aatctgctctgggtaaatacatgtcatctccaggttttccaaggacagaaagcattgtatttacttgtcttttattctcccaagaccccaagcacaaaaggttcttgatcaaaaaatactcagtaatttcactgtgtaaacaattcatacaactgaattaaaaagagaattcttgacaacaagcccaaaagacctacaattagagatatactcttttccaaaataatccatccacttatcacaagtaaaatcaacaatgagaaataataaatacttaatatcctttgtaaaactacaatttcagttgcttttgcaaaaagggaaggaagagaagaaatgggcagagaaatgctatcatcactgccttgaaggaagatgaaactcttatttttgcatacaataaattacatttgtttccatatgaatctctctcacacactggcttaaataagaaaggggaccagaagtatatttcctcctccaggtttcaaaatcaaaacagacctaatgatacaagcacaatccctcagtgaataaaattacaaagagtctagctactcaggaccaatttgtaatcagagcatcaagccatactgtacaaaaatgtcaattctggcgcagctctgatgagctaagattgaacacacgggccagtttatcatattatcctgactgccctcttttaagactggcaggcacaatttgagtacaaaaagatttcagtgtgagtgatcttgcatctgaaaaagaactcacccagactgacaatgtttccattactatttttttcttaagagaaataaacacacagaaagcatccaatataaatattttctcaaaatcaagtggtcctttataacacttttcactatgatgcatacaaataaaaagcagggcattaagagatctttt

SEQ ID NO: 60456 - DNA, 1529 bp, Bovine  19866880480918
atctttaaaatcttcccttcttttcagccaggaccaattttttatgtagttccaacacactttaaggaaacaattcactgtaccctagacttctttgaacatttacaccattgctcatatcagcaggagttttcttggaattcaacagcaatttttatgaccatacatgttttatacaatgttggagctttttttttttcttttctgaattagtttttcaaaagaaggggataaacacacttgccattttataaaaagtgaacaacaccttctggccttactcagttgtaggaaatgagttttcatgaagatatgaaagataggaaagagcagtttttacaatttaccacagtgagaggacagatatatattaaaagtaacagtagcaacaacaaaaactattggatttctagaaacttcttgaataggaaaaaaagcttggtgactttgggtttgtcaaagatttttaacataatacaaagagcaaaaggaaaaaaaatgtttttgctcttttagaagcacagttttaaaaaatgaaaaagcagagtgcacactgggataaaatactttccaaacagacattaaacaaaggatatggactatagagtctctcttatagagaacttatgtaactcaataatgaaaagcaatccaatggaaatggggcaaagatttaaagggttgtttgatcaaagaacatgcataagtggaaaatgagcacaggaaaaaaatgttcaacatcactatcattggggaaatgtgcatttaaatcagagggagatatagcacacctctagaactcttaaagttaaattctaaaaacctgaaaataccaagtgtttttgagtatgtggaacagctctcatgtataactagtgagaatgcaaaatagtactgctgctttggaaaacagtttaatagtttcctgagaaagtaaacatgcaccccttaccatatggcccagccattgtattcctaggtatttacccgagaataaagaaagcatatgtccacaccgaagaactatacatgcatgttcactggagcttcatctgtaataacccaaactggaaacaacaaaaatgtctagcaacagatgaatggataaacaaattgtgatatatccatgaggtgtaaaagtccttggcattaaaatagctgatgcatgcagcatcatggatgaatctcgaaatgattatgctgagtaaaggaagccagacaaaaattgagtacatactgtatgactccatttatataaaatcccagaaaacactagttaactttatggcaacgtataactcatgtcagtggttgcctgggatggaagagggtgattggagacacaggagaaatattacagaggaatacaaggaaactactggatctgatgggatttgtttctcatcctcattgttgagatagttccgtagatgtgaacatatgttaaaaagtatcaaatcatgcccttgaaatagatgctgtttaatgtatgtcaactgtaactcaacagatctttaagaaaaagaaat

SEQ ID NO: 60457 - DNA, 1298 bp, Bovine  19866880548689
tccagggaattccctggtggtccagtggttagggactccatgcttttaatactgagggtacaggtttgatacctggttggggaactaatgtatcacaaattacatggcatggccgaaaaaaaaaaaagactagaatctaggtgactgtacttgctcagtagaattttctgtagaagttaagacctcacatgctagagctgatttgaatcacttatataaccttatattatttaattaatctaagcctcatttttaaagtagttactgttaagaattactcatgctattacagatacaatgcttaacaaagtgcttgacacacagtgcttaataacactttagttatcatcatcataattgtgtcaccaacaattcctagatgaaattctactttactgatataatcactatatcagacaatgaaaagggaagaatctaccataagaattttctcatgtattgctccatatcctttttcaacatttattaagaccttctttgtacaagaagctgtgctcgatatagaggaaaatatagtcatataagacatagtttttgccctcagtgaactgtaatacctgattttgaaaagtaaataatttacatggtggagaaacaaacaaacaaatccagaactgcagtttttttcttatttttaatatttgatatagaaaatttaaagtgtatgattccccttatgttagtaatgataagtagccattcagtccctactggttctcctttatttgggggttgatgaattcttcaggaagttaaagcagattatggacccacaccatatcacccagacaccagttggaacataatcttagggattctatattgcagaaatctctaattctaagggtgtaacactggctgttgaaaagctcaaaggagggaaagaaccgtgaactgaaatgtacatccctgagcctttgggcccttcagtggtcctcattctgccctgcggacggcagcctgctcccttttgcagaacaagagctctgtagatatttggagacagttaatgtgctgaatgtctccatttcctttggtggttattcatttctcatgggctccagactctttatcagcctgttactttcctctaactgtgtaatagctctgtaatttgtttcctttaattacaagaggaacatattcttactgtaaataaaggtgaaaccaaatcaaaacacaaacaaatccaaagctatacagttttgggtgaaataaaaagtaaatgtgtctacaccatttaggcaaattactttcctacaaacaactgtcaagag

SEQ ID NO: 60458 - DNA, 1635 bp, Bovine  19866880591463
tttccttatctgtaaattgaaaccgtaaccatatggtatttgtgtatatgtggcctcattttttaacttttcattttgaaatgatattagacatgcagaaaaattgtaaatacagaattcctaggtatacttcaccctgcttcacttaacacgagcatcttacagaaccatggtatatttataaaaacagacaaatcagcatggctataaaactttacactgcaaactttagatttcattggttttttccattaacacattgttctgtaccaagactcaactcagggccacctcattgcatttaattgtcatatatccttagtcttccccaatctatgacagtttttccaccttcctttgcgtttcctgcccttgacacctttgaaaagcagtggctaggtaattttgtagatcatctctcccccagttttcccatggataaactgagattgtcgatttgggagtagaatactctctctttggccacatgattttgtcttctgctccagcttgggattttataaaaggaagtccttttcccctggtctataccctttttgtcattcctccaggtccagcataatcggcacattagacctgaaagaaacttaagacagacagtcacacaaagtcctgtgtcctatctagttttatttttaggaggctcattaatcttcaacctttcttaaatattatttattctcttcatttcttatgtgttttcccttctctctggaccctgaagctaccacagatgcaacatgtctacaatgacaagataagtattatgttctgtagaagagttttctctctggtctctaaaacctcacagggaacctctttcaaggtagcctcgtctatctacattggcagggaattagcacatgcaagacctgtgtctgcaaattttctagacctcacagtttactctttaaaaagacaatgactcgttcctaattatgttttctcttgaagaaagaacagtctccctggatttaaatcacacctatcaatgtgctggttaatctttggatggaatctgtaaaattggaacacaacaaaagcaatatttctttgtgccttaagataagtctctaagtcagtttgtatacacaactttcattttagataaatttgatgggtagaattgcctgattttggagttaagaaattaggatctgagaactctgcagatgttataaggtgaactcaaaggcctgtagaaatgctgggttttggcttccctggtggctcagagggtaaagcgtctgcctacaatgcaagagatctgggtttgatccctgggtcaggaagatcccctggagaaggaaatggcaatccactccagtactcttgcctggaaaatcccatagactgagaagcctggtaggctacagtccatggggtcacaaagagtcagatatgactgagcgactcactatggaagagaaaataactgcatttctacttctttaaaagttccatcacacttgctcttttttccttgaacacatggtgctctgctctgactcagggccactgcacacaatgctccttctgtctacttaactctcctccccatctctctattgttttccttaggaaagtcagtcattcaccttccagactagatca

SEQ ID NO: 60459 - DNA, 2369 bp, Bovine  19866880707189
tatgagtgacaggcaatgcatgtgatgctacctgatacctgagttagaaagcaggttcctgactaccttgccagcatgcctttcatgtaacatttagaaggtctttctgacttggttcaccctttctttgaaaatacgatccaagatttaatgaaatgtgtttaaattaacaattctcctatctaggaggtacagacctctaatgaataattggaaggccgattacttacatatctgtattctcttgttaatcactttaattaccaccttctgaatcttctatgcagcaaaaactcaaagaagcctttctctccagagaatgataacactttcctgtggagccctaaacttctttatagaaaactaggtcttagagtactaaggtaagtctcatttttacggaaatgtatgatccaaaatgcccaaacttccaaaatattgtaaatgtgaaaggaaccatacttatttttgaaaataagaccaaaaaatatctaccttgggaatttacttaaacagtctctctgtagatgagtttattttctagcttctttctatattcagtgcttacagaggcctaacacgggccaagtactcaactaggaacacaagatatctcacataagctccttgccttcaaggaactgagagcttagtagtggagacagataagaaaaaagcataagtaacacacatgtgacttaatgtaaatatgtatgaatacagcgttacaaggttaaagaaaccaatcattctgtgatgagaggagttgggaaagagacaagatggaggactgaacagagtttgagagaaccagcaaggtaaccagagcaggagagtggaggctgattaaaatagactcaagattctgtacaaaggtatagacatgaaatgaagaatccagcgtaagactggacaacaagaggagaactgggaagatttgttgtgaaggactgatatgcctcataaatggagagctaatgaaaacttgtgatctactgaacgtttttaaaaaataactttaagaggaggggagcagacggactgagaagggtcaagctggagcagagggatcagatagaaaattgccttcagatcacaagagagatctgcaggaaccaggatggagaggagggaactagtcgagagctatttcagagacacaatgggctgaatttgcttacagaggctcaaagttattacaagcatgagttttggggttaaatgaagttgaatataaactggggctctgccacccactaaatgtcgaccattataccagttttcttatctctctgagtttcatattcctcatctttaaaatgaagatcatgttattgagaggattaaataagctaatggtgtaaagcacttagtataaattaaaccctagcatataataaatgcttagcattcactgaatgctggtattatgactatcattattattacaaatattctaatgaataattgatggagagagatagcagagaaggtcattggaaatcactatcaagcttgaaagtctggtaaatgataatgccattaatgacaaagtcagtgactataataatgagcatttactgagagtttaacatatgccagacagtgttttcagaggttcgcatacacaatctcctttaatccttataagaatccctgatattatcatctgccctttgcagaggcaaaaactgaagtacagaaaagttgaatagcttgagtaacaaagccagtaagtataggaacatagaaactttggtttaagattctacatatgcacagagaagacaagggatgttctgggatgggtaaagggaccttggtgagggaagagagatatcattagctaggtggagtttaacaagctcagagacactgacgtggaaaaatgtagtagtaaagttagaaatgaaggtatgttcataaatcatttttctactcaaaagaaagaccaaggaacaaagaacctgagatagcaaagcatgaagagctactgctagcaggagataaatcagaaaggcagaagtgcctcaaaaacaagtttgcaaggcaaagagaaaatataactgaaataatgcaagctcaatttccatgcaaacttctcaggaagcaatccacatgtgatggagagaggcatctgtactactccattttcccaacatttatatccccaatgtcagccgtgagagtcacaaggctaggtgttgttccttgaacagctctgtctcaatgaaacaaaagggaaatcaggatttttcctcttggggctgctcatcaggaggtttcagatggcagagaaaggaagaatgtggctttcctgccaaagacttcaccaggggcttctgggaaatccatagccccatctggtt

SEQ ID NO: 60460 - DNA, 3397 bp, Bovine  19866880752169
aaattctgaagcacccaaatttaggaaaatcccttttatagaaagactatcatcttgggcaaactcccaagaggtgtcagtcccgtgaaagaggcaaagtgttcattagtaggtgaggggtagctccaaaggtacaaccatctattaaagctgacagccatctgccacgaaacatgcttctcctctgtccattttgtgaacctcatttagtcagcactcctgctctgtaaggaatcagtgcactaatgtgaactgctaccactcaaaagtaatggagtgagaatgctattattttaaattgtttgaagccatgcagtccctaacttcattagctccacttctaggaaacctatctaccaaattctgtggcatctacagaaatggaagaaacccacagaaatgtcattctattacaaatgccattctcttcattacaataactcacacacaaatgtatgtacatttgacttatggtaggtaggaaaaggattctgcaaatatgcccatgtcctaacccctaggatatgtcaatccgatgagattatcctagaatatcctggtaagctatggaagagcctgaaaagcagaagaggtgggaaaaacaagtcagaaaatgaggcagaggagaaggcaaaagctgataaacacaaagagagtccgtgaccatgggctgagggctgtttatccagaactaagagtagcccctggccaacaacagggaagcacacagaattctaccaacaacctgaacaagcctaaaagcagatggccccgcccctagacgacagcccaggcctatcaacatcttaactgtgacctcgtggccataagcagagaatctgagtcatcttgtacctagacttctgacccatggaaacagacaaataacagatatttttgtaagccatcaaatttttggtaacttgttactgcagtaataaaaaattcaagatttgtgtgagtaatccaagaacatcaaagatccaaaacgggtgagccttactttgattcattcacctaaatatctatttttggagtgtctcacctactcttgtcaggcacgtggtggtaactttcacatgaattaagctccctagtggtgaacaaaaataggcatctcctccactgctttcagtccagtgggggatagaaatattaagtgaacaacatttatataaatacatatgaaaatagtagccaaatggaggggaggtgctcggcagtaatagtctgtatcagaggttctggtagcaatgtgtcaactaaacttccctggcatattaaaaagttgaaaaggtgcagattgaggcaagaaagaccagtgaagactgtgaagcaagagaaaacagagcaacggtgagaaactgaaaatgctggaattgtaagattgggctgaagacagacataaaagctagaatgagagggtgttataaaccattctaaggattttccataaagaaaatacaagcaggaaccatgcttctaaaggaaagggactgtttactgattaatgcaaaggaattcttgttgattaataattctagaaactgttatatacatgaaatgatactcaggctgcccctgtgagcaaaattttaatccatggcttaggaaatgaagtacagagtctgtccttcaaacatcagctcaccacaggtttagagaagccctaattttggcattgtaagactgagaaaggcacagaaggcaatttattctctttgagattcagtttacttatctgcaaaatggatacttttatacaaataggagacacaaggaaaacttgctgaatcaagaagggaatgaattcctgccctgcctgactcaggatcacatgaaaaccaagtacacgaacatgttttgtaaagcggaaaatactttacaaatatgaataatttctattaagtaacatcttcatacaagagatcaccttaatgtttacaaagacggaaataatagttaccataaatggactggaaccaggtcagtgaaggtcaaggaatttccaccccacttacacctgggacagtggccatctgctgtagacagatcaggggactatgagcagagggacaagaagttattccagataaagcatcttgaacccgaggtttctatgtaaacttgctcaaattagaactagaaataatatagttgctgttgttgtttagctgcccagtcatgtcggactctttgcgaccccatggattgcagcgctccaggcctccctgtccctcaacatctcccggagtttgcccatgttcacgctcattgcatcagtgatgcattccagccatctcgtcctctgatgccctcttctctttcttccctcaatctttcccagcatcagggacttctccaatgagtcatctgttctcatcagatgaccaaaatactggagcttcagcatcagttcttccagtgaatattcaggttcccttctccaggggatcttcccaacctagaaattgaatccaggtctctcacaatgcaggcaaattctttaccatctgacccaccaggaaagcccaataatactggagtgagaagcctagcctttcaccaggggattttcccgactcaagaattgaacagagaacaatatagtaagtccactataaacgaaccagttctgatccaagagcgcattttaagtccaatgaagttagcctaggtatccaactaacacaactggctacatagtactgtaatataatagatttataatacttttcacacaagtaatacataaaaaaaaaattaaacattttaaatgtaaagtatagcaccttgaaaagtacagtagtacatacagtacaacagctggcatacaagggctggcatcaagtgaacaagcaaagaagagttactgcctggagaagggagaagtggtgggaaacggtagagctgaaggacggtcagcaataggagacagagggcaagcagcagtgtcactcatgcctgacattgatgacacgggttctggttcgctgctggaaccagacatgtgttcacatctttgaaaattcgcaacttgaaggtttaggggactttcagtacaactgccccagtaactctagggggttattaatgtaacacttagttatcattaaagtaaaaatctgcccaaaattatgatcatttacaagtttgactttctttaaaacaaaatgtttgtagggtgaccactatccttccttggaaacctgagaaaatgttatttctataggagctctgtttctgaaatctttctggccaagaatatcagtccaagcagtttcatatcacagagagaagagtgtagtattaaaagcccgaggtgtggattccaagacaactgtgttctgggtcacagctctgccagctagtaggaaagttatttaattccagcaca

SEQ ID NO: 60461 - DNA, 3083 bp, Bovine  19866880753372
ataacatatggaactgtattcaatatctagtgataacccataatggaaaataatataaaaaataatgtatatatgtgcatgactgagtcactttgctatacagcagagattggcacaacattttaaatcaactgtacttaatttttaaaaattgaaggaaaaatatttgtctttgtggccagcccaaaataaataattttaaaagtttatgatcaaataaatattatctatctatattttcatattggtcagcagtacagtactttttgcatgatagcagcagagctttgtcagggcagaaaccatatatcaggcaaagtctaaagactgatattgacatatattcactattgatactacatataaaataaataattaatgagaacctactttataacacagggaactctacacaatgctctgtggtgacctaaatgggaaggaaatccaaaaaagagggcttacatatgtaaacgtatagctaattcactttgctgtccagtagaattaacacaatactgtaaagcaagtatactccaataaaaattaataaaatcttttaaaaaatatttactatctggccttttaaaaaggttgttaactgttgctctaaaccatcagacaaattcttcccaaatagccacactctgcctggactcttcagcaactgccccttcagaatagctcaccatgggaactccaacagaatccatgtggctgggaaaaattaggtaatgctattcttggaatcggttacatttgcggttgatatcactaggaagctaatgattaaactcaactaatttcatttaggtctttctaaggacaaagtccttccatagctcaggctcaaagaactctttgatataaaaacaaagtttgtataatcaaaaatgtatagctccacagagtgatgtacttacacttgtgatctttcctctgccatatctgagattgctcattccttgttagtctgggagctcaaactaaatagtgtaccacttgtctccatcaagctccttgttttagaatttcacatattcctttcacccagaacatgtatctcaagtcatttgaatacacttgtaagtgtgattattagattaatatttgttctaaaaaaatctacaatatttatgataattgtcaccatgtcaatttcttgttacttaacagattccttgaaaggactgatgaagctccaatattttggccccctaatgctaagagacaagtcactggaaaagactctgatgctgcggaagagtgaaggcaaaaggagaagagagtggcagaggatgagatgctagaatagcatcaccgactgaggagacatgagcttgagcaaactccaggacataatgaaggacagggaagcctgccatgctgcagtcaatggggttgcaaagagtcggacatgacttggcaactgaacaacaattacaacaacacactccttccttaggaattccttatattcctgaagaacttagtacagtgtggggcacagaggaaatcctcaacaaacatcttttgagtgatatctattgtctatttagcaacaagtgtttattgctgtttaccccgcataatactaggttgcaaatttcttttgactcttctcagagcccatcaatggggaacgcatttatcagaaattcagtgactcttctttgataaactcaaagtccaatcaagtttgatttaacaacaaccaactctgctactcattttacagaaaatgatgttacccagcaggtcaaagaaacttggtggcagctgttatttcacatgagtgataatattttcatctcctagtcttctaaaataaaaggccagtagactgtaaaaacagcatgaaccattctactaccagaaggccactgtttccttgtcacccagcaatcacttctgctagattccaacagttcactttgtcttttctgaatgtgctctttagagacactgaaatgcagctaggaattgcaatggcaagtagcatttttttttttttagcaatttccatgttaataaaggtttacaaataggaccaccacaagggagatgagaataaatgatgctaatagtagcagtgagaaaggaaatgtagaaattatctcagtttttatcaaaatatctcccatggaatagtcacgtggtaagtagttccatgaaggaggagttctatgatcacatgaatttggggaaaatcacaaagaatgggaccatcttgaagatgggaaaagtgtgttaccatgttcaaaacttcaagaaactttctacagttacagaaatgtgacacaattcaactcaagaagtagaaattgctagtgctcattcacatctgggttttttcccacctttcctaagcaaaagaagagtctcaaccctttgccacagggtggaaacctaaggctagttccaatcaatgaaatgtgagtgtgtgtgtgtgattagtgtcactttcaagttgaggccaagagaggcttctgtgtgggcttccagatcagtaatttcctacaaggaaatcatgagtgccatgatgttccaaagacagagccgtttgatgggaatacatcatgtcactaagtcaccccatggaagctggctaccccgggaagttccccaagtaccacaggacttcaaatgagcaagaaaaaaaaatcctttttaaatttaaaccactgactcttcagaattcatttgttaccacagcatagcctaccctcatttatcaaatagttcttaaattgatttaactacagaattctttattctcaaaaaaatatatatcacacagaaaaattattacagggaaatgcgctgggaatcaccatgatatctaaaatagttttgttttgtttttttttcttccaggaaccatggctaaaaacattttgagcaaatatagaccaacctgcaagagagacagagggagaattcaagagaggaagttcaaaagtggaagagaggtatgacagcagacaactgggttgaaaatccaaaaaccagagtcctccctgcttctgcatcccctataaatttctcagtgttgtagacccagtgtttcttctttcaacaat

SEQ ID NO: 60462 - DNA, 856 bp, Bovine  19866880833915
aaatgcaaaatgtataatttttttttctactttccccctgaatttcctccagcattcacactgatagtgcattaaacaagcagtctacatggtttgtgatttttgtgctgagtcgtatgtcctcctaacgggtagcattaacaatgatgatttttctctgacaagcaacagtaggtttgggacagcatcatgctttattctcttccttgggaaggaggattattaaatttttatctagtgattcagatgaaatattaaatctctttcaaggaaaaaaaattcttcctaactttctcatatctcataatatgtgatacacacattttaatgacttatctagtatcactgccttcttaagaaaataaaaatgatattctgattgtagagctcaccatcattatcatcatagcaattgtttgttgaagaattcctatatattaggcagaattgtccatactaattaagacagagcattaagttttttaatttaaccattgtgataatgctatgagctaaaaagtgtgattactattattttatacaggaaaaaaacagatatgagaagataaagaacttgtcttaggtcatatagctagtaattcaaggagtcagattttaattcagatctcaatgactagagaacatatgtgctatttgctacattatcttatactcatttttttaacagaaaaaaatgttaagctataagaaaatcaactgatttaattttaaaaaattataaaccactgttcaggggctatttctgggctgaatgcatattcaaccccaatcacagctatcaacagtcgtttaacctagaaattccataacattcagaggaaattgaaataaaaat

SEQ ID NO: 60463 - DNA, 1374 bp, Bovine  19866880959152
atgttacataaagaaaataatgatcagcttactagttaaaacaggtaaataactctctgctgggggaaaaaatagtaaattgccaaaataaaaggcactaaacaaatactaagtactcctggtaaagaaatattgcttgcattagccaaatctgtttgtccaatttctgtgatgctttttcttgcttctctagaactctaatcgaaaaagcaatgacattcctcagtttggagagcctgtcacattaacatatcgatcagtgatggcttttccaagggccttatgtggaaatatccattcacaaggaccctattatataaagagcatgaaataaataaataagaatggccatctttgtcattttccagctgtcttcactgaagtaaggaatcagtttttgtggttaaaggtctaacaacttctgatcttaaccattagtaccagacaaaagattaaggctccactgatttactgccaaagcccagagaggtatttcagagatttgtctttaaacctccaaaccttgataatgcaccccattaatataataaatttgagtatatactccttaatatatgcacttcatggtaaattacacatatactattatatttgtatattatgcactttagaaaacatacaaaatgttaaaagggtgaaataaaagtatataaatacaaagctcttatttaagagcacctgaatagtcttactgacctccatgcaatatgtgaacccacataagagatttatcttctatcacatcaaggagctatatactactaacagtggtgggtatcacctgcttgtgctgtctgtcccaaataataactatgtttcatcctgtatgcttatgataatagcactcataagagacagacctcttctccactgtacacatttgttcattaccctctggatcactggggcattgtctgatgtccacatttctcagtgggcattgattgagctggagcctctggtgatttatcagtctttccagatgaaatagtcaacctcacatgccttccttctctacaatttacttttctttgggggctgaaaatactgccatttggttgaaagtacttgcatgcctttgcagcaaaatatttttactagcaaagagaaaagaagcaaacccagtatctgggactgtaacccaaaaggtagtgctaataaatacccaaatacatattaactttagaaagtacttaccaaatataattttataaactattaaatttcttggcaacttcctttttcctttaattttatattctgttctttactaagccattttaaattttaacacaaaagtaatgttttaaatgatgagcaccacataaatgaatgccattcagggagataatc

SEQ ID NO: 60464 - DNA, 493 bp, Bovine  19866880975669
tgattggaggttgtcaggcccaccttgcaagacaactcctctctccctggaaggaggagtaccttgaaatctgtgggttaacgggaaagggaaaagtccttacgctggggggaaggcggggcaagccgaaacaggcatatctctcacccggggtttctgaaacccattctccgaggggggagacgtgacggtattcaaggatacttggaacctgtccctttggcggagacacgtagccgcctccagccgctactcgcggccgatcctgtgcagtggagctcccccgcccccggcaggctccctccgctttgcaaagggaggggggagctggggaagccttgcacactagtcttcctggagctgcagacgaggagctccgtgccctcccgagcctcttcagcggcttcccctcggctgcgcgggtgtgcaggctctcctcgccacccccacgcacggctcgccctcccttcctccctccaaccccgcggccgga

SEQ ID NO: 60465 - DNA, 1474 bp, Bovine  19866881077984
tgtcagtctgttcaggcaagagagttaaaatcttaggagagtctggaatcacaagtttcttgcattcaaaaataatgtggcagcattttcagcccagctgtgaagtgctgcatgactaagaaaatacaagtcccctaggagacacactgtgctacatgataatgaaatcaggatgaggccagctttatgatctgtttggtcatctgagaggccagttttttttttgttgttgtttttaaaccaagctttaaatagaaatttcttcattgtaaatactcttttaaaggcagcttttctgctcatcactttccatcttctcttttttaaagtctaacttcccccccaaaacactctctccgaaggaacagttctgctcctgaataataattttgtaaaagtaacatgaaatgcttgcatttatagggtgtaggactgacaatatataccgttttggatgtgtgctaagtcgcttcggttgtgtccaactctttgcaaccctatggactgtagcccaccaggctcttctgtccatgggattctccaggcaagaatactccagtgagttgccatgccctcctccaggagatcttcctgacccagggatcaaacctgcgtcttctacaatttcttcattggcagcagggttctttacaagtagctccacctgggaagcccaggtatattttttagagcttaattaagaagatatcaccataaaagttctgggttgatctttatacttggtgagggctgagtctggacaagggaagcaaaatcaacatgaatttttatcatgtaagagttgaagtagaagccattatgtactacagttggttagcacatttcattggtgtaataatgacatcaccctccttgttaagggaatctagtgacacagtcgccatgtttgaagacggacaccatgaccggtgctgccactaaatcaaaagtttgtaattggtcaaggatttttaaaactgtttgtgttttcctccagtgttccatcccacctccactcttatttactattttgatgcagatatttgggctctggtccatctgaacgtactgattcagaactgctttctagatatgcgctggactctgcatttttcagaagccaaatgtgattcttatacataatagtatgttggaactaatcctttgacaaatgaaatcataaatggaacccccaaacacaaatgtactatgccacatgttggtcttttcatagatgtatgcattccaatcacttgtatgtgactggccctcccccagccatgaaaacatccaccatgaccttcagttcttcactctttacttcctggtttcctagcctgctggcctccaaaccttgacttgtgatagtaagctgatatttctctttctttttggtggccactctggacaagcttttcacccttcagatccatgcaccacatcacagggaagagacaaactggggtcacaggca

SEQ ID NO: 60466 - DNA, 1741 bp, Bovine  19866881097148
ccaagatagggaatatctttatgtcttagttaaacacaatttaaaaaattaaatggttctatcttaatgacggaagggatatataaatctaccatctcttccctgtacatagaaataaccctctgtcttttcacagacaaaataatatgatattgcttaaatgttgaattaaaaaaagaatcaaagtgtaatgaaaatctaattattagttttagaccccagctcagcaaaactcccatcatgatgaatgatatatagaatattccacagtagtcttagaaaataaatttacgatgatatgttaggtttgaaactactatagaaaatctctaagatcattgagtcatatttggaagtttcatggaatcagctaaggtggagtattgttttactttccagtagacttgcagacattcatagtataatttaaatctcttttagaaaatgaacaaatttgcttttcattacatattaatatggccctaattgctttattaccattagcaatttagttgtattatttaaagtgtgcatgcataaatacatgcttaatactttgattttttttcctgagtataaaatgcttaaatattaatacagtgacccaagttcttttgaaggcattcttattttatgttttattgagtattaattaaagactgtttgctaatcatccctcgttaggtcacatattaatagagtttttctgtggacaagacactggttaaacttactctatattagagaaatttcatagcctttcatgttacatgagaatgcagctaaattgtagtctgcatgaaaactcagagtaaattccatgggaattcttgaggtgcaaatcagtcttacactaattgtactaacctgaatttgcacaatgcttgataactctcatagctctttcttatctcaatttcacctctgatcttcacaatatgctcaagacggtagtaatataggtattataatctttaatttgtaaatgcccttgttcagttgcagtctatgaggaatctgcccaatattgaatcccacttcagaaacaaggttcaagtatacttgctggactttttccttgtagtatactggttttaggtccctgaagtactcactcattgctgacttctgtgcttttgattgtgttctatggttatttttatgccagtatctaaatgaagttatgaataatttttcattaaagaatttcattttggcattgacacaaatcttctctttagaaaatggtattgaatcaagtgtctaatttgctgtgagcaataagtattaaaatagtaaggcataatggtcttgactctttccagagcatgtcctggatttgattgttttgctctgtgccttggcacattttttaatctttctgaacattgtttccctcatctttaaaaaggatataatggtttattttttattcagttctgagattaaatgagataatgtatataagcataaatgaaataagtatataagatacataataagcattgaataaatgttagtgaattccaactctttcttttgtaaaatgtattttaacccaagaaggaagaggaaatgcagaatattgtacagataaagtattttacacacattttcttgtaatacaataaaaaacaagaaacctgctgagaatatgtgtacctttctgatataaatcagtgaacaaacttgtttttaattttttggcagacttatgaaaccaattagctttgtaatatat

SEQ ID NO: 60467 - DNA, 1437 bp, Bovine  19866881233002
cactttttgaaaagatgcttgggaggctctgtagcatttggagtcatatgtgttgtctatatatccaagtaaactttatgcattctggcaggatttgatttcaaatggttagaaaatgctctctttgtggagccaattagaatagtgacatggatagtgcattattttttcttcctctgtagtggaactcctgtcagtattcctatatcttaattggctctatttgaaaggaaattttgaaatccccggctgcagtctaaatgtacttatttatcctttgaatttccatctggtgccgttgcagcagttgttgagaattacttgttttgctgctctttgggaaatgaggtgcagtggcacctgaattgatgagaacggtaccacctcagatgaggtggccttcgataatcatgggaggtggtggaatgtagttctgctaggtgcaaaggtgagaacataatttctagaagtatgcagttcagtgtggatgctttactcattaacatcgattttagagcaatgattctcaaactttttgtgttcacaagacactttggaatatgtagacctatttttgacctctcatttaaagggagtaaaagacaccaaatgacactgaatgagataacagtatatacataatcattttgtcttgtctaaatgtgtcacagactttgtaaaaacgcctgtgattatcacacttctgacttggtcattcttcagctcagtgttgttgttggaatattaaggtccactatactgatcttcctgtatgtatatttagaatgaaatcatagaatgagtttagcttgtattgtgtattcattttcttgagaggtaaaataaaactttaaattcactgactgatgatcttttaggcatagaaatggctctggacatcatctagcttgattttggcagaaatgaggaaactgagactcagagaaatcagatttatcaaaaatgaagaatcatttttggttatttcctgaagttttcagaaacttccaagaagaaaaataccttcttaatataggtttcttggagattttcctggtcatggagtcctatatgtcttcttaactcaggttctttggtaatttccacagcccagcaaaacctcaaataaaaagacgtggaaggaagttgctttatggtgtgattctcagtctgcctatgtccatatttttataaaccaaattataaactaacaggtattttcagttaattattccaaagctttgtaatcctcagactgcttgatcattcaggtcagtccagcttatcatcccagataaagaaagactaagaaagaatataattagtggtttatgcctgcattccatgaagcctggaaaatccttaaatagaggtccttaaaacagaggtcccatagggagggaaggttgagtaattacagaggtagggggtccaaga

SEQ ID NO: 60468 - DNA, 1176 bp, Bovine  19866881237981
ctaaatgataacatgatgcagttcaaaagctggtcatatcaaattgccatctaatcatttaattaaagccccatgctggcaccagccatcctcagggcccatttttcatttgggcacatttcattgcacttttcaaagcaaatttgccttttcaaaggcgaaaaatgcaaatgactaggtttgaaaggaaatgcataacactctgcataatgacagagattttcttggaaagcagtaatgcacagaaagagctatctttagggactgaggatggcttatcagccctataggaactctacatgatatttcattacagcaccaggatgcaaacagaagtgaaataccaaatacacaaaaactaaacagccatccccagtcttctttttcagcatcactgaaaccacattttgaaacaagatgcatcctttagaccggtaagaccaaggcaggcagtgataaatggaggacatttatagtgtggccaagaaaatgatgaaaaaactaggaggaattgacctgttcgaagacaataataggaacacctaaaggccaattaacataaagcgttagtgggcaaattcaagtacactcaaaaaaattctcaggaatacgaaaacacccactttaaggccgtgaaataatcacaataagggaatgaaagtgaccttaaccacataaatcagcatcttcctcttcggtgtggggaaactctcagaagcactgctccccaattactgcatcttttaccttgaaagatgaagctgcagcacaaattttatgaatctgcagatcccaaagtgagaagcaattagttcaaagaacagcgagtggcaaaaaacgaacacctgttaatttattctttaccattaaggagagaaggaaagcttaactttaggctgccagatagaccctttctccccatgaaagtgccaccagcatctggagcagcagcatccactgtgaagttgagagtctggataaagttcagggctgcagactattccgtttcatggccagagcacatgtggatatttcaaacaagagcttctgatcaggggaggttcactagtacttgaatcatggctggttagctcagccaaagcctccatcaagagtaagctaaagacctgattctattacttatatagaaaggatggccatccccagctgggaccc

SEQ ID NO: 60469 - DNA, 1249 bp, Bovine  19866881259149
catctcagagaacctgaaagagtgaactttttttaagataggaaaaaatattgaaaaaataagctgcaactcactaattgtttatcagcctatttcttttctctctactattggcaaagggaagaagaaaactgaaaacctgcctacacaagttttcccagctgtgctactcatcttcactgggggttgtctgttcaaggcagaaataaaaactgcaaaaattcagggttgtgttaagtacaaaaaccagtacatcctaatttcagagcccaatctcaattgctggcatttgaaatactttggagataggagtcataataatttcaaaaaagccttcccccgagaaagcagccagaccaagtcattcatctgcaatatcatagctgagggctcaaagcgagcccagagttcaggcatgtggtaattaggtctctaaatttactccactggctgggaaacctgtcaaagaaattcttatcacgggcagagttaattatacataaaatgacagaaaagacacgcgtgggagacaaaaggtgtcctggagagagagatggccagaggaagggcagtgaacggccgtgtttagattgggtccctgtgaatatggaaccctaccagcctacaagtacaaatgagtctagtgggattggaaaacactgtcttcagtgtccagacagatttatgttgagttcattcatggaaaggtaaaatacactacaaatccagtaaccgagaactttctactcttcaatttacttcctcaccagtacaagaagttctttacatttttctttcatttcattcatttgttcaaacatcactgactaatatagacattcatcagacagaaaacatgacgtagaatgacagacaaagccctcccctcgcaccactgacagtctgaacagaaacagagatcaaacagcaaaacacaaaacaaataggtctttctctactgtgatgagtacttcataggaaaagaacggtgcaagggaaggcatatttgggataaagtgtataatttgaattgtgaaggaaagtggaagggggtgatatttacatttcagactggaagcaaaatagaaatatgtacattaagaacaagcagaggagtgtcccaggttagagggttttaaaatcctttgtttcacttaggtctcttgttaaaaaaaaaaaaaaaaaaattctttatttacttgtactgggtctaggttgcagcattcaggatctttcgttgcggcatgtg

SEQ ID NO: 60470 - DNA, 1142 bp, Bovine  19866881291247
aacataagacatatcagaatagaattttggagctggaagtggaactaaacagcatccaatctaatcctttcttactgcaggcaaagacatgtgagttcaaagaagttaagttccttcctcgtacatagttgagccgggacatgagcacttacttttccactttttgcccagtgcttttccactatcaaaaagaattataatacaacaagcaggaccaaagttataaaacttccactccagacagggatttgcctcaaatgaagtttacttagcaattctagttctgtctcctgcctactttttcctccttaattattgttgttaatttgtatttattgattcatctgccaggtgaactatttcattgcacaagctagtattataaaccctcttagagattacacactaaaaaggacaaaatgtggctgtaatttaaaaccttgttttccaggactttaccaacatttctcttatcttctaaaatagatttttctttgtagcagtctgttcagcaccaatcacaagattcttggaaggatgagaaactgatttcttttcctttcctgttcttatttcattattacccctttaccttttcaaactctgcttcattacttcttttggaggatggattgactaggtttattgatttattcaataaatattatatttggtgactactatataccagtcttaggctgaactctgggaaacagaaagacaaaaaaagtactgagttcctgagttcctgtggacttatcatttagcatagggaggaggaaacctgtggcagagggaccgactgggatgaagtggcaagagcagtttcttgtcttttttgcagcatgacatagacagaaaatgataatattgtatgacaaatggcaggaccctggtggtagtttggaagcctgagaggttattcttggatagatgcaaatgagtggtattataatagagcttggctgtgcacagcccttagcacgcagctgttagtatgtgccattaccccacaccctgttaccaggcagcagttatcccgggactgttagtggtcctgcttagccattggttggtaatgcagtgggcccctcccccaagcgaccaactgtcaataaatgaccggttagtggtcctgctca

SEQ ID NO: 60471 - DNA, 1069 bp, Bovine  19866881316410
cgagttccttgtgctatacagtaggtccttattaggtatctattttatataatagtagtacctatattgcccagggatcttaatgcacagccaagagtgatgaacacaacagtggtgagccacttgtttgctttgaaggcatgcttgcaagccttctgcatgtatatagcctggactttgcaaaatttcaagataaagctcatactgagaaggaggaaagagggactaaatgatttgcttccagggcaaatcccaagtgtcagagacatttctggaagagcatcctggcaggtcctacattggtaagcttgtggatttctgggattcccagtctgctttccaaacaaggaaatatgacctgacagggatcttcctttgatgttatcgagggtgatatttcaaggagacatggaagatgtatgaaagttcattgccaagcccctgacacaggggtgttggcagaagagcagttcagatcactcttccccttcctttttagtgcttttttttttttaaaagatgggcgcagtcaccttaggacccttctctctacctctggggtgccttggagtctgactaaatagaccagcctaaatatatcctcagacacagaactgtgtgcagtgtactctgatgttgttaacacacagatctttatcacatggtgtcaatattatggagacagttaagacacagatcattggtgcaatatattgtggatgatcctttggaaacattataattagtgctgacaaggcagtagaaatagctcaacacagcaccttccctgcctcccaaaaggcttgccaagtcaacccaaagtaacaagactttgattattcaaggagagaaggcacagttaagaattctctttgcccctcaactgtagtcattctgagattattggtgctgtattttgtattttttgttggggggtaattgatttacaatattgtgttgatttctgtcgtacatcaacatgaatcagccacaggtatacatatgttccccacctcctgaactcctctgccacctcccaccccatcctacacctataggttgatacaga

SEQ ID NO: 60472 - DNA, 803 bp, Bovine  19866881366658
tagaaaaaaagagctttatattccattgattcattaataaatgatataatcacattttgctctcgtattaagaagaattttcagtctgaatagaatctttctgcctcatattctcagttttgaactattaatgttttccacttaaacaatattcttgttgattaacaattcaattttcaaatacttatgttctgtaagaggtattattgaacatctaatttgcttgagttgagtattatttttctattacatacatttattatcttgaccagcaatcatattttaagtgaaatatatggaaataaagacagtatgattaggagtaaaatagtaggagtgatatattttttgaattaaaatttaaaaataaatatattgtgtcagcactcaggcagagccccatctccagtgactgacctagaaggaccagtgaaggtgaaaagacaatcggaaaagcacccccagataacctgtcaggccctctaaaaatagatacttctgaggagcttaagttaggtcaattggtttgactgacagtgagacccaggatcaaaacaggtgcccagagattgttctgatgtgtgaggcctaagcttgcaacgcagcaaaagaagagtcaggagctgttatgagctaagttgtgtgtctcccaaattcatatgttgatgatctacgccagtacctcaggatggggttgcctttggaagtagaatcttaaaagaggcaactgagttaaaatgaggtgattagactccgatccaataagagcagtgctcttataagaagagatagacacagacagg

SEQ ID NO: 60473 - DNA, 1552 bp, Bovine  19866881404069
ttaaaaattgtctgaggataatgactgtctttggcaggtttgttaaaaaaaacaaaacaaaactttgtatttagtatagtaataacttttactgaatgtataatatatgccaggcactttgcatagattacttattttaaacttcagtgccagtctatgagttgggtatttctttttgttttatacaagaggaaagtggagctaagagaggttgagtaacttacctgaggtcacacagtagctaggggttaacccggatttgaaccaggctgtcttatttcagagctcatgtcctaactcttatatgacagcccttcactagtgtagatctaggatctaatagatgctagatcattataccaatttaccttatatgacaacaacataatcataaaggaaaattagatgataggaaacaattacaaaaaaataaataaactcatccataaatccactatacagtgataagcactgctagcatgtatgcttgaatcttttcatgtttctctctaagtctgcacatttatacatatttggattacactatactgcttatgtgattttataactctttaaaaaattaacaataccatcagcaatttttttgtcaatagatatactcatataacatcaatgttagttgtaatttattttctgttttatgagtatgccataatatattgaactgttcttctctagatgggcatctagaaatgtgcctggatactgagaattatcttaaatggcaagccactccagtattcttgcctgggaaatcccatggacagaggagcctggcaggttacagtccatagggtcacaaagagttggatgtgacttagcaactaaacaaacagatagtctgagaattatctgatctgtggatgtattattaacctgaagtatagaccttgaagcagagaactctgaattttattggaaaggataaaattcatgtagttaaattctcccatttaatagatgagaaagccaaggtccaggtaggtaaagtagaggtattacattcacaattataaactaggactattatcttctcatccatctattcatttatcccttcattccttccatccctccctccatccatccatctgtccatcaagtattagtgagtgcttatttatgtaggatactgttctgtgtacagcagtgaccaaaacaaatcaaagacccttccatcattggagcaaacatgatggaggaattcataacctggtctcttttactgccccacattgccagttttctagatcacttgtttttgtgtcatcctatcaaagatgccagccaagtagaactgctcgatgcaagacacagtcctttcctcactgagtttacaccaagggaaaactgtgtctttctaagcaaaacaaacaagtgtagtctgctcaaaccccctgcaggggcattttgctccactgtccagaggtatttaggtatgccctgtcaatttttaatggtcctcttctcctaccctactccttacacttgaagaaacacaatttgtttcccacaaaagactgcagtcaag

SEQ ID NO: 60474 - DNA, 2083 bp, Bovine  19866881503141
actttttcacttagagtaacttttatttaataaaacctgtaacactggatcttcactaaagatgatcttgcttcccaccatcagtggtgtgatgtctcattgttcttcacagttcaagtcctagaagaggtaacatatagatgcagtaccaaccagcaccataagtacagcatggacttgcatgtgttaattgttaccctaaatgctttacatgtaagacttcactgaatgttcacaacaccaaaatgaaatggatgctgctaatagactcattgtctagatgagaacactgagtcatggggagcttaatgaaattccccgatgtcacacagaaaagtcagaattggaagtccaagtccttttggactccagagttcttaaccaaaatgaaagtataacaaacctttactgtgttgtgattttctctgttttcctccctctgggatggtttccattatctctcaggaaagatgcatgaagtgaatgtcttggaggtagaactttattttccaaataggagccactataatatctttcattccacctgctcctttttaaaaatatgagcttgataaagggagtggttggggtatggactccagattggttggtttgcatagaaaagggtaaggctctgctatctctaaaaactagctaaccctttgagggtagtctctcaagcatcaggaaggctctagatgtaaaatcttcagaaatacagaaaataaaaagacatcttccacagatggttccagacccagacatcaactcagttcaagacttaaagtctttttatttgaggctccaaacattttatagcagagaaaatatatccttgctgggtctagtgtgaatccctgactgacagaaccatgaacatactgttttattccatgacattttacagcagaacagtttgttatgcagcagtagataaccaatactaagttttggcttgagtgatgatcgtttcaatcagttctagttcatttcgccttgtggaagggggaattcctgagtatgctgtttctcttggcattacattttcaccaattagtgctcatgaatgatatgaaaatgtgttttaggttatttttccctctgcctgcgggaagagttctcacagattagggatgctaatttttcaatgttctcatgaaattttcccttattaaaaagagaagagacaagctgcaattttaaaatctgcaccacctgaggcagccccagtgaaaaacatgtatcctgaccttcctcagcaaaaatgagttgcagtcatttgtctaatttgtaccaaaccagagggataaattctccagagtgtgcacagaacagtaagaagggagcaagcagggtttgaagagggctctttcgatctgatttagcttgcatttcataataacagaactctggtctcaatgtaatagtagcaccgacacagaagaggggaaatttatgtattttgtgggaagatatgaaaattatatttcaaacacatacatctatttgaaaaaagaatctaagagctttgaagattcaaccccatgagatgtggaaaagtgacatgacaatcttcatgttaagataaagacagaaatgaggacaggaaggaaaataaattagggacaaagctgaattcttcttctgccaccttatcgaaaaccatgcctctgggaagttcagaatacagtcccatgttgagggggtaattttaaatgataggggaaaaaagccctcatagacttgactttaagtaaaagtagtcgcaggttattaaggcttccatcagaaagtaaggacaaatgtatgataatgtgtgacttccattttatcccaacataggcaactatatatttagtaataattttggtcataaaatctagaagttgctttgggctcagaacaaaaaaggatgagtcaaaaatgactgcaaagtatttctgattctattcacacttaaaatagtcacttgaatttttaccgaaacctactgtatccatggcactgaggtatgatgttcatgtcagacaacacaggcacacttcccagagtatatactcttcccttgaactaagggaactaa

SEQ ID NO: 60475 - DNA, 882 bp, Bovine  19866881608092
atataattgccaaggatcacatgtagtcagacaaaattctacctcaatccaagtaattaatcctagttctttcctccccttagtcagtggcctgggtcccaggatgacaagattctgagcagcttcttttttgtgtgtcagatttgaactcactgatctttgctacttctcccatttcttatccttttctaataatctacattagttattcagctgctttccgccataaccaagcaaggtttggaattttgtgaagcgataaaggtgagctctattggaaaataagattctggctgccagtggaacatttgaatgcatggttgttttataaatgactttttctgctcatagtccattgatactgcttcagggaattggagatttggataaatattttcttggcttaatcctttcctacattccaagcttctctcctttcttccctcagcctgcccccaacccctggctgccatccattcatacatccattaattgatttacttctggaatattaactgagttgctactacatagaaaaccttctgataacctctgccctatatttcagtgataaaaaatatccgaaccttgccttccaggttcaactcacaaactagtggaagaggtaagatacacatacaaccaaagtgaaagtgaaagtgaagtcgctcagtcgtgtcagactcttttctaccccatggactgtagcctaccaagcttctccgtccatgggattctccaggcaagaatactggagtgggttgccatttccttctccaggggattttctcaacccagggatcaaacccaggtctcccgcattgcaggcagacgctttaacctctgagccaccaaaattcaaggcaaaaagaataaatacag

SEQ ID NO: 60476 - DNA, 1742 bp, Bovine  19866881615306
aatcaggtgtcaaggatgtactggcatataagatatgttgaagaggtcagtgaaacaaaatagcaattgatatatttcttgtgtgtgtacagaatagtagaattttaaaatatatgattttttattagcatttaaagtttcaataatactattttttaaacttgacagtacctaattttctctttaatatatcttccaagctatgttctttctaggaaatatagatacttttcataaactattgtccatgaacatgtagatcagtttttaagaaaatcagaagatattgaactaaagttcagtagttaatataaaaaagtaatacagtactaatttctgtaggaaaaaaagatggattttgcgtttgttatatcaaatataatggatgggaaaatccccacactggtgagtagtttgcagaatcatacagagcaattactccttttatttataaattgtaaaattttttctgacagtcatgggcattcaagagacctcttttccaatagagggtgcttctactccataagttatggtgaaccccaacagatgaaggcacccaaaataattcttctaaataaatgcatcatagctagttagctacatgaaattatgagttctattcagttcgagcccaaaatgaagaattttaagccaaggggtcagaagtctacccattcattttttaagttctagtcttgttacatgctttatttcagcactttcaggttaaacaaggaaactatagttagtagtatagagaaatgtttagagagactcccaaggtgccctctcagagaaggcaatggcaacccactccagttctcttgcctggcaaatcccatggaaggaggagcctggtaggctgcagtccatggggttaggagtcagacatgactgagcaacttcactttcacttttcactttcatgcaaaggaaattgcaacccactccagtgttcttgcctggagaatcccagggacgggggagcctggtgggctgccatctctggggtcgcacagagtcggacacgactgaagcaacttagcagcagcagcagtagcaaggtatcctctgaatgaggtgtgagtaactttgcctctcaaggaacctacatttgccgagtgtgtttctatttctctttctaataattttagactatgtctacctacttggcctctggctacctgaaaggagtgaatatggactatatgatgatgaatcattcacgggaatggtttggagaatgaattttcttagagacctgatgctaaagcgtggaaggaccttagcctttttcatgcctccttgcatttgatatcagtgttctcgttgtgtgactgcccttgttgtttgtctaccgattgaatcctcaatcctcatcaatctctaaaagcagcacacaatgtagaattaaatattccttccattttactcccccagccacatttcttgtaattattaatggcatttgctttattttgtcttgtataattattagttgtttccatatttgtctcttctcagagactgaaaataccccctggggaactggcttttattcatctttgagctcttctggtaccaataggctgcacataaagggtccccagtaaacatttattgatttgaagtcagtgtttcttagagccatactacatgtaaatattgaacttagaataacaatcgcaactccatagactttttagaaatgcagttgtctgtatgtgttgataagaata

SEQ ID NO: 60477 - DNA, 1168 bp, Bovine  19866880107869
tttattgtgatccacccccgtccaaaggctttggcatagtcaataaagcagaaatagatgtttttctggaactctcttgctttttccatgatccagcagatgttggcaatttgatctctggttcctctgccttttctaaaaccagcttgaacatctggaagttcacggttcacgtattgctgaagcctggcttggagaattttgagcatcactttgctagcgtgtgagatgagtgcaattgtgcggtagtttgagcattctttggcattgcctttctttgggattggaatgaaaactgaccttttccagtcctgtggccactgctgagttttccaaatttgctggcatattgagtgcagtactttcacagcatcatctttcaggatttgaaatagctcaactggaattccattacctccactagctttgttcatagtgatgctttctaaggcccactggacttcacattccaggatgtctggctctaggtgagtgatcacaccatcgtgattatcttggtcatgtagatctttttatacagttcttctatgtattcttgccacctcttcttaatatcttctgcttctgttaggtccataccatttctgtccttacacagatctaaactgtgaaaagctcaatgagatttaggaatggaatgatgaagagtcatgcacatttttggtgctaaattgcttcagttgtgtccgactctgtgcgaccccatagacggcagcacacaaggctccaccatccctgggattctccacgcaagaacactggactgggttgccatttccttctccaatgcatgaaagtgaaaagtgaaagtgaagtcgctcagtcgtgtcagactcgtagcgaccccatggactgcagcccaccaggctcctccatccatgggattttccaggcaagagtactggagtggggtgccattgccttctccaccatctcacctaattctaagttatcttcagcttatggtgatagttaaacaagacagcatccttggtatataagggcagagtgtggaagaaggccctggaggagttcaggggacttcctgttgggtttgttttgtttttttttttgcttgcttcacttgaccacactgacactctaacaataaatactcagaaacattctagcaaatgttcaggagtgg

SEQ ID NO: 60478 - DNA, 1444 bp, Bovine  19866880408170
atatatagtagtttcttagacttctcaaagtttcttcttagtctgtttcagtgataaagtggtaaaatatgaagtagagaatgtgtgatatatgtgttaggacccttcagtccatatgaaatttaactcttcaagagagatgagagaggattcgtgtattatggcagaaccttttaaatgaacatgcagaaaatgataaatatgtccaatggactaatttcctcacagccaggtaatattcaggaataaggccacactgaggtaaggggaagagtggtgcaaaaatggaaattgaggaaaaagatcacatggtggaatagaatctattatgcaagaatttggttggcatttttcactatccaaacagataatctctaccttttaatttggatgtttagaccatttacatctaatgtgactgttgacatactttggtttatagcagtcatcttgttatttgttttctttgttccatctggtctttgttctcttctagcattctactttaaaatacgtgtaaaaagaaaattttaaagcatgattgaatagccaaaggcacagattctgcctatggagtcagatctgcctggatgcaaatctctgctttcctgttacatagctttatgtaacaattccttacctcaggacttacacatgtaagatgagggaaatggtaattcatagccaaaaggttgtattgaggattaaataagctagtagaagtaaagggcacagtgtggtgtctggctcatcataacggtacactattatgtcgggtgttgcaatggtacttatgctattgacattatacaaatgcaaagttaaatatgaaaaacgggtcgagaaataaagttcttattttgaggcatcaagttttggtggtatcgtttaggaggagtaaaaatatattgcattttgaattaactaccgaagagacatgttggattataatcatctttccctgcctttagataagtgtccgcaaaagtcaaacttattaataagttgctgcaaatgttcatatgtatttcctgtcactattgctccttccttcccatctagaggtttctctgtttggtttgccaccatcactatgagttctccttaaactcttgtaaactgtatcctaagtggtcttcctgcggggttttcttctctcaacttgcctcatgcatgggtatctgaggagctcttctaaagcattccctaatcataactttctcttccaccataatctccagtggctccctgttgttctagcatcaactttaagcttcttggcacaacatacaaggctgtctctgttctaactcttcctgtcttcctttctagctctgtcttcactggtgtctcttcctcattttgtgctttggcataccaaactactctctgtcctccatgcatgccaagtgtgtcctttctctcctccgtgattttgttcatg

SEQ ID NO: 60479 - DNA, 3392 bp, Bovine  19866880460393
ctggttttgacactaagcagttggctaaagtctatgaaattagcaggctgtggttgcttatacatctcacccatcacaactttattgacgagaatggctaccagctgtcacctctgcctccgcctctgtgcttggtgattcagactgcgtggccacagcaaatcaagccatgatcctgctatggctcttcgtgttggggtttgaactcctggccaaatggctgttgctcagctgttatgctgccaatcacctgtcactgagggttaaatgtgataggcttacccatatcttccaactcttcagacatctcaaaggcaacttgccttccacagcaggaggcagcagtcttagtgatattcaactcctggattttagaattcctgacttctggggggcagggtacagaggaaacttgctattttacagaacaagctgcagaagggcctcaaacccatgagtgggaaaaatgatgtcaggagcatatcacctaagtcataccaattttgagatcactggaaaatgtatccacacaaatgaaccatactcttggcataatggatcatagctcattacaaaaagaaagctgcctgaaatctttcacatactattgctgtgttttaatttttccctgtcagataggcaaagacataagattcagaaaatcctctcttttataaaggttttattataattgtatttgagatctgacatgcactatctttttttacttccgtataaattttatttattttttttatttttttaaattttattttatttttaaactttacataattgtattagttttgccaaatatcaaaatgaatccgccacaggtatacatgtgttccccatcctgaaccctcctccctcctccctccccataccatccctttgggtcgtcccagtgcactagccccaagcatccagtatcgtgcatcgaacctggactggcatcttgtttcatacatgatattttacatgtttcaatgccattctcccaaatcttcccaccctctccctctcccatagagtccataagactgttctatacatcagtgtctcttttgctgtctttcctccaaaagtgagagaaatagtttcatctttctgaagttacaaaattattattctaatcatagaagagtatttcacagactcattttttttccccctcaagtaacttcatacttaggaagtggggacagagaggaaattgacacttactgaatagctgccatgtgccaggtcccatgcgggatactttgtgtaaattacctgctatgatcttcacaacagtcctgagaattagaccttaatgagtcccattttgtagctaaggaaactaaggttcagaagttaagcaatttcccctaaaccatatgacaaacctggtggtacagccaggatttaaagtaattttgactcccaagtccacgtgctcaggatggtatataaaactctccccaaagctttgactggtgccatatccaagatggaaatcaatgttagagctggtctactaaaaagagcattgggtgaagactcagaacagggctctgatatttgtcattaagcttatgtaacacataaggggagacaacttatgtagactctctgtgcttctgtttgatctgtttggggagaaaacaaaatctgcttttctacacacagaagtcttttgagggaaaaagttcaataattcttgtcacagcacagttaattttcctataaggtttctttactattacttggacagagtccccaaactaataagggtttcataaaatgtgacatcacattttatgattctatgtgaaaaaaatgaaatacataaatgcaattcaagagtgttgttgacatcattattaatcaattattgactacaatgctgcttcactcaatggtgaggtggtaaagataccatctgaagaactgcctttttgcagccagattctggagctctacatgaagtccataagggaggaaatgattcccacccaaagaggttctatccatgggtttactctgaaatttaatcttgagtcctgtgatgccaaccactgcaccaaagtttcatcttcagcatttccatgccgtgtcagtatgataccaggaaaaagcagacctcagttccacactggctttgcagcttcttctctaactgttaattaggttaacagtactttacctgctgggtgtttaattctaacatgggcaataatttgatttcagaacaaaggacattcctttgcatcacaagttactttatggtaagaattttactgcttgtgcccagtgaggtttggcagagcccatttcttgacagaaatctcgaggctaaggccagactctgtctctgctatacaccacttccctgaagccatgtttctggagctctctgtatgtcctgacccagctcacagacaaggcacattttcccaaagtaaatcacaatccttaaccatcaccccccaaaacattctccttctctaagaagttatacctgtggttatcagaaaccagttgcagacctttacctacagagagtcagagaaggtcagacagtgcaagtagactctgcaggaccctcacattgcctgaaaggcaccttccttcagttaatcagagcttggaagacagtggagctagcgtgagctctccattcacctcaagctcaggtgcaccagttaattccttcccctagatgttgttttactcttgtgtggaaatggcctgaaataccaggaatggagaggcagctggctcctgccaagaagagtttggaacttttcttccctcacattttgagaaatcacatgttttgtgcaaaacaaccaggaatatttccaaaagacagaaacagaacgagtgaagaaacaatggaatagggtggaatgatagagatgcatagaggagcatgcttgttttcctcctatctgtccaaagtggatattttccctcactgggtacattcatttgactttcctctactgtttgactcgtgatcaacaatgtgcttatgcacagattcatcaaactgaaaaacatctgcctaatcatttttaccttcaagaagcttgggccatttcaatgtattatggttggttgtttagtcactaagtcatgtctgactcttttgcaatcccatggactgtagcccaccaggatcctctgtccatgggatttcccaggcaagaatactggagtgggttggcatttccttctctgggggattttcctgacccagggattgaacccatatatcctgcattggcaggcagattctttactactgaggcaccaggggaagccatttcaaagtatatcctcagctatatatcacaatgattttgactctttggtgtttaatagaattcccttccaaggag

SEQ ID NO: 60480 - DNA, 4165 bp, Bovine  19866880499267
tcgaggacatctaaagcctttttgaaatttaaatatttagtgcatttatttaacacaatttcactggcgttctcctatcaaatcttcacaccagctatgttaagtaggtgaaaagtataaaccgaaagctcagaaaggttacctgaccctggtcagagagctaggaggaaggagcaataggcaatccagatgtatcatgagtcctataagcaagttctttccaggagccatgcagcctgcatttcactgtcctttaaggtacattggtagttaaatgacgatccacctgggacagatagccaaaatgcagtttaatatataatatcccgatgctttcatttaatctttatctgagaataattgaactggcatgtattgagtacccgttatatgccaaatcttgggctttaccccctaatgctccatttaatcttcacagtaatctgttagatagatgttatcatcatcattagtagcatttttacaggaaactgaggtgtggaaatgttcagcacagtccaatggggcagtatttgaaaaaaacttgaagcttcagacagctattaacttatgaaatatgaaattactgaatgtctggaggcagtgtggaatagcctcagcaggaatttgcagagatatcctggatttcttggtgaaaattaacaaaacaatgggaaagatgatggtgagccttctgtttgaagaccacctaagccatcttttatccaaaagaagggtgcattaaactctcttgtcacaatctacatttctgttgtgattagtttctcagatgtgctaacttctgagagctggtactaaagcaaggaaccaagaaaaacaaactttttggagactgacaggcagtaaaaagtctggggtgtgttatgcaaaggcagccataggcagtagttctgactgctagaacctaagctaaaaaacactgttgataaaatagataactaactgatcattgactgtggaaggaggaaggcactatggggtgcttagcagctcaccaagcacacttcagaaaagaggagagaaaacatggtcaaagaggacaaagagggtaggagctgggacagaatctctttaaaactgtagttttttcatctgtccagtgagggcattgggctcctccatggggcctatgcctgggtttccaaggaccctcaatcagtagcttccttggcttttcctgaaccagcatgaaatcccaagactttatgtcctgaaattcagcatcctacattcacttccagatttggatcctgccaatcaacaaccatcaaaccactgaagcacctattcagtacactaggtctctccagttactgactactattctaacatctttattctgtttatatttaatatgtttgggtgacttagcacctttaaaaaattattagcaaattcacatcttttccccattatttatacttacaagctagatataacaagaaataattcttattaaatactgtaagagtttgaagttctacaaggcctccacagggtatttctgtcagtatacacttaataactactgcagacaagcctatgcattttggatcaggttagtttcttgttatatgtggtgatgatcctctcaacagaagcaaaatcagtcagcaaggaaatgtttgatagatttaattgaaatagtataaaaaaacttggttcagttcttgttttcactggggttcactcctttcccctagcaagtagacaagggggtaggttttgtcactgatgtgaaaaactagtcttgatttcacttcttgtcctacctgacctctccccgacccctatctgaagactggagtcatcaaaataacacaccacactacgggtatccttaggaataaaaggctggggacaaggtcatgattcataatagaaacacttccccatgaccatcatattgaaagctccagttgatcacattatgtgatggcaagttaaatgtataattcatttgtttttggggaaaccaatcctacaataatggtacattttatgtgtactgtgtcagctagtgctagtttggtcaagaggccatatcactaagacatttatagaaccagattcaatgaatcttagcaattgattcttctctttggtgatctattattactgtgaaggcagacaggctgatactggatttcaggacttcagaaatagactgaaaagtgaaaaaatttcagttgtccttcggacaattgtggtctgtgacacaccccatcattatttggctttttccagtagtatcagcatgttccccaagtctcaggaggacagagttcccagattgaaacctcaatttatcagtcttgggtttgggctctgtagacataactccataccgtaattcataggaaaaagagtggaaaacctttaacaaataggataactgcttgctaaattaaatttccctgacttagaatatataagattttatgtggttcacaataaaattccctctgaattctcaagatcttattcatgaataagaagagtcttatttgctttagtggcttttccatattaaagattcaggaaaataagacctgtcctcagagcctgagtgcagtaattcattcattctccattctcataaaactgtgtgtttattagtttttaatggaagtcagctatgaactacagtgcttttattgggaacagttttccttactggagtccattttatattagagagtagtactttatattgaataaagtatgattaccatttgaaaagctatataatttaggccttatacaaagtcagactgtccatagcacaaatatacatccattctaaagtaatgaaatatagctgtactagcgccttatactaaagtataaaataacacaaatgtttcagtgtgtagtccacaagctgaaaactacatgggaaacatatggaaaagaacatagaaaattgggggaagaacagatgattgtttgtccctaattcttaatagtgaatgtccttccctttggacttttctctgttattggataagaggagagagctccaggtgaaaataacaaggaataagaacagacaaggctaagatgaaagcaagtttgccaaccatctgccagatgggaaatacaattcatgagcatctgagttgcccaagatattttaaagagagacataagttgtacatagaagataaactggctgagtctcgaactcagaaaaatctctaagaccacctattgttagtttttttaatgtatgaatacatacatctccatttctactttatagtctgagctagagaaaatgtactgcagcattattatccaggcctcattacctcgtggttaattagctaacatttgtaaagtgctttgaagatgaaaagcatcatataaatgctaagaattattaaataatatgagaggaaaatcataaaatagatacattgttaacattaatttgtattttatcttttcttattatctgctccctagcatttgacatttggggctgaactatatataaaaggctgagggagctgccacatttattatagttgtgaacagcagtattaacctagctccaaattaatatctgccaaaaatgagtcctcgggtgaaaacaaataaactgtccagagagatcagcacttatactggttgaacagttaactagttaaacgttttgtctcgtccagcaattaaaagaaaagctgtattagttaattaagacacaattaataaacattactgctttattcaaaacaatgcaaaatgtactaacgaatagtaaggtcagccaaacaattttggtgtgaaacatatgattctactttgcacccactgggtagctgcagatcccgcctctgaatagcttaggatgatatattacgggtatattatgtaatgttgactgttccctacttttttgctgtcatcaaagcaagttaaacttttcttagagctgcatttctactctctatcatcgcacctcctccctcctccaatcctaaatggacagaaggacagacggagggaaaccggccttagacagtctggcagtctgccagggactgatcttgaaggaaggaaaagctatagtcaaataatcttaaaatatgctctatcaggaacgctttcgataaaacaggaaataatagatcaagta

SEQ ID NO: 60481 - DNA, 1885 bp, Bovine  19866880625473
tgaactttgagtttacaaacataaagcaaactaagttaattcagcaaaataggttgtctatagagatacagacaaagatacaacaaaagaaatcaggataagaaagatccagcctcttccttccatttccaggactgctgacataaactgtgtttatttccagcatgaattaacatagaacataatgaatatacacacacatacatataatcacagtctgattattcatttaacagtccagaccagacataaactaaaaatatttactaccttttgtgtttattttcatagctgttcatgcaatcattcattcatttctactaaactttattcccataggagttagggatggcttacttcaaggatatatacttagcacatttagtttcttttgtttttaattttcttatcttaaaacatcatctgttttattattatgtctaccattaagacagggctgatataatagcctttcctttagaattggcatcaatctttccacagtattctacaaccattgttgtacttattagaagcaaaatattatgaaccctatgaatgacttttctgttgttcctgtgcccttttaagaaagtatgcccttaacacttcagcatgagccaggtgaccttaaatggctctactgtcaagctttgactcttctggtgatgcatctttgataacaaccagctctataaattaacaaccacaaaggtcctttaataatactggaacctgtttaattgctgtcctctacgaagccaagggaaatatatttctatttgtatctgacctttgggattttctgctgtcagtttaaagtctgtgggaggctgacagaaaaatttaacagctagctagaaagaagaaatgtattattataactaaaatcaaccaagctggggaggaaagggctggccaaactcctaggattacaaaagcaatattttatccagagtggctgtcccaagctaactcaagtgtcttgtaatctaatccctgaagatttaaacattttcacttatctcctaatcattcacctcctttgttggaaaggcaaaagaatctgtatattttacaaatttgatggcaaaaagcccagaaactatgacacaaatgtatcacagagtattatttgagcctagggtaataaatattttctgtcacccctggtatatatttaatagagacagcctgtatctagtatgataaaggcaatataatacttagaactatagctaataattgcaattctgcaccatggagaagaaagtgactgcaagaaaattgaaaaggtttaatttgtctgaggtacaagcaactacttacacaaatatattcctgtggcttgggggtaacctccacattcttattctcctactagacaattcactctaatgtttggaacaaccccagctcagaaaagggcagtgttgttttggtgtttgttatcaaagctggagtgaattgatgacagaggtaacagttcacaggtatttggcatttataaaagtacttctacatcattttttgtttttatttttaatacttctacttcaatgttccccttgggttttactaaaatgcagattttgatttatctgttcttggttagacctgaggatctgcatttctaacaagctcttaggtgatgacaatgtttctggtccttgggtcacacttttaagtagcaagaccttataacatgaccagcatggcatttgaaaagcatgggtactgccccaagttggaactttcaggtcttcattctcattgacccaagaatatgaacactttgagtttctttttgtcctggcaatcacttaccttgtcagtgaatcctataatcctgaagcaatgctgaattgcttcaaactgtcttctg

SEQ ID NO: 60482 - DNA, 3102 bp, Bovine  19866880638923
cagccccttaagcgtacccgctcccgcctccgctgccatgctttctctttccgtgttatatgccatcctcactgcagtccttacctgcatgatcatcatcagcaagttcagacctgtaacaagtcctagagctgggattcgtacttaggtttttctgactccccctgccttttttcttctgcaacattccatgtttcttaaagcgtgggatgtagatctctgatagtttgcacgttgattttagatggtgtgtggctatgaccttaaataacattgaattgtgtaaaagaaagttattccttttacaattctcactttaagttcttcagattaaggagaaagtcttagtggtattagtatgtcttaaattcttctcacctgtctttttaacaaaactttaagaagcccagaacattctgtgggaaatagaatctagctcaggtgtaataatgttgttttattctcactgaatttactttgtgattttcttctatttatggcaaataacacttacaatagtgagtttccacttacaatagtgagtaaagcttcattttaaaagaagtgtatttaagttaaaaaaagaaattaagttgatttttaaaatattgaagaacagtacaggtgtcttgaatatagcaaaaaaaaaagtttatgtggcagctcaatgacggaagtttgaaaaatactttcctgcaacatggcaattttaaaaataggcatctccgcacctgttagccaatgggaactttcatctaccatttgattacaccagacaggcaactggtttttcagggtccatggttccaaagtccaactggttcctcaaaggtccagccaggacctttgaactttgttgctgctaccagctcaagaggaatcctgaaacacaggtgactgataaccatggacagcaggaaagggcaggcattcaccctctcaagtagttaatgaaatgcagatcaaaacaaatgatacgccatttttttcacctattgaattgtcaggctttttcttcaagatgctggtccatgatactgaaagccttcagaaacaagtcatctcaggtacaggtgacagaagtgtattttgctacgtacttcctagaaggcaattggaaataaaatttgtaaattttaaaaatatatataatctgtggccaataattccacttctagggacttatcctaagaaaataatgtgaattgtcaaagctcaaactatgagtatgttccccgcagcattgcttattattgaaaaacattgcaagcaacttctgtgcccaaaacaagaaattgtataagttaattatagttcattcataaaaagaaatagcatgcaactttagaattgatgccatttagataaatctggaagacagataagaaatatgttccaacatttactgctattatggcaatgggatcagggttttttgttgttttgttttgttttcattgcttaacttctttgaacatcatgttcattcattactttaaaaatgtaactcaaagtatgatactatttttaaattaggctaaataatggaaaaatatttatgactttactgttaagtatgaggaaaagtagtaacaaagtatatgaatgactaatttttttttaaagagtgaatatatattcctagaaaaaatattgaaatgattttaagaaaaaattacacatgaatcttgtttgttaaaggccattttcatcttccttgttggcagactaaggttccctagaggtatcctaggataagaaagtccttggcaatatcccaattgacagaaacaaagagtggaccacagaaatggaacaggccttaacaagaataatgaatagtcaccattcattcattatttggtgagtgtatgccaagccctgagctatgaaatagtttcaggagaagttattaccacttccctaactaataaggagaaaattccacacagacaatttaaaactgcaccatcttccacaggcactaatgtaactcaggggggtgttttctttgtagcaattttgcaattttgaagaagattgttcatgacataacatggcaactgggaaaatttgtagctttcctttcatcttagaaaggaagatctgaattacatgcaccccaggagaaaatctctctttctggttgtgtgtgtgtgtgttttacaaaaacctactgaattccttagtcttccctgaagttagatgtagtaagctgaaaacttgtcagaatgtctcagttaaagaacaagcatcaaaatacaggccatgacctaggccatggggttcgaatcaaaagacctgagtccaagcccaggttctgagcagaggccagcagaggggcccaagctccctgaccttcagaacccctagacataagagcagggagctgaaccacagagattatcatcctccatatcatgacttaaaatggaacatttgaacttccaaggcatgatttctcccctttgactccctatccagtatgtatggatatgagagttgacccataaagaagtatccagtacgtatgtagccagtacatacatactggatacttactgtacatacatacttactgtattcagtatgtatggatgtgagagttggaccataaagaaggctgagtcccaaagaattgaagcttttgacctgtggtgttggagaagactctcttttttatttatttattcatgtatttattttaattggaggctaattactttacaatattgtagtggtttttgccatacattgacatgaatcagccatgggtgtacatgtcccccatcctgaaaccccctcccacctccctccccatcccatccctcagggtcatcctagtgcaccggccctgagcaccctgtctcatgcatcgaacttggaccgatgatctatttcacatatgataatatacatatttcaatgctgttctctcaaatcattccaccctcgccttctcccacgtggagaagactcttgagagtcccttgggctgcacggagatccaacctgtcaatcctaaaggaaatcagtcctgaatattcattggaaggactgatgctgaagctgaaactccaatactctggccacctgatgtga

SEQ ID NO: 60483 - DNA, 1134 bp, Bovine  19866880645795
tggcagagttgttgctatactgttatctcttcagaacggaggcacaaggagagatgaatgcatacatcgcaaggagcaaaggagaaagagagaaagaaatggtgtcaggtggcatgttggatgcgatttttgttttagtagagattgagatgaccgtaattgtttagctgattccttcggtctgcaaagatacacttgtgttggtgctgatggttcttgactaatcctgtttcaattacaagttggttatgtttttcctaaaagcttgtggtatttaaattcagggtttataactctctctctcacacacacaccccaaaacacatacattaaagtcaatccctactacactatctaatattccatactgagacgtcaaatcttctatatgcattctctccaactaatcaaatattttaaatccagaagaccaaaaattcgaacactagaataaacacctccacacgctgttcacatcacaaacttgggtcaaacagcagtggtgtgatgtagttattggtcctgataactttcaaaattcttactttctctttattttggggtattatgattggtaatttatatttttaaaataatattatgactagagagaatctattacaaggaagatggtttaccagggatttttttaaaagttgtttatgttagtttagtaataatccttggaaagcacatccacatagttttgttcaattctagaattaagattggagttatacaaacaaccacctagtagaactcctcaaattacaaagataaacgactttctcataactagaatttatcaagaccggtatcaaaacaggatcaactataaaagctaactggtacacagcttattagtttttcttaaagccagagatgccacatgtggcacaggtacattatcggatttagttgctctaccttaaagaaacaaaattttaaacataggaaattattctcattacaactataagcttataagcgataatcaaagaagtttatgcataatgactagtagcaaaaagttattttgtgtaagtttcaggagtaatctgtataatatacatatatttgactatatacttcctttacgttctagtaaatctttagctgtataaaggtaaaatt

SEQ ID NO: 60484 - DNA, 2574 bp, Bovine  19866880679922
ccatggttcacgtacaataaggagtattccctaaatcagacatgacttagcatttcctggtgctattgaaactccctccatatttcttgcattttctgacagatttatatccagtttattatagagttctgtgacaactcagaagagaagggtgtgttcaagatctcaaaaatgaaatcgaaaaggtgcagggggaaaaaatgtacagagattcttgaaaaggaaagagacctatgttaaatgcaaaccggtattcatgatataatatacttttaaaaagcacagtagataggtggcacccagagtacgggcttcccgggtggtgctagtggtaaagaacccacatgccagtgtaggagctgcaagagacacgggttcaatctctgggtcagggaggtgtcccctggaggagggcatggcaacccactcccgtattcttgcctggaaaattctatacagagtagccgggctggctaaagtccatggggccacaaagcacaggacatgactgagcatgtacacacaaacaaaacccaaagtattacaaactgaagtttggcttggcttacaagtatttatgtgaggcagaagttggctacttacagaatatgaacttcattgtctccaaagtaaataactcctattctaatgtatgtcttcaaactcaaattgcccagtttatctacataaactagtcaaatgaactaggaaattgccagataatcctgttgctttgtatctcttatgggcaaattgattggctcaaaggctaaaagacagggattcgtgcatccactctgccacttacagacttagtctttctcacttgtaatttctttatatactgaaagaaacaataatttttgttctacatgccccattattttttttttaatttttaaggaaaaaaatcttgacaaacttctcaaagtgcatacatacatagatttaatcagtgtaccatatgctattttgtgttttgtgtctttttcttaattttgaattttcatgtatcagtatcatagccatttttatcctcattggtgctttcatgacatgacatcatatttatatctcagcggtaatttctccccaattattaaatatttattatgattctagcttttttctgttgaagaaagtgttacatccatcttcatacaagtggtctttttgttctctttcagtttactttgttggaacatggtccttgaaacaagttgcttagcttttgttatctattgtcaagtcacttcaggagaggggaagcctatagactcatctgtgtatccagggccactgccacattgtcttttgacctttcaatttattctaatagaaagtcagtagtaattgttttaactgaagctctttgtcaaggtggctgaatattttttcagtatctcatttcataattgtatttcaacatatataaatatatgctagctcagttggtacagaatctgcctgcaatgcaggaacccaggttcaactcctgggtcaggaagataccctggagaaagaaatggcaacccactccaggattcttgcctggagaattccatggacaaaggagcctggcggactacagtctatggggtcacaagcgtcagacatgactgagtgcctaaaccaccaccaccatctttgtccttcctcagcctttccacattatgtataatatcgtgtctctatattttaatttgtttttaatctttctgttgcgctttctttcatcttaaggttttgttaatgttcatcatatagaatattttactttaatataattgaacccatccttgtccctattatcttcttccacagttaagataggtagtctatttcatttccttccacagttttcatggggctatttaaaatgtttaactatataacatctggaatttattgtggcctgtgagaatcaagaactgtattgagaaaagtaaaagatatagaatttaaaaagaactaatttgagatcagcagcaatagctatggccttaggcagatcactaacctcttaaggcacggtgtcctctactagactgaaggcaaggaccttgtcttatttctctttgtcttccccacgttatcaagcaaactacctcacatattgaatatgatttgtaaactctgtatttaagtgatatttttgcacactgctgtccagttgttgtaacagcagtaattgaatctgtttctcaatttagttggctgcttgtgattgaccatatatcactaatactcaattttgttccaatagcaaaatacctgttccagtgttttgaaaaacatcatgaaatatggaggtattaaagttaaaataataaaaattaaaatttgatgctaaatcagacaccaacttatgctagattgctagtatggtatcagatattaatattttgttttaatttatgggaaattttaaaaagagaaaattcaatgcaataactgattctttataaggatcgggaaaagaatacccacccatggtacagcaagttcatcaggagcaaaacttgagaaccacatcttgtattaagcatttctagaggataatataaataaagg

SEQ ID NO: 60485 - DNA, 782 bp, Bovine  19866880712491
agtttctctaagtccctgactccaagcccatggcctcttgcacacaccagcatagaaaatgtacatctccaagcagataaatagatctgaatatcaactttcctgcttctctcccaattcttagcaagagctgagaacacagacccaagtgaggtctgtgacttcgacgacgtcattagtctcacaaaacatactgagatccacttacagtatgctgtgaggtatcataaataattaaaagagaactgcacatcttaaaataatgagctccatatacttgaacacgatgcagccttggctttccactgttattttttttcccagttctctctgatgtgcaccctggtagtcattagtcaggagcatctgtgaggttttcctgtgtcatgagatgttagcccatttttcctagagaatccatattatttcatggagctctctgaatttgtacactgtgatattcatgacactgtaaccagcaatggttagtgtcagcattccttctcctccacttcgtctgatcttgtcactttccttcctttgggaaattgctccccaacacatacacttcatgtggttctgatgaggctctcaggcaaattatgccaattcctggtctaaacttggactgtgtgacccaggcctggtatctcaggtatcccctcagccactgtgactggcgcagggtgggagaaatgccctaagttaggcccacttgtaattttttacatatggctgcctccctcccccagatcacatcctccggcattggcactccccca

SEQ ID NO: 60486 - DNA, 858 bp, Bovine  19866880747075
agaatgttgtctttccagagactctaagagcaaaaataaaatgatgcaatgcaggatgaagagggaatgatttcagttattaacctaatgtttagttataagcttattattataatacgattatatatttatatggttagatagcatacaagatggttagagagcatcaccaactcaatggacatgaatgggagcaaatacccggaggtagtggaggatagaggacggtgggccacagttcatggggtcacaaagagttggacatgacttaacaactgaacaacaacaataataattataatatatttctattgaaactgtcattctgatgccaaaatcaaaactagatgagtgttaatgaaattaataagaatttcaataagatctttgtaaatttctgtaagtttcgcaactgaaaatgttaaatttctcccctaccaatgaattttaggtgatgctagtgaagattgtgggagattcaaagaatgggacttatagaaatatttgaaactctttggacctgaaagtgtgacattgctttgttcatataaagtcatgtaatgaaaggtttaagaaagttaacaggatacagacccaatcagagactgaagaagttttaaaccactgagcttcacttctgatcagcataagatgttttgtttggggccattggctgaagttggaaaggaatgatttgacttgctgagtggatgctgagatgcctccaggcagaaagtccaatggaaaagaacaacatagagccagagtcacaaagtgaatgccactgtgaagaaagccataccttttactgcttcttatggggaacagaaataattacaagtgtttggaaattagggt

SEQ ID NO: 60487 - DNA, 1294 bp, Bovine  19866880773251
ctgcagatggtgattgcagccatgaaattaaaagacacttactccttggaagaaaagttatgaccaacctagatagcatattcaagagcagagagattactttgccaacaaaagtctgtttagtcaaggctatggtttctccagtggtcatgtatggatgtgagagttggactgtgaagaaagctgagtgctgaagaattgatgcttttgaactgtggtgttggagaagactcttgagagtcccttggtctgctaggagatccaaccaatccattctaaaggatatcagccttgggtgttctttggaaggaatgatgctaaagctgaaactccagtactttggccacatcatgcgaagagttgactcattgaaaaagactctgatgctgagagggattgggggcaggaggagaatggggtgacagaggatgagatggctggatggcatcattgactcgatggacatgagtttgagtgaactccaggagatggtgatggacagggaggcctggcatggtacgattcatggggtcgcaaagagtcaaacacgactgagtgactgaactgaactgaataaagtggagtgggtcacaaagggatttaaaacaaacaagataaaatatgagcgtttcttgattcattggtatttgctatattattctctaaagttttctgtagctttaaaaattccccagaaaatggggagtggtgctggtggaagcaagaggggacctcaagggaagtaccttaatgagaattatgtgtctgatgctgaacagaaaataatgtgaggaagtactgtggttggcatttaagaaaagcagatatgagtattatatgggcccatttggcagtgctcctcaccgcagcagaaggcttgaatgctggagcacccctttcctctggaatttctgcagtgatgagagagggctgagggcttggactaggcttgctcttcctatcccttctctgaagtctctgaacgtgttgtgtgataagacagtggctgaattgttcttgtggcctagtttctgatatattttttactgccttagtactaatattctctggataaactctaggcatgaaaggatgcacaccaaaagaccctatcatgtggaagatgctgaaaaatactgccttgaggatgacttggtcaatatggaggtcctggatgaggtactaaatatttaataggcaattttcaccaaggacatttgtttcacacgactggtctgatctttctgtcgtagaccatgttctcctaaggtcacttgagacttggtttgtgtag

SEQ ID NO: 60488 - DNA, 953 bp, Bovine  19866880841701
aggatggtgatgtgggcttgcctggagattctgagctgttctccctggggtcacgctccttcccagtgtgtgagcatctgtgtacagtgaaagatgcacctgatggaggtttgttgcatgaaaccagtgtgagagcaggtaaaggctgagaaccattagctgagatgctctgtaaggtccttgccaactttaagatgctgtaactacagacttcctgccatttggcctcttagtacctcatctgaaaaatggacataaatgctgttgaccctactggcttgatggaatttaaagatgatcaatcaaaatacattcggggggttaaattctccataactacaccagaacttcattctaacacaattcagtcatttaaaatgcaatgctgcacaaggtggcctcatctgaacacctttctgggtcatttggttactgatggactaaaagaccacattttaagctcacttagtctttccccagacatgagcaaaacctgcaatttacagattaatgtcatacagctgtacaaacactcacccaggttcataaattctacattatttttacaaatagagagagcagtcattagtatgaatgagttggtctgagggagattatacacacaaatgactgacaggtatgtgtgtacctgtgggaaacagagagaatgtgaataacagaggaaaagaaatcacaggtatgatttttgtttgcattaaactaatgagatgcaaaagtgaaatcaatgtagtattagtggtgaaaaaatagattcctctcgttctctcagttttaatctccaaaaacccaataaaataggacgtatcttgggggagacaaggttaaatagaaaataattacattttggggttattttcctattttgtgcttcatgttggaaaaaaaattctttggtacactgtaaatgaaatctgattcaactatccagtaaa

SEQ ID NO: 60489 - DNA, 1666 bp, Bovine  19866880890969
cttcttccctctcttcatctcctattaagatggtatagaaccctcaaaaatctaacgggcccttagagtcactattttggtgaacctctgtatgtatatcattaaaatatgttttttttctcttgctaatctgtccgttcaagttgaattcagtcatcaaacactgaacttaagagggtagaggaaaaaaatttttcccctgacacaggattgtaaaggattccatgatgatgtttcaaatctcttaaccccaaattcctaaatgcctcagtctctattctagacttcctgggtagtgggtcagataaaggaaactaatcctgcccacctaggatgatccctagggtgggaacgtcttgtggtccacagtactttgggtataaacctacaactcaccttgagtctcccagaactgaaatgcggaggcaaagatcttgaggctgctgttatcctggctcttgtctgggccaagttacctgtgcaaagaagacaaaaaattaaggcaaaggaaaagttaaagaatagtatgataagtaatttttccctttgtgtccctgtgtttttcagaatgttctaaatgatctgccctgaacttgaaacatttggaaaaattttgaaattcaattatataaattataagtaaaatataatatttataagctataatttgtaatataaattaaatttatgttagtttaataagcaaataagaaagcacaaagtctcccattcacttaacaagctagtgcttagtcgctcagtcgtgtctgcttctttgcgacccatggactgtagactgcctggttcctctgcccgtgggattctccaggctggaatatcagagtgggttgccatgtccccctccaggggatctttccaacccagggatcaaactagagattgaaggaaattactataacataagagaaccatatatgaaaatcccataactcatgcactcaacagtgaaaaattggaagtttttcctctaagattaggaacaagacaagaatgtccactctcaccacttctattcaacataatactggcagccctagctaggtcagttaggcaagaaatagaaattaaaggcatccaaattgtaaagtaagaagtaaaattatctccattcacagatgacatcatcttacatatagaaaaccctaaagatcatacacatgcactagcaaatgaattcaaagttgtaggatataaaatcaatatataaaaagttagtggcatttatatacactaacaatgaaaatctgaaaaggtagttaagaaaacagttccatttacaatggcatcaataggaataaaatacttaggagtaaacttaaccaaggaggtgaaaatttatacactgaaaactatacaacactcctcaaagaaaccaacaaaggcacaaataaatggaaagctattccattgtgagggagaaaaaaatatactttttcctctacctgttaggggaagcacactgattgaaaccgcccaccctggccaggcaccatagtaaccatttgcaagagttgttttatcacaggaggtcctggtaaggaacaggaaactaataagcctccaccaaccagaaaagtttgagaaaggtcaaaaagagacaccacctgtccgcccacctcccagaatccttctctctggcatccat

SEQ ID NO: 60490 - DNA, 2286 bp, Bovine  19866880904923
tcttcgcatgaggtggccaaagtactggagtttcagctttagcatcattccttccaaagaaatcccagggctgatctccttcagaatggactggttggatcttcttgcagtccaagggactctcaagagtcttttccaacaccacagttcaaaagcatcaattcttcagcactcagccttcttcacagtccaactctcacatccatacatgaccacaggaaaaaccatagccttgactagacgaacctttgttggcaaagtaatgtctctgccagaatagttattatcaaaaagactacaaatagcaaatgttggcaaggatatggagaaaaggaagccctttgtatactgcttgcaggaatgtaaactcatgcagctattatagaacatagtatggaaattcctcaaaaaactaatgggagaactgcaatgtgatcctgtagttcccctcttgggtacatatgaataaaaattctagttcaaaaaatatatacacttcaatattcaaagcagcattattgcaatagccaatatttagaggcaacataagtgtccattatacatgaatggataaaaaagatgtcatataaatatatatatatatatatatatgtgtgtgtgtatgatatacatagcatatatatattatatacagactcataaatttagagaccaaactagtggttagcaatgtgaagagagaaggggagagggctaaaatagggatatggaattaatagatacaaactactatgtataaaataaataaaatatattttatagcacagggaaatatcactactattttttactaagtttaaatgaggtataatctataaaaatattaagtcactatgttgtacatccaaaactaattaaactgattaatacaatattataatttaaaacatttaaatatttactaaaataataactgtataggttaattgaaacatgtttctatacagagggtacaggcagtgcaaaggttttgatgcaagatctttctggccttatttttttaattgtgataaaatataactatcttaaaattgacttttaaatattttaagtgtatagatcagtgcaagcatcaccaacttccagtccacacactttcttgtcttctcaaacttaaattcattatctgttatacaataatgctccatttttccctttactcagcctggccaatcacaattctactatctgtctttatgaatttgactaccttgctgctgctgctgttgctaagtcgcttcagtcgtgtccgactctatgcgaccccatagacggcagcccaccaggctcccctgtccctgggattctccaggcaagaacactggagtgggttgccatttcctcctccaatgcatgaaagtgaaaagtgaaagtgaagtcactcagtcgtgcccgactctttgcgaccgcatggactgcagcccaccaggctcctccgtccatgggatattccaggcaacagtactggagtgggatgccattgccttctccgaccaactgagctatgagggctaaatcttctttggagatcatgaatctgacatcgttctccataagctatcagtgacatacccaaggtcacacagtaaatgtcagagacagccttgaaccaagaacagtccatgctattgaccactactgctatgctgctattttttttttttttcttttttgccgcaccatgcagcttgtgggatctcagttccccaaccagggattgaaccctcagcagtgagagccagaatcctaaccaccagactgccaggcaagttcctatactgctcttcttaaaacaaaataactttttcctctctcaaactaggggaaacttaatatatggaatattctcagtgcttttttttttttaatagacaagctcaattttaagggaactagtaatttataaaagtaactgcatattgttaaattctacctggtataaccaactccagggaatgggcatatctatcccaaagtaatcccaatccagcccttttctattgtgcttgtaaatatcttttaggttagaaatcaccatgtatcctttccttaaatagtttcttgccttaggggaggctgagggtaggaatggggagggatactaagaacaaagaatggaatgtagccataaaaattcccagagcctcctgtctatgctgcagcataaaaccagagtgagaaaatagggcacgtacactgcctgttttataactctggatttttcaaggagatattcagagattcttgctcccatcacagctccag

SEQ ID NO: 60491 - DNA, 1046 bp, Bovine  19866880956180
tttttgttcattacttactgacatctcttacacaatggcctttattcatttacatagtgaaatatttaacatactatttcctaccagtttgtactaagtgtatatgtgaggagtaaagtccaaaattaaactttaactccagcaatgttttagattttaaaatcagtcactccaactctgttagtaatatgtcttcttgtggagtatttagagttttttatcgttgaagccctggatcatttcaaataatgctgggctgcaaattccataattctattagaaaaaagtcagaagctgttgctaatgttactgagcacaagtttgtgtgcctgacacacagtgaggccaaacaacaccgaaatgttaagagtgtacagcaaagaaaggtttattccaggaccaagcaaggaaaactggtggttcctgctcagaaaaacccagactccctgaagggtttcagcaaagcatttttgaagtcaaggtgagggaggggtatcccagggttgtggtcaactcatgcacagttccctgattggttggtggttgaaggtctgtggctacctgcttataatcttcaagtcgttgtttcttgcttttggtggtagtttttagcatctgaaaaacttaggaaatatgcatgagatcctataatctgggtacttgagagaggagctacagcagaggatatggaggaaggcctgtccagaggccctgtagagtcctactcggttacactaacataagttcctaatttcttgacattcttttactttgaggaatatttgagtgttaatgaaacctctacttattgaatattttatttacattagttattatttctccaatagggccattgtatgcttaagctaattagcattagatttttatttattaagaaaaatttctatgtttacagaataaagacaatgatactcttaaagatctactgaaagcaaatgttgaaaaacctgtgaagatgcttatctacagtagtaaaacactggagctgcgagagacctcagttacaccaagtaacatgtggggtg

SEQ ID NO: 60492 - DNA, 1123 bp, Bovine  19866880975323
ggattctgaagaaattcagtatctattcatctcttgagatcccaaagtgaagacagggctgtgtagctctccccaccaagggctaacatacaaagatcctttcttcctgcaacagtattagcatctctatcaccatcacaccacttttattattatatttcagatcctatgaaaataagtttgggtgaaataaacatattacctgctagtgaaactaattcaaacaaccattttgccctagagggaaaagcacaattgaatctgagaatagcatccttaccctcccaggaggaagaaactaaaaataaaagacaacaaaggtgcttcctgccagttggtaaatccaataagcaaagaagatgcctcaacctggcactgggcagttaacagtcagcctgactccctccattggagaatggccatgtggttctcagagctaacagctgccaagcagaacctctcagattaacccataggtggtgttgaaccacttcccattaagatatttgcaaagcaaacaaaaatgatagccccattctgagtgctgggagccggccaggagctctagctgttcttgttgacacaaagagctctccagggagggtctgggccagagtgtggaaggccactcctgcctgcctctccagactgtgttgatcttaagccattagaatctcggtatcaggggctgtttattatctaatttcccaatcacagcagttgctggagctttgtttcaccagaactctctacttctctgtctccctgacctacaccattcatgagggaaagaaaaaattcaactctcctcctgttatgtctactcattaaggagacaagtctgagaagttactaagatgcatacggagagtgtggcatcaccactgtcaacagcttctgtggcaaacacttgttagggttccttctgaatttaaagtaaccatagcaatgctaatgggaaatatgcttgcatatttgtgtcctacaggtaggagcaagctgctgtttaattcacaaaatacacttagagctgaaacactaatattttttccttctaatccagagggtaaaatgaaataaggtttaaaaggctgtggacacatgcaaaattaatcttctttca

SEQ ID NO: 60493 - DNA, 1324 bp, Bovine  19866880987646
tatctgtatatggtattttataacagatcagtctgctaatggaatggacttggtgggggggaggggagcagcaaaggaacattccgcctaattcaagtttcctatcatcaaaatataagtactcctctgataatgatgatcagattttaaggatttatctttgaaaaaaatcttttctgaaaaataagtactgccatatgctgatattaacccggaagcacatgattttaattagcatattcattatttcaaaggcagttagagaagtctattagattattcttgtgatatttgcctttcgctctgtcattacagtgcagattaatcacttccaattgaaggttagatagacttcctcaagtgcacaattaaattgattctgaattatggaaacattctttgtgcttgcatcagtgtctgaaaaaatgctgctggaactgtagtttggggttggaaaatatattcaagcaaattcatgtgggaatgaagttctcattttgacaggatgagaactgtataaagcagcttgatgttacttgtaattcaaacatcagttaccactcaaagactttactgcagctaaatttcataaatgaatgctcttatgccttgtaattttacattaaattcatttaaaaatattttcaactccatacaaaaagttagtttccaaaaccaatcagtatttgataatagtgattgagggctgcctctttgttcagaaaaatctcaaactcagtcctaaaatcaaaaaactgcaataaaatgttaccactgctaagccagtcaggatattcagcttcgaacaaaaacgtgtacagctggtgctagttaagtccatgagaacaaatcgagttcactgttgaccatactgattctgtaacacgtaataaattcacatattttcagcaaagtacctgctgatgaattgtacaacgtataacagtaggctctgaacacctcacatttttacaagctttgtagatgtgtctaactaagcctctttctctttcacacgtatttttaccattatcagttgtagcacatcttaccagattccacttcagattgtacttagtgttttctcaactgtgaaaatatttttacctgaagttgttccacacagattattcacagaagctaatttttctgccacttcaaacttggtattgatgccttaaatcaacaactgagtaacatcaataaaatctgtggattcatcaagacaaggaaaaccattctaaatctttcgccttgtttttaaactgactattgatattgcttcaaatgtcctcaactcttaaatcaactgttcttgccaaaa

SEQ ID NO: 60494 - DNA, 1349 bp, Bovine  19866881034442
tgttgaagatgaaaaatctgaagccccaaactaaatcccattgttccccttgagagtagctccagcataaagcagttacttaaccagtagttgaataagtgaatgaaataaagacatttcctaatttgaaatatagttgttctgtgcacctagggatatttctgggaatctagttctaggaaattattgcaacaacccagtcattgccaacccaccaacaatgctaaaggaatcaacctttcaaaattagaaaagactaggaggaaggcttaccctgagagaggtttaaaagttcaggcgttttaagtgttaaaacttggttctgccgtgatgtggggtcagacttttaaaagaagttaacctggagaagggggagagcctgtctggattctatgcttgctttcctctttggaaactacatttaaagcaattcccattggctggcgtcacatgatgtgcccaggggttccagctgcagctggtttaaaatgcctgctcacaggctcaagcaagagggcctctcagccttggcaggactgaggatgccgttccaaaaaccactccccctcagaaggcattagaaggagaaatggcaatagattttagtgctgttatcccctgtaggaccaaggaggggagtaagtaggaagctaatcagataacagagagaaagagaaaacaatttccaaagcactgaagcaattagatgagaaagtgctataaaccaatgggctcttcctgctcctggagggctaggggaagagaggctgcaagagccagctcctcctggagacaccctttgaagttccttcccagtccctcaggctccgctgtcactgagggcttctcccctgtgagatgaggagcctggcactttgttcttgcttaaaaaacagatcttgagttagaggggtaatttttaaaaattgtgctttcaaaaacttagagaatgagacattgtagacctttaaaaaaaattccctgcaggttgtttgttttgatagtatttactgaggaacgtatgcaattttagttgacaaaatctagttatatccattctctgaaagttaagaattcattaagaaaaaacaacaccaattacattagtgatgggtgacaactattggtttttacttctactatcccatctatccaaacaggaatatgtttgcaattatttttctgattaaaaaagtacatatttttaattgttttgttatgttttcccatagcaagagcctattatcagcattaatcaaaaataaacacacacacacacaaaaataataataaaaaacacaataaagcatgccacttctcaccaaggtgacacttgaagtcgtttccct

SEQ ID NO: 60495 - DNA, 1952 bp, Bovine  19866881070131
tactttcggggtaaggagtcttcttgatctcttctctgcctgttttcagaaaagatgagtcagcccttcgcacaagaggcctagataccacagagtcactgaaaacaagagcaaagctcagagtcagttaggaaagatggaggtgtagggaaaggagaattataacagggaacccacccttgagtacagcgtgagaccgcaagtgtctacagaggggccctctgccactggcacatagtccactgaatgtgctgattctgttagtgtttcagctgcttcttggccttaaagctactggagtcagccactttcccagcatatttactgagaagtaaagtagttaataaaattccagaaggaggcttatcaagttcatgagaaaatatgtcttagcttcaactttattttcctagactgaattgacccattgcaagagccatttgcctgagcacaattatttcccatctctgttaccccaattcctgatatttttacctggtgaatgactcttttgagtgaaaatgttgtctccataaggactctgtcaaatgcgcattagagaggaaagataagagactgtcactttgtactgatttgcacagatttgtttattttcaaattatgaagcactgggattgggaacccattagagatcactcaccatggggaactgaggtccaggcaacttcacgatggagatgctgttagtccaaagacagaagtactgaaaccagggacaacaacataaggttgtaaggtggggttgccaaagtaagggacttggcagggacagtaagtcaagtggatcatgagctggagttgccaggcaggctggagggtgggcctgggagccagcatcatggaaagaaggttccacccaaagctagtgggttcaagaaggacctagagccaagaagtctgacctgtgctttagaggtagactagaatgggcctcagtgtatggattgtagggacctagaggtctttgggtccagcattccatcgatgtagtgatgcctgctacagcttctccaacaggtaggttttcagcccctgtttcatcacttatggttggacatttctaattgccatttatttcttatcctgatccccttagtggtttgattatactctcctagtttctgcatgtatgggatttgaaggctctaactataaggttatcctcaagatcctagagtccctctttcagcagaagaagccattggcatgcacttttcagaagcatatccataacaaacaattgggtgtcctcaaaatactagtccccaaatgctaaaaaaaatggcgcattgccaagctaggttaacaccattttggatcagtagcaggtaaaattatgaaataatgggactgattttatgtgtggcttgtaattgccccaaagacatgtccaaaagaagaactgctgctgtgaatgtctgtgagaaacagagagcacccctagttttccatgtgctctttctgctctctgcacaaccatttggtgtatgttaatttatcttcattagaatctccttttaccgtccagttttcttgttttctttgccctctttattcttctcattttgctttagactttctggtgattgttaggttaaggaggcaactgaccccttccctgaaagctggacctttgaaattacagatacagttgatggagcatcaccgtgaaatatcagagacaagcttagttctggcaacagagttatgggataatctaagcaaattcttagatggctgagtttctgccaagtgggatattgcttggccctaggtaatgtttaaagaaaatccacaggcagctataagtacagaacaatataagtcagaacttatattgttatttctttttgctgaattcttgtttagcctcaaaggttccatgagttgtttacaaggtgacaaactgccctggaagcctgggccagcca

SEQ ID NO: 60496 - DNA, 1267 bp, Bovine  19866881093456
aagtctgaccttgtttcttgttaagaaatggctctttattttccccctgattctggcagaagccaggctgggagattgcagcaaatggctgcaacaacctgtgtttaatgtggtgacactaatgaattctgagaattaatcttcagccaagaatgcatgatggaaggtactatgaatttcaaattaggtaatggattaatttctttcagggctgaagtttgcttcctttttcttctggtagacttttctatcatattctaaaccaccttccatggctttgtaaatccagctaatacatctcatggtagttttaattttttattcttttgttttgtatcttagcacagagataaccacacataagtccagatttttaaaaaagagttttaaaacatctggaactgaaagaaaaaattacttaatgattttgggggaaaaaaagcaatattttctaaatctagtccttgttcaatttcttttttccagagtcaaagattctgggaagaagttattttagagaatgtatttccccaggtccccagaagaccctgtcttctgcagaaatgcagcctacatgtatctcaaacatgctggtgaaaattaggggctctgagtgtctcccctcaatcagctgagatgaagactcagctgttatttgcaaaagtttggtactgatttctcacaatggagctttcaaggatgtcatttatagggccctggttccatgatacaaaaaaggatctgtggccgagtaagtttggaaacatgaacctaaacaaaattgaattttctttacctccatacttctaagaacatttaatatgctcatatgcactatgaaactccaggtttacttgatttagggaatcaccagtgtttcccaaccttttgaccagaagactagtttcatttttcagtggaatgtctcatgaatctattgtttcactcaacttacctcacattggccagcccctatattcccacacagatgtcaatgttttatgcatgttcttataaaaactgttgaatcccaggctgggagaaaatattctgcatctggaatttgcaattcctgatttaataagaaatcctgaaatgaataaacatattataacttccttagttttccatgtttgttctccacatcgttagaggatttaatcatgctgtaaaaaaggtcatggaagctgtcaggagttcttatgggtcttgactgtcaactctatatcaatccactaaatccctgccgaaaggagaataagacaga

SEQ ID NO: 60497 - DNA, 660 bp, Bovine  19866881110513
ataaagaaattttggaacagaaagatttaataacttgtctgtaagtggttgagctgggattcaaacctggcagagtcaggtttttttttaaaccactgcattgtaccacctgctgtgtgaccaaaactgtgcagaaaaaaaagtaaattgggtatttgcctcactcatctatgcacttaccccacttattctttgctttttccaccttaacttggaaactcacaactttaaatatattgaattaacagcatcaaacattatctaagaatttttctggacttaacaaacacctatgtagccagctccccgccgtttgctaagaggaagtaataatataggctaggtcgtaagatgtgtcaattacatgcattatgtttcctttagaattagttttactttctcctaaagaagtgcctgcttaaagttttgacacctatttgtgaggttgtatttttttagtgactttttcaaagaaacatacacttctgagtgaaactttagattacaaagaccctgagagaagggtctttgaccctatgaggcctttgacatcaaaagaattaacacacataaagagaaattagagggggagggggagagagcctggagccctggctttctatggcaaatggaggaaaatttttaaaaagaggacacaca

SEQ ID NO: 60498 - DNA, 1295 bp, Bovine  19866881190506
taaaaaatatataagggtatacaaacaacatgacggtattaatttgtttgaggctttttaatattggaaaaagtttatgttcaatgatactgacaactcctaaaagtgtcctaaggttcacctacattgtatttcttataatgaacaaaacactcctgtgtgcctgtgctcagtcactcagttgtgtctgactctctgtggccccataaactgcagcccgccaggctcctctggccatggaatttcccaggcaggaatactggagtgggctgccatttccttcttcagaggatcttcctgacccaggaatcgaaccagcatctcttatgtcaggttccttaccactagcgtcaccaaagcttaagtaaaacattcagggaggagccaagatggcagaggagtaggacggggagaacactttctcccccacaaattcatcaaaagagcatttaaacgtcgagtaaattccacaaaacaactcctgaatgccggcagaggacatcaggcacccagaaaagcaacccaactcttcgaaaggagataggaaaaaatataaaagtcaagtaaaacattcgtaataaatgaagtattctgattctacatttgaaagcaaaatatgtttatgaaacaattcatagccttttactagcagaggtcaattttgggagcaggttaaaatctttaaatggtgcttataaaacttttttcattataagatcatatttggaaaatatcaaataacccactgttttctttttgcacccattgttttcagagtgagtgaaaagagaaggggctaatagtgagatttttatgtttttaaaatgggggtatgagttaaaaaagttaaataccgtgttagaataaaaaaaattatgactatgaaataatgggatttcattttctcaaaataagaatgaagttgaaatcttgcaggatgtaatgtagattacttaggtaccattaagaaagagcacatctatataacagtagatatggtcttggtattgttttctatagaaataatttcacttactgtccctttatcctctaaggagaatacctaatactgcccagtatccagcaaatggctcagaagatagaggcctgttattacactagagccgcaattcatctcaatggcctttccttcaaaacttccatcatctcaaaatctctctcggaggaaattataaggaatagtgaacatgacattttccatgtccccatactgttgtgaacatcggctccagaatgtcctcagatatcccccatttcaaagagtatgaagtgca

SEQ ID NO: 60499 - DNA, 859 bp, Bovine  19866881281421
tcatgatttgaggagcgtatttttgtctaaaggaccagagagttcccattgtaacttttaaacatgaaaatccacacagataaatttgaagataatcttcgatgcaaatacttctggaggcccaaaggaatggagctgtgctttggcattcagcactatgctggaaaggtgagttattaaatctgaattttgacaaggaacaagggtccacagtactctgtttgtggcattcatgaaattgcttgcagatttctttctccttttaattcttcttgaatacctaatcataattcttaaatcttctcagtggtattgctcatggaaagtagcccctggcaaaaaagcaatttctcactggggtggcccacagagctgccatctgcttctcacctgaggtttggcctagaagtgacagctctccagggagaaaacatgatggcttttgcagcgtttagtggtgaatgctcacattcaaaagtaatttggagatgtgtaggcaacgaaggagggttaatatcacagtggggctcaatttttagcactttgtagcacaagcatatgtctacagggcaccaaaagtgtctagataaaaagggggggaaattcacttcatcatccagatgttaaggttttacaacattaactgaaattttcacttttcatccattattcttcagtctcagtttcaagttcccgaacgaggttagtgagtgattcaggaaatcccctcctcctgtagccaacaattcattgctcatgttactctctaaggagccatgtgaattatggctaattggttccggcagggtctgctgaggccctgggcccagaaaatgggtaggagttcaataaaaggcat

SEQ ID NO: 60500 - DNA, 956 bp, Bovine  19866881309938
atccctttcggtaacccgttggttcagtgaaatatagagctgcaagggccaagtggcagcctcatcttccaattcagtggaaccactgttatatctccaggtggaaacactcctctcttggggaccaaggccttcagattaggagaggtagaagttgtggggataagaagcaaaaatttcatatctaactattttatttaggaagtaataaaaaattatagaatgggcctgttatctgatttattatccactgggaaaaatgtttttgcctttagactttaatctcctggagggcaaagtttacagctcattcttgtttggatgcctaatggggccttttttataacatctgtaacctgagaggcagtcaataaatgctggttgaatgtattggtaaatagatagctagatatgggctaattggtttgtatcagaagagtaaatatttttttttgttttcactttaatattgctagctcacacataaaagctaggtttcttcagtctctggatttaagaataaattctagtaatctgtgactcagcaccccatttatcagtattgggttgaagattactaggatgtgaatttcttcaaggagatgatgggtccctatttccctttggagtatcatggctttcaggtagtggtttatattactatgcactttaaaatggaatatcttaaatttttagaagattcattttcctgtgactttaaacagggaaatatttcattagctcctcttcccaaattctgaggagcttctgaaatgtgaagcaaagcagtcttccactgcctggagctccttcacaacatcaaacacttaatgaaaatgttttcctcaaacctcaagcatttccagatattgaatgtgaagaggaaagattttgctctaactgcaaagtgttccacaactgcagggtatgtgagaatgtctctgtgcgtgtgcacg

SEQ ID NO: 60501 - DNA, 1101 bp, Bovine  19866881345376
aaatcaccaatgcagtgaaaaggcggcatactgagaggaagaaaatatttacaaacatgtgcctgatgaagggttaatattcaaaataaagaaactcaagcaactcaatgggattaaaaatgggcagaggaagtgtatagacatttctccaaagaagacatgtagatgagcagtaggtacatgaaaagttgctcgacatcactaaccatcagggaaatacaaaccaataccacaataagtcatcatctcacatctgttagactggctactctcaaaaagacaagggctaacgagtgttggtgggggtgagcgaatcactgtgcattgttggtgggaatgtagattggtacagctactagggaaaacagtgtggagtttcctcaaaaaattaaaagtagaattaccatgtgatccagcaatcctacttctgggtatttatcctaaggaagcaaaaacactaactcaaaaagatatcgacaactccgggttcgtgacagcattatttacaaaggctgaaacatgaaaacaatatcagtgtctgtcaaagtatgaatgtataaggaaaatgatcctatgtatagaaggggaagattggacacaacagaagagaaaggattagtaaacttgaagatagctcaaaataaatcatttaaactgaaacacaaagagtaaaatattaggagggaaacaaagaacacctcaatgggcctgtgagtttaacacatgtgtggtcaggattccagaaaaagggagacagaaaacaaagttggaataatatttgaagaaattttaatcaaaattccaaatttgatcaaaaaagaaacccacagacaggaaatcccaaccagaaaagaaaatacacctacaaagaaaatcacacctacacacatcatagtcaaactgctgaaaaccaaagacaaagataagatcttataggtgctgggtcttgagagatacagattcctattagtattgtatccatcagcgagagagtaaaaaaagcaaaatgtggtgagggattattactcagccttaaaaagcaagggaaatcataagacatgatacaacatggatacattttcaggacattaatctaattga

SEQ ID NO: 60502 - DNA, 980 bp, Bovine  19866881380369
ttgcctgaccctttgccatgaatccttaccaacgttttaacacaatgattttgggacttttgagcagaggtctgattttagcctagggacatcatttccaagattggtacttgttcttcaatttacttccattttgtaaacctagtcatacatcttctttgactcaatagagcatcactttcacatatgggcaggattcttgtgtcaacaagatgaggatattctgtttatcagcaagtgacactttcccactttgtgtgtgctactaattatggctgggaggctgtgaagttttcagcatcctgtcacagagagcagctcgttaactaattatttttgaaaatcactggctccaatacaccgaaggctggcaggtgccagagggttagagtagcagaaattaattaacaaagaatgaaagctcttattagctgtaattttttttgctatcttccttttttccccccatttaaccagtttagagtgggtctaagaccttcaatctgcacggagagaaaagttagaaactgaatgttcaagacccaggaaacccaagtgtcagccctcacctaggaatggagtacttggcttgttttccaagtagtatatcactatcagtcacatttagtggacccgcaggtcagtgggatcccaaaccacctttagcttttgtcaatgtttagttgtttccaaatagaagttaacccttaaaagcatcactggaatccctctgcacagcagcctgttagtgccggatttcagtggcctatggaagttctcatgctctgtgaagatgtggctctttgctgttattttttaaacagcaaactagttagaatcaattgtagaagattcctctattaaatctatgcctggtctaatttctctcttaaagtaacttcccgatgtggtaaagtggcacactccaacactactaaaggccgtatcagttggcacagactttctttcttttgtacagt

SEQ ID NO: 60503 - DNA, 748 bp, Bovine  19866881497544
taattgaaccctatgaatgtgttttatgaccaactttcaaaatgcaatttttcatggaataaataattgattttttttcagtagatagatgattatgtcaggaaggactctgatggtttaccagaatcagtgccttgaacaaaacaggtacttaatatttagctactaaattgaaactgggcaacgattctttcaacaccaatctcttcaactagttggggtgattattttccttatttagtagtaattgttcttctcatagtaaataaaaatctgattttaaggtaaatattcctttaaaatgatattctcaaagaaacgagcaagtatcaaagtgaaacaagaatgagcaatgaaagttatataagtaaaattcagaatacttggcatttaagcagttgagaaataggtttgaatattatctatacccctacattttttatcaaaattcatttttcatttaaaatgtcctcttatctaagaaacagttgctttgactgaagcaaaagctaagtgctaatccatgcatttctggcctttcaaatttaattgggtgacaaatgattgcattatctacttctaattgcttaaaaggcatgatagatcagatgctcaaggagagacattgtcttactctgacattccttcatttggttcaatcatcactttttctgaaagagaagaaaaaaaactcaacccagtattttatcaataggggatgttcttaatagaaattcctgactggcaa

SEQ ID NO: 60504 - DNA, 1470 bp, Bovine  19866881551852
gcagagcttagttgtagcctctgcttagggtctctcataagactgcaatcaaggtgttggccaggaccagggcctcatctgaaggctggcccagggaatgatacactgccagacttaagtgactactggcaggactcagttctctgtggggtgttggactgagggccttggttctttgttggctatattctggagacgacccacggtttcttaatacatgagtccctccaacatggccacttccttcatcaaaacatgcaagctgggaaggcaattaaaaaaaaatatgctaggaagatggaagtaaatcttttgtaatctcctcaagaagtagaagtacagcctatcaatattctgttcacttgaagaaggctactcaagagaaaggggttatataaggatttgaataccaggaggtgggaatccctggaggccattttagaggatgactatcatatcttgtgacacagcttgtcaaacataataaaaaaaataatggagtcacatatatagaccattaaggtttggacaaagagtttctcagcatcagctgtgatgcctcctcactggtgagagattgctaattatcccccagcatgcatcgttcctttcttccttatagtaatgcccaggttttagggaggcatatgactctctatctagagatgacatatcacagcctcccttgtagtcaggtgtagccacatgactaagttcccaccaatggaatgtgagcctgagtgatatatgccactctcagtaacatcctcaaaagaaagctgcatgtcctccccttcctctttaccccttttctgaggctggaatgcatatgtggtgggcttccaggtcagtcatgtagataagggcaacatcctaaaagaccttggaaaaataaaaaaacagaaggaataggagtccgaagaccatcacttgaagcagaacagcccaactttcctgggctgcctacctgctagacttctaagagagaaataaaccatcttgtttaagccattgttatttgctgtctgttacagtaactaaaccataaccagtatcctgacggatcacatggtgcttccaggggcaggcattagcagtgctcctgctgagtcttcctgtggcagttgtgaattacatcgctttaaaagatgtcacatggtgtcaccttaccagctcctcctagcctatgtctgctggagtcctcaaaatgagttctcacccgcaaaagggtattctcttaggctgttgctatggaaaactccatcactgctttccagctttgcccatgcttgggtacccagaggactttagtcattcaatgattcatttattccactatttatagggcttttctcatgtggcagtcagagacaggagcagtgaacaggatagataagctttctcctcttaggagactgatattctagtagggcagtaaagatacaatagacaaataaaccaacaagataa

SEQ ID NO: 60505 - DNA, 1560 bp, Bovine  19866881593379
attctcctctggctctatgcagttgttttgaagttagtctatacacatttactcaaatctttcccattcaaaaatccaagaaatctcaacaagaagaatcttcaaaacaagaagagggaaatgaaagcaggggaaggtaaatggagatatgtatgttataattcaaatcaacggaaagttgtagaaattctaagacttttacagaattcctggaacccaagaactagaattctaataattttattctaaagctagctgcaaaaataatttttaaataaattaagccttaagaacattaaagtttagtatatttggaaggaaaatgaccaggtaacatgtcaaaatttaaagtgggattattttaagacatgcccgtgtgatgttaaaatgcgtgtaagtctgccttttccacacacagtaatgtaagttaaactcacaatctaataggactggacagtctgcactactgctgcaaaacacagctaataacatctgatggtaatcagcattattgtatttaatcagtaacaatagcaaaacacacaatatactctttaaatttgtttcactgaaattctaccattttggtttcatgtaatgaggtatttgtagaagtatttgttcacattttatgtaccatttaaattgaaaattatttttttaggagaaggggatggcagccagtaagtaaaaaacagacttaaaacttcatttttgaaaaacaaccaagtagctacccaactccagacttaataaattagtgtggtttctacacttatttcctctcagcatgcatgcactaaagctaattcatatcagagaaatattataaattatatgcaaaaactatacatttaccttgcagtgcttcttaaagcgaggagaccttggctactgtctaagggtaaaggaaatgctttaattttgaggatagaatttagaccaaaaaacaatttaagcctcaaaagctaattagagtaaaagattatcagcgtgactgaaattagtgataaatagaagtgtcccaggtaaagataacagttctcactttggctcagttagctatcttgtacttgctggggtagggacatactatcccaaagctgtgtcatttctgtcatttctttggaaaaactttaagaggaatagagggtctcaaagctggcttatcactcacacaccttggattctaaacagatgattacctaagcccagggaagcaattttattttatggcttattctcctcctcttctgcattctgacagtagcagtcacttccacttatttgaaaatgatatgataaaggccagtgatctaagtctgtacctcttcttcaatctcatgttagacatacacatccacttatatacctcactaaaattttaaaactgggtattttaattggggactttaaataacagttactataatgaacatagtatttcaggattcagaagggtgaaaactcaaacaacaaaactgaaaaatttgcagacagcacctaaagcactcaattaatgctaacattccattactatgtcaataatttttaaaatag

SEQ ID NO: 60506 - DNA, 999 bp, Bovine  19866881722792
ccttatttttcctacatgtaccagatatgcctgtcttttcttttcattccttcctttctttttaagaaaagtgtcatagatggttggactgaaggcagacagctgagtgtccatattcagattcatggccaatttctacacattgtatcttacatttttttcccctttgaaatcagttgtattttactctacagccatttgttcagaagctttctgggaaagtgatagagttgaacttgtaggttgaaccacagaagacagaaattggccaggaaggactgaataagcccagggcacagacaggccttggtgtacgcctgtcatgaacagcctgctggggacaaaagaaatgtggtggggagagaggctatgggagaagctggaggaaaatcataaagcagagctgcttccacccctctaagggcccaggccactctgagttacagcacttacatcgacatgcagccaaaggttgtatttctcacatatatctgcaatctcctgtatcggatcaaaagctccataaacagtggtgccagcagttgcattgacgtagagagggacgtaaccctataagaaggacaggctgattagtctttctaacctcccctcctttccacacaacgaactgcagtagcattcatttccaacagagatcagctaagctggtgtgtatctgatactatatgtgggactactctccgttggtgcattcactcattccttcatttattcaaccaatatttttagtgacattcatgtgccaggccctgctgaggatgctgggaacacagtagtgagcacaaaagacaaagacttctgtcttcatggagtctgcactttaatggtgagtgactgacaatcaacaaatttaaataagaaaaataaatagtatgtttaagagtgacaagttctatggcaaacaataaagcaagaaaaagtcacaataaatgtctggagtgatggcgggtatctgaatgccatcggacaatactacat

SEQ ID NO: 60507 - DNA, 1311 bp, Bovine  19866881953360
tcgggttccccttgtgtgtggagcggcgctcgtgcgtgttattacccttcagatgtgatcaatcaggaggactcctttccccatcaccaagggaacagaagctaggggggggagcgtatagtgggttggaaatcggacccttttctctacggaggcactcggtagtgtgcgccggtggagtacttggggaagctccgagcaggatgagaaaactgaagtgaaaaagagatggagtcctctacgggtctgcgagttctctcctcatctctgcgtcctttgcttttacaacgaacctggctcagtagagagccagcaaggacatgacccagggagaggtttccgctcttggaggcatcagaaagctgggggagccgcggggcaagtaacagacgcaaagctacagctcctgtcttctcgaggatatggtaatgggggagaggaaagggagggagaagcactcagcgaggcagaattcttcacagaatttctcttttccttctccttacccgaccctctgcctagctcaaaaaacagagcgtgttgagtacgttctggattactcatagggctttttcttttctttttttccgggtgcaaacccgtgatctgggtttataatcgccctataaagctccagaggcggtcaggcacctgcaaggagccccgccgctctgcccacgagctgcccccgcgagcagcggcctcgtgattcccctgctgagccggtccccgcctccccactccgcctccgcctcccccaaagccaagcagccgtctcttcggatcgctctcctctcttccaggagctcgcgtgcgggacggtgctagcaaaagagaggctgcatctggaggtgacgccgggcagattacgcctgaggcagagccgggccgagccgggcagatcgctgggcgctacgcagaagagcggcaggagcgcgcggcttgctgtctcccagcctaggtgggtacgcgcgcaaccgccgggaccttcccagtgcccagttgtgattgttcagctgggtcctgttcagccgcggtgtcatggccaacccccacccccagagtctgtcgtctataccctcctgaaccgagagcttcccgcccgccccagtcttagctcccggttcctgcgcgatgcagagacctcagccttcacaatcatcctatccccatcagcgagattcatgccccgaggacgcacagaggctgaggctcacgcaggagtggagagagagcgattttctcctccgcttcccggctgcgagcaccggtctcaccaacgggctcctggccagcagcagccgaaggcgc

SEQ ID NO: 60508 - DNA, 1098 bp, Bovine  19866881992899
atcttctgaactcgtagagttaatctatataccatctatctgtctcacagatttaacctccaggaattatgcagatgttgtctgcaaatatgagcttgattctcataaaatctccagtaatattttataaacaagaaaaaccttttaaaagatttaacctgctgtccttagcaatgtatgaccttttctcatgtgtataagcaattaactttgggagcaattatttgctcccaaaattgaaactagcaatctagaagttgatgtagatgtaaggtatttccactctgataaaggccacttcattttctcaaccaggggaaaaaaaatatgccagccatatctctatcttcctcaactagtgttcctctgaaactgctacctgcttcattttcctgctttggatactggaaaggtttggagagaataaagagaaaaaattatttactccaatttttatattttaaaattgacattaccctagattacatgtttattcaaagtgttacacggttttatatttatgcatttttagttgaaattattcaaaataaatttggtttaatttttttacagttttctagagttaaataatttgttgtcactggttaacagatgacaccacccttatggcagaaaacaaagaaaactaaagagcctcttgatgaaagtgaaagatgagagtgaaaaagttggcttaaaactcaacattcagaaaactaagatcatggcatccggtcccataacttcacggcaaacagatgggaaaacggtggaaacagagacagactatttttgggggctccaaaatgactgcagatggtgaccacagccatgaaattaaaagatgcttgctccttggaagaaaagctatgaccaacctagacagcatactaaaaagcagaaacattacttggccaacaaaggtctgtctagtcaaagtcatggtttttccagtagtcatgtatggatgtgagatttggactataaagaaagctcagtgctgaagaattgatgcttttgaactgtggtgttggagaagactcttgagagtcccttacactgcaaggagacccaaccagtccatcctaaaggaaatca

SEQ ID NO: 60509 - DNA, 747 bp, Bovine  19866881996675
attttttattgtgatgaaaactcttagaactctctcttagcagttttcatattatgatgcagcaatgtgatattcacatttatagctgccgagagattgaatacacagacaatggaccatatataaaaaaagaactctgacccacaaactgcaagaacttgccaaggaaatcaaccctcttgtcaatcataaacagtccagccactaaggcagtcttttacaagtcagtcttgtagaagatagagtgttcatttgggtaacaatataggaagcttaacaatcacttctgtaacaacaggccccaaatgtcaaaggctcgattaataactgacaacttccctaattttttaccccacttccaagttaaggccaaccaaaaaaagccaaatatgtaccctaccaataatggtgctcttgatgagatgccaacagattcaccgcagcgatattctgcactcagggcacatgtggagcttctctttttctaaagctttcccactcctctgcctgcctttgtgtctctgccaaaatgcaagtaacagtggctgacccttttgctatcgaaagctctgaagaaagaccctttgcttccctcatgtggctgctctttgtttcattgcatagtgcacaaatatagcttcttgaatggaaaccaaaaccaacaatcaagtccataaaggtataggacatcacttgagtacaagtttcataggttaactgaccagggaccacttcatcatccatgac

SEQ ID NO: 60510 - DNA, 5211 bp, Bovine  19866880353924
tgagaaactctgggctggaagaagcacaagctggaatcaagattgctaggagaaatatcaataacctcagatatgcagatgacaccacccttatggcagaaagtgaagaactaaggagcctcttgatgaacttgaaagaggagagtggaaagttggcttaaagctcaacattcagaaaacaaagattgtggcatccggtcccatcacttcatggcaaatagatggggaaacagtggaaacttggcagcctttatttttttggactccaaaatcactgcagatagtgactgcaaccatgaaattcaaagatgcttactccttggcaggaaagttatgacaaacctagacagcatattaaaaagcagagacattactttgccaacaaaggtccttctagtcaaggctatggtttttccagtggtcatgtatggatgtaagagttggactctgaagaaagctggacattgaagaattgatgcttttgaactgtggtgttggagaagactcttgagagtcccttggactgcaaggagatccatccagtgcatcttaaaggagatcagtctgggtgttcactggaagaactgatgttgaagctgaaactccaatactttggccatctgattcgaagagctgactcatttgaaaagaccttgatgctggaaaagattgaaggtgagaggagaaggggatgacagaggatgagttggttggatggcatcaccgactcaaaggacatgagtttgagtagactctgggtgttggtgatggacagggaggcctggcgtgctgcagtccatggggttgcaaagaatcagacatgactgagcgactgaactgaactgaactgaatttaaaggctccatcaccaaatccagttatcttctgaggtgctaggataaaaacatcaacataataattttggaagaacataatttaactcataatagaaggtatggagactattaatatccttgcttatatgcaatgctgtcattgagaagaaccctgagaataagttcagaaactcagctctaatggtgacctgcctgaattccatacccattctttatcttgtggttctctgttttggtaaatggtagtgtctttgccttaatttaccccagtcagacatcatggaacctagtgccccctctctcttgtcatcatgtttaattagtcatcctactgtatttatctctgctgtttttccagtgtaacatttttttccccttttcaacttccgctactttggtccctgcctcctcatctattatcacactaggtatagccctcaccacgtgtcattctcctgctttaaatcattcatggcttgcactgccctaagaagtaaatgcagtctccctagaatggcctacaagctacttataatctattaaaaacaaatgcaattccatctctcccttctgccccaaactccaattctttacaacatctctggccatattgattttttttctagcttctctaatgtgccacattgtgtctcatgacagcctctgaaaaagctataattccctctacttagaactcattctttccttttttctttcttattccccgctgcccaatttttattgtttttcaaatctcagccctatgtcatttcctttctaaagccttatttacctcaattgtcctgcataggtgactttcatcagtgctcctaatatgttgctcatcacacaatgtaggggatgcctactcacctgtttgtttccttcaatggactgaaaatgtatcaagattagggattataatttacttacactgcatttctgaaacctttccagtgtgtgacaacaagggcttatacatacttgttgaatgtacctcgtgacaagttgttgtttatatgaatccccaaatttgggaaatggagcacctgaatgccagtacaaatcattaccataatgtgacattctcaaggaagtaatttccaatgggagagaagtacttggtcttttctgaagaagttaaaaaattttatccccaaagcatgtggttttagaagtttaagtgtacttatggggacaaagggatagactctgaaaccatgatgggcactgtgccactgtagcacactattccacccctcaaacatctcaaccttctgtgaatctctcgagtcccctgcttcccataatcatgatgaatccagcctggcccttcctcctgatgaggtggcacagagaacattgtatccgcttgttttctcagtcctctgtagcaactcaggggaaagagcaggctagtaggaatccttgctctttcttggactctctttttagaatggtgtggtaactgggcctcagagaatactgaccaactcatacttgttccttgactttagttcactgtactgtttttcttatatagctgtaaatgccataaagtcagtgatcaaatctacatagttcaccactgattaaccacttcttaacagcatactcaataaatactgattttgaagactttagcttaaaaaattaggggattgtaacaccaataactaagaccagaaacaaaggaatgcacatctgacaagggaaattaaagcctgggggcagtcaaatcacagtgcaaacctagagcctaagaaatacactggcattagagatacataagtttattgtcatggaatactgctgatatttaaagctttgggaaaatagggaagtactcagggagaacatatttagcctatgtatataataattataatattaacatgtattgaacatttaccatatgctatgtacttttttaagtgcttaaaaagtatcaacctacttcattcttacaaaatctccatattgtaaatagtgtgagtctcttttaactcatgaggctgctgctgctgctgctaagtcgcttcagtcttgtctgattctgtgcgaccccagagatggcagcccaccaggctccccctgtccctgggattcttcaggcaagaacactggaatgggttgccattttcttctccaatgcatgaaaatgaaaagtgaaagtgaagtcactcagttatgtccgactctttgcgaccccatggcctgcagcctaccaggctcctccgtccgtgggattttccaggcaagagtactggagtgggatgccattgccttttctgaactcatgaggaaactgagccaaaactgaggttaaggaacttgtctaagctcacaaagcttttgagtgccagagggacctttagacgtagccagctggtccatgagccatgatgcccgaagaaagaagagggagggtagtggtttatcctatttcttccatcatattttagtaaatgttggagaaaaagtcatttttaataaaatgtggaggtaaattttagcttttgatagtttgtcgtaagtattgtgcatttattctaatgtacaagtctctgaactggcagggttttgtctaatgcttcaggtactgaaatggcccatagatagcatgatagcaaaaggctctcttttaaaagtaccttgaattgttcttggcagcttatccttcgaaaggaaggagcatcagaaaaatgaactgaaacatgctttgcattgctatgccagctgtctgtcagagtctaaaatagctaagactctccagaaagtgtaaaatcatcttaaaggtccaattacacttttagcttatttgattttcttaaaaagaaagtagtttaattcattcaatattttaaaaatatttttaataatattactatattttattttaaatgagttggcacttgtgttgactaaggggtttgcctcccaccagaccagatcagggaactgcttaagagccctcattatcatgtgtaagtcacagttgacatgtgcttttatttttatctctgtattttcatgttatattttgatgtacttcttgataatatcctagatgtttcctgttcccaggaaagcaataaatacactgaaccaaacgcttttttatgtatagttgaaaatgtattttttatagtatatctacttatcaaatttttaaagaaacagttttgctgaattgcagcttcaggtaagtacttgtgcttctcaataactgctttaagggaaaagcaaaaaccccctccaaatccccaaagactatgggcattttaaaataaaattcacagaatctgatttctgagcatgtgcctggtgaaacagactggctttgcacctcattaggagatttcagacagccctgcaccaaggcagctccagccagctgactcttcagtgaagtcatgaattctgaagcatcttcatgtatagattctattaaaattaggtttgatctctagttgggctttgtaatttgcagtttctagtcagcagtcagttttagataaaactgcatcactggatgtttatttaaagatttcattgtctatctttgagcatgtgtataatgtacgggtgtgtgtgtgagagggagagacagagaatgcaagcacaagtcttaacaaaagctgttgaaattgagaggaaaagtccatctataccttttctcactgttgcctcattttgcaattctctttgttaatacttaggagaacggagggacaactacccaaagagctccctccttaaacatgaatgtccttgcaatggctatggctaatactgcaagattcccactgtgtttttactaagctcagcttgctctttcctggggctttggagagaagcccatttattcacttgagcattctggatatcgttgacattttcttcaactgtgcctcaggctgttgtagtggtgaaggcttttaacaggagggttaactgcctgaatgtcagaaagcttcaacatccacatgctttactagcaaataaattcgtgtgctttgtactttcaagtaggtctgagagcaggtcgcatattaataggttatgtatgggaatggggaaggtgggctggagctttgaggaacatttctggcccttgctgctgtccctacacttgtgtattgacagtttaatcctgcctagagattatggtgatagaggatggattggtgctcacagaataatcttgataattgtgaatttattcaatattatagtctgcatacttcaaaacccaatattaaatccattgaatttacgttatcaggatgcaaattgatggatccgtcagaacttaactactcgatctccagattcctcctatagaaataag

SEQ ID NO: 60511 - DNA, 2988 bp, Bovine  19866880811450
aatataaggtaatattaaaatatctagctttagttaggttttgttcttttttagtttttaaaaatttgttttaagtatagtttatttacaatgtgttaatttctgctgtacagcacagtgattcagttatatatatatgtatatacatatatatatacacattctttttaatattctttttcattatagtttgtcacaggatattgaatatagttccctgggctgtgcagtaggttggaaagcccattttcttaagaagattatatagtgttagtgggagacttcactctaccttttgatgctagctatgcaggactcaaggagatccaaccagggctaaaggagattagccttgggtgttctttggaaggaatgatgctaaagctgaaactccagtactttggccacctcatgagaagagttgactcattggaaaagactctgatgctgggagggattgggggcaggaggaaaaggggacgacataggatgagatggctggatggcatcactgactcgatagacattagtttgagtgaactctgggagttggtggacagggaggcctggcatcctgcgattcatggggttgcaaagagtcggacacgactgagtaactgcactgaactgactgactgatgcgggactcaacactgtatatactaatgacatttactaatacagtgacatcttgaaccttaaccatgtagagtgtcattccctgcaaaactcaacagcatatttacaatctcaaacctagtctacagagaacagttaccactgagcttctcactgagctggcatcccacttttggggacactcctattgctttggtgaagggagtgtcatctgggctctcctggggaacataatcagctagtagtttctctgacattacaaaataaatgtgttataacatgctaacttctctgagaccttgggactcttctccagtgttttgccaaggtaggtcaagctttgttctttgcttatctttctagagctctttgtttgatatgactatattattgcagtaaagtcagtgatacttttatgggccttcaaatattttgttttactgataatgcatacagaaacaggaagctggcattgacattctaactcagtttcctttttcatattaattttgccttaatttcaaaaagttggataagttgcaaatatttaaatgaaagacaaatgctatgcaaatgatagaagaatgaatatgcattgggttagaacttctatttggggatttcaatttcatttttggcacttttcctttttaaaaaataagtttaatctcttttgccacatgatggtagtgttgcttctcttgttaagccacaaaaatagattcagatgccagttaaaatcataaaaaaatatatttctccaaggagatctaacaataaaacattagttttataaagaaaaaagactcctacacatttatgttatttttaaagagcaggaaacatcaatgccagtgtttcctgaggagaattgccatttcttccctaggaaacagatctttggatgtcaggaacattctcgttatctcctttcttaagtgaatcttgttttgggcattgtctttcaaattacttcccccttttaattgggctgacaagtataatttatttccttctaagttgatgtagatatttatcttggagaagagaaattttaaatggcacttatgttgattgtaatctacataatcttttatagcagatttaggattagaagccaacttcgaaagttgtctagtgtgaccctctatttgcatgcagtaatttcttctgcatcatccagaacagatggctgtgcagtttctcaagtgcctccaaggatgcccttcaaggcagcctctgttcattggcggactcctagaaaaggaatttgtttgctttatgctcagcagaatgtggtgttgcttggaagctgtgaagcttctgtttgcttgaattcaaaaccatttcatttgtctggaggcaaccatcttgttgagagaatgagtcacaggataaaattatgaaatgtagtttgctgcatactggagtcagtcacaatctgtccacagatccaaaaaatattgaagaaatatagcaagctacattttgtactctgagagatctgggtttaacatgtcagaaattatttattttcctcatgaccgtcatgggtttactgaaatattcaattatgatttttggttgctctgttctcagcagtacagtttccattaacattgaatttcacaatcagcagatttagtggaggaaataaattcctttgtcaccttgtcaaattaggtgatggtgtgtgagaaagcatacctgtctcagcagagccttagctattttctccggggacaattttctctacacccagcaatccagtgactctatagccttttgaaggtaagatagtaagagaggtttgtggaaagatttagactgagtttacagggatctgaatggcaatagggtcaccaggcatcctaaatgcattcttcagctttgtagatttagaaatgtcttatcatttcagcaagggactgattatgctctttgaaacccactagagtaactgatctcaaaagagagtgagatataagcctgaggtgctccattattataattcccatgagaagtgcacctggcagaatagtctacagtggtcatagcccatgctatactattttagtaagttttgtagtatcggctcctgagggtcactgtgtcaaggatagatgaatcaaaacctcatgaatttgctactttggcagatggctagtcacttctactttgtattcacacttgttggtgataatttcagaagatgatgtttctgatcttgactttaaattcttatctgagtcctgaaaccacctattcttgataactacatagacttttatgattgtaaattttgtgttgtctaaactagaaatcaaatatgaatcatatatttttcaa

SEQ ID NO: 60512 - DNA, 660 bp, Bovine  19866880813061
acaatcttttattttagaactagatggcagagtaacgtgaagacccataacatggttttctctagatggagatctttgagtaatttatagattcacagactacttgtcttgtgtttacgggattatgtgtgtttgtttattcctgtttgggttagtcttcagaaaaagataatatcagtttcttttgcttatttatacttgttatcttctaacggcttccctgaagtttcaaaatgcccatgctgaaaagaaggtatttgacataaggagagaaaatcagttgagcttgctaatcagattctcctcttccctggggccttcagaattgatgttttctggtcatggggtaactgggcattgtgccaccatgtcggtgcctggactgtgtttaacaagaagcttcattagattgtcctcaatttcttgagaggtaatcctgttaggcagtgtttatcagtcattgtgtgctcttgtcattcctatcctgttcagtagcagcgctcctaggggaatatggagtgtgtgtatatgagtagtggtgtatgtgtacaaataatactgccagaattgttttataaaagagatatcctcccaaaagtagagaaaacagaaaagagactgagcagcaagcccctaacacacacacacataaataacatt

SEQ ID NO: 60513 - DNA, 653 bp, Bovine  19866881599715
aaatctgtacagagcagcttcttaagtacagggtcttgaaagcatgtcctctgagatcctaaacaagatgatcttgtttctttttcatcagagaagaaaaagaaataagaggaatacaaatggaaaagaaagaagtaaaactgccactgtctgcagatgacaagacactactcacagaaaatcctaaagactccaccagaaaattactatagctcatcaatgaattcagtaaatttgcaggatacaaaattaatatgtggaaatctgctgcatttctatatactaacaacaaagtatcagaaagggaaattaatcaacttaaggttataaaaactgcttttgtccttctgaattcttagcatctagaccctataatgtttgctcttcagtagataacctagatgaaatggaagcatagcaagattacacacttgctatgcatgaactcctagtacacaattatcctttaccagtgaggaaatgatttccctggtaatttgtcttataaaccccattccgcatagacacctgaaatagccaaagaaaaggctgaatatgcaagctttttttttttttaacaatctctataaattcctagcaatattttgaacaggacttcttaaatgattatatcttttttgctcttctaaacg

SEQ ID NO: 60514 - DNA, 2909 bp, Bovine  19866880442581
catgtgctttaagagactgagatacttgaagatgtgtttatttttagtggccccaagagtgtcctgccccatgtaactcattagcttcagttcaagtatccagagtttgactgtctctagggttcaaggaaagagggagtctctggagaggtgacatcaacatagtccatcttttccttccaaattgattaggagtgaacctattgtttccacttaactttcaaatttcaaatctcgtatattgattgcaaattttttttggctagtcttttaaaaaaaatatttaattttgtctgtgctgggtctttgttgctgtgcacaggctttctctagttgtggtgagcagggctactttctagctcaggtgcttgggcttcttactgcagtggcttctcttgggctgcggttgcacaggattcagtggttgtggcacacaggcgttgttgccctaaggcgtgcggaattttccctgaccagggatcaaaactgtgtctcttgaattggcagttggactcttgatcactggaccaccagggaagtcctagtctttacatttctttataagttgagatatcgttgacacttacattagttttgggtgtgcaccatattgattcaatatttgtacgaatttagttttcatgtagactctaattgtggtggaatgagaaaaaatactcaaattaccttactctctgtgtatatattgaaggtccatgtatatccttcaagtggatattcatttaagatgtgagattgtgaatgtggacttgaggaatctccttaatgtttaaaagtgagaattctttttctgctcaaatttctttgtgcactattttcttcagtaaagtgtataaactcttaagcatcatagtcaaggttctttttcttgtcctgttgcttccttattgtttagtttcacggttcagcttttcccctatgatgcttcttttgctttgagtgttttgatatagtgtatttctttcaaccgtcatacttcagttcaagctctggtttctcttcagattgagtaaatcttttgccttttacttttttttttttttaatttaaagtttttttaaaatttaaagcattttttttttcctctttgaagtgtgtcttcttccaggtagatagggaaaaattggaactcaaagggcttcaaaagaaagcaccagctctgtgattttggaaaaataaatgttattggacatctcagtaacttaataagtctaaaatgattcaacattaaaaaaaatgtagcttcccaatgtacttaatctttctgtaagttgaatgtgtaaagtgactaggggagaaggaataatatgtgatatttacaatataatcaaagattggcttgttgtactggctcagatagtgaataatctgctgcagtgcaggagaactgggttcaattcctggtttgggaagatgtcctggagaagggaatggctacctactccagtattcttgcctggagaattccatggacagagcctggtgggctgcagtccatgagtcgcaaagaattggacatgactgagtgactaacacaacaacaacaaataaacacatccatttatatatacatacacaatattttgtaaatattggctttctacttacaaaatatgttctttggagaattatggaaatcattctctttacagtagactggggaacaaggtaagtgaaatgggaaagagccaacatattgaaagcagatgggagaaaagaagttgaggggtgggaaagaagcgataaagaaattgaaaagactgagattttgaggggggatctctaactcaaacatccaacaagatagattattaataaaataaattgggcaaggtataagaaacaccagcataaaaaattaaaacataacagaagctatggtttttccagtagtcatgtatggatatgagagttggatggtgaagaaagctgagtgccgaagaattaatacttttgaactatggtgttggagaagactcttgagagtcccttggactgcaaggagatccaaccagtccatcctaaaggaaatcagtcctgggtgttcattggaaggattgatgctgaagctgaaactccaatactttggccacctgatgcgaagagctgactcatttgaaaagatcctgatgctgggaaagattgagggcaggagaagaaggggacgacagaggatgagatggtttgatggcaaaacaaacttatgcaatactgtatataagacatgaagtcataaaacttttagaagaaaatattattcctcaacgaagctggaagaaaataaaagaatagctattattaaaaacataaaggataacaacagttggtgaagttggaaaaggaacacttatgtactgttgatgggaatgtaagatggtaagccatgaagtgatgggatgatcatggcatctggtctcatcacttcatgggaaatagatggggaaacagtggaaacagtgtcagactttatttttttgggctccaaaatcactgcagatagtgattgcagccgtgaaattaaaagacgcttactccttggaaggaaagttatgaccaacctagatagcatattgaaaagcagagacattacttttccaacaaaggtccgtctagtcaaggctatggtttttcctgtggtcatgtatggatgtcagagttggactgtgaagaaggctgagcaccgaagaattgatgcttttgaactgtggtgttgggagaagactcttgcaagtaccttggactgcaaagagatccaaccagtccattctgaaggagatcagccctgggatttctttggagggaatgatgctgaagctgaaactccagtactttggccacctcatgtgaagacctgactcattggaaaagactctgatgctgggagggat

SEQ ID NO: 60515 - DNA, 1273 bp, Bovine  19866880513126
aatggaaagagctacaacagcgccttctctcgattattctcctgggcttctccaaccagccccagctggaaacggctctctttgcggtcatcctgatcatctactccttgagctgtttaggcaatggcgccattatgcttttgtcaacgatggatcctcacctccactcccctatgtacttcttcctctccaacctctcttttatggatctttgtttgactacttgcactgtccctcagaccctggccaactttaaggggaaggacaagaccatcacctatggtggctgtgtggcccagctcttcattgccttgggactcgggggagtagagtgtgtcctcctgtctgtcatggcctatgaccgctatgtagctgtgtgccgtcccctccactacatggtgatcgtgcatccccagctttgcttgcagctggttgtaactgcttggcttacaggctttggcagttctgtagtccagacagcactgaccatgactcttcctctctgtggtaaaaaccaagtggaccatttcttctgtgaagttccagtgatgctgaaactggcctgcaccaacacctctgtcaatgaggctgaagtctttgctgtcagtaccttcttcttggtggtgcccctgtcactcatcttagtatcctacggtcacattacccgtgcagtcctgaagataaagtcagcccaagggagacagaaggcttttggaacctgtggttctcacctaatggtagtgattattttctttgggacgctcatctccatgtaccttcagcctccttccagctattcacaggatgtgaacaaaagcattgcactgttctatactctggtgactcccctgcttaatcccctgatttacactttgagaaacaaggaagtcaaaggggcactaaggagacaaatgaggagaatcctagacttgaggccgagttaatgcagtgcttgcaggcccaggaagttctgcaacggaacacttctgagagtaaaaactagttaatttaaacacatccttataaagcaccaaccatgtgcgagactgtgttctagatacttgagatgtatcagtgagacagaggctaaaccattgagctaaaccttttgttagggagaatatatgttaaataagaaattctaaaaacaaactatgctatatcatgtactacacaataatgggaatgaacaataattacacatacaaaaacatgaatgattcctacaaacagatttacagtgagcaaactagatacaaaataattcctacag

SEQ ID NO: 60516 - DNA, 1831 bp, Bovine  19866880592728
aaaaaactgttgagtgataatagaattctgatttaactgtttggtgtaaccttttaaaaatttgattaaccacataatcttttctcttgtctccctcccccccccgccccttcccacccctttcctaaggcctccaccaagatgtttgatttaaaggcttgggctgagtatgttgtggaatgggctgcaaaggacccatatggcttccttacaacagttattttggctctgactccattgtttctagcaagtgctgtgctgtcttggaaattggccaagatgattgaggccagggaaaaggagcaaaagaagaaacaaaaacgtcaagaaaatattgcaaaagctaaacgactaaaaaaggattgaaggaatgaacaggctgtgcgtccagaggaaaattgttcggaaaattatgcatctttgaaaggacctattaaggtttctttttggatcttatgacagtattactaaatgaagtctgagtctgtggaagaatgtcagttctcacctgtactgtagcaacttttcagcttcggcatagaactctgttgacagttactgtaaattgggatttattatgctacagattcttataactgactttcatttgcctttttgcagcttatgtgtgaatactaaaatgaaaacatcctgtgaagaaaagtggctttagattatgaactctattcaaaaatggcttaaaatgtcctgttctggacaaagattaagaatgtaaaaatcaagagttgttctgagcagaaaagcgtggtttggcttaaaagatacatggtgtattaattacatctctttatcattattacttatttcttggaatagaatcatttctggtttcctcaaagcaaaataatattattcaatgagtacttctttattatctgtatttttcttattttagcttttgagatactggtaattaccagatagtctgcattttaaaaaatctaattttataaagaattgtcttgactatgtagaataccacctactggatataatcatttttgtacttatgaacactgccattttcttagagatgacttgagtagagtaacactatgatttaaagcttaagagtaaaaatgccaaaccttggaaccagttcattctcacttatgctaagtagaaatgtgaagtagttaacatgtcttatcagataatttgctgattatatagataccacttttgttttttattccattctttgttttaattcatgtggtggttatgtcctttactttttgatcagacagattcacagtgaaaattaaaatttcaactttcttttaaggaacttttaaagagttacagttatcttatatgtcataaatggtaacacaatatcctcttaatatttggaaaaattttgtttgcattgtattaattgggtgaaaaaggtgtaaattgtgtcaaaatgagaatgttataattagaaataaagaggtaaaggatatttccttcagttaaatagtataattggaactttttactctttaacatggcttttttaaatgcatggttgataattttgttttcagtaatagtttattaatgttttcctcacctctaataatgaattttaatttgcaaaaaattgtccaatagctttaatttaaaaatgaaactagatattgaaataaatttgatacttttttataaagaggtcctgagcttttttgggggggaagggataataattcaggttagatatgttatagaagttaaacctttcaaagggttatgagtttcatttgtagacaagcatatagctgaccctgaacacagggttaggagcatttgccctccctcgcag

SEQ ID NO: 60517 - DNA, 1301 bp, Bovine  19866880603685
ggagcttgtcaagattgggttcccagagtctacaaagagctataaatttcaatgtagggaaacccacattgtggtcactgcaattcttactaagccagacatatgttccgcaagaaccattccatctctcatccttatacatctgggggggcgggaaatgcaacattctcctgtttttgtttttcccattagcctggaggctgacttggaagaaaaagtctcatcccagaagagtactaatatgagcatctggtaagtgcaataaactttaattggtcaaagccattaagaaatgagtcaaaaaaaaaaaaaaaagaaatgagtcagacttgaaaatgagcaatatgtgactctatctctttctgcaaatctactttttccttcccaagctgaagataggtttcctttgctgctcagtccacacagcttgaagtggaaatagattaaattttaaattttcatatcttctctgcccaagaactaaccctacttcacctggccatcccccaccacccctcaaagacccctgagtgaaagggcagggactttgatgcaaggatggagataatcacagggccattttctcttggagatttctctttaagctgaagagaaggatctacacactagaagtagctactgtcaaggtagagaggccttctacactttatgtgcaaagtggtgaaagtcattggtgtttggggacccagaaaactcagggctgcatcaacattagtcacattggcagctctgagagcattggtgcctgacatagcatcatttttgtcaaagcaggcactggcagaacagtagtgatgagcgacttagatcagaagggaaagaaaatagagggttctatccaccagggtgagggaaaagggttcatgtgagaactttctggggactctagatagaaacggtggcaaatgataaaagcagagatttcttttgtgccagccagatgtagaggtgagggaaattacagagagaagaaacctcccaagaaagacttttaataattttcttccttctgcttcttgcaaagctcagagcctgccttcccctccatctttgcccacttgatattccatggtgaaatgctgtaatctccacagatattagagaacaattttccagtgaacgttgttgaatgccccctatgtggcaagagcaatgccaagtgatatgatacaactctatcctgtgtttcctgaaactgtatcagcctgaagcccaagagtgataataaacaacaggttgttttttcatctactgttacaatccctgcagtctaaggaaaa

SEQ ID NO: 60518 - DNA, 2003 bp, Bovine  19866880640235
ctaaacccagcttaaacatctggaagttcacggttcacgtactgttgaagcctggcttggagaattttgagcattactttgctagcgtgtgagatgagtgcaattgtgcagtagtgtgagcattctctggtattgcctttctttgagattggaatgaaaactgaccttatctggtcctgtggccactaatgagttttccaaatttcctggcaccactttcacagcatcatctttcagaatttgaaatagctcaactggaattccatcacccccactagctttgttcatagtgatgcttcctaaggcccatttgactttgcattccaggatgtctggctctaggtgagtgatcacaccatcatggttatctgggtcatgaagatcttttttgtatagttctgtgcattcttgccacctcttcttaatatcttctgcttctgttaagtccataccatttctgtcctttattgtgctcatctttgcatgaaatattcccttggtagctctaattttttgaagagatctcgagtctttcccttccaatgtcctagttcatcacatgatatgcttagtggcaagaacttcagggtcttgtttggtaaaccgtcaggtgcttgtctattctaggacattggaagggttcatttcattattctgaaacttttcttctctgaagcaagtggctccagcatactaaatgttctgttagacatataacgaaattttagagattactactctttcttctctccttctctttccatccccccccccctttttttggctaaagtatgaatttagaattaacatctggtctacacacacacaaaaatatgggtttttggttagcttgataaaatatattagcctatgaattatatacactaaaaatattgtgtactacaaaagccattttgtgatattggaatgaactatgacttgcatgggtaggatatgttaggggtggtggagcaagatttatcttgcaatttcccagtgacctttcacatcttaaaccagagagagcaaacaggccaatgagttctatttagcctgtgcatggatttttctcacaaagtatgattatctcttggtaatataaaattattgccactacttaaagagattttacataaaatctgactttccagattctcttagaaaaatgcatgatgtggcaacacaggcaccagattcccatgtgagaacaattgactaaagctgactattgtctagcgagacatggtccccactgccgcacagcttcctactgtcttacatacctccctttgttcattttgcctgtgtgacccctaccactgccttaagggtttctcaaggaggcttcagggctctaggtcccttaccaccaaaacagcttcactttaattagttttatatattggcctcccaaataagatttctctgaagattttctgcttgaggatttagattaataatttagattaataataaattttaaaatgtaacttttgagcacctgaaggtagaggaaagccactttaaaattttctttagatagaatttataggtaatcttggagaaggcaatggcaacccactccagtactcttgcctggaaaatcccatggacggaggagcctggtaggctgcagtccatggggtcgctaggagtcggacacgactgagcgacttcactttcactttgcacttccatgcgttggaggaggaaatggccacccactccagtgttcttgcctggagaatcccagtgaaggcgggccctggtgggctgccgtctatggggtcgcacagagttggacacgactgaagtgacttagcagcagcagccacaaaacaaattaccctgaagtgtagcagcttaaaataacaaacatttattatctcacactttctgagagtcaggaatctgattgcagcttaattgagttactctaactcaggatctcttacgaggttgcagtcaagctcccaggcaaagaatactaggcctatattcag

SEQ ID NO: 60519 - DNA, 1521 bp, Bovine  19866880689873
cttacctgccatcagagttgcttcttcttgatgaggctcaaaccaaaccagataaccctctgtggtagcaccacaccagattttatagccaattctaatagatttaccattcagaaattggtcactatcaaagcactcacacattgtcttatcaaaacagtagtattcttcgaggggagcatataggagaaaatttttattcatttgctttatgagaggcctcagttttgtgaacttatcattctgatctagatggctattatctgcaaaatgcaggtatgagaaaatcaattcaaatctatcccttctgattgcatctctaaccaggttctggtcagcatcagacgtttcccagtacattccccttctgggacgctgcacgagtccactcaaaagcaggacaccaaacacacacctcacttcctgaactgtgacttccaagttgacatttttctgagaagcataattattggtttcactgacaatcaggttgaatgtttcatcatcaaaaaataactcaaagaactctactgggttcaacttttcactcttgagattcaaaagtccagaatccagtgctgaccagcatggaaagctgggtttaatatctcttttggtccagtgcttctctgggacacctggcccttttggccgttttggagcaggctgggtctcaggcccgttatcctcctccacatctgaatcaccagaaaatgcaagcccttggagcagttcactcactcgagctttgtctttcttcctccctttccgggtgatgtctcctgcagcatattccagggaggagatgtgcatccgagcccacaagtcccccggatgacggtccttgagagtgttcaaatgcacaagtgtcctttcagcaggaacaggggtatcacaaggggtctggggtacacagtctctgagaaagaaaaaacataggctgtaaaaattctcagtcttatttactgatacaggataaatccactgacacctaaagattcttctgtggggaatacttctcactcgtgtttctgtggggagggctctggccagactgagcatttctggcctcccttcttccaactcactcctcatgacttaactgttgaatctgggagaaggaactgggctgtcctctttctgagcaggctgcagacattccatgttccttcccccagccaagatggatcaggaaggcctatgcggaaaggatgcagccactatgcatccatttagctctgcctctgagtggctttattggtctagcttctgtcagtcataaagctgaggtttctagactatctgttttactcctatgtctctatcaattggttctgaatttagacaaagaaatgggtgattatttactgagccccctcatctctaacagactttctgaacaaagaaggatttagcctcctctagttctgcattcatctggtggatacactgttttggggagaaacaaaagagaaactcagactgattgccctgaacgatttttagggtttctcaaagaag

SEQ ID NO: 60520 - DNA, 1544 bp, Bovine  19866880698466
cccccacccccgcccggttccaactgtgcttgaaccacagtttcatatcttgtgatgagatatttgttcttgtgagaacaaataacattggcctgatggggggggggggcgggcatttatctctatcttcaaagtggacattgtgaacaataaggtaaatgcatttttttaagtggttaaagcagatgtacatcttgtaaatcagactaacttccctatgcctcaataggtgaaattttcttccatcactatctactgttactatccccatttacagattgggaaagtcaggcacagaaagctgaaataatttaccaaggtcacccagttagtatgtggtaaagccaggattactcagataacttggcttgaaaatctgcagatctaactattatgccagatggtaaatgagggctaggaagaaacaagagcaaagaaaggagataacaggactagagagtttctggaagtgggaagcctgaaagcctgcttggctgagaagaagccatggaaaatagaaagggataacttatgtgcagagggggagggggagtggaaactttagttacttttgcaggagcaatctcaatggctttgctggcagtttgccacctacagtgtgttatggatgaatggaaattgaggactagaatcagagataggagggcttcctttcaagtttaatagtttagccttgaaggggaggaaagagagtggtaactggagtggggcagcacccaggggcagccactgtttcttcgagtaagggcttggtaatatgttctgcttctttgatgtttctgagagaaagggagtgacctcctgcctggagctctgagaaaaccctgctttctactgaactttagtgacagttttatgccagctccttagtcaagcttacatcagagcatggtataggccacaacagcatccttacacgatcgaaagatctagtcttatttcttatgattcagagcctgtcatcctttctttctcctcccctaactgcttcacttggaggtaagggcatggttgctaatgggttaactcggggacaaccaccgagaggctcttcctagagggcccgggaagtggtattgattcccacttgggcttcctgtgccccacagtctcaattcttctccagcatctggaggctgctcattgcaccaagacatctttggggatacttattgtgggattcaaggtgaggtgcagaggaggacgctgcagaggcgcggactgcagggggcaacctgtgaagctgctccccaggtgtgtcctcgcccctggacacgcggaaggggaccgctgcagttttacggtcctatagtgattgcccacgtttcaataattttccgaagacatatagctcccaagtagagtgaggctcaagtactgccttggtccacgatggctagggaatcgaaggaaagcgcagctttggacgcccagtctgcagaggaccggacggggatcctgaccgtgaaggtggaaaaagaggacgcctccgtcttggctgcatatgcgcgcgccccatgcag

SEQ ID NO: 60521 - DNA, 939 bp, Bovine  19866880776196
tacctgataaccttgttataagaactgttgaaggaaactgaatgctttggtctaaagaaaatttaggtgtggtaactcttttaaaatattttaatgatggtcatattaagagatattaagatatgatatatgctcaataagattaaaatactttgtcttatgaataaggggaaatttactacttgataaaaagttattgattctcgttttaaattttccaacaatgaaataatctgcctatatgtttgaacaaatgataaacaaattatgtgcctgggcagaagctattcaaatattaaatgggttgtgagacttgatgtcttacatgttccttaaaaatcctgattttcaatggttttcagaaaataaagattaagaattctttattccattcttaccagttatacagatgatctgaaaagaaggcaatggaaaaatccaatgacagctcagagtacggttttatcttagtgggcttctctgatcgtcccaagctggagatggtgctcttcatagtaaattttactctgtattcagtggctgtcctgggaaattcagccataatccttgtgtgtatattagactctcgacttcatacaccaatgtacttctttctggcaaatctttcctttttagatctctgcttcagtactagctgtgtcccccagatgctggttaacctctggggccctgataagaccatcagctatgcgggctgtgttgtccagcttttctctttcctttctgttggaggagtagagtgcctccttctggctgtcatggcctatgaccgctatgcttgcagtctgcaggccccttgtattatacggtcattatgcacccccagctgtgcttacgactggtggctgtggcctggggaagtgggctggtcaatgccatcggtcatgtccccactgacaatgactctctccagatgtg

SEQ ID NO: 60522 - DNA, 910 bp, Bovine  19866880871675
aacacaagaaaagactctacacatggacatcaccagatggtcaacacctgaatcggattgattgtattctttgcagccaaagatggagaaactctatactcagcaaaaacaagactgggagctgactgtggctcagatcatgaactccttattgccaaattcagactgaaattgaagaaagtggagaaagccactagactattggctgtatagtggttaaataaatgtttgcagagttgtaaagtaacagaaaaatcacacatgaaaaaaaaccctggtgtgttttattgatatggaagacaatatttaagtatattttaagcatattctgtattaaatattttaaacatatgtattaactatattgaacatactaaaattatattaaatttaaattatatttaaaacaatatatttaaattaataaaagtattaaacttaattattttagtataaaataaacttttcaaagtttcaaaatgtcagatatagtgcattcccatttctatggtttgcataaatatgcaaagataattagagagtttgaagaaagtggattttcaatcttctaaattaaaaagttaatataaccatataaaaatgtaacatataaccatgagtatatgttaccttaacatttaaaagggataagtaaaattttggaatggaataaaagtaatttgactgaagtttaatatttaggttagtctctagaacaattgtaacctcccaaaaaatacaaacgcttgcatcacatctctaaagtataaaaattattacaagcagttgcagacatgtggtatagagcccatgattttgctttataaaacagaatcacattgatccagagctctaccgctgcccagatgtctgacccacattaatgtaaccacataattaaattcatcac

SEQ ID NO: 60523 - DNA, 952 bp, Bovine  19866880905120
ggatgactgggactctctcttcacatgatcttccatctttcaggaagttaggtaggatttcttcacatgatgtctcagggtctcaagatggcaagaggagaagttataaggctcttgaaccctaatattgaaactcccacaacctctctcccacaacgtcattaccacagcattctattggccaaatcacaaggtcagctcacatacaaggagggaaatagactccacctcttgatggtagctgctgcacaatcatattccaaagggacatgcatagtaggaatttgtgacaggacttggtgactgaacaacaacaatcaatcaatcaaacaatgctttgttatctcatttaacactaaaaacaacactgtgaatagccactattgatatatcttggtaagtaaattatccgttatcacttctttaccagtgttaatctgaattggtctgtgaaccttgttttgaacccacatttacctggtgggcagctcaaagtgggccagggagaatgtaagcactccaaaatgtagcagcagctgaaaaagcactgatagtgctgagcatttgaacacgtgccattataaatttttgtaaagccagagagctccatgtccttgtctcaggatgactctgataatgtttaagatagagagggtgagattaagtgacccacacacagactcctggttaaactccttttctgatactgagttcctgagtgtctgatgtatctacaggcagcatggacttaaagagagtaataagcaccttagaggaagccccgatgagtggagaaactgaggaaagcaggttcaaacacaggaaaatttccactgagatacgtttaaaaaccaagagcgtccacatttcacataaatgacaaatcagacgtagtttattactgtggaaacagtcttggcaagagacaaaagttaaattgccaaagtgtcgg

SEQ ID NO: 60524 - DNA, 1424 bp, Bovine  19866880942070
tgtattctatctcatggtaggaagataaagagaggtagttttgaactcttagtattacttcctgaatacaatgacctggctgttttgacagacccatgtaggcaacaagagaaggtggtatgaaactgcactgtgactgggttggcacagagaaaaaaaccaaacctggctgacgtctctggtgaatgtgtgtcctaaagtgttaatcaactgatgtcacctcgctgtccagagattccaaccatcagggaaaatgaatatcaaggaaaatagcagaggacacaaaatctgcctcttttataatttcacatatttgacagatgactgatgatttcctagacctcccagttatcttagctctcatctttgaataatttagatgtttcacaaaacatgagattttctcttacaattgcaaaaacaacttttacatataaatatataatgaaaacttcattcagttacttaatattaaacataaatatgcaaattatttttcacttagtataattcataaccacttataagggatcatagagctaatgcagtaattaggcacattcttatcttttatggtcaatgtaaaccactatatttagtactaaacatctaatgtggctaagaaaaaaaaaaatcagtgtatagaagtatacattgctcagtttatacccaaaggttttaattatctactcaaacaataaagagaaaaattatcatttttttaacaaaattgacatggtttgtttaaattcaactagtctttgcctttacgtttcacatgatttcggctaaagaaaaacagaaggaagttgatgggccttgtgtctgtttaagtcaagttcaaagttaattcagttaaattatctcaaaacagtttatcttgacaatatagggaaaaggcaggtataaacaacacctgactttgaaaaactttagctctaaacttcaaaggcagtttcaaaagtgaaattaaatccccttttcaagatgggaacacattttgtttcagagtaatacatgactgctagttagcagtacaagctagctcagagaaagccatttaggtttgaagcatctcagtttccacatgctagtcagacaagcattgagagcttctgtgaataatttacattttattgccaactgcttcccatatattcataaatttcagttttcttgataattttctgctaaactacccattactaaaaacattcatagattaaaatttttctgttatgtaatactagttaaatctcatcatatttataaggaggtctagttaagacaactctgcttaagtcgtccagaggagggattgaatagaaacctgctactaatgcatttcttcccagtttactcttactgttgcaagtattagttagcaaaatctcttttgataatagttggctgtcatctagcaa

SEQ ID NO: 60525 - DNA, 1296 bp, Bovine  19866881029143
aaaaggctcatcagtgtaataaatgtggcagatgttttagtcaaagatcaattctttcaaaacatcaaagtctccacactgaaaagaagccttttgaatgtatatactgtgggaaaacctgccatagtgcagacctcactgaacataaacagttgcacaacagagagaagccttatgaatgtagtgaatgtgggaaaaccttcaggcagcgttcaaatcttagtgagcatcagcgaattcacagtaaagaaaaactttatgaatgtaaagtatgtggaaaagccttcactcagtatgcaggacttaaccaacaccagagaatccactctggagagaaacattttgaatgtcttgtatgtggttgagcttttagccgaagctcagaacttataatacatcacagaattcactcaggggaaaaaccttatgaatgtgctgagtgtggaaaaacctttagagtgaactcaaccctcatcatacatcagaggagtcacactggggaaaagccctataaatgtgatgaatgtggtgaagccttcagtcaacacttaggccttaacaaacacaagttaggaggaaagcacagaaaccgtcctaaactaagaaaatacacatgtgatgagtatgggaagaccttcacacagttaactggcctgagaaaccacaaaagaatccatactggggataagacttcccagtgtcctgagtgtggcaaggcctttacaaggggagagcatcttattgaacatcaggggattcaccttatcaatgtaaagagtgtggcaaagcctttagtcagaagacaggtcttagtcatcatatcaaaatccacacaggagagaaaccttttgaatgttctgaatgtgggcgagacttcagctgtaaatcaaatctcaataaacataagagagtccactctgaggaaaaatcctatacatataaatagtgtaggaaggcctattaggcagagagcattgctaatccaacatcagagaggccacatcctgctaagcctcagcagtggcgtgaatgaggtaaagcctagaagctcagctttgattagtcaccagagaatccactaaaatgactccttgccaagatgtctggtgacaacttcaagtagaattcagaatttttttcaattgagatgaaatgtttcttaaacttcattacttaaagaatgtcagagatactgtgttgaaaagttgtttaaaagtcataaatgctggaaaagttgagaatttgggaaaattaacattagcaagaaatttacctgttactacctttgttaaagtg

SEQ ID NO: 60526 - DNA, 2197 bp, Bovine  19866881338600
cttttgattcccgtccctttactccaacctatgtctctctcaatctttactatctcagtgaatgacaaattcattttacctgatgtacgaaccaaaaaccttggaataatctttaactcactttctctcatatcctgcaacctatataaacacaaatcctctcaagctctatcctcaaaatgtatcagaatccaattacattttgccacttccaatgctattattctagtcaggcaccagcatctcttgcctggattactgcttatagctatagcctcctcaactggtttccctgcttctaactttgttccctatgttctccttccccacccccaggcccagtgtagaactttcgcaacatagaagctagagtgattatgttaaaattaaaaactttaaattggaattaaacgtcagactggggcttccctggtggtccaatggctaagactctgctctcaatgcagggggcacaggtttaacccctggtgaaggaactaagacctgcatgccacatggtgtggccaagaaaaaagagcagcaaccctctacacttttttcactggtgcattcccagtgcctagtaaacaacagatggccaataaatatctgctgaatgatgctgctactgctgctaagtcgcttcagccgtgtccaactctgtgcgacccatagatggcagcccaccaggctcccctgtccctgagattctccaggcaagaacaacggagtgggttgccatttccttctccaatgcatggaaagtgaaaagtgaaagtgaagtcactcagtcgtgcccgactcttagcaaccccatggactggagcctaccaggctcctccatccatgggattttccaggcaagagtaccaattcactttcccctacgatcttgaactcaggagtgtttccgttatactagtctttcaagcttgaaaatccctagtgcttagcctagaatagactgctgaatagagttctccattctttcttccttctttatacctccatctgtataattttcaattaatttcatgcaaagatgggctcgatgaaggacagaaatggtatggacctaacagaagcagaagatattaagaagaggtggcaagaatacacagaagaactgtacaaaaaagatcttcatgaccaagataatcacgatggtgtgatcattcatctagagccagacatcctggaatgcgaagtcaagtgggccttagaaagcatcattacgaacaaagctagtggaggtgatggaattccagtagagctatttaaaatcctgaaagatgatgctttgaaagtgctgcacccaatatgccagcaaatttggaaaactcagtagtggccacaggactggaaaaggtccgttttcattccaatcccaaagaaaggcaatgccaaagaatgcttaaactaccgtacaattgcactcatctcacatgctagtaaagtaatgctcaaaattctccaagcaaggcttcagcaatatgtgaactgtgaacttcccgatgttcaagctggttttagaaaaggcagaggaaccagagatcaaattgccaacatcctctggatcatggaaaaagcaagagagttccagaaaaaacatctatgtctgctttttgactatgccaaagcctttgactgtgtggatcacaataaattgtggaaaattcttaaagagatgggaataccagacacctgacctgcctcttaagaaacctgtatgcaggtcagaaagtaacagttagaattggacaaggaacaacagactggttccaaattggaaaaggagtacatcaaacctgtatattgtcaccctgcttatttaacttctatgcagagtacatcatgagaaatgctgggctggaagaagcacaagctggaatcaagattgccaggagaaatatcaatagcctcagatatgcagatgacaccacccttatggcagaaagggaagaagtaaagagcctcttgatgaaagtgaaagaggagagtgaaaatgttggctttaagctcaacattcagaaaactaagatcatggcatctggttccatcacttcatggcaaatggatgggtaaatagtgtcagactttatttttctgggctccaaaatcactgcagatggtgattgcagccatgaaattaaaagacacttactcctgggaaggacagttagaccaacctagatag

SEQ ID NO: 60527 - DNA, 1760 bp, Bovine  19866881415406
gacgggggagcctggtgggctgccgtctggggtcgcacagagtcggacacgactgaagtgacttagcagcagcaacaatcacttagatcaagatgtagagtgcttatatcaccctaaaaaattccttcatgttcccaccttgttaaaatccccaaagaaaatcactgctctgctttccattatcttagcttagtcttttgactacctggaagttcatataattagaataatatggtatccatgcttttgtttttgacttcccatgcaacaggaagtttttgaggtccatccatattgttgcatggatcaatagattattcattttcattgatgaatagaactacatttggtgacttatcacattgtatctattttttcattgtagatttttgcattgtttttggttttgtgctctaatgaacaaaacctctgtgagacttctctcacatgaatcttttttatggacatttgttttcatttctctgaggaaaatacacaggagtgtaaatactcaatcatagaggatatgtgcttaattttattaaagaggtagccaaacactttcccagaataattaaatcactatatttcacgagcaacatatgagggtaccagttgctctccatctttattaatatttggtattttatgttttaatttagctattttaatgattataaagtggtatcttgtggttttaattttcatgaagatgaaaataacgagcaccttttcatgtgttttttgccttacatacatcttactttgtgaaaagtctggttttagcttttttccccttttcattcagttgtttgccttttcattatttgtacacattcttgatatattctggatacaaatctttatatatattgattcatggttttaatgattcatggtgttgcaaagagtcagacatgactgagtgaatgaactgattgttttattggatttcagttagatgaggacaactgaaaagaaggaaaaaagatgatttgaagtgttaaacataagatatattgaaaattaatttttacctaaatttacctgttatctaatcaagatcatatttggcctttatagtacatatttccaaattccattcatggaaatttttattgggttggtagaggtgtttaaataaattaaaaatttttactttaaaaattatttatttctattaactgaataaaagaagtaaccagaaaactggtcactgtcaccttactttgtagacacaagtctcctgagtgcaccctttacatccttatttctcagtgtatagatgacagggttcaacatgggagtcaccaagttgtagaagagggtaaggaatttcccttggtcctgagatgaattatttcctggttgcatatacatgtagataatattcccataaaacaaggaaactacagtgagatgggacccgcatgtgttgaaagccttcctccttcctgccgccgacttcatcctcagcactgcaagggcaatgcagctataagagatgaggatgaacgacaggggcaccagaacgatgatcactgataggatgaaaacagcgctctctacagccactgtatccacacaggcaacttttatcagagccggcatctcacacaggaagtgtttcaccctgcatctcccacatcgtggcagtttcatagtcactggagacataccagggagttggagaagtccaactccccaggccacagacaccaacttccaacagagctgagggtgcatgaggacagaatagt

SEQ ID NO: 60528 - DNA, 1067 bp, Bovine  19866881462730
ggatcattattccagttatgttgggaaagttgagatttgatggtgtgcatgatgttgttgggtaaatcctcagggctgctgagtagctcttagaggcaactgtaaagcaaagggaacacaacagtgatgggagctgagtcatgttagctttccactgcagtcggtccttaactgactgattctccactaagacgtaaccctagagattgctccattttgtgagtgataatgaaactcagttgaaactttttaataactgcatgcagcatggggaggccatgttaatcagctctcctgttcaaagagctgaatccctgtggacatagagaaaacaagatcatgcttatcagtagttcaattctgtcattataatgagatctctagggtcttgttttccttccaacttgtgtaaagagcagcagaaattgaaaatcactcttcctcttgctctagttttaaacagtactcattgacctcatcatgaccataagaatcccttcagattctctgtaatccagagggaaatacatgagtgaatgcagccatgtttgactattacaagaaaatagaaatggcctaagagaaactacttttctcaatagatccaaacatttcacattcttcagttttttcaatctataatttcatctcttctttctgatctcctttagaacataactgttaagacaaataagtcacttgttcagtgaaataattggcaggttatattttcttttcacctagaagacaagaagaaagtaaatgactcaaacaaaagcctgcatttcttcttggtttggatttatcaattttatgttcatataaacaactgcaaaatatttaatcatagaaagcaatgtactagtacatctaaccttttcccaaacttattcacactgttaccttgaaaaataccaagaaggaaatcaagctaatgtgttttcttttttaaaaaacctagccatctgtgtaaaaatattttttgtttacaagttccatttgagcatacagaatcaaagtgaagtttaatttacagggaaagaaagtttttagtgtaatagattttt

SEQ ID NO: 60529 - DNA, 1231 bp, Bovine  19866881477386
tcatgtctctcttctacactgtcattatccccatgaccaaccccctcatatatacgctgaggaacagggatgtgaatggggcaattaagaaggtgctttggaaagactcttgactccagatgatggctgaggacaatttactggaaggacctggaatgctagtgctctttagatgtatttgtgtattccacacgagtcatctaaaattccctgtgagaattctgaagggaatttgtttacttcattactgttgaaaagtgagtgttcagattctaagttcatatactcatttcaacttccagagacgctgattcagtgttgtgacagcatctgctttgtagttactgttttaaaaatctccaataacttttcttgtttgtactcccatttgggttccacataactccacatctatttgcaaaaagattgtatgtgtctaaattacaagaagcccaaataagatcataaaaccactgaaacactatatggaatattattaattaatattttctaggagttactctaatataccattcattctcttatttggatcatggctctactaaaattccatggtttgatgtttttcactgatgtaggtggagcacttgtggggaaaataaagttgaatctcaaagaaaatcttgctgcattaaccccggtaaagccattcagacatcaggtgcaactgtaacctcagcagtgcagccgccatattgtgtaggatcatttcagagaaggccgcgcctaggactcactgagcgaagggtatgatgcactgctggcggtgacactggtagccctttgttggtaagaacaccaggtagttcttacatgcatttttgtacacagcaggagaaaaacaccaatgtgaggtacaaagttggttattttaattttgtgaaccacctagttcctttctaaaatgagatttttaaatgaggaattttcgagggcattatatctgagcagcatatgacccaagttctactgcatattctacacattttacctcctgtgatgaagcaaaagtttcaaagggtaaaatatgtttagatttttctcgtcatgccattttataaactctttgatttaggcatcaattggttaagaccttagaatgtctactctggcaaacgtcctgtgaaattcagatttagtgaagtataaaaatattgaaaattgccccgattcccaggaaatcccatgtttggggagatgtcctcagact

SEQ ID NO: 60530 - DNA, 987 bp, Bovine  19866881477387
ctcccttccatccctgttcctcagcgtatatatgagggggttggtcatgggaataatgacagtgtagaagagagacatgaacttttcctgatcctgggagtcgctgctgctgggctgaaaatacacagagatggctgtgccaaagaacagggagaccaccgtgaggtgggatccacacgtgccaaatgcttttctctgccctgcagtggactttattcttaacacggccctgacaatccgaccataggagaacatgattaatgaaacaggtgtgagaagagtgatgacactgccaaaaaaggtcatatacacattcatggtggtgtcaacacaggcaagtttgagaaaaggagggatctcgcaaaggaaatggtctaatttatttctcccacaaagtggtaaaaggaagatgagcactgtctgtaacaaggaattggcaaaaccaatgatccatgaagcagaagccatcaaggcacacagacgagggtgcatgattactgtatagtgaaggggcctgcaaacagctgcatagcggtcaattgccataactcctaggagaaatacattctgtacatcccaaacccagtgagatgaacatttgaactacacaaccaccaaaggagatggatttgtctgctccactgagattaaccaagaactggggaacaatgctggtggtgtagcacatgtccaaaaaactcaggttagagaggaaaaagtacatcggggtgtgaagacgtgggtccaagtaggacaatgcaatgatggttgtgtttcccagcaaagtgaagatgtagaaaatcaaaagaattaccaagaggacgagctcaagttgaggcctgtcagagaaacctagtaggataaacccagtgaaagaacttccatttttctgttccatcctttgctggcacaaggctcctgtcaaaccaggcatttagcaatttataaaaggtattttccaagaaagagcagtgttaagaggaaaat

SEQ ID NO: 60531 - DNA, 1420 bp, Bovine  19866881725139
ccttcagaaggtaggagaggcaggacgctactctagaccttcagagagcaggccctgctggttggtcctactggtgtgcagtgtggtagtcagcacccttcacaaccagtccctttatctttaccacagtgaagactaagaggccatttgttgtccttgtagacatcagtgaagactgaggaagcagcgccgctccttgtctcagaggaatggccagttccgagtctggctcaggaggaggctacagacgtcagtctcatgggtgaggacaggcctctgactggtgtccacctttcccgtcattaaccctgactcagccatcatgaacccacatttcctacacacacttctttccccttcttctgggctcgatctccacacttctctcagcctgtcattttgtatccctcacaatcacagtaccttctattactagacactcagcctactgattcttgctgttctctgatcatccctctgtattgcctgattccctcaatgtctcctcctttgctcctttttttccccctttgcaagggtcccatataatttgtcattttcacacatcccttaatatctggaaattccacaaacacctctgccttattccttcttcacatcagaggaagttctctttactctgagaacactaaaagttatgtgtaattttctttaaatagtctttgtcccattaggccttctcccctggaaactgacctttcttactatcttcccacactccaccacgtttttaggattgctatgagtatgttcctgggacacctgttgatttttggttttaatttgaaacatcctattccctaccctggagatattttctagattcaggtggcaatgacatttgaattatcaatgtgttattttagctgaagaagttgtaactaaagatggattttttaatgcaaagcaagaaacttctgaagaaatggaacgaggtgctgaggcctcaggaatagtgaacaggtgagtgtccacgtagaatagctcctacaaaagtaaaaaattggaatgaaaccagagaaaccagttggtaaacgtctgcttccctggaataatacagaaaaagtaacactcacttctatgatcagaggaggccccacgtcaagacactgacctgtcggtatatcataattacacaaaaccttcagttggcacaccggttgccttcaagaatcctctcagttccttgcctgatcactgttcccctggctcccttatgtttttgtggagctatagatactgaagccagaaaaagaagatagagaaggcagaggattgagataggagagtgagggctgcagatgaggctgttgtcatgatggttaaagaaatatcagatctggaaaaggacttaagacaggaagataggtagggtattttcagcctccattaggggagt

SEQ ID NO: 60532 - DNA, 982 bp, Bovine  19866881803796
tgctgatgttaggtaagatgtgagctaaggataaaggttttgatacgttctttacatttataaggcctctctccagtatgaattcgctgatgataggttagatctgaaattttgaataaaggctttgttacagtctttacatttataaggtctctctccagtatgaattccctgatgttgggtaagttgtgagcgattgataaatgttttgttacattctttacatttataaggcctctctccagtatgaattcgctgatgataggttagacttgagcgttgattaaaggctttgttacactctttacatttataaggtctctctcccgtatgaattcgctgatgtttagtaagatttgcgcgctgaataaaggctttgttacactctttacatttataaggtctctctccagtatgaattttctgatgtttagtaagatgtgagcgctgaataaaggctttgttacactctttacatttataaggtctctccctagaatgaactcgctgatgtttagtaagaagtgagcgactatgaaaggctttgttacattctttacatttataaggcttctctccagtatgaattcgctgatgataggttagatgtgaggaagagacaaaggctacactacattctgtacatttataaggtctctctccagtatgaattcgctgatgttcagtaagacttgaactgtaaggaaaggctttgccacattctgtacatttataaggtttctctccagtgtgaattcgctgatgttgagtaagatgtgagcgacggttaaacgctttgctacaatctgtacatttgaaaggtttccttcctgtatggattttcctatgtttacttagattggatgctttactaaagacatttccacatatattacacttattttctttctgtggattctgaaccgtctgctgttgaataagttctgaagactgattagaaaccttaccatattcacgacaa

SEQ ID NO: 60533 - DNA, 844 bp, Bovine  19866880282342
taaaatgagattaattccttacaattttgaataagaaaatgacaagagaatgccctgtagtctttagaactgaacagttatacacccaaaaatctcctatatatctcagaaattgttggttttgtggaaaggacttgaatctctccttcaaaggtcatttagcaggtatttattgaggctgtgtgggatatgagcctagtgttcagttcagttcagttcagtcgctcagtcaagtccgactcttttcgaccccatgaatcgcagcatgccgggcctccctgtccatcaccaactcccagagttcactcaaactcatgtccatcgagtcggtgatgccatccagccatctcatcctctgttgtccccttctcctcctgcccccaatccctcccagcatcagagtcttttccaatgagtcaactctttgcatgaggtggccaaagtactggagtttcagctttagcatcatttcttccaaagaaatcccagggctgacctccttcagaatggactggttggctctccttgcagtccaagcgactctcaagagtcttctccaacaccacagttcaaaagcatcaattcttcggtgctcagccttcttcacagtgtggggtgctgcaaaacttagttagtccttaggttcacatggggagctttgtagaaatgttcactttagacttactgaattaggatttttatgagtggagcccggagaaggcagtggcacctgactccagtactcttgcctgggaaatcccgtgcacggaggagcctggtaggctacagtccatggggtcgggaagagtcagacacgactgagcgacttcacttttacttttca

SEQ ID NO: 60534 - DNA, 3307 bp, Bovine  19866880593954
ctctactaagtaatgcccaaaagaagaagcaaaaagggactctacttgccctttgggtcctgtaacaatccctcttctgtggccccttcgtctaggctgagtggacttatttacaagggtctagttaatcatgtccatctgtaatgtaaatgtgcttctcattatgctaatgcaagcactagacatgcaaatccataagcatttgcatgcctaatgcaacagttcttgtccatcctgttctgttgctatttactatctagtttttatgacttatggatttccaaccctttaaatttatatcagcaccgtgacatatctgcaagcagcgacagttttacgagcactaaaaaagctgcaacacaccgccactaaatactaatgacataaatggtagctgtaatggcctctatttttattacaataccaaacctcaatatattgcaattacctctacactcaagccagacccagccacactgtacaggagccagcccagggagagagatgtgaccccagtagagttcccgggtcaagcctgtctgtggcgctgaggaggtacagtggcaggaaatgtcctctgagggtttactggggatcagagatcctcatcaggaagagatgcgcctggattctgaggtgggtctcacaaacctcagggattgcttggagatggttcacaggttttagccctgccacttcctgccttccccatgaaaaagaaaagaacagaggaaaagctatcagtactaccaggtcccagtctcaactgagccaacaacttgctgtgtgaccctgagcaatccctgccctctctgggcctcagttccccattgggaggggaggaactaaatatctctaaggatgtttccaactccaacattctgggactgactctgtggaaaattcaagcccaagacatagacattaattttctccagaatgaaaatacatccatcaggacatttttatgcccgattttataagttctgattttacaccttaaaataataacaccttgaatttattttatggcattttccatctgaaacacttttctgtctgttacggcattcattctgtgtcctgggagagtgagccagacaactattctttccattgtgcaggtagagaaactgaggtgtggaaagaagacagttatataatatacccgtgccaacatatctaaaatccatatctgtggatggccttttacaaagccatttctccacgcttccagtggcatccctgacaaaatttgtaagaatgacaccttagtacagtgagaaggaagacagaaaggatccttgaaccagcccgtcagcaatgccttcaactctaccagtgggttgtttgtttttttttttggctcctgcgctgtgttcctaggagaggtagttcaccagttatccatcactaccctctcagtgtggactagtatacaggatcacttttcctggggatagatagtcaagggcaagcttgggggacagctgtagggtatatcagttagtaagttacattggttctgtccatgggggcactttttgggagtaggaggcctgaatggaaggtagtgtatggccagaaaatagcaggagtggaacaggccagagagagaaggtcagtgaggacaaaccacccagtcgaaggccagttgtccttttgtttgtgctccaggtcatgatctatcctcagggtgagaggagggccccactggctcagcagagtagctggtacagagaaggtgctcagccaatgttcactgagtggaagaacttctcctgatcaccactcaactaagacaattaattaaaatctatctgaaatgaaaagaaattgccaggactggctgaaaagtggtgttatagactgagttatgtcctgcaaaattcatgtcgaagctctaactcccaaaatgactatgtttggcactagggcctttaatgacatggttaaggtaaaatgagggctcccctggttgctcagactgtaaagaattcacctgcaatgcaggagacccagattcaatctctgggttgggaagatcccctgcagaagggaatggctacccactctagtattcttgcctggagaattccatggacagaggagcctggtgagctgcagtccattgggtcacaaagaaccagacatgactgagtgactaacgctttggtcacttcagtctttccttaaggagcctgcctgaaaaaaggggagcctcaggttaaaatatctcagatttactatctgttcacaccactctttcatcccaccctttcacacttataatctcatatacttctctaatcttatattcttacttctactctctaatcttttattcttttctctatgaaaaaaaaaaaaaaaaaaccttttgagaatgacctcagcaaaatggccaaataagacatccctgacatgaattcctccttcagcaacactaatttggcatcgacccaagagatttcatgggatctgtggcttccagatacacatgtgtataatgcagacaaatttctttgccgttattgttcagtcactaagtactgttcaactctgtgacaccatgggctgctctgtccttcactttgtctcgtactttgctcaaattcatgtccactgaatcagtggtgccatctaaccatttatctttattttctgcttccccctgttctctttcccttgaatctttcccagcaccaggatcttttccagtgagctggctcttcacatcaggtagacaaagtattggagcttcagcctcagcatcagtttttccaatcagtatttagggttgatgtcctttaagattgactagttttatcttcaattcaaaagtgtcaattcataagtgctcagttctttatggttcaattctcatgcccatgcatgaccactggaaaaaacatagcttttgactgtagtatatatagagagtcaaatttctactacgtatttttttcatgggtacagtctgaaatgtaaaaaaatagcaatgatagaaaaaatgaaggatgtttaaaactgaattaatttgaacatcagagcagcacatatgaaaaacattatgaatgcataacatatctagtatagaggtaggtgtattatgacccacagtcaaaatctgttttacttgcatgttttgccaaataagtaattttgcttcacacctgttattattcatctacagctacttttgtgttataagagtagatttgagtagttacaacagagatagtatatcccagaaagcctgaaattatttattggctgaaactttatagaaaacaattgctgacct

SEQ ID NO: 60535 - DNA, 1813 bp, Bovine  19866880615887
cgctagttgatcttgccgcccaggcacggccctgagaaggctcatggtgcctcctctgcctgcttcctattgtgacagaactcccctggctacaccgtgcagtacagagcacactttctatgcatcatctcagtcggggctttctaccagtgggaaggcaggctgggccaggagaagtgtctggtctaaggccacacagcagcgaggagggacagatgtaagattcagagctgggtggtctgactctgaagtcggtggaggaacttgggatccaaagtgaccttctagaatgagcatggtggaaaaatgaccagaaagagggctgcccaggtctcggcctgtgagggagaagccctgaaggaaggaaagtgggaggaggagagaggttggagcctgctcctgccttgatcacctgcaaagatttgcacaggacgatggggctagaagagattcctggggtcaggaggtgacctggcaggccccaaggggcccctgttggactatgctatagagcaaagctgtgtcagatgatgattttgaccaatcctctcttaaccgggggcctggaaaactctgtttatcattagtggcaaaactgcttttagcagcatgacaaaggcagacaaatagagacatacagaggcccacgcagacatgcatggcccagacacagtcacccacacacacacacaccaggcacataaacccagctgtctgcttggacacacacacgcatacatggagacaggccccccgtgcatgagcacacacgtgcacgcaccacacacacccacacggcagcatatggagcaaccctgccttcccccatagtttccaggaggctcagcggggggtgcgagttccacatctgactttccttgtgttcgttagactctcggtgtaattaaacgttacattgaataatccagcacgggctcagggatggcagaggcggctgtggtgggcccggcgatgggggcctggagggctgtctcagcgtcgcccttctcctccatgcttctcctggcctaggaccctggagcggaggaccccttggccgcagggccacgtggccaggccttgaacaaggatgagagtgggatggtggtcctgggagacccttgggtgtccttagcttaggagtcccttgtcttcctctctagtgaggtggaatcccctcctggctctcaggggcagaggaagggtacccagacattggggaggccctctgtccagcagaacggccaacttgcccacttctcctggggagaggaagcaagaaggcctcccatttcctccctctctttccttttaaatgggccactgatgctcccagcctgcaaggcaggagccctgtgtggtggctcataccacctgcatgagtattacttgctatctgtgtgacttggtgtgacattcttcccatctgtgagctcggtgtcctcgtgggtaaaataggggtcatgggaggactcacctcatgggtttcttgggggatgaacctggctcctaaagcagtgttcctcagatttgctaacaatcatacctggcccagcagttaagccacaatctgtgcgtgtggctctttcccacaaagctgatttgggtcacacctgctcatctgctgaaggtgagattttggatccagtgtggatgacatcatgattccatcttggtccccactctgagcctcgactgcctcatctgtggaatggggttgacagctagtggtacccagcatggtggcaaggatggagcgggcttctgcaatgccaagaaccagacaaactgctggctgctgtgtccaggggca

SEQ ID NO: 60536 - DNA, 1215 bp, Bovine  19866880735711
tgcctggagaatcccatagtcaaaagagtctggcgggctaaagcccatggggtcgcaaagagttggacgcaactgagtgattaggcacacaagcagaccatggaagtggagttggtttcatctaaagaaaatcaaagatttcccaaatccccctcctctctctgactcagtgtccagctgggtgttcagcccaacaaagagttttctggaatactcagcttgccagcagcaatctgcttcctcaggtgaggctctaagagcccttcattccatcatcagaaattgcctgctttcagggaaatttacacagagggaagagggaattaaaaggagatacaactgggcatcgtgtcctcctcatttaaaagggagccgtgtgctcttcccagatcctgtattggaagactttcctttgtattctgagaggctcaaaaataaactccccaaagtgtacttccactgagaagttcagatgattttataatgactccaaatatggaattaaaatgcagctgatgaggagcctacaattttactaactcatcttgatcaaagttggtcaatttaagtctcagcaatgttccaaatgctcactcactctctctttttgaaggagttcatttcaggtagacagattatttacttattctgaagatgccaagggaaagggtgtgttagcaatatcaattgagctgtgggtgcaggcttgcagctcagccttcatgtggcatctgagtgtctgttgtttttccttcttttccctctgggttctctgtgcttctaagtgggactttgccttacaggtctacctaaattacctccagcatcagtatgagtgacagtggtgtgttctgaggctgtgaagtttgtagttgtttttcttggttgcctaaatgtgtccctatctcttgtcataagaagttgggatccaggctgaggacagaagcacgcctgttcccccaggagggagaccatagcacctccagatgtgacctctataggggcagtgggggtcttcatgtctgaatttccaccttacatctgtcaccagagtcctgtcttctagcctcagcctgcagagaaagccacctggtgactagctttcaaagctgtcacatggatcttctttgggcccctcataattaattcttccctcggtagccagagtgagcttctcaaagcataaaccaaaaaccacactgtggaaaccacctt

SEQ ID NO: 60537 - DNA, 905 bp, Bovine  19866880936017
cctttgcacataccgctccctccaatggggcacacagcccctcactccgactcccgtctgttccctgaggcctcctgtggcttccccatcccccactttgaagcaggggcctctcccactcacccttagcccgccttgacctagtctttccctgtcgttagctctgatggcttctcccctgcatcttcccagcacccaaggtgcctcacagagatgcggggcgctgctttgctccccttgtatccccgacctctaggtaaaacctcctcacctggcttgacgcctggcctgggctgccaggtaaccagggagactccgagtaaaggcccgacgtctgggtgaaccatcccggcttctccccagcgcacaatagcacctaataattaactctccaattaggcccgtaataaaggcttaatctggggctcgctggtaatgaggctgttcacagccggcctttcatcctgggcccaggccggggcccaggctggggctccacggcccccaccctggctgcgcgtcagagccacccccttgttaagcagggcctcggccctctccctaccctgaacccggagcccggagcccagggctgtgcacctcacaggaaagcctctgtctgtctgcggggccaggaccagctgctgggaacgtgtgcccggtgggcagaaggccctcctcgttatggagacggggacacaccaattggcacagcccatgaaagacttcaggtctgcgaatgttaagacttaattgccttatggacgctgaaagaatggagcggcttctccaggggagcggtcctcgcctggcttctttccccctccctgctggatcatgacagggcctgggacagactagaggaagggagacaagctcccctgttgcaggctagtgacagggtt

SEQ ID NO: 60538 - DNA, 1000 bp, Bovine  19866881059212
ggcagcctagtgacctagccggctgaaatgacacgcctgagtagcaaatgagaggagaaatctcggagtcccactcctttggtggacttttactggatggcaagagggcccaacgcttccagcgcggatgatgtgcagcactaaggagggtaaccctttccaccagcgtctgcctgccagcgtgcggacagaggttccttctgccaagatgaggaattcagcctcccccttttctgccatccagtagcctccgtgtggacatgccacattggtttattgtggcgtcagcatccttgtcgaagggggatgttggtgggtacctgggtaaataagtataaatagttttctttctgatatgtgaccggattattttccagttgatttcaagccttggccccaagtggcccacagatcaaaaaaagataagggtcagttacaaggttgagctcattctcggtcgccatggcaactgacctcaggcaaccctcagaggactacacccagctccccaggtgatatttttactgtccacgccatcaatcccaagcctttcaaaactcagactgcctaattgtctgggctctgttttgaagaggctctgggtcccccgtggggccccaattcaggctgccagagctcatttataagcctttctgaaacacgggggactgtgggatgggtccctcctggccagagaggcctgggaaggtgctcctgaggggaggaggaagggcacagcccatcctccaggattaattaaggaaatgggggcccaaaatgggggcagtggtggtggggcatgccttcatgccttcaagccctggctgcatgttctggagtgatgggaggtgctgggcagccccgagcaccctggcactggggaatctgcagccatgggggtgctgaggtagcctggggtctgtcagccacccacccaccccagagtcttccctccaaattcaccctcatcattttcatcccactcatgataacaggaaag

SEQ ID NO: 60539 - DNA, 1664 bp, Bovine  19866881165968
acagccactgtttcatcttcccgtctcccctttctgtgccatttaaactttaacctggtagtaactttgctgccttgattcccgattcaaaggctggcagatgaaaagccctccccttggatgtggcttgaaaacttcattcccagtctctctctgtctttgaactgccttggagcctttttgcccaagccgttttattctccctgggcctcgagctttcaggcctgggggctcgggaaaggcagcaataggggcttctcagttggggcccaagaggaccccaagtgcctagaatggacaactcctgtgcccgcctgcacacacccacctccccctacccctgagagccaggagtctggctcaggagaccttctctggcctttccgggcccagtccctgccttcacccagccctcccccatctcagcttcccttcacaagccccagacccacagcacttcaaggcttctagccccaggtgggtcctccagaaactttttccttttcaatgccaggcaggccacttgctgtttcagatatcgggcaaggcacaatgacagaattctgccatcacagaaaaattcaggtaatcaagaccaaattcgacagtgggaaaatgaaccagagagagtgttagaagtcaaccccaaagcagacctaacttctcctcctccaagcaggctctacacatccaggtggtggccacatcactcgtctcagatggatttccttttgttcgatgctcggcggtcttgtttgtctacgaggacattttccccaccacccctgtatctgctggcagaactaaagaacagtagagtgggttgaatcttggccgtcaaatcagtatgtccacatccctccactcctggaatctgtcaactgacctcatttggtgaaaggctctttgcagacataataaagttaaggatcttgaaatgaggagagcatcctggattagtcaggtgcacctaaatacctttttgagaaacacacagaggagaggaggagcccatgtgatctcagaggcagagagtggagcagcatggccacatgtcaagaaacatccagggccaccagaagtgggaagagataaggaaggaattgtcccctggagccttcggaggaagcacagccctgctgacactttgattctggacttctggccccaaaactgtgcaagaataaattcctgttgttttaaatcactaagcttcccaagtggcttagtggtaaagaatccacctgccagtgcaaggagacactagagatgcatgttcactccctgagttgggaagatcccctggaggaggaaatggcaacccactccagtattcttacctggagaatccaatggacagaggagcctggcaggcctgcagtccacggggtcacaaagaatgagttggatgcaactgagcacacatgcaaaaaaaaaaaaaaaaaaggcttatagtaatttgttacagcagcttcaggaaactgatataagtatgcaaagatgtggaaggaaattttcataggctttcaccagggtttggtgctatgggggaaatgtgccgggggactccctcttcttcctcagggtgtgatcatctttacctgcaactccacacagccagcctgagggtgaggcaggacagaggggaaagggcctgcacaagg

SEQ ID NO: 60540 - DNA, 1049 bp, Bovine  19866881205214
ctcagcctcctgtgacagcacccggcaaagctgcatgagtgtgaagatgcatcacaggaagcgtgagagcttgtgaggttcctctccccaaacctggcccccattcttcctctctccctaagcctggcctgagctgactgctcattgcgagaaaatttgcaggctcttggcctcaagctgcagccttgcaaacatggctacataggactggctccgcagaacagtccccggggtgcttccgctggggcccacccacgagcaggttcttctgcatcccctgttactgctatttgtgctacctgcttggcccaactactaaaatagtttctgggtcccctgacacaaggctttttatagttcagcaccgcaggcctcatttaaatctattagctcatataaatggcaattcatttaaactttggaggatttctgtttgccttggtggcgaagacaatttgtctgtggctctgccatgggcaaatgaccctgggcaaatcatttaacctctaggagtctcagtttccacatcagtcaatggggagaaggaccccagtgaagacagtccacgcaagacgcttagaagagggcctggcccacactaggcatccacccagggggcgactgttataactacttcctggccagttctgcaaggagcctgtccacctgtcagaggcctgctgtgtatggctgggaatcggtgatcccccttacagacccccttggtgataacgaagactgagatgcagtgaggctctcaggatggcgagaaggaggtgccgtctctgccagtgtctgtgagcagagaggtgtctgcggggatcagagacagctgggctgggcgggcggagtgcacctctcccctcaggtcagctcacccctggcaaagggcccacagggccccagaccttcatctgctgaggcctgaggctggaaacgcaaggccaacagccttgacatttttggggtgtgtggtttacaggcttatctcacgtccccaaccaaatctgcacgcctccctccactgagccccagcacagctgaggaaa

SEQ ID NO: 60541 - DNA, 1599 bp, Bovine  19866881216474
gtgcatggtgctaatgaattgtgagggtcctggagccctctgatttcctgtccacgtgagatttccttttttttttttaatagtccatctaaagtaccaaaactgacacagagatatgggccgtatctatcagtactccctcattgtcctgtccctaagtgctatcacagtgcctggagcacaggaaagactccataaacagacacagggaatgggtggcatgtgcagagtcagacttcttggagcagacaaggcttcccatgcaagtgccaagtatgaagtgctcctgggggtcccctgtaggggaagcagaagtaggcaagaaagtggggaggggaagaacaggagcaggatcaaagccgggggcagtttccagctgatacctcaggaacttgacccagggagctgggctttcctacgcccactcctcagtctctgcctggggaccactccagggggacagaaaactcagtgccttcagctctcaactctcacagttaaagtggttccagaagcacaagagtggcacctgctgaccactggaggcaagcgtacagcgaagctagccgaagggtatgcagaagtgatgaaagggattgaagagggtctggatatggtccagcaatgggggccacagggtagataaatgaacaggcctagagcatgtccacgactgagcctcaaacagcaaaactgaggcagctttctggtctacaaatgctcccaccatatccctcctctagccagaggggtcttttcctgctgcccacacaaggatggctaacagaagcccccaactcttattaagattctctttgcaaaacatcaaaagccagatcataatttgatgatgaaatattgattatgcatctgtatttgtatgcagaggtctacagtgtgtagatagaacacccacactgtaatatcttctatttaagtcaatatgaagatggatgttccccccaggctggttttgataaaatacttgtgtcgatacaaagagacattaatgccaatgcaaatcaatacccacttattggtttgggtcgcttcttcttcacgcagcagccgcccccaagaggggctccaaacaccagcagctcccagccctgtttgcatatttcttcatttacaccatgtgagtgggaaatgtcaggggaatgtggaatggcagggggctgcccacgcctgctcctgaattgaatcgggaaggaaatgaaaataaaagcaaacacaacctgtaaacaaatctgggagatgctttattactgtcattagcaatgtgcttatcctgtctccctttcaaaaagagtaatatcaaaacagcagaggagccaagaatcatctcatccttgccaggttctcagcatacaaaaggaactaggtctcatcttaactgtggacacttgctgtgtctgcccgcccagcacttgttgtcacctgaaactccatgtatttagtactttctaaaaatctcacttattctctgccttcgccaaccataaagtgaggttcccaaagggctgagtttttaatttgctttatttccaatgtgtagatgtgaatgatttctttcgcttcattcattcacccaacaaa

SEQ ID NO: 60542 - DNA, 1385 bp, Bovine  19866881229857
cagagaaggaagggatttctgggcacttggaatagtgcaactatccaaaggcaagactatgcctggctgatttaaggaacatgaaaagggggtggcagaaatggattgagcaatatttggacagctggactagatggaggatgttaaggcttctaggggccaccttgcccctaacagctgccacatggggagaccccatgaaaagaatcatacagagtcccctggatccagccatgcctgaagcaacccctactcaacatcttttctgtgcctgaaccaatatattccttttaaaagtcacttgtaactgaaagagtcctgataaaacattctgaaaccaagtgcctaggacgcttgagttgctgtgccaacagtgggtctcaaagataccggtgggctggctcaggggcagtgggaaatcccacctaggggagtgaggcctgggagccgtctgtgcaggggaggcctggactcctgacaagtgagaaggaatctttcaaatttgcaattttcaagtgtcagaaggatgcggtgccgctcctctgacactctgcacgttaggcagattctccccatttccatcaacacgtctagtgtgcgagatgcagcctttgcacccccatgacccggaacccacaactgagaatgagaacgccaggtgttggtttgtccagcaaggtacattcaaaggaccagacaggcccttcttcctcaattaccaaagtggacgcagtactttcaaaggattctattcagttcagcaggcgctttgaacagcttcaagatgctggggagtcagagaaacacacagcttggtctgtccccttagaaggtaatctagtgggtgaggggccctttaatttacttcattcacatgtagtggcttattcgctaagttgtgtctgactctttgcaatcccatgggctgtaacctgccaggctcctctgtccatagggttttccaggcaaaaatactgaagtgggttgtcatttccttctccaggggatcttcccaatccagggatcgaacacaggtctcttgcactgcaggcagattctttaccaactgagctaccagggatattccatgctaaaggcaaaacagggggtgctggggtagaaactccccaaacaggggaaggacagacatctgcagatgatactggtgtgtgatcaccctaccattattcattcatcagaagtgaagtgcttcctgtgaacccagcactcttgggcattaagaatacagcaaaacaagatgagcaagatccccgcccaagtggaggatgaagacaacaaagtgaaactaactttttaaagaaaggctttctgaaactggtaagtgcagcaagaagaatgtaccaggaaaatatattccaatagag

SEQ ID NO: 60543 - DNA, 1188 bp, Bovine  19866881256765
aaaaagtctgcacagaggtcactctgtgaagcaactcagtggctgtcattactgaaatttattttgctctgtcaggtcttaattttagcatgctcaagggctcagtagttacaggacaggggcttagttgctcagaggcctgagggatcttagttccccattcagctattgaacccatgttccctgaattgcaaggcagagtcttaatcactggaccaccagggaagtcccagtagctgttcctgcaatgtttaaataaacatggacattcaaattgtggtaattgctcagttgtgtctgactctttgtgatcctgtggactgtatcccaccaggcttctctgtccatggaattctccatgcaagaatattagagtgggtagccattcccttctcccaggggatcttctcaacccaggggtcaaacatgtgtctcctgtatggcaggcagatttttatcgtctgaccccattatatggttatcatgtatttgatttactttcccgatggagcattgaataatacatagcagaagcagcgagaatctacaaacccaatgttggagaaaggaagccaggggcatctttcaacagtgggttcccagcctctcctaggataaggccccaggatgcctaccaggctccaagggactcaaggactccagatgtcctgcagcacatttggcctcaatgtttccccatctccaagaaactcatgagctgctttaaatgagtttccaaatgtgtgtttaggctggatttacgtctgggtggctgcatattaaatgctgattattaaaaacatttgcatggcgctttaacaacgatagattatgtatctgttacctaagtctcagtgaaggctttattaattcattattattttatcaacatacaataaactgttctattaaatctaaattagacagatatttggggagggatcatctagaaggacctcagccgagactatccccagggaaggacttaatgaagtttcaaacagttaataaccctcagttcataaataaaccatgggtatttaaagacctgcaaaatactaaaataagatgttgagactcaacagaggaaggataagagagtacccttggaatcaccctccttgctactcacaggtaaaagctctattttaggcaatatttcttgaattcctgggaatatgtaacatt

SEQ ID NO: 60544 - DNA, 1596 bp, Bovine  19866881656540
aagtgtttgaatactgtgctgtgaagggaacagtcctgcagcgaggcagttgtgatattagagcaggcgtcctaagagatcccctggctctgagctgtgatccacacaccacattcgcagacagctggtcgcccagcgtgggctgcgcctgccgctccgagctggcacactggcggggaccaggtaatgctctaatttccctcgtgcagatgcggccaggaatatcttaatttattggtgtgctggcatgcaagagggaatgctgccggtgcagccttgcataactattagcaaaaaatggagctgaataggggcttgacttttcctaaagtgggtttgaaataatcatcgccttttgttgtgtttggaagggcttgaacaattcttaattatttaattatagatatgcaagtaatacactgggaatggccctgccattccagggatactgagcggaggaaaatgtttagttaccggagggggaaaaaaaaaggtggtaattaaatggaagtgtggtttgtatcatgccacgctactccattggtgacgtgggcctcaccgtggaaatcctgacgtaataattgtgacagaggcagcaatcgccaccttcctccgggcgaggcctgcggagtcagcaacgctgtttcttctcgatttgctcgtgttgtgccaggttagggttctgagagacgggtgctcttcttcccattttacagatgaggaaatggagtctcaggtttgcccaaggtcttccttcattctgcatttgaaaccacagcttatgtggcggccggccttcctgccctgtcaccggctaagcctgggggttcacagtggccatgcgatgacttttctctctccgagtgccctagaccagcctctacaacttgggtgattgtttgcctgaattgtgtgtctgactctatggcagcttctcttgacggacaccttgtaattatcccatataagcactcactgtattcatatcattaattttgtttgggctattacatttgatagatacattaagcattatatagttctctttatacatgaaattgaactgcctttgaacagtcagccagctaattgccggtaatttgtgttgctaacgagagcagaatagtggtataacattagactcaacagtcagttaacaaatttgccgattcagattgcgaagcatgccctccgtggcagaggcaggctgcatctcacacgtgaatagacttttaaaaatgcctacgactgaaaaccaaccacggcgaagtcgccccccgccccccacccccgactgtgcaacactgcctggctgctcaggagcgatggggtgaccgtgggtgcctgggtctgaaggatgggggatttcaggggaacctgggtggggatgggaggggcggttttgactgctccttcagggggcttcccaggtggctcagtggtaaagaatacacccgccaacgtgggagatgcaggttcaatcttgagtcaggaagatcccctggagaagggaatggcaacccactgcagtattcttgcctgggaaatcccatgtagtctggcgggcacagtccatagggtcacaaaaagtcgaca

SEQ ID NO: 60545 - DNA, 830 bp, Bovine  19866880819006
ttaaaatattttttatctgtgttcaaactggataatttatattgatctctcttcaagtttactgacactttcctctatcttctttattatgcaatagagtccattcagtgagttttaaaattttggttattgcatttcttcggctctaaaatttacatttgtttcttttttatattttctttttacttgctgaaacctctctctgtccattcatttcaagagtgtttttaatactttctttaaaaaaaaaacatatattttttaattgaaagataattgctttatagaattttgttttctgtcaaacctcaacatgaatcagccataggtatacatatgtccccttcctcttgaaactccccttctcatctccctcctcatcccacccctctaggttgatacagagcccctgtttgagttccctgagactaatacttttttttcccaacatcattgtgaggtaattctaacgtgtgtcatcttggcattgaagtctgtaaattttgttctcctatttattggggttctagaggttcattgtaatgctgaataactttgtattgaattctggacattcttaatattgtgttataagactctgggtcttatttacattttgtgtaaaatattggtattttaacttatcaatccagagagttcaggttgcaagttctgaccaactcttctggtgttttgtggtttcaatgtcaatttcattttcaaagcctttgcattgctatcttggtctgttcccatgtgtttgcaaccaagtggccagtctgagatctaggtggtggtctataatttagctcggttctcaaatctttgtt

SEQ ID NO: 60546 - DNA, 1146 bp, Bovine  19866881175028
ccttctttttttttttttttctttttttcccaaagccttataatatttttgttttgttttgggcttctgtaggcaatggcaccccactccagtactcttgtctggaaaatcccatggatggaggagcctggtaggctgtagtccatggggttgctaagagtcggacacgactgagcgacttccctttcacttttcactttcatgcattggagaaggaaatggcaacccactccagtactcttgcccggagaatcccagggacgggggagcctggtgggtttccgtctatggggtcgcacagagtcggacacgactgaagcgacttagcttagcttagcttatgctgattttaaacattattgcatttagtgcccctttgtatccaggagattttttgttttacattattgtgcatttcatttattctcacgccctatttaggacattgttgtttcagccataggactgacccagatgttcagaaacggcatccagagagagatacctccaggcactgttggcacataatcgagttatggttatgctttgtacacttatccttgggcatgttctcaggatttatttagagtaagtatatattctttccagtgattttgcttttatttccttagttttggaaatgtgattatgcatttactaatattacaggaatgattttctcacacagccgtgaatattttatctacctaaattgtcaatgaaagtacttttcaactgttaatgatttacaaaaagccttttttattgtgtgtaattagaggaaattaaaacaactctcttaatatgcaataagagttaatttaattagttgcccatttggaaataggttattgattcacttttcctgtacacagaaaaattaaataaaataacatagtgtatcttcttttacaaaggagaaaactacattactctaggcatatattttgtcccacattttgtgttttacaagtaactaaatgaatttactctttaaaaagtgagcattaaataaatacagtgacaggcgagtactttgtatctttctcactgttgaataataaaaaataaatctttttaattgctttttttttagttacatttatgctcctgaaaaaaaattgtgctaatatatcctttcaattt

SEQ ID NO: 60547 - DNA, 3855 bp, Bovine  19866881316807
ctgatagagatatttgttttaaatatttacattcatgcactctttctcaggaagctagtagaaggtgggctctaccaaagtgagaatgtaaactaggaaatagggagatgtccgactctttgtgaacccgtggactatacagtccatggaattctccaggccagaatactgtagtgggtagctattcccttctccaggggatcttcccaacccagggactgaacccaggtctcccacactgcaggcggattctttaccagctgagggaagcccaggatctagaaactagctctaatagagaagagaggcaaaagaaattcccaggttagacctgaagttcagtgcagattaaagcaggggcacacgatttctagtgggcataaccacaggaaaaaacaaattgttttataggtttgactttaagaaaaattatatttataatgtttttagagttcttggagtatgggggggaagatttacccaaagattgaaaaagaacaataaagtgcatgcaaatcaattaaaaaaaagaaaagctattacagcagggaaatataatttgtagtatagggctttaatcagtaagcaatatttacttagtcattataaaaacaattatggtaatagccgcaaattatgtttcaagcatatggggtggaggagatgaagtggatataaagtgaaaattctcataccatgtaggataccaaaatataagtatacacacatgatttagaaagcatggagctaatgccagaagcataagctgaatgagcgtaatgtgatcacatctgggaatgagagagccttgatggtggggtgaccatgagagagtttgctaaaggacagctgtgtttttaagtctttttgtactacttgactgtatgtatgtattactttgacaaaagtaataagaaaaagaaagctcagaagtagaggaattctgaaactttctatatacttagacttttttgaacagtgttttttcacatttgcacttttactttactctttctgaaatgttgctcttctttttgtctttctggacaaatcttattccttccatatcatttggctaaagtgaagccatccattatcttcctaagcagagttagggtttcccttcttggtgccccagaattttgtgcaaacttcttttatatcatttatcttttggcagttatttgtttgcaagcttatctcccttctgtctgtcagcagtttgagagttgggaagtgatggctttaatttttgcctcctctgcagcacttagcatacagcctgatcatagctgatgctcagtgaaagttgaatgaagaatggatgtaggatacaatcaggaaacctgtgttcagatttggcttttgcctttgcccctttcctgatcaaagcatttaaaaaccggatgtgatgagcttcaagttctctatgaatttgaaaatatattattattttttttattaatggccctaaacttgcaattaaaaaagctatgtataataagagttcagttcagttcagttgctcagtcgtgtccgactctttgcgaccccatgaatcacagcacgccaggcctccctgtccatcaccaactcccacagttcactgagactcacgtccatcgagtcagtgatgccgtccagccatctcatcctctgtcatccccttctcctcctgcccccaatccctcccagcatcagagtcttttccaatgagacaactcttcgcatgaggtggcctaagtactggagtttcagctttagcatcattcgttccaaagaaatcccaggactgatctcctttagaatggactggttggatctccttggagtccaagggactctcaagagtcttctccaacaccacagttcaaaagcatcaattcttcggcgctcagctttcttcacagtccaactatcacatccctacatgaccacgggaaaaaccatagccttgactagacggacctttgttggcaaagtaatgtctctgcttttcaatagagtacttcttaactaatgggcagctgctatatataacacagggagcccagcctggtgctctgtgatgatctggaggggtgggatgggagcagagagggaggtgtatatataataaacagggaaggaatgtatatatcattgtgattgatgcacagtgttatatggcaaaaaccaacattgtaaagcaattatcctctgattaaaaaaagactgcttcctacatctttagattgcagtttgtaattattttatattttcagttaaaaaatctattttctctatagacagtatgctttcagaagacatgtctgtcttgtccagaatatttcccagtattttatttaattgactaaatatactagttttaggtgtataatatcatgatttggtatttttatacattgcaaaatgaccaccatgataagtcttgttatcatctgtcaccatataaagttattttaatattatttactgtatttcctatgctgtacattatatctctgtgacttatttattttataactagaagtttgtacctcttaatctccttcactctgtttcactcatcttcccatctccctcctctctaggaaccaccagcttattctctgtatctttgagtctgtttctattttgttatgtttgtttgttttggtttttagtttccacatatagatgaaggcttcgtatttgaagacaaatatggtatttgtctttctctgtctgacttattttacttggcctaatagcctctaggtccatccacattgtcttaaatggcaagatttcattttttgtttaaatggctgagtaatagtccattgtatactatatatcatatttcttaatccatttacgtagttctggacaattaggttgcttccatatcttggctgttttaaataatgctgcagtgaatataggggtgcatgtatcttttcaaactagtgcctttgttttcagaaaaatacttacaagtgggattgataaatcatatgatagttctaattttttgaggaacctccatactcttttgcatagtggctacagcagtttacattcccaccaacagtgcaagagggttcccttgtttccacatccttgccagcaactgtcatttgttgtctttttgctaatagccattctgacaggtgtgaggtgatatctccttgtggtcccagcatttgatagagagacttgcatatagagacacacagtaagcttttgtttagtaaatacataatgacattaattatgagtgctctgaagatcctatttttctcacagacattttagaaaaatatctttaaatccaaaatctaataactgagatttgtccttgtcagctattatgtaataccacttctgtctgcatgcttggttttacattttctgtgtattcagtgctgtttcactcctttaattacttcttcaaaatttctttcatgagggctttctgagttaatcttttcttccaaggctcagcaacttagtgtttgagtgttgtgatttatgtaagattttttttttttttttttctgagttaaactaaacaatttggggcagtttttgtggcttgataaaacactatacattttaacgagtcaaaatctaaatgattcaaatctacaagctggctttccctttaatacatgcaagtaaaaagtcaaggacttgtcaaaatttattttagattttgccaaatctaacattttgaaatgcagcttaaatgtttaaccaaatgtttaaccaaataccaaacatcactgcatttattcctctcctgctgtaagttgccatttggcaagagacgaatgaaagtctttttctaacattcagatttctaaagaa

SEQ ID NO: 60548 - DNA, 975 bp, Bovine  19866881324242
tgagagtggaagcatatatagtccagataataaaaggagtccaggtccaagtccatctcacagttggcccaatgggtctacagacccaccatctggttatgtatctggcccttgaacacataattgagatggaaatatttagcagcagccaaaacccaaacattggttctttgacctgtgaaataagatccattatgatagaaagggacaaaggaagcccctgatattacttaccctttactctctttcaggtagtaaatcagaaggaacaatgtagccatgtaccaccaaaaaaaaaaaaaaaaattatgcaactctcaaagagtggctgctgcagaaaacatacagctcacagatggatccatttgatatgttggtacaagataaaaatacactattacactatagcccatgcacgaatgaactacttcagtgttacttaacatgtggtccacagatgaaagcaagctcacaaactgttttttatcattccacaacaagttatatatatgcaagtataaacagtgagagtacacagttgaaaacatttatatcaactttcagttcagttcagttcagttgctcagtcgtgtccgactcttcgtgaccccatgaatcgcagcacgccaggcctccctgtccatcactaactcccagagttcactcagactcatgtgcatcaagtcggtgatgccatccagccatctcatcctccgttgtccccttctcctcctgtccccaatccctcccagcatcagagtctttttcaatgagtcaactcttcagatgaggtggccaaagtactggagtttcagctttaacatcagtccttccaaagaaatcccagggctgatcttcagaatggactggttggatctccttgcagtccaagggactctcaagagtcttctccaacaccacagttcaaaagcatcaattcttcggcgctcacctttcttcacagtccaactccca

SEQ ID NO: 60549 - DNA, 1565 bp, Bovine  19866880902195
tctttcttacctttttcgtgattctgcagtggtaggaaatcaaagaaaactttcatgggggaaatgcttccagggaagcatttgtgaaaagggaagccactggtgaaataaagagtagagatctcaccagtgaaaggcaacatcagtagactggcagtagacagatgtctggggccagggttgttggtgttgggagggagcctcctgagaccaaacagaagttggcctcctttcccactgtcgtcaatgaaattcatttaccagacactatcggagaaggcgatggcacccactccagtactcttgcctggaaaatcccacggacggaggagcctggtaggctccagttcatggggtcgtgaagagtcggacacgactgagcgacttcattttcacttttcactttcatgcattggagaaggaaatggcaaaccactccaggttctcatctggagaattccagggatggggaagcctggtgggctgccgtctatggggtcacacagagtcggacacgactgaagtgacttagcaacagcagcaatcaggacataaagtgggcctgaagaacaaatggtttttggttgaaatccactgtctgtatggtggtggaactcctggcctttgcctatgaacagacttttaactactgaacagttcatagacccctagactccacagtgcttttagacttgacatagggcagaccacttgtgatatatgcaaacttgtcctcaactcattgttgctgctcagatataagctttgtagaaagatggaggaggacaaaatctgaaagtgcttcagaaggctctcttccctggtgctcaggaaaccagtattgatttctttttgccagtaagaagaaacagaactaagaggtggcaaaataaatccttttggaaagtctattttgaggacactttattctgtgggtgaattaagaacaagatttgtaattaagtgcctaatctaataaatacatagcaccatgaggtgtgtacagatgaaagaggagccagttaagctctgccctctaggagctttcacaaagaagcccatatttcatcactttctccctcttcagtttctctctgaggctgccactaagtgttggcaagttctctaatggaattagactatcgagaggcccttgcacgcagtctggcctcaaaaaaaaaaaaaaaggtgtttgtggtttaatatatgattgcagaatttgttatacacaggcaacccagataagtcttcagttatctttattagaatcattatttttggcaaaagtaatggctaataaaaagaagtttaaatcattgttgaatgtccagtcagttggaaaaggtggcttggtccagatgcagttctgtggctctgagttgttccacatgatgataaaattttatcatgtaacaacagcaaacattatgctatttaaaacaatttatgtaagatatttgaataaaagtaatttgaaacaattcatagtgatgctgttaaattttccctaagtcagtgctcctggaaactgtaaaggttaggaaactgcctttatgttcctagaa

SEQ ID NO: 60550 - DNA, 1856 bp, Bovine  19866880361472
ttctaagtcttttggaaaccggtattctgatttttatagaagccgtgtctcctagtgatttaaggcatgggctctgggtttgaatctccacccatcatctgctggttggatgagttggacaagtgacttaaaatccctgtgcttctgcctccccatctgtaaaatgaggttgggagcacccattgctggtgtcaacagaaaaaaaattgctcaacctgaaagttgagagctatgtatttttcctatttaaacaaaatcttgacgtttgtcttggagtatagccgattaacaacgttgttaacagcttcaggtgaacagcgaagggactgagtcacgcatgcgcatgtatccatttccctcaaaccctcctcccctcgaagctgctacataacattgagcagagtaccctgtgctatacagtaggtccttggtgattatccattttacatacagcagtgtgtatgtgtccattccaaactccctaactattcctcctcgcaggcaactgtaagttcattctcttaagtctgtgagtgagagctgtgttttagttggcggatattcttaggacttcaagccctggaggcagcatctcaagtaatcctgagaaaattgctccgaggagacaaggagggagctagaatacatagttttccaacaaagggcaagtagtctgaatgtcaaaagattattgtgaattaaaggaaaaccagatatctccagttaaggaatttagagtttttctaggtatgggaagatgcaagtgtctgggctcactgaagtcgttctttggatatgcacctcagctattgggccagtgttcagtcttttcccatcctaagtttcctctggggtcacgtgtggagtcgctatagtccaatggctgctagttggcaagtactttttgatcccttcctgagtccttgtcaggactcactggctcaccattggaggtgcctgcaatcgctgatgactgtaacatcttttgtttactgatatgccaggcagtattttacttctcactggattttcatgagtattagatgaattaaaacatgtagagtttgctagaactgtgtctagcatggtgcaataaatattagctcttattacctattattattaataaacttacttacctgccccatatcctcatcacttttaatactgtagataaacagtcctcccctcaaaagagcctattatttatttagctttgcagcgttcaagaagaagaaatggccacagtttagatgtgtaaatatatgcttttagtgagtatcttttgctccttcccgattcagattgagaactcggcagaggagtttgcactgtatgtggtccataccagcggtggtaagtataaagaatacaaagcgcttaaaacttttaattaactcaaaatagcaagttaaaaacagaatctctccctcatttgcttagttcttggttttggaaacctccaaatgttgtttgtcttcaaggcgggtgggctccctgggtaagttcactggggaatgccatatatggtcagtaaacaaaccctaaaacctaactgcctataaaaaaaagaactggattttctcaaagcacagagaaaactattttctccaatgcagcatcttccaaaaggcttgaggcatggaaatattgctgaggggtaggagagcggcagcagttgctttgaacaatacctgttgaatctctcatttacaaatcagtttcctgacttgtatggccgcatctcctaaggtgtcgggtccatttgaacccctgagttgacagctacttatagtaagaaagacctcaggcaactcagagctgctctggctgtgtgggttccagagaaacagaag

SEQ ID NO: 60551 - DNA, 1166 bp, Bovine  19866880363922
caaacatttactttgttgatcaggattctgcaggctggtagcagtcattctgctctagatgtgggttgacttcagggggctcaatggtaaagaagttgcctgcaatgcaggagacccaggctcaatacctgggttggggaaatcccctggagaaggacatggcaacccattccagtactcttgcctggagaattccatggacagaagagcctggtaggctatagttcacagggtcacaaagaataggacatgactgagtgactttcactttcactacattgtatgtcttattcagaggccaagggttcagaggcagtggctacttaggtatgcttcctatggcagatggctggagtgcaaaaaaccatgtaagctcatttaaagcccccacttggatttgacatatgtcacatccacatacatgttccattggccaaagcaagttgcatagctgagcccaacattaacagggtgaagacatatacttcttgcatagagaagagctgatagagcagggtaaggactcgggtgaggaccgaagagtggctggtgggggccactctctcacttacagcttctcaggaggaagttcacatttggatacctgtttgagacttgaggcacaaatcatcattctgaacatggttccttaaattcttttaggggagatcagaggggtttattgaatattatgagttccagtcttctctgcatgactgagtcaagagaaagtgcttttctgtgtttgacattacctctcgtggtattgaatacatgagataaaaatgagaagtcatgagataatgtattaaatatcatgtagataaagcgatctttatcatggactctgcccaccttgagaagaataacacttggttcctgtctttgaggaaatcctgaattagcacagaaacagatttcccaagcctttgtgccatgagagagatgccccaaaaagttggaatagtgctgataggggtcttacaccccagacttactttttcctcctcaggtggctcagtatataaagttcgagatgcctgtccttaaaagcttcattcagaagctccaagaggaagaagatagggaagtcaagaagctgatgcgcaagtaagcatggcccctggggtggctggttggattctcctgaggcctcaatgagagaa

SEQ ID NO: 60552 - DNA, 1142 bp, Bovine  19866880566837
tgagaagccacataaacccaaaggatcctaagaaaactaaaactaccctacattctaaaataccctcaaagatcctaaacaaaactaaaccctaaatcctaaacaacacaaaacatcctcaagtttcttaaatgatgcttaaaatcttaagccccaaattacctaaactaactcaaacaactctacatgacctaaggatcataatagactctaaaaaatcttaagcttcatacctccctaaagctccttaaaaaattcacatttgctttaaatctattttaatgaatttaaatctattttaatagatccaaaccctttcagtccaaaaggccattaaaaaaaccccaagaaatcctaaatatgcttatattctagattccctaaacaattctaattgatccaaaattatcctgtgcttgctaagtcacttcagtcatgtctgactcttagtgagtccatagtactatagcctggcaggctcctctgtccatgggattttccaggtaataccgaggtgggttgccatgccctcctccagggtatcttcccgacccagggatcaaacccgtgtctcctgtgtctcctgcattgcaggtggattctttaccactgagctaccagggaagcccctttgtaagtgcttgctgataggatacaacccatcctcctcatctaggaacctggatgccccagggccctaaaaggtggggaggctgcagaacatccctctctcctgagcaggggagtgcctcttctctacaaggaaagtcttgtaggcgtctggttgcatggccgaccaaaggcccaagtggtccttttcacatcagtgactccatactggctacacattctggcatcttcaaaccaatgacttggtcagctttgacaggtcctgtcaagagctaatgctctatctcttgcccatttggagcttctgttaggaccagcaaggtcattttgctcaggttcaaattaatgaagtgccttaaatgtctgcttttgacattatcactagatgacacacaattgtgttttagtttggattcaaacttagtttgggagttgattccgcagacgaggtggaataggaaagtgtgataggaaagggaaggaaaggaaggaagccaatatacggtttgtta

SEQ ID NO: 60553 - DNA, 1636 bp, Bovine  19866880608732
acatcctggaatgtgaagtcagtgggccttaggaagaagcatcactacaaacaaagctagtggcagtgatggaattccagttgagctatttcaaatcctcaaagatgatgctgtgaaagggctgcactcaatatgccagcaaatttggaaaacacagcagtggccacaggactggaaaaggtcagttttccaatcccaaagaaaggcaatgccaaagaatgctcaaactaccacacaattgcattcatctctgctgctgctgctaagtcgcttcagtcgtgtctgactctgtgcaaccccatagacggcaacccaccaggctcccctgtccctgggattctccaggcaagaacactggaatgggttgccatttccttctccaatgcatgaaagtgaaaggtgaaagtgaagtcgctcggtcgtgcccaactcttagcgaccccatggactgcagcctaccaggctcctccatccatgggattttccaagcaagagtactagagtggggtgccattgccttctcccatactactacatacttaaataataagtaaaaaattttactttgtttggttgccttttttcccgctgcattccctccacctcctattttgtttggttttaaaacaaaaagagcactgccagtttttacccatgttcaattttcagtagggttgcttgcatctaagtgttccaggaaaacctacttaaatttattcagaactttacagtaaagtcttgctctcatagcaaactccagttagtaatagcttcattacataaaatagataccaacaaattatttcataaaatctgttttcataaagcaagacagaaactaccaactcctttggcagcagctattagtatttgttgggtgacttcgggcactctaacttctataaattttactgcctgacttgaggtcttagtaggacccccaaaaagaccatttatcttttgtttatgttgcctacatccaacatactgtacagtacaaaaaccctcactgctttatatgtgttagctgtctgctcatctatttcactcagtttaattaattcagcacctaaaaagctgctgcttggagtgaaaactaaatatacaagcattgatcggtggcactgataaaaatatagtcttggttgttatctttttctagaggccaaattatgctgttcattctttatgctccatgaccagatattctaggacaactgtcagtcttatatttaaatgttgtaaaccaactacacaacctctctctgtgttagagttctgcagagaaacagaaccagcaggatgaagatatatatatagatagatacatatatagatatatgcatatacatatatatatagagagagagagagagagtgttactttaaagaattgactcatgcaattgtgggagacgaggaatccaaaatctcaagggtaggctggcagtctggaggtcagggaagagccagtgtcgcagctgtagtccaaaggcagactggaggcagaattccctctccctctccctcagtgtttttctgttaaggccttcagttgattggatgaggcctactcacattatagacagtgatctgctttactcaaagtctatgatttcaatgttgtgtgcatgcc

SEQ ID NO: 60554 - DNA, 831 bp, Bovine  19866880696332
tgaggctctcaagccctgaacccagtgtttatgaaacttacctatcaaccaactacacaaaataccccaggggaaatatgtttgatacaataagtcagattcttggggtcctactgaatgggaatcccctggctagagcctaagcatctgcattttacccagttccctgagtgactctgttgtctactcaagtgagagttaccactgtcctcatcccctttgttccactgaaatctttgtctttataatgtagttgtggggcttttctttcttttttttttttaatattggcgattctcaggaagtaaacatcctgttacaatacaggagtggttccttttccaccccaaactagctctgcctcagtcagcttccagctctgtcagcagttccaccatgtcccagtcacacaagcaggtaatactgccatcatcctttgcttttctccctgttctacccccacccacacaccccctttgccagatgcagccctacaccaggtcctggcaatagtccctccagcctcatctcttggcaagtcatggctggaccatcactatgctcctctaacttgtctcttcacccctataggagatcctgactgccccctgaaatccatactcatccataataagcatcagaatatcaccattgaagagactttctaatatgtttcattccttacaaaacctccaaaagtttcaatgcctgtagaacacatgccaaatcctgagtctggcacctcgtagtctttgtagtctgatgccaatctgtctttcagtctcatgtatggggacacagatagtcttttccaaaggacactgtatttta

SEQ ID NO: 60555 - DNA, 2690 bp, Bovine  19866880742015
ttggcttgttcatcattgcattctcaactctggtgtagcatctggcccaccatattatgcaataaatgtttggtaagcagataaaagaatgtgccagggaccataccaagcacttcataatgcttcctgacaactctctaaggtaggtgtaataggtgttattctcttggtatagatgagaaaattgaggctccaagaagtaaaacagaaagtatcagccataattcaaccctggcttatctaacccagatttcctgctctgtacggttatacttttggaaatacgaaattactgatgctgatggccatgtttttgataatttattacatggaagttaattaattagtttaattaaagtaaggtataataaaggaaattaagctaaaatataaataaaatctagacaaatgtccatattgcctagtaaggaagtattaccatcttgattcctggagtagtctagatctatggcacaaagatgttttttcacaagaagtataagtatttgctacttgcatctctgaagcagttaatgtatttaagaaactatttctaaatgatgaatttcctttctaatgttcctccaaccctgtgtgcatgtttttaggtatacatgcatctttaaatatatcccctttatacaggtgctccatacaatctccggtcattctcttactgccactttggtgaggggccatcatttccacgaaccacttacagcttcaaaaacacaattcctcagtagaaaggttaaaaatgaagtatatctttaagaagatcaagtaatgaattcatacatgccataattaggaattatcattagttaaactacatttatattacaaaatatcaatacagtttaaataaaaataatgaatctaatactctaaaagatgcccccagaggctctctgaggatatgctcagagtacccagcccccaccctcaggagttgttgaaacatatttggtgataaaagttgctgaatattatcaattggtgaaaaaatgtgcattgtcaggcaattttatccaaagtattctaaaatgtgactgttgataatggtaccttttgttctgatctccactgctaatcagtgttcttctcaaggatacagttggaaggtttttacatagaaagtcagtggaggacttggaggccagacagtccagcaccttcccctgggtgtgagggatacctgcctccctgccctgacagctcagggagctcctatgcaggagttcctgaggaactcccacctctgtggctttcacgctgatggcactatgctcatcttccacagtcctggtgagttctagatcagaaactaagactaaagtccagaacacatacaggttatttcctacatgtcactattttaataataacaatagcaataacaacaaagtacctataggctgatgttaaaatttcaagtcccggctctcctgagtttaattataagggcacacacagcctcgtaagtaaaatgacttcacttcttatgtgaaaacactcagccgtgatgtagtacgttttctataattcctgtctttcttcatttcattaatagttccagaaaccagatttaagtgggtgtgtagtagattggtatatagtgatttaaatgtcaaatttattattggaactttaaattgattccatatgtatttgaacatccttgctcatgtttatgaattatgagataaagtcaaggctttgtgagtctagtttttcactttagcaaaggtcggtcaagtgcctactatgtataagacattgtgaaggatttctgaattattcttgatggagtcattttaaaagtgaataatttcaccaaccattgatttcttgtcccttctaagcattcattttaaaaatatatttattgtaaaaatgacactaaaattacaacagaaatccaaaaccaaacattgcccacagttccaggatctgattgtcagtgttctcattttgccctataacctcctagtccttaccatttgcatatacaaatgtacatatttgcaatgataatttaagtgatcatttatattctaaatttttgctcaactttgttctatgcttttttcatttttctatgatttaggggtttttgcctcctgctgccttccccaacccactctccttcctgcctgagatgtagcctccatgctttcattgtactcatatagagagttatttgtttgatcactttttaaaaatactgtaatcatagaactcgcatttattcttctgcaatttgtctcactgtgttatcaccttcaccctagtgcaacagccacctagttagttaacttgtcctttaggatgtggcatgatattctataccatggaccagaccctgattgatttaatcgtttccttgttgatggaccttcattcggttttttgccactgcaaacaataaacatcaatgtacagacaactttgcaatctgttacttttatttctgtggagtagatttatacatgcaacatttccagaacaaagctacggtataatttaagtttttctagacatgactagattatgttcctaaatagctggagcaattctcatgctaccccctgcagtatactgtgctaactttaaaagtctctatgtgatttaagttacagcacctgccttttctccaaatggtgcttgagcatcttttctactttgcg

SEQ ID NO: 60556 - DNA, 4731 bp, Bovine  19866880899705
tgttaagaaaaaaaaaagagagatatactaaatgactgctcaccacttctagtaataaatggtgaatcaaagatttacctttagtgaagattatctcatcaatttaagacagcagttataagttcatatttaattaaaatcagtaagtcacatgtctgcggaatctgagatagtgtgtcaagactaatgagtgaacttgtgaatattttgaattatcactgggcttactatgaattcagtataatttccagtgtctggaatagctacataaggttctaatttagagctagtgaatttccaagtggaaatttattattaataaacctttaccctacaaactataaatttcctaaaatggcagtagtataattttaatggaaagaacgtttgttccagacttgccactaaattaccttgtagtgagtccctcagaccattgaggcctgcagtttcctcatctgtacagatagttgaacttaacacctgatcccactcagctctaaaaggttcaccacctctgttgctaatagtgtggtctgatagttattgtactgtcttctggcatttgtctaccagttttgtccttacggtagtttgggtttctcccactgcatttcctacttgactggttgtattttaaacttggcatagtcagcattttgctagaaagccttctcagggaaatggcagcgagatgcaggaagagagagggcacagtgctccggccacatgccctcccctcttcgtgtccaggaagtcctgcaggcagtggttcccctcaactaacaggatactgtactaaatttattctgaaatgtctgtgatttgatacttaagattaatcatactgatacttttctatttcattttctgtgttgtccttttctaaccctggtagccttcaaactttctgactggcctgctttccccttctcctctctgtagtgttgtctcagcttggctctgccgagaacagacctgagcaaagccttcctcagcagagactccagctctcctctgcctttcaacagcagcagcaacagatccaagtaatccagcaacttcactctgcttacatttttaaagacactttgctccaaaagtacttcaaaataccttacttcagttttatgttactgtcttttgagactatacagtaattggtaaataatttagcaaatttatttaaaagtctgacaactttagcaagtcaacttggagcactgcatctattttgtacatttaagtcatactctctgcctaatttaaaatctttcttgaagtgctggtggcacattaacatacatttttagattcctttatattttgaaatagtcatttgtaagtgccaatggttaactccttaatactgtactgcagaaaaaggcaagtataccagtgttcctatttgtaaattgtcctacctgttttagaaaggtgttattccattcttaggaagtcagaatagtatacttgactatctttaatttgcagggtggttttatactgctataaactatcatacaacacaatggtaactgaagttgctgagttactgcaatatagactggccaggcaaagtaacagagcttcttctcaagtttaaaagccctgtctttaaagccctcagcaggcttctgtaccactggtgctgtttgactgtgcattgtctcgacgtggtatagtccctttttgttatcttggtgctctctccctttcagttttgttctcatcactctcaggaaaatcatctttccatacctacctacgtttaacctaactagatttttttccctctctttgcagcagttacgattcttgcagcatcaaatggctatggcagcagcagcagcacaaacagctcagctacatcgtcatcggcatacaggcagccagtcaaaaagtaaaatgaagagaggcacgtcaaccactccaaaattctgagtcttgaatagttttcctttttaaaaacataagagcattgaatcaaaaggattcggagtttctacttcatttttgttttttaaaatgtgtcagtattttacattgttagacatacaaactttatacagaaatttgatttttaaataaaaacaaatagtttttaaataaaaacagggaaatggtttaacaaaccattagggttggtttgcctaagtcattgtttcttaaaaatggtttcacggtacataatacagaagtgacctgagaaatactagaaacatctttcaaaagaatgtagtttggtatttatttagtataaaaggtttgtgcacagtgtaacaaatacagtttttataaatctgttttgaaaacgtggttgctcatttgggtttcatactcttaaatacttcatccatcagtttttttacttctttgtgtcttgtaactgctcggctcatacagtcttgaagtttagctccagtcagtccacttccacctgaaaaattgtgccaacacttaattcttacatgacctatatcatgtcaagttagaaaacaaaatttgaataatataaaccagtgatatggtctcaagatttgtaggtatgtattaacaagacctcctaaagtttaagaaccactaacatataagatgcaaggcatcttgagtaaataaaacatcccacattccatttggccctccctaatgtaaggaagctcactctgggttttcatctacatgtttagtactgagatggaagaaaagtgcgtgcctggtttgtgaagacaacagagcctgccttcctcgtccattacaactgttagggttccagttgccagatgttcctcctcttcagtaggatcaactataagcagagtgctattttaaaaataaaaaggtatacattatcaacccattagacacattttatgttagaaaagtaagttaaacttactacctgcattttagcttagatgggagctagacagaaccggtagaaaccagaaaagctagtagcaagctgaaaattgtacttgtaagaatctttgcccttcagttaaatacacaaccttttgattaacttactcatcaaacacagcaaaggaagttgcaactggatgagttctaatattcaaacaacttttcttctttaaattaacttctgctaaagcagtttcttcatttatagtaacttcaggcaactgtactacaaaaaggcaaatatgttaagtcagtttctcactccagttaaacagggcattctatgcttgattaattcacttttccctctgtttaaacttgtccagaagtattttttgttttaaactttattttgtattgaggtataggagggcacggcaaccctctccagtagtcttgcctggagaatcccagaggagcctggtgggctgcagtccgaagggctgcacagagttggacacgactgaagagacttagcactcacactcacacaaccaattaacaaacaatgttggcacagtttcaggtgaacagggaagggactcggccatacatatacatgtatccattctcccccaaatcccctcccagccaggcttccacattaatactgagcagagttccatatgctatacagtagcagaagtattacttaacaaaacaaagcaaatatggtggatacaaatactgtttttctttaatttagaaacatgtggatagataagtcctcacaaaaacctttagaaaattttaccaaaacagaacactggcgtttaagtaggaatattcccttttattaaagttgcttaccattttttaaagctgctaacaaagcaaaggtacaagcatccaaaatgtttccatcatggttgaggcaaatgagatcacagtacaaaacccaagcaagctaaaacggagttgacaaagaaattaaagctttctgataggtataatgtggtatttgtttctactcacaaaccacatccttggttaaacaatcaacttttgaagcaaaaacttaaattaacctttataaagtaaaaaagtgagcaagtttggtaaaagctggcttctaactaccaaaagctgaacaagtgaacatctccatttcccctcaagggagctacagatgtaggaggaatttccattcttactgctaaattagcagatgagggaattgcttctgaaaagcccaaatgagactcaaaatgtgttctaccacagaaaccttaatacatgaaatttttaggtctcacactgcttaataaatcaatataatcaaacatgaagagcctctaggtacttgtcaatgtagttcaaagttttcagacagacttgaaatttataatgtggattcaccttaaacatgttagctgatcagatattaaccatctgctggaaaaaaattttaaatgactgcattattagttgaaaaaagattacatcagcttaaaagatagtttctagccaggcaatgaagtaaacaaaatttactgggttttttggtgaactatatctagacagttacagagtaggagtgattttttttttctttaattccatctagaaacaagatatctgtatttaaggcttctgtgttttttatattttccccaccccaaaaaacacttcagaattaataaaagctcacagcttctttactccctcttacctttcctgaagagatgcataagtcttctttctgaattatctgtgaacttgatttaaagacagcacagtaaacaaaagttcagaaactctaaagtgaatgacagtcaaactttatcacgataatcttacttttca

SEQ ID NO: 60557 - DNA, 2559 bp, Bovine  19866880940330
cttatggcttcttccttccaggtatcttccttctgctattcctctgtcttccacctgtccctctcttttcatcctttactcaaaatctcttcctttcatcatgaaaaaccatcagttgtccaataccttgactgtcaaggattgaccgtgggaaccctgactggagctgtcctcagtagtggtgctgaaagcataaatttgaccatctgctagccagaaattctgggaaaaatggagaccccaaacaatgaattagaacagcttttgtgaaggtcttttttggtatgtccttcaggtccctcaagctttacagtccaaaacaaaattcattttattccagactctctgttctccctcttacattccttaagtccagccatccctcttagtttttaaaaccatcttctctccattcccacggccactgaaataatttcctatcttgtttctctcaaatatcttgatactcaatgacttccattaattctcatcccaagttcatatagaattcaattcaagtttgttaaagtaggagtaggtacagcaaagcactccagaaatgctggcaattaaattgtaaatatcaacccattgtagatgagaataatacatacaaacattgccttagggacaaagtagctccaggtctagaaacagaaagaataaacaaagcttgcttgagtgagccagatcaatcctaggcagagtgaaggccgtgtccatactcaaagatgttcaataaagaaaatatgttgttcacaaggggtgagggtaccatcttcaaatgataggagggtgagtttgcaacaaggaagaactgcaactctttgtactagcactgcttaggtggccggtctgccccttgtcacagaagcatctctgttggattaaacaggatgtgccggttattctcagttggcccctctaccctgctctggctttgggaggctagccagaatggactgcatccatgtatttccttgtcctctggctttgcattaaaattagttaatatagaatgtagttaggagataagagggagagaagagagtgaggttgaattattgcttccttcaggtccatcccatgacggctgtcctgacttatggtcacagcatctgtactgtagctgcttctacagcagctctctccctctgacttgcagtaggcactcccttctctcatccctgctggcctgccagtagtgatgtggtactgcactgcccaccagttacctgcttcaagtgtgccattttctgcaggatctctgattagggcctgatatcataagcattcaaatctcaacttctttgccccaatctcatcctcaccaagcattattctgtttataaattggcttcacatgtaaatccatgtacacaaagacagtgtactggtcatgttgaaacaagcattctgttctgcttggcatttatttatttacttatttatctttgtttattagtatatatcctttatttctaaatttttattggggtacagttgatttacctagaggaggggcatggcaacccactctattgttcttgcctggagaaaccccatagacagaagagtctgtcgggctacagtccaccaggtcacaaagagttgaaccccactgagcgactaagcacacatagttgatttgcaaagttgtgctagtttcttctatcagcaaagtgaatcagttatattttacatatataactgtatatgctatatatacatatagcatatatacataaaatacatattatgttttacattctgcctttttttttttttttacattctgcttctgtataggtcattacagagtactgagtggagtttcttatgctatacagtaggtgcttattagttacctattttatatatagtaatgtgtatatgtctgctactgccactaagtcgattcagttgtgtccaactctgtgcgaccccatagacagaagtccaccaggttaccccgtgcctgggattctccaggcaagagcactggagtgggttgccatttccttctccaatgcatgaaaatgaaaagtgaaagggaagtcgctcagtcatgtccgactcttagtgaccccatggattgcagcctgccaggctcctctgtccttgggattttccagggaagagtactggagtggagtgtcattgccttctccagtgtatatgtctatatatacatatatagacaatttatcccttctcccttttcccctctggtaaccataagtttttttttttttttacctgtgactctatttctttttttgtaaataggatcatttggaccatttttttagattccacatattgcttggcatttatacttctcattgctaaataagaaatggcattctgattttatatcttcatattaaactagctttgttagtgccacttagcctgcctgggattaatgaatctgatgtactgccaaaactgaaggtccagacagtctctgctggtttggggctggggagtgggttgggattgtctacaggataaagctgctctcctttgtaattatttttgagggtgggggggaag

SEQ ID NO: 60558 - DNA, 1030 bp, Bovine  19866881018976
tacatgatgtgagtatgtagatgtaataatttttgattaagccttacaccacgattatcaaatgttttttatactcttcataggctcctgcatgtgtgctttgctctcttaaaacttgcagttcctatttttaaagtgcaatgacgtgtacaattttccttcagctccatgaaatttgcttaacggaaactcagcttgttttccataagtcctactggttacatgagcattgtttacctgaatttcaagtacatcacttgggagaaaataattcaacttttgtgattcttaattcaattattgttcagtttctgctgcatttacacagttggagcagcagcttggagtcatactattctttcttctgaaaatatactactgaaagaagtcagaacctgatctataagaaaaggaacatctttctttgggcagagtatggctaatacagcaaagagactccaaagcctgcaaacgtctattttggtaacagacactgggttaagtagtctgcaaacacttgaacagagccatgagatgcccaagtttaggaaccagcattgtcattgccctaggactgctctccagtgaggagtaataatgggttacagatgcaagtgcttggactgggacagggagacaggttcaagacactgttctcccctatacttgagtgactttgggaagatggcaggaagctttgctttcctcatctctaaaattctaattgggcttccctggtggtccagtggttaggaatttgacactggtttgtccctggtctgggaagatcccacatgctgtggagtaactaagtccctgtgccataactactgagcccatgtgctgcaactactgaaatctgtgtgcctagagcctgtgccctgcaacaagagaactaccacaatgagaagcctgcacaccacaccgctgagtagtccccactctctgcaagtagagaaagcccaagtgcagcaacaaagacccaccgcagtcaataaatgaacaaataaatctttaaaaaatttaaaaa

SEQ ID NO: 60559 - DNA, 1548 bp, Bovine  19866881092103
cacacatgacagcaatatgcaggccaagtttctttgtcctcctctcacctccccctcttagtcatccctgagcctccatggcctctcagtgtacagggatccctagagtaccccagatgaggggcgctttatctgttccctccttatcgcaattctcccccagccccacaaacatactatgggcttcctgcaatgcaggagacctgggttctatccctgggtcaagaagatcccctggagaagggaatggcaacccactccagtattcttgcctggagaattccatggacaaaggagcctgacgggctatagtccatggagtcgcagagtcagagacgattgagcgactaacatacatactccagccctgtaaagttgatctccaggccttttggtgtcagagactaagggttaaactatacctcagggtacagctgggtcagctcatccctcctggaagccagacacactttataaattcattgtttggtgcatgcaatgtgtttcccttagaaacaatgttataaatggtgatctgcttcccaggctggccacaaaagtcttttgaatccaaaatgcagctgaaggttagtggtgaaaactgtgtcagctaccccagaacaaggagaccactgatgaactttttctataggaaaaaactcttctggttccttcccagtgagctgtaaaacacaaaagctcaatcattaatcccccttcccccaccccccaaactttggagttaattctcagtaagcttctttgctttgcaagtaataggagcaccttcagggaaatgtattttgaggacatgaggatttccctccaacattaaggtcaaaattacaggcagagctccataagaagcaaatacagaacttgaagggcttccagtaacccagaaggtcttctctgagaagccaactcttctctttcatcatagactggccttccctgcaccccagacatatgccaaagagtggccatcacttccatcactggggcttaacgctcctgttgaagaaagcagccagataatttttcatgttttcttgcaaacttctacccccaggaggcacatgacctcaaagaagcagcagaaaagtatttctagagccatcctccagtagaaatacaacgcatgcccacagatgcaatttaaaaccttgtagtcacattaaaaatagtaaaaaacaaaaaaagtgagattaattttaataatatattttatataaaccaacataaccaaaatattactatttcaatgtgtagacaatataaagaaagttattcataaaatattttacattccatttttgtactaaggttgaaatcaggtatgtatttacacttcagttcagttcactcactcagtcgtatccaactctttgcgaccccatgaaccacagcatgccaggcctccctgtccatcaccaactcctggagtccacccaaacccatgtccattgagttggtgatgccatccaaccatctcatcctctgttgtccccttctcctcctaccctcaatctttccaggcatcagggt

SEQ ID NO: 60560 - DNA, 1164 bp, Bovine  19866881166611
cttgcccctcagagttctctgacccagacaggtaagtctcctccccatccccactgtctcttgagaattcctttcactcttctccttctggatgatggtccctgtgacataagcctctgaactatctcatgctctgaaggacttccctctcatggttctatgtccaagcaacacccaataaaacttcttgtgtgttactgctgtggtcatatctttttccttgattaattattggattcctcaaaccctctagaagcccacactgaattctgactggctcaacccatcagagcccttctttgggagagttttaatctgagagggagagataaccagcagttgacagtcagacccgtgtagcaagaccaaatgatatggtagcattctcccccaagaggtcaacctttctggccatgtagacatgagctccattcccaagttccattatctctaggacaatgagaggatcaaatttctgagcaggttgtctgagggccaacaccaaggaaatgccacctttgtggggaggtgtctgagaggccacagacatggtcattcttagcaactctgcaacgtaaagtgtagcagtggagccaaccaggcaggtaacaggaattatagggaattaacagcaaagaaaggtccagacaaagagagaagcagccaagaaatgacaatgggaattcacatggaccaggatgtccctgaggtggcagatgtcccagtggttgaggtcggcatggaaaccactgagtgtatcagtgtaagactgagatcaaaaacacgaagaaggttgaacttttaaaggggcaggagcaaattatttattttgaagggattaatcaaactcactctgtgatgtagggacagttggtaccagaaacacagatgtagctgagctaatttaagtcaaaggatgccattgttagagactgggcatctcacaaagctcagcagcaagcagacagtccacagggacagagagaagggatatgaaacacccccaaaatggaactagaggaggaaggaggctgggtaaacacacccaaaccatttctttataagtcccttggtgctttttgttaacacttgtgggagcagaatgaagctaaagcaggattaatttgctaatagtcaataactctttactaaaactgaatttta

SEQ ID NO: 60561 - DNA, 1065 bp, Bovine  19866881217293
attccaaaacattatataaaagtgtgcctgggcatgcctcccacacatttgtccttttgaaaggctgtattgtgcagtgattaagatcatgggttctggagccactttggctcccagaattcagttcccagcttaagcacttcacaggatatcatgtgtacatcccacttcctcatctgtaaaagctagtagtgttgagggttgaatcagttaatacacgtgaaaagtccttgtagaagtgccaggtgcatatgtgccaggtgtgatagctgttactaccactgtgtctgatattgttattaccatagtgatgcaggagcagagaaatgtaggattctgctgcaggaaaaatgttaatagttttttctcagaggcacccgtagaagccatctaaatacatacgtaagggaggtgggcagacattacatttcccttgggagttttgcctgattgcttcattaaaaaacaagttgagtgtatttttatgcaagccttgagcacttgctgagtttagtgtagatgaggtgatggctctgatgggtgaggtgacctgcttcttccggcatacagctactgcctctgttaaggtgaaagacatactcctggaaagcactaacctcagagccctcttatcccaaaagaaccatcccccctgagtttgtgcttcagttcctttgggctcctaacatgttttctccttcccttcctctctgtcttagatggaagaactggtgggtgagaggcatcctgactttggcgatgattgcatttttcttcattatcatttacttgggaccaatggttttaatgatgattgtaagtgccatttacttgctgttttagttttaccttcagttttccctgcatgtctagtcattttaagtgccaggtgttgggttggttctgggaatcacttgaggtcctggctgctcagaccacatccgccttagaataactatgatttctcaccctccaccagccacctggagggctattggcatgggccagttgtaggtgattaaagatcactttaaaattgattttagtacttcagctcttggtcaa

SEQ ID NO: 60562 - DNA, 1172 bp, Bovine  19866881255083
tattctctctgcatctcagttttgtccaataaaacaggactaccttataggactgttgggaaagaccactgaggtcatagtttatgaaagtgattttcagctatacaagtgatgagaatggataagtgacactgagcaatttgtttggaccccatccactgtggcttattatggagaaacactcccactttttcatcctattctatgaaccaacgagccctgaactctttgcagatatctgagctctacatcaggaggaaaaaaaataaaatccttgtcctggatcataatcaggaagattcgacctcagaatctcagtaacccccctcccctgactttcagtatccctgtgatcatagaagtattttgacaatcttccctgcactttgccaaacaacacaccccagagttgcctaattctgtttgtattatcacatatctgtggtaattgtgtatatttgtcctcatttcttctggattcattttgaagcagagactatacaaatgggaactgatttgggattgactcaaatgactcacatttggacaattcccacttttctgtatgtagttaaagtgttatttagttgcttatgtgtgtttaattaatcattggtgttttatccaacagtggtgtttcaaccaacattttcgtatgtcaccacccagcagactcactttcagcccaattattgtaccctcagaaaatgtaaactcacttgaacatcaggctagccaaactgtttataaattctgattttaaaaaactatatgatttattctaaagccaagcaagtaaatatttggggttatctgcattttcacaaatgtaataacttcatttttatttattactcctatcctgactcttctcctaataagatgattctttaagagtagactgttaccaattgtatctgtcaaaagaattcatcccctttttcctttttatattatactaacctctccaggagttggtgatggacagggaggcctgctgctgctgctaagtcgcttcagtcctgtctgactctgtgtgacgtgctgccattcatggggccacaaggagtcagacacgactgagcagctgaactgaactgaactgaacctctcttcatttaaatttaatggaaacaagttttgtaaatatctgtgtgatttgtaagtttcca

SEQ ID NO: 60563 - DNA, 1352 bp, Bovine  19866881275950
ctctgcccagtccctggagcctgcagactggatgctgattcacgtgcattttaggagtttatttgactaccacatatctgaagggtctcggataaatatactgaatgaaaaactgagcagggaagggaaatttctgttttattggaggctgatttctttttttttttttttggaggctgattctgagagacctcactgtgtccggtaattctggtgtttttggtttataaactcttcgtgctgttgacatcagagtcctattttctcatgactaaaaacgtcatatagaaatgctgtgttgtttacattaatagttcaatcagtggcaacaagggaattaaatatttatgagagaaattgcgtagtttcaaaaaactgtataaacactaatgatgattacagagcttgcataagaaagaggaagatggaagagttatgtaatggttatacgaaagagattccaagcatattagaacagctgtggtcttttcagttggatatattttaaaatcaacatgttagtgttgaattaagacatataaattgcttaatttgtttggtatagacagtaaatgtcccattccctctgatgggacaaattcccatcagattcccttttaaatacaagtattttgttttaggttagccatgtaaaacctgaacttacaattcagtaattataaagcccctttggggtctccttggtggctcagtgataaaaaaaatctgcctgcctgtgccagagacacgggttcgatcccagatcccacaagccaaggaacagctaagcccctgcaccacaactattgagcctatgctctagagcctgagaacaacaagtgctgagcccatgcaccacaactactaaagcctgtgcatcctggagccccttctctgcaacaggagaagccaccacaatgagaaactcgagcactgcaactagagagtagcccctgctcaccaccactagagaaaagcccagctcaagcagggaagacccagcatagctcctgcaaaaaaaaacacccctttaggtttgtagtagagtttacccttggatgggccctgtgtttttatttagatttattctggttctgagcttcttaagaagagctcctgactcctcttttggcctttcagcttgtgcttgttaccacatggatttcagctttggccttttcccttcctcctctcggtgctatgagtgagaaattaggtgaaggcatgtgttcccatctatcacagagccggctgcaaagtgattatgtaggacacgatataggattcgctttgatattggactaagatgcccgtgttgtgtacatgtgattatagaaagggtcagaatcgct

SEQ ID NO: 60564 - DNA, 659 bp, Bovine  19866881391687
ctttctttttaatgagacaactcgataacagaagacaagtattataatttttcacactgtatgaatttataaacttcaaggcatgaagagtaaaactggatgcctactcccatttaattaaacttgttcttcagatttacccatgcatgtttcctttcctgaaggaaagggcttcttgtgctccttaaaagcacgggttactctgatatgaggatctgatattcttcttgttacctacttagcagttttaaaatacatgaaatgaagaactctatgatgccttttagttccttgcatacttgcaataattgatcttacagtatttgttcttactgtttatttctatcggagagtttcagctttttccaaacccttgaagagttacttcagatgagatgcttcttccagtaatcacattgactgccgatatacggaacataatgtgtatttgctgttaatttaactcagaacagagtatcagttaacgattaaactgagtattgcaggcagattaaagaatgggtttagaacggttttagtgtgccagttcatctcatttttctttgtttacttcctcaccctcattttcttccagcgttcatcatgttttgtgacctggtacattccgatttggggaattataatatgatattaacaag

SEQ ID NO: 60565 - DNA, 1838 bp, Bovine  19866881730697
gtaagcacggtcctgcagcattcaacagaagtattttatgtatactttccattttggcaccagagtattaggagatgtatagtcaaggatcaagatttaataaagttaataattttcctatttcatcaaagacactgttaagataagctggataggtcttcttgtgagtgtgtggcataatgaatccgatgacagtccagtttggtgccactgcctccactcatacaaggtgtcagcaggcttacccaccactgcttttgcaccaccatggcaaatgatgacaaaatgaaaaagcaaatgatgtcattatgttatgaagaaaacaactgtgatctcacagataccctcaaggcatctcagggtgccccaggaaccaaaagcacactttcagaactctggtcttaataatttgaggtaggaggaaacatctcctcctgtccccaccctgaactgacttaagcaattctcttccatcctggggtttacagctttggggaggggagaagctaggttttttgagggaaggcaatggtggagagggggctctctctctgtagtcactaaccagccgaggatcattcgccccatgtgaatggtacatacccagccaatgattgattggatcaccccaggaatgttgtattcctgcagccgaaacaggcccgagggctcacagtccacagtgaagctgttggtatcattgttgtactccacagggcagacaaaacatctgtacccagacatcacataggacagctgaggatgagaacagacagacaaaggagacaagttccagccatcttgcctgggcagtagccacctgcttaggccatgctcctcacagtacctagcaccctaattgcaagctatgcactaactcagaggttcatgtttcaccgtatgtgttattttacctgaattctggaaaaaactgaaaaggagacttacgggctactgaggcctcacatgtacttgctcaaacaaccaggtcctgaataaatccaggaaagacctaaaggaatctgagcaataactataagaagttttgtcctatttggagaacctatggttcatttttctcaggatctcttcatttgaaattacaagtggtgaggggaacagtacagtgagagggcgacaaccaagaggaaagaagcagaagaccactaaataggcgagtgagtcctgaaggacagctagacaactctgaaaaggggagagactaacttgaaggtcagaagcagggaatggtgctctagaaaggggtggtaaatcactcacctccaggcaaggcacacacaggagaaaatctgggttagaatggcatgtcccacctcacctcttactctcagacaaagtaacaaaagcctgaccatgaacgccatctcctgagtgtcaccaggccttgtcagcatgagaggagtacaagttgtgcctggcctccgctcctctactgccaagaccctgcttgaagcctggcagacaaagggcagctgatgctgccctgccatgttcacgccctgctacagggcaaggctaccattcagcaggacagagtccttggccttgggagatgggctctgaaggtgggtgggaggcctctacccaaccctcacccagctgggagccactacctaccagaaggccaaagaccacagtagcaaagaagcccccaatgaagccttcccaggtcttcttcggggacagctgtggacagagagcaagttcttaacaaaatgcattttgataattctggctttgggaataatgattgtttaaagtctttctactatttaaaaaacctcattcaattaaccacttcactttctaaaataccc

SEQ ID NO: 60566 - DNA, 1669 bp, Bovine  19866881751547
atttgggactttttactcaactgagaagcagatgaaattctaaaatccaccaacttggttcggatggaaaggtactatacctgataaaactagcaatatacacgttgacaaaggtggccatcagatactggcagtcaaagcgatccatgatgcctccatggccaggaatggtattggcaaagtcctgttagaggaaggaaaggattggtaagcctggcttcatccaagtcaaagccttgtctatggtcacacctcagtgtccacctactatagctactgcatgctatagctgagggcaacagtaagtgaaaagtattgattcaggtgctgaagctatagtatacaatcttattaaattataaaatatctcttttgaagaaagattaacataaaagattatcataaaactgaaatccaaccacggaattttcttggaaacaatgtatcttcctttatcctacttaaattccatgcatgggtgaagagcacacgctaacagtcaaggttcacagcctggtattttgaagtgggtggtagttgatgaggtgagacaggaggaggaaggcagagatggtgaaaaggggcctggctgggagacaacgagaggaacaaaaagggttttcctactttgattttaaaggctcgtttgaatccactagcaaagaaccctccgaaggggccgatgagcgaggcaaaagtagagagggcaatgctgtgaatctggaaggggtacatccggactgttttctaaaaagaacaaatgaaatcagttcagatgcctgcaagcccaggcttattacttattactataaaaaaaaaaaaaaagacaaaaaaaccacctctttatgaaactatatctcccccctccccaaaattagaaaaaagactggtttaggagttctgtttctgctaaatctctaatacactgcttaacagaggacattaacatattatgcattcagtctacagcaatatgttttgtttgaagtatatgaagaaaatccagtcctacaaggatacatcattgaaaaaagggattattttagcactgtctttccagataattacagggattcttttctgatactacatcaaaacttgacaagtgataggtttctaaaagttggtgcaatgtggaattgaaattctatcaataagttttttgtactctcacattaaaatccattggtctgcattgcactttgaatagatcattttatccatgcatgattgtgtaacaccatgcactggccatttcaaaaacactggtttatgagttacataaacctgccatatgtagatacattttgccatacaatgtcaaaatgtcatatgttaaaatcaccacagattccatcagaaaagtcttttcagtattaagaagttatcaaacttacgtggcaggtatatactctccaaaattctaatttttacttgaaaaccaaattttatcattggtaacagttcctgtcagttgttttcttggaagtgacaaatctcacttaatttctttttcaagaaaaatgtctgccaaaaacctatatgaaaacctacagtttctcatttcttttcaattaaaatttatgtccccataaaaaagctgccagtactgctcagaattcaaacaggtgcacacaaactcttcctttgggtaagcacggtcctgcag

SEQ ID NO: 60567 - DNA, 1514 bp, Bovine  19866880354615
ctatgacagtacttactatagtggttaaagaaacagaaccccaatagaggtatgtgctagggcaaaatatcaggaaaaaaaactcaatttaaagttatcattctgtatatcaagtgcccattgactgaacataactgttttcaataattcacatttgatcaactcatcaactattgcaaaaagctaaataaaaagatttatagttgaacacagagttcctaaggctagtatcacatatcattccctgaaagagggagaatttgtcagcagagaacttaagagccaaattgagaactggattgaaaataccctttcctgctctgtgtataataagtaacacattgggtgtagtgacctaaagaatatttcatgttattcaattttcttttctgggcagactaccacacagcccaatgactttaaaaaccaaactccaaaattctacctgatagtcttaataagggcagttggagcacaaagatagaggaggtcatcttagccactgatgggaaaagatatcatcggttggccctttgccccagtgagacgataactaaagccaattatgaggcttaccaatcattactaggagattaaaataaataacttgtatgtacacggaaaggagagatagcaagtcaaaggacactggagtggggacaaaggaaagcctaaatgtgcagaacctataatatcccttcaaaaattcttgacttctacaacctcaaggtcaaattgaaaccagcaggaatagagttggaattctaaaacctctgaaaagaaagggctaatagtaaaagctgcagctgattttatgcaccaggaatgaaatgttataacatatctatcattcacatgtgggttcgtgtaatttatcttcaattagaattattatctattcagcagctgtagcccagaactgctgatacaccacagatgagaaaacatttgcgggtctctggactctggccttccttaagttaaatgatgatcacataaaatagatcactcgttctataaagcgatctgggcttatgtggacagtatactgcatcaccagcatctacatccacagcatcacttcatttcctttcacagactggagagggtctatagcaactcttcatcttaatcagttcttcgattcagtcccaaattcacgttaaaaacattatacaactttttaatccaggatttacctttgaaagaaatatttaaagaacccagacacttcaagtatctgaaccccagacataaaaaatttcaaagcaaccctttacgatagttgtaattaagtacttatctcaacagtggacttccaaagttggcaataaaatattctaacttaccagtgggagtggcagcaatctaagctcatgtttaacagtttacagtaccaaaccaatgaagaaaaacacaatccagaaagaaaagtggcattctctactgtagtgttttcaaaaatacattcaaagggacgtcagtaagtatttaattaaaaaaacaggttccat

SEQ ID NO: 60568 - DNA, 1588 bp, Bovine  19866880383872
tttgggggcatataattatctcagaccaagtcagaaagaaagcctaatcaaggtctatgggaaaagatctgtgaaggaggagaggaaacttgaaaatttttcaattgatgaaggcagtttaatataaaagggaaaaaattaccacaaaatgaagctaaagtaacaatagaaaaaaaagaaagaatgcaaaaggtttggaaaggataataataagtctagagaaagtctcaaaacaaaaacaaaaaacagaaaaaccatcaaaggtgaagtacaataaacgaggtttacattcgccccaggagatctggcaaaatcttctcccagtgagcatgtaatggggcagtagttcttatctttagtaggaatcacaaaaaaatgaagatttgttttgttttatagttttattctaattcttctcaaaagttggctttctctctaattgaaaacactgctttcaccctgtctgatatacatgatctaattagaaccttttcccccagtgcactgagttatataactactttcagtaaacttggaccttggaactagttctcaaaactaaaactccaacatttgtaacagttctttggtagtaacacagcctgtctaaacaaacaataactggttaatccacattaattgctggcatctgccttatcctggatctgccttcttctgcctcctcaccatttcaaactcttgcccacagtgaaaaaatggaaataagtttgagcaaactcgaggagatagcaaaggacacggaagcctggcacgctgcaatctatggggttgcaaaaagtcagatatgacctagtgactgaacaacaacaaaatgtggatgaaagttttctgaggaatgatgtgtttcacaattttaatgtctcagatgctgtacaaacgagacctgaagaaaaagttttaccctgactctgggaccatctgaatgatgacagtatcaagatggtttcaacaatgctgatagcaatgacctttattctacgtttgctgtgggtcagggacaaggctaagctttttaagatattatctcaagtgattcttaaaaccttatgagccagatatattgttactatgctcatttaacaagataagtttcagagagttagataaaatgtgtaggcctagttattaagtgccagaactaggattaaaacctagttccttttcaactccagagttcattctctttttcattcaattactcactcaatgtgtatagggcacctactatgtgccaaacattatactgtatgattattcactgtcaaaggcagcaggtgtacctggaagccagaaatggcttgctcagttaacatctctaggatatgtcagctatctctgcattgcaagtgtccatattacagtagaagcatccttcagataagcaacagaaaactggatgccctaaaaaggaaagtaaaccagctttgagaagaattatgatacagattttgcctaaagcagagctcaagaaatcaaggttaaaatgacttgtgctacacagttttggaaaggaatctgttaatgtggttcaacagccatgaaaatgtccattaaactgacaatgtaa

SEQ ID NO: 60569 - DNA, 1097 bp, Bovine  19866880403483
taaaatatcttaaagcacaatgtactgagtcctacagtatttcacatattaaggtcctaaatgctctcccattaatatcactacactttaaaaatatcatttaagagactgtaccactatttcctacactaatacttagctaagcagttttttacctgatatattaaaggtatttcaaaacctgcactatttttttcctacagttaaatctataactgacatttattataaaatactcctgtgaagggagaaatttataagcactccaaacaaatgtatatagaaagatcttacttaaaagaaatgaaatattattgattttctatgtcttttgtgctgtatttaacttaattttaaaagattcttcaccagagataagctgaactgtacacctgaatgctaatgtcagctacatttctagaataaaaatatagaactttacaccataactcaagatgttaatggaagagaagttgaattacattaagcattatctttcatatagccttttgcaaattgatttgcagttgtgaagcccaacatctagcttatctgttcccataatccaagatgtacataattcactaaattttaaagaaaagggtcttaggtaaccacgtctttcgaaataactatttcatgttacacgatgaaagagaacttcacatatgattacaatatgcctcataaggtgggtaataaatcaaaaaggaaacataacaagtagtctggtatttcaatgataataatgtgtaaggatggacagacaatggactggaggtacacatccactcacacagatgttctaagtgaagacacacatactaaacgtgggatgctgctatccatgacaatggccaggccacaggttcagacacactccatgccgcacaggctaaagctttcaaacttctctactgatgcttcatatccaggcctaaaatctgacactttcgttgggattcaactactctacctttagggctacaaagtttgtttgagttatatgtctaacgctctccaagtttcagcaaacaaattccagtcactgaagcagccattttgtcattccttttcgcagaattctctttcccaaa

SEQ ID NO: 60570 - DNA, 1378 bp, Bovine  19866880421043
cctagctcattatttgcttttgttaatcatattaacaactttcaaaaattagaaataaatgtttctatattttcttctgcatttttatggttttattttgtacaacaaaatctttgatctctttgggacttttcctggtatatagttttctgataagtgcactttaactaatattaattttgctcctcttttccagatttttttcttatacgatctttgtataaatggcatgccaatcccttttttaaaaaaattctgatcatttaatggattgaattttcccagactatccactgggaaggaccaggaaggggtcaggatagctcaaagcacaaaggtctctgctgccacaaagacaaactgcttcctgcaaaaatggctccacagtgtatttcacagcactaactccactgcttctctgaatatagctgcatctagaagagcttctgttcctaacatatcccagttccctcacaaggggttgcaaacaaagtctacggcttatgtgctttaggatgagctgcttgccttcaggaagcatattttgctggcactttctgagatgcaccaccactgaaccatctcactatgtcaagggcttcttttgtacttccttctatgcaactcttcacctcagatgtttggggcagtccttacaggtatttcagagtttgtggattatttctactttttattcttctgaaaatgtaaattgtgggagagatttgagataaagagagggatttttattggtcatcttacttttgtgaatttctaggaggaaaaagtagaagattctggcttacacagccaatgatcatagtggaagtcttccaaattagttttcctttcaaccattcaaagggccttttcttctttgcaacctcacaatctgggctggtgctataatgctaagacctaagatgtaagcaccttattttagacaaggagagaaaaggaggtagtgaaaacattttaggttccagctccaatgcctaagttcaaatccctcctcttccccttagtaactgtgtggatttgagcaagtcaatgcacctttcagtttccaatttttcatatgtgaaatgaggataaaaatgtccactttgtaccgttatgtatgtagtgaatcctctgatggatacaatacagtgatgattcaacagggactcagtggcatcagcataattggtagcttctgaggatgtgaccatctctaagtccttttgtaaagaaaagaaggtgaaggcagattgtaacaatagcagtactatgcattacaggtctattactcaccaggtactgggtgaactattttatacactttgccttgtcacaatagaattttagatcatctaaagccaaaatcaacaaaaga

SEQ ID NO: 60571 - DNA, 1681 bp, Bovine  19866880563843
acctgcatataggtttatgcattaggcataacataataaatagccttagaccatgaagagatctctagctgttggagttgctgattggaaaagtgggtttaaaatacttaatacatgcttgtcacatttattgttatataattttttttaagaagcttttctttatcttgatttgttttctttatgttccttttggatttgatagatgactcagaaagatatcacatttgttgctgaatttcttactgaacatttcaatgaggtaggaaattggcatttctatagtgctttttcaacaataattacaataaatctggacaatggtaagaagtaatcaaatttaatccagtttaagtgaccttatagcaattatgtatgctttttcaactactgaactaattaatggcagtacttatttattaaatgtaaagcatataaattgaactttgtttttgtgtcttaccatccacagaagaaaagagtaactgctactaacagctttcttaaaaaatagagtttttggttaaaatgtaagatgatttttttctttaattaaactttatttattctttctaggctccagatctttataatcgaaaaggaaaatactttaacgttgaaaaagttggtcaggtatgggctctggattgaatgtagttactaattttttaaaaattaattttaaaacattagcagtgttagtctttattatacaaaactttctgaaagtagcataatgccaaattatatagtagccctctccttttactaaaatcaccaaagaatagctttaaacttttggggggtcttcgaaccctttatattaaagttattgaaaactcccagagagcttttatgtgggttgtgtctatgaatagcatatattgttagatattaaaaattaaacagaaaaaagaattatttcttaattcacttaaaaagaacaaaccctcttttcattacatgttaaaatggaaaataactatttaacaaaacaaaattatgtgaagagtgacattgttttatatgtttgcaaatctccttgatgtatggcttaagagaaggaagctgcatttgttctgttgtgatatgttgtttgatcagaaagcctggttttacacaggtgtatagttggaaaggcagaaatattttaatagctttttagaaaattgtgaatattctttgatactacaccaaattctgacaaacagtagtatcttaggttagttctagtgtggaatctacattgcaacagtatactttccatattatgattcattaaaatttattcatctgcttttcactttggaaggatctttgttaccctgtgcttgattttgtaatatcatgtattgatctttgggaaaatactgattcactgaattacatagatcttctgtaggctgaaacctttcttcatacagtatccaaaagtcagattttgttaatatcattaccaatctcatcagacaatctttaactactatgaggctgtcaagcacatagtagcagatatgggttttccaaaattttaatttttgcttgaacatttaaattttatcactgacaacaaatactgtcagtcattttgcttaaagtgacaggatccctttctttagtttcaagaaaatatctgccccatacccaagaacaaataatcagagtttgcctgccagtcatt

SEQ ID NO: 60572 - DNA, 1395 bp, Bovine  19866880597890
atggaaataccagatcactttacctgtctcttgagaaatctctatgcaggtcaagaagcaaccgttagaaccggacatagaacaatgggctggttcaaaattgggaaagacgtatgtcaaggctgtatactgtcaccttggttatgtaacttatatgcagaatacatcatgtgaaatgccagactggatgaatcacaagctagaatcaagattgccaggagaaatatcaacaaccttagatatgcagttgataccactctataacggcagaaagcgaagaggaactaaagagccccttgctgaaggggagagtgaaaaagctggcttaaaactcagcattcaaaaaaagaagatccatgacatatagtcccatcacttcacagcaaatagatgggggggaaagtggaaacagtgacagattttattttcttggcctccaaaatcaccacaaacagtgactacatgaaattaaagatactttctccttggaagaaaagctatgacaaacctagacagtgttttaaaaggcagagacatcagtttgctgataaaggtacatataatcaaagctgtggtttttccagtagtcatgtatgtatgaaagttggaccataaaaaaggctgaatgccacagaactgactcttgaattgtggtgctggagaagactcttgagagtcccttggacagcaaggagatccagccagtcaatcctgaatattcattggaaggactgatgctgatgctgaagctgaagcttcagtactttggccaccagatgcaaagagctgtctcactggaaaagaccatgatgcagctgtctcactggaaaagaccatgatgctgggaaagattgagggcaggagaagaaaggggtgacagtggatgaaatggttggattgcatcactgacttgatggacatgagtttgagcaaagtccaggagataatgaaggacagtgaagcctggcatgccgcaatccatggagttgcaaagaatcagatgtgacttagcaagtgagcaacaagaaaaagaagatatgaagttaacatttgctaagatggatttctgtatgctccaattttagcatgaaagatgtgaaattctgtttggcaaactacatccaaataaagttatatcaaaaagctgaatttcttaagttcatttcgtgaactaattttattcagctcttgattacatttcctgtgtgtagaacatgtttcatacttggtaactggctctcatttaaagagaatgaatggccaaattaaatggatgtccttttgagcagttttcaagtgtatgcatttctgattggttttgtttgccttattcaatggagagaataattctttgtggccaatttcattttaagagggtaatgttgagtgcttttt

SEQ ID NO: 60573 - DNA, 3623 bp, Bovine  19866880608429
agttggtgatgccatccagccatctcatcctctgtcgtccccttctcctcctgcccccaatccctcccagcatcagactcttttccaatgagtcaactcttcgcatgaggtggccaaagtactggagtttcagctttagcatcagtccttaagatcagacctcaaaaaaaaaaaaaaaagagagagagagagaagggtaaagataggtttcaaacaatatgtaaaatactatctggggcacttacctggagatccagtagttaagactctgcctttccaatgcagatccctagttggggaacaaagatcctgcatgctgtgctacagcaaaaagaaagaaagaaaacaaaaaataagcaaaaatttttaaataaaatattattttgggaaaaatatatataagtaaacatatgcaataaaaattcaaaaagaatgtaaacaaagtaacactttatctttgaatagaaggattttaggtaatttttatcttattttgcttctgtgtagtcttacatgcttttttttatgatcagcctacatctcttgagcaattagtttgttctagttttttcttcttaagagtaatttttagaatgattagaaagctgctttctaaagcattttgctggagggcccagaatttggaaatgtctctattcttttgttgctactactaaaaggagaaataaaaatcctagccaaatcctgacatttggccaatatagtttctttttttaattacattgtcagccgctgattaaaatgtaagcgcctgaaaacagaaaacatgtccttttttcctctttaatccatgtccctttgtgatgttcagtgactattcatggttctttgatttattcccgttacttctttggttttaggttggggtttttttttcctattttataccagaagcttattcatttggactcttttaaaatctagtttttgaaaaatgaaaatgaagacaagattgaaacttactttttttctttgaataaaattcaagattgttgactgaagtatccacataagcaaatgaggcaggaggggtatatttaacctacatgggaaaacacttctgaactctttacagcatcctttgtgcccagttaattaatggactgattataaatgattataactcattgagtcgatttggcagaattttctcctggcagcactgcatctcctattagtttgtgttacttgtcagtattgaaaatgacacatctaccttcctgacaaatggcacagatattcactaactcagaacctgtttagtaacctgagtgggtcttcatattctaatttttcagattttactgcgttatggaactgagcagatccctctttaaaataaaactgtgcttttgaaaatggaaaagttttccttcttgaaaaaatacagctgtagcatccagggtatatagggaagtgttcattacactcatggaattaaaaaataaggtaaactgggacttccttggtggtccagtggttaagattacaatcttccaatgcaggaggctctggtctgtggtccaggcactaagctccctggttgaggaactaaaatctcgcatcccacatcatattcccaacccagggatgaaacccacgtctcttgagtctcctgcattggcaggtggattttttaccactagtgccacgagggaagcccagaaaccttttattctggttcctattgctatgaaaccagtcctcccatacttagtgtcttaaagcaacaacaatcactgttacctctccagactggggaggctgggccgggtgaggtggttcttgggtctgtgttggctgcagtggtggccaggcctgcaatcagcctcctttcttcagtattggcagctgatgtgactgtcagctgggatctgtcctggaggaaacagtaacacctctcacttctcagaagctggcctgggaagctgcatcaatcatcacattccctccgttactcaagaggagaaagaacagacagcccctccaatcagaaggatagtccgcctcacatttggaaggcatgggatgggccagcttgggaattaccatctgctgcaccttctcaggacagaccaagggtccaccgtcgcgtccctaccctcctggtcactggctctgactacaggtggaagcaccagctgggaattgatcgtgttaaagaataactaattgcataacttccacagtgttttttttctaccaaagcacaaattctaaatctatattgtgccatggatcccttcggcaatggggtgaaatctttggattcctcagggtaatgtttccaaagtgcataaaatgaaaacataggatgtcaaaggaaatcagttatatggaaacacagttaccaaaatagttaaataacaatttagtaatagccaccagcaggtctagtactgtagtgtcaaaattctggtgaatcttaatgatattttgagatatctgtaacaattacatacgtgtgatatggaaatatctatgagttctgttaatgacactttcacaagttctgctgaaacttttgtgattggttacctacattcataattaaaggaaatgctaaatctgcattaaaggctagtgacaataaggatatgatcttctttctcatccagctttgccagtccctgactctgccctgctgaaaagccacaggagagaggctacagcagggcaagaggaagagctatgagtagagacttggctcagggtgggcagagggtgagaaagccggggctgaactgctcagggagagaaaggaacaggaatttgggtagagaagaaaaagtttctggaaggacagaaagcgagagaggatgctcaaaggcagaggcctgaggaaaaaattcccctggtgaggaaattttctctggctaggatgaccaaggacatgtttgcccttccccaccccacaaattggaactccctcccctggatagcagtgatgcaaaatggaattccatgctggagtgattgcatctgaggatggagaaggctgtctggactaagccattttatatcagggacttgggcatcgggattctggcagtcacagaaagcaaatcccccagggatactgagggtcaactgtacttgatcttgcctgcccagccagccccagccaaagacatgaaatgacttactgtggccacattgagctacctcctttccctgccaggctaggctttcttccaacatgtccaagcaggttgttgccacgacatcttcctggaggtactggtccggtcccttctgcgtgggccgagggaactaattaactacactgctctccactctctccaattctcaatcaaatgagagagccaggaatgaggagatggatatcaaaacatctgctttgttgctactaaaatctggattgcagggtaggacttaaatgtgggattcctccttctgctgactctactcctgcacaccccattttaaagctgggtatgggcagggggagggtgagtctatagaacagatgtctggtgaaggatggctgcctggcattggtctagggcaggatggtgaagggtgaggagggcagagagagctgcaaacacacacgtgtgtgtgttagtcactcagctgtg

SEQ ID NO: 60574 - DNA, 627 bp, Bovine  19866880753269
tgggcaggcaggcaggagtgccgtgaagagctgcatgtcctgtgtgcaaagagggtggttacagggaggcttccagggctatcaggtgcaaaggtagaaaaggccatggactcagacttgccgtggccatggtgaggggcatgcctttggggaggataagaagtagggccagatcgcccttctgtctgggagattatgtctgcaattcctttctgcaaaaaggtgctgagcgtaggtgtgtcaattgggtaagtgtccctgtactgaagttgtgtcctgacatgcacgttggcaaggctgcccacttggcgaggcggcacagtccgtcctggctgctgacccatttcccagcgccaggtgacaaaaccccactgctcagactcatggctccagggataattggttctgatcaagcagttctgggaaatgatgccttcccctctcctgagcagatgaagaagtccaggaggcagcaggcatgcgacttcatgtgctgtgtctcctttctggctcgctgactttgacttccccagccgactccccaccatcccctggctgcactatctccagccagagaggacactgggcaacttcagacacaaaatcatgagcctggggtggggcaga

SEQ ID NO: 60575 - DNA, 1510 bp, Bovine  19866880764593
ctgtttgctctgtgagagcttggaaaacatatatttatgctgcatttgtgatatagagaatgttcaattgagactgaatttggcgttttgccttatgtttcaacttttcttttaaataacataaggaccttcattcatgcaaataatgctattgacgcatcagcatggtgcagcaaaagaacggggatatctgggcttcaaaacgagttgccgttctgctgcttcggtaatgaccttcctggatgtggcagattacattttccaaagatggcctcaaaaatctcacatcccctgtactcctttcaaggtgaccttgacactcttccacctaaaggaaaagttcacatcccttcctttagaatccaaatgggctgtgacttccttacaaccaatggaatgtgggagaagtgaccatagatgacttctgaggccgagtcataaaatgcaatgcagtttgctcatctgaacatttgtgcttggaaccaggctgctgagtaagaagttgactatcccaaggctgctgtactgtgaggaagctaagagtgtgcaacagacacaggtggcccctccagttacaagtcctcatctttgagttctcctggcccccatgccagacaagtgactgaagaagtctccagatggtccagctgccagtcatggagtcaatcccagccttcaagtattttcacctgagatgcactggacccaagctatccctgctacatcctttcggaattcctgactccaataattcactgctgtactattttggagaaggaaatggcaattccactccagtatccacttcccagggaagacagggaagaatacttatcttcccatggacagataagcctggtaggctacagtacataaggttgaaagagtcagacacgactgagcataatattttatgcccctaagtttggaggtaataggaataatattattggaatcagaaacagaaaatttgaaatctggaagtgggggctactgtaacaaaaaacccaaaccgcggcattagctttgggaccctgtggcaggtgtgtcccagaagcccttgagagggaggttagggacggttggaagggtctgaggacagtgctaatgaggacttaaaggaaaccaaggggcatttggaaaagactctgatgctgggagggactggggtcaggaggaaaaggggacaacagaggatgagatagctggatggcatcactgactcgatggatgtgcgtttgagtgaactccgggagatggtgatggacaggaaggcctggtgtgctacgattcatggggtcgccaagagtcggacacgactgagccactgaactgaactgaaggggcatgttatcagaaactgagggaaaagaaatccttgttatgtggtggaaatatttcagcaaaacatttccctgtgataaagtataaaagtagaaaatatatctagtaaatttatttctgggcagcacattgagggtgctgccgacttccagtgccaataaaaaaa

SEQ ID NO: 60576 - DNA, 1995 bp, Bovine  19866880853462
ctttcaactatatgcttcaaataataaaagatttattttacttgaaaacaaaaaaggcatactttacctaaatatttttgaggtattgctataactaaaaaaaacaaacagattagggtaaaaaactctcaatagaaatgcattttttaaaaacacatgagaaaattgtcaatattaaaagtaaaagaaagaaccctgtaaggttaattctaatgagttaaactgatacttacttttttggcaatgtaggaagtttaggtaagagaagatttgattcatcctcagaattataaaaggatgttagaacactacaaaggggaaaataagacaaaaataagtattataaaaacaaagattctacttctctttccattaaaaaatattaatttttaaaggcccaattttacatatgacacattaccaaataaaatagtgacttttacagtggtaaaactgtgtatggcatttaacaatcacacacaagaaatagaaaagttggaaattcttcatttatcttgaactttgtttctgaaagaaaaaaaatcagcctacccactttatgttaagaggaacataaacaattttctcagcatatgaaatgcatccatatgtattcagtatcagtaccagatatggactgagaatttatgattccttatctttcctctaaaaaccaacactgaacataggagtaccaagagtacttttaaagaacactgcagttattacatgatgtaatgatgggttctatgacttacacacatttggagacgtaacaatccagttggtgtatataagatgacaccaagtattttgaaacagttttatttatcctcccatttttttcaatcctacctccaaatacagacggaaatgaataaggtgaaaagtggtgtcctgaaagaccctggaatctccatataacatttctgaactcttaacagaaagtgtgttaggaatacacttagcaggtaactggactgggacagaaattacatggtatactctgttcctctataaattcacatgaccacttgcaacctttattatttgatgatggattgatccttgttttatctacagtgaattttaaaccccaggctagaccttattatctaatatttttacaagcccctcctgaggaaatttgtgaattaataatcaggatttacaaattcatttgatattaacttaaaacctaattagaacagaaaagctaacaagaagaaaatgatcttatttcctcaaaaaaaaaccaaaacaacttttcatggttcagtactcactaagcctactgaccctttaggctatctttactgcaaacgtggcagagtacttgatttcagactaaggcaaaactatttgcacaaaataaggaacctatagggaccacaaaaacaaaaagaactcattcagcatcaaaacaaaatgctcaattcagcacttttcatcgtcgaagaacatgtactcagacacagaaacacaaagttccaggatgaaatatatggtgaacagaaaaacagaaccttaattcgctaatcagcaatattaactaatattacttgaaactataagtcattgatataagcttttaaaaataaccaagaagaaaaatcttggccattcaggcattgctgctccaataataaaacagatttttttccagaagagaaagaaatctagcaaacattaaaaaaattcatcttgataagcttaagacaaaaggttaaaagcaaatacacatactcaatactcagatacacctaagtttccactttttcatttaaaaaatgaaaatttcatgaacatcctactgggaccactggggtttttctttatcactctacctgctctcaacagtcacttccatccaatgcatacaagaaactggggcctccacaggaaaagagtgcaagctttcaggtttttctacatcacacaacacaattttcttggtatcagcaagagcaaaggccaaaactaaaacaagaagaa

SEQ ID NO: 60577 - DNA, 2351 bp, Bovine  19866880853669
ttcaagatggaaagattaggaaaacatttaaggagcagttttcatttttatatctgctcagagaaagtcatttcttcccttcccgctttgtattctcccaactcaaacattgctgatctgtgatactctcgctttgaacttttcaaggtacctaagctggggacccaacaccctgaatctaactctgccagaaatgacgtgtttgccaagttctcagcatttataaaaaacaccaagaaggatgcaaacgagagagtccctcccatcttcctgttttctccatggacctccattctgcctctggtgtggcttcttatgagatgtggggaattctgcctcactgcacagtggggagggacctgtgtatagaaataaggaaaaagtacctcccactctgagcctgcacatgggtttcagggactgagtgcttttctagagattgtccagaaaaggacatttttaggagaaaatcatcaccaccagtgattcctctcccatggaattcagggtgaatgaaccttctgttggtgcttccttcattatgtgattttcacaaagatttttttttaatttttaattaaaaaaatttttttggttacattgtgtggcatgtgggatctaagttccctgactctgaattggaaatgcaaagccttttttagttttttatttttagtggaatataattgctttaccatattgtggtggtttttgccatacatcaacatgaatcagctatgggtgaacgtgtggataaaccagttttctgagatctttctgttcaatagacctatgtccttggcctcctgttaatagttttatccttttcccctactttctccaaggtacaccaattaagaattctggcttgtaaaccattggtataaatggtttctattatcttgagaaaacctatgggaatggagcccctcatcttattttggagtttattccaatattctagcaccctgatagtaaataagttctttcctgtgctcatctagaatgttttcctttactgtcaactcattttctcttaattaaaattattggccatggaaaatcattgctcatcatcctctgtattatcctaagagacaatgcacaagatctctttttgccctattctaatttttacttgtgaaaaaatggaagcttacttttcatttctcatcatttttggatgctgttcagcaattgcatgtgattactgaaatgtggccaaaatgggaccccatttaccagatctttgtagagatggtagattttgaaagattgaaacaataggagaaattaaacaggaaatgacagatttaactgtctaaaaattttcaattgcaattccatgaaaattaataaagttggctaggaaagtatttgcatcacattaaaatagtaaaaataaattcatgtctatacaatataaagaatttacttttacgaaaaatctgcttatatataagatccaatttttaattaataattgtgttcatttaaaaatattttggttattttcatttaaaaccatctttttgagtaacatcaagactcctgtagatacatgaatcatgaatagacaatattcttattagccaacagtcacttttcctcaaaatatagttgacatgtcatatcttggcagtcttcaagaagcttcaagagaaagcaagctcttcttcaaacctgtgatcctatattctgtgacacactgtactgcatatgttgtaatagtcacaatattattctgcaattatttataagactgtcttcttcctggaaatcttcataagatgtcagagaaggaacaatgttttgcttcattatcttttcattgtctaacatgctgtatactacatgcagtaggtgcttcagaattgcttatagaatgaattaattcatgttaacataaatgtaaatagtaattatagaattacagaaaggtcttccttctcaggctcttaatcaaaggtctacatatataatgcaatattattttttcaaagactttaatgtgttggtggacatatgttctttttatctaggaatttaaaaatatgaatattattaaaagaaatgaaaatgtaagagtgcgcctggaaataatttatccaagtattacaatgacagtcagtttacagggttcttaaaaatgtaatgcactcattctgaagtccatctagagaaatagaggtaagagaagagccagataaaaagaaataatgaagggaaatggcatatcaaatatttaaatgtttcactaaattacactaattaacatgctatggactgttatggaaacagaaagattctattaaagaaatagactgagaaattctggggttatcagaaga

SEQ ID NO: 60578 - DNA, 986 bp, Bovine  19866880853946
tgccaccttactgatgttctcaccagacttacaagctttagaaagccttcactaacatctaactggctctgatgcttgctgtaataaccaaagaaaaattattcatccaaacctcaaaggcacttggtttgaatggctacaaattggattctctggggggaaaaaaaccaaaacagtcttgtctcttttttttttaaatcagagtttgccaatctctctttgaccacatcaccctaatatgccactcttgtggttggctgctggtcaaatatttctggcttcccatcgtttcctttcttcattaactcagtgggtgtcacaagtctggaattcattctgaatatgccccaaactggcctcttgaattcaatcgtattcttgaagagctgcctgtggatatttcatgcagtttcctaaatcagctgaaaggccctcatgatgctggccatggtgtctgatgatctttgccacctcctccccaccaccagggtaatggacacctgtgggatatgcgtcaccagttattaacaatcccttctcatgacaacaggacacaatttttctttgaagggaatgatttcttcccaacattcaattcaattcaattcaattctatgtggctcatttgatgaatactctcattttccattgcacatggctctagactagagcattccagaacattccactctcctagccacagtgactggttttgtggtgaatgcaccatccaacacgagcaatcagggctaacaaaactgcttgacaggtcttatggttaccatatggggaagcagtcttaaccttctactcgccaaggagttggggtagtgtgagctggagaacccacacaggttgcccctttaggagaggtgcccctctaggagaggaattcgatggtgttgtttgggcctcagattaagtcacccagtaaactcttcagttttgtgagacaataaattccctttctttgtaactaaccagag

SEQ ID NO: 60579 - DNA, 891 bp, Bovine  19866880965546
tctgttgtgtttgctgcttgggggcttaattctcactggtgcctcagtttaagcattcttactgcactatctggagggcaggcaagcactagaatatctttggcacataaaagagaattaaaatagaatgacatttagatgtacaatcgtgaatcatcaccctcactgtcagaatcttctaccttgtatttggcaatgttagatttcaagaggttgacctcttcgtgaagttgctttaatctctcttgaaggtacctggaaaagaatacgtacaactagaaagagtttgggagcaaaataaaaaccatacactcaacaataagggggaaaaaaggaaaaccacacacctgaagaaccaccttttacatataatgccttcctccacccaaaagaggtaaagtgcatcttggtgacctcttcttaaatggatgcgatgaaggtcaaatattcccaagtcacctaaacctcacttcagaacagccctctgcagagatcccctaaggggtatcagcacagttttcaaataattctcattaagatgaattccactgggaagcaaagcaggaagaggcgacaccagacacgctgttaagttagtcatattcagacacggaaatttgcctccaggaaaagaaacagctaagggaattcctcaatttattttcttattcttttctgtcttcttgatagcaataacaagcagcttccactgttccctacccttctcacccaaccagagaaggcagggaaagactgcacgtatgtagcctgtgagcactttggttgttcttttcgtactttgacaactaatgggtgacattaatatcattgctttagagttgggactttcctttcattgtaaggcaattttatcaaatgtaaatagggctg

SEQ ID NO: 60580 - DNA, 828 bp, Bovine  19866880998476
caagtgcctttgaataagcaagtttgggaccagcaacctgcatatattagaatgtcaacactgaactaaattagggtcctagtggaaaaacttgctagactttcaacagtggacatagaaatagattagcaggcaggaaggaagggagaaggaggaggaggatggtaagaaaccaggagaatgacagagtgggaggagaagggaagaaaaaataggccagggcttatgggacctaaattttaccttcttattttctagtggaactcagacttttttcaccctcctctcatggtatttttgacattaaatatccaatctcctcggccccatatcaacttgagtaatataccacaaccaaggttggctgcgtctgctctctcccctactcaattcaagaatgctcctaccatacattactattggggtttaaaaaacgatttattttgctacacaattcagacctttgaaccacgctggatgctgggtgctttgttgacatagtagttagggataaaaggagagtttgggggattgtggaattctgactttctataaatcactaattttattgtagtaaatagaggtcacctcctggaacttcaatagcctgccttgaaaaatggtatgaaactatcaaagtccatcaaaaggaaaaataggacaaatggagtagaggggaaagaatattttctcactttcagccaaggccatggcaagaatatggtcagtacagtcagagctacttttaagaggttggcccaaaactttcccttgcttctttgagcatcttgtctattagccctgcccttgatgagaagctaaagataa

SEQ ID NO: 60581 - DNA, 1215 bp, Bovine  19866881013446
tgtttttaggctgaaaaggggaagggagaacattctcagtgtttgttgattctcaattgccttcagatcaaaataattctcatggcagaggagtatattttggggtgacatatactgatctcatgtccaacttttcatttcttatatcagtgagaaaattggtaaataatggatcttgtctccccacctaaaagatttagggctgcttcttgtaacagatatcctgaattcccctccttgtaaaccagtcttggttacttgatcttagaaaacaggggtccttcaaagagattgtcattgccaatgtgatataccattaaaataaaaaaaaaactcccaccacttcttataagtttaaaaaatatattgcatctatagtgtaaatttctatgtattttctgacattgatgaaggaattcaaacacagtggtagaggcaagagccagagtttaggatgcagcaggacttgaagaaagcaacgacagctccccttgtccatgtgaccagtctgcctcactgagaatttctgcaaaaataaagcagagtttggggcaagatgcacacagctctctcaactcccagacctctgcatttataacaactgtcaggatgtgtagtcttcatctctgtgcagagagaatttccacaagcatcatagtccccacaccaggggctggccttggctggcacttttgtgaacatccattgtaactgggggttgactggatccttgacaaaggaaagtgtgttggaatagacagctgtaaagtcctttcagcctcgggtctcccagccatgttttcagcacatctgtcttctctcttttctgcatcacaattttaatatagaaactccgaactagaagagtgacttaaatatatagcttctacaatatactctggtatattcagcatcccgctattatcagagtgaaaatgtcaaccttttaacatcagccctggctatatctgaatattaaaagaggcttcttttgaaaccttttcatgttttgctatttatgctactccctgccccagagacttagaggaaataatcgctcggttttgttttcttccctgtgaaatcctttccagtgttagacggtctgccactttttccctgacatttcctttacatcgtgcagctattctaaactgatggtcacagagtccttctcaataacacagagacaaacgctctgcatagctgataaat

SEQ ID NO: 60582 - DNA, 735 bp, Bovine  19866881022761
cctttcctgttttgaatgatgaagccgcacggcaaatacccttcggatgagacattaagcgaggtcctttcagtttgtctctggggactgtcaaagtggaaagcgaaggttccggcactctttctaaagaactcttttgggagaatcccatcttggtgaatgtctcctttcttcaaaacagagttcgtgagcctataatggtcagaacaatgacaaccgctcagctaagagccatctagctgactgccatgaagccctatactaactttgagatattcccagggagacatcaaggaaccaagacttttcatgaaaggattctgatagctgatcactggagggtccagttgctattgtggactgtctctgagcaatttcattgtctgcaaattgatgaataatacccctcaaagggtggtgagcaatgaatgagataatccaggcatttgatcagtttcaaagccttgttcaaataaaaagtgttattattcataatgtataagaataatagttcagctccaccttttcactccatttcagtttttcttgtttcagcttcaagcaacagaaattgtctcattctgctggtattttgtgttcttgctggaagattttgggtctccctggtagcttaaacagtaaagaatccaccctgggttggatccctgggtctggaagatcccctgaagaaggatctggctacccactctctgctccaaatgaagctgctactaa

SEQ ID NO: 60583 - DNA, 852 bp, Bovine  19866881050766
ttctggaggctgggaagtccagatcaagtgctgacagatccagggtctgctgagagaactcttcctggcttgcagatggctacctttccttgtgtcctcaaggaggcggtggagaacagagacagaaatctcgtgcctccttccctttttataaggatactaatgctgttcactggggctgctaatgagcaaatcacctcgcaaagcccacgtccaaacactaccatgttggggatgaggtctcagcatacgaatcttgggggatcacaaacattcggtcaatagcagctatgaacctggaggagcgcttcaaaccttcagcccagtaagatgaattcattgattaaagcctcctctattgaaaagacaaaacaacattttgaaaaccagtactctgatccatctcccttacttcccagcgaggaaagtgaggtagaaaatctgatattgagctgatccacattgcaaatctggaaccttaactacctgatggctaattcctaatttgtcctcaaggatactcttctagctttttcttggggccatacttcagagtcacatgctcctctaagcactggtgtttgtaaccacttgctgatttttcgtgagaggtctcttaaatcacctgctgtaacccactgcctggccaggctgatgcctctgaatttacggttccagttaaagtcacatccatgaagggggagggaatgaacagctctcccatcgcttcaagcccccaaattgatttggcactcgaagtcactgttatattttatactgagtcttctgaatcagttcattgaattttagctgtagctatataaaatcctctccagtgaaattatttggcca

SEQ ID NO: 60584 - DNA, 1705 bp, Bovine  19866881067956
ttataatggagaaactgagacagtgagaattttaacattagcctataacagatcagtgattgcctggggttggggtgaactgagaaagacaggaatcttttttttcccccatttttgctgcaggagaattttgatcgtggtgcttggtaatgcaagagatgtcacagttttttacgtcaggtgttgtactgtgtacagaaaggttaatgatactgacctacttctccagtagtattatgagacttaatgcttagaagggactttgagatttaggggtaaaaagggcacatattatttgcttagagtaattatcttacagatgtgagcttaaagagcttttaaaaaaatgatatccatttctatattcagaaacagaaaaagtgtagatgacttccacttataacacttaatcttcagggcacatttatgtaaagcccaaggaaattcgatttttgagatatgttactgtaaggataaaaatatcaacttccataagtaatgtcttattgatatcagaggtaatggtagtgacatagtatacatttataataatggttttctgttatggttgatattttttcttcttactgatcagtgatttttttttaaaaactgagaatagtgctgaaaactgtttttgttttttttaatttcttttggttccaaagttagaaaaggatttcatactttactgaatgcttggagagactattacagtttgtggtaaggctgttatgaccagttagaatctgagttatttggtttatttttgaaaagaatcaggatttgctcttttgagattttatttttagctatgtgtttgatttgttaaatctgttctaaagctttaaatgtcatccagataggctatactagaacagtaaggattattatattccatagtaattgaacaatgatatatgaacctcatgtaataatttcatttctgatttacttttatcttttagagttatagatagcagtatgaaaaacttcaaagcattttttcggtggctgtatgtgggtaagttaattgaatgaagcattcttgtatttttaacacttttgaagaaaaaatgtgggaatataaatttggaatattcaattacactagtaaaattttaaatacttgtcaatgtagaaagaatagtttaaatgaccccacttacacacttcactcagtttaagcagttttcaacacatggccaattgtatttcttctttataccctcccattcccgcctccacagatacaacttctaacattgattgtctctatcacttactgataattgacctttttttttactctgtaatgtctcttaaggttcaaataacattttttaatctctactttgtattaggcactgttaagtgttagatttggagtggaaagggggagagaaaataagacaaagcctctgccttgaatagttgaactcctgttttatactttgatcttctgtctgtagatctgtgccgttcattatggtagccactagtcaattatggctgtttaaattagttgaaattataattacatatgcaattccttagtcatgctagccgcatttgaagtgctcaggagctgcttgtagttagtggctgccacgttggccagcacagaactagaacattgccgttatcacttctactggacaatgatgccctagctaaatagattgcaggtgcacagagtcggaca

SEQ ID NO: 60585 - DNA, 1545 bp, Bovine  19866881151246
cttacaccagaatccacgcgcttctctcacttttcggcctccgcttctccccttgctgggcactcaacctcccgccaaggccctcttccagaccccgctgcccgagaagtacctagtgcccttggaagcgactactcctgccgcgccctcccccactctctcctccggatccaggccttaccgggagcccagaccacgaggtccgcggttccctcccgtccgctcccctcgaagtgactctcgctcgactccgcccggggaggaggcgccccagtgaccacgccaggcctctccgctctcccgactgggcgggcggcggccgcgccactcagctccccgcgcccttgccgggccgaacgccgggagtggcaccgctctcccgtgccccgccgccaatgacccaagccgaaagggaaacaaagcgtcgggccccggagtccgctcggcctggccctccctggcccgtctgccgccgggaccccaacaaagcccgagcccttgcctcgcgcccccggcctggcttacccatcggtccccgcacgcttcttgccggaggggtaatcctcccccaggtccaaccggtgtcgcttagacattttcgaactcttcgagcaggcggttatgaaggaaggaaaaaacaaaccctggcggctctatcggcgcagtcgagggcacctactaaactctggaggacccccacccctcccgctacaacagcctacaccgtgcggccggaaccaggagctaaaatggcggcggcgacgagggctgggcctgcgcgcgcgcttccgcggtatgatgtgcgtgcgtgcgtctgtagtgcgcgcgcgcgcagcggaggcgggaactccagccccgccctctgcctcgtgggcccgcctttattcctccgtgcctgtcttctccctcttgccaccactttccgccctcttgccaccactttccgccctcttggtgggtactaggcgggttgagcctttgggtctttcatgcccctctgattttggaaattgagaaaagagaaagtctaatcctgggtaggtggttctatccatctgtattaccctggcattagggggacagagctaggactggaacccaattataactccaggtctggaacttgaaactgctgagctcagctgcagtgaggaaactgaattgagaaaatttcaagacttaccgtaatcagttttgcctttaaaaaaaatttttttttgtatcagagtacagttgatttaacattttgtcttagaaaaggacaatatgcattcagtctatcgatgtttttactggaatagggaaagttggcaataaaggtgtaactttttcttgcgtgcctattatggagaaggcaatggcaccccactccagtactcttgcctggaaaatcccatggacagatgagcctggtaggctgcagtccatgggatcgctaagtcgcagactgagcgacttcactttcacttttagctttcatacattggagaaggaaatggcaacccactccggtgttcttgcctggagaatcccagggaaggtgga

SEQ ID NO: 60586 - DNA, 814 bp, Bovine  19866881168175
caccaaagcagcaagataccttacaaaatgaggatgtttggacaaccaagttatttctcctatccaagtactaaccaggcccgaccctgcttagcttctgagatcagacgagatcgggtgcgtttagggtggtatggccacagacccaaattatttctcttgggctacatcttggtttcaaaaagtttcctttggtttagatttaaaaccatttaagatcctagtgacattctgaatatgatttatctttcaaaacttttatttgcattctcaaatgaaaggcaagctggcgtgctgcaggccatggggtcaacaaagtgttggacacgactgagagactgaactgaacactaaacctgagggaaaaatcctttctacagggaagcccaaatacaattctgaagttccacaagttcacgagctataataccaactgttttgctgttatactttccctaagcctaaagaaatcctatatgtagtagctatataccagtacaaaattaaataatctaaaattaaaagggattacacagcttcctaatttggcattaccaccttaataatgtgaaaactaagacttagaagagttaagttagcaagtctaaagtcaaaggagcttaactaaaagctgaaatggaggggagggaagcagtatgttttattattaaaaacattagaatcttatctccttgattcaaacttcagattaatactcactgggaaatatcagtatgtcttcttaagatgcacattttgtaaagtgaatcttctaaaatagtaaaaagaagataatgtagatttgaggttttat

SEQ ID NO: 60587 - DNA, 532 bp, Bovine  19866881187530
accccacccatttcaaaccctttcctaattttgaccaacaactttaattgataatagaaaaacatcttatctctaaataaaactaatgctgacagaaaagaccgatgctgaaaaccagccatatggctgacatgaacccgtgcctggccacatttacagcagtgtggcttccacagaaagagacactgaaaagcttgaggacctgtgtttaacaaatcagactctgctggcatcatcagaatattcacagtttgcaaccggatccgtgtcccttctcacttgcagacttggaggtgttttaggagaaagtgacttcttcgctgagctgttctgatgtgtaattctttacgtctggagtaccttcgacatggcatcgtgcctgatctctttccgcttcatgttttcacagtgctccttgtgcctcctccaccctctgcagtgtccttgtcatcctccagggtggaaactttggcttctggctggctggactcagaggagtcccggcaagttttggggcagggcccgtcggcgg

SEQ ID NO: 60588 - DNA, 790 bp, Bovine  19866881221553
atgtaggctctgaaacagtaggtctggggtaggactctgcgtgtctgacaagctgccaggtgatgctcccactgctggtccacagaccccacttggaggagcaaagttttagggaaggttcctctcccaacaggttggatctgagcagaaggagtatgggaacctattaggaactaacatacactatcctggctgaacagatctgaatagttacttttttaaaaatcaagacttgctttagtcactcatttatacattcaagaatctcattgtaaacacaagtaatggtctcattttcagatacagtacttactgtggtcaatgagttctcaggagagttgtccataactaaaacacaggctttagagtatatatgaaagaattaaatttttgttcctgggggatttctgtggtcatccaaagagctaaagagaaagaaatggcttattttgaaaggtgagatgcaaatctatatcagaagaactagagatctggagtgtagggacagaggtcaagctctgtctgttgaaggagaccacagtcctcttccccagggaccagcctgtcagttgtcacacccaccactctctttgcatcatctcctcttccgtcattcttcccacccttcatcttagctgtttcattgcagtcttatggtccatctgatctcatcagtatttcatctcttctagagtttctcagaatttttgccagggttcagccatgtttaaatttcttaaaacttttaaacatttgattgggtaaataaatgttaaaaaacacatagtta

SEQ ID NO: 60589 - DNA, 1235 bp, Bovine  19866881232458
tcctcccctgcctccttcttatgactcttcctttggcttcctacatccccactggctcttgtgggatatagcttctcatctttgttccttacagcctcaataattgttggattggttgaacttcactgaacggaccctgtttttacttctactttcttgatctgtgtgttctgccagctatgaaggctctaataagcctctcctctccctgggctgtgttacatcacattcagtggaccacctgctatatctgttcagtgtgaagccaactagaagaccatgtgtcatttgaaggatcttgagttatattttgcaggtccagctgtggctgcatccatatttcagttatgcatagttttaaagagaacttgctttaggcatgtgaatgctggttttctagtgtcgtgagggtgttattggttaagaacatgaacttgggaggcaaaggttaatctacctgaggcataggttaaaaatccatgctcatcaccagctgagtccagcatgtggttttggttacgctgactaatttctatgcctctgttttctaatgggagtagagggtgctgggtgagaacactgggggttgggaaaagacagatttaggatgagctgtgtgtccttagacaaactgcttgacctctctgttagggcccacatatataaaaggaggataaaaatacagtctacactgcagagttttgtcaggtcagagaagaaagtgtacttttggtagatgtttggcatgcactctgactcagacctgggattcaggaaagattaattgctatttgtgttaaccatagaatagttgttattgttattgatgatgttattgttgccattactactaccacaacttctactgggtccattttactacctccagccctgcatcagatgcctgtgtcagactaaagaaaaaaagcagtcagcaccgacaaactaaggcaaggtccctgagagtagattgttccagacgccagcaaattcacgtttctgggagacgtggctgcgttatccaggaacatcagaaaaaatacaaccaaatgtctcttcaccacgcctttgagcgttgccctgacggcatctttcattgtacacagaagagttaagccttatcttttgtttccaagaagcagccacatacagatgatctgatcattctaagaagcaggcatcagcttgaacaccaatgtgattgcatctcaaacccatcagctggtgaaaaggga

SEQ ID NO: 60590 - DNA, 823 bp, Bovine  19866881241734
ctgaagtctctgtcccctaagaaagtaatgggattgcagggggcagatggctaaaggtcttcttatgaccaacagagatgtgaggtggtggtgtccttcttactgctctggggctttcttaggttaagtgtaacaataccgatatcaactggaggctttgcaagagaaggagctgacactaatcctaaacttacctttttcttactgttttccatacataaaggaagtactttgaagttgtatcttttcatatgtaaatcttatttttacttttcattctagttaactttgattactcaatatgtttatatggtgtcattcatagaatttccagaggcttaagtcctgaccattgatgtcaagaattttctggcactgtgaaccaacctcacagatttttctttttccatgattacctgttttcagggcctagttatatttgtgaataatcagtaccataggtaattgtgactttagcgtaaactaatgatatattttaaatgttactgcatagaatgtcaacttgacattttcattgtcagtttttggtttggtaccagtataatgctatatatatagtattttctcggtcatgataactttgatataacggaacttacttaattctagcacctacagttgtttagatgcccagttttatgacgatgaaacagtcacggtagtccttaaagacactgtaggacgggaagggaagagatagactcttggtgcagctgccactgtcttcagtgtacaacagtgaagactctgcagaatatcaattcactgggacttactctataaggtaactcatattagtaag

SEQ ID NO: 60591 - DNA, 779 bp, Bovine  19866881309561
agggatgaaagggcttggtttggttcctgtggctctgacttgctggggagctgacagcaagcctcccggcatcttcccgcactgccaacgcctcgggagcagcacaactttcatcttgcttctgagcctcccctgaaacagacagcgggtgggggcatcagcatcagacctccagctggaattcagccctcacttcccctctcctcccaacctccagcccactgtggccgggcctccgaggtagaaaatgctgccaaaggcaacacagggcccacaaaaaagaaagcagccactctggtgactcctgtcattaattgaaggaaaggggtcacgtgggccgtgtctgtaacccctcctttccaggagcctggttatcacctgcttcgctcactgatggtgacttcttgagctcatgaaatatttaaactgaggacaaaggttttgtgcgttgtgtagctcagggaagatctggggcttttcagtaatacaaagtggttctggcttcttcagtgtgggaaaaaggagtagttaggagagattgagtgccccccgccctcaatctccatcagcacctcattctttgatgccaaccactggtacttcctcaattttaataaaaggttatatgcaaaagcagcttcaagctccctacccctcctaactaaactgttctccctaaacttgtataatagaaattctccagctgcaactagagggggatgaaagagaacgtgggcccctgagaaccagcctcctgcccccattttcctatttgcttg

SEQ ID NO: 60592 - DNA, 1706 bp, Bovine  19866881358223
cgcctaagtgactgaacaacttgtgacctatactcctgccccctcctgggcctaacaccagtcaaaagtaacagctaggcaacaacccacgcacagcaccaccctccccccaccccccctctgtattcatgacacacctaggactgtttttgcaggaatttttcatccaacattcaaatatcaattaacattaatgttcagctgaagaagtttggtcaagcccttcctgccctagatttgactgggattgggcaacccctatgtctccctggatcagttgagctcacatgcagcccaccccaacaacatcaaatgcagaactcaaggagcagtgaacacttgctggtggcaggaagcaggcggtggcggaggagggctgtcagccttcaaatcatcaaatcaaatcaaatctgtatttgatcattcatccatccaagacatatttctccaaaacctcaaggtacagggtggtgttggcctaaagtgtgaatctggtaacaggtcactctgattctgcacatgctccttccttttctagaagatccttccacctcccactagcatcaccctgtccccacctgcccagctcccctccatctggtgaatgtcctccaccaaggctaagttcagacacatttcctcttgaccacctctcccagtctggctgcccattccctgtgttcccacaggaccccaccctgcaattagctcagtcctgccctgggcctgctagatagtaaccacctgtctcttggtcttcctttttctctagacagtgaccttcttgagggcaggtactggctttttctctctatttatacagtgccaacccagtgcctcaaaatggagttaaagtttgataaatatgtgttgcctctttgtgtgtccattcctcacactagtctgtgagctctcacaggtgagaactctgttttgatcataaatcatatcataaattaagatagattaagaaattgagttaaatagagaagtgccctggcctcgggtacagcaggaagagttgaagaaccatgtacaattgaaaacagaagcagtgagtgaaaatctacttattgaacaattagaccatccttgtctttcaccctcaagctcccccatatcctcagcttccaggacatgggcagtcaggtgaaaaaattttattcttttagtgtaaaactcatggctcagttggtaaagaatacacctgcaattcagtaggccccagttcgattcctgggtcaggaagatcccctggagaagggatgggctacccactccagtattccagggcttcccttgtggtgcagctgataaagaatctgcctgcaatgcgggagacctgggttctatccctgggttgggaagatcccctggagaagagaaaggctacccacttcagttctctggcctggagaattccatggactgtgtagtccatggggtcgcagagttggacatgactgatcgagtttcactttcactttcaaagctcatttatacatacagtacctaaacggatgtatatttaagatatgaaaactgtacagggtagaggcaactaggaacaaaatgtctataagtcttgctgcggtggggaagaggtggtgggtgataatgaggaaaggttgagaaacactgggttagacagggaagacactgacaggagactagggcgagaagccacggagtcggaagccctttct

SEQ ID NO: 60593 - DNA, 1263 bp, Bovine  19866881394905
actcagtctcaagccaagattaactccttttgcaccagctctcctttctctcagctaagtcatcattttccagaaaagtctgatttttctgactccacgatttaacccatttgaagtcaaagaaaatgctgtaatactgaaaacaatcaaactagagatggaaattagtgttgtggaagatacatgtcaagtgctctgcaaaggtaatgagaaacttgcaagaaaacagattttaaactctgcctggcttccttagttactcggtatacgataatgttgctctgattactagtcaggacaataaagtgctcaaaggcactaaaatatgcatcttggggggaaatgcatggacattaagatttcctgggagttggccaaggcatttttacatccataaggactgtcaacttaaacttggtctgtcacagttattaaaaaaaaggaaaggagtggaattcctgcttacaactgggtttggcagaaacacatctgtatactctgcctctgtgatcacacaggcctttaattagggacaatgagtgtgcccacagagcagcactaatgaaaaatttataaggagtctatgatagagcttcacaatccagctttactaggttgtaaacactcttcttacccaagcattactttgtgtatctgtgaaacatctgaaaaatacttttctttgacttaccaggctgtagggaatgagtcattttatgtacaagcatctacagtagaacttggtactttcttgcattaactgaacaatgttccaactggaacctaaaagaaggttgccaatgctcacttttcgaggctctgtgaggtgctggatgctctagatcagtttgtctgtggaagcttctctctttggcatgcttcctctgtccatttagtaatttgcctggaggtgacgacgtagctcgtaactgacattcatctggggatccttttagccaggttggcctcatttgttcttgattcacctctttctgaagctgcaatgctaataacctatcctgttcttcttgtttatgtctcgcaaaaaatagacgttccaaatctaacagttttggggtgaagtgaacttgtttactcttgttcggaggaaactttgaggaacattttccttctttttgtagaatagcatggattgctgactgcttcagacaaagattcctggttttttgctgtggagatgtccttataggtcagtaggtgagactcctcattttctgtcacagctgtgttatttttcagtgt

SEQ ID NO: 60594 - DNA, 1254 bp, Bovine  19866881423979
tcacatgctctccactcatcaggatgtttaaaaggaaaagctagaccgttatcaattgcagctattttaataagtgtttctttatcatcagtccattttgtatcctaaaagggagaaaataattgataaaacaatttacatgcatatttccaaaagaaaaatgtataataattattgagctttaaagacattttatctgaagagtctataaaaataaagttaccaaaaagtaccaatttaccatttaagggaagacagggtcttaagaaccagtaaaaacttcataatcactactttttaaatttgctattacaaagttatacagtaatagtttcattcttttcatctttggggaagtaggcttgacattattaagacttcagaatgtgtagttctgtataacaggctctaggttcatccacctcactgcaactgactcaaatccgttcctttttatgccaagtaatattccattgtattacacacaccacatcttctttattggctcacctgtttatggacatctaggttgcttccatgtcctggctattgttaaatagtgctgcaatgaaccctggggaacatgtgtcttttagaattgtggtttttctcagggtatatgcccagtagtgggacagctgggttatatggtagttttgtatagagtgaggtaagtcagaaagagaaaaacaaatatattaacgcatatatatgaaatctagaaaaatggtactgatgaacccatttgcagtgaggaatggagatgcagatgtagagaaaggacttatggacacagctgggtaaggaaagggcaggatgaactgagaaggtagcactgacatgtatacactattatgtgtaaaatagaaaactagaggaaagttgctatataacacaggaagtccagcctggtgctctgtaatgacctagaggtgagatgcaggggaggggagcgaggctcaagagggagaggatatacatataattatgattgatttgcgttgttgcattgcagaaaccaacacaacattgtaaagcaacatccctccaattaaaaatttttttgaaaataaatgttatgaccatgtataccaaaaaatgttaattatgtgatgggacggaggtgttagctaaccatactgtgatggtcatttcacaatatatacttatatcaaatcatcatattatacaccttaaaactgcatgcatgtcaataatacgtcaataaagttggggagaaaaataaataaaatg

SEQ ID NO: 60595 - DNA, 810 bp, Bovine  19866881453043
agatctacacatacaaaaaggtaacttgagccaatataatctatagtatcatattttctaaaataaaaacaggattgtctctccttctataagatctctaggagcatcagttccctaataagatattgattttaaaatattattgaagtgacatcagcaaaatggcagaataggagttttcagtcaccatcatcccacttaacatcaaattttgacatttatccatagaaaagagtaattttatgggagcccagaagtatgcaggtaagttccagcataccactagaacaaaaattctgagaacacattgaagaggattaagaagaaaagtgtcaatttacctgtgtcatccttcccccaaggcagcacaattcagtgccaagacagactccttcagcccatgacttcttccacagggaaaagcaagaatgtagtgagtgagtgcctggtttccctcgctgtataggttgcagcctgagaggttcaatattttctcacctcactcagaattctcaggtgactggcacagttaaacgcttgggagaggctgagagcagagaagtgaagatttcagacataaggatttggaactcaaaaagggccactgatgttaatacttgtttcatgaactccatcagggaacctgcccacaagccaattgggatgccatctggtacacctctggtttgtggatgcctcaaaactctgacaatctcacccccactttgaccctcttcccatgcacatcccccgccaatggtaagtgtgagcctttgcagatgactttgcaggattgagagatggcataca

SEQ ID NO: 60596 - DNA, 1435 bp, Bovine  19866881515241
tggaagagaggggggaaaagaacaatttctttatgattacccaaggagtcagagaatgtgtgtgtcaggaaggtggttgattacttgattttgcataacctaattgagattattattatttttaaatgtgggtttgttgtgctaattaactataaacatatggtatgtaaaatgcatgctgctagggtaaattaatgtacctctaacatacatccatatttcatagcttcatccacacaaataaacctcctatggaagtgctgtaaagcaaacacaattttgcaaattgcatatcactagtggtagagctgatacaccattttcccatcattatccctgacatttcactcacaatgatgatgagaggcattttcaaatagaaaatttctcccatggaactgattaatgtgatgaagtactgtatagaaatgagggaaagtacaaaatatctgcaattcctaacttttaattttatctataagcaaatgtcttctgcaacacaagactgaaactagttctatggaaaccaagacattcaagtcgacaattactctgcacctactatgcttgaaatgtcatgctgggaaataaagattaaataaaaacagtacatacttgtattttcagaactcccctcaagtatgttgtttaatttcattatattcaaaagatcccaagtgaactcttcagctccatcactcaacttctgccatagcaataaggttttttacatatatattacatatgtaatatattcatcaggcttaagtttaaaagtaaaacttatctgccatcctttttttggttcaattattttattttacaggtaaggaaacagagacctggaaagataaagtgacttccctcaagattaaagaacttctaaaaggttaaaaaccttattccatgtaacctcttattttaaatatcatatgtatagatacatatagatatatacagagacatacacagacatgtttgtgtgttattcatcacttcaaatccattaaatgttttatgtttactatatattgagttttgagaatttcttgtcaccttataatttacaatcatttctcagaaattcctgtcaaagtgtcttcatttcttaacatgaaatcagcctcgaaaaactgttttctaatgggatgatttttttaaatgatagctttaaaaaaaaaccagaaaagcaaagatctctacttttaaccatccagataaatgtcccagactaagtagaaacaagagatcatagcatgttccaggtggaagggaagtgagatgatccagctcagatatggtaaatacaggacctgaatctaccactctctgaccctgaccctgtggcagacatgactaatcaatctcactactttctgccactgagtatggtattctcaacaaattctccaggaagtcactgacaattcatcag

SEQ ID NO: 60597 - DNA, 789 bp, Bovine  19866881530497
cacatagtagatgactaactctgtcttttgttaggtaaggattaaaagaagaggaaaattcctaccaggtttatgaattatgaatgagtctccttaagaccacaagcatttttatccttgtcaacacagtatattttatattctgacctaaaaaaactttaatactcattcttaaatttttaggatcttttaagatcaattctcagcatgccagaattatgaaatcttagatcactaaaatatactgattctttttatattaaaaaagttaacatccacatttgtcataccaaatgaagttataagtaaacatactgttatatttaataaatttttctcttctgtcattaaaaaaaaaagtgtacagaaatactttaggagacatatgttactcaccactttgcagtaacagaaaaaagagtgggcatcttttcttagacatactaaagatttcctggcccttccgtcttaaactaatattttgatgttcactaggtgaaattataagaaaatcaaatgaaattttaaaatcaagagtttttcctataactggaataatttaatatcttttaggtaccatgccagtgttaatgaagagcaaaattcctgggtttcatttatgtatttccctttactataaagtaactaggtcactatcataatgctcagtgttgggaattcccctagaggtccagtggtcaggacttggtgctttcactgccaatggtctgggttcaatccctggctggggaactaagatcctacaggccaaaaacattaaaaataaaa

SEQ ID NO: 60598 - DNA, 1469 bp, Bovine  19866881535194
tcttaatttcctcaaactttagatcttggctgtagtaacccgaccgttttcttttttcctataaccaaatatttacttgaaccacttgaaagtgagaagcctactttcttttaaagctttgtatttcagatttggatagctctgaaaattcttccttaccagttttatgtagattgacatttgctattctgttccaaacgcaatgaataacttcattcttctgatccagtctttaaagggtccagatataaaattctaaatgtgagtttcagaacacaggaacagatcatgtcaagattgtccaggcctgtgaagacagcaattccctgtacaaagatgctcagaagaagggatgtgagaaaggtgaagtctggccatttcactgtgtgattcattcacctgcagggctgcatgtgtccagtagatggcctctttctaattcacctgtaagtgttggatgagccagcagaggtcctgaatcttactcctgtggtgcatggatgattatttaaatatacagtaggatgcatgcatgctaagtcgctgcagttgtgtcggactctttgtgaccctatgggccctagcctagcccaggtccctctgtgcataggattctccaagcaagaatattggagtgggttgccatgccctcctccagaggatcttcctgacccagggatcgaactgaagtctcctgtggctcctgttttgcaggcagattctttaccactgagccaccggggaagcccatacagtagggtaccacagtcttaagatcaatgcagtgcatgcagctttaacattttctgtgctgtgcgcttccaccttgattacaggtgatggattactctcctctgctccttctgacagttgtagaactgtttgctcttcttctaattcccactctttgctcctggttcactgttagtctctcacttgtcagctacttgatctcttctttaaggttttattagtgtatcttcttcatttctctgagctcttatacatggttcttcaaattcttttaaaactccaacatttttcagccaataaacgcctaaagtacacctagtttcttataaatagggtttgtacagtgagttaaaacaggaaatatatatgtctgtatatatgtaagtcatatagctatcacctacctgccactagtcagtgtcggtacttataaactaacatctctggttttcacaaagaaacgttctttgactgagattttaagatgaaaacacatttcctagtgaccctgggggaaatttaagtatttcacttaaagggatatggaattaaaatgtgtctacttgtagtttctgcccattgatcctagctgtcactggcagcaaagagaatgagtgttgtccttcctcctcctgtctgccctggagattttaaaaatagttatcatacctcccctcctctatttcaccctcttaatccctcctccataaacaaaa

SEQ ID NO: 60599 - DNA, 800 bp, Bovine  19866881702022
aggaacttcaggacagacttcccctgaaatcagaagatggactaagctttccactactgcctacaggcccaactatgagtctcccatctgcagcctgtgcgtgtgtgctcggttgctcagttttgtccgactctctgcgacctcatggagtgtaacccaccaggctcctctgtccatgggattccccaggcaagaatactggagtggggtgccatgtcctcctccaggggatctttctgacccagggattgaacctgggtctcctcccattgccaggagggttctttaccaccagggccacctgggaagcccctctataacccacccatgtcttagaggaagagctgctctgaagaagagtgtctagaacttatcttcagagtccttcctcaagcccacctttctgagttcttcagaatctagtgctgggaaggacccactgatggcgtgggaacatcaccaaatgtgttgtcaaggtacctgatataaatcccagattcagcaggtcttgtcttcaaaggactttaatttcctcttctacaaatgggagaggacaatacacatcaccctggattgcttgaaggatgaaatccagttgaagaatatggaagttttcatatttgaagttaggtaattacatggttagctgattggtctttatctgcttattgaaagccacaaatcatagtagatttaaatatggatataaactgatataaatatggatagatatagatttaaatatattctcctcagagagcttaaaacatacccaagcaaataagacttttctatgtcaa

SEQ ID NO: 60600 - DNA, 792 bp, Bovine  19866881737276
tgacagcaaaatgcaaatgtattggcagtaaacatcagggaaaatagctacctcagcagtacccacagtacgtaaatgcagatggaaacggtggggagagagtgtcatttttagtaagtagagcaaatactccacttcgctgaatatatgaatgccagaaaattcacctgactttctacgttactgaaagacatttaaagttgacctgcttcttctttcaggaccctggaatgacattagatttcactatatttggtgctatatgatatgaaaagctgataaaatagaaaattaaaaattagaacattattgtggggaaaacagagctttactgaggtatatctagttccatcacctgcaggaaggaccctgcctcaatgtgggcaaatttcccttttcttctggtctatttcaatggcaacccactccagtgttcttgcctggagaatcccagggacggggagcctggtgggctgccatccatggggtcgcacagagtcggacacgactgaagcgacttagcagcagcagcagcagcattttataccaaaatatctttgccaagtggttaagactatatttttatggtctctgtggataacttgcaaatagaggtaaggaacagaaagtcgagctccccagatccagtcaaggaccaagacacactgacatgtcctgagctgttgacagtagtggagaaaaggctcctttccttctgctgatgtttccctccacatgggaaggagccccaggagtgtgattctcctggtaccagtatgctggcttcaccct

SEQ ID NO: 60601 - DNA, 1553 bp, Bovine  19866880433264
cttttgaatgttgagttttaaaccagcttttttactctcctctttcactttcatcaagaggcgttttagttcctcttcactttcttccataagggtggtgtcatctgcctatctgaggttattgatatttctcccggcaatcttgatttcagcttgtgctccatccagcccggcattttgcatgatgtactctgcatataagttaaataaacgggtgacaatatacagcctcaacgtactcctttcccaatttggaaccagtccgttgatccaggtccagttctaaaattcacagaggcacatcctaataacctcagttattataacggtagcatctagtacttagagaatacttcagtggctagcatggtgttaagtgcattttgctgtttaatcttcacactaacccaatgagatgggtatcatttcccccatcttacgggtgcctttagaagcttggagaggttgagttacttagcctcccataaaaaaatttgcttatgattgtagggattcccagaccttactaaagtccaactgtgtgccaccaagcaggaccccaggttaagaacctgccccccagagacagaacagatgcacacaaggactcttcaagatgtgactgaggatgtcgtaaatcaaagctcattctaaaacaccaaaaacaccaccatagatgtgtctacatacaagcacacatatatgtctatatgtatgtatgaattatcatgtctaggactgaccaattattattttggatgctggtctctaaagttgattgaaactgatgacctgtctcacctctatccagctctgttacctgataagatactattatgaggtgtttacacccctcccccacacacacacacacacacacacacacacacacacacacacacatcaaacaaaaactacatttcagccaccagaagccccagcattgaccctggggaggtgtcagataaagggctcccaaccaacagacagattcacagttcctccactgacattgataatgaataaaatattaccctgggccttaaagcctctctcagacccattactgatgaccctccctgtcactgggctcctctaggagctggcgtttaatcataggcgtgcaatgacctcaggggactgacgctggttccagggaaggggtggttaacattaagtgccactgaggaatccggcgagccatctccaagggacctgacagcctgcatctttcagccagtatccaggtgagccagaacctatagcagagactggccctggaccccacatccacataggcttgctaaacagccctccagcctcccatcagtcttccaaaaagagggtcagcctgaaagtcagtattacctgcaggcttccaggacatctgctcaaacacagagcagcttcaggaagaaagtgctggccactggggtgtgttttcccctcttccttcccagcaagagactttgaagtttaggtggtaagccaagagtcctctccgaacatcaggagttgtcaaaagaagttatcccgtcctcctattgtaggaa

SEQ ID NO: 60602 - DNA, 1642 bp, Bovine  19866880536941
taaaaatacatttctgctttacaactattttcttcagtcttttctctgatatttaaaagttctgttgagcttaacataaaattgggaggaaatctgctattgactttacacacgcatctctactttctagagctggaactctctagaaccacatccgtgtgtgctaagttgctttagtcttgtccaactctttgcaactcctggcccgaactgtaacccaccaggctcctctgtccatgggatcctccaggcgagaatactagaatcggttgcatgccctcctccagacgatcttcccaatccagggattaaacctccatctcttatgtctcctgcattggcaggtgggttctttaccactagcgccacctggcaagcccctctagaaccacactgtccaataaagtagacactagccacttgtggctcctgacctcttgaaatgtgaattgaaatgttctgtgaatataaagcacccaccagacatttgaagatgtggggagaaaaaaagagagtatgtaaaatatgttatcaataacttgatactgaatatacattaaaaaggtattttggagataatgagtgaaattaaaactatgaaatcatttcatgttttttttaacttttatgtggcctataggaaatgaaaaattacctgtgtagctcacatcatatttctattagacttacatgatctaaaaaaagaaaattctgaagaagtctgatcaattatccatcgtctttctaagatacaggatgtacacatagactgcttgcccaagccccatctatagtccccataaaatgtattccctgcccctggtttgagttgcactacactttcagtggtcagataactaccattatttccaagcacggatgagttgaggccaattccagggcaaccgtacacaccagctatacctaaaggaaatcttgcctatcttcaaactgacacatatctcagagttctctaactccctaacatctgcagcggacagcctctgttcttatggattcactcacacatctgtgtaacatttcattcaaagggtgcagtccccatctgcgacagcctcaaatctcgccaagcccccaaaagccaagccaaagagacttcctccatggggttcaaggccatctctcaaagtgcccctcatataaggagactgaaaatgattactcttcaaaagggcagggaaaaatatgaaaggaaggattatatctgcctgaactgccaaaccaaactctgaggaacaggtcctccagagaatgactcagacccacatgatgttttccagggacagtgttttcacgggaggggcagctgtgtattcggctctctggccagaggctacgctaactttaacagctagcccacctcaccacaatgtggaccaagaggaccttgttctctctgctcagagctgcatgctatcattgaagcagtcattagaataaataaaaccctgactgtcaatataaggagcagagtacacactatcttttcagtgctggggggcaaggggctgaagaaaagaaaaaagaaaaacaaactgtgaggtctgtcggttcccagccccatcagccagaagtaattaagttacattcttccacagtggggcgctctcagaaatggcaa

SEQ ID NO: 60603 - DNA, 1013 bp, Bovine  19866880702385
tttcatcaaatccaaactcatattaagcagaggctgaagaataagtaatgcgacacagccaaaaagtaacaaaagttttgttatgacttctacctccgtgtaactgggttctcccatttggtggcatttgaaatgactgttcatgcttcttctgtccatttgttttgatttaggtttctagatgtggtgcagcagtctggtatggtgatttttcctaaatatcttaactttggggtatttgctcatcagttctcctccatgtaatgtgcacttaaaaaaacagagccagagcctggcagtttgccaaaatcaggctgtcagctgatttcatgtagaaaaaggattccttgttgagagagcatggttcttcaccttcttggagcggtcattaggttcacctgcctttggctactcactggagcctaatgacttcccggaaagggagcacttcccagttctgagcaaacagcatttaccttcttttcttatttgtttaagatgaggcatggtttttgtcctgcttcttccttttacttaaaagaaaaaaatcaccttctttcagagtgactattttgccaaacctgcccatcaacataaagaacgctggggatgtcttagtggacctatagaatatgtgctctaatttatgtctcatggacttaaaagtaaaaatgcatgtggtagaggccatggtcactaacatgcaactctaatgctttaacttatcttcttcaaacaggagagatgtttttcttctgggcttacataaatacagcagttgaatgcagtctaaatcacggtatgcagctgtggagcccttcggctttgccaaaccctcttgcttgtgcactcagattttacaagggggcagtcctgttgctaaaggaactctagtcactttttcgtgaatgtcctgtgattggcaggaatgctggctgttgttaagtatcatattgttccgttgtggagaatattttttattgctagttcaatagcttttcacagttattaaa

SEQ ID NO: 60604 - DNA, 1755 bp, Bovine  19866880970155
tggcatcactgactcgatggacgtgagtctgagtgaactccgggcagttggtgatggacagggcaggcctggcgtgctgtgattcatggggtcgcaaagagtcggacacgactgagcaactgatctgatctgatctgtagttgtatacctagctgcaaggaaggctgagaactgtggttttactcagagtgactttatgtccagccaaaattttattacagaagaaagggagaagtaattttgcaggacagctatcagtctctgacactttaaggcaaacaggaggaacttcttggagctctatgagtagttgaggctgaggtctcgggactggttatcctaggtctgcatcttaagcattaccagaagctgttgtctccttgtgggctgaagagaaggcaaagaagggagagagagagagagagagagagcgagcacacgcgagcgagcttgttttctgaggcacgacacataacaagcagttggatcctgggtagactctccatgtggatcagcgatatctcctgacacatgctcctcagaataacaattctgaaaaatggtagaggcatgattcaaaagatggggttctaaaataagcttattaatgcttatttatagacactaagcaggcttctttatagtgaggcgtctcaagacctgtagtgtggactaatgatactgtagaactccaagagaagaagccacacagcatttcccactgcgcatgtccaggatcctggggagcttggcctgtgaaattcccagagataggcaggacaagggaccctgcatctgaatctcctggcaccatccctgacaacatgagtggcagtagattggtgctacagggggagatctggtgcagcagcaaagaccagaagatgctgaggctcaagttgaaaaaggagaaagttatttgaaatctggatgaggcagcaaaggcatgagttttaaagtggaaactctcagataaaatggagtggaaagaaccctgatcgtttttccaggatggcagagagagggagggcttgattgttcccacctcaacaaagatcagcagcgtgttcaaacctgcaagagtaggctcactccatctataacaagcacgaggaaaaaactgcctgatggagacagagtgccattagccacatctttccacaagccttagctattctgatgagggctcatcatcaacacagtttataagctgaaatgtagtcctccagaaatatataggattatctttcccccagattaaaaagtttacatttgcataaaactttctttttcccttgaaaggtgtagggaaaataagcttccatagtagtgatttagtggtggtggtgatataagtgatggagaagagggactggtctcttctgttttcctcttttctctgtgtggacttctctacattttctgcaggtctctttctttgcaaatcccatttttgtcagggtgaaggaccagaagaggaggaggtaccagccaaggcatgaagttcctgtgcataggagcattcccagttatctcaaagcttctgaaagctgcccttgatgatgattttaacctgattttattggaataagtatgttctatggtggaagtcagaggtgaaggcaaagtcacacactcttcctttcctctgcccatcacgctggttcagtcacttggtgctgctctgcagcgtggagcagaaacatccctagtcttgtttgtttccatgtccattggagtttagagtagagagca

SEQ ID NO: 60605 - DNA, 743 bp, Bovine  19866881072770
tttacttttattaagacttttaagcacctgcacctcattttaccttcatttcctatgactatgggagagggggctcacatagccttaggttccaaataaagcatgactcaaccctgagaagagcctggggaggaaaggggacatgagaccccagtacctggaggcagaggacagacgagttcctgtaactgcgtgagtgagagggtggggagaggcaaggacccacagcacaggtaggtgagagagtgaatatgtaagaaagccttcaccctctgactgctttgattgtgttccaatgacatatttctcacggctttgtccaatatcttttcatcataaatagaacaaatctcaagtcatcatatattaaaatgtgttgaagacaccactttaggaagtttgtgcttaccgggagcagcaatttcttttatcaccaaccctagtttggcttctgattgaggtgggggctgggggaacatacccctacaagttcctaagggcagaaaactgtgacagaaggaaattcactggtcccaagctcagaaatcagccacataagctgtgagatgccaagcttctttgcacttgtctggcaacactcacggtatcgacagacgttttcttggggctgactcctccattgccattcccactattttgcaagtgttgtcatgtttgttcttcacaaacaccctataaggtaggtattattattatccccatttgaaaggtggggaaaataa

SEQ ID NO: 60606 - DNA, 601 bp, Bovine  19866881156717
tattcaaatagcacagaattttcaacttcctaatctataaggactgttagatttcaaggaacagaatcattggaaagttactacttttatcatatttcaagctaagcatgtaaataataaaggctgaactcagaaataaggctgataatttcatggtgaccagccagactcctgttcccatcatttattcctctgttgatagacttccccaggaagcctgggaaaataacagaaaggaactcaacttcccccaagagaaaaggcttcatttttttcttggcagattcattcctaatcacatagcagggaaccattattaacatctggttattcaaaaagagccactgaattattataaaaatgtttcaaatcatcagctgaaaactcagatgatctacaatgtgtatgatgctttttttctccctttagtcaagaagataaatggagaattttttatatttcaacttctattacacatttgtttctaatctgggaaaattcttgtctgcctactgtacttccatatcaaagaccgatatgtcagcctttgcttctgctcctcttaccctgggtttcttttaagaggaaaattttataaaga

SEQ ID NO: 60607 - DNA, 701 bp, Bovine  19866881218417
caagatctgggcatgcacacctaggcagcccaggcctgggaacgccctctgaggcatcagggtgaggcgagagaaatcactaagcctgcatagcattacgcccggggtacctgtcactgtgagaactccagggattccctctgagaagcactgcttcctgtctgccctggctctagggcatcgcttctcttctctgactctgtcatgctcacccttagcttagccaacacccaagggaaatgctggggaaatttcagacatgacaaggcagacacatccatgcctttgtgaaagtcacaaacaaggccaagaaaacaaagaacttcacagcttcagtaacccagaaaattccagaaatcaggtcaagccaaaagtggcttttcagtgaacactaaatcaaatcctccatttagagcagcaaggtcctgcgagggcaagcctgtacgcactgtcttctctctggggaggtgcacatgtatcacttctgttttcatttaaaagcatgaaaggcgatgttttaaaaaataataacattgaccctaaagaggttcaaggtatggcttagtagtttgtgagcccaaggaatcttaaaagaggacatttaaagaactagaggtgatcaaattccactgggactaacttccttctgcaaaagggtttcctcgaaatcacaggggcgagtgtaggtctcctgctgtcag

SEQ ID NO: 60608 - DNA, 1342 bp, Bovine  19866881312158
tgaggaggcacgttgctgggcttataggttctcttagccagaagctccagaagatcaagtgcccacttggggttttcccccagccctgagtagctcctatttggtgagggttcatcttgtgatgtggacctgccaaacatcccttatcggggacaataagctgtaggcctaggcccaagagcaaagtagctttactctttctccaagagagaagtcagtgttggaggtgagaagaaggttcaaagctatttacaggaaagtcacgatccctgtgctcatacgtgggatggggggtgggcaccactttctcagatgtcactgccaaactgcagatatttcagcacctcttttctttcagacgtcttgggtttcagacagagaggtaaccagacgcttcacatttgctacactaatgctgtttcaggccctattccttgaccttacaagtcacctgttccccttgagatatcgttaccctgtgggctgagatagctactatccagatttactaataatattgaggaaaatgtatagttcaaacttatgtcatcagttagtgtggatccttggatcactctggatagcaaagtttaccatcctgttatggctgtagtattggtttcacttcttccattcccatagtgaattagaaggttctgtggattattgcccctgactcctgaaagattatttaatccctccacagtctttttttttttttttaaattatttatttatttggctgttctggctctttgtttctttgagggctttcctctattcgcagtgcatgggcttctcactgtggtggcttctcttactgcgcagcacgagctctaaaatgttcaggcttcagtagtttcggcatgcgggctcagtagttggggctcctgggctctacagcacacgctcggtagttgtggagcatgggcttagtttcctcacggtatgtggggtcttcctggtccagcaatcaaacctgtgtcttctgcatcctcaggcggattctttaccactgagccgccagggaagccctctccacagtcttttgtctatagtgtaagtctctgttctccaagcatttaaaagtaaaggttttcagtggttttcttatttcaataaactcaaactctttagcatggcactcacagctgtactagtcaggactcttaactcaaactaactcaagcaaaaagggacattagagtcagataactgagcagctcattcagacagagatatagagcttccggcatgggtgaatccagatgctcaatcagtgccttgtaggctctgtgtccctctgtcacctcctgctccaggtctctcattattgggcttc

SEQ ID NO: 60609 - DNA, 1106 bp, Bovine  19866881644834
ctgttttacttcccaagccactttgacgaccttaattttacctacgctacggtataaattttcagtgagatccttatctcatcctgacaccaattagcacatgagtttcagcagaagaatccacagcaatttaatacacaccttcaaagaaaaggaaacactaatcgaaatgaagacagtctcagaaccaattgagcaggtgtgcatttccataatggctgcacaattcagccccatcctcatgtttgctcctttcgcttgtgaactgaattagtaatcttcacatgcgctgtccaagtgattgaaataaattactttgttaaattgcgaagcaggttgacccatctgttggcccacgaatgttcagattctcagagggtttattattccaaataatgactgccatatgcagcggtaaacagttcctttaaaactgactgaaggatttggtgcgacttttgaaggcaatttataaagctgttcgtgttctcctaaaggatctgcccttcaactaacttccagaaaagttgtcttgattggttaatcctggcaagacaccttgttctctttggagaggaaagaggaaggaaagagcagaaacatatgttctgagaggacctactatgcgtcaggcaccagcacaaacgtgagccctgctccatggtgtctcccacagtcctgtgcagtggaaattaacaacccagagaaattggaaggccagagagggcaagtggctcatccagagacaaatgctaaggtgcaagcggagactcgaacccagtccactgactcagagacacactgtgctattttcaccaggcctgagcatctgatagaagggatctacatggagcgttacagcaagaattgtgtaccctcacaactgagacccgtgggagagaaaaaaaataaaagaatgttaatgccactgttgagattcagctaacaacaccattctgacaagcttatgccctctttccaaaaaaaaaaaaaagagcctcagacttcactagaggggtgaggaccgggctttgaactcccattggcaagaatctaatacaaaggttttaaagacaaaaatctggggggtcctcttttcatatgtg

SEQ ID NO: 60610 - DNA, 955 bp, Bovine  19866881741045
aggaagcctcttcaaaattagaaagggtgagtagtaattcaactggcaaggaagaaagcgcagatgaacctttcaggtataaggaacagaatatgcagtcatccacaggagcagtattgtatggagtattttagaggctgtgagaggtctaacatagttaaatacagtggctctcaagaggataatctcagggagaatttggaaatgtcacaatgccctgggggtgaatctagggtatagtgtatggttatatgaaccagcagtgtgagagttgtggaactaacacaaatatgaagcaggaaatcctcatggaaacaacatgccttccttgtctatatagcatctcctttgggggcttccctgatagctcagttggtaaagaatttgcctgcaatgcatgagaccctggtttgattcctgggttgggaagatctgctggagaatggataggctacccattcctgtgttcttgggcttcccttgtggctcagctggtgaagaatctgcccgcaatgcaggagacctgggttcagtctttgggttggaaagatcccctggagaagagaaaggataccactccagtattctggcctggagaattccatggactgtacagtccacaggattgcaaagagtcggacatgactgagtgactcacactcacttgggggcaagaaggcttcctttctttgaattctgaggaagagaagggctgatttcgtatcctaggggagagaaattgtacccatgtttaaagggtgactagggccctcctgacaattactcatttaaatatccttagaattgtcttcctaaacacttcaattccttattcagaaatttgtcattcttgtcataaacaactctgacaacagcaacaacctaggaacaaggaataaactatccccctgaatgaaaattgtttttatgtttgaacagatcaaactcttacaca

SEQ ID NO: 60611 - DNA, 1247 bp, Bovine  19866881788736
atgccaggagtggctgttgcttatgtagtggactgctcagcactgaaggggttacgtgtaagagtgatcaaagatttaaactgtcatgttgacggtaagctggggaacaggctgtgcaggggccttaataaatctgcccttgacttatggccgaacctcattcagcagaaaattatttctgtagcatattgagtgctgtgctctgatggagacagaaataaaagaaaggtggaaatgaggagaagagaatggaaattcaatccacatgcggtggggaggattctttagtacattctttctcagataaaataagaaacagaatgtgtaggactctcaaagtacggtgcattcctttgattactaacatgtcttaggggaagaaaatggatgaggagtaattctcagtgaagactgatatggagtggggggagagggagaaaaccttagtgatttagacatgattgtccattcatttgttcacacagaccaccaggctttattgaacactcactataaatgagaaggtgtgggtatgaggatgagcatggcatcttactgagttcatagctaatgtggtagatctacacattcattatagacctagaattggtccagcaccagctcagttcaatatgggattctctggtggctcagacagtaaagaatctgcccgcaatgcaggagacctgggtttgatccctgggttgggaagatcctttggaggaggacatggcaactcactccagtattcttgcctggagaatcccatggacagaggagcctggcaggccccagtccatggggtcgcaaagagctggacattactgagtgactaagcacagcacaacacagttcaatatagcacaatggcaaccgtctttgaataaagtgtgagagaatatagtcagattttaggtatgagagaagggccaacactttttcccaaaacattttcccaattcaatgtaaagaacagagttttcattaatttgaaaggctaagttaaaataaaacagctaatctctttcttaatcagttgatatgtgatttaaatcttcatattgtttttcttttataacatttcagaaagaaaagaaaggttaagattgagagagtctgtgcttttcagtccagttcataaaagcacaaagaaccctttcattcccagaccagagataatttgaattcaatggataatttaggagacaggacttctctttctgccagttttgaaactattgggaaaa

SEQ ID NO: 60612 - DNA, 1052 bp, Bovine  19866880388437
gctcagtatcagggtgggtccttctaccagcccctgggggtgatggcagagccagtgactcagcattgtggggtaccggtacttagagccaatgccccccaggaataaaaacctgctctgtggtatttgttcctctacctgcatgcccaggccggagctcccctggcttctgcagctctgagcctcctagacattttcccaggtgggaggagaagtcacaactgcaggccagttgggaaagtgtggccttggggttccctctgctggccagtgctgcagacgggcgcccgcctgatggcagataccttctcacttgatttctggacgtgaacacccagccctcaattcccttctcttagatgaggtcaccgagacccagtgtgttaattcatcagtcgacaagatatgcaggctctgaactgggtgctgggttggaacggttcagtgggattggtgggagggctcaggaaagagagccacccggcacgttagagcagaggtgggctctgacctggaagaggtgggacaggcctggagtgaacatgatctcctctccagctctggagagccctgcacgggacctcctgcctggaagggccacagcctggtgtgtcaaccggagttgaatcgcagcatcttgaaataaaaacctggggcaggggtgagatctgaaactcctccaccctgtcttcctcctgcagaaagaggaacggaccatgctggaagacatctgggtgaccctctcggagctggacaacgtcactttctccttcaagcagctggatgagaactgtgtggccagtgagtgattcctcccacccccactgagagagtcggggttctggggtggaaggggctgctctggggtcaccctgcccctccctctgccaccaggccagctgcctagggttgacctgggacccagtgctttcaaaccgcctgctcccaacatatgtggaagaagggggtctcgtttcatataagcccagccatctccaacagcacttaggagggaagaacagccaggacccagttcttaataaaactcccag

SEQ ID NO: 60613 - DNA, 834 bp, Bovine  19866880400896
ttccttctgttaaaagaaaataggagctcggagagaatattagtccggtaggtgctccctgccaccctccacccgcctgcactcggcactagacttgctctgtaggaaggagagaagctgcgttcaatataaatgcaaagcgctccagacactcaggattatctgtgctttgcatgaatcatgacagcagcttgcaagtgggcaggacttggcggagcggccctgtcacaaatccaccaacacgctcctcggaagtgcctgtgaaatctgccttcagtcgctaatttcacactccaggatcagagccgcgagcagctccgggcacagaattcccgtttttcacaacagttttcttaccctcagacccccttggacggcatctcctccaccttttaaaaaacttaaatgctcgattttttttttcaggtcaaatttcgggggggttgttgtttcgtttttgggttgttttttttttttgcttcattctctgtctctttagtgccttgactttgctaacagcagagattttattttggcttcagatcttttgtgaagctctctctggctgggttgcatttttgagaaatcaaaatgaatcgctcgcatattctgcatttattattccctctcctgcagctttctaaataatgtacgaactgtagatgcttctgtgatgaacgtcaatgcatttgaaatgcactgttaagatatgcctttcacctccgttcagatcagaaaatgagttttcttcctgggtttctgcaaacctgagaagcactcctcacttctgaaatgtgtcagaagatacggggagggtcctttaggcccaaggaa

SEQ ID NO: 60614 - DNA, 807 bp, Bovine  19866880435849
ttcaaggtctcctgctttctctgtgtgggtcactgcctgcccttccccgctctggtcagtatcataaggagcctgtcccctgattcccacagactcccttgtcctcaggctttgggcagggtttggccaaccaaaagcactgtctggggactagaggctggaggaagggagaggccagggtatttctcaccctgtcttccatgaagggccaatgctgtgccctctctgtggctcttaaaccaaccccaggctggctcacttctcaccaggtcccagcctggcacccccaacacttctggctaaaacgacagattactttcttccctcagaaaatgagtcttaagattaactgtccatccctggctgccagcttcagtgtggtcaggagagaacagttaacccatttaagagcaagtattttgaagcagatttaccaaagatagagccaagcaggtttccatctcatgaaagccaacatgaacaccctccccccactaccccccacaagtacacacacctgcctttgagctgctcaatggaaaagggtctgggttattgggagaagtcccagtcagaggaatttccagaacagaatatccagtatttgggttcataggcatgtcatggattagttacaatgagctgtatactggtcagggtaccagtgagtaagtgaagtacggtcctctcttatccccaagcaaggtcaattccaagctgtttaggaaatctgtgtcctcacatgtcctactcagcatccttcgattccagaaagacggtgcaagggaggggaggttagatgcacaa

SEQ ID NO: 60615 - DNA, 1379 bp, Bovine  19866880475968
gcagcagatgccaaatcccaatacacggtgcttgtctggactcagtcctttagaatcctgagttaattcagcattgccacaagtaggtgacctgcggggcactgcagcacacaaggtaattttacacgccgagtccataaacattatttatttttaagggatggatttatttcaaagtatattagaagaaatagaaaacgtgaagacgaattccatgatttcacatccataactgcatgggctgaggtttaatttttttaaatgtttccatttaaagaggaatgttaaataatagtgcaggtagtagtacatcgagatggcccagaataattgtggggtggttgggaaatgctgagttcctggcaggctggtgtttgatccctggagttcaagtcccattggtctggggaggccccaccccagcccattaaagtcacagagaaaggtgtcagggtgacctcacccctggcccagtgaaataggaaggtttgctcatggaacaaaattgggtctgtttttctgcacgtgtccccaggctaatactggagaaaatgaattggggttgactggtctggcttcacttaaaatatgtaaaactggcttcctttgcccttcgtggcgacggcttccagctgctttacctcccttctaacctgtctgcctgcagcagggcagggctgcagaaagagtttagctcaaatgtttttgtggaagagatgctgatttataaagcctctccattaaccactgttttaatgaagcagattaccatccccaaggggagacttaacatccagtgtaacttacgcatagatgctgctgtcatttaaaaggatcgctaaaactgtattttaatagtgagctgacataaaccttccacccacctgtgtggacaggggtgagtgcatctaacaagtaagtgtgcaaaggcacttacagacaaagacacccaacagttaattgcctcttaaatgagtaggctggaaacataagcacccaagaccctggttttatgtctggtagaaatcagaaatggttctgcaggctgcttgctctttgcccacatagcacttagagctgctgactgcagcacgtgaattattcaccaggtggtggctctccctgcgctccgggagacaggtctaaccggtggatggcagccaggttttgcttctcacgttgtctctagagactcacagaggaagagttctcagcacgaactgcttcattatgattcgtgaagagcaagcaaaaggtcggttctgcctgaggtgccctggattccacattcaataagtacttattgagcacctactatgtgccaggcactgtgcttgaccaggcttttagggagagataacacggactaaatccccacc

SEQ ID NO: 60616 - DNA, 1772 bp, Bovine  19866880560408
gagcaggagagtgggaaggaaaaaattgacttaataaataacttcactcatgtgatggttttctttttgactctttgaatctcctcaaatttttggttctccctgttaatggagtgaagataagtatcatttgaggttgggcattttttgcactcaatctctccataatcttatttttgtctgcatgaaagcattaacatacattttctgggctctgagccaagatgagtcattttgtctgtttctccgtctccatggagccctggtctttgccagaaccaaaatcagccccagtcaggaaatgctccagggatcttgagcacccccctaagcctggtgcctggtaacccctcttgcttacttggtagagcccactcttaactaatgctctgcccccctcaccgtggacagggcaaggggccagggacaatgcctcttggaatctgagaagtcacgcttggggccatgcccagatcaacttttcattgcctgagaaaagagatgggcttgggacatttcaatctccactggagccctcaggcatgcctttgttattactgggtgggattgttgtagcttactagaaggacgcacccccaccttgggctgtgtgaagattagacggggtgaaaaagcaaaatgagaatgtcagatttctattggggattaagaggcactcaactctagccaagttttatttttttccattctaaagcaggggaaaaaagtgcaccctgaattctccccttctctgcaacatgctgtaattttgtgatttagaagggaaaaaacctgaaatcaaaaagaaacaatttggcaggatttctttgcctgaaatgttttaattttctatgactttgaggtcagcacacccaagagtttctaagactcatctctggtgtgaatgaggcattgatcctggagacagaagccccctaaaagtgagaaatagaagaaaacacaggctattaaccagccacaatttatcctatcagctataaaaatttggtcagaatatttgctgagtaaaataaccatgttgaccggatcttcttacactgaaaaaggcacttctgaatgcccataacttcagtgtagaatcaaatagtcattctcaactatttctaggtataaacattttcaccaaagaaaacacttgataaaaattcaacttgtgaaacaaaccagaaactgagctaggatgggggtgggccctgctctcaacccagacgaatcattatgtctgaatcttgtagatagttcactcattttcagaatccttggtgcagactgggggtggtgccgctcattagagagcatttgaaaacacttaggggagatttggggagttttactaactgatgcttgatgtcctttccagcctttggtggggccagggatgctactgtatgacctgcaatgatatgacagccctcaggagaaagaatcgtcctgcctaaatgtccatatagcctccaggaagagacattcttgcagggacaggagctaagggtcaccaacctcatttctctctcaggaggagcatggcactcctcccactgtagagcatgaaaatgccagaaacatcttgcccagcctctcctgaaaccagaagtggctgtggaatccaagtctgacctatgcaacagaagagcaaatttattctggggtctggcgaatcttctaggaaaaacgttcatctttcataaaatgaatgcacaagaagaaattctgtttcctggctttgaaagcagttggttgaggacagcagg

SEQ ID NO: 60617 - DNA, 1245 bp, Bovine  19866880715189
caagaagaaaaagatggaggagaggctattccccaggtcactccatccccatcttctttgtctttgctcccaaaataaataactcaggcccattttcaccctgatcatctgagacaagaccgagatgggtatagaaatgaatgtatcgatttaggcgctgttcacagacctgcttcctttttctgtgagcagctgtaattagaccgctgtgattttcaagtcaggaaaatgctaaatggaagcacgtcagctggttataaaagagctacccaaaataacatcacagggaatggatcttttgataaaatattcctaaagggttttaagctataaaatattttctcccccaaattggcagtttttgcctcccatttccagatttccagatttgacattccagattgtggggttttttttgtgttgcaaaatctgcttacttgcccctctgcaaaaagtgtctcttttatgttttttagttaattttaaacctgagactgataacttttttaatgctgagtcactggtataggaatggccccgttgtcagctctccaggcagagatagggacctggaaccagttaaaaaaaaaaaaaaaaagcaactctcagcatatcccctaagagactaacaaaccctgctggtcaatgctctctgaggaagattcttcttgtgtagcttttcctgttggcagagaaagaatgtcttcctggccacctgtctgaattttaatgagtcaagaaatatttcttaagtgtccagggaacattttagggattatgaaagaaacatgggggaaatctctctcttcaaggaacccataagatttagatgaagttgagattttaagacctacaagacggatgtgtgcatgtgttgtatttgtgccagaggaacataaaaattcagcttcccattgcttgacctccagaaaagtgcttccattatgaatagtgctttaaagaagtgtccttacttccccgactggaccacagaggctgaaacctcagggtctaatgtgtgggtggtcttaacagcatctactacctcttgggggcttccccagtgattcaaatccacctacaatgcaggaaacatgggttcaatccctgagtcaggaagatgcccctggagaaggaaattgcaacgcactccagtattcttgcctggaaaatctcacggacagaggagcctggcgggttacagtccatggggtcacaaagagtcagacacgaatgagcatctaa

SEQ ID NO: 60618 - DNA, 658 bp, Bovine  19866880892267
agaagcggctggaccgtgccctgtccaaatgctgtccagcacaatcctaatgccccccaaatcttacacacccccacgtgctcctgatgcggtctgcacccccagcttcccttctcaaaggacagcctcccctggagtgtgcacacagccataaagctcatgtgtattttgctaattgatataaatgacttgtctttcacagcccagcatcggtgctgggcacgtccacgttaattggcttggaggaggaaaattaagtgcttcaatttgtcatttttcaagatgaaaaatgggaaaggagaaaaatcactcatttaatagagaggtgctgtgagtaactgaaaccccctttggagaaggagcaaaggctctctcaggaaggggtctgggttgggagcagccctagggaaagggaggtgagccagcacctccagcagccctttatatgcataaagtgtttaaaaatgacaaagtgcttttcaaaggcagttctcatccaaagttcacaactgccctgcgggtaccactacactgacagacagggtcctaaagttgcaaggacagaaaacgcaactccaagagatgcaagcggaaagaaaatgtatgggttcataaactcaaaagtcccgaggatggggtggatctcaggtagggctgg

SEQ ID NO: 60619 - DNA, 753 bp, Bovine  19866880911688
taccgaccttctataccctccccagcccggctgtgggaggggctgtgctcaagatgaagactcccgagtgacctttgcgatgcaggaatatgactaaatcagcttctggatccgtcatctgccctgagctcgactgcagtattgattttccatttcaggggtggaaaacggacatttattttgaaacctgtttggtaatgaatctgcgactggaggaggatgcttcgacgatgattattcttgaacttggcgtgacttccagcagcagagaacgtcccggcctgtctctgggtttactttaacctcttatgagaagcaagaccccaggctgagcagcttaggaaatgaaccaagtgattcccatggccgtaatgtagtaaatctctttctgaataccccagctataaaatagattatgtagaactttctctacctgagacagccctggtctggaggcgagggtttgtaggtggggtctggtcactactctggtcacttggggggcttacttcctcttcagggccctcagtgcccgccccgcccgggggtagggtgggaggagattagatttcagttaccctggtggtgagcaggagcacaatcgccatcccctaagatgtctgtgtcctagttcttggaaactaaatatgcttgttacatggcaagggggagttaggttgcagatggaattaagttgcttaatttgctgaccttaaactaggaaaatgatcctgggttatctggggggggggg

SEQ ID NO: 60620 - DNA, 920 bp, Bovine  19866880976311
ctatgggtgcagttgtgggttctccctgtatgcaggaggtctcttatgatatgttcctctccccccaaaatgccacttgcagctttgagatggaaactgcaagaagaatgaaatagtgagtgacctcctctagccagcacatgactgataagagatgtcacagtcagattacctttagaactaaaaatgtagagtttttcttgatatttgcacttgaaattacgaagtcatcacaaacactgaattagcaaatactgaacccattactcttaggagaaactgagagctaagttcctgtgagcctctggtcacagtgtattcatcaactgatcaataaatacattttaaaaatgtgtgtttttgttttaaaatatcttatttaatatatattgttggggcttccctggtggtccagtggttgagaatctgctttccaagacaatgtacatggattctatccctggttggggaactaagatccaacattcagtggggcaagtaagcccacacaccacagctagagagtctgcatgccaaaactactgagcctgtgcactctggagcccacgcattgcaatgaagagcctatgtgcagcaactaagatctgacacagcccaaataaataaataaatatataaaatattatatatatatatagttagttcatcagcattgatggacattgttcacctatggcatatgcctcatgcatgaacaaagcttatctaacgcacatattttctttgaaaggcacatcacagccttctcgtgggtaggaacagtggacagcacatcagcactacacttggaggccatcttaaacagcaagatcaccaacaaaaggcacaaaagtgtgaaaaactggcactaaataggctccaaaaacagtagttgtttacagcatggggctcaaaggcag

SEQ ID NO: 60621 - DNA, 1417 bp, Bovine  19866880994242
atcaatagtttaaacaatgaacacatgcaccaggacttcaaacatattattacacaaatttgtgtaataaagcacagcactttaaaatataactctctctggcttataaatttgacctacagcttgcacacgagctggagcaaacatcaaacgtctcattgacacttgtttgccctcttagaattccgaagaaggtctggtgacacctgtcactttcttctgggcgcctcagttccctgtagacaccccctctttgatctacggttctgggacttggcatttataccagtcacctctctagttaaccctgacctgacaaggggctttctgtctgctcaggactcaggggattcacccaatgataggtttttttggagtacttgctgtttttcttacccaaccccattccccaggccagaatggagctccaccgggcagcgcttttgtctgccttgtttattgctgtatccacaagggctagaatgtgactggtgctcatgttccgtggatctttgtggactgaatgaatgtgaaggggataaacagcagtgacgttaacctgcagggtgtgggggtggggctgtcgcatttgagctgagacaggaaagaccagaaaagaccacaggaaaaggtgtggggaacagcaggtgcagagagcctgggataggattgaacttggtgagttggaggaacagtaaagaggttagcatggctgcagtgccatgagccgggggagactggagggggatgtgttgcagaggtggccagacctctccagggccttggaggccatgatctggagtttaggttttattctaagagcagtggggtgccattgaaggtttcagagtggagggtgacatgatttaatttacatttctaaagcttgctctgactgcaatatgtgttggatgaccagagctttggattgaagggcattgaatggaagccaagagaccagggaggaggctgttataatccaggaaggccatgatgggcgatggaactcaacccagggaggcagtggccatggagaggtgtgggtgaacagagggcacactttggagatggactcagcattccagcttggctgagcggaaatttgggaacagtgaggtgtgactttgcctggaaattctcttgattcctggacgtatttacctcagcacatggtgggatgatggggatgagatgcaattttaatagcaccctcaaatccctgcttcctccacgaggctccagaagccctgattcctaggcttccctgctgggcttcatgcttctgaaggttgttctttgagtttgcacaaagctcatgtttatttttgctaattgatataaatgacttgctttcgcttgttgtacttcagtgctatgcactttcatattaattggtttgaaggaggaaaattaagtg

SEQ ID NO: 60622 - DNA, 991 bp, Bovine  19866881132156
ttgcttggttggaggctcaaattttaaagagtgagcccatttaaagcccatactaaataacagtccaattagtgccttaaaatggccccagaacagcaatcacaaagtgtatatgaacgggtgacacttgggaaatgctgagtttctggtgcacagggtggttcgggcactggcatttaagttccatcattgtggctggaggggctttctcgtgactctaatgagctgaggaaaggtgtcagagtgacctcactcccagcccagtgtggtgggtaggtttggtcatggaaagaaattggtttctgtttttttccccacacgtcttaaagtcaatgctggggaaaacaagttttggttggctggcctggtttcattaaaaatatttaaaattggcttctttccccctcacagtgatgtcttccaggtgctctgcctctcatctgagctgtctgtctgcagcagggcggggcggtggaaagagattagatcatattttttgtgttaaagatgttgacatataaggcttgggaattacagcattttcaataaatcaggttactgtcccaaggggaggcttaccacgtgctatttatgcacgaatgcctctatcatttaagaggctggttaaaagttgtagtttaagagcggattaacaaagctctccgcagcccgtggatttgggcaggaatgagcactccgaacaagcagacactcagggagctggcggcaagaacacccagcagctaattgcctccaaaatgagtaggatggaaaagcaacagcttcaagaccctggttttgagcagattaaaaataagaaacagtttctcagtctgtttgccttttgccaacgcagcatttggggctgctgactgcaggtgaattactcaccaggtggtggcctcctgctttccaggagaagtctgaaaggttgggtgggtggccaactttgtcctttttctctcattgaggtgcaggagaagggatgcag

SEQ ID NO: 60623 - DNA, 757 bp, Bovine  19866881135973
ataaaaatgtaaaaagaagattgcagaattgataaacccataactaacatttttctgcatcttggttttatcactcaattcctggtagaaatacttaaaatcaccttcaatagctctaaattaaagtggttctttacaatggctgtgcaacattccaccaggtggatatacttgcaaagcattcagccactccattattaaagagaattaatgtttttttctgggtccaggccacttaaaactatagttgtgacatccttatgtctattgctacaagatgtagtttggttttacttctatgggatgtattgccaacaagttgtgagctcagaagaggtatatttttccatggattgtctctttatagctgttgcctctttttcttgtcagtttataagagttctttcatatattgaactacattaagtgaattcatctattattgacttgcaaatacttttacagacatatatagagactttgtgtaatcattttacattcaaaagttccaaattttagtattttcaatatgtctccccgctaccccctgccttttcgtgctttcagggttatctgtcttgctttgtaaagtcttgccagcctctccaagttgtaattgcagaatctcagcttttcttgtaaaatttttgagctcctgaagctggggcctctttctgttttctgctgcatctcaaaccacagctgtgtccggcacatggttggtcctcctgacatatgtgcagaatgaacgagtcaa

SEQ ID NO: 60624 - DNA, 702 bp, Bovine  19866881168076
atgtctggggaagatttatggaagaaataacagagtgaaacctgagtttcttagagcctggggacgtcaaccacagcatcttgggagggaaggaaacttttccacgatggcacctgtcacgtggataatgtcacgtggttcccttgggatgctctacccccagctcctccacctcgtgagacccactggcccctcacagtccagcccagtcctgcctcttccctgaggtctgctctgtggcccctggctcacaggaatgggggtcttctccgagctctgaggcagccctgctgacccactctctggggtttatttctgcataaatgccctccctcctccccaggccctgctccgggacgctgcctccccccagggtcatcagaacactacttgcaccaccctaaggcccgagattcttctttttggttgtttcctaaccaaggacttagcatcaaccaaggcacagataagaccatgttatttcaccatgggtcataaaaccaaagctacaactttgaacctctgtaaatatttaacagtaatgaaattatactccaagttttataaagatggtcataaatcaggagtccatgttgattatacgtgggtcccccaatgtaataaaaatatacacatcatatattataaaatgtacctctctaggcctataaatttgaagtaaaactaacatatgagttctaa

SEQ ID NO: 60625 - DNA, 619 bp, Bovine  19866881189415
ggttggtagaggaggtctgtttatcataacctctcacggatctaggccaacagaggctccaccaccttactatgttcccaccatccccatggcccccgtgagaccagacagaatcatacagcagttctttaatgattctacctgcaaacagtaagtcacttcctctcagattccatcgcccatgtgagatcatctgtctccttatgactttacaagttaagagagtgtgaacctcctgtggggttggaagaggaggggaacccaggaggcaaatgagggcttgtgctgtctaccctggcagagcattagtcgtggaaaggacaggactgacttaaagacaacttcactaatgtgatggttttctctttgacacgttggatctcaaaagattgggtttctgagtggatggattaaacagaagtgccattcgaagttgcctttctctgcactcagtctctcataatcttatttttgtctgcatgaaggcattagcgtgtgtttctgggctttgagccaggatgagtcattttctttgcctatttccttgtctccatggagccctggtctttgccagaaccaaagagcagccccagtcaggaactacttcaggatcctgaaa

SEQ ID NO: 60626 - DNA, 772 bp, Bovine  19866881306939
aaatatttgctttctgaatgaatgcataaaaggttcaatgccagccctaccaggaaccagccatgcactgaccctgcataggtctctttacatctctgagtctcagctttctcatccaaaatactcaactcagaattatcagtgtacaaggtacaaggcggctatcaacctcagatgtatgcagagggatgtccggtgtgaccaagccctttatgagctgtacatgctgggcacagctgactcccaccctgccccagctccccatctctccagacaccaggaccccagagccccaaagggctggaggcggcttctcagagagtgagatcacactggaaagccaggcctggggacctctggggcccttactgagcacacagaaggcctattgacttcctcctgaaattccccagagccacagccaagatgaagcctggacccagttactcatccactctgcctcgcacttaacgcccagtgcagggcaggggcctgggctgccacgagggcagctggaggtgccaggctcccaggggcgcttgggaagggattttccactggcaccaagccaggggcccccgcgcaaggaggctgggacacaggatggttgtactgagcaaggggagaaaaatcctgagctgggagtgggggcctgaggccgagccctcctcacagagccccagcatggtccgctcacgggacccaggggcctctggggaccacagggagcaagtggggtgggggagggcagagccagctgcccacggggtag

SEQ ID NO: 60627 - DNA, 1315 bp, Bovine  19866881372693
atgctgagacgtggagtctgtggttgggcagccacgtgccagctgaaaccacctttctcggacggaagaggagcatgggtctgagactcccccctccccaggggcccataccctccaaggtctctttcccgcttcctctctcttatcactgtaagatctctctgccccgggccctggtctgctcagagctccatatggacctgtgtggtccttggctccgtgtcctccttccagcagggacctcgccccgtccgcatcctcagcctctttatctttcgctgtcctcctgggctccccagcgcctttcctgatcacgctgcttgagccccacgagagttcagtgcactccacacacacccggcatcttggttatttagcacagatgaccaggtagaattcaggaatggttcccatcgcttctcacacctgcagctagagggggtgctctcagaatccttcccctggtggtgttcacgtggggttggtcacttgttctgcaagcatttgttgagcacctactgtgtgccagagtgtgtgggaggtgctagaagtacagtggcaaatggttgatagatgcttgataatgcttcctgtccttaggaaagtggcattctttatatgtatataatgaattctgccagcatttaaaaaatatctatgtatttacttggctgttctcagtcttgcggcatgcaggagctttcggtgtggtatgcgaactcttcgttgcggcgtgtgggatctagttccccgaccagggcacgaacctggaccccttgcctggggagcttggtgtcttagccactggaccaccagagaagtcccagaggtggcattctcatggaggaaataaagtaacaagtcaagacacaaataaataaggggaggaggggattggcaaaaaaccaactaaacaaaacacaacaaaacctataacaaaacactgcctgggccgtgtgggctgagtgagtccttccacctcgccaggtcccaggtcccctctctgagcgatggtcgtctctgtatgctctcctgccagcagagggaagctgtcgattgggtggtactgtcgattgggtttctgtctgctcacctccagtggtgcattgagattttgggggtgtgagggaggcaggggcaggtctgtctctggaaacaaagaggggtatccccaagggctgtctcctggattcaccagctcatgtactgcacccctgccctgttgctctcctagggctccaacctcacggacatctgcacccagctcctcctgcaagggactttgttaaaaatctctgcaggcaacatccaggag

SEQ ID NO: 60628 - DNA, 720 bp, Bovine  19866881633813
aaggagggtctgaagctgcccttacagctgtgtccctggcccaccatgtccccccacagataccaatgtcttctaccacattgagggcagccggcaggcgctgaaggtcgtcctctacctggacagctaccacttctccaagctgccctcccgcctggagagcggggccagcctgaggctccacactgtgctcttcacgaaaggtgagctgcggagacgggccgtgggggccccacgggggaacggctgtgcccgctgggggccaagcacctgcctcgcccgtcttctcccttcacagctctggagagcatggaggtctcgcctcctccaggcagccaggctgtggaagatttgcagcaggagatcaatgcccagtctctggagaaggttcagcagtattaccgcaaactcaggtacctgcgtgggcctcgcgctggggccaggatcctggacactgtcacctggagggggcctttgcgtggaaggcaccagagagcccccagtgcctgggcgggcaaagtgccgtttcttgagcacctactgggtgtcagtccctctgcctacacgagctcctcagattctcacagtagttacctttctaacccattttacagatgagggaaactgaggcccagggagcacacccaagggatgcagctagacactggctgagctgagctttgaactgggtctgcttggcttcgtagcaggtcctgccag

SEQ ID NO: 60629 - DNA, 1496 bp, Bovine  19866881705685
aggcctccttctgtgggttcctcgtggtccaaatagtggctccgctccagccattatacccactgcccagccagcaggaaagaggaagagatggaatcaaagggggacctttggcacactctaggattcttctaaggaagcttccatttttacccctttagttacaaactgcttgtggctgcaactttttttccgagtgactaagcacacacacacgtgcatgtaataataatcattatatgttaatagttaatgcttaacttgtggttaccatgtgcccggtccacttgtaagctcagtgtatttcattctcatgcatgtgtgttcagtcatgtccgactctttgtgaccccatggattgtagcccaccaggctcctctgtccatgagatttcccaggcaagaatattggagtgggttgccatttccttctccaggggagaaagaaattctcatagcagccccattgtggtctctgaatagtatctccctggagatgtccatgttctaatccctagaacttgtgactatgttatttcccctggtgaaagaaacattgcaggtgtgattaaggcttctgcgatggggtgatgagcctggaatacccaggtgggcccaatgtaatcacaagcatcctcacgaagggaaggcaggaggtcaaggaaaagaggaggatccgcggtgcttgctttgaagatggaagacggcgtcttgggcctgtggaaggtggaaatggtaaggaagcgggttgtcactgtactgtggaaggagcacagcactgtggaccaaacatctgccctttggagccataaaacactaacgcgtctttttatgccgccaaatttgtgatcatcggtaacagcagccattggaaatgaacctccacatcatgatactcttatctgtattcagaaaggaggaacctgaagcatagagaggctaagtcacttgcccgagatcacacagcttactagtggggaaagtgcagatctgaaccctggcagtccttctctggaacctgcccttttagccactgtttaccacatgggatacatatgctgtctgtctggggtttgctttgattttgcttacaatttcttaggtagtagatttttccagcctttaaaggctttcatagtttggaaaatttaaaacatatgtgaaagagaatgatgtaatgaactcctcaacacctgtggccaaacttatttcgtctatactccctctccttgttttttcctctcatttatttggaagaaaattccaaatattatagtacttcatttgtacatatttcttaaaaaagctcgcttctgtaacacatttgtcacccctaaaatttaatttttaatatctttactatcatcaaatatgcaatcagtttacaaattttttcaattgcctcattttttttttttcagtttctttgaattaggatccaaatttcccttggttgatgtggcttgactttgttttagtttataaaaacaccattca

SEQ ID NO: 60630 - DNA, 1121 bp, Bovine  19866882037384
cagaaagtagcagctgaaaggctaagaaactcagcaaagctttcaccaatatcatgatgctatacagcagaacttggagctcagtgatcaccaaataggtggagtcttggaaaataaacagtggtatatgttcagtctctcaaagaacttgttctaggaagtaaggacaaatcaaaataaaccagacccataaagcagaaaatcagtcttgaatcattacagtcataataatctgtcctcactatagtggctatcagagaaaagaaatgaaaagataaattagaatcctctggggaaatagaacattatccgtagatagtacaatgtttcaaacaaaatgccttgccaacgttcagaaaaatattaccagatatatcagaaagaagacctaataaccaaaaaccaagaagaaaaaatgataaacaatgaggaaaaaaatcacagttgatggattatcagagtctatcagagataaactgtaaaacatttattattaacatattcaataaaaagctccaatgatggagaattttattagagaaatggaatatatagaaaggactcacatgaatatttgctaactagaaattataattaaaatgaaaaatataattggtgtgtcaggcaaagattttgataggttttttgaaaatatcctttttgaagcatggagacaaaaaaggattcatatacaggcataactagttttactgggccttgcagatattgcatttttcacaaattgaaggtttgtgataaccccgcttcaagcaagtctgttggtaccatttttccaacaatatttgctcacttcacatctctgtgtcacattttggtaattctcacaatatttcaaagcttttcactattacatttgctgttgtggtctgtgatcagtgatcgagggggctttattgtaactgtcttagggccctgtgaactgtgcccacgtaagatgaggaacttggtgcatgtgtgtgttctggctgctctattgccggatctttcccctgacttcctccctctcctctggaacgacactgaaattaggctgattaataatcctagaagggcctctgagtgcgaagtagagccgcgtgtctctcactttaagtgggaag

SEQ ID NO: 60631 - DNA, 692 bp, Bovine  19866880552003
tagtagaatataaaattagataggtaagagtgaacagattatctagggattcctacatgagtgtgagtactttagattttactaagtaagatggaaactgttggggagtttcagacttgagaagtgatccgcatctccacctgcaataactgtgtaacataagctttataagctttgtgtattttacactgacctgcctactctatcctctgtaaacctgtctgaatttcctcaaattatttggtgtggttgtcccaatcttcaagagtagtttctcaattgacttcactatggactttgtatcttcagctttatcagggtacttctcatgagttttactggatcccagtcctctggaatgttattgtagtctattctcctgtcattatgtttacaaattattttggtactcaaatactactccatatatagatttcagaatgccagccatagcagtagacctttggttctgagaagttttcaataaattataccttttctctcttatccaaatttggaactaagtgaaaaagaaagagccttaagaataatatatagaagatggcgaggaataggacagggagatagatcactttctcacccacaaatacatcaaaagatcatttgaatgtggagcaacttccacaaaacaagtgaacactggtggaggacaccaaacacccagaaaggca

SEQ ID NO: 60632 - DNA, 1245 bp, Bovine  19866880568454
acagtggtcccaggaagcatgagccctgggtcttgggttggcctgctgctgctaagtcacttcagtcgtgtccgactctgtgtgaccccatagacgtcagcccaccaaggctctcctgcccctgggattctccaggcaagaacactggagtgggttgccatttccttctccaatgcaggaaagtgaaaagtgaaagtgaagtcgctcagtcgtgtccgactcttagcgaccccatggactgcagcctaccaggctcctccatccatgggattttccaggcaagagtgctggagtggggtgccattgccttctccatgggttggcctaggtcctcggaattatagggaggtcattgggcctgacttacataccactctctgaccttgctactgagagaaaagtaaacattgtttgacaacagcaacttcacatccttgtaacataatgagctcatagtgaaatcatctttagttcattaaaagaaaaaattaaaagtgaacttttgtggcacagtggttgcgtgtatggactcaggagacaggctgcctggatccacttcctagctgtataagctgggcaacttacttaatttcttcattcctcagtttccccatttataaaatgagaatactaactactaaacttacaagattatgtgaggatttaatgagttaatctatttagtgcttagaactgtacctgatagacacatataaatgtctattgagtcatatttttttcaggggaagcaagctaccatcagtatatcatttgatagtatttcatagaacttaaatttttacatattgctcaaattcacccaaataagtatgtttataaactgggtgccaaacttttggcagtaatgtacagctaagtacaactcacatactatttatagactttcatttcttttcaatcccctgatgtaaacacagttggaaacattatagctacctagggacacaaaagatgcactaaaagaaatcatgattacaatccttgttaggtgaaaaacaatgtagctttatgttttgaaggcattatggaaggttaactttgaaaaagtatgaaaaagaaacttccattgcagccttgtaagagtcaaactatcttaaagacataatcagttaatgtcataatgtttatgatgatatgatctaaaaattatgtcattatgcttcttcaagaaggactttcaacaattcaaaatattattagactgtaaaatcttttacaaaaaaa

SEQ ID NO: 60633 - DNA, 1943 bp, Bovine  19866880612546
aatttaagatctatcagtgggaaaagatacacacaaaatagctgtgatatagacccaatagattctctattcacagcacttctgataataacccccttgagttagtgtagaccccacaagtcaagggctcagtcccacaaaactaactccacttcagacaccaacctcatgtccagacttccagtacttctgactgattggctaaattgggggttctcaaaatcccctcttaagggtcgacaatttattagaacagcttacagaacccaggtaaataaagtttacttactatcattaatttattacaaaggatattttaaaggatacaaatagatagccagatgaagagacacatatgacaagatccagaagggtcctgagcacagaagtttctgtccccacggagtttagaatatgccaccctcctggcatgcaaaggcattcttgttcaccaacccagaagctctctgaactttgctgtttattgtttttatggaggcttcattatgtaggcatgactaattaaatcaccagccatggtgattaagtgggggggaggggagcaactagggggatggctaaaatttccagccctataatcacatgattggtgcctctcgcagctaactcccatcctccaagagttaccgcattgtgtaaactcagatggttgaaaggggcttataatgaataacaagaaatactcctcttgcccctcccacccaggaaatatcaagggttttagacattcagtgccaggaactttggatgaagaccaaatatatatatatatttcttactatagcacaatcacatagtagaaaaccaagactcttggtttgggatcataaagaaagataagattaattctgactacaggctggaaaaacattcctgaaagtggatcttaaaagacaggtagaatacagattcggagaaggcaatggcaccccactccaggtactcttgcttggaaaatcccatggatggaggagcctggtaggctgcagtccatggggtcgctaagagtcagacacgactgagagacttcactttcacttttcactttcatgcactggagaaggaaatggcgacccactccagtgttcttgcctggagagtcccagggatgggggaacctgatgggctgtcgtcatggggtcgcacagagtcagacatgactgaagcgacttagcagcagaatacagattggagaataagccctgttagggcagcgtctgaatccatggttgttccattgttctttactagtgaagctcattccccaatgaatgatggaatggtttggacactactgtgtccagggtgtgtgtgtgtgtgtgtgtgtgtgtgtgtgtgtgtgtgtgtagagccggggagggaagatgcacgcagaccatcattggcagaaagtaatctgagcaaaagacacgaagtaggaaagtaaagaactttgggttttttgtttgttttattttaaatggtcatagagagtttacatttgctggccttacatcaacaaagattatccaaatttactcatggagatcaaccattatctattaatatttttaatactgtcctggtcattggattataaagaagaattacctgaaattctctcaattcttttgtacatatacacataaatttcaatactaagatcatgcaagtcttgtggagactcctatgctctcatgtaaagaacaggccttggaggagaagctaaagatttctttttgtggcctccagcctatcacttacacagctagtgattgctccctgatgtagcagattcagctgaaagcctgagatatggagaaagtgatgtctaaccctttctccatatcttctgataagacagaagttttatcagaagtgattttgtgctgctctgctatttatcatacacataaaaaatataaagttaacctaaatctcat

SEQ ID NO: 60634 - DNA, 796 bp, Bovine  19866880884329
ttttcttattaaaaacattctccttcaaatgaacacaaatcatttcccttttccttatgttctctttaaggtgacacccttttttctcccttcccatcacagccaaaccttgtgaaagaatttccactggatagcacctgctaatgtcactcataaacttgatgttgctaagtctagccctcacctttcgttcaacctcttccttcatgtttcatcaacacttaagaccgtcaactatgccttacttgaaatacattctgtctgcctttttgatattgttttcctaatttttctccttccctattttgctagtttatagttttaccctcttttctgaggttttggagtatccctgtgctccaggtactgtgctagcttcaggactaaatgttccaacacttgagggcttgatttcacccttatgaatagaaacaatttgattagaatgataaacatgccaataccagtttgtgtttagaaaatatttcctggagcaactaccattaagataagtaaagtgcttgatcaattttctatacaatgccatttctctttgttttctttttcctttgcttctttctgttctgtcttccgttttcacttttattttactgaggttattttaaagagaatcaattctttcccgagtaaattttattgcaaagtttgaatcatcaagccaattctttatatcacattttaccaattactacataatgcaactttgaatattctttcaaagaaaaccttacaaattttttttaccaagttcagttttgaagagtaagactttgca

SEQ ID NO: 60635 - DNA, 882 bp, Bovine  19866881160436
gagcctaatgggcctggggtcacaaagattcatacttgacagagcaacaaagcacgcgggcgcacacacacacacacacacacaatttgccattattgctaaaaaatcacctacttttgaagttagctgaagagttgcttgtagcaatttccttccagttggcaatgtacctaagcacattatataggcattcattaaattaagtcaacttattagtaaataataaagtggttcattagtacatacttggactacttctaaaattctactttctctatgaaaccatagattaatgatgataaattcactagtccaaatgcttaatttcttgacttctcatctcaaagtagctctcatgcacctgaggcaacccctaggacaaggaattgtaagaggtatgaaaatggtgcccaccatctaccatattggtgccctttggcctccctccagcacacatctcctcatgttatactgttccattctgctagatcatgtcctcaactgagtgacagctaagatgttggttaacttctaaattcaaagtatgaaggggaaatttttgaaagtcatgggaaaacttcaacaacaaaactttatccttggttctggattgccagacctactgtctctgacatgtaaatttaaatcatttggtttatgatcttcttagagcaatgatgctgtctttgctgtgtccagtaaacacgagatcatattcaagcagggtatgtgcagctgccacttgagttccttaaacagagactgacatatggagaccagagtagcctgagaagaggtggacagggaaggacaagtatggtgagctgagggaaagctccaagggccaggtttcctgtgacttattccatctcattttaggct

SEQ ID NO: 60636 - DNA, 896 bp, Bovine  19866881243072
agtatatgtgtatatatatatatatataagagccaccaaaccaaagaaaattgttagcacattcttgagccaccatgccagtcacaccatcatttccagctgctaagatgtaagtaccggtaatgacatggcttccaactgtttgatgctctgacagtcgtgtggggaggcaagaatgtttcatttagagagtattttgaaaaaagaaaaattatgatggagtcttttccagttgacttcatagactccccacacaaaacaatatgacatttaataaatacaggcctaaggaagtttttaaactaattctcattctcagtgttaatattaagtgggaattctagaattcttccttctatctttcttccagtttttccacttttcaaggcatgtaagtaacaagcatgtgataaaggaaacagacagattatgagacttttcttccctttttaaaaaatcttatgttagtgatattgtcattagcaatgttttgtatttgtgttgtattcgtctactgtctggaacagcttctgttcattcttagattcatagttcaaggtattacaggagaagagcctctatttttagagcttctaatctctcctatttctcttgatctttaatatgataactcttagatggccataatgcaaagtcatcatctaagatttttgtctgtaaagttaaatggaaatgctcatgctctcaattgtttataattttaaaaatcaataaattttatatgaaaaaattgaacctagagaagaatgtatgagtttaaaaaaataaaaataattaagatacagttgctgctccacaaggtttaccaaaatagtttaccatctagctaagggagaaaggtatgtaaacaaaaagtacagtaaaaattaattcca

SEQ ID NO: 60637 - DNA, 919 bp, Bovine  19866881331533
gaaacttagaaaccttctatctcagagttctctccacctcagcactactgacatttcgggttgaataattctttgttgtgggggctctcgtatgtattacaggatgtttagtggcaatccctgacctctacctactagatgccagtagttcacctccactcaactgtgacaataaaaaatacctccagaattttccaaatgttccttgaggagcaaattgcccccagttgagaaccatctccttaaaggtgaggaatccaaaatccaagtggtcaccatctctgagcacagacaaaccgtacggctctggccacttacccactcctcatttccgagcacattctggtggtgatacgcccactctgtacccctagaaacatacctccagcgtggcactatccacactaggctggtgtgagctccctgaggctgggaccacgcctgctcacctgtgtatccccacttccagcacagtgtgagaactccaaaactgaaagaagaaatgaatgtgtggtttttaagccacacggtgcaatgctggatttgaccttgcaggaaaaccgatgcagagtaaattcaagaacaccttgaaaaattaatttgttgactttaccaaggcatttggtaacatccatgaccttaagcttcagttttgacagctgttctacaggtttggctgccctaaaagtagtcagataatctgaggttactctgtgacagagatctggttgtctcatgtcagcactgcaaacgttagtagagtgagttgaggttggaaaaacagccttactttgctcagcatgttctatgtactatgtttaagattgttaacaaaccctaaagccagcattttgagtctctggcctctaatcttttaggatatttctctaactcattaggctgagagcaccagccaaag

SEQ ID NO: 60638 - DNA, 1802 bp, Bovine  19866880408078
tgctgttcttttactttggattgtggccctcagatgactgctatagtggagaaggtgttgcactgggatttagtagaggagggttcaactttagattttgccgccgactagtaatactcctctgggcctgtaacttaatctctctggctttcctcttttttctctgcaaaatgagagtattagaacagaagatccctgaggctggaagacgttagtatactattttctttctcattttccagatggcagtagaaacacagggagtcagtaattgtgccaggaatagtgccaacatataagataaaccacatttttcagagtttttaaaaagaggggcattcgtatatgtgcagttatacccctactttcttgcttttttaaaaaaattttaattgaaggatttataagtattgcatttactgtaagactgtacaacattgcattggtttccaccaaacatcatcgtttttttctttttttaaccactaggatcaacagtgacgatgaccgagtgtacgagccttcagttttgtcagtccttttgcttttgaggcaatgcagaaggtggatgttgttcgtttggcatctttaagtgatcccgaattgagacttctcctgccctgcttggtgcggatggcactttgtgcccctgctgaccagagccaaagctgggctcaggataaaaaactcatccttcgtcttctctctggagtggaagctgtcaattctattgttgcgctgctgtctgtggactttcatgctttagaacagggatgccagcaaagagcaacagcttaggtaatgaacattgtataatatgtgcattggtatttacttggatatgcttaaaaaaaaaaaaggaaatcaaaattttttggagctttttaggacttcttatcgcagcgcattcttccaaaaaagagaagattgggactctaaactttggagagcatttttttaaagttattttttatttataattaaaattctaggatcatttgaattctgtattgtgaaatgtgctgagaaccttggttgtatatacatttgtattcagaccttccctggtggctcagacagtagagtctgcctgctaatagaggagatgccatttcaacccttgggtcgagaaagtcccctggagacaggtggcaacccactgcagtattcttgcctgggaaatcccatggacagaggagcctggtgggccacagtccatggcgttgcaaaaacagcctgagctgacttatggatgtatgcaggctcaaatgattaggccagttgctctcagtgggaagtggatagagtaagtttcctaagagcaaaaggatttattggagtctcctgggagcttgttaagcttacattgagttccccaagtttgaggcgtgctttgtccttccttgcccattgtgggtccagttgtgagccactgttattaatggaagtgcgtgttaacctgtcagttgtgattggagtctttacacaggttgtatatctctgaaatagacaatatagtattcagaagtaacacattcatgaaatatatcagaagaattcatacattcttttgtagattatttctataaaagatagtttttatgcttttatttctgtgccagtgttctcataattgttttacatgtgtgtactttattaggcataaacttggaggaggcagtggagagagcatcctggtatcacagcttcagcatggactgactttagagtttgaacacagtgattcacctcgtcgattgcgtcttgtgcttagtgaactgttggcgattatgaacaaggtg

SEQ ID NO: 60639 - DNA, 2971 bp, Bovine  19866880647110
aagtcaaggttaagcttaaaggtcaagatctccctgctagggacttccctgggggaaaaatccacctgtcctcatggattcagtccctattccaggaactaagatcccacatgccacggagcaactaagcctgtgagccacaactaccaagcctacgctctatagcccacgagccaaaactgctgagccctcgtgcagagcctgtgctctgcaacaagagaagccaccgcaatgagaagtctgagcaccacagctagagaggagcccctgctcactgcacctagagaaagcccatgtgctgcaacataacacccagcacagccaaaataaataaacaaacaactttttaaaaacataaaagttagaaaaaaaaaccaaaaaacctcccagctagttgatggctaagtttggattcaaaacgatcacatctgacttggggcccatgctccttaatcactaaaccatatagctctgcacacacctgggatgctcggaggatatgctttctatcacgtagaggaccttagtctgcagcaaggagagagaattttaaaaaggaaagaggcagacataagaagtagagctagagttccaacagggcttgagtccttggtttgtcgtccctgaggctcaggagtatccttgttcttctccagacttaggttgtttcatcagatactccagttattcctgtaaaaatcccccctttccagtcagcttgatgtggctttctgccacttgcaatgcaggagtcctatttaaacaggaaacaagtagggtacttttgaagatcgtctaggtatgaacacccagagcagcattaaacagaacagtgatgtctgatccacactgggttggtttggttacaagaaacagagattgagtcaagttactaaaggtaaattagtcatcactaagacacaggttgaaagaagggattatagaagatctaatactctggttacctgatgcaaagaactgactcattggaaaagaccctgatgctgggaaagatagagggcaggaggataagggggtaacagaagaggagatggttggatggcatcaccgactcaatggacatgagttccagcaaactctgggagatagtgaagaacagggaagtctggcgtactgcagtccatagggttggaaagagtcagatatgacttagcaactgaataacaatagaaaaaaacatatatattcactaaattttaagtaaattgaaccacaaggcctcaggaagaggcctgcacagtggaactgcagcatagctacagtaaggaaggacactccatcatctctcagggctttttgacctctcagtgaatcagcaccactctctctagaccagccttcttcactgactttttgtacctgtctacaaaagtggccactcaagcctctggactctgatggccttccagttccaggatacaccaatattgcagctctcttctgtgtctcttattgtcggttcctgagagagcggatttcactttttctctccttttaaaccaaagtacatgaggcatatgtcactggatatagattatggtcaggtgtccaagtagccatggtcacagtcatgtggtccactgaccactcagtaaggtcagtggatagggattttattagaaactgatctgagaaggccagtaataactggcatctctaatcaggcccacttaacatataatttgaactcttgccaataagaaaaattaaacatgttgcaaacatgggcaacccattttcattaattatctcaagttggcaagagagttcgccttctggtgcttttaggcttgtgtgccatgctctacctcagactgcaccttcctcaagctcccagtctgcctgcacctaccctaaacactctctgtgagcgagactactccattcacttgggagtccattaatttttttcccccttaaccacactgaagactttgcttagtaaagcattttgaagatttagaaagtgactgctcagtctgcttaggatttatatcccaaacagatgtgccaagaagtcataggaatcaaactgctgttctgtgagtagaataatatattaacttgccttttagtagtgtcgattacacagctgtacaaattgcaatggagtcttcacagcttaagttgcttttatcaaaaatacatcacttcttcaggctggaagttttaacattgcaggcatctcgatgggcatgcatccttgcaaaatacttattatttgagaggaaaacagtccagaaaattgagatatggcagtgcttaacttaccttgaggaattatctgctctctttttgaactggatcatttcatgatgaaaataaggagtgcctaaataacagtaccatcatctcatacttctagtttttctgagtcttaatgtcctcaactcttatgtcaggatattagcatccattttattgggttgctgtaaggagccaatgagagttttataaagagctcagcaaattgctaaacataggaaatgctcaataaatggtagttactattagtaacattgtattttgtttctcacttcatgatttttcaagggtttttttttgttgttgttgttgtttgttttttagcacagagtctcattttctccttacaacttgtgggaagatatggtggtaagtggcttccctggtggctcagatggtaaaaaatctgcctgcaatgcagaagacctagatttgatccctgggtcaggaagatcccctggagaagggaacagcaacacactccagtattcttgcctgttgaatttcatggacagaggaccctggtgggcctcagtccacggggttgcaaagagtcggacacgactgactgactaacacactgtgcggtggtaaatactaatcccattcctggggcttcctaggaggcactagtggtaaagaacccgtctactaatgcaggagacccgagagacatgggtgcgat

SEQ ID NO: 60640 - DNA, 2612 bp, Bovine  19866880847189
aagctatgccagcttcaaagctctggagaccagaactctatcctatacccccctgttactaggttaaaaaaaaggaaaaaagagaaaagaaaacagctgcggaggtccaattagctcctagcagaaaggagaaagctgaatcccacttgagcacttctcaagagtaatcagaaacaaaaaaactggtagccaaagccatcccctcagagacccatagactagcaggatcatgcgtaacaagagccgtgagcagaaacgttctgcttttcagcaagaggagctggccttttaacagaggggcgggctgagagagcagaggcaaggagacctgagcgctcataggtctcgccctcgggcgtaacgtgaaccaaccagtccctccgctggagaaaagtcgggccggtggcggacacggaccccgaaaacgctccgaggccttagaagcgggagccttataccttcaggtctaccctccggcctcccgggaccccacacggattccgcgccctaccggcggggcgcggtagaaatccagagcgcggtccgaggttgggcctaggcgagaacccggcttccccagccctacagctctgccctgagtcgacctgggcaccaaaaaccccagacgtcgggatcaatcaggccggcggtgcgacgggggctggatggggacaccgcgcaaaggcagagcctggactgcagggacggaaaagctgaggcgactgtttccacccgcacgcagcaccttcattcatccccagcgtctggctccggtcggccaccgtactggactgagaggaaggctcgctgcgagaggacacccggaggcgtcggcggtgacgcagcggcgcgcgtgcgcggccccgccccttcctccgcctccgttagcgctacttcaccctggatggctgtctccagtctcatttccagagcataccggctgaatccctttagctaaatcattaagcctcttcgcgctgccgtgtcatcatcaccggattactgtggcattcaaatgacagcgttatgtaaaatgttcaggttgccgcacggttcagttggccagaacgctaaatggaaaccagacagttacacctttccgtctctgcttctgcctttccagcaccgcagttctttccagcaccgcaaatcctgggatttgcaggagaatttaaaaagtaatctaaccctgaagcattattctgctcttgatctcaaaacacagtcatgagttaaagatggttattttgggttctcaggaagcatagatccttcgtgggcgatggatggcatttcaggagttctctagaacccctgccgaattgtgaatgcttgagcttcttgtggaaagagggtccaaaactttgaacaacttctcaaaggactttggaccacccagaagaccaagtatgcaatatatttgcatattatttctggtttctggttgaatccatatgtatttaacactttctattcaccagatattatgcgaggtactgaaacaaaaatattttacagagatacagtactttatattaggttggtgcaaaagtagaggtttctgaccatgaattttaagtcattataagtaggctcagacacatctttattaatcaagataggaatcattacaataaacattattgccaaagagaaataaatttgtttattcctgtagaataaaaacccgtgccttaggattcgaggaactcttggaaagcattttctgcctcctgctgattgtggaagtgttttccttgcaaaaaagttgtcaaaatgcttgaagtggtagtcggatgacaagaggtcaggtgaatgtggcggatgaggcaaaactttgtagccccattctttccacttttgaagcattggttgcgctacacgtggtcaggggttgtcgtggagaagaattgggacctttctgttgaccaatgctggctgcaggcattgcaggttttggtgcatctcatcaatttgctgagcatacttctcagatgtcatggtttcacccggggattcagaaagctgtagtggagcagaccagcagcaaaccaccaaacagtgaccatgaccctttttttttttgatgcaagtttggcttgggaagtgctctggagcttcttctctgtccaggcactgagctggttgtcactggttgttgtgttaatatacaatccaatcaagaaatggtttgttgttgttgcatagaataagagttcagttcagtcactcagtcgtgtccgactctttgcgactccatgaatcgcagcacgccaggccgccatgtccatcaccaactcccagagttcactcagactctcgtccattgagtcagtgatgccatctcatcctccgtcgtccccttctcctcctgcccccaatccctcctagcatcagtcttttccaatgagtcaactcttcgcatgaggtggccaaagtactggagtttcagcttcagcatcattccctccaaagaaatcccagggctgatctcctctccttgcagtccaagggactctcaagagtcttctccaacaccaaagttcaaaagcatcaattcttcggcgctcagccttcttcacagtccaactcccacatccatacatggacca

SEQ ID NO: 60641 - DNA, 800 bp, Bovine  19866881711459
ccaaatttttgtagtgaatctcaaaaaggcttcctacataattagtgggagacaatgatggaagtcactcctggcatgggattttaaattcctggtcttgtgtgttttctccaaatggagcagtctcttcacacagctctaataagaggtgttttattcacattatttatatgggtatctttaactttgtattccagatagtaaggaaaaatttctacacgggaaaaatatgtttacaagataactatattataaaaagctagtttcattgtgtgtttgatgtcatgtaattaagtcaataacaaatgaaaaacttttttttggtagtcggattgcaaattcactttctcagatcaaactttatgaatcagtttgctcaattttaaagtaaataaatgcacctgggtttctattgcagcaagagagatttactcaacaagctcaacatagatgtatttgtactggatgaaatttacatattaatcaagttctaattgccttttttagccaattgtatgcaaatatatttgctggtatttaaacatttttcagaatgtttggaaagtgcccaagccaaaaacactaattaacaataagaaagcaaaatcaaaattgtttgatattttcatacttaagagaaagaactctttgaaatgatattcatgatattggtttatttttcagcccttatataaattcacaatcactagattaattttaaaattatttctcctattctctatatttcctgcatatcttaatttctgattatcattaaagtatctttgagttttcactaa

SEQ ID NO: 60642 - DNA, 758 bp, Bovine  19866882158530
acttttgatataattctaccatgaaagtggttgaactctagaggaaataattttgtaagattgatgattaaaaaaaaagtatttgtttgcaaggactgtgagttcttacaagtgtgttctttgtaagacagtgtgttcttgttttagttctaagcttcctatttgctcttttaaaatttatatggcagtatataataaggacttatatgttgtttttccttaaattgctttttcttagtggaaagtcaagagaaatagaaggatatacgaatattcacagtttatgttgaaactatccatctgagatttttgggtagacagaatcttaagttttataataaactcggggttatactttatcttcacttaatgaagtacagtaaattcattttctctggaattgatcattatgggtttccttttctttgtttgaattgcgtaattatttgccatactattcagtgtcatcttatttggtataattgtcttcagttacttacttaatgtctgttttgggtttctagttatcttaagcccatttggactaaatggcactctcacaggacaggcattcaagatgtccgattcagctacaaaaaaattgattggtgaatggaaacagttctatcctatctcatcttgtttgaaggagatgtctgaagaaaaacaggaagatatggattgggaagatgattctttagctgcagtagaagttcttgttggtacggattctgagtattaatcctaagtgggaaatg

SEQ ID NO: 60643 - DNA, 3073 bp, Bovine  19866880358488
catgcacggaaacatgcaaataatgaaaactctgcaaaagaaatccaagaagactctgttgttaataaacatgtatgaataacatctcttgacctcttccatctcgagagaaggaatgattaaagatgcatcatttaacagagatgagtatgaaaatatttataattttcagggtcaattagcaactctgttttcaccttagcaggaaatttcaaaagtttaagtgaccattttcatcttgtcaacacactttggaccactttgttcatctttcaaactcagtgagactttgtaagcttattcatagtttgtaattcactgaagcaggcaaccagttatacattgtgtgtttcaaggtgataaagatgacactttggtgtctcaactgataaagtattcagttcttccataaggaatttattatgatgttcagaaataaaaacaacaaaaccaacctgagcatgatgctatgctatgctaagtcacttcagtcctgtccaactctgtgtgaccccacagatggcagcccaccaggctcccccgtccctgggattctccaggcaagaacactggagtgggctgccatttccttctccaatgcatgaaagtgaaaagtgaaagtgaagtcactcagtcgtgtccgactcttagcgaccccatggactgcagcctaccaggctcctccgtccatgggattttccaggcaagagtactggagtggggtgccattgccttctccgtggagcatgataggaatacctatatgagcaaggctgatgggtcactgggatagacaggtgggaagggagagcttgccttacttatatttctatgttctccaaataattatagcctaaactgacagtgttgcaaataaattgccatagcttttattgatagttgtaaagtactttggtgcaactcttctagaaagcaatttgtccataagtttcaggcccttagacatatttcctcagccttcatacagtggtggtggtttaattgcaaagtcatgtccacctcttggctacagcccatcgggctcctctgtccatgggattttccagataggaatactggagtggtttgccatttccttctccaagggatcttcctgaccaagggattgaaccccagtctcctgcattgtaggtggattctttaccaactgagctaccagggaagcccatactactgggaactaatcttgagacagaaattaatccaagagaagaagaaagtcacctgttaactaaaaatgagatatatgagggctgagtaaggcaagtctgtgcgaatggagaagacgtaagagattcaagaaatgttagaaggtcaatatgacctagtcaggtgatatgggggataagtggaggacaggaaagggaagaagaagagagagcctagaatgacctccaggtttcagacttggtcagctgtcttggctcactcgtttagatacaaaatacacaaggagaaaaacatactggaaaggttacccaaggtttgcattgagtacttgtattgtatttgaaaggtctgtgtgacaaagatgctgagtagacaaaaaaaagaagaaaacggatcttggattagaagatacagatttggctggagatgcagatttggaagtcataagtggtcactgagaagcaacccaacaaaagaagtgaaaatgtatttattgagtggaataatggtcgttggtaaacattgtgagggctgtgttgatgcttaggaaaattctgatgagcttcagtaaaatatgggaataaaagacaccactgctatgattataattgttatgcatgtggacaaggacaatatgcagacaataaacatgaaaatattataatttgaatgactggtaggatgatgaaaatgctttctttgatttgctattaacattgtttttactatgtgcaacaagaatttcttgaaaatatttaccaattttacctacatgttgctgtagaattacaagttgaggaacattcttagaagctcagataggatgggcttatggggtagattttacagctgcaatcccagacttagacctaatttattgttctaaacattatcaaatttcagtattgttattacagtggaagttttacaatggtattctaaggtatagtcatttatgttttcgtatttaatgacagctttctttgagatttattgggtgaatggccaacaacttgacccttttcttcttttttttttttaatttaagcagttgattttgttgtattaatttatgctgtatagcaaagtgattcatatatatagatacacacacatacacatacatgcatttttttatattctttgctcttatggtttacaacaggatattgaatgtagttccctatgccgtatggtaggatcttcttgtttattaatcctatatataatactttgcatctactaatgccaaattcccagtctgtccttcccccaccccccttcccccttggcaaccgcaagtttgttctctgtgggtctgtttctgtttcatagataggttcatttgtttgacccttctgttctaattagagttgccagataaaatacaggttctccagccaaatttgaatttcaaataaacaacaaatatatttaaatataaaaatgtttagtatatgcagttttactatgtcttatataattattcttcactctttatctgaatttcaaataaatcagacatcatgattttttttcttcactaaatcaggcaaccaagtctcagtattaagaaggtgaaagtgaaagtgaagtcgtgaagtcatgtctgactgtttgtgacctcatggactgtagcctaccacactcctccatccatgggattttccaggcaagagtacttgagtgggttgccatttccttctccagagggtcttcctgacccagggatcgaacctgggtctcctgcactgtaggcagactctttaccatctgagccaccaggggagtcttattaagaaggtacttttattctaatatggaagcctagattcaacaggcactggcaagccattgacaactgagcacttggaatatcgca

SEQ ID NO: 60644 - DNA, 741 bp, Bovine  19866880408589
aactgtattcatctcctgtgataagcctaatggaaaagaatattatatatctgaatcactttgctgtacagcagaagttgacaacattgtagattaaaatatctcatgggaaaaataaaataaagaaagcaactcacattgactgaagggctcttgattcaggttgtaaagatccaccttcacaaatctggggtcttgttcttgctgacctctaccattttggaagggctgtaatactgggatggagcacattcaaaagggctctagtccggggtcacacatctcatcccagtactaaaccatctttcccagcaatctgcatagccaccaggtttccttgcctccctgcactgagtcagaggctctgatgctgaccacccacttccaagcagaatgtttaaagcttccagggtcaccgggcagaatcctggtacaacacttgatttgcatcattgtgtctccagctccaaacattcctcagccacttttaatgtcaaaaaggctttgattacttctgaggacactacccactcctctcctccccttggcaaacatagagatttagcatttcatttcctgcaaacaggcgctcaaaaaccagctagatgaatatcaaacgtgcattcccctaaatgacaggcactctccaaaggatccctcaaggctcaattatttgccacttctttgcttggtttcatatgttagcattccttcccagtctctagcgaaaatcataaggcc

SEQ ID NO: 60645 - DNA, 1934 bp, Bovine  19866880615383
acgtttattaaaaactggcattgacatccaggtctactgatagtacaggtgctttgtagttttcactcctcataatgatattactattacaactttgtatactcacatgttacagctcagggattgccagacaagaatggtcaaaacactatttgtaactaacagtaaacctgcttgactactactttaggtaaatacttattgtctagtggtttaggtaaatacttatttaggtaaatacttattgtctagtggtttaggtgtaggtcatctgcaagactcacacttcaaattgtgtgtcccatggactaatacatgtttcccctgtcatctcaaggcagagcattcccatgaaacctttcataaacccaaatggcattaaacaaagaaatgattaccttaggaagaccttgctattgatgcacattataaattgagataactcacagatgcttggagatacagttcaaagctctggcaatttgatgctgagatgctgaaggcaggaccgaggtaggagcttagtggggccgttctcactgctgggggagggtgtgggtgtgctgccttggtaaagactccctgcaaacaaacactgaaggtattttcactttttgctctttttcagaaaagcaaacatcctctttggatttcttttggttagccaaaataagtattgacatagccctttcataaaagtgaaatggcataaagagaattttcagaaagtgggggggacctatattgatgtcaggcttaagagagcatgatcacgttttgtcaaaatctaaaggcttttacattcaagcagaagttcctgacttttatggagtcttctgtgatttttacccccacactctttcttcttggaactacagacaaattttcaagatggaagtaagctaagtagtaggcttttcatttttccaatgaccctgaaatgcagagtttccagtgactcgtctaagaccatacagctagctgatggcagggctgctcagcctggattactctgtacacaccaaggtattccatttagtttccagatcagggaagcggcctaagttatcttttcctctttacaaccaaatcttcatgcagctaagcacagacatatgcaggcattcaacacacacacactattatgtttttaagggctttctgttaatcactgaaatctgtaattcagtccctgtttggaaacaattcttttctcagtgactttggtgggggacaggtatatattgtcatgtaactcagcacatgacctgctttggtgaccttcttaacacctggaagcacatttgtagctcgggaaaagtgtgcactttgtagattaagcagcgattattggccatagatcacagaaagttgtcaaagctgatgaagggtggggtatatggaggcgtcaccaaaaaacacgtcttgcatcaaattgtcttccccaaggatcaaagattttgcttacacttgttttaagttggttccatggggtctgttacagaaatatcataaaaatgctggggaaaataaaaaagcctgtgtttagcagtaccactggagaaggcaatggcaccccactccagtactcttccctggaaaatcccatggacggaggagcctggtgggctgcagtccatggggtcgctaagagtcggacacgactgagtgacttcactttcactttttattttcatgcactggagaaggaaatggcaacccactccagtgttcttgcctggagaatcccagggacaggggagcctggtgggctgccgtctatggggccgcacagagtcagacacgactgaagcgacttagcagcagcagcagctgtaccacagtctgtgttcagtgctgaaaaatttacataatttgtaatcctgacggaagcaggaaatacattcttttctgtctgaagatatcatcataca

SEQ ID NO: 60646 - DNA, 875 bp, Bovine  19866880676496
gtgctgatgtaaaagcacttcaagttctccatccataaacactgctatcctcccagagcaagaaacgggtgattttctcaagactttagtgtcatttctttttctttcccgttaattattttatttattttggataggggaggatgtcagtttttcatgttatctatttttgaatgaaaagatatgatttttataacaggtacagttttcctttaatctttaagtgcctgcctttaaaatgattcttagaattgagaccctgaccacttgcccttgttaaatatctggtgatccttctccccaacagatgggaagggcctcctgatatgcccctggcctcatttcaatgtgggtaattgcattctgtcaacttgaaatttccccaccagtttcatctgcctgggctctgatgcctcgccctcagccctgagctgcctggcgtgccgtcggaggctggggagcagctggcgctttccacccagaagtggacacattttagtggcaggtgcaaaggttttctttggctgaatacaaattctgacctaggaatacgcttcatggatgctctttattttttcaatggatgcaagtaactcctgggaaaccaaaaatacaaaagtatttaaggcataaatttgaattggaagaaaaatacacgttcactaaaaccagtctattgtgtgatcattttgcactccatgaatcttgccaagcttctagatttgacagtaagaagaaataaataacataaagtaaataacctttccccttctgaaaggaagaattttatgcaaatctacacatacatgcatatacacgcacaatacatgtatatcccaactcttaacctctctctggagagtctttctcagttt

SEQ ID NO: 60647 - DNA, 1158 bp, Bovine  19866880686940
ctcgatctgtgggtcaggaagatgcccctggagtaggaaatggcaacccactccagtactcttgcctgaaaacaattttatggacagaggagcctggtgggctacagttcaaagggtcgcaaagaacttaacacaactgagtgactaagcaaaagaagccttgatggatgggaagagccaaccaatagtttgcttccaccataactaagaagctatcctggaaggaaaataatgaagcacgacagacatcacagttgcctaaattgtattttcaggagggctgaaattccacatcaggtaattaacaattctccagcctgttttgaaaagactctggttagaaacttccctgggggtccagcggttaagaatctgcctgcaaatacaggggacacaagtttgatcactggtcctggaagatgccacatgctgtgggcagctaagcctatgatgcccacgttccctagagcccatgctccacaacaagagaagccccactcgccacaactagagaaaagcccacacactgcaacgaagacccactgcagccaaaaagtaaaataaaaaaagacttctggttggagttgaagttcttcaagagaggtcttcaggtcctgggctgggagtcagagacagtaaccactggggtgtctgtattctcttttctgaaaagccccttatggaaagaaggcaaaataatttgttttactcattttctctgtgattacatgttgaaaaatttaaattatcctttttggaaagagacaaagggaaccacatacatgaaaattttggcttatgttagttccagaaaaggtgccaaacactggtaacatacacaaaagaaaaatgttacctttctaatcagcagaatggttgcacataatagctaattgatttggggctgcatttaagacattagcctcaacaaggggaataccatttatagtctttatgaaattaaaaatagtagctctgattggaaacttcctctctgtcagcaatttccaaaagaagattcaggactggtgaactgaagtaaaaccaaggacaattcctagttgttcaatgaagggaaacgtaagtttttaggagtgtctgctatgctttccaggaatcaaccaactactgccgtgtgataaaactctactgaccaca

SEQ ID NO: 60648 - DNA, 1825 bp, Bovine  19866880705285
acaatgtaacaatgggacataatagccgccttcctattacattgtcgtgtccactttgtgccgtttgccaacacggattctcccattgtctgtccacggaggaataatggaccattaagaagcgcagtgcagagggtcagcacagcatttacctattggagaacagagaagccatcacatgcgtctctctaggtcaataagcaagtatgggtgtgaagaaggtgcgtcaaaagcccattctgctcccaatttttacacgtggagtcagggtgcaggctctagtgctgagaagagcccatccactcatcaactcctggaaatcaattttgtttcctgttcatcctttttgggaaccaggcaggaagtaaatatgaaaactgtgccattgactgaacaagggttcagtggggtcctcttctgagttctgaggactgcgctatgtggaagaaaagacagacaagatggggattacctcctaaggggacaaggaagcccggaggagaagcggcctgtaacgccccatgctcctgaagtgctgtacacggtgtggtgtgtgtgtgtcaaaccacagagaccgatagggcacagcggaatgctggaaggagagagcttatttctgacgggagataatggagatgaatctgagctctataaaatgtccctttttcttactctataatatctttctcagctttattgatgtgtgatttacatctgatcaatgccccatttccatgtatagtctgatgagttttgacaagtacatccacctgtataccagcataacaaccaagattgagcactttcatcgccctcaaaggtcctgattcctccttgcagtcatgcatccccagctgccagccccgcagaccctgaactcccccgtcattacagatgcacgttgcctttcccagaaactcacacaaagagaatcacaagcatgtacccttttctggttttgttttttgctcagcgtaatgataacctttagacataagaaggaaagggaattttagtgtgagcaaagatttagggtcaggtaattaaaaggtgagttcaaggacttgcggggacagctaagttagactaaagaggcctgggaagggagacacacgacccagccatctgacctcacacagcctagaacctgtgaacaattgtacaccaaccctgcaccagtctcctgctctctcaggatactcagaccacactgccgcaggacatttgcacgtgctgttcccactggctggaatggccctctcccagactgcacacacctggattctccctctcctccttgggcctgtatcaccacatgttcttaaagcccttcactgcactaggcacaatctgtggattattttatttatatatttcactaaaacagactgtcaagaaccagataatagagaacaggatggttctgctcataaatggacaaatcaccaagacttgagagacgctttctggtttggttcatcttagccactgaaagaatgaagaagcgagtgagtgaaagaatgaatggtaaatgtgtaagaaatacctctgttttcacccagtcacatatatcacctagggcactgtaactcacacaacactctgtgacaaacaactctccacctttcttcttctaaaacacccttgtgtcattatataatttaaaggcaacagagtcttgtaaatttgcaataccaactcccagatggcagcatcagccctgatctatgtgtgtgcattttggggcaacaagacaaaataattaacatccagaaagacctggaagaggctaggtgtcaaagtcaccaagactaaaagacactaa

SEQ ID NO: 60649 - DNA, 1536 bp, Bovine  19866880766740
aatgtgtacaaattactctttaaagagaaagtcatggagaaaaattgatgcacttaacaatcacagtgagttgtaaatattttcccatgcatatttagtaagaacaataatggctagaacaatcatgaatgcttatttaacagaatgagagtcattaagatcacattttggttagttttcccaagtggatgaaggttaaccaaactctctgaaactaagagatactattatttttccagaggacttttcggcccaacaaattgtcttaaggaaatctcctcctaagtgataattgtgatctagttgcttgccagctgagccccacaaaatgtgccactaggacagtaacacagagtaaatagaattttcatcactattttattgagagagttgtgaagtcaaaagaaggtgagagaaactgttggtgtaaggcctgcttcttaagaatgatctggactaaaaagacatgatacaaatgaacttatttacaaagcagaaagagactcacagactcagagaacaaacttgtggttgccaaggggaaggatgggggaaagggatagggagcttggtaccaatgtgtacacactgctatatttaaaatgggcaaccaacaaggacctactctatagcacagggaactctgctcagtgttatgtggcagccctggatgggaggggcgtttgggggagaatagatattatgtatggctgagttcttttgctatccacctgaaattatcacaacattgttaatcagctatactctaatacaaaataaaaagtttaataaaaataaaaagtatgatcttgaaacacccttaaatgtctgtgttcaacatcacttgacttgtgaactcagcttgtactggtctgcttcaccaatgtttctctccggatgacttaccttccatgaaaccaataagtggacctttcaaaactaaaagtgatcaggataacaggtctttttagtaacttttgtttttacaaggttcacataaagttcaataaagaacagacagaaccatgatatcctgatagaaattgtatcagggcctgctgaagggtagggtacagagcattgcctgggagcaggaccgtgggaagtttttggaaggaagggactgtccttatatcgattgccatcgcgcacacctgcatgctgagttgcttcagtcgtgtccaactctttgaaacactatggattgtagccctccaggctcctctgtccatgggattctccagacaggaatactgcagtgggttgctatgcccttctccaggggatcttcctgactcaaggatggaacctgggtctcctgtgtcttctgtattgcaggtaaattcttcacccagtgagccacctgggaagccagactggggtggaagttaaggttatacacgtgtgtgtgttagtcactcagtcatgtccgactctatgctaccctctggactgtagcctgccaggctcctctgtccacggaattctccaggcaagaatacggagtgggagccattcccttctccaggggaccat

SEQ ID NO: 60650 - DNA, 4971 bp, Bovine  19866880779030
atataaattttttcttttttaaaagacaccttatttaatatacatttttgatccattaacactgaactcattaacatataactcatgcctgaaggtagcttatctaacatacatatattctccataaggcatatcgcggccttctcatgctagctttagcactccagcactatacttgggagtgattttaaacaacaaaatgccaataaaaggcacaaaaatgtgaagaatgttgcactaaatagactacaaaaaggacacttgtttacggcaggggagctgaaaacaagaaggcagagtgtcaccgtgtcccactgcagttgggaacatgccctttggtgactcaggcttttcactgctctgtgcgtgtcagcaggtaaccatggaagcaccacaagtaatgatttgggaggttacacataaattttagcaagtaggcaaatttggaaatacagaatctgttaatagtgaggatcgacgctatattcactatttggttatccataaaatacaagttctttggagtttttttcccccatttgtatgtacattaagaagtagtcttttgcgtaatttctataaatgaagttctttagtagattcatcagtcatttgagagcagagtcctgaaatagaatacttagttgctagcatcttgcttggaataaaacagaaataaacagttgttctacaatgttcttattaaggcatgattgggatcagtacctggtgccatctgatcatcccaaaggcagctccattcctcaaggatgggtccttcccccgctccccagcaacgacatctgggcaaccgctgttaagctgcattagtaaaagacgttgcaggagtgtcatccagccaaggctccttccagctctgagtatcagcgatgctgccgtcttgtacagtagaccaaactctgtgtggcattgccctgcccagagggtacactttccttccgtcctctgtctcagccagaggtgcctcttaaatcgggagatgaatacgattcttcaagaaaagacccaggtggactgaggttatcatgacaggcactggccttggttcaccgaatttgcctctgtgttgaggggcttcgtccagagtgactcgcaagtttactcgtacctttcttgcgtgctaatgggtaagtacactatacacgcatatcctcgacacaggtgtctctgggtaggttagcagtccttcccccagtactgcttggtaaggcaagcctgatgcaaaatctccttacctttcttacccaaagacccccctaacttccaggaagaaaagtcagcaaggctttatcttcagttttgtgaattctacttttggtgcagctggagaggctaggctgccagaaaagctggtggcctcactgctagtcatgtagagaacttggaaagcctgcagagtacttgtatccaaactggactgtgttttaatggaagctggctgcatgtcccccgtgttagaaggatcctaatgaaagcacctgctttttaagttcctaaaggtctggttgttcacaatccccaacaataaaaattaatttccttatgggattgggaccctgatcaacttcactcagtcacccaccctgtgggaaccaggatagtggaaattgtggaattttcttaggaacttaagcgtccaaaaatatacatgtagttgaagtggggggcaggggggaagtgtattgaaataataaaatttattttttatattcattaataaatgctgttgtgcctggagatgatcaatcatataacattgtccagtttttttctttggtttggttttccttttttgtcattgtgttatttccaaaaagctaaataaataatatttttattttttagtttgagcctttgccctcaatttgttgcctcccaaatcactgcacactctttctcacggctgtaacacacacacagtataaagttcacatttagtaactaggcatttgctccaggaaggcagacctcaagcactagactttgtatgtggaatccagctctggataagcaggaaaggacacctcagctttggaagtgatttcatgtaattggaagcacttgggtacaagatactaactaacatattggtcccttttttgtttcattcgcactgttgagtttctatattatgcattacagagttaacagatagggtgtgagtgccaccactcctccaaagtgtgtctaagctcataagcctcagaatctgacatggtcaggctcacataaccccacaggtctgtgtgcccttttcttataaatctccaccattttctggtgagctgcaggacaagtagaaataaaagatgaattgtacaatatatatttggttccagagagccttgctttgaagatacctgcattgatgggcttagggagtgtggagcagggactcaggaaaactcaggcagtggaacccagggaaaagaagacacagtctcaggtggaaaaaacaattccctctttcctctcattcggcttctgcgaagttttaataaagtgagcattatttttgttatttgcttggttttttgttttgttaagtttttcctagtttattgccctgtgtcgtggtggtggcagcagccactggtacgtcatgagttcagaaagaagacttacagtagtgtctttcacaaactgtacttcggacaatatggacagtatctctgtaatcttatcccaggtcttcttttctttcttttttttttcaattgtggaaaatttaaaacattgaaaggtagaatggtataatttttttcatcatctggcttcaaaaaatggtcaactcctggccaatcttgttttatctgtacccctaccaatcacactggattattttgaagcaaatctcaggtgccatattacttcataagtgtttcagtatatagctctaagacattaaccatagtgctattattgcacctaaagaaataaataactccttagtatcatcaaatatccagtcagtgttcaaatgatctcagaaatgtgtgttttacattttgttccaaatcaagatctgcatgcaatctatgcatcagtgttagctgatgtgtctcttaagtttctcacaccctgtaggtcttcttcctatgtactgttacactttcactctttcgctcccttgcaacttattacttgaggaaatcagatcatctttttttctaaagagttcccagtctggatttagctaactgcatcattgtgattacatattcctctgttcctgtatttcttataatttaatgattagacagaactgtaccatagccatctatggctgttgggcacttgaaattgagtttgaactgaaactgagtttgacttgagatgtacaattacacacgtggctcataaagttctattggactacgctagaggtttgatcacattaagatcaggattttctggcgcaagtatgtcgtagacctggtactaaatacaggaggactaatcggttgtctccttttgtgattttagcagccattgttattcaagactcacttatttggatttgcaaaagacttgacagtttaattgtgcccttctttacttcagctgggatattaaaaggagaagcatcacctcatcaactatttgattacacaggaccaggatttgtataggaaaggcaaaaaataaacacatgattttatttactagtattcaaaataatgagttgcatcctctaaaagttactagtaaattttgtttttaagtgtcattatgaattcggatctaaatgggtttttctttcaacccattgttactattttttattgatcgcttcttgtttggccagtgggagcctctttaactccgatcctgagttcccactctatcccagtatcctgttccaagtttacctcataggtgtagcctatactgggcttcccaggtggtgatagtggtgaagaagctgcctgccaatgaaagagacataagagatgtgggtttgatcccttgattgggaagatctggaggaggagtggcagcccactccagtattcttgcctggagaatcccatggacagaggagcctggtgggctacagtccagtccatagtgttgcagagagccggacacgacaagcaacttgccacacagcgcaatttagcatgcagcatatagcctatattctctatgtattgaacatatataaatgaaaatagagaattaaaatccttcaaagactaaccagaaatgtgttaattcatcatgtcctatatacaagaaatttatctcgacaaattaacaggagacactagatttgtgagaaactcttaataagagcatttaagaaattagataagtacagggaagattgggaaataaaagagattagttgtatgttaaatactaagagtgttcagtgggagtgtctgagtttatgacgtcaaagaatttgctatagccaaccaatttaatcactctaaagccattcatgctcctatgtccacgtgatttttgtgcaaggattattgagaagcttagctgggattataccatctgttgtagcaatttacttccataaattttgtcctcagagacgctatcttgggaattacaaggtaagtgcaaagtatgtcttattccattcaaataagaataatatatagaaagagtgtgaatgctgtgaagtattagctgtgacataattttgggagtagagattacatgaagcatttccaactaaatttttttaaaaaaattacttataaccagctattcccacataattaactgtttacttttgggtgtacccattagtagtttctgatttgccacacctgactgtccatgaagaatttgtttccaatgaaggttccattttccttttggaataagctgggtttttcttagtctctgaagcaaagattgaagtcttggaggcaactggacttagaatggataactagaagagcagcagacacttttcaactt

SEQ ID NO: 60651 - DNA, 1620 bp, Bovine  19866880815588
attcaggatagagaagagcagaatactgacccctgagttaagaagcctatccaaggggtgatttccatgagcccagattcttgcatttttcctgtacacagaaaaacactaaattcgttaccttgagatgtctagttttctttaattaacagttatcttttgatgttctgactactggggttttgctgcaaaagctctgtgggtataactggcttctctcttgtctctttggagcagtctgtcagagctacctgagaggctgtcactcacccagccttaagtcctcagcaagttcaccaaacgaaacacaattttcaactttcaggttgtgcttcccccctccccccaagaagcgattctcagaaaaccagcagcctcatgatagcaggagggaaactgctgaaattcacattctcaggccccaccccagaactagtgaattgcaacctcaggggcccagacatctgtgcttccacaagctctgtgagtggtagagagcagtaggaaagaatctttccttaatacctaccactgtttttatgaatgagattcacacacaaatataatagccagtctacttcttcacatcagtatccattccaggagattcttcatctgaagcttctaatgtaaagtgtatcatttttcatatcttcaatgaccttacttttcaaaatagtttagttttttctaacagtagcaagaagtaaaaaaaactgttgagtgatttaccaaccaattcccaacttgaacattttattgaccaaaacctaacatatttttatgtcttagccctggcatctttcttttttaaaaaactgctttcaaataagtatttattttccaatgttctgttttccctctttcacaaatcaagacagttgatagtagcaggggcagagtggggggggtggggcgcttccctaatctacaaactgccctgtccactgattatgtatgattatgttatgcatttgtgttttgtctaatctgccatttcctgttgttttgtatttgttcccaatcttcaaaaccgggacaaaggcaaataaatactatctgccttgttttcctcttccaatattttagaggttggaaaatttacaaaataaatatccactcgaccttcttataaaagcattgcaaaagagcaaaagaaaaactgagtaatagtttccctaatttaaaaatacccagctgaggcacaatcaaataacaaatagctgcactgatactactttgacaataatcagcaatctgaaattaaggactatgattcttaattcattatccattattcatattatttggaggataaacttaaatatgtttaattggtttgcacagaaataagagagttaataacataagtgttggtaggtagtagatgaatgaaaacattttggaagggcatttaatcgctaccatatttcttgggaaatagaaacctacttggtgactgcggttcttggccttggtgagaaatatatttagtgggctcggaaatagatattttcaaggatacgaaaggattagcccttctaatcttccaattacctggtcccagctgaacttatatttaccaaacaagaactggccagaaaagcttgcaactagcaa

SEQ ID NO: 60652 - DNA, 1821 bp, Bovine  19866880866682
tcttttactgcatacccatcttcacagcgttttcagaatcctagctataaactgtcatatgggcaatggccatgtgttctctctggaattttgccaacacagaagagctgagaaagatcttttcatctctgattcagacgaattttcaaatcacaaaaatcattctggcccttgccaacccagggtctggttactgtcagttaaaagaagatcgtgtttactcctatagctggcacctggttctaggaagtgcagttgatgagctggccactgaaatctcactgccctagtcttgaagattggagagaggggaacagagtgagcctcacttgtccatgagctccttcactaactccaaaatgctattagagctggagcgtgaactcttcaataattaaagaggtaacacagcagaataaatcaacagcatgccaaccaaggcaggatttgtgattcatgtgtcattgcattttatctccaccagaacgctctgaatggtattgtccctttgatggatgaggagtttggattcagagaagttggcttatgatgttcacccagctaatagaggcacagaagacacaaattcaggcccatctgagtctacagattttccacgctcattgatggcactggagtagtggtgtgtgtaattccccaaaggccatgagatttcagagcctctcccacatccttcctttctcaccacactctgaggacttggtcatcatggaggcattccttctgtttattctgtcactgatcccagagttagaccctgtggttatgggattgcctgctcatagctctcttgtggctaaaataaagaaaagcgtggaagagaagagctaagtggggcacttagagggtatgaaggaaggagggagagaagcagccactgagggagatgactctgggggtgcagctgcttagtgacctcacgcttctctcgagggctaaagctaggctgcctccctccttccaaactagcccagggcaatgatcgcttcacacatgctgagcaggaatggtcaaagttgtgggcaagcattcaacacaggaccactgaagacccaggtcagtttttgtgatagcaccgccacagactgagaactgactctgatttatgcaaagaaccctgagttattatggaagaatataatcagtatttgaaataaatttaagtatggaccacgggaaacatgttagtaactcatgctatggcatgagcctggaagtggatatcttaggccatataggcaaaggttaattaatgggcactcagagcgggcaaacttggaagatgccaagacacttggccgttgtgtgtgtaaataggcatctacagagcatccactggtttacactgccagcagtccttcccttataaattggttggaagtgcaatattgcatttgtgttcctaacacatatggggcacccacatttgaaaatgaactttgcacaatttcattattaaacactcagcaggcttcaaagacaactgcatttcattaataataaataataaaaatgaaaatgcagtaaaatattaacatatcaaacacctctgtggtgctatttttatgcatgcaacatcttcctttcccaagagatgaagtccctgcctgattgcaagctaggtatttagcaaagcaaataaactccttcagaggagcctagaagtctccactgcagccctaggtggtaaatgagtgtctcattatttttttaatgtttttttggtaagtaatttcaaatacagaaaagttgtaagaagagtacaagtagtacaagagatgtaagagaaggtccaggagc

SEQ ID NO: 60653 - DNA, 2143 bp, Bovine  19866880992774
tgccagccatttttttcctgacaggctatgtgtttagagcagagggaatgagtaatggatattccatagaaagtttccatgcttaatagccaaaggatataagagccgtgagagtgtgccaacgcataccgacttctaagagcttgaaatactcccttcttgtctttgttgtcacaggctggttgaattatatttatggaagattatgttgcctttaccatttcactggacccctaaaatcaaagatgaagacaataatccaaaagctctgaaatcatccatgaaatttattcattctttattaaatgaaaccataaattgtttttcttctctaaaaggaataattctgcatacttgattcatttgtacagagagggatagaacccacctagattgtttccaggaggggtgtgaataaatccatttagcagttatagatttataactgtgttacctgcgttttaaaattatttctggggacttctctggcagtccagtggttaagacttcatcctccaatgcagggggtgtgggttcaattcctggtcaaggcactaagaacttccatgccttatggccaaaaagtcaaaagataaaacagaagcaatattgtaacaaattcaataaggcttaaaaaatgatccacatagaaaaagctttaaaaatgttgaaaaataaaaaataaaattatataaaagtatttctgggtaactaagtaggaggtggtgtacaagaacaaagttgaaattattccattttgtttattatttaattttctcccttacttactgaaggggagtatttatatagcaagtggggaaagtgtaggagatttgcattacaccccatgaacctggatgggggaatagatgctctattttgttatatttttcagtagccttggtctcaggtagcctcagcctgcttggagtggggttttagtttctagccagagattcagcccaggtcatggctataagagtactgaatcctagccactagaccagtggtcagtgataaggccctgactctttgactttgcagggaagaattcccacaaagatggaaagtactgaagcaaataaactatttattagacaggaaaaaaaaaacaaaaaacaaaaaaaacacgagtatggtacatgtggatagacacacatgtctatccagtctccatgggcagactcagagggtctgtgcccttgaaatggtttatattacttttgggggcatttcttccagttttccttttgatttgcctggttgaaagtccgtatttggtacatcccaagattctcccatgtgtgtgcacgcatcttttagccaaagtagatactaccatagaggcctcttagaatcactcccctttgacttctaaggagcctactgtgcgtgtcgtcggggaggtctcctgattgctagaatgagaaatatgtggtttgggcaaggtccgtcccccactcttaattgtcctgctattcttgttttggagcttctgtccatggggaatgaatctccaatcactttacttgggttgggggtgaggggatgtctacctcctgcctcagtgtttgcagggtttgcagtagcccctactgagggacagccctagtaagtgacactgacgtgtgcctgggtggaatgtgtatgtgtgagtagaaccatttgatttccagaaaagagcatacctacttcaggctggtccaccaggaaacttaaaaagaaacggaagaagctcaacaccatgcaaagcctcttttctagtacctgttgttccaaattcagtgcagactaaagtaaatgctgtgaaatttatgagtgtgaggaattacatcctgagagtcacaggctccttcactggggtgggaccacagtctctagagcaaggagcccaaaaagcaaagtgacttgaaaaacacatttatttcattttcaaatattgggattaggtgaagtgaagtcgctcagtcgtgtctgactctttgcgaccccatggactgtagcctaccaggctcttctgtccatgggattttccaggcaatagtactggagtggattgccatttccttctccaggggatcttcccaacccagggactgaacctgggtctcccgcattgtcaacagacgctttaccgtctgag

SEQ ID NO: 60654 - DNA, 899 bp, Bovine  19866881272243
gggtaaggaaacaggttgtcacttcaaaagattccactggattttctggatgcttccagatccttccctgctgcaggaatatttcctgatcaatggtttcacacccgcaggacatgggccagacagtccccagagagccaccgttgcaaagtcattaaagaaagaaacatagtcagatgaaatcaatacgttttaaaacctaactactggaaattctcacagacacaatgcaaatgggctctctgaattctccaccctagtttctttctcagcagttttacagacaggttttttttttttttttttttttcccctctccccagttgaacaagaaagaacaaaagtagattccccaaaggaggaatcattcgtactaagtttctttatgtaggtcacctctgatgtgttcttggttgcatttcaactgctgaattccccatgtcaagctttcagttctgatggctctgcacataaattctactgctttccaaaagaataattaagttccctgtttgaaagttgaaggattctatatgtttcacagatgctcagtacattattatgttagtagtgtgatacaaaatgctggaatactttacatggaggtgtctctgggtatgtacaatatgttaacaggaaaaaaatattgttcattaagctaatttaaggagagttactatcacctatattcaaatagactgtaaaagtatgttctttgccacagccagtataccatatgccaggccagcttccctctccccttctccagatttatgtcttgtaaatatctcttgagcccatgccctctgctctacttcaaatgtcattgtttcagttcaaacttttgtcaaactattctatacttttcgtcctcagatccattttcactttaccatcaa

SEQ ID NO: 60655 - DNA, 1327 bp, Bovine  19866881277196
gtctcagattctgctcagagcctggtgtgaagttggggtcaggtggaggagcagttctccccccagcacactgactttaagctgaatttccagccatctgcagctggacagctgccccagctctgaacgtctagctggagcccagttgtgccatgaaaagagcagatgcttgaaagcacaaggctcagcgggtcggcagagagagagggaggctcctgtggggccgagatactcttacagatgtgaatgtacagatcctgcaaaaacaaaacaaaacaacccttcttcacacattccttgcacatgaaaacacagaaaatcttgcagagggagggaaggagtttagaatttccttcatacttcctgtcccagatttgcattgatagttggacttggtaacttgccagttaccaaccagctttgtacatttcaggcttgaaaactcccaagtactgttttcctttgagaggctgaaatgtacaaaactggttttctgaaaatcttccagcaaaagaatttttagaaataactccaaaaatttctttccctgtaggagggtgatacgatagtgtggaacgatgatccatcgtgtctcatgttagaatgtatactattgtaattggtttaaaaagaatgtgtattattgtaattggttttaaatgagagaaacaaaataagaagctaccctcccttttcagtttttttttccttttactcttacaaatctttgttactgttgaagttcttttctctaatgtagtcatcattttcacaacactatgtctagtgcctactaaaaggagtagaaaggtaagaaagttcatgttttttttgttttccgaaataatcccaagcttaagagaaacaccatgtatgttgctttgaacagtatctttccaacacattttcctttcactttctctcaatttggaaaaaagaaaaaacagaatttcaactcaaaaatatttccatgaagtaataaaatgtagttgagtgttggaggtagaggccgtgtgaggaagaggccaaagagaagggaggatacacgtcatttcagatctctctggctccaggaattctgaaaagctttgtttttgtactaatatgatttacacaatcctttctgacattatcagtctctttggcagagagagggctcggtcacaatgatgcccgtgccagattctaagaaaaccaggcttttcctttaaaagaaaatctttggagtgttggacttcttattcagagtaaatggttgatgtttatccaaaattggcttcgagtactacattaaaattgtgttttgtaacagtctcataagccacag

SEQ ID NO: 60656 - DNA, 1093 bp, Bovine  19866881314761
tgatcactggtttatggatgtttcaacaaatcatcctcaatatttcttttcatttattgacttagaacagaggaagaaacataataaaataaagtgcacttttatccttcctgattagttataatctagttgtagagaaagtgcattacgtcctttatttttctagtttcaccaaaataattgagtaagaattgggaaatattatttgtctcttttctgaaaaacaaaacaaaaaatattttcttctaagagtaatacatgttttttataagaaaaaaagtggaaaatatagaaagaaagaaccagaagttttaaaagttatatatcttttaaattttcctatgctttcttggtgattaaataacatttttttgtgttttcctgattataaaagtaatacatgtctataacagaaaacatggaatatagagaattctgtaaaatataaattatattgattatagcagtgttactattttgacacactgcatttctgcatctacttaaatatttgttctgtcttgtctcccctctgtcacttatccctctgtctctcacacgcattgtatgttgctttcttaacatatcacaattgtttatcaggttattaatggttttcttgaaaatgagttttagtagagattcagtacttcatcatatagatgcaaagtaatggaatgcttatatattaggattaaattattttttgtggaattttttcatggaataaacttcaattttttgaattatgttataactttatccataaactggaataccaaatgaaattagtaagcttgaagtaaatatcatatattcaactcaggaatagtttttacacaattttcaccagaaaatacatacaagtaaattctttttcagcttttccatgtgtttccaaacatcattttattttttacaaaacattccccccactgttggacatctgggctgctaattgacctttacaattgcttttgatgacttgatcaaggatcaacatgattttctagtaaagactgacttctattttcatttttaaagccacagaaacagcaaagaagttatcaacaagcgtcacagctcaccacac

SEQ ID NO: 60657 - DNA, 931 bp, Bovine  19866881364942
acttgagaattaataccaagaatcttgcaggaaaaataaaaaagagaacacactaaacaatacaccacgtggtggtgaggcaagctgtaatgtttccttgcagatccatactggacaaaagctgtctcatatttctaatgccgtgacatgtaaaccacgctgcatatacacgctttcaactctggcatttagaatgcatgtatatgagcagagggccattctgacttcccatcttttcattacaatctctgtagcagttccaaaagtccttagctggaggatagatttggattctgctgcttttctgctctccacacattcaggtaaccattccaaggctgccaaaataccactggagagggaacttggtttctgaaactagcagtaccctatggtccttccccacctacaccctcatgtcctcagcctgccttttgtctacagttgaattttagccaaataataagtttaatcagagaagtgcaaaaacaaagggagacagttcaacaagactaataatagtttagtcattaagcaaagtcaagatgtttagttgctcttcatgggctatagatattgttcggagtcatatcctctgagctgccttatagagactaagacctccaccaggtggaacaagttaactacatgatgatcagactatagccataagctgccacaattctaagaactggcttgaaagaaatgggagcaaaccaaccctggaaatgaaagttcaaactaccgcacaattgcactcatcctacatgctagcaaagtaatgctcaaaattctccaagccaggcttcaacagtatgtgaaccatgaacttccagatgttcaagttggatttagaaaaggcagaggaaccggagatcaaattgccaacatccgtggatcattaaaaagcgagagagttccagaaaaacat

SEQ ID NO: 60658 - DNA, 2230 bp, Bovine  19866880488909
cgaggtaggggctgacttcttccttaaaatgcaatttttttgttttttcccctcacagatgtcacgaattttatttccaagttagatttcctctctgctcgtaaatgtttattgcagagattcccaaacagtctcagttcacagcaccctcattatcaaagtggcttttttcatggcgtccccaggccaaaagaaacactaagtggtccgtttattaggtgcttaaggccaaataacttagtaagtatgtataacctaacaatttaagaggcatttgaaacctatgtatgtaaattcaaagaaaaaaaattttatttttaataaccacagttcttactaatggagcgtgtgtgcctattggacactgcacagcttctcacatttgaaatcagattgctcaccggcattctcatttcctgttccacactgattttcacccagtacttggcttttatcacagcaaccccacttcagagagatatgacatcatggaaaggaatgtagcagtctgaggtcaaaactacggtttccgacagatgtcaagtattgtgttttccttgaaaattgaaaatgtcccgtgacacccctcggggttttctggggctcctgggcatgccgtttgagtacagtgggtttattgcatgatttaagttttttttatttgaaggttataggtggatttatctttttaattttttgaagtctttattctaccccagtctgaaacagcatgttctccccaagtctgagcaatccaaggtggtttctcgtaagtgacttgatagttatgtcggaatgtttcagactcaagtttacttttacactacatggcctagttctttaaaggagaggtaactgaataaaagtcttgagccaacttcctcacagaaaaaacaagtttaaacaagtgccctaaaagcagtctcctttgaagctgagggcttacctttattttgttctttctcaccaaatctgggtcttggcttgacctttgtttagcttctccatatacgaactcaactcccaacatcaatagcgtgagaaatgctgattcaagaggctccctcataagcacagattccgggaacagccttccagaaaggaatagtgagaagagcaattccctggagaaggtaagttcctttcctgtaatttcggtgttttcttataactgatggattcagcccaaagtaggcatgcttcatgttcgcatgttcatcaggttggacctttttttccctttctttctgaaacaactcagttaaacctggggtagtcggtcagagtatgatctaagggtggggcccatcccctgcacccctctattcctgttccagcatttcatcagtgttcacagtgagcactttggttctggaagtttagacagatagggaaatcagaatgccacttgctaagaatctccacggtctgtgtgccagagaacagtgtttataacacagttacccatgcaaatgggcgctggatccaaagctggctccagaaaagattaattatggatgactcagggataaatccttattgggaatcactccattcaccctgtgcccccaacacaacacatctgctcatattgaactatttttcttgaaataacaaaaactattctgaattttgtacgcatggataaaacttagatttagacctggaaccatgatagatgagtctcaccttggccactgttttcctaagttatttcaagttataggcaagcacggtgtatcggtcaacaggtgacccacttagggatgcattccaaattctcagacacacggaggccatccttacttggaatcaggtgcgtaaccttaccatggggttgcgggtctggcctctccccgatggtgctcagccacggtcctggagccatgcggacatctccgtgcaggggtcatgacctgtcgaacttttcccttgaccctgacacgccttcctgcatagagggagaggctgctcagaaggcactcggcttgtgtcgtgcatggtgctggagaggaggaggaggagagagaccagccggccaggagacaccgagccaccgtggacttctcgctcctgatgctgccacctctgccggaggaggccccgctgggaggaggcctgagctctcccaggggcactgaggaagtgggtgggcagcagggtgcccccgcgctgcagctttgccactgatggacccgggttcctccctatgatggaactactcacatat

SEQ ID NO: 60659 - DNA, 1094 bp, Bovine  19866880577536
tcgagcctgaaaataattgaaaaatgatttattgaattgaaattgaactgaattgaaaaataattatgtattttttcaattgcccaccaatgccttgaatgaaatattgaagtgaaagacaaaatatttttttcactgatctttctgctttggtatttggggaaaaaaaaaattcctgattccaattggaattataactttgaagattttctaatttcctgtgttctcttttaatgagatgagattcttgttctttttttttttttttttttttaatgtgaatagtttggaagtgaacctgctgcctggtggcaaaactgccctcgccctgtgccctgagctgtgtgaagtgtgcagtgttgcgctgagctgatggtggcgtgatagcatcagctcagggcctctggccctgctgggctgagatgaccctgtttgcccctatcaggccgctgcccgtggtcctcccttaaggctgctctagaatgtaacagaatgaccatgactcagctccaggcttcagtggctgatctgcggcagcaccttggacttaatttgctgtttcagccactgacgtggcttggtttggcggtgtcttctgaagcatcgtttctgtgttccgtcttagcacataaacttttctgcatgaagttttacttggtatttcagaactaagccagtaaccacgactgtggttattcagtttgaaaggtccgtgccttctgccttgtcctgggagagtgtgcaaaggagacaagacagcactcccatggattattagcacacgtgtgtgtgtttgatgacgatgtgcctgtggtctgttgacaaatcatggatacctgccaacttacatgatttgactaaattctgaaaatctttctcttccaagggagaaaagtgaacctaactttgttttacttgtaacaaaggagaaaagtcacctgtgttttctcctcctttagcaccaacaaagtggcactttgggaaattctgtcgttcgctgtgacaaactagaccagtctgagattaagagcctgctgatgtgtttcctttacatattaaaaagcatgtctgacggtaggtaaaaaaataagaaa

SEQ ID NO: 60660 - DNA, 2104 bp, Bovine  19866880614444
ggaactctgctttgaacatggtgaagatcaatgacgggacacatgtgaagtcttgagacccagtggaatgcttggcacataacagctacttgctatgcatccgcccacttctcccgcctgttgtcactgctcttgaccatgtagaatagaagtctatggccgtgtatctttgtgggccttcagcccctctgcagccacccactccctcatctcaggccccaaagactcaatggctttttccctaagagaaatcttataacacatgtctcagcttctatataaaatgtaaccatgtaaaaatggttaactcccagatgataacactgtgtgtgccgtgctgcatgggtaagggtcaagtgaattcgtaggatttgccttaactgaaaatgtgcccagttgcttgtgataaagagtaggttgacccagaggttcaaccagtaggcgaggttcttaagcacagatacattataccatcgggctgggaaacaggagctctcatacactgattattcagaaggcggtttgacagtatctgttgaattttaaatgtacaaaccattaacacggttacttcacttctaagaatttgtcctgtagatgtggttggacaagtgtgcaaagacccatgttcactaaagcatgatttataacagcaaaaaattgaggggaagaacaagtaaaacgtctgtcagtcggggacctggtaactttgttatagtgcgtccatggagaagaatattatgcagcttggaaaagattgggatagatcgaagctctgttgttgaattaaaactcagtgaaacagtgcacatagcatgcgtatttccatttcagtgtgtgtgttgggaaggggttacttatgtacatataagaattttcaggagattctctactggggagggattctgtagttggtaaagagtgaacctccctttagattgtatgcctacaatgtattctttgaattttctaacccatttaagagctcatcatgtataagttaaaatatgtaccatgtcgggttagatgatacatgatgaaattaaagttcaagtgttcaaatgtagcttctttaccctgactaagctgttgtacgtgtcatctggtatagagtggtcaccatagttcattctttgatcaattatgaaagggggctgggagggtttggaggcctacactcaggtctcttcccatattacataatgtagaaaatatgtagaaaataagcatcctgattctgaccaaatacatgtttactttccagatgctttgtttacgtattggaacaaggcctcaacagctgaacttatggatttttttacaatatcagagtgagtagttttgtctttgctcattgactcttgatttttcctggctaattaaggggtgtgaaaaatactctgttgttgaaccaggaatgcaatgtatggtcacatccacacttatccttagttaagttctttctcctggagctgaccccaacacccagtctcaggaactcatggcccagaggacagtgacagccctgaatttacatatatgatgattatagatgagaggttactacttgtgtggttaagccgttttaataaaataacacaacatttgttagctgaattgggtggatgctgcatttctgagttgactctaacttaagcagatacagtacctaagacagaaaaattgctataatttaaaaatatacagtaagtaaaagtgaaatcttaaatacagtctatattatttgatctctttaagtttctattttttcctttaagctttttatttttagaaacacagatccacaatcccttatccaaaaccagtggggccagatggtttttcaaatccagaattttttggatttttgaaaaattttcatagagagtatattccgtaacacccagtagggtctcagggagcaacccacagtcaagcacattattgtttttgcattaagaacttatttatttaataccgtgattgttcacagtaattggttaaatcatgggcttcccttgtggttcagctggtaaagaatccgcctgcaatgcagaagacctgggttcaaccctgggtgggaagatctccggacaagggaaag
